United States Patent 9,782,462 (MODIFIED POLYNUCLEOTIDES FOR THE PRODUCTION OF PROTEINS ASSOCIATED WITH HUMAN DISEASE) - sequence listing, part 11

SEQ ID NO: 11228 - DNA, 7324 bp, Homo sapiens
ttagtacaaaactagtagtgagaaaggaagctgggaagagactgggaagaggcaaccgacctcattaacaaaagctcagttttgtccctgcggacccaaccagcagaaggcacggggctagcggtggctgtccgccagggaggtcgggctctgtgtaaacagtagaaggcatctttatcatgcccttctcacagggagtcctgaggcttggcgctcaggaagtttgcaaagctgcagcagctgccttggagaagaccagcaaagaaagtggagtgtgtatgtgaacttcaattctgtattttctgtgaggtgggttaatggatttttagtaaaaagaaatctcaaacacagctgacctgaaagactggaatttcagctctcttccttcccggggttctttttcctcccccttcctctcaaagccctttaaaccagattgctgtgtcagtgactcttatcctgcccgccagttccaagggtttctaactttttgtcttggaaaggaaaaccactacctgattagaaaagcacttgggaagcccattaatcttgccggcgttgtcaggagtgatcagcgagttttattaaaagccctgggattgcctgaaaggcccccttgtctgactttgaaatgaaaggggcatgttaagatctcggggcacattgtcaggacccctcaccctgccccttggactatgagctgaccctccaggaggaagcacagaagccctcctttgttaaagggatttcgccggtggacagagaagagttgggccctgtcagcatgaactctctgagttggggggctgcgaatgccgtgctgctgctgctcctcctggcctgggccagccccaccttcatcagcatcaaccgcggggtgagggtgatgaagggccactctgccttcctgtcaggagatgacctgaagtttgccatccctaaagagaaagatgcctgcaaagtggaagttgtgatgaatgagccaataacccagagggttgggaaactcactccacaggtctttgactgccatttccttcccaacgaagtcaagtatgttcacaatggttgtccaattcttgatgaagacacagtgaagctcagactttacagatttactgaaagagataccttcatagaaacttttatcctgtgggtctatctcctggaaccagactgtaacatcatccatatgagtaacaatgtgctggaggtgcctgaattcaatggcttgtcccaagcgattgataaaaatctgctcagattcgattatgataggatggctagcctggaatgtaccgtcagcctggacactgcgagaactcggctgccagcccatggccagatggttctcggggagcctcgaccagaagaacctcgtggagatcagccacacagttttttcccagagtcccaactgagagcaaaactgaagtgtccaggtgggagctgtaccccaggattaaagaaaataggaagcctcaaagtgagctgtgaggagttcctgctgatgggccttcgttatcagcatctggatcccccttcacccaacattgattatatctccatccaactggacctcacagataccaggagcaaaattgtgtacaagtcagagagtgcgtggctgcctgtctatatcagagctggaattccgaatcagattccaaaggctgcattcatggccgtgtttattctggaagtggatcagttcatcctgacctccttgactacatcagttctggactgtgaagaagatgagacccctaaacccttgctggtgttcaacattactaaagccccgctccagggctatgtgactcacctgttggatcacaccagaccaatctcctcattcacctggaaagatctcagtgacatgcagatcgcctatcagccaccaaacagcagccattctgagaggagacatgatgaggtagaattggaggtatacgacttcttctttgaaaggagtgcacctatgacagtccacatctccatcagaacagcagatacaaatgccccccgtgtatcctggaatacaggtctgagtctccttgaggggcagtctcgagccatcacttgggaacagtttcaggttgtcgacaatgacgacattggtgctgtccggctagtcaccgttggtggcctgcagcatggatggctgactttaagaggggggaaagggtttctcttcaccgtggctgacctccaggctggagttgttcgctatcatcatgatgacagcgactccaccaaagacttcgtggtcttccggatatttgatggccatcacagcatccgtcacaaattccccatcaacgtcttgcccaaagatgatagtcccccgttcctcataaccaatgttgtgattgaactggaggaggggcagaccatcctgatccagggatccatgctgcgagcttcagatgtggacgccagtgatgactacatcttcttcaatatcacaaagcctccacaggctggggagatcatgaagaagccagggccaggactgataggctatcctgtccatggcttccttcagagggatttgtttaatggaatcatttattatcgtcattttggtggagaaatctttgaagattcttttcaatttgtcctgtgggacagccatgaacctccaaatctttcagtgccacaggtggcaacaatccatataactccagtggatgaccagcttccaaaagaggctcctggagtttctcggcatttggttgtcaaggaaactgaggtggcctatataactaagaaacagctacattttatagattcagaatcatatgacagggagctggtctacacaataactactcctccatttttctccttcagccacagacacttggatgctgggaaattatttatggtggacagcataccaaaagtagttaagaatcctacggccctggagctgaggtcattcactcagcatgctgtgaactatatgaaagtggcctacatgccccccatgcaagacattggtccccattgcagagatgtccagttcacattttctgtcagtaaccaacatggcggtactttgcatgggatctgctttaacattacaatcctcccagtggacaatcaagttcctgaggcgttcaccaaccctctgaaagtgactgagggaggtcaaagcatcatcagcacagagcacattctaatttctgatgcagataccaagctggacaatattgacctctccctgcgggaattgcctctgcacggaagggtggagctgaatggatttcctctaaattcagggggcacattttcttggggcgatctccataccttaaaagttaggtatcaacatgatggaactgaagttcttcaggatgacctactcttggaggtcaccgatggcacaaattcagcagaatttgtactacatgttgaggtattccctgtcaacgatgagccaccagtcttaaaggctgacctcatgcctgtcatgaattgctcagagggaggagaggtggtcatcacctctgaatacatttttgctactgatgtggacagcgataacttgaagttgatgtttgtgattgctcgcgaacctcagcatggggtggtgaggagagctggagtcacagtggatcagttctctcagagagatgttatctcagaggccgtgacatacaaacacacaggtggcgagattggcctgatgccttgttttgacaccattacattggtggtttcggatggagaggctggcccttttgtgaatggctgttgctacaatggacccaatccatctgttccacttcatgcgtcctttccagtgtatgatctcaacatcacggtatacccagtagacaaccagccaccttccattgcaataggtcccgtgtttgttgtagatgagggctgctcaacagcccttactgttaaccatttgtccgccactgaccctgacactgcagcagatgacttggaatttgttttggtttctcctcctcagtttggctacctcgaaaatatactcccttctgtgggttttgaaaaaagcaatattggcataagtatagattcatttcagtggaaagacatgaacgcttttcacattaactatgtgcagtccaggcatctgaggatagaaccaactgccgaccagttcacggtgtacgtcacagatgggaagcatcactccttggagataccattttctattataatcaaccccacaaatgatgaagctcctgactttgtagtgcagaatattactgtgtgtgagggtcagatgaaagagctggactcttccatcatcagcgctgtggacctggacattccccaggatgccctgctgttcagcatcactcaaaagccacgccatggcctcctcatcgatagggggtttagcaaagacttctctgagaataagcagccagccaaccctcaccagaaacatgcacctgttcacagcttttccatggaactcctcaagactggaatgaggttgacgtacatgcatgatgactcagagagccttgctgatgattttacaatccaattgtcagatgggaaacataagatacttaaaaccatttcagtagaggtcatcccagttaatgatgaaaaaccaatgctgagcaagaaggctgaaattgcaatgaatatgggtgaaactcgtattatttccagtgctattctttcagccatagatgaagactcacccagggagaagatttactatgtatttgaaaggcttccccaaaatgggcaacttcagcttaagatagggagggactgggttcctctctcccctggcatgaaatgcactcaggaggaagtggatctgaacttgctgagatacacacacaccggggcaatggattcccagaatcaagatagcttcaccttctacctttgggatggcaacaacaggtcccctgctcttgactgtcaaatcaccatcaaggacatggaaaaaggtgatattgtcatccttacaaaaccactcgtggtgtctaaaggtgatagaggtttcttaacaaccaccacgctcctggctgtggacggaacagacaagcctgaggaactgctctatgtcatcacctcccctccgcgatatggccagatcgaatatgttcactatcctggagttcccattacaaacttcagccaaatggatgtagtggggcagacagtttgctatgtacacaagagcaaggtgactgtctccagtgacagattcagattcatcatcagcaatggactgcggaccgagcacggggtgtttgagatcacactggagactgtggacagagccctgcctgtggtaaccaggaacaaggggttgagactggcccaaggggccgtgggcctgctttcccctgacctccttcagctgaccgaccctgatacacctgcggagaacctcaccttcctcttggttcagctcccccagcatggccagctctacctgtgggggacagggctacttcaacacaatttcacccagcaggatgtggacagcaagaatgtggcctatcggcactcaggaggggactcccagactgactgctttactttcatggccacagatgggacaaaccaaggctttattgtgaatgggagagtgtgggaagaacctgttttattcaccattcaggtagaccaattggacaaaacagctcctcgtatcacactcttgcattccccttctcaagtggggctcctgaaaaatggctgctacgggatttacatcacttcccgcgtgttgaaggcatcagaccctgacactgaggacgatcagatcatctttaaaattctacaaggcccaaaacatggacatctggagaacacaacaacaggtgaatttatccatgagaaatttagccaaaaggacttaaacagtaagactattctttacatcataaacccatctttggaagtaaattcagataccgtggaatttcaaatcatggaccccacagggaactcggccactcctcaaattttggaactgaagtggtctcatattgaatggtcacagaccgaatatgaagtctgtgagaatgtgggtttgttgcccttggaaattatcagaaggggatattccatggactcggcctttgtgggtataaaggtcaaccaagtgtcagctgcagttggaaaagatttcaccgtgattccatctaaactgattcagtttgacccaggaatgtcaactaagatgtggaatatagcaattacctatgacggattagaggaagatgatgaggtctttgaagtaattctgaactcccctgtgaatgcagttcttggcacaaagacaaaagctgcagtgaaaattttggactcaaaaggaggacaatgccatccttcatattcctccaaccaaagcaagcacagcacatgggagaagggcatttggcatctgctgcccccagggtcttcctcatccaccacttctggttcctttcatctggaaagaagacctcttccatcttccatgcagctagcagtcatcaggggagacaccctgcggggctttgattctacagatctttctcaaaggaagcttaggacccgtgggaatggcaaaacagttcgtccatcctctgtttatagaaatggaacagacatcatctataattatcatgggatagtttccttgaaactggaggatgacagtttcccaactcacaaaaggaaggccaaagtatccatcattagtcagccacaaaagacaatcaaagtggcagaactgcctcaagcagataaggtggaatccacaactgactcacacttccccagacaggaccagttgccctcatttccaaagaactgcactctggaattaaagggactcttccattttgaagaaggcatccagaagctgtatcagtgcaatgggatcgcctggaaagcctggagtccccaaaccaaggatgtggaagacaaatcctgtccagccgggtggcaccagcactcaggctactgtcacatcttgatcacagagcagaaaggcacctggaatgcggctgcccaagcttgcagggaacaatacctgggcaaccttgtaactgtattctccaggcagcacatgcggtggctctgggacattggtgggagaaagtccttttggataggtttgaacgaccaagtgcatgctggccactgggagtggatcggtggtgaacctgttgccttcaccaatgggagaagagggccctctcaacgctccaagcttggaaagagctgtgttttggttcaaagacaagggaaatggcaaacaaaagactgtaggagagccaaacctcataattatgtgtgttccagaaaactctaa

SEQ ID NO: 11229 - DNA, 10089 bp, Homo sapiens
acacaaaaagccttacaaatggaagaactaaggtggtacttaaaaacagcaccttaggatctagttccatcctatcttttcccttaaatgccatgacaaaagttaaaacgggccctgtcccttctgaatgctgggcttctcatctaaatttaaataaaaacctttgaagatgggaatgtgttggaagaaaagaagggcagaaaaaaagtgtgttggaagagtctgtggagtcctgaggcttggcgctcaggaagtttgcaaagctgcagcagctgccttggagaagaccagcaaagaaagtggagtgtgtatgtgaacttcaattctgtattttctgtgaggtgggttaatggatttttagtaaaaagaaatctcaaacacagctgacctgaaagactggaatttcagctctcttccttcccggggttctttttcctcccccttcctctcaaagccctttaaaccagattgctgtgtcagtgactcttatcctgcccgccagttccaagggtttctaactttttgtcttggaaaggaaaaccactacctgattagaaaagcacttgggaagcccattaatcttgccggcgttgtcaggagtgatcagcgagttttattaaaagccctgggattgcctgaaaggcccccttgtctgactttgaaatgaaaggggcatgttaagatctcggggcacattgtcaggacccctcaccctgccccttggactatgagctgaccctccaggaggaagcacagaagccctcctttgttaaagggatttcgccggtggacagagaagagttgggccctgtcagcatgaactctctgagttggggggctgcgaatgccgtgctgctgctgctcctcctggcctgggccagccccaccttcatcagcatcaaccgcggggtgagggtgatgaagggccactctgccttcctgtcaggagatgacctgaagtttgccatccctaaagagaaagatgcctgcaaagtggaagttgtgatgaatgagccaataacccagagggttgggaaactcactccacaggtctttgactgccatttccttcccaacgaagtcaagtatgttcacaatggttgtccaattcttgatgaagacacagtgaagctcagactttacagatttactgaaagagataccttcatagaaacttttatcctgtgggtctatctcctggaaccagactgtaacatcatccatatgagtaacaatgtgctggaggtgcctgaattcaatggcttgtcccaagcgattgataaaaatctgctcagattcgattatgataggatggctagcctggaatgtaccgtcagcctggacactgcgagaactcggctgccagcccatggccagatggttctcggggagcctcgaccagaagaacctcgtggagatcagccacacagttttttcccagagtcccaactgagagcaaaactgaagtgtccaggtgggagctgtaccccaggattaaagaaaataggaagcctcaaagtgagctgtgaggagttcctgctgatgggccttcgttatcagcatctggatcccccttcacccaacattgattatatctccatccaactggacctcacagataccaggagcaaaattgtgtacaagaagtcagagagtgcgtggctgcctgtctatatcagagctggaattccgaatcagattccaaaggctgcattcatggccgtgtttattctggaagtggatcagttcatcctgacctccttgactacatcagttctggactgtgaagaagatgagacccctaaacccttgctggtgttcaacattactaaagccccgctccagggctatgtgactcacctgttggatcacaccagaccaatctcctcattcacctggaaagatctcagtgacatgcagatcgcctatcagccaccaaacagcagccattctgagaggagacatgatgaggtagaattggaggtatacgacttcttctttgaaaggagtgcacctatgacagtccacatctccatcagaacagcagatacaaatgccccccgtgtatcctggaatacaggtctgagtctccttgaggggcagtctcgagccatcacttgggaacagtttcaggttgtcgacaatgacgacattggtgctgtccggctagtcaccgttggtggcctgcagcatggatggctgactttaagaggggggaaagggtttctcttcaccgtggctgacctccaggctggagttgttcgctatcatcatgatgacagcgactccaccaaagacttcgtggtcttccggatatttgatggccatcacagcatccgtcacaaattccccatcaacgtcttgcccaaagatgatagtcccccgttcctcataaccaatgttgtgattgaactggaggaggggcagaccatcctgatccagggatccatgctgcgagcttcagatgtggacgccagtgatgactacatcttcttcaatatcacaaagcctccacaggctggggagatcatgaagaagccagggccaggactgataggctatcctgtccatggcttccttcagagggatttgtttaatggaatcatttattatcgtcattttggtggagaaatctttgaagattcttttcaatttgtcctgtgggacagccatgaacctccaaatctttcagtgccacaggtggcaacaatccatataactccagtggatgaccagcttccaaaagaggctcctggagtttctcggcatttggttgtcaaggaaactgaggtggcctatataactaagaaacagctacattttatagattcagaatcatatgacagggagctggtctacacaataactactcctccatttttctccttcagccacagacacttggatgctgggaaattatttatggtggacagcataccaaaagtagttaagaatcctacggccctggagctgaggtcattcactcagcatgctgtgaactatatgaaagtggcctacatgccccccatgcaagacattggtccccattgcagagatgtccagttcacattttctgtcagtaaccaacatggcggtactttgcatgggatctgctttaacattacaatcctcccagtggacaatcaagttcctgaggcgttcaccaaccctctgaaagtgactgagggaggtcaaagcatcatcagcacagagcacattctaatttctgatgcagataccaagctggacaatattgacctctccctgcgggaattgcctctgcacggaagggtggagctgaatggatttcctctaaattcagggggcacattttcttggggcgatctccataccttaaaagttaggtatcaacatgatggaactgaagttcttcaggatgacctactcttggaggtcaccgatggcacaaattcagcagaatttgtactacatgttgaggtattccctgtcaacgatgagccaccagtcttaaaggctgacctcatgcctgtcatgaattgctcagagggaggagaggtggtcatcacctctgaatacatttttgctactgatgtggacagcgataacttgaagttgatgtttgtgattgctcgcgaacctcagcatggggtggtgaggagagctggagtcacagtggatcagttctctcagagagatgttatctcagaggccgtgacatacaaacacacaggtggcgagattggcctgatgccttgttttgacaccattacattggtggtttcggatggagaggctggcccttttgtgaatggctgttgctacaatggacccaatccatctgttccacttcatgcgtcctttccagtgtatgatctcaacatcacggtatacccagtagacaaccagccaccttccattgcaataggtcccgtgtttgttgtagatgagggctgctcaacagcccttactgttaaccatttgtccgccactgaccctgacactgcagcagatgacttggaatttgttttggtttctcctcctcagtttggctacctcgaaaatatactcccttctgtgggttttgaaaaaagcaatattggcataagtatagattcatttcagtggaaagacatgaacgcttttcacattaactatgtgcagtccaggcatctgaggatagaaccaactgccgaccagttcacggtgtacgtcacagatgggaagcatcactccttggagataccattttctattataatcaaccccacaaatgatgaagctcctgactttgtagtgcagaatattactgtgtgtgagggtcagatgaaagagctggactcttccatcatcagcgctgtggacctggacattccccaggatgccctgctgttcagcatcactcaaaagccacgccatggcctcctcatcgatagggggtttagcaaagacttctctgagaataagcagccagccaaccctcaccagaaacatgcacctgttcacagcttttccatggaactcctcaagactggaatgaggttgacgtacatgcatgatgactcagagagccttgctgatgattttacaatccaattgtcagatgggaaacataagatacttaaaaccatttcagtagaggtcatcccagttaatgatgaaaaaccaatgctgagcaagaaggctgaaattgcaatgaatatgggtgaaactcgtattatttccagtgctattctttcagccatagatgaagactcacccagggagaagatttactatgtatttgaaaggcttccccaaaatgggcaacttcagcttaagatagggagggactgggttcctctctcccctggcatgaaatgcactcaggaggaagtggatctgaacttgctgagatacacacacaccggggcaatggattcccagaatcaagatagcttcaccttctacctttgggatggcaacaacaggtcccctgctcttgactgtcaaatcaccatcaaggacatggaaaaaggtgatattgtcatccttacaaaaccactcgtggtgtctaaaggtgatagaggtttcttaacaaccaccacgctcctggctgtggacggaacagacaagcctgaggaactgctctatgtcatcacctcccctccgcgatatggccagatcgaatatgttcactatcctggagttcccattacaaacttcagccaaatggatgtagtggggcagacagtttgctatgtacacaagagcaaggtgactgtctccagtgacagattcagattcatcatcagcaatggactgcggaccgagcacggggtgtttgagatcacactggagactgtggacagagccctgcctgtggtaaccaggaacaaggggttgagactggcccaaggggccgtgggcctgctttcccctgacctccttcagctgaccgaccctgatacacctgcggagaacctcaccttcctcttggttcagctcccccagcatggccagctctacctgtgggggacagggctacttcaacacaatttcacccagcaggatgtggacagcaagaatgtggcctatcggcactcaggaggggactcccagactgactgctttactttcatggccacagatgggacaaaccaaggctttattgtgaatgggagagtgtgggaagaacctgttttattcaccattcaggtagaccaattggacaaaacagctcctcgtatcacactcttgcattccccttctcaagtggggctcctgaaaaatggctgctacgggatttacatcacttcccgcgtgttgaaggcatcagaccctgacactgaggacgatcagatcatctttaaaattctacaaggcccaaaacatggacatctggagaacacaacaacaggtgaatttatccatgagaaatttagccaaaaggacttaaacagtaagactattctttacatcataaacccatctttggaagtaaattcagataccgtggaatttcaaatcatggaccccacagggaactcggccactcctcaaattttggaactgaagtggtctcatattgaatggtcacagaccgaatatgaagtctgtgagaatgtgggtttgttgcccttggaaattatcagaaggggatattccatggactcggcctttgtgggtataaaggtcaaccaagtgtcagctgcagttggaaaagatttcaccgtgattccatctaaactgattcagtttgacccaggaatgtcaactaagatgtggaatatagcaattacctatgacggattagaggaagatgatgaggtctttgaagtaattctgaactcccctgtgaatgcagttcttggcacaaagacaaaagctgcagtgaaaattttggactcaaaaggaggacaatgccatccttcatattcctccaaccaaagcaagcacagcacatgggagaagggcatttggcatctgctgcccccagggtcttcctcatccaccacttctggttcctttcatctggaaagaagacctcttccatcttccatgcagctagcagtcatcaggggagacaccctgcggggctttgattctacagatctttctcaaaggaagcttaggacccgtgggaatggcaaaacagttcgtccatcctctgtttatagaaatggaacagacatcatctataattatcatgggatagtttccttgaaactggaggatgacagtttcccaactcacaaaaggaaggccaaagtatccatcattagtcagccacaaaagacaatcaaagtggcagaactgcctcaagcagataaggtggaatccacaactgactcacacttccccagacaggaccagttgccctcatttccaaagaactgcactctggaattaaagggactcttccattttgaagaaggcatccagaagctgtatcagtgcaatgggatcgcctggaaagcctggagtccccaaaccaaggatgtggaagacaaatcctgtccagccgggtggcaccagcactcaggctactgtcacatcttgatcacagagcagaaaggcacctggaatgcggctgcccaagcttgcagggaacaatacctgggcaaccttgtaactgtattctccaggcagcacatgcggtggctctgggacattggtgggagaaagtccttttggataggtttgaacgaccaagtgcatgctggccactgggagtggatcggtggtgaacctgttgccttcaccaatgggagaagagggccctctcaacgctccaagcttggaaagagctgtgttttggttcaaagacaagggaaatggcaaacaaaagactgtaggagagccaaacctcataattatgtgtgttccagaaaactctaaatataacagaccctacagggggccacctggagtttgtcacctatttattcacaggatctgtgaatattgctccatagaaaacaaattgttatgattgagtgggtatacctttgtgattctgtctagtgaaaatgggacatttttaatagtgccagaaagattgataaataaatattttttacaagataagatacaatttttgtatctcaataccttttaaaataaatgccagcagtattataaagtgtaaggtttgtttattccagaagaccctcacccttaccccattccaaatctcagggagcaccagtctcatagtccttggatttttttaaaaaaaatttttggtcccgttacctctaatgaatttattctgaaatatgtatcgtaggtgctcctaccactttagtctgagtgaagctaactctactagttcattaaaccaaagttgaaccgcaaagttgtccctttggagccctttaaatgtgaaatctaagattagaggctggggttgaaaaagagaattttctatgatgaaaaagaaagactttagatgaaagaatcttgtaggtggaggctcatctacaaagctgtagttcaggtaagaattcggggggctggctgtactcagagttctactcatcactattcatgaaacagatctccctttccaatttgagtgttggcattgtaccatcccaaagctaatgattgggtttccccagccttacagagtcatgagaaatttcaagtaacataatctgttcctctgtgtttattgtactgacaagcatttctcagggacacttgggataaggagtatatatgaatgatggttgacacatggaagaaaaatactgcttcctcagaaatgtcctgatgaactgtgctgatgaacagagaaaaataataccgaaaacagagcccctgaaagcctacattctcggaaaggattttgaggaattttgagccaccttaaatctttaatatttgcagaaatgccatgttaactagattctctaacggaaaggtaccttattaatttataatctcaggtgagtggaacatttttgtaacaatgaagtatgttgcagcgttaccagaactcccttctgaaatcaaggtttaacagttataggaaattagaatgtctgaaacatttatttaaagtttttctcttttcataatcactgagaaatatggttgtgccaaatgtcacttgctctatgagcaccaatgtaacttcagaatcaaattggggttatcaagtaggctagagctctggtgctggttttattataaaaataccttgagtgttgtagacactaaaactgcttgaagaaagtcagttcagtttctgggatataaaaacatggcaagctttttttatttcagttcatttatcaaggttgtaattaatagaaacatttagaaagagatattggaatatgatccagacattctgtctattacttaaatctaaacataattatagtgtcagagggtccttacctgagatgtcgcaggtgggctccagattggcataatgtacaggttctctgtgagacacaagcagtttctggcatttaaccaaaagatgccacacctatcctcttaccagctcctttcaaattccttctggtccacaggcttcttgcagtatggaaatgtgagatttgggctaaagaaaaaatagttgtttacctaaagggttaagtcctaggaaggaagtagaagtttgggaaatgagggattcaagggccactccttccactggaactctaaaactatataaaccatctaaaactggaaatctagaactatgtcaactgtgtagaaccttgtcagcatggcagatttattatacatttctgcaatataaatgataaatgatactgaactaattgcaaatgttagcataaagagtgttttgatttttataacaattagaaatgctacaagaatatttaaaaatattcctgatcatgaaagcattaatcaaattagaaaatccaagtcattttaagaagataaaaatagaaattcaggcaagtttgggtgatgggcggtattcatcacaaccttcattttattcttacaattgagctttgactcagggggaaaagaagtaaatgattgtcaaggttccctctgccttgattgatagtttctgatgggagtgggaaggaaggaattggagtaatgggtagaatgggaatgagagattacgggagagagagatgagatgggttgaacagaagaggatgggaactgatggtagctaggaaggaaagcgtcaagaaggacctgaatgtacccagcttttctccccaaacttcaataccacctcaggaaaaggcccactgtgtccaggggcgtcagtccagctcaatagtgtctagcttttcagaatcttctgattgtttggtctttaacaaaaacatagcatctatttgctaacaataaacttaagcaacatatgataatcatttcatctccttccaagaagtggtgaaaatgaaccaggtgacattaatttaacttctgtttttgtttatttttaatacaaccaaaaagatatgcacatattttaatttacattatggtactgtataatttaaaccataaactggtgctgattaatttctgcaacaaagcagcatattaaatgtactacatctagtgttgtagcaaaattaataaacttgttttaagttctgagacactttc

SEQ ID NO: 11230 - DNA, 1779 bp, Homo sapiens
atgctggatgagtccttggcagtcaggaggtccaaaaaatgcaaagaaatgataatgcactgggagaagaaagaagatattgacatcgtgaacacagtagaccaattggacaaaacagctcctcgtatcacactcttgcattccccttctcaagtggggctcctgaaaaatggctgctacgggatttacatcacttcccgcgtgttgaaggcatcagaccctgacactgaggacgatcagatcatctttaaaattctacaaggcccaaaacatggacatctggagaacacaacaacaggtgaatttatccatgagaaatttagccaaaaggacttaaacagtaagactattctttacatcataaacccatctttggaagtaaattcagataccgtggaatttcaaatcatggaccccacagggaactcggccactcctcaaattttggaactgaagtggtctcatattgaatggtcacagaccgaatatgaagtctgtgagaatgtgggtttgttgcccttggaaattatcagaaggggatattccatggactcggcctttgtgggtataaaggtcaaccaagtgtcagctgcagttggaaaagatttcaccgtgattccatctaaactgattcagtttgacccaggaatgtcaactaagatgtggaatatagcaattacctatgacggattagaggaagatgatgaggtctttgaagtaattctgaactcccctgtgaatgcagttcttggcacaaagacaaaagctgcagtgaaaattttggactcaaaaggaggacaatgccatccttcatattcctccaaccaaagcaagcacagcacatgggagaagggcatttggcatctgctgcccccagggtcttcctcatccaccacttctggttcctttcatctggaaagaagacctcttccatcttccatgcagctagcagtcatcaggggagacaccctgcggggctttgattctacagatctttctcaaaggaagcttaggacccgtgggaatggcaaaacagttcgtccatcctctgtttatagaaatggaacagacatcatctataattatcatgggatagtttccttgaaactggaggatgacagtttcccaactcacaaaaggaaggccaaagtatccatcattagtcagccacaaaagacaatcaaagtggcagaactgcctcaagcagataaggtggaatccacaactgactcacacttccccagacaggaccagttgccctcatttccaaagaactgcactctggaattaaagggactcttccattttgaagaaggcatccagaagctgtatcagtgcaatgggatcgcctggaaagcctggagtccccaaaccaaggatgtggaagacaaatcctgtccagccgggtggcaccagcactcaggctactgtcacatcttgatcacagagcagaaaggcacctggaatgcggctgcccaagcttgcagggaacaatacctgggcaaccttgtaactgtattctccaggcagcacatgcggtggctctgggacattggtgggagaaagtccttttggataggtttgaacgaccaagtgcatgctggccactgggagtggatcggtggtgaacctgttgccttcaccaatgggagaagagggccctctcaacgctccaagcttggaaagagctgtgttttggttcaaagacaagggaaatggcaaacaaaagactgtaggagagccaaacctcataattatgtgtgttccagaaaactctaa

SEQ ID NO: 11231 - DNA, 2481 bp, Homo sapiens
agtctgcagggaggaaagtcagaattagatattcaagatggccgcctctgatggagtccctggcactcactcaagcttgcatttggtagatggtgacacaagaatccatgctgaaggctgccttgcctctctttaccagattcatcatcagcaatggactgcggaccgagcacggggtgtttgagatcacactggagactgtggacagagccctgcctgtggtaaccaggaacaaggggttgagactggcccaaggggccgtgggcctgctttcccctgacctccttcagctgaccgaccctgatacacctgcggagaacctcaccttcctcttggttcagctcccccagcatggccagctctacctgtgggggacagggctacttcaacacaatttcacccagcaggatgtggacagcaagaatgtggcctatcggcactcaggaggggactcccagactgactgctttactttcatggccacagatgggacaaaccaaggctttattgtgaatgggagagtgtgggaagaacctgttttattcaccattcaggtagaccaattggacaaaacagctcctcgtatcacactcttgcattccccttctcaagtggggctcctgaaaaatggctgctacgggatttacatcacttcccgcgtgttgaaggcatcagaccctgacactgaggacgatcagatcatctttaaaattctacaaggcccaaaacatggacatctggagaacacaacaacaggtgaatttatccatgagaaatttagccaaaaggacttaaacagtaagactattctttacatcataaacccatctttggaagtaaattcagataccgtggaatttcaaatcatggaccccacagggaactcggccactcctcaaattttggaactgaagtggtctcatattgaatggtcacagaccgaatatgaagtctgtgagaatgtgggtttgttgcccttggaaattatcagaaggggatattccatggactcggcctttgtgggtataaaggtcaaccaagtgtcagctgcagttggaaaagatttcaccgtgattccatctaaactgattcagtttgacccaggaatgtcaactaagatgtggaatatagcaattacctatgacggattagaggaagatgatgaggtctttgaagtaattctgaactcccctgtgaatgcagttcttggcacaaagacaaaagctgcagtgaaaattttggactcaaaaggaggacaatgccatccttcatattcctccaaccaaagcaagcacagcacatgggagaagggcatttggcatctgctgcccccagggtcttcctcatccaccacttctggttcctttcatctggaaagaagacctcttccatcttccatgcagctagcagtcatcaggggagacaccctgcggggctttgattctacagatctttctcaaaggaagcttaggacccgtgggaatggcaaaacagttcgtccatcctctgtttatagaaatggaacagacatcatctataattatcatgggatagtttccttgaaactggaggatgacagtttcccaactcacaaaaggaaggccaaagtatccatcattagtcagccacaaaagacaatcaaagtggcagaactgcctcaagcagataaggtggaatccacaactgactcacacttccccagacaggaccagttgccctcatttccaaagaactgcactctggaattaaagggactcttccattttgaagaaggcatccagaagctgtatcagtgcaatgggatcgcctggaaagcctggagtccccaaaccaaggatgtggaagacaaatcctgtccagccgggtggcaccagcactcaggctactgtcacatcttgatcacagagcagaaaggcacctggaatgcggctgcccaagcttgcagggaacaatacctgggcaaccttgtaactgtattctccaggcagcacatgcggtggctctgggacattggtgggagaaagtccttttggataggtttgaacgaccaagtgcatgctggccactgggagtggatcggtggtgaacctgttgccttcaccaatgggagaagagggccctctcaacgctccaagcttggaaagagctgtgttttggttcaaagacaagggaaatggcaaacaaaagactgtaggagagccaaacctcataattatgtgtgttccagaaaactctaaatataacagaccctacagggggccacctggagtttgtcacctatttattcacaggatctgtgaatattgctccatagaaaacaaattgttatgattgagtgggtatacctttgtgattctgtctagtgaaaatgggacatttttaatagtgccagaaagattgataaataaatattttttacaagataagatacaatttttgtatctcaataccttttaaaataaatgccagcagtattataaa

SEQ ID NO: 11232 - DNA, 10086 bp, Homo sapiens
acacaaaaagccttacaaatggaagaactaaggtggtacttaaaaacagcaccttaggatctagttccatcctatcttttcccttaaatgccatgacaaaagttaaaacgggccctgtcccttctgaatgctgggcttctcatctaaatttaaataaaaacctttgaagatgggaatgtgttggaagaaaagaagggcagaaaaaaagtgtgttggaagagtctgtggagtcctgaggcttggcgctcaggaagtttgcaaagctgcagcagctgccttggagaagaccagcaaagaaagtggagtgtgtatgtgaacttcaattctgtattttctgtgaggtgggttaatggatttttagtaaaaagaaatctcaaacacagctgacctgaaagactggaatttcagctctcttccttcccggggttctttttcctcccccttcctctcaaagccctttaaaccagattgctgtgtcagtgactcttatcctgcccgccagttccaagggtttctaactttttgtcttggaaaggaaaaccactacctgattagaaaagcacttgggaagcccattaatcttgccggcgttgtcaggagtgatcagcgagttttattaaaagccctgggattgcctgaaaggcccccttgtctgactttgaaatgaaaggggcatgttaagatctcggggcacattgtcaggacccctcaccctgccccttggactatgagctgaccctccaggaggaagcacagaagccctcctttgttaaagggatttcgccggtggacagagaagagttgggccctgtcagcatgaactctctgagttggggggctgcgaatgccgtgctgctgctgctcctcctggcctgggccagccccaccttcatcagcatcaaccgcggggtgagggtgatgaagggccactctgccttcctgtcaggagatgacctgaagtttgccatccctaaagagaaagatgcctgcaaagtggaagttgtgatgaatgagccaataacccagagggttgggaaactcactccacaggtctttgactgccatttccttcccaacgaagtcaagtatgttcacaatggttgtccaattcttgatgaagacacagtgaagctcagactttacagatttactgaaagagataccttcatagaaacttttatcctgtgggtctatctcctggaaccagactgtaacatcatccatatgagtaacaatgtgctggaggtgcctgaattcaatggcttgtcccaagcgattgataaaaatctgctcagattcgattatgataggatggctagcctggaatgtaccgtcagcctggacactgcgagaactcggctgccagcccatggccagatggttctcggggagcctcgaccagaagaacctcgtggagatcagccacacagttttttcccagagtcccaactgagagcaaaactgaagtgtccaggtgggagctgtaccccaggattaaagaaaataggaagcctcaaagtgagctgtgaggagttcctgctgatgggccttcgttatcagcatctggatcccccttcacccaacattgattatatctccatccaactggacctcacagataccaggagcaaaattgtgtacaagtcagagagtgcgtggctgcctgtctatatcagagctggaattccgaatcagattccaaaggctgcattcatggccgtgtttattctggaagtggatcagttcatcctgacctccttgactacatcagttctggactgtgaagaagatgagacccctaaacccttgctggtgttcaacattactaaagccccgctccagggctatgtgactcacctgttggatcacaccagaccaatctcctcattcacctggaaagatctcagtgacatgcagatcgcctatcagccaccaaacagcagccattctgagaggagacatgatgaggtagaattggaggtatacgacttcttctttgaaaggagtgcacctatgacagtccacatctccatcagaacagcagatacaaatgccccccgtgtatcctggaatacaggtctgagtctccttgaggggcagtctcgagccatcacttgggaacagtttcaggttgtcgacaatgacgacattggtgctgtccggctagtcaccgttggtggcctgcagcatggatggctgactttaagaggggggaaagggtttctcttcaccgtggctgacctccaggctggagttgttcgctatcatcatgatgacagcgactccaccaaagacttcgtggtcttccggatatttgatggccatcacagcatccgtcacaaattccccatcaacgtcttgcccaaagatgatagtcccccgttcctcataaccaatgttgtgattgaactggaggaggggcagaccatcctgatccagggatccatgctgcgagcttcagatgtggacgccagtgatgactacatcttcttcaatatcacaaagcctccacaggctggggagatcatgaagaagccagggccaggactgataggctatcctgtccatggcttccttcagagggatttgtttaatggaatcatttattatcgtcattttggtggagaaatctttgaagattcttttcaatttgtcctgtgggacagccatgaacctccaaatctttcagtgccacaggtggcaacaatccatataactccagtggatgaccagcttccaaaagaggctcctggagtttctcggcatttggttgtcaaggaaactgaggtggcctatataactaagaaacagctacattttatagattcagaatcatatgacagggagctggtctacacaataactactcctccatttttctccttcagccacagacacttggatgctgggaaattatttatggtggacagcataccaaaagtagttaagaatcctacggccctggagctgaggtcattcactcagcatgctgtgaactatatgaaagtggcctacatgccccccatgcaagacattggtccccattgcagagatgtccagttcacattttctgtcagtaaccaacatggcggtactttgcatgggatctgctttaacattacaatcctcccagtggacaatcaagttcctgaggcgttcaccaaccctctgaaagtgactgagggaggtcaaagcatcatcagcacagagcacattctaatttctgatgcagataccaagctggacaatattgacctctccctgcgggaattgcctctgcacggaagggtggagctgaatggatttcctctaaattcagggggcacattttcttggggcgatctccataccttaaaagttaggtatcaacatgatggaactgaagttcttcaggatgacctactcttggaggtcaccgatggcacaaattcagcagaatttgtactacatgttgaggtattccctgtcaacgatgagccaccagtcttaaaggctgacctcatgcctgtcatgaattgctcagagggaggagaggtggtcatcacctctgaatacatttttgctactgatgtggacagcgataacttgaagttgatgtttgtgattgctcgcgaacctcagcatggggtggtgaggagagctggagtcacagtggatcagttctctcagagagatgttatctcagaggccgtgacatacaaacacacaggtggcgagattggcctgatgccttgttttgacaccattacattggtggtttcggatggagaggctggcccttttgtgaatggctgttgctacaatggacccaatccatctgttccacttcatgcgtcctttccagtgtatgatctcaacatcacggtatacccagtagacaaccagccaccttccattgcaataggtcccgtgtttgttgtagatgagggctgctcaacagcccttactgttaaccatttgtccgccactgaccctgacactgcagcagatgacttggaatttgttttggtttctcctcctcagtttggctacctcgaaaatatactcccttctgtgggttttgaaaaaagcaatattggcataagtatagattcatttcagtggaaagacatgaacgcttttcacattaactatgtgcagtccaggcatctgaggatagaaccaactgccgaccagttcacggtgtacgtcacagatgggaagcatcactccttggagataccattttctattataatcaaccccacaaatgatgaagctcctgactttgtagtgcagaatattactgtgtgtgagggtcagatgaaagagctggactcttccatcatcagcgctgtggacctggacattccccaggatgccctgctgttcagcatcactcaaaagccacgccatggcctcctcatcgatagggggtttagcaaagacttctctgagaataagcagccagccaaccctcaccagaaacatgcacctgttcacagcttttccatggaactcctcaagactggaatgaggttgacgtacatgcatgatgactcagagagccttgctgatgattttacaatccaattgtcagatgggaaacataagatacttaaaaccatttcagtagaggtcatcccagttaatgatgaaaaaccaatgctgagcaagaaggctgaaattgcaatgaatatgggtgaaactcgtattatttccagtgctattctttcagccatagatgaagactcacccagggagaagatttactatgtatttgaaaggcttccccaaaatgggcaacttcagcttaagatagggagggactgggttcctctctcccctggcatgaaatgcactcaggaggaagtggatctgaacttgctgagatacacacacaccggggcaatggattcccagaatcaagatagcttcaccttctacctttgggatggcaacaacaggtcccctgctcttgactgtcaaatcaccatcaaggacatggaaaaaggtgatattgtcatccttacaaaaccactcgtggtgtctaaaggtgatagaggtttcttaacaaccaccacgctcctggctgtggacggaacagacaagcctgaggaactgctctatgtcatcacctcccctccgcgatatggccagatcgaatatgttcactatcctggagttcccattacaaacttcagccaaatggatgtagtggggcagacagtttgctatgtacacaagagcaaggtgactgtctccagtgacagattcagattcatcatcagcaatggactgcggaccgagcacggggtgtttgagatcacactggagactgtggacagagccctgcctgtggtaaccaggaacaaggggttgagactggcccaaggggccgtgggcctgctttcccctgacctccttcagctgaccgaccctgatacacctgcggagaacctcaccttcctcttggttcagctcccccagcatggccagctctacctgtgggggacagggctacttcaacacaatttcacccagcaggatgtggacagcaagaatgtggcctatcggcactcaggaggggactcccagactgactgctttactttcatggccacagatgggacaaaccaaggctttattgtgaatgggagagtgtgggaagaacctgttttattcaccattcaggtagaccaattggacaaaacagctcctcgtatcacactcttgcattccccttctcaagtggggctcctgaaaaatggctgctacgggatttacatcacttcccgcgtgttgaaggcatcagaccctgacactgaggacgatcagatcatctttaaaattctacaaggcccaaaacatggacatctggagaacacaacaacaggtgaatttatccatgagaaatttagccaaaaggacttaaacagtaagactattctttacatcataaacccatctttggaagtaaattcagataccgtggaatttcaaatcatggaccccacagggaactcggccactcctcaaattttggaactgaagtggtctcatattgaatggtcacagaccgaatatgaagtctgtgagaatgtgggtttgttgcccttggaaattatcagaaggggatattccatggactcggcctttgtgggtataaaggtcaaccaagtgtcagctgcagttggaaaagatttcaccgtgattccatctaaactgattcagtttgacccaggaatgtcaactaagatgtggaatatagcaattacctatgacggattagaggaagatgatgaggtctttgaagtaattctgaactcccctgtgaatgcagttcttggcacaaagacaaaagctgcagtgaaaattttggactcaaaaggaggacaatgccatccttcatattcctccaaccaaagcaagcacagcacatgggagaagggcatttggcatctgctgcccccagggtcttcctcatccaccacttctggttcctttcatctggaaagaagacctcttccatcttccatgcagctagcagtcatcaggggagacaccctgcggggctttgattctacagatctttctcaaaggaagcttaggacccgtgggaatggcaaaacagttcgtccatcctctgtttatagaaatggaacagacatcatctataattatcatgggatagtttccttgaaactggaggatgacagtttcccaactcacaaaaggaaggccaaagtatccatcattagtcagccacaaaagacaatcaaagtggcagaactgcctcaagcagataaggtggaatccacaactgactcacacttccccagacaggaccagttgccctcatttccaaagaactgcactctggaattaaagggactcttccattttgaagaaggcatccagaagctgtatcagtgcaatgggatcgcctggaaagcctggagtccccaaaccaaggatgtggaagacaaatcctgtccagccgggtggcaccagcactcaggctactgtcacatcttgatcacagagcagaaaggcacctggaatgcggctgcccaagcttgcagggaacaatacctgggcaaccttgtaactgtattctccaggcagcacatgcggtggctctgggacattggtgggagaaagtccttttggataggtttgaacgaccaagtgcatgctggccactgggagtggatcggtggtgaacctgttgccttcaccaatgggagaagagggccctctcaacgctccaagcttggaaagagctgtgttttggttcaaagacaagggaaatggcaaacaaaagactgtaggagagccaaacctcataattatgtgtgttccagaaaactctaaatataacagaccctacagggggccacctggagtttgtcacctatttattcacaggatctgtgaatattgctccatagaaaacaaattgttatgattgagtgggtatacctttgtgattctgtctagtgaaaatgggacatttttaatagtgccagaaagattgataaataaatattttttacaagataagatacaatttttgtatctcaataccttttaaaataaatgccagcagtattataaagtgtaaggtttgtttattccagaagaccctcacccttaccccattccaaatctcagggagcaccagtctcatagtccttggatttttttaaaaaaaatttttggtcccgttacctctaatgaatttattctgaaatatgtatcgtaggtgctcctaccactttagtctgagtgaagctaactctactagttcattaaaccaaagttgaaccgcaaagttgtccctttggagccctttaaatgtgaaatctaagattagaggctggggttgaaaaagagaattttctatgatgaaaaagaaagactttagatgaaagaatcttgtaggtggaggctcatctacaaagctgtagttcaggtaagaattcggggggctggctgtactcagagttctactcatcactattcatgaaacagatctccctttccaatttgagtgttggcattgtaccatcccaaagctaatgattgggtttccccagccttacagagtcatgagaaatttcaagtaacataatctgttcctctgtgtttattgtactgacaagcatttctcagggacacttgggataaggagtatatatgaatgatggttgacacatggaagaaaaatactgcttcctcagaaatgtcctgatgaactgtgctgatgaacagagaaaaataataccgaaaacagagcccctgaaagcctacattctcggaaaggattttgaggaattttgagccaccttaaatctttaatatttgcagaaatgccatgttaactagattctctaacggaaaggtaccttattaatttataatctcaggtgagtggaacatttttgtaacaatgaagtatgttgcagcgttaccagaactcccttctgaaatcaaggtttaacagttataggaaattagaatgtctgaaacatttatttaaagtttttctcttttcataatcactgagaaatatggttgtgccaaatgtcacttgctctatgagcaccaatgtaacttcagaatcaaattggggttatcaagtaggctagagctctggtgctggttttattataaaaataccttgagtgttgtagacactaaaactgcttgaagaaagtcagttcagtttctgggatataaaaacatggcaagctttttttatttcagttcatttatcaaggttgtaattaatagaaacatttagaaagagatattggaatatgatccagacattctgtctattacttaaatctaaacataattatagtgtcagagggtccttacctgagatgtcgcaggtgggctccagattggcataatgtacaggttctctgtgagacacaagcagtttctggcatttaaccaaaagatgccacacctatcctcttaccagctcctttcaaattccttctggtccacaggcttcttgcagtatggaaatgtgagatttgggctaaagaaaaaatagttgtttacctaaagggttaagtcctaggaaggaagtagaagtttgggaaatgagggattcaagggccactccttccactggaactctaaaactatataaaccatctaaaactggaaatctagaactatgtcaactgtgtagaaccttgtcagcatggcagatttattatacatttctgcaatataaatgataaatgatactgaactaattgcaaatgttagcataaagagtgttttgatttttataacaattagaaatgctacaagaatatttaaaaatattcctgatcatgaaagcattaatcaaattagaaaatccaagtcattttaagaagataaaaatagaaattcaggcaagtttgggtgatgggcggtattcatcacaaccttcattttattcttacaattgagctttgactcagggggaaaagaagtaaatgattgtcaaggttccctctgccttgattgatagtttctgatgggagtgggaaggaaggaattggagtaatgggtagaatgggaatgagagattacgggagagagagatgagatgggttgaacagaagaggatgggaactgatggtagctaggaaggaaagcgtcaagaaggacctgaatgtacccagcttttctccccaaacttcaataccacctcaggaaaaggcccactgtgtccaggggcgtcagtccagctcaatagtgtctagcttttcagaatcttctgattgtttggtctttaacaaaaacatagcatctatttgctaacaataaacttaagcaacatatgataatcatttcatctccttccaagaagtggtgaaaatgaaccaggtgacattaatttaacttctgtttttgtttatttttaatacaaccaaaaagatatgcacatattttaatttacattatggtactgtataatttaaaccataaactggtgctgattaatttctgcaacaaagcagcatattaaatgtactacatctagtgttgtagcaaaattaataaacttgttttaagttctgagacactttc

SEQ ID NO: 11233 - DNA, 14876 bp, Homo sapiens
ggacggcctgggaaggcttcggctcctcggctgcggctccagcccggacggcgccgcgcaactttgccatccttctggcccagccccggctacaggaggaccccgcgggcaacgcgcggagttcctggcacttcccggcggtgtctcttgttgtctgcccggggaccgacttcgcatgctctcaggctgacctgtccaagcccgaacaccgggaccatgcactcagccgggactcccgggttatcctcgcgccggacaggcaactccaccagctttcaaccaggaccgccaccgccgccccggctgctgctgctgctgctgcttctcctgtcactggtaagccgcgtcccggcacagcccgctgccttcggcagggcgttgctgtcccctggtctcgcgggggctgcaggggtccctgctgaggaggccatagtgctggcgaaccgcggactccgggtgcctttcggccgtgaagtctggctggatcccctgcatgacctggtgttgcaggtgcagcccggggaccgctgcgcggtttcggtactagacaacgacgcactggcccagcgaccgggccgcctgagtcccaagcgcttcccgtgcgactttggccctggcgaggtgcgctactctcacctgggcgcgcgcagcccgtctcgggaccgcgtccggctgcagctgcgctatgacgcgcccggaggggcagtagtgctaccactggtactggaggtggaggtggtcttcacccagctggaggttgtgactcggaacttgcctctggtcgtggaagagctgctggggaccagcaatgccctggacgcgcggagcctggagttcgccttccagcccgagacagaggagtgccgcgtgggcatcctgtccggcttgggcgcgctgcctcgctatggagaactcctccactacccgcaggtccctggaggagccagagagggaggcgccccggagactctcctgatggactgcaaagctttccaggaactaggcgtgcgctatcgccacacagccgccagtcgctcaccaaacagggactggatacccatggtggtggagctgcgttcacgaggggctcctgtgggcagccctgctttgaaacgcgagcacttccaggttctggtgaggatccgaggaggggccgagaacactgcacccaagcccagtttcgtggccatgatgatgatggaggtggaccagtttgtactgacggccctgaccccagacatgctggcagccgaggatgctgagtctccctctgacctgttgatcttcaaccttacttctccattccagcctggccagggctacttggtgagcaccgatgatcgcagcctgcccctttcctccttcactcagagggatctgcggctcctgaagattgcctaccagcccccttctgaagactctgaccaggagcgcctctttgaactggaattggaggtagtggatctagaaggagcagcttcagacccttttgccttcatggtagtggtgaagcccatgaacacaatggctccggtggtcacccggaataccggtcttattctctatgagggtcagtctcggcccctcacaggccctgcaggcagtggtccgcaaaacttggtcatcagcgatgaggatgacctagaagcagtgcggctagaggtggtggctgggctccggcatggtcaccttgtcattctgggtgcttccagtggcagctctgctcccaagagctttacagtggctgagctggcagccggccaggtggtctaccagcatgatgacagagacggctcgctgagcgacaacctggtgcttcgcatggtggatggaggaggcaggcaccaggtacagtttctgttccccatcaccttagtgcctgtggatgaccagccacctgttctcaatgccaacacggggctgacactggcagagggtgaaacagtgcccatcctgcccctttccctgagtgcaactgacatggattcagatgattctctgctgctttttgtgctggagtcacccttcttaactacggggcatctgcttctccgccaaactcaccctccccatgagaagcaggaacttctcagaggcctttggaggaaggagggggcattttatgagcgaacagtgacagagtggcagcagcaggacataacagagggcaggctgttctatagacactctgggccccatagtcctgggccagtcacagaccagttcacatttagagtccaggataaccatgaccctcctaatcagtccgggctacagcggtttgtgattcgtatccatcctgtggatcgcctccctccggagctgggcagtggctgtccccttcgtatggtggtacaggaatcccagctcacaccactgaggaagaagtggctgcgctacactgacctggacacagatgaccgagaactacgttacacagtgactcagtcccccacagacacagacgaaaatcacctgccagccccactgggtaccttggtcttgactgacaacccctcagtcgtggtgacccattttacccaagcccagatcaaccatcataaaattgcttacagacccccgggtcaagaactgggcgtggctactcgagtggcccagttccagttccaggtggaagaccgagctgggaatgtggctccaggtacctttaccctttacttgcatcccgtggacaaccagccacctgagatcctcaacaccggcttcactattcaggagaagggtcaccacatcctgagtgagacagagttgcacgtgaatgatgtagacactgatgttgcccatatctctttcactctcactcaggcacccaaacatggccacatgagagtgtctggacagatcctgcatgtagggggtctcttccacttggaggacataaaacagggccgagtttcctatgcccataatggggacaagtccctgactgatagctgctccttggaagtcagtgacagacatcatgtggtgcccatcactctcagagtaaatgtccggccagtggatgatgaagtgcccatactgagccatcctactggcactctggagtcctatctagatgtcttagaaaatggggctactgaaatcactgccaatgttattaaggggaccaatgaggaaactgatgacttgatgttgactttcctcttggaagatccacctttgtatggggaaatcttggtcaatggcattccagcagagcagtttactcaaagggacatcttggagggctctgttgtatatacccacaccagtggtgagataggcctattgcctaaagcggattcttttaacctgagtctgtcagatatgtctcaagaatggagaattggtggcaatactatccaaggagttactatatgggtgaccatcctgcctgttgatagccaggccccagaaatctttgtaggtgaacagttgatagtaatggaaggtgataaaagtgttataacatcagtgcatataagtgctgaagatgtcgactccctgaatgatgacatcttgtgcactatagttattcagcctacttcaggttatgttgaaaacatttctccagcaccaggctctgagaaatcaagagcagggattgccataagtgctttcaacttgaaagatctcaggcagggccacataaactatgtccagagtgtccataaaggggtggaacctgtggaggaccgatttgtatttcgttgttctgatggcattaacttttcagagagacagttcttccccattgtaatcattcccaccaatgatgaacagccagagatgtttatgagagaatttatggtgatggaaggcatgagtctggtaattgatacacccattctcaatgctgctgatgctgatgttcccctggatgatttaactttcactattacccaattccccactcatggtcacatcatgaatcagctgataaatggcacggttttggtcgaaagcttcaccttggatcagatcatagagagttccagcattatttatgagcatgatgactccgagacccaggaagacagttttgtgattaaactaacagatgggaagcactctgtggaaaagacggtcctcattatagttatccctgttgatgatgagacgcccagaatgactatcaataatggactagaaatagaaattggggataccaagattatcaacaacaaaatattaatggcaacagatttagattcagaagacaaatctttggtttatattattcgttatgggccaggacatggcttattacagagacgaaaacctactggtgcctttgaaaatatcacactgggcatgaattttacccaggatgaagtagacagaaacttaattcagtatgtccatttggggcaagagggcattcgggacctaattaaatttgatgtgactgatggaataaatcccctcatagatcgttacttttatgtgtccatcgggagcattgacattgtcttccctgatgtgataagtaagggagtgtccttgaaagaaggtggcaaagtcactcttacaacagacctactaagcactagtgacttgaacagtcctgatgaaaacttggtttttaccatcaccagggctcccatgcgaggtcacctggaatgcacggatcagcctggtgtgtccatcacgtctttcactcagctgcaactggctggaaacaaaatctactacatccacacagctgatgatgaagtgaaaatggacagttttgagtttcaagtcaccgatggacgtaaccctgtctttcggacattccgtatctccattagcgatgtggacaataaaaagccagtggtcaccatccacaagctggttgtcagtgaaagtgaaaacaagctgattactccttttgagctcactgtcgaagacagagatactcctgacaagctcctgaaattcactatcacccaggtgcctattcatggccatctcctattcaacaataccagacctgtcatggtttttaccaagcaagacttgaatgaaaacttaatcagctacaaacatgatggcactgagtcaagtgaagatagcttctccttcacagtgactgatggcacccatacagacttctatgtttttcctgatacggtgtttgaaacaaggagaccccaagtgatgaagatccaggtcttggctgttgacaacagtgtcccccaaatcgcagtgaataagggggcctctacacttcgcactctagccactggccacttggggttcatgatcacaagcaaaatattgaaagtggaggacagagacagcttacacatttctcttagatttatcgtgacagaggcccctcaacatggatatcttctcaacctggacaaaggcaaccacagcatcactcagttcacacaagctgacattgatgacatgaaaatatgctatgtcttaagagaaggggctaatgccacaagtgatatgttctattttgcagttgaagatggtggtggaaacaagttaacgtaccagaattttcgtctgaattgggcatggatctcctttgaaaaggaatattacctggtcaatgaggactccaaatttctagatgttgttcttaaacgtagaggttacttgggagaaacttcttttataagtattggcacaagagacagaactgcagaaaaagacaaagacttcaagggcaaagcacagaaacaagtgcagttcaacccaggccagaccagggccacatggcgagtgcggatcctgagtgatggggagcatgagcagtctgaaacctttcaggtggtactctcagagcccgtgctggctgccttggaattccccacagtcgccactgttgagatcgttgatccaggagatgagccaactgtgtttattccccagtccaaatactccgttgaagaagatgttggtgagctgttcattcccatcaggaggagcggagatgtgagccaggagttgatggtggtctgttatacccaacaaggaacagcaactggaactgtgccgacttccgtgttgtcttactctgattacatatccaggcctgaggaccacaccagtgttgtccgctttgacaaagatgaacgggagaaactgtgtcggatagtcataattgatgactctttgtacgaggaggaggaaaccttccatgtccttctgagcatgcccatggggggaagaatcggatcagagttcccaggggctcaagttacaatcgttcctgacaaagatgatgaacccatcttttacttcggtgatgtggaatactctgtggatgagagtgctggctatgtggaagtgcaggtgtggagaacgggcactgacctgtccaagtcttctagtgtcacagtgaggtctcggaaaacagatcctccctctgcagatgctggaacagactatgtgggcatcagccgtaatttagattttgcacctggagtcaacatgcagcctgttcgtgttgtcattctggatgaccttggacaaccagcgctggagggaattgagaaatttgaactggtgcttcgcatgcctatgaacgcagcccttggcgagcccagcaaagccacagtgtccataaatgactctgtctccgatttgcctaagatgcaattcaaagaacgaatatatactggcagcgaaagtgatgggcagatagttacaatgatccataggactggggatgtccagtacagatcttcagtgagatgctacacccggcaggggtctgcacaggtgatgatggactttgaagaacgcccaaacactgatacctccatcatcacattcctccctggtgagacagaaaagccctgcattcttgagctgatggacgatgtgctctatgaggaggtagaggagctccgcctggtactcggcactccacaaagcaactctccctttggggctgcagttggtgaacaaaatgaaactctcataaggatccgagatgatgctgataagactgttattaaatttggagaaaccaaatttagtgtcactgaacccaaagaacctggagagtcggtggttataagaattccagtgattcgccaaggagacacttcaaaggtttccattgtgagagtccacaccaaggatggctcggccacctctggagaagactaccaccctgtgtcagaagaaattgagtttaaggaaggggaaacccagcacgtggttgaaatcgaagttacctttgacggggtgagagagatgagagaggccttcactgttcacctaaaacctgatgaaaatatgatagcagagatgcagttgacgaaagccattgtgtacatagaagaaatgagcagcatggcagatgtcacttttccttctgtccctcaaattgtatccctgttgatgtatgacgacacttccaaagctaaggagagtgctgaacccatgtctggctatcctgtcatctgtatcacagcttgcaaccccaaatattcagactacgataaaacaggctctatctgtgcaagtgagaacatcaatgacactttgacgcggtaccggtggctgattagtgcacctgcgggccctgacggtgtgaccagccctatgagagaagtggacttcgacaccttttttacgtcatccaagatggtcacactggactccatatactttcagcctggctcccgggtacagtgcgcagctcgtgctgtgaacaccaatggggatgaaggcctggagctcatgagccctattgtaaccatcagcagagaagaaggtctttgtcagccccgtgtacctggggttgttggagcagagccgttctcagctaaattgcgctacacaggccctgaggatgcagactacacaaaccttatcaagctcactgtcacaatgccacacatagatggcatgctccccgtgatctccactagagagctttccaactttgagctcaccctcagccctgatggcacaagagttggaaaccacaagtgctccaacctcctggattatactgaagtgaagactcattatggtttcttgactgatgctaccaaaaatccagaaataattggagagacatatccttaccagtacagcttgtccatcagaggttccactaccttgcgcttctaccggaacctgaacctagaggcctgtttatgggagttcgttagctactatgacatgtcagaactccttgctgactgtggtggcaccattggaacagatggacaggtcctaaacctagtgcagtcctatgtgacccttcgagtccctctgtatgtttcctacgtgttccattcccccgtgggggtaggaggctggcagcattttgacttgaagtcagagcttcgtctaacttttgtgtacgacaccgccatcttgtggaatgatggaattggcagccccccagaggctgaacttcaaggttctctctatccaaccagcatgcgcatcggtgatgaggggcgcttggccgtgcacttcaagacagaggctcagttccatggcttatttgtgctgtcacatcccgcatcctttacaagctcagtgatcatgtcagctgatcatccaggcctgacattttccctccgcctcataaggagtgaaccaacctataaccagccagtacagcagtggagctttgtctctgactttgccgtacgtgactactcagggacctatactgtgaagctggtgccatgcactgccccatcacatcaggaataccgcctgccagtcacctgcaaccccagagaacctgtcacctttgaccttgacatccgattccaacaggtcagtgatccagtggctgctgagtttagcttgaacacccaaatgtacctgctctctaagaagagtctctggttgtctgatggatccatgggattcgggcaagagagtgatgttgcttttgcagaaggtgatataatttatggtcgtgtcatggtggatcctgtccagaatctgggtgactccttttactgcagcattgagaaggtgtttctatgcactggagctgatggctatgttcccaagtatagtccaatgaatgcagaatatggctgcttagccgactctccttcactcttatatagatttaaaattgtggacaaagctcagccagagacacaagcgaccagttttggaaatgtcctatttaatgccaaactagcagtggatgaccctgaagccattctcttagtgaatcagcctggatctgatggatttaaagtcgactcaacaccactctttcaggtcgctctaggccgagaatggtatatacatacgatctatacagtgagatcgaaagacaatgccaatcgaggtattggcaaaagaagtgtggagtaccattctctggtgagtcaaggaaagccccaatccaccaccaagagccggaagaagagagagatcaggagcacaccctcactggcatgggagattggtgctgaaaacagtcgaggaacaaacatccagcacattgccctggaccgcaccaagaggcagatcccccatgggagagcacctccagatggcatcctcccctgggagctcaacagccccagctctgcagtcagcctggtcactgtggtgggaggcaccacggtagggttactcaccatctgcctcactgtcattgcagtgctgatgtgcaggggcaaggaaagtttcagggggaaggatgccccgaaaggctccagcagcagtgagcccatggtgcccccacagagccatcacaatgacagctcagaagtttgatgactgcaggtagaattcaaccttttccgtaagtgcctcggaaaagatcacaatggaaccttaaatacttctggtaaaccatagagaatggaggatggctgtgatgaagctgcttagagaatatgactgtactaatggagtttgatttgaattctccatactcttttttgcatcaaaggacaaattaaggcatctttcctcttgccccaaaggcagcaacaacgtactcatatgtacacagagccatgatgtgaggaatgtactcctcattttagacatattctctatgcagtggagataaatctattaaaaggtgctaacagactctcttacaagtgtaagaggaatctactgttgctatgttagtgtgaatgttgaaggtgcaattatcacattgtttattaattgtataacagattattactagaaaggtttttgttgctagtctggaaaactggtgaacacactgtttattatgacaagttttcaaataggtgaagacagcatagaattatgaccagggtggctcaacccacaaatcaactgatctactacttgggagacagtggaaggaaagatagagggaaggaagttcactcacttgaatttgaattgcttctcattctcatcagactctccttgttttgtttgcatatttaattttaaattaaaccaaagaatatgttaattctgaaagagatttttaagagatgctgctctgttttggcatatagtgagtaatggtagagctcttgcatggtaatataccttattggtgctcaacatttgtgggaaattagagggttggtgagattttggtgatgaataaatgccatagagttagagtcactacaagacaatgttctctaagaactgagcctagatgtttgcagtattgaacccataaatgataataagaaacattgttacagatggtgaagggagaaagtggtatttattaatataatgtgtataatcagagtgcctcttatacatactttatagaataaaggaacattttgacagatgaggttatccctcggagtagcgtaatcacacaataacatttagaacttaaattggctacaggacattttattagctttctatccagcatctggtccaaacgatgggactctctgcaactatcattccagaaatggtcttggaggtggccagaatcattgaccatatttttatttggttcaagaagacatcgctctggcatccccagttcagtgaactggtacaatgtggtccctctcaatatttaaaaatataatttgtaacagtgcttaccattcacctcccaaagccaaggaacttgagtgagcttccttggcaagcctcccattgcctttctgcatcaatgtgtttgttaccaaatagcagaaatttcgcttagaaggggaaaacttcagctttccaaaagctagtaaacatgtttcaaagaaaaataaggtcaggagaaaaagaataatgcctacagattatccttcagatgctggctagaatcccctttgacttctagccataagctggccacattggacatcttggtcactgcagaattttaaaaggcaaacttctcagaacagatgtgcacatcttaatttggtgtctgtaagtatcaaccatttcttgatcaagataaggaagcaacactgatactgagagagaggtcatatgtccaatagttgcctttcttctcttaggcagctctgcacttcatgttcagttttttaaaaatagactgtagtatcctttcattggagaatttacaaaaatatcatctacagctcaaaagtcccactaacggcttatatgaacagaaagtactgtgtagcccaggagtttatttagcaagataaatagtggtaatttcttaatcattcccctttcctttgctttaccttctggcagatgcttagctacttctttggctacctcataatttgtatgggaatgaacatgaattagggaacttcaaatagtgcgtagacttttccctacttaccattgggttcaattgatgtagactgttagagcaagtatactcaatcaacttgctgatattttagtagttaacagcttccgagcctatcatgcaatttggagtctgtcaatgaatatagcaatcggtgaagcattactgtacgaagtctgttttcaggctttgggtcaagctggttttataccaaatttcactctacaatgcatattctaatgaagctactttatataaattggagagcttataaaatgcagaacatttctatcctatcctaccaaatatttatccttctctgtcctctattctcttactctcctctctccctttttccttccctttattcccttgaaaaaagagaatctgtgggaaataggcagatatagctttttaaaatataaagtacttgggattttgcattatttttcttaatatctatttactaagtatgtaatttaatatacattaattattttttgaaactcttgttagtgggaagaatatggtaaattttttgttaaataaaatagacccttatgtttagcattttgtttttagagaactattctggtactatcagaacaaatacataaaataacttcccatagagaacaggatatagcaataatagctccttagatactcagtggcttctgactccaatcaaggtcttgttgatattatatagtaaaaataaaaccaaaaataaatattattcaagtggctcttctaagcatgtgaatcatgaagcactgaaatatgtattttaatgatgatcttatttattcccatttttgcccttagttaacatttactggtgctcacctaggattggctattctgagggattgcatagaaaccaagctccacttgctgtccttgggaaggttataactgaatgcagctctttatttggactaaagtgtcaggatatgcattagattctctcctgaaccaaaaacacaacagtcattatctgtgaaccataatttaaaaatctttctagaataacaacagcagactccactcttgtttgtctaaaagagccctactgggtatggatcattctgatgacagatttatacaaaatgattcaaaccagtaacttagtaaaattgaccttcgcaaaacctcactgggggagtgccttgtagagctgtgggtgggactgcacattcttttcctcttagtaaaagataggcccactttattccaagaataacacttagcacataaactcttcttccagctcgttagcagcattagcaccttctgaattccaccctctcagaagaatccacagtgtttgaacaatttgcataaaggtcagctagcatcctgctgccaagccactgcatagcatttgtgataagaaggaccaactctaggctcaatatgaagggatttagttctgtaagcagcaaaaaagcttctttatcaagtcatcttacctctaattcttttccagtgtgccaactccaaagtcaacattaaaaatgtaaatggacctgtgtaaatatcacagagagcttttccttatacatctcaatgctgagagttaaaatattcccaggttaaaatttttttaaagtaccaataatagagctaaatacaatgacatttgcttttaaaaggtggatattttatttctgctttttgaaaatacttatttagtattgacttggaagccaatttggtcctttaataagtaaagaaaataatatgtttaaaaatgtaaatgttttacaaatttgaaactttcataattgtattaatcagaaaacaagcacattgccattctttgaaactcatgtttctagacatgacagcagtaataaaaggatgaaaacaagtgtcttcactaagcgtatggccaataaatgggacccaaacgttcaatctgttcagtttaccaaggttcagaaatacgtaatttagcaggaaactataaataccagtgctatcacagccacacatacacacacacagacataaaataaccaaacatctcatttctaggaaagagataacactaaaggcatcataggtttaactgaaatacgttatatgaagttttacaaaaaggtcaacagaaagctcatttgtgaaaacatactctcatgggagcttctttaacattagttcagaggttaatatatttcctggaggtgttttcctagaattgattgcactattgcatggtaataacatttaattgttaaggaaacattatatataggttcaaattatcccttaatgttgatttctccccttttccatggattttgatactaagaaacaaaatgctttgagattttggtaactattttgattttgataaaacatgttaaaatagaaggacatgatatttttctatagtttccatcaggaagagtacatcagaaacttctccataaggaaagaaaactgactctctcttgaactagtgttgacaaaatacactaatgtctttcttaattttattttattaggagaaaaatcagaatattaaatttgcaaacttttgaacagcagtaatagctccttagacactcagtatctttcttccctatctttcaagcacatttaatttctttcccctggtatttgtttgctttgtgttttttcaatattttgtttgctaaagaacaataacaacaacaaagctggtccagccctgacacctacttttgctttttttctttctttcttttaatttgttgaactataggtttctttctgagatgtatttttcattcttccaataatgctctctttttcatttcaaaaccattaccactttcaatatgtaattaacatcctcattcatcagaaagctggtaagtccacacagcatttgtgcagtatcccttctgtgtaaaatgttaaggctttcagatgaaagaaaaaagaacttcctgcaaaagatcaaaagcatcatactaaataaaatgatgacaatatgtgccttgatttttctctcaatggaggttcaacattgacatttaagatgtaaaaaaaattactttgatggtttaattaagaataataagtcaaatatcacatgtatgtagttcttttggatgaccgaataccttaaaatgaactaaataactgaaataaagtgttaaaatgttaa

SEQ ID NO: 11234 - DNA, 12479 bp, Homo sapiens
aactttaaaaagctgcttcggacaaaccagagccaggatttccactgtcggggacccgggatcggaagggtctagcccgagggaaatgctggaagatcccatcggccagtgaccagcaactttccggcgagattttgacgcggagaactgtgctctgcctcctcttattctcccaaagctcacgttggcgtcctgccttgcgggggaactcggcgcgctctctgcctgagcagcgagtgaattgaaccccagcccgctccggcgcctccgggctgatgagtgtcgctctccgcccgtccatctctttttcccggaggtaaaggcccgcggtcccccaccttcagtgcgcccgggttccaagcgccggagccagcgttttggcggagccgcttcttggatgctgaaggctgggctcctccatcgtgggtgccgaggcggcgatgggtgtcctcaaagtgtggctcgggctggccctagcgttggcggaatttgcagtattgcctcatcattccgaaggtgcttgtgtctatcaggattccttgttggcggatgccacaatttggaagcccgattcatgccagagctgccgttgccatggtgatattgttatctgcaaacctgctgtttgcagaaaccctcaatgtgcctttgagaagggagaagtgcttcaaatagctgccaaccaatgctgtcctgagtgtgttttgaggactccaggatcttgccatcatgaaaagaaaatccatgagcatgggacagaatgggcctcttctccatgtagtgtgtgctcttgcaatcatggggaagtccgatgtaccccccaaccatgcccaccgctgtcatgtggacaccaggagctggcattcatccctgaaggaagctgctgcccagtttgtgtgggccttgggaaaccctgttcctatgaaggccatgtgtttcaggatggggaggactggcggctgagccggtgtgccaaatgtctgtgtagaaatggggttgcccagtgcttcacagctcagtgtcagcctctattttgtaaccaggatgagactgtagtccgagtccctggaaaatgttgcccgcagtgctctgcaagatcctgctctgcagctggccaagtatacgagcatggtgagcagtggagcgaaaatgcctgcaccacgtgtatatgtgaccggggtgaggtcaggtgtcacaagcaggcctgcctgcccctgagatgcggaaagggtcagagcagggctcggcgtcatgggcaatgctgtgaggaatgtgtgtctcctgccgggagctgctcctatgatggagttgtgcggtaccaggacgaaatgtggaagggctcggcctgtgagttctgcatgtgtgatcatggccaagtgacctgccagactggagagtgtgccaaagtggagtgtgcccgggatgaagaattaattcacttagatggaaagtgttgtcctgaatgcatttcaaggaatggttattgtgtttatgaagaaactggagaatttatgtcatcaaatgctagtgaagttaaacgtattccagagggagagaagtgggaagatggcccttgcaaggtgtgtgagtgccgaggggctcaggtaacttgctacgagccctcttgcccaccatgtccagtgggcacactggccttagaggtgaagggacagtgctgtccagactgcacatcagttcattgccatccagattgtttgacatgctctcagtctccagaccactgtgacctctgccaagatcctaccaagttactgcagaatggatggtgtgtgcacagctgtggactgggtttttaccaagctggcagtctctgtttagcctgccagccccagtgctccacgtgtaccagtgggctggagtgctcatcctgccagcctcccctgctgatgcggcacgggcagtgtgtgcctacctgtggggacggcttctaccaagatcgccattcctgtgcagtctgccatgagtcctgtgcaggttgctggggcccaacggagaagcactgcttggcctgcagagatcccctccacgtgctgagagatggcggctgtgagagcagctgtggaaaaggcttctacaacaggcagggcacctgtagcgcttgtgaccaatcctgtgacagttgtggccccagtagccccaggtgtcttacctgtactgagaagacagtgctgcatgatgggaaatgcatgtctgaatgccctggcgggtactatgctgatgccactggcaggtgcaaagtttgtcataactcatgtgccagctgctctgggcccacaccctctcactgtacagcctgcagcccccccaaggctctgcgtcaaggccactgtctgccccgctgtggagagggtttctactctgaccatggagtctgcaaagcctgtcactcctcctgcctggcttgtatgggtcccgcaccctctcactgtactgggtgtaagaagccagaggaaggactgcaagtggagcagctgtctgacgtgggcatcccctctggcgagtgtctagcccagtgtagagcccatttttacttggagagcactggcatatgtgaagcttgccaccagtcctgtttcagatgtgcagggaaaagcccacataactgcacagactgtgggccttcccatgtgctgttggatgggcagtgcctctcccagtgcccagatggctactttcaccaggaaggtagttgcacagagtgtcacccaacctgcaggcagtgtcatgggccgttggagtctgactgcatctcctgttaccctcacatctctcttaccaatggtaactgcaggaccagctgcagggaagagcagttcctcaacctcgtgggatactgtgctgactgccatcacctgtgccagcactgtgcagctgatctccacaacactgggagcatctgcctcaggtgccagaatgcccactacctgctgctcggggaccactgtgttcctgactgcccttcaggatactatgcagagagaggagcttgtaaaaaatgccactcctcctgcagaacctgccagggcagaggacctttctcctgctcctcatgtgacaccaacctcgtgctgtcccacactggcacctgcagcaccacctgcttccctgggcactatcttgatgacaatcatgtttgccagccatgcaacacacactgtggaagctgtgattcacaggccagctgtacctcctgccgagatccaaacaaggttctgctctttggggaatgtcaatacgagagctgcgccccacagtactatcttgacttctccaccaacacgtgcaaagagtgtgattggagctgcagtgcatgcagtgggcccctgaaaacagactgcctgcagtgcatggatggctatgttctccaggatggggcctgcgtggagcagtgcttgtcatcattttaccaggactcgggcctctgcaagaactgtgacagctactgtctccagtgccaaggtccccatgagtgtacccgctgcaaagggccatttctcctcttggaagcccagtgtgtccaggaatgtgggaaggggtactttgcagatcatgcaaagcacaaatgcacagcctgccctcaggggtgcttgcagtgcagccacagggaccgttgtcacctctgtgaccatgggttctttctgaagagtggcctctgtgtttacaactgtgttcctggcttttctgtccacacctctaatgaaacatgttctggcaaaatacacacccctagtcttcatgtgaatggttccctgatcctcccaattggttcaataaagccactggatttttccctcctgaatgtccaagaccaggagggtagggtcgaagatctcctatttcatgttgtgagcactcccaccaatggtcagctagtgctctcaagaaatggaaaagaggttcagctggacaaggctggccgttttagctggaaagatgtgaacgagaagaaagtgcgttttgtgcacagcaaagaaaaactcaggaaaggttaccttttcctgaaaattagtgaccagcagttcttctctgagccacagctgatcaacatacaagcattttcaacacaggccccctatgtgctgagaaatgaagttctccacattagcagaggagagagggcaaccatcaccacccagatgcttgacatccgagatgatgacaacccacaggatgtggtcattgaaataatcgatcctccacttcatggccaattgcttcagacacttcagtccccggcaacccctatctatcaattccagctggatgaactctctagaggccttctccactatgctcatgatggttcagacagcacatccgatgttgcagtcttgcaggccaatgatggacactccttccataatatactgttccaagtgaagaccgtgcctcagaatgacaggggtcttcagcttgtggctaattcgatggtgtgggttccagaaggggggatgctgcagatcaccaacagaatcttacaggccgaggctcctggtgccagtgctgaagaaatcatctacaagattacacaagactacccccagtttggggaggtggtccttctagtgaatatgcctgcagacagccctgcagatgaagggcagcacctgcctgatgggaggacagctacccccaccagcaccttcacccagcaggacatcaatgaaggcatcgtatggtacaggcactcaggagccccagcccagagcgactccttccgcttcgaggtgtccagtgcctccaatgcccagacccgcctggagagccacatgttcaacatcgcgatcttaccacagacacctgaagcacctaaagtgtctctggaagcatctctccatatgactgctagagaagatggcctgactgttattcagcctcattccctctccttcataaactctgagaagccaagtggaaagattgtctacaacatcactctacctctgcatccaaatcaaggtatcatcgagcaccgggaccaccctcactctcctatccggtatttcacgcaagaggatattaaccagggcaaagtcatgtaccgccctcccccggcagcaccccacctccaggagctcatggccttctcgttcgctggtctcccagaatcagtgaaattccacttcacagtttcagatggagaacacacaagtccggagatggtcctcaccattcacttacttcccagtgatcagcaactgccagtgttccaggtcacagctccacggctggcggtcagcccaggaggcagcacttctgtaggacttcaggtggtagtaagagatgctgagacagcgcccaaagaactcttctttgagcttcggagacctccacagcatggtgtgcttcttaagcatacagctgagttccgaaggccgatggccacaggtgacactttcacctatgaggatgttgagaaaaatgctctacagtatatacatgatggttcctctacccgggaagacagcatggagatctcagtcacagatggcctcacagtgacaatgctggaggtgagagtagaggtgtccctgtcagaagaccgagggcctcgactggctgctggctcctctctgagcattactgttgccagtaaaagcacagccataatcactaggtcacaccttgcttacgtggatgattcttcccccgacccagagatctggattcagttaaattatctgccctcatatggtactctcttaagaatctcaggatctgaggtggaagagctctcagaagtttccaatttcacaatggaagacatcaataacaagaaaatcagatactcagctgtgtttgaaactgatggtcatctggttactgatagcttctatttctctgtctctgacatggaccacaaccatctggataatcagatatttaccatcatgatcactcctgctgaaaatccacctccagtcattgcttttgctgaccttatcacggttgatgagggagggagagcaccactctcatttcaccatttttttgctactgatgatgatgacaacctccagagagatgccatcattaaactaagtgctctgcccaaatatggctgcattgagaacacaggaacaggtgatcgttttggccctgaaactgccagtgacctagaggcatcatttcctattcaagacgtcctggaaaactacatttactactttcagagtgttcatgaaagcattgagccaacccatgatatttttagtttttatgtgagtgatggaaccagtcgttcagaaattcacagcatcaatatcaccattgagaggaagaacgatgagcctcccaggatgaccttgcagcccctcagagtgcagctgagctcgggagtggtgataagcaattcttctttgagcctgcaagacctggacaccccagataatgagctcatttttgtattgacaaaaaagcctgaccacggtcatgtactctggaggcaaactgcttctgagcctctggagaatgggagagttttagtccagggctcaaccttcacctaccaggatatcctagctgggctggttgggtatgtgcctagtgtccctggcatggtcgtggatgagttccagttctccctcactgatggcctccacgtggacacagggaggatgaagatctacacagaactgcctgcaagtgacacacctcacttggctataaaccaaggcctacagctctcagcagggtctgtagcacgcatcacagaacagcacttgaaagtgacagatattgactcagatgaccatcaggttatgtacatcatgaaggaagatcctggtgcagggcgcctgcagatgatgaagcatggcaacctggagcaaatttctattaaaggccccatccgaagtttcacccaggcagacattagccaaggccacgtagaatatagtcatggaacaggagaacctggagggagctttgcttttaaatttgatgtggttgatggagaaggcaacagattgattgacaagtcattttccatcagcattctagaagacaaatccccaccagtcatcaccaccaataaaggactggtcttggatgaaaactcagtgaagaaaatcaccaccctgcagctgtctgccactgaccaggacagtgggcctacagaattgatctacagaatcaccagacagccccagctgggccacttggaacatgcagcatcaccaggtatccagattagttcctttactcaagctgatctgacttcacgaaatgttcagtatgtccattctagtgaggctgagaaacattcagatgccttcagctttacactgtctgatggagtcagtgaggtgactcagactttccatatcactcttcaccctgtcgatgattcgctgcccgtcgtacagaacttaggaatgcgggtgcaggagggcatgaggaagaccatcacagagtttgagcttaaggcggtggatgctgacacagaggccgagtctgtcacattcaccatcgtgcagcctccacgccatggcaccatcgagcgaaccagcaatgggcagcatttccacctcacctccaccttcaccatgaaagatatctaccagaaccgggtcagctacagccatgacggcagtaactccctcaaggaccggttcaccttcactgtttctgatgggacaaaccccttctttatcattgaggaagggggaaaagagattatgacagcagcacctcagccgttccgagtagacatcctcccggtagatgatggcacgcctagaattgtcaccaacctgggactccagtggctggaatacatggatggcaaggcaaccaacctgatcaccaagaaggaactgctgaccatggacccagacaccgaggacgcgcagcttgtctatgagataacgacgggccctaagcatggctttgtggagaacaagctgcagcctggcagagctgctgccactttcacccaggaggatgtgaacttggggttgattcgttatgtgttgcacaaggagaagatccgtgagatgatggatagttttcagtttctggtgaaagacagtaaacccaatgtggtcagcgacaatgtcttccatatccagtggtcactcatcagctttaaatataccagctacaatgtcagtgagaaggcagggtctgtcagtgtcacggtgcagaggactgggaacctgaaccaatatgccatcgtcctgtgtcgcaccgagcaaggcaccgccagctccagctccagggtcagctcccaacctgggcaacaggactatgtagagtatgctggccaggtccagtttgatgagcgagaggacaccaagtcctgcaccattgtcatcaacgatgatgacgtgtttgaaaatgttgagagtttcactgtggagctcagcatgccagcttatgccctgttaggggaattcacccaggcgaaggtcattatcaacgataccgaggatgaacccacattagagtttgacaagaagatctactgggttaacgagagcgctggttttctgtttgcacctattgaaagaaaaggagatgcaagcagcattgtatctgcaatttgctacacagtccctaagtcagctatgggaagtagcctctatgctctagaatcaggctctgattttaaatctagagggatgtctgccgcgagtcgtgtgatattcgggcctggtgtgaccatgtccacctgtgatgtcatgcttattgatgacagcgagtatgaagaggaagaagagtttgagattgccttggcagatgcctctgacaatgcccgcattggaagggtggcgacagccaaggtgctcattagtggtcccaacgatgcctcgactgtgtccctgggcaacacggctttcactgtcagtgaggacgcaggcacagtaaagattccagttatccgccatggtactgacctctctactttcgcatctgtctggtgtgcaacgcggccctcagacccagcttctgccacaccaggagttgactacgttcccagctctcggaaggtggaatttgggcctggtgtcattgaacagtattgcaccttgactatcttggatgacactcagtatccggtaattgaaggactggagacatttgtggttttcctcagctcagcacaaggagccgaactgaccaaacccttccaggcagtcattgcaattaatgacacattccaagatgtgcccagcatgcagtttgccaaggatttgctcctagtgaaggagaaggagggtgtcctgcatgtccctatcactcggagcggagacctgagctatgagtcatcagtgaggtgctatactcagagccattccgctcaggtcatggaggactttgaggagagacaaaatgcagactcttcacggattacatttctcaaaggggacaaagtgaagaactgtacggtctatatccacgatgactccatgtttgagccagaggaacagttcagggtctacctcggccttcctcttggaaaccactggagtggagctagaattggaaagaataacatggccaccatcaccatatccaatgatgaagatgcccccaccattgagtttgaagaagctgcataccaagtccgggaacccgcaggcccagatgccattgcgattctgaacatcaaggtgatccgcagaggggatcagaacaggacctccaaggttcgctgcagcacgcgggatggctctgcccagtctggtgtggattattacccaaagagccgagtcttgaagttcagtcccggtgtggatcatatcttttttaaagttgagatcctgtccaatgaagaccgggaatggcatgaatctttctcactagtccttggcccagatgacccagtggaagcagttcttggggatgtgactactgccacggtgacaattctagaccaggaggcagcagggagcctcatattgccagcaccacccattgtggtcacacttgctgactatgaccatgtggaagaagttaccaaggaaggagtcaagaaatccccctccccaggctacccactggtctgtgtcaccccctgcgaccctcatttccccagatacgctgtcatgaaggagcgctgcagtgaggccggcatcaaccagacatctgtgcagttcagctgggaagtggctgcccccactgatggcaatggggcccggtctccctttgaaaccatcactgacaacacaccattcaccagtgtcaaccacatggtcctggacagcatttacttcagccggaggttccatgtgcgttgtgtggccaaggctgtggacaaggtgggccatgtggggacccccttaaggagcaacattgttaccattggaacagacagtgctatctgccacacaccagtggtggctgggacatccagaggcttccaggctcagtccttcatcgcaaccttgaaatacctggatgtcaaacataaggagcatccgaacagaatccacatttcggtgcagatcccacaccaggatggaatgctgccccttatctccaccatgccgttgcacaacttacattttctactgtctgagtccatctacagacaccagcacgtctgctccaatttagttaccacctatgacctgagaggcatctcagaggcagggttcctggatgatgtggtctatgatagcactgccctggggcctggctacgatcgccccttccagtttgaccccagcgtgcgagagccgaagaccatccagctctacaaacacctgaacctgaagagctgcgtgtggacctttgatgcttattatgacatgactgagctgattgacgtctgtgggggctctgtaaccgctgacttccaggtgagggactctgcccagtccttcttgacagtgcacgtgcctctatatgtgtcctacatctatgtgacagcccccaggggctgggcctccttggagcaccacaccgagatggagttttctttcttctatgacactgttctctggagaacaggaatccagacagacagcgtgctctctgcaaggcttcagataataagaatctacattcgagaggatggccgtcttgtcattgaattcaagacccatgccaaattcagaggacagtttgtgatggagcatcacactctcccagaagtgaaatctttcgtattgactccagaccacctaggaggaattgaatttgacttgcagctattatggagcgctcagacttttgattctccacatcaactctggagagccacaagctcttataacaggaaggactactcaggagagtacaccatctacctgatcccttgcacagtgcagcccacacagccatgggttgacccaggagagaagcctttggcctgcactgcacatgccccagaaagattcctgatacccattgcattccagcagaccaaccgccctgtgccagttgtgtattcacttaacactgaatttcagctctgcaataatgagaaggtgttcctaatggatcccaatacatctgatatgtcactagcagaaatggattacaaaggagccttttcaaaaggtcaaatcctttatggccgagtactttggaatccagaacaaaatcttaattctgcttacaaactccagctggagaaagtctatctttgtacgggcaaggatggttatgtgcctttctttgatcccacggggacaatctacaatgaagggccccagtatggatgcattcagccaaacaaacacctaaaacacagattcctgctgttggaccgcaatcagccagaggtaactgataagtacttccatgatgtgccttttgaggctcactttgcctctgagttgcctgatttccatgtggtcagtaacatgccaggtgtggatggatttactctaaaagtagatgcactctataaggtggaagcaggacaccagtggtatctccaggtcatctacatcattggccctgacaccatctcagggccccgggtccagcgctctctcacagctccactcagacgcaaccgaagggacctggtagagcccgatggccagctgatccttgatgattccctcatctatgacaatgaaggagaccaagtcaagaatggcaccaatatgaagtccctgaatctggagatgcaagagttggcggtagctgcgtccctgtcacagactggggcgtccattggcagtgccctggctgcaatcatgcttctacttctggtgtttttggtggcttgttttatcaacaggaaatgccagaaacagaggaagaagaagcccgcagaggacattttggaagaatatcctctgaataccaaggtagaagtgcccaagaggcacccggaccgggtggagaagaacgtgaatagacactactgcactgtgcggaacgtcaacatcctgagtgagcctgaggcggcttacacgttcaaaggtgctaaagtcaaaagactgaatctagaagtcagagttcacaacaatttacaagatggaacagaagtttaa

SEQ ID NO: 11235 - DNA, 2654 bp, Homo sapiens
aactttaaaaagctgcttcggacaaaccagagccaggatttccactgtcggggacccgggatcggaagggtctagcccgagggaaatgctggaagatcccatcggccagtgaccagcaactttccggcgagattttgacgcggagaactgtgctctgcctcctcttattctcccaaagctcacgttggcgtcctgccttgcgggggaactcggcgcgctctctgcctgagcagcgagtgaattgaaccccagcccgctccggcgcctccgggctgatgagtgtcgctctccgcccgtccatctctttttcccggaggtaaaggcccgcggtcccccaccttcagtgcgcccgggttccaagcgccggagccagcgttttggcggagccgcttcttggatgctgaaggctgggctcctccatcgtgggtgccgaggcggcgatgggtgtcctcaaagtgtggctcgggctggccctagcgttggcggaatttgcagtattgcctcatcattccgaaggtgcttgtgtctatcaggattccttgttggcggatgccacaatttggaagcccgattcatgccagagctgccgttgccatggtgatattgttatctgcaaacctgctgtttgcagaaaccctcaatgtgcctttgagaagggagaagtgcttcaaatagctgccaaccaatgctgtcctgagtgtgttttgaggactccaggatcttgccatcatgaaaagaaaatccatgagcatgggacagaatgggcctcttctccatgtagtgtgtgctcttgcaatcatggggaagtccgatgtaccccccaaccatgcccaccgctgtcatgtggacaccaggagctggcattcatccctgaaggaagctgctgcccagtttgtgtgggccttgggaaaccctgttcctatgaaggccatgtgtttcaggatggggaggactggcggctgagccggtgtgccaaatgtctgtgtagaaatggggttgcccagtgcttcacagctcagtgtcagcctctattttgtaaccaggatgagactgtagtccgagtccctggaaaatgttgcccgcagtgctctgcaagatcctgctctgcagctggccaagtatacgagcatggtgagcagtggagcgaaaatgcctgcaccacgtgtatatgtgaccggggtgaggtcaggtgtcacaagcaggcctgcctgcccctgagatgcggaaagggtcagagcagggctcggcgtcatgggcaatgctgtgaggaatgtgtgtctcctgccgggagctgctcctatgatggagttgtgcggtaccaggacgaaatgtggaagggctcggcctgtgagttctgcatgtgtgatcatggccaagtgacctgccagactggagagtgtgccaaagtggagtgtgcccgggatgaagaattaattcacttagatggaaagtgttgtcctgaatgcatttcaaggaatggttattgtgtttatgaagaaactggagaatttatgtcatcaaatgctagtgaagttaaacgtattccagagggagagaagtgggaagatggcccttgcaaggtgtgtgagtgccgaggggctcaggtaacttgctacgagccctcttgcccaccatgtccagtgggcacactggccttagaggtgaagggacagtgctgtccagactgcacatcagttcattgccatccagattgtttgacatgctctcagtctccagaccactgtgacctctgccaagatcctaccaagttactgcagaatggatggtgtgtgcacagctgtggactgggtttttaccaagctggcagtctctgtttagcctgccagccccagtgctccacgtgtaccagtgggctggagtgctcatcctgccagcctcccctgctgatgcggcacgggcagtgtgtgcctacctgtggggacggcttctaccaagatcgccattcctgtgcagtctgccatgagtcctgtgcaggttgctggggcccaacggagaagcactgcttggcctgcagagatcccctccacgtgctgagagatggcggctgtgagagcagctgtggaaaaggcttctacaacaggcagggcacctgtagcgcttgtgaccaatcctgtgacagttgtggccccagtagccccaggtgtcttacctgtactgagaagacagtgctgcatgatgggaaatgcatgtctgaatgccctggcgggtactatgctgatgccactggcaggtgcaaagtttgtcataactcatgtgccagctgctctgggcccacaccctctcactgtacagcctgcagcccccccaaggctctgcgtcaaggccactgtctgccccgctgtggagagggtttctactctgaccatggagtctgcaaagcctgtcactcctcctgcctggcttgtatgggtcccgcaccctctcactgtactgggtgtaagaagccagaggaaggactgcaagtggagcagctgtctgacgtgggcatcccctctggcgagtgtctagcccagtgtagagcccatttttacttggagagcactggcatatgtgaagggcaaaatctggacttctgtcagaatttagaagtgatttctgctgtttgccttggcatatcatctacagagaattga

SEQ ID NO: 11236 - DNA, 3330 bp, Homo sapiens
ggctcctccatcgtgggtgccgaggcggcgatgggtgtcctcaaagtgtggctcgggctggccctagcgttggcggaatttgcagtattgcctcatcattccgaaggtgcttgtgtctatcaggattccttgttggcggatgccacaatttggaagcccgattcatgccagagctgccgttgccatggtgatattgttatctgcaaacctgctgtttgcagaaaccctcaatgtgcctttgagaagggagaagtgcttcaaatagctgccaaccaatgctgtcctgagtgtgttttgaggactccaggatcttgccatcatgaaaagaaaatccatgagcatgggacagaatgggcctcttctccatgtagtgtgtgctcttgcaatcatggggaagtccgatgtaccccccaaccatgcccaccgctgtcatgtggacaccaggagctggcattcatccctgaaggaagctgctgcccagtttgtgtgggccttgggaaaccctgttcctatgaaggccatgtgtttcaggatggggaggactggcggctgagccggtgtgccaaatgtctgtgtagaaatggggttgcccagtgcttcacagctcagtgtcagcctctattttgtaaccaggatgagactgtagtccgagtccctggaaaatgttgcccgcagtgctctgcaagatcctgctctgcagctggccaagtatacgagcatggtgagcagtggagcgaaaatgcctgcaccacgtgtatatgtgaccggggtgaggtcaggtgtcacaagcaggcctgcctgcccctgagatgcggaaagggtcagagcagggctcggcgtcatgggcaatgctgtgaggaatgtgtgtctcctgccttggcctcccaaagtgttgggattacaggcatgagccaccatgcccagtcactacttgggccatttttgactcaaataaagaagccacatttctcctgtttagagtgataaatttaagaaaaaagtaaaaattggaaggaattttagccgttccttctggaaaccctgaactgtatagcctaatgattattgggtcactggccgcttagacctctctcagcttctgttgcctagaggaataaaatctgaggggtaaaatttaaaaaaattcatgttattgaagaaaaaaaaatggtgttgagctcttctttcaaatgaattctaataaatatgacactgtctataattcaggaagttaatagccttttaattttggatctgatttttgcaaagggtcatggagaagggaaggggaaagcctgttgccttcagatctgctagctgcacttttctgtgttgatgtatatccaggcaatgtttgaagacacaagggttttcttggtctcctctctctagaataacattgtgatgacaatttcaaatcaatcagttagactcaaattaaaatcaagtaaaaaacaagacatctatcatttagatattgcttactcttcccctgggccttttgcagtgtttggggttgggatgagaggagtaatctgagccagcattttctgtggagctctgaatggtaactgggcatctcggtacctgaatggtggtacccaagcgcctcagtgcctgaatcccacctgagcatcatagtatctgaatggtacctgagctctgaatggtcctggagcatcacaatagccctggtgctctatcccaggggctgggctctgacccatgcagaggttcccttaagaaactgggaggtccaatgaaaacatgctgcaaatgtttcttcgattaaaagatacacagttaacactacagatgtttttagattaaaagatatgcatttaacattttcttatgtagtgaaagagggttcctcatgcaggatatgccagatagaatggttttgaaactagctggagcttaaggtagaatctctgcttctgtattgtcacttgccctagtaacagaagttatgatcagagactcctaataaaacaaccagtggttctatgttatataaattattgtaagtttttttgcatattatctcatttgattccttttggaaatggcagggcaggtatatccatttatagatgagaaatagtcagtgaggaaacggatctgacccaggccttccaattcctggtcttgtgcttatcccactctcccaactttatcctcaaatacattttctttttttttgccgaaaatgataccttgttttctagttcagcctagtaagcaggaattgatagatcaaggtaaaaatgctctcttgatgttgatgcaggtgatcgttttggccctgaaactgccagtgacctagaggcatcatttcctattcaagacgtcctggaaaactacatttactactttcagagtgttcatgaaagcattgagccaacccatgatatttttagtttttatgtgagtgatggaaccagtcgttcagaaattcacagcatcaatatcaccattgaggtaaagactttggaagttggaaaggttgagcccttgaccacaatatttcacaccattagagagctttctttatagggactcaaaagcaaagaagattggatttgaccttcaaaattgaaggtcgttcttaaaatatagccttcaggaatcttgtagaattaaggttggcatttggggaaggcttgagttagaaatctaaatttccatttcaggattgaatttatttgttcggtgtgaaaaacagtttgtgaaggtcagagatgctttgccagtctcatatataaatgaaaacttacatatgtctatgtttctctgaaattgtgtttggttctatatgcatatttgccttttcttattttactgcatttatttatttaattgtaacatcaaagaaatgtgttccttgatgctgtatttattctcatttgagcaactacacaggcttgctctaccgagagagagacacaggggaggggaaagataaatctcagaatgaaataccctctgccttgggaaaataaaatgtaaagaaccctctgcactcttaagggtcagtggtggaaaggggctggcaccagggcagggagacagctttagagacccacactttcaaatatagtgtccttctacaggtactgtggtatgcttagcattttctaagagagttctgagttatattagtatggtcttttatcttcaaagtatgttaatacttgtacttgtcaaagcacatatccatatttttggtctagaaaatatggtcattgtacttacggaagatatctgagaaaacttttatgaaatgtccatcagcttcttttgaagggggcattttgttgcctggac

SEQ ID NO: 11237 - DNA, 9869 bp, Homo sapiens
ctcagaagtttccaatttcacaatggaagacatcaataacaagaaaatcagatactcagctgtgtttgaaactgatggtcatctggttactgatagcttctatttctctgtctctgacatggaccacaaccatctggataatcagatatttaccatcatgatcactcctgctgaaaatccacctccagtcattgcttttgctgaccttatcacggttgatgagggagggagagcaccactctcatttcaccatttttttgctactgatgatgatgacaacctccagagagatgccatcattaaactaagtgctctgcccaaatatggctgcattgagaacacaggaacaggtgatcgttttggccctgaaactgccagtgacctagaggcatcatttcctattcaagacgtcctggaaaactacatttactactttcagagtgttcatgaaagcattgagccaacccatgatatttttagtttttatgtgagtgatggaaccagtcgttcagaaattcacagcatcaatatcaccattgagaggaagaacgatgagcctcccaggatgaccttgcagcccctcagagtgcagctgagctcgggagtggtgataagcaattcttctttgagcctgcaagacctggacaccccagataatgagctcatttttgtattgacaaaaaagcctgaccacggtcatgtactctggaggcaaactgcttctgagcctctggagaatgggagagttttagtccagggctcaaccttcacctaccaggatatcctagctgggctggttgggtatgtgcctagtgtccctggcatggtcgtggatgagttccagttctccctcactgatggcctccacgtggacacagggaggatgaagatctacacagaactgcctgcaagtgacacacctcacttggctataaaccaaggcctacagctctcagcagggtctgtagcacgcatcacagaacagcacttgaaagtgacagatattgactcagatgaccatcaggttatgtacatcatgaaggaagatcctggtgcagggcgcctgcagatgatgaagcatggcaacctggagcaaatttctattaaaggccccatccgaagtttcacccaggcagacattagccaaggccacgtagaatatagtcatggaacaggagaacctggagggagctttgcttttaaatttgatgtggttgatggagaaggcaacagattgattgacaagtcattttccatcagcattctagaagacaaatccccaccagtcatcaccaccaataaaggactggtcttggatgaaaactcagtgaagaaaatcaccaccctgcagctgtctgccactgaccaggacagtgggcctacagaattgatctacagaatcaccagacagccccagctgggccacttggaacatgcagcatcaccaggtatccagattagttcctttactcaagctgatctgacttcacgaaatgttcagtatgtccattctagtgaggctgagaaacattcagatgccttcagctttacactgtctgatggagtcagtgaggtgactcagactttccatatcactcttcaccctgtcgatgattcgctgcccgtcgtacagaacttaggaatgcgggtgcaggagggcatgaggaagaccatcacagagtttgagcttaaggcggtggatgctgacacagaggccgagtctgtcacattcaccatcgtgcagcctccacgccatggcaccatcgagcgaaccagcaatgggcagcatttccacctcacctccaccttcaccatgaaagatatctaccagaaccgggtcagctacagccatgacggcagtaactccctcaaggaccggttcaccttcactgtttctgatgggacaaaccccttctttatcattgaggaagggggaaaagagattatgacagcagcacctcagccgttccgagtagacatcctcccggtagatgatggcacgcctagaattgtcaccaacctgggactccagtggctggaatacatggatggcaaggcaaccaacctgatcaccaagaaggaactgctgaccatggacccagacaccgaggacgcgcagcttgtctatgagataacgacgggccctaagcatggctttgtggagaacaagctgcagcctggcagagctgctgccactttcacccaggaggatgtgaacttggggttgattcgttatgtgttgcacaaggagaagatccgtgagatgatggatagttttcagtttctggtgaaagacagtaaacccaatgtggtcagcgacaatgtcttccatatccagtggtcactcatcagctttaaatataccagctacaatgtcagtgagaaggcagggtctgtcagtgtcacggtgcagaggactgggaacctgaaccaatatgccatcgtcctgtgtcgcaccgagcaaggcaccgccagctccagctccagggtcagctcccaacctgggcaacaggactatgtagagtatgctggccaggtccagtttgatgagcgagaggacaccaagtcctgcaccattgtcatcaacgatgatgacgtgtttgaaaatgttgagagtttcactgtggagctcagcatgccagcttatgccctgttaggggaattcacccaggcgaaggtcattatcaacgataccgaggatgaacccacattagagtttgacaagaagatctactgggttaacgagagcgctggttttctgtttgcacctattgaaagaaaaggagatgcaagcagcattgtatctgcaatttgctacacagtccctaagtcagctatgggaagtagcctctatgctctagaatcaggctctgattttaaatctagagggatgtctgccgcgagtcgtgtgatattcgggcctggtgtgaccatgtccacctgtgatgtcatgcttattgatgacagcgagtatgaagaggaagaagagtttgagattgccttggcagatgcctctgacaatgcccgcattggaagggtggcgacagccaaggtgctcattagtggtcccaacgatgcctcgactgtgtccctgggcaacacggctttcactgtcagtgaggacgcaggcacagtaaagattccagttatccgccatggtactgacctctctactttcgcatctgtctggtgtgcaacgcggccctcagacccagcttctgccacaccaggagttgactacgttcccagctctcggaaggtggaatttgggcctggtgtcattgaacagtattgcaccttgactatcttggatgacactcagtatccggtaattgaaggactggagacatttgtggttttcctcagctcagcacaaggagccgaactgaccaaacccttccaggcagtcattgcaattaatgacacattccaagatgtgcccagcatgcagtttgccaaggatttgctcctagtgaaggagaaggagggtgtcctgcatgtccctatcactcggagcggagacctgagctatgagtcatcagtgaggtgctatactcagagccattccgctcaggtcatggaggactttgaggagagacaaaatgcagactcttcacggattacatttctcaaaggggacaaagtgaagaactgtacggtctatatccacgatgactccatgtttgagccagaggaacagttcagggtctacctcggccttcctcttggaaaccactggagtggagctagaattggaaagaataacatggccaccatcaccatatccaatgatgaagatgcccccaccattgagtttgaagaagctgcataccaagtccgggaacccgcaggcccagatgccattgcgattctgaacatcaaggtgatccgcagaggggatcagaacaggacctccaaggttcgctgcagcacgcgggatggctctgcccagtctggtgtggattattacccaaagagccgagtcttgaagttcagtcccggtgtggatcatatcttttttaaagttgagatcctgtccaatgaagaccgggaatggcatgaatctttctcactagtccttggcccagatgacccagtggaagcagttcttggggatgtgactactgccacggtgacaattctagaccaggaggcagcagggagcctcatattgccagcaccacccattgtggtcacacttgctgactatgaccatgtggaagaagttaccaaggaaggagtcaagaaatccccctccccaggctacccactggtctgtgtcaccccctgcgaccctcatttccccagatacgctgtcatgaaggagcgctgcagtgaggccggcatcaaccagacatctgtgcagttcagctgggaagtggctgcccccactgatggcaatggggcccggtctccctttgaaaccatcactgacaacacaccattcaccagtgtcaaccacatggtcctggacagcatttacttcagccggaggttccatgtgcgttgtgtggccaaggctgtggacaaggtgggccatgtggggacccccttaaggagcaacattgttaccattggaacagacagtgctatctgccacacaccagtggtggctgggacatccagaggcttccaggctcagtccttcatcgcaaccttgaaatacctggatgtcaaacataaggagcatccgaacagaatccacatttcggtgcagatcccacaccaggatggaatgctgccccttatctccaccatgccgttgcacaacttacattttctactgtctgagtccatctacagacaccagcacgtctgctccaatttagttaccacctatgacctgagaggcatctcagaggcagggttcctggatgatgtggtctatgatagcactgccctggggcctggctacgatcgccccttccagtttgaccccagcgtgcgagagccgaagaccatccagctctacaaacacctgaacctgaagagctgcgtgtggacctttgatgcttattatgacatgactgagctgattgacgtctgtgggggctctgtaaccgctgacttccaggtgagggactctgcccagtccttcttgacagtgcacgtgcctctatatgtgtcctacatctatgtgacagcccccaggggctgggcctccttggagcaccacaccgagatggagttttctttcttctatgacactgttctctggagaacaggaatccagacagacagcgtgctctctgcaaggcttcagataataagaatctacattcgagaggatggccgtcttgtcattgaattcaagacccatgccaaattcagaggacagtttgtgatggagcatcacactctcccagaagtgaaatctttcgtattgactccagaccacctaggaggaattgaatttgacttgcagctattatggagcgctcagacttttgattctccacatcaactctggagagccacaagctcttataacaggaaggactactcaggagagtacaccatctacctgatcccttgcacagtgcagcccacacagccatgggttgacccaggagagaagcctttggcctgcactgcacatgccccagaaagattcctgatacccattgcattccagcagaccaaccgccctgtgccagttgtgtattcacttaacactgaatttcagctctgcaataatgagaaggtgttcctaatggatcccaatacatctgatatgtcactagcagaaatggattacaaaggagccttttcaaaaggtcaaatcctttatggccgagtactttggaatccagaacaaaatcttaattctgcttacaaactccagctggagaaagtctatctttgtacgggcaaggatggttatgtgcctttctttgatcccacggggacaatctacaatgaagggccccagtatggatgcattcagccaaacaaacacctaaaacacagattcctgctgttggaccgcaatcagccagaggtaactgataagtacttccatgatgtgccttttgaggctcactttgcctctgagttgcctgatttccatgtggtcagtaacatgccaggtgtggatggatttactctaaaagtagatgcactctataaggtggaagcaggacaccagtggtatctccaggtcatctacatcattggccctgacaccatctcagggccccgggtccagcgctctctcacagctccactcagacgcaaccgaagggacctggtagagcccgatggccagctgatccttgatgattccctcatctatgacaatgaaggagaccaagtcaagaatggcaccaatatgaagtccctgaatctggagatgcaagagttggcggtagctgcgtccctgtcacagactggggcgtccattggcagtgccctggctgcaatcatgcttctacttctggtgtttttggtggcttgttttatcaacaggaaatgccagaaacagaggaagaagaagcccgcagaggacattttggaagaatatcctctgaataccaaggtagaagtgcccaagaggcacccggaccgggtggagaagaacgtgaatagacactactgcactgtgcggaacgtcaacatcctgagtgagcctgaggcggcttacacgttcaaaggtgctaaagtcaaaagactgaatctagaagtcagagttcacaacaatttacaagatggaacagaagtttaatggaggagacctatgtgtatttttttctaaaatcatttttataaaatggggggaaatactggtatttttataatctcgcagataaaaaagggaaaactatagctttgagtggcagacagcacacatcacatgcatcaactcacaactgagctacctcattcagcaaagaaccactgagaaccccagagtattacagttatttccgtagatccctttaatagtgtcaacaactgtacacagctccttctgtaaggctggtcttagaaaacaagtactttagtatcaggacaggagttgaacaattaggttagcagatggagatgagaggactgggtagagtaccatggcagatctcagagagaagaagtaggtacgggcctttggttccctcccccagccccagctttctcctacagggcttttcctgagtccccagacagcagagtatgaactgctgacacccagattccattaaaaattctgctaatcgacacaacacatatatttgctcatgatttcacttgacagcgtatgctccttggcctctaattgtactttgcttttccagagccctttttacctggggatttcagtgtgcttaagtaaaatcctctgaaaaccacgggagcctctgcctcctcagccacagagaactccctcctacaaagggggagactgaaacccgagttaaggaggggcctggcaggcgtatcagagcacattagtgatgcccttcaccccagggaggtgtctgttcccaactagtttatgtggcactgagacatccatccctgaccaaggatgctgcgaaacaggatcaatgtactacggccttttaattcaacattgccataaatgctttaaagaaaacccaccacactttcctcctactccggtctttgcccgttcctgtaacagacaatcccatgtcctaggtatggttttttattctgttagtgcttcgggaaagtaagtgattcatttgaataaggcaaattaggagaaagcccaggttggggtgaaatcagacttaacagatacatgctggttctccttgctgtgtgtgacacagcagacagaggcactattcctggtgcagtatttcagggatttctctttgaggggttcttttctggtagctcaggcaattatttttaccatatcagcacatgacaaggccatgaacacatggctctaaaataatttagtgttcaagtatcagcttaactattttgtgtaggctacacacagcttgcttttgtttctcttctgtttctgccttattggcggaaacataagcgtgcatgccatgttgttttgaattggaggcacaatttcattattcgagagtaaaagacatgtcctcttctgatgcatggcacaccatagtcaccaagcaaataacagagccttcacattgtgtaatatttgtatgagaatgactcaagctctttgagaacattccaaactagtaacatttcgctactaaaagctagaaaggatgaactgtgaaaggttctaggcagctctgtgagactccaagctccttgaaagtaggacctttgtgagccacgcctttcattcttcaacagtgccttgcatgtaacaagcactccagaaatgtttgttgaatgaatgaatggtgtcatgggtgaatgatggggagtaaatttaggaaggggaagtgagagagtatggtggcaatatcacaagggaggagagaggaaaacaattatcttctctacttggattatgagataaccttttcttggaggaaagaaacaccgctttacaaaggcatgactctggcggtggtcctaaggaagcatgagcagaaaattcataaaaatgtatcatcagcaggagatgagactatgaattggcatccagaacaggagatttagagcaaaatctaatttagcattctgagatgagtgtcaggttttcaggagagaatgagttggggtgagcccagagtctgaaactcctgactggtcaggtgctacttaagaccagcttgggcaattcagggcagaactcctgtatcagcctcatggacacccagaattggtatctcatggctggagagctgatcagccaggcacagaatctccagaacaacctagagagtgaatgctaatttgtagagcgaacttccatttggcccattatttgtaactgtgtaactgctccaagtgccagaatgcttacacgttaaagcagcacctttccatttgcccacatattcttcttgcacaccccttccattactgctgaataggacattgcatgggaagagtacagaggtggcagaatgaagctagagtgggaaggactaaagactgagccccagagtgctcccagcaaccgccacgtacaaggtctgaaatgacaagggcaagagtgagataggaaactgtgtgtgaaaggaaagcccttgcagtatttctgcctccctttctttctgcctttcaccccactaaatgtatgttattgaatgccagtacttctctagtggatgcacacttgttaaatagtgttaagagatgtggagatgagatatacccctttgatgtagaattattcatttggtttgtttcatacttcattataggaatcaagtaatttgatgactaatgtggattatatttcagtcaaagctctgctttcaatttctctgatttgctcactaatgccttgtgtgtgttttactaaccttttatatcttgccttcaagtgagaaggaacaaacaactctcagtggttactacttgcttttatatgctggctgtgaaggttaaaagaaagaatggtctgtaccattctgctttgctgcccttttattgtaccccaggcctcctagaggactcctgcagattctattgttgggtgggaaatagtgttggaatgtgtttgcacagtcttatgatattcagtctcagtctgctataggtatttgttattcttggatactacacacctgctcagactgagtaaacatttgtggtgctgtcaacctgatttcttgactctcaaatgatttttgtatttccaatatgaatttgtgtgttatgaatttctgatttctccaatagtatatgccactatataaatttgtattaataaatgacagtcttgttggttt

SEQ ID NO: 11238 - DNA, 765 bp, Homo sapiens
gagaggcaaggtcagagcagggctcggcgtcatgggcaatgctgtgaggaatgtgtgtctcctgccgggagctgctcctatgatggagttgtgcggtaccaggacgaaatgtggaagggctcggcctgtgagttctgcatgtgtgatcatggccaagtgacctgccagactggagagtgtgccaaagtggagtgtgcccgggatgaagaattaattcacttagatggaaagtgttgtcctgaatgcatttcaaggaatggttattgtgtttatgaagaaactggagaatttatgtcatcaaatgctagtgaagttaaacgtattccagagggagagaagtgggaagatggcccttgcaaggtgtgtgagtgccgaggggctcaggtaacttgctacgagccctcttgcccaccatgtccagtgggcacactggccttagaggtgaagggacagtgctgtccagactgcacatcagttcattgccatccagattgtttgacatgctctcagtctccagaccactgtgacctctgccaagatcctaccaagttactgcagaatggatggtgtgtgcacagctgtggactgggtttttaccaagctggcagtctctgtttagatgatggcttcagcctgccagccccagtgctccacgtgtaccagtgggctggagtgctcatcctgccagcctcccctgctgatgcggcacgggcagtgtgtgcctacctgtggggacggcttctaccaagatcgccattcctgtgc

SEQ ID NO: 11239 - DNA, 2121 bp, Homo sapiens
cactctacctctgcatccaaatcaaggtctcccagaatcagtgaaattccacttcacagtttcagatggagaacacacaagtccggagatggtcctcaccattcacttacttcccagtgatcagcaactgccagtgttccaggtcacagctccacggctggcggtcagcccaggaggcagcacttctgtaggacttcaggtggtagtaagagatgctgagacagcgcccaaagaactcttctttgagcttcggagacctccacagcatggtgtgcttcttaagcatacagctgagttccgaaggccgatggccacaggtgacactttcacctatgaggatgttgagaaaaatgctctacagtatatacatgatggttcctctacccgggaagacagcatggagatctcagtcacagatggcctcacagtgacaatgctggaggtgagagtagaggtgtccctgtcagaagaccgagggcctcgactggctgctggctcctctctgagcattactgttgccagtaaaagcacagccataatcactaggtcacaccttgcttacgtggatgattcttcccccgacccagagatctggattcagttaaattatctgccctcatatggtactctcttaagaatctcaggatctgaggtggaagagctctcagaagtttccaatttcacaatggaagacatcaataacaagaaaatcagatactcagctgtgtttgaaactgatggtcatctggttactgatagcttctatttctctgtctctgacatggaccacaaccatctggataatcagatatttaccatcatgatcactcctgctgaaaatccacctccagtcattgcttttgctgaccttatcacggttgatgagggagggagagcaccactctcatttcaccatttttgctactgatgatgatgacaacctccagagagatgccatcattaaactaagtgctctgcccaaatatggctgcattgagaacacaggaacaggtgatcgttttggccctgaaactgccagtgacctagaggcatcatttcctattcaagacgtcctggaaaactacatttactactttcagagtgttcatgaaagcattgagccaacccatgatatttttagtttttatgtgagtgatggaaccagtcgttcagaaattcacagcatcaatatcaccattgaggtaaagactttggaagttggaaaggttgagcccttgaccacaatatttcacaccattagagagctttctttatagggactcaaaagcaaagaagattggatttgaccttcaaaattgaaggtcgttcttaaaatatagccttcaggaatcttgtagaattaaggttggcatttggggaaggcttgagttagaaatctaaatttccatttcaggattgaatttatttgttcggtgtgaaaaacagtttgtgaaggtcagagatgctttgccagtctcatatataaatgaaaacttacatatgtctatgtttctctgaaattgtgtttggttctatatgcatatttgccttttcttattttactgcatttatttatttaattgtaacatcaaagaaatgtgttccttgatgctgtatttattctcatttgagcaactacacaggcttgctctaccgagagagagacacaggggaggggaaagataaatctcagaatgaaataccctctgccttgggaaaataaaatgtaaagaaccctctgcactcttaagggtcagtggtggaaaggggctggcaccagggcagggagacagctttagagacccacactttcaaatatagtgtccttctacaggtactgtggtatgcttagcattttctaagagagttctgagttatattagtatggtcttttatcttcaaagtatgttaatacttgtacttgtcaaagcacatatccatatttttggtctagaaaatatggtcattgtacttacggaagatatctgagaaaacttttatgaaatgtccatcagcttcttttgaagggggcattttgttgcctggacttgctctcttttcaaactaactattttgcttgggaagtaaagatggtgccacattaaatgctattttgaggtg

SEQ ID NO: 11240 - DNA, 7142 bp, Homo sapiens
aactttaaaaagctgcttcggacaaaccagagccaggatttccactgtcggggacccgggatcggaagggtctagcccgagggaaatgctggaagatcccatcggccagtgaccagcaactttccggcgagattttgacgcggagaactgtgctctgcctcctcttattctcccaaagctcacgttggcgtcctgccttgcgggggaactcggcgcgctctctgcctgagcagcgagtgaattgaaccccagcccgctccggcgcctccgggctgatgagtgtcgctctccgcccgtccatctctttttcccggaggtaaaggcccgcggtcccccaccttcagtgcgcccgggttccaagcgccggagccagcgttttggcggagccgcttcttggatgctgaaggctgggctcctccatcgtgggtgccgaggcggcgatgggtgtcctcaaagtgtggctcgggctggccctagcgttggcggaatttgcagtattgcctcatcattccgaaggtgcttgtgtctatcaggattccttgttggcggatgccacaatttggaagcccgattcatgccagagctgccgttgccatggtgatattgttatctgcaaacctgctgtttgcagaaaccctcaatgtgcctttgagaagggagaagtgcttcaaatagctgccaaccaatgctgtcctgagtgtgttttgaggactccaggatcttgccatcatgaaaagaaaatccatgagcatgggacagaatgggcctcttctccatgtagtgtgtgctcttgcaatcatggggaagtccgatgtaccccccaaccatgcccaccgctgtcatgtggacaccaggagctggcattcatccctgaaggaagctgctgcccagtttgtgtgggccttgggaaaccctgttcctatgaaggccatgtgtttcaggatggggaggactggcggctgagccggtgtgccaaatgtctgtgtagaaatggggttgcccagtgcttcacagctcagtgtcagcctctattttgtaaccaggatgagactgtagtccgagtccctggaaaatgttgcccgcagtgctctgcaagatcctgctctgcagctggccaagtatacgagcatggtgagcagtggagcgaaaatgcctgcaccacgtgtatatgtgaccggggtgaggtcaggtgtcacaagcaggcctgcctgcccctgagatgcggaaagggtcagagcagggctcggcgtcatgggcaatgctgtgaggaatgtgtgtctcctgccgggagctgctcctatgatggagttgtgcggtaccaggacgaaatgtggaagggctcggcctgtgagttctgcatgtgtgatcatggccaagtgacctgccagactggagagtgtgccaaagtggagtgtgcccgggatgaagaattaattcacttagatggaaagtgttgtcctgaatgcatttcaaggaatggttattgtgtttatgaagaaactggagaatttatgtcatcaaatgctagtgaagttaaacgtattccagagggagagaagtgggaagatggcccttgcaaggtgtgtgagtgccgaggggctcaggtaacttgctacgagccctcttgcccaccatgtccagtgggcacactggccttagaggtgaagggacagtgctgtccagactgcacatcagttcattgccatccagattgtttgacatgctctcagtctccagaccactgtgacctctgccaagatcctaccaagttactgcagaatggatggtgtgtgcacagctgtggactgggtttttaccaagctggcagtctctgtttagcctgccagccccagtgctccacgtgtaccagtgggctggagtgctcatcctgccagcctcccctgctgatgcggcacgggcagtgtgtgcctacctgtggggacggcttctaccaagatcgccattcctgtgcagtctgccatgagtcctgtgcaggttgctggggcccaacggagaagcactgcttggcctgcagagatcccctccacgtgctgagagatggcggctgtgagagcagctgtggaaaaggcttctacaacaggcagggcacctgtagcgcttgtgaccaatcctgtgacagttgtggccccagtagccccaggtgtcttacctgtactgagaagacagtgctgcatgatgggaaatgcatgtctgaatgccctggcgggtactatgctgatgccactggcaggtgcaaagtttgtcataactcatgtgccagctgctctgggcccacaccctctcactgtacagcctgcagcccccccaaggctctgcgtcaaggccactgtctgccccgctgtggagagggtttctactctgaccatggagtctgcaaagcctgtcactcctcctgcctggcttgtatgggtcccgcaccctctcactgtactgggtgtaagaagccagaggaaggactgcaagtggagcagctgtctgacgtgggcatcccctctggcgagtgtctagcccagtgtagagcccatttttacttggagagcactggcatatgtgaagcttgccaccagtcctgtttcagatgtgcagggaaaagcccacataactgcacagactgtgggccttcccatgtgctgttggatgggcagtgcctctcccagtgcccagatggctactttcaccaggaaggtagttgcacagagtgtcacccaacctgcaggcagtgtcatgggccgttggagtctgactgcatctcctgttaccctcacatctctcttaccaatggtaactgcaggaccagctgcagggaagagcagttcctcaacctcgtgggatactgtgctgactgccatcacctgtgccagcactgtgcagctgatctccacaacactgggagcatctgcctcaggtgccagaatgcccactacctgctgctcggggaccactgtgttcctgactgcccttcaggatactatgcagagagaggagcttgtaaaaaatgccactcctcctgcagaacctgccagggcagaggacctttctcctgctcctcatgtgacaccaacctcgtgctgtcccacactggcacctgcagcaccacctgcttccctgggcactatcttgatgacaatcatgtttgccagccatgcaacacacactgtggaagctgtgattcacaggccagctgtacctcctgccgagatccaaacaaggttctgctctttggggaatgtcaatacgagagctgcgccccacagtactatcttgacttctccaccaacacgtgcaaagagtgtgattggagctgcagtgcatgcagtgggcccctgaaaacagactgcctgcagtgcatggatggctatgttctccaggatggggcctgcgtggagcagtgcttgtcatcattttaccaggactcgggcctctgcaagaactgtgacagctactgtctccagtgccaaggtccccatgagtgtacccgctgcaaagggccatttctcctcttggaagcccagtgtgtccaggaatgtgggaaggggtactttgcagatcatgcaaagcacaaatgcacagcctgccctcaggggtgcttgcagtgcagccacagggaccgttgtcacctctgtgaccatgggttctttctgaagagtggcctctgtgtttacaactgtgttcctggcttttctgtccacacctctaatgaaacatgttctggcaaaatacacacccctagtcttcatgtgaatggttccctgatcctcccaattggttcaataaagccactggatttttccctcctgaatgtccaagaccaggagggtagggtcgaagatctcctatttcatgttgtgagcactcccaccaatggtcagctagtgctctcaagaaatggaaaagaggttcagctggacaaggctggccgttttagctggaaagatgtgaacgagaagaaagtgcgttttgtgcacagcaaagaaaaactcaggaaaggttaccttttcctgaaaattagtgaccagcagttcttctctgagccacagctgatcaacatacaagcattttcaacacaggccccctatgtgctgagaaatgaagttctccacattagcagaggagagagggcaaccatcaccacccagatgcttgacatccgagatgatgacaacccacaggatgtggtcattgaaataatcgatcctccacttcatggccaattgcttcagacacttcagtccccggcaacccctatctatcaattccagctggatgaactctctagaggccttctccactatgctcatgatggttcagacagcacatccgatgttgcagtcttgcaggccaatgatggacactccttccataatatactgttccaagtgaagaccgtgcctcagaatgacaggggtcttcagcttgtggctaattcgatggtgtgggttccagaaggggggatgctgcagatcaccaacagaatcttacaggccgaggctcctggtgccagtgctgaagaaatcatctacaagattacacaagactacccccagtttggggaggtggtccttctagtgaatatgcctgcagacagccctgcagatgaagggcagcacctgcctgatgggaggacagctacccccaccagcaccttcacccagcaggacatcaatgaaggcatcgtatggtacaggcactcaggagccccagcccagagcgactccttccgcttcgaggtgtccagtgcctccaatgcccagacccgcctggagagccacatgttcaacatcgcgatcttaccacagacacctgaagcacctaaagtgtctctggaagcatctctccatatgactgctagagaagatggcctgactgttattcagcctcattccctctccttcataaactctgagaagccaagtggaaagattgtctacaacatcactctacctctgcatccaaatcaaggtatcatcgagcaccgggaccaccctcactctcctatccggtatttcacgcaagaggatattaaccagggcaaagtcatgtaccgccctcccccggcagcaccccacctccaggagctcatggccttctcgttcgctggtctcccagaatcagtgaaattccacttcacagtttcagatggagaacacacaagtccggagatggtcctcaccattcacttacttcccagtgatcagcaactgccagtgttccaggtcacagctccacggctggcggtcagcccaggaggcagcacttctgtaggacttcaggtggtagtaagagatgctgagacagcgcccaaagaactcttctttgagcttcggagacctccacagcatggtgtgcttcttaagcatacagctgagttccgaaggccgatggccacaggtgacactttcacctatgaggatgttgagaaaaatgctctacagtatatacatgatggttcctctacccgggaagacagcatggagatctcagtcacagatggcctcacagtgacaatgctggaggtgagagtagaggtgtccctgtcagaagaccgagggcctcgactggctgctggctcctctctgagcattactgttgccagtaaaagcacagccataatcactaggtcacaccttgcttacgtggatgattcttcccccgacccagagatctggattcagttaaattatctgccctcatatggtactctcttaagaatctcaggatctgaggtggaagagctctcagaagtttccaatttcacaatggaagacatcaataacaagaaaatcagatactcagctgtgtttgaaactgatggtcatctggttactgatagcttctatttctctgtctctgacatggaccacaaccatctggataatcagatatttaccatcatgatcactcctgctgaaaatccacctccagtcattgcttttgctgaccttatcacggttgatgagggagggagagcaccactctcatttcaccatttttttgctactgatgatgatgacaacctccagagagatgccatcattaaactaagtgctctgcccaaatatggctgcattgagaacacaggaacaggtgatcgttttggccctgaaactgccagtgacctagaggcatcatttcctattcaagacgtcctggaaaactacatttactactttcagagtgttcatgaaagcattgagccaacccatgatatttttagtttttatgtgagtgatggaaccagtcgttcagaaattcacagcatcaatatcaccattgaggtaaagactttggaagttggaaaggttgagcccttgaccacaatatttcacaccattagagagctttctttatagggactcaaaagcaaagaagattggatttgaccttcaaaattgaaggtcgttcttaaaatatagccttcaggaatcttgtagaattaaggttggcatttggggaaggcttgagttagaaatctaaatttccatttcaggattgaatttatttgttcggtgtgaaaaacagtttgtgaaggtcagagatgctttgccagtctcatatataaatgaaaacttacatatgtctatgtttctctgaaattgtgtttggttctatatgcatatttgccttttcttattttactgcatttatttatttaattgtaacatcaaagaaatgtgttccttgatgctgtatttattctcatttgagcaactacacaggcttgctctaccgagagagagacacaggggaggggaaagataaatctcagaatgaaataccctctgccttgggaaaataaaatgtaaagaaccctctgcactcttaagggtcagtggtggaaaggggctggcaccagggcagggagacagctttagagacccacactttcaaatatagtgtccttctacaggtactgtggtatgcttagcattttctaagagagttctgagttatattagtatggtcttttatcttcaaagtatgttaatacttgtacttgtcaaagcacatatccatatttttggtctagaaaatatggtcattgtacttacggaagatatctgagaaaacttttatgaaatgtccatcagcttcttttgaagggggcattttgttgcctggac

SEQ ID NO: 11241 - DNA, 2608 bp, Homo sapiens
tttacagggcttaactcattttatccttaccacaatcctatgaagtaggaacttttataaaacgcattttataaacaaggcacagagaggttaattaacttgccctctggtcacacagctaggaagtgggcagagtacagatttacacaaggcatccgtctcctggccccacatacccaactgctgtaaacccataccggcggccaagcagcctcaatttgtgcatgcacccacttcccagcaagacagcagctcccaagttcctcctgtttagaattttagaagcggcgggccaccaggctgcagtctcccttgggtcaggggtcctggttgcactccgtgctttgcacaaagcaggctctccatttttgttaaatgcacgaatagtgctaagctgggaagttcttcctgaggtctaacctctagctgctcccccacagaagagtgcctgcggccagtggccaccaggggtcgccgcagcacccagcgctggagggcggagcgggcggcagacccggagcagcatgtggactctcgggcgccgcgcagtagccggcctcctggcgtcacccagcccagcccaggcccagaccctcacccgggtcccgcggccggcagagttggccccactctgcggccgccgtggcctgcgcaccgacatcgatgcgacctgcacgccccgccgcgcaagttcgaaccaacgtggcctcaaccagatttggaatgtcaaaaagcagagtgtctatttgatgaatttgaggaaatctggaactttgggccacccaggctctctagatgagaccacctatgaaagactagcagaggaaacgctggactctttagcagagttttttgaagaccttgcagacaagccatacacgtttgaggactatgatgtctcctttgggagtggtgtcttaactgtcaaactgggtggagatctaggaacctatgtgatcaacaagcagacgccaaacaagcaaatctggctatcttctccatccagtggacctaagcgttatgactggactgggaaaaactgggtgtactcccacgacggcgtgtccctccatgagctgctggccgcagagctcactaaagccttaaaaaccaaactggacttgtcttccttggcctattccggaaaagatgcttgatgcccagccccgttttaaggacattaaaagctatcaggccaagaccccagcttcattatgcagctgaggtctgttttttgttgttgttgttgtttattttttttattcctgcttttgaggacagttgggctatgtgtcacagctctgtagaaagaatgtgttgcctcctaccttgcccccaagttctgatttttaatttctatggaagattttttggattgtcggatttcctccctcacatgataccccttatcttttataatgtcttatgcctatacctgaatataacaacctttaaaaaagcaaaataataagaaggaaaaattccaggagggaaaatgaattgtcttcactcttcattctttgaaggatttactgcaagaagtacatgaagagcagctggtcaacctgctcactgttctatctccaaatgagacacattaaagggtagcctacaaatgttttcaggcttctttcaaagtgtaagcacttctgagctctttagcattgaagtgtcgaaagcaactcacacgggaagatcatttcttatttgtgctctgtgactgccaaggtgtggcctgcactgggttgtccagggagacctagtgctgtttctcccacatattcacatacgtgtctgtgtgtatatatattttttcaatttaaaggttagtatggaatcagctgctacaagaatgcaaaaaatcttccaaagacaagaaaagaggaaaaaaagccgttttcatgagctgagtgatgtagcgtaacaaacaaaatcatggagctgaggaggtgccttgtaaacatgaaggggcagataaaggaaggagatactcatgttgataaagagagccctggtcctagacatagttcagccacaaagtagttgtccctttgtggacaagtttcccaaattccctggacctctgcttccccatctgttaaatgagagaatagagtatggttgattcccagcattcagtggtcctgtcaagcaacctaacaggctagttctaattccctattgggtagatgaggggatgacaaagaacagtttttaagctatataggaaacattgttattggtgttgccctatcgtgatttcagttgaattcatgtgaaaataatagccatccttggcctggcgcggtggctcacacctgtaatcccagcacttttggaggccaaggtgggtggatcacctgaggtcaggagttcaagaccagcctggccaacatgatgaaaccccgtctctactaaaaatacaaaaaattagccgggcatgatggcaggtgcctgtaatcccagctacttgggaggctgaagcggaagaatcgcttgaacccagaggtggaggttgcagtgagccgagatcgtgccattgcactgtaacctgggtgactgagcaaaactctgtctcaaaataataataacaatataataataataa

SEQ ID NO: 11242 - DNA, 980 bp, Homo sapiens
agtctcccttgggtcaggggtcctggttgcactccgtgctttgcacaaagcaggctctccatttttgttaaatgcacgaatagtgctaagctgggaagttcttcctgaggtctaacctctagctgctcccccacagaagagtgcctgcggccagtggccaccaggggtcgccgcagcacccagcgctggagggcggagcgggcggcagacccggagcagcatgtggactctcgggcgccgcgcagtagccggcctcctggcgtcacccagcccagcccaggcccagaccctcacccgggtcccgcggccggcagagttggccccactctgcggccgccgtggcctgcgcaccgacatcgatgcgacctgcacgccccgccgcgcaagttcgaaccaacgtggcctcaaccagatttggaatgtcaaaaagcagagtgtctatttgatgaatttgaggaaatctggaactttgggccacccaggctctctagatgagaccacctatgaaagactagcagaggaaacgctggactctttagcagagttttttgaagaccttgcagacaagccatacacgtttgaggactatgatgtctcctttgggagtggtgtcttaactgtcaaactgggtggagatctaggaacctatgtgatcaacaagcagacgccaaacaagcaaatctggctatcttctccatccaggttaacgtggctcctgtggctgttccatccctgaggaaaagtgaggaccatgctctccaaacaggccatgtgctggactacctctgtttctgtctcctgggattccaatcagcaagtgagcaacgaagcaacccagacagtgtggttcataggatggctgggtaagtggctgtttgttttttccttactgtggatatgtatcagtgaaggaatctgtagaacattcttgatgggaacatttagtcatatcaagtcaataaattaatgtttaggctggg

SEQ ID NO: 11243 - DNA, 922 bp, Homo sapiens
gggcggcagacccggagcagcatgtggactctcgggcgccgcgcagtagccggcctcctggcgtcacccagcccagcccaggcccagaccctcacccgggtcccgcggccggcagagttggccccactctgcggccgccgtggcctgcgcaccgacatcgatgcgacctgcacgccccgccgcgcaagttcgaaccaacgtggcctcaaccagatttggaatgtcaaaaagcagagtgtctatttgatgaatttgaggaaatctggaactttgggccacccaggctctctagatgagaccacctatgaaagactagcagaggaaacgctggactctttagcagagttttttgaagaccttgcagacaagccatacacgtttgaggactatgatgtctcctttgggagtggtgtcttaactgtcaaactgggtggagatctaggaacctatgtgatcaacaagcagacgccaaacaagcaaatctggctatcttctccatccaggtatgtagtggacctaagcgttatgactggactgggaaaaactgggtgtactcccacgacggcgtgtccctccatgagctgctggccgcagagctcactaaagccttaaaaaccaaactggacttgtcttccttggcctattccggaaaagatgcttgatgcccagccccgttttaaggacattaaaagctatcaggccaagaccccagcttcattatgcagctgaggtctgttttttgttgttgttgttgtttattttttttattcctgcttttgaggacagttgggctatgtgtcacagctctgtagaaagaatgtgttgcctcctaccttgcccccaagttctgatttttaatttctatggaagattttttggattgtcggatttcctccctcacatgataccccttatcttttat

SEQ ID NO: 11244 - DNA, 2204 bp, Homo sapiens
ggctcgagtgcctggcgggctccggcttccgcgtccgcccctgctccggcttcgcccgcagctccgcgcccgcgggcaaccaagcccccagcgaagcccgcacagctccgggtgccaggacggggggccatgccgtgccggagggaggaggaagaggaagccggcgaggaggcggagggggaggaagaggaggacgacagcttcctcctgctgcagcagtcggtgacgctgggcagctcgggcgaggtggaccggctggtggcccagatcggcgagacgctgcagctggacgcggcgcaggacagcccggcctcgccgtgcgcgcccccgggggtgccgctgcgggccccggggcccctggctgcggcggtgccggcggacaaggcccggcccccggcggtgccgctgctgctgccgcccgcttcggctgagacggtgggcccggcgccctctggggccctgcgctgcgccctaggggaccgcggccgcgtgcgcggacgcgctgcgccctactgcgtggcggaggtcgccgcaggccccagcgcgctgccggggccgtgccggcgaggatggctcagggacgcggtcacctcccgccgcttgcagcagcgccgatggacccaagccggggcacgcgccggcgacgacgacccgcatcggctcctccagcagctcgtgctctcgggaaacctcatcaaggaagccgtgcggagactccaacgagccgtcgccgcggttgcagccacgggccccgcaagcgcccctgggcccgggggaggccgcagcggacctgaccgcattgccctgcagccctcaggctccttgctctgacgcaggcctcctggaggaggaagtggaggccgctgcgtagacccaacagcgtccagttcctactaactctgagctgaagccgacgtcgccagcctgggagcgaccactttggctgcggggaggcgcgtggggagagatctcaaccagagaagttaccagccgcggcgaggccgtcggagaaaacttaagcgtggagaaatgtatgcgccagggtgcttccgtggggcatgagaatttcccgggccatccaagcccaaggacctgggataaactgggagaactatggcagctacttgcatcgacttgtacctcacttagcccttgggggcgtcgtgagcttggattgtttaaggagggctcaggggtaggaatcgcgatggctttataacaatacttgaaaactaacgacacgcatacattttcttattttctggtggaggagcttagtaagtggtgctacaattgctgtgcaaagaaattccagaggggagaagaatgtaaaagtttggtggtgggtggcttggcattgcccctttttcccaccgattcggtggctggtgaaggtgggagatgtgaactccaattaagggactggagagaggtgaagaattttgcaggtgggagatttggatttgaatgtggacttgtaaatgacttgaccttgccatctgtgttcaaggtcacggtttgctgtggggttcctgggagagcttactcaccccggagtcttttctttctcttgctccaagaagagccctgttggtgctttaccaccgcttggagtctcccgaggacacaaacaggcagagagggacgtgtagggagagttctttcctgttttctgtgctttcctttttacaggactcccggaaggccactcatggccatgccaggagctttctcagaaacagtcataaacgatctcttgagtctctttcttgtcctcccagctgagctttcttattccaccctttctggtgtctataggaatgcatgagagaccctggacgtttttctgctctcttctggccctccatggagtcatgggcctcggcctcggcggctcctcaccctcacaatttatttcctcctcccgtgccagcccttcttttgtgtctgaaaccggttttaaaatgtgactctcccagagaagaagccgctggctgtatgaaacttgacggcgcttttgtaaggtgccacccccaaactttaaggtagctaaaccaatttttaaaagattcaatggcttgttcatcctccagatgtagctattgatgtacacttcgcaacggagtgtctgaaattgtggtggtcctgatttataggatttcataattaaaatgtctgctgaataaatttggcttttgttttgg

SEQ ID NO: 11245 - DNA, 3439 bp, Homo sapiens
atggagggaggactggcaggcgagcgggcgagggagtctccggtggactgcagcgttagcaaatgcagcaagctggtgggcggaggcgagtccaaccccatgaactacaacagctatatggacgagaagaatggcccccctcctcccaacatgaccaccaacgagaggagagtcatcgtccccgcagaccccacactgtggacacaggagcatgtgaggcaatggctggagtgggccataaaggagtacagcttgatggagatcgacacatcctttttccagaacatggatggcaaggaactgtgtaaaatgaacaaggaggacttcctccgcgccaccaccctctacaacacggaagtgctgttgtcacacctcagttacctcagggaaagttcactgctggcctataatacaacctcccacaccgaccaatcctcacgattgagtgtcaaagaagacccttcttatgactcagtcagaagaggagcttggggcaataacatgaattctggcctcaacaaaagtcctccccttggaggggcacaaacgatcagtaagaatacagagcaacggccccagccagatccgtatcagatcctgggcccgaccagcagtcgcctagccaaccctggaagcgggcagatccagctgtggcaattcctcctggagctgctctccgacagcgccaacgccagctgtatcacctgggaggggaccaacggggagttcaaaatgacggaccccgatgaggtggccaggcgctggggcgagcggaaaagcaagcccaacatgaattacgacaagctgagccgggccctccgttattactatgataaaaacattatgaccaaagtgcacggcaaaagatatgcttacaaatttgacttccacggcattgcccaggctctgcagccacatccgaccgagtcgtccatgtacaagtacccttctgacatctcctacatgccttcctaccatgcccaccagcagaaggtgaactttgtccctccccatccatcctccatgcctgtcacttcctccagcttctttggagccgcatcacaatactggacctcccccacggggggaatctaccccaaccccaacgtcccccgccatcctaacacccacgtgccttcacacttaggcagctactactagaagcttactcatcagtggccttctagctgaagcccatcctgcacacttactggatgctttggactcaacaggacatatgtggccttgaagggaagacaaaactggatgttctttcttgttggatagaacctttgtatttgttctttaaaaacattttttttaatgttggtaacttttgcttcctctacctgaacaaagagatgaataattccatgggccagtatgccagtttgaattctcagtctcctagcatcttgtgagttgcatattaagattactggaatggttaagtcatggttctgagaaagaagctgtacgttttctttatgtttttatgaccaaagcagtttcttgtcaatacacggggttcagtatgacacagaatcatggacttaacccgtcatgttctggtttgagatttagtgacaaatagaggtgggaagcttataatctaattttaggaggaccaaattcagtggatggcaactggaacattgattgtaaggccagtgaagttttcacccaactggaatttgatggaaagaaggtttgtgtgtttaagacgccaagggcattgcagaatccctctcagtggacagtatgcactcagctgaccactctctctagaaatagtcaagatatgaactaagaaattttaatgcaaatacatacattcctgaaagacggggaattaaattactaatttttttttttttttaaatgatgacagtggtcccagaacttggaaaagttgtagggatttctaaactcaagcagattcgcaagtgctgtgcgcttgtcagaccatcagaccagggccaaccaatcagaaggcaacttactgtataaattatgcagagttattttcctatatctcacagtattaaaaataaataattaaaaattaagaataaataaacgagttgacctcggtcacaaaagcagttttactatcgaatcaatcgctgttattttttttaatgtaatttgtacatcttttttcaatctgtacatttgggctgtctgtatgtttttatagctggtttttaaaaagcataatatgcctatagctgaaaaggaaacagggctgtttaagtcactgacttatgagaaagcaaagcactggtacagttatttaacaggcatacacaagcagggaaaagataatccatttagatctttaatgctttggaaatgcgtgtaacagtactgcaataatcacagctctgggaaaaacaacgaaactttcccttgtggagaggagggattttcctgctctatataagcaacatatttttagacattaaaatatatataattttgcaggtaattgttgacttttttaactatattaagtgttaagctgacaactgtcaaagaagaccatgttgtaaaataatttgactaaataaatggttccttctctcagtgctgaggacagttttcttatttaccgcccccgttaggtcaaagggttttccctggggaactttcctatttacttcttgcactatcaagaatttttcgaatgtacctactgcagtacagcagaaggtaaaaaatcagtgtggtttttcattgttgttgatgatgtttgtagtgtttttgtgtgtgttatttaaatcttcctccagcctaaaagggttttataaaacagcagctaaggccatggataaacctgtatgtaaggactggagcaaagcgagctggtctatccagactggtctgtgagatttaactctgcagcctcccctgggcacttcagacccagacggccaccttctgccactccagcaaagaataagcgccctgcttccttcaggtctcagaccaggactttatggctcatgcagatttttaaggtcatttttcttcccaaggaagaaacttgcctccagttccttcactgttaggtagcttattttcattttctctattttacaatgaaaagagtgagacctgggaagtccttgatttgcaaggaattagactcacagcattggtaaccctagaaccttcttagggtaacactaagtaccttctagacaacatgtctacctaaatgaaatgggatgtgtttcggaacatttgtctccagtttttttttaatcttgcaccctgccatttaaaaagatgtgtaaagcacatattctcaacatatgcacattgatttataaatcatatatacaaactgttacattattcttcatattagaaaacaaatacaaaatagaacattttaaatggtgatataaaaataaattgaaactgaaattct

SEQ ID NO: 11246 - DNA, 3926 bp, Homo sapiens
gccactccaggtctggtcacgttcagacccgtgtctgtattcgaacccaaaattggagccgaattgatgagactaatttctagagagggagggggagggagggagacgagtgagctctcgggctcaattgctcctgaagaaataaagaattaataagtcaccttttttcgcctctgtggacacccttttgaaattttttcttccaattgacttggatctcctctggattttttttccctctttcccccgtcggactcttaaataaaagtgagcaagtccaaagcgtggtccggagagcgtggacaaggaggctctgtcggtggtgagcgacgaccagtccctctttgactcagcgtacggagcggcagcccatctccccaaggccgacatgactgcctcggggagtcctgactacgggcagccccacaagatcaaccccctcccaccacagcaggagtggatcaatcagccagtgagggtcaacgtcaagcgggagtatgaccacatgaatggatccagggagtctccggtggactgcagcgttagcaaatgcagcaagctggtgggcggaggcgagtccaaccccatgaactacaacagctatatggacgagaagaatggcccccctcctcccaacatgaccaccaacgagaggagagtcatcgtccccgcagaccccacactgtggacacaggagcatgtgaggcaatggctggagtgggccataaaggagtacagcttgatggagatcgacacatcctttttccagaacatggatggcaaggaactgtgtaaaatgaacaaggaggacttcctccgcgccaccaccctctacaacacggaagtgctgttgtcacacctcagttacctcagggaaagttcactgctggcctataatacaacctcccacaccgaccaatcctcacgattgagtgtcaaagaagacccttcttatgactcagtcagaagaggagcttggggcaataacatgaattctggcctcaacaaaagtcctccccttggaggggcacaaacgatcagtaagaatacagagcaacggccccagccagatccgtatcagatcctgggcccgaccagcagtcgcctagccaaccctggaagcgggcagatccagctgtggcaattcctcctggagctgctctccgacagcgccaacgccagctgtatcacctgggaggggaccaacggggagttcaaaatgacggaccccgatgaggtggccaggcgctggggcgagcggaaaagcaagcccaacatgaattacgacaagctgagccgggccctccgttattactatgataaaaacattatgaccaaagtgcacggcaaaagatatgcttacaaatttgacttccacggcattgcccaggctctgcagccacatccgaccgagtcgtccatgtacaagtacccttctgacatctcctacatgccttcctaccatgcccaccagcagaaggtgaactttgtccctccccatccatcctccatgcctgtcacttcctccagcttctttggagccgcatcacaatactggacctcccccacggggggaatctaccccaaccccaacgtcccccgccatcctaacacccacgtgccttcacacttaggcagctactactagaagcttactcatcagtggccttctagctgaagcccatcctgcacacttactggatgctttggactcaacaggacatatgtggccttgaagggaagacaaaactggatgttctttcttgttggatagaacctttgtatttgttctttaaaaacattttttttaatgttggtaacttttgcttcctctacctgaacaaagagatgaataattccatgggccagtatgccagtttgaattctcagtctcctagcatcttgtgagttgcatattaagattactggaatggttaagtcatggttctgagaaagaagctgtacgttttctttatgtttttatgaccaaagcagtttcttgtcaatacacggggttcagtatgacacagaatcatggacttaacccgtcatgttctggtttgagatttagtgacaaatagaggtgggaagcttataatctaattttaggaggaccaaattcagtggatggcaactggaacattgattgtaaggccagtgaagttttcacccaactggaatttgatggaaagaaggtttgtgtgtttaagacgccaagggcattgcagaatccctctcagtggacagtatgcactcagctgaccactctctctagaaatagtcaagatatgaactaagaaattttaatgcaaatacatacattcctgaaagacggggaattaaattactaatttttttttttttttaaatgatgacagtggtcccagaacttggaaaagttgtagggatttctaaactcaagcagattcgcaagtgctgtgcgcttgtcagaccatcagaccagggccaaccaatcagaaggcaacttactgtataaattatgcagagttattttcctatatctcacagtattaaaaataaataattaaaaattaagaataaataaacgagttgacctcggtcacaaaagcagttttactatcgaatcaatcgctgttattttttttaatgtaatttgtacatcttttttcaatctgtacatttgggctgtctgtatgtttttatagctggtttttaaaaagcataatatgcctatagctgaaaaggaaacagggctgtttaagtcactgacttatgagaaagcaaagcactggtacagttatttaacaggcatacacaagcagggaaaagataatccatttagatctttaatgctttggaaatgcgtgtaacagtactgcaataatcacagctctgggaaaaacaacgaaactttcccttgtggagaggagggattttcctgctctatataagcaacatatttttagacattaaaatatatataattttgcaggtaattgttgacttttttaactatattaagtgttaagctgacaactgtcaaagaagaccatgttgtaaaataatttgactaaataaatggttccttctctcagtgctgaggacagttttcttatttaccgcccccgttaggtcaaagggttttccctggggaactttcctatttacttcttgcactatcaagaatttttcgaatgtacctactgcagtacagcagaaggtaaaaaatcagtgtggtttttcattgttgttgatgatgtttgtagtgtttttgtgtgtgttatttaaatcttcctccagcctaaaagggttttataaaacagcagctaaggccatggataaacctgtatgtaaggactggagcaaagcgagctggtctatccagactggtctgtgagatttaactctgcagcctcccctgggcacttcagacccagacggccaccttctgccactccagcaaagaataagcgccctgcttccttcaggtctcagaccaggactttatggctcatgcagatttttaaggtcatttttcttcccaaggaagaaacttgcctccagttccttcactgttaggtagcttattttcattttctctattttacaatgaaaagagtgagacctgggaagtccttgatttgcaaggaattagactcacagcattggtaaccctagaaccttcttagggtaacactaagtaccttctagacaacatgtctacctaaatgaaatgggatgtgtttcggaacatttgtctccagtttttttttaatcttgcaccctgccatttaaaaagatgtgtaaagcacatattctcaacatatgcacattgatttataaatcatatatacaaactgttacattattcttcatattagaaaacaaatacaaaatagaacattttaaatggtgatataaaaataaattgaaactgaaattct

SEQ ID NO: 11247 - DNA, 3051 bp, Homo sapiens
aggacttcctccccgattcgcaaagtgaagtcacttcccaaaattagctgaaaaaaaagtttcatccggttaactgtctctttcgctccgctacaacaacaaacgtgcacaggggagtgagggcagggcgctcgcagggggcacgcagggagggcccagggcgccagggaggccgcgccgggctaatccgaaggggctgcgaggtcaggctgtaaccgggtcaatgtgtggaatattggggggctcggctgcagacttggccaaatggacgggactattaaggaggctctgtcggtggtgagcgacgaccagtccctctttgactcagcgtacggagcggcagcccatctccccaaggccgacatgactgcctcggggagtcctgactacgggcagccccacaagatcaaccccctcccaccacagcaggagtggatcaatcagccagtgagggtcaacgtcaagcgggagtatgaccacatgaatggatccagggagtctccggtggactgcagcgttagcaaatgcagcaagctggtgggcggaggcgagtccaaccccatgaactacaacagctatatggacgagaagaatggcccccctcctcccaacatgaccaccaacgagaggagagtcatcgtccccgcagaccccacactgtggacacaggagcatgtgaggcaatggctggagtgggccataaaggagtacagcttgatggagatcgacacatcctttttccagaacatggatggcaaggaactgtgtaaaatgaacaaggaggacttcctccgcgccaccaccctctacaacacggaagtgctgttgtcacacctcagttacctcagggaaagttcactgctggcctataatacaacctcccacaccgaccaatcctcacgattgagtgtcaaagaagacccttcttatgactcagtcagaagaggagcttggggcaataacatgaattctggcctcaacaaaagtcctccccttggaggggcacaaacgatcagtaagaatacagagcaacggccccagccagatccgtatcagatcctgggcccgaccagcagtcgcctagccaaccctggaagcgggcagatccagctgtggcaattcctcctggagctgctctccgacagcgccaacgccagctgtatcacctgggaggggaccaacggggagttcaaaatgacggaccccgatgaggtggccaggcgctggggcgagcggaaaagcaagcccaacatgaattacgacaagctgagccgggccctccgttattactatgataaaaacattatgaccaaagtgcacggcaaaagatatgcttacaaatttgacttccacggcattgcccaggctctgcagccacatccgaccgagtcgtccatgtacaagtacccttctgacatctcctacatgccttcctaccatgcccaccagcagaaggtgaactttgtccctccccatccatcctccatgcctgtcacttcctccagcttctttggagccgcatcacaatactggacctcccccacggggggaatctaccccaaccccaacgtcccccgccatcctaacacccacgtgccttcacacttaggcagctactactagaagcttactcatcagtggccttctagctgaagcccatcctgcacacttactggatgctttggactcaacaggacatatgtggccttgaagggaagacaaaactggatgttctttcttgttggatagaacctttgtatttgttctttaaaaacattttttttaatgttggtaacttttgcttcctctacctgaacaaagagatgaataattccatgggccagtatgccagtttgaattctcagtctcctagcatcttgtgagttgcatattaagattactggaatggttaagtcatggttctgagaaagaagctgtacgttttctttatgtttttatgaccaaagcagtttcttgtcaatacacggggttcagtatgacacagaatcatggacttaacccgtcatgttctggtttgagatttagtgacaaatagaggtgggaagcttataatctaattttaggaggaccaaattcagtggatggcaactggaacattgattgtaaggccagtgaagttttcacccaactggaatttgatggaaagaaggtttgtgtgtttaagacgccaagggcattgcagaatccctctcagtggacagtatgcactcagctgaccactctctctagaaatagtcaagatatgaactaagaaattttaatgcaaatacatacattcctgaaagacggggaattaaattactaatttttttttttttttaaatgatgacagtggtcccagaacttggaaaagttgtagggatttctaaactcaagcagattcgcaagtgctgtgcgcttgtcagaccatcagaccagggccaaccaatcagaaggcaacttactgtataaattatgcagagttattttcctatatctcacagtattaaaaataaataattaaaaattaagaataaataaacgagttgacctcggtcacaaaagcagttttactatcgaatcaatcgctgttattttttttaatgtaatttgtacatcttttttcaatctgtacatttgggctgtctgtatgtttttatagctggtttttaaaaagcataatatgcctatagctgaaaaggaaacagggctgtttaagtcactgacttatgagaaagcaaagcactggtacagttatttaacaggcatacacaagcagggaaaagataatccatttagatctttaatgctttggaaatgcgtgtaacagtactgcaataatcacagctctgggaaaaacaacgaaactttcccttgtggagaggagggattttcctgctctatataagcaacatatttttagacattaaaatatatataattttgcaggtaattgttgacttttttaactatattaagtgttaagctgacaactgtcaaagaagaccatgttgtaaaataatttgactaaataaatggttccttctctca

SEQ ID NO: 11248 - DNA, 1557 bp, Homo sapiens
acagtctctccatctgcatccccacttcatcaccatcccaccgtctctccctcgctccactcgcgggtaaccgaggcttctccctcccaggctggttcttgggcgttcccgacccttagctacccacgatgtttcagacagtccccgacacgtcgtcttacatcaaggaggctctgtcggtggtgagcgacgaccagtccctctttgactcagcgtacggagcggcagcccatctccccaaggccgacatgactgcctcggggagtcctgactacgggcagccccacaagatcaaccccctcccaccacagcaggagtggatcaatcagccagtgagggtcaacgtcaagcgggagtatgaccacatgaatggatccaggttcactgctggcctataatacaacctcccacaccgaccaatcctcacgattgagtgtcaaagaagacccttcttatgactcagtcagaagaggagcttggggcaataacatgaattctggcctcaacaaaagtcctccccttggaggggcacaaacgatcagtaagaatacagagcaacggccccagccagatccgtatcagatcctgggcccgaccagcagtcgcctagccaaccctggaagcgggcagatccagctgtggcaattcctcctggagctgctctccgacagcgccaacgccagctgtatcacctgggaggggaccaacggggagttcaaaatgacggaccccgatgaggtggccaggcgctggggcgagcggaaaagcaagcccaacatgaattacgacaagctgagccgggccctccgttattactatgataaaaacattatgaccaaagtgcacggcaaaagatatgcttacaaatttgacttccacggcattgcccaggctctgcagccacatccgaccgagtcgtccatgtacaagtacccttctgacatctcctacatgccttcctaccatgcccaccagcagaaggtgaactttgtccctccccatccatcctccatgcctgtcacttcctccagcttctttggagccgcatcacaatactggacctcccccacggggggaatctaccccaaccccaacgtcccccgccatcctaacacccacgtgccttcacacttaggcagctactactagaagcttactcatcagtggccttctagctgaagcccatcctgcacacttactggatgctttggactcaacaggacatatgtggccttgaagggaagacaaaactggatgttctttcttgttggatagaacctttgtatttgttctttaaaaacattttttttaatgttggtaacttttgcttcctctacctgaacaaagagatgaataattccatgggccagtatgccagtttgaattctcagtctcctagcatcttgtgagttgcatattaagattactggaatggttaagtcatggttctgagaaagaagctgtacgttttctttatgtttttatgaccaaagcagtttcttgtcaatacacggggttcagtatgacacagaatcatggacttaacccgtcatgttc

SEQ ID NO: 11249 - DNA, 4341 bp, Homo sapiens
agttgagggattgacacaaatggtcaggcggcggcggcggagaaggaggcggaggcgcaggggggagccgagcccgctgggctgcggagagttgcgctctctacggggccgcggccactagcgcggcgccgccagccgggagccagcgagccgagggccaggaaggcgggacacgaccccggcgcgccctagccacccgggttctccccgccgcccgcgcttcatgaatcgcaagtttccgcggcggcggcggctgcggtacgcagaacaggagccgggggagcgggccgaaagcggcttgggctcgacggagggcacccgcgcagaggtctccctggccgcagggggagccgccgccggccgtgcccctggcagccccagcggagcggcgccaagagaggagccgagaaagtatggctgaggaggaggcgcctaagaagtcccgggccgccggcggtggcgcgagctgggaactttgtgccggggcgctctcggcccggctggcggaggagggcagcggggacgccggtggccgccgccgcccgccagttgacccccggcgattggcgcgccagctgctgctgctgctttggctgctggaggctccgctgctgctgggggtccgggcccaggcggcgggccaggggccaggccaggggcccgggccggggcagcaaccgccgccgccgcctcagcagcaacagagcgggcagcagtacaacggcgagcggggcatctccgtcccggaccacggctattgccagcccatctccatcccgctgtgcacggacatcgcgtacaaccagaccatcatgcccaacctgctgggccacacgaaccaggaggacgcgggcctggaggtgcaccagttctaccctctagtgaaagtgcagtgttccgctgagctcaagttcttcctgtgctccatgtacgcgcccgtgtgcaccgtgctagagcaggcgctgccgccctgccgctccctgtgcgagcgcgcgcgccagggctgcgaggcgctcatgaacaagttcggcttccagtggccagacacgctcaagtgtgagaagttcccggtgcacggcgccggcgagctgtgcgtgggccagaacacgtccgacaagggcaccccgacgccctcgctgcttccagagttctggaccagcaaccctcagcacggcggcggagggcaccgtggcggcttcccggggggcgccggcgcgtcggagcgaggcaagttctcctgcccgcgcgccctcaaggtgccctcctacctcaactaccacttcctgggggagaaggactgcggcgcaccttgtgagccgaccaaggtgtatgggctcatgtacttcgggcccgaggagctgcgcttctcgcgcacctggattggcatttggtcagtgctgtgctgcgcctccacgctcttcacggtgcttacgtacctggtggacatgcggcgcttcagctacccggagcggcccatcatcttcttgtccggctgttacacggccgtggccgtggcctacatcgccggcttcctcctggaagaccgagtggtgtgtaatgacaagttcgccgaggacggggcacgcactgtggcgcagggcaccaagaaggagggctgcaccatcctcttcatgatgctctacttcttcagcatggccagctccatctggtgggtgatcctgtcgctcacctggttcctggcggctggcatgaagtggggccacgaggccatcgaagccaactcacagtattttcacctggccgcctgggctgtgccggccatcaagaccatcaccatcctggcgctgggccaggtggacggcgatgtgctgagcggagtgtgcttcgtggggcttaacaacgtggacgcgctgcgtggcttcgtgctggcgcccctcttcgtgtacctgtttatcggcacgtcctttctgctggccggctttgtgtcgctcttccgcatccgcaccatcatgaagcacgatggcaccaagaccgagaagctggagaagctcatggtgcgcattggcgtcttcagcgtgctgtacactgtgccagccaccatcgtcatcgcctgctacttctacgagcaggccttccgggaccagtgggaacgcagctgggtggcccagagctgcaagagctacgctatcccctgccctcacctccaggcgggcggaggcgccccgccgcacccgcccatgagcccggacttcacggtcttcatgattaagtaccttatgacgctgatcgtgggcatcacgtcgggcttctggatctggtccggcaagaccctcaactcctggaggaagttctacacgaggctcaccaacagcaaacaaggggagactacagtctgagacccggggctcagcccatgcccaggcctcggccggggcgcagcgatcccccaaagccagcgccgtggagttcgtgccaatcctgacatctcgaggtttcctcactagacaactctctttcgcaggctcctttgaacaactcagctcctgcaaaagcttccgtccctgaggcaaaaggacacgagggcccgactgccagagggaggatggacagacctcttgccctcacactctggtaccaggactgttcgcttttatgattgtaaatagcctgtgtaagatttttgtaagtatatttgtatttaaatgacgaccgatcacgcgtttttctttttcaaaagtttttaattatttagggcggtttaaccatttgaggcttttccttcttgcccttttcggagtattgcaaaggagctaaaactggtgtgcaaccgcacagcgctcctggtcgtcctcgcgcgcctctccctaccacgggtgctcgggacggctgggcgccagctccggggcgagttcagcactgcggggtgcgactagggctgcgctgccagggtcacttcccgcctcctccttttgccccctccccctccttctgtcccctccctttctttcctggcttgaggtaggggctcttaaggtacagaactccacaaaccttccaaatctggaggagggcccccatacattacaattcctcccttgctcggcggtggattgcgaaggcccgtcccttcgacttcctgaagctggatttttaactgtccagaactttcctccaacttcatgggggcccacgggtgtgggcgctggcagtctcagcctccctccacggtcaccttcaacgcccagacactcccttctcccaccttagttggttacagggtgagtgagataaccaatgccaaactttttgaagtctaatttttgaggggtgagctcatttcattctctagtgtctaaaacctggtatgggtttggccagcgtcatggaaagatgtggttactgagatttgggaagaagcatgaagctttgtgtgggttggaagagactgaagatatgggttataaaatgttaattctaattgcatacggatgcctggcaaccttgcctttgagaatgagacagcctgcgcttagattttaccggtctgtaaaatggaaatgttgaggtcacctggaaagctttgttaaggagttgatgtttgctttccttaacaagacagcaaaacgtaaacagaaattgaaaacttgaaggatatttcagtgtcatggacttcctcaaaatgaagtgctattttcttatttttaatcaaataactagacatatatcagaaactttaaaatgtaaaagttgtacactttcaacattttattacgattattattcagcagcacattctgaggggggaacaattcacaccaccaataataacctggtaagatttcaggaggtaaagaaggtggaataattgacggggagatagcgcctgaaataaacaaaatatgggcatgcatgctaaagggaaaatgtgtgcaggtctactgcattaaatcctgtgtgctcctcttttggatttacagaaatgtgtcaaatgtaaatctttcaaagccatttaaaaatattcactttagttctctgtgaagaagaggagaaaagcaatcctcctgattgtattgttttaaactttaagaatttatcaaaatgccggtacttaggacctaaatttatctatgtctgtcatacgctaaaatgatattggtctttgaatttggtatacatttattctgttcactatcacaaaatcatctatatttatagaggaatagaagtttatatatatataataccatatttttaatttcacaaataaaaaattcaaagttttgtacaaaattatatggattttgtgcctgaaaataatagagcttgagctgtctgaactattttacattttatggtgtctcatagccaatcccacagtgt

SEQ ID NO: 11250 - DNA, 3281 bp, Homo sapiens
cgagtcttctcatcccgggacgcaaacctcgaaacagctgccggctggtcccggccgaggccggcgcagggagggaggagccgcccgggctgtgggggcgccgcgagctgggccggcctcggtgtgcccgcgccgccagcccgctccagacgcgccacctgggcgctccaagaagaggccgaagtttgccgcggccgtgagttggagctcgcgccgggccgctgcgccgggagctccgggggcttccctcgcttcccggtattgtttgcaaactttgctgctctccgccgcggcccccaactcggcggacgccgggcgcggagagccgagccgggggcgctgtgcgcagcgctcgggccaggccgggcgggcatgggcgggggcccgagcaggggtggagagccggggccagcagcagcccgtgcccgggagcggcggcgctgaggggcgcggagctccccgcgaggacacgtccaacgccagcatgcagcgcccgggcccccgcctgtggctggtcctgcaggtgatgggctcgtgcgccgccatcagctccatggacatggagcgcccgggcgacggcaaatgccagcccatcgagatcccgatgtgcaaggacatcggctacaacatgactcgtatgcccaacctgatgggccacgagaaccagcgcgaggcagccatccagttgcacgagttcgcgccgctggtggagtacggctgccacggccacctccgcttcttcctgtgctcgctgtacgcgccgatgtgcaccgagcaggtctctacccccatccccgcctgccgggtcatgtgcgagcaggcccggctcaagtgctccccgattatggagcagttcaacttcaagtggcccgactccctggactgccggaaactccccaacaagaacgaccccaactacctgtgcatggaggcgcccaacaacggctcggacgagcccacccggggctcgggcctgttcccgccgctgttccggccgcagcggccccacagcgcgcaggagcacccgctgaaggacgggggccccgggcgcggcggctgcgacaacccgggcaagttccaccacgtggagaagagcgcgtcgtgcgcgccgctctgcacgcccggcgtggacgtgtactggagccgcgaggacaagcgcttcgcagtggtctggctggccatctgggcggtgctgtgcttcttctccagcgccttcaccgtgctcaccttcctcatcgacccggcccgcttccgctaccccgagcgccccatcatcttcctctccatgtgctactgcgtctactccgtgggctacctcatccgcctcttcgccggcgccgagagcatcgcctgcgaccgggacagcggccagctctatgtcatccaggagggactggagagcaccggctgcacgctggtcttcctggtcctctactacttcggcatggccagctcgctgtggtgggtggtcctcacgctcacctggttcctggccgccggcaagaagtggggccacgaggccatcgaagccaacagcagctacttccacctggcagcctgggccatcccggcggtgaagaccatcctgatcctggtcatgcgcagggtggcgggggacgagctcaccggggtctgctacgtgggcagcatggacgtcaacgcgctcaccggcttcgtgctcattcccctggcctgctacctggtcatcggcacgtccttcatcctctcgggcttcgtggccctgttccacatccggagggtgatgaagacgggcggcgagaacacggacaagctggagaagctcatggtgcgtatcgggctcttctctgtgctgtacaccgtgccggccacctgtgtgatcgcctgctacttttacgaacgcctcaacatggattactggaagatcctggcggcgcagcacaagtgcaaaatgaacaaccagactaaaacgctggactgcctgatggccgcctccatccccgccgtggagatcttcatggtgaagatctttatgctgctggtggtggggatcaccagcgggatgtggatttggacctccaagactctgcagtcctggcagcaggtgtgcagccgtaggttaaagaagaagagccggagaaaaccggccagcgtgatcaccagcggtgggatttacaaaaaagcccagcatccccagaaaactcaccacgggaaatatgagatccctgcccagtcgcccacctgcgtgtgaacagggctggagggaagggcacaggggcgcccggagctaagatgtggtgcttttcttggttgtgtttttctttcttcttcttctttttttttttttataaaagcaaaagagaaatacataaaaaagtgtttaccctgaaattcaggatgctgtgatacactgaaaggaaaaatgtacttaaagggttttgttttgttttggttttccagcgaagggaagctcctccagtgaagtagcctcttgtgtaactaatttgtggtaaagtagttgattcagccctcagaagaaaacttttgtttagagccctccctaaatatacatctgtgtatttgagttggctttgctacccatttacaaataagaggacagataactgctttgcaaattcaagagcctcccctgggttaacaaatgagccatccccagggcccacccccaggaaggccacagtgctgggcggcatccctgcagaggaaagacaggacccggggcccgcctcacaccccagtggatttggagttgcttaaaatagactccggccttcaccaatagtctctctgcaagacagaaacctccatcaaacctcacatttgtgaactcaaacgatgtgcaatacatttttttctctttccttgaaaataaaaagagaaacaagtattttgctatatataaagacaacaaaagaaatctcctaacaaaagaactaagaggcccagccctcagaaacccttcagtgctacattttgtggctttttaatggaaaccaagccaatgttatagacgtttggactgatttgtggaaaggaggggggaagagggagaaggatcattcaaaagttacccaaagggcttattgactctttctattgttaaacaaatgatttccacaaacagatcaggaagcactaggttggcagagacactttgtctagtgtattctcttcacagtgccaggaaagagtggtttctgcgtgtgtatatttgtaatatatgatatttttcatgctccactattttattaaaaataaaatatgttctttagtttgctgct

SEQ ID NO: 11251 - DNA, 3282 bp, Homo sapiens
cgagtcttctcatcccgggacgcaaacctcgaaacagctgccggctggtcccggccgaggccggcgcagggagggaggagccgcccgggctgtgggggcgccgcgagctgggccggcctcggtgtgcccgcgccgccagcccgctccagacgcgccacctgggcgctccaagaagaggccgaagtttgccgcggccgtgagttggagctcgcgccgggccgctgcgccgggagctccgggggcttccctcgcttcccggtattgtttgcaaactttgctgctctccgccgcggcccccaactcggcggacgccgggcgcggagagccgagccgggggcgctgtgcgcagcgctcgggccaggccgggcgggcatgggcgggggcccgagcaggggtggagagccggggccagcagcagcccgtgcccgggagcggcggcgctgaggggcgcggagctccccgcgaggacacgtccaacgccagcatgcagcgcccgggcccccgcctgtggctggtcctgcaggtgatgggctcgtgcgccgccatcagctccatggacatggagcgcccgggcgacggcaaatgccagcccatcgagatcccgatgtgcaaggacatcggctacaacatgactcgtatgcccaacctgatgggccacgagaaccagcgcgaggcagccatccagttgcacgagttcgcgccgctggtggagtacggctgccacggccacctccgcttcttcctgtgctcgctgtacgcgccgatgtgcaccgagcaggtctctacccccatccccgcctgccgggtcatgtgcgagcaggcccggctcaagtgctccccgattatggagcagttcaacttcaagtggcccgactccctggactgccggaaactccccaacaagaacgaccccaactacctgtgcatggaggcgcccaacaacggctcggacgagcccacccggggctcgggcctgttcccgccgctgttccggccgcagcggccccacagcgcgcaggagcacccgctgaaggacgggggccccgggcgcggcggctgcgacaacccgggcaagttccaccacgtggagaagagcgcgtcgtgcgcgccgctctgcacgcccggcgtggacgtgtactggagccgcgaggacaagcgcttcgcagtggtctggctggccatctgggcggtgctgtgcttcttctccagcgccttcaccgtgctcaccttcctcatcgacccggcccgcttccgctaccccgagcgccccatcatcttcctctccatgtgctactgcgtctactccgtgggctacctcatccgcctcttcgccggcgccgagagcatcgcctgcgaccgggacagcggccagctctatgtcatccaggagggactggagagcaccggctgcacgctggtcttcctggtcctctactacttcggcatggccagctcgctgtggtgggtggtcctcacgctcacctggttcctggccgccggcaagaagtggggccacgaggccatcgaagccaacagcagctacttccacctggcagcctgggccatcccggcggtgaagaccatcctgatcctggtcatgcgcagggtggcgggggacgagctcaccggggtctgctacgtgggcagcatggacgtcaacgcgctcaccggcttcgtgctcattcccctggcctgctacctggtcatcggcacgtccttcatcctctcgggcttcgtggccctgttccacatccggagggtgatgaagacgggcggcgagaacacggacaagctggagaagctcatggtgcgtatcgggctcttctctgtgctgtacaccgtgccggccacctgtgtgatcgcctgctacttttacgaacgcctcaacatggattactggaagatcctggcggcgcagcacaagtgcaaaatgaacaaccagactaaaacgctggactgcctgatggccgcctccatccccgccgtggagatcttcatggtgaagatctttatgctgctggtggtggggatcaccagcgggatgtggatttggacctccaagactctgcagtcctggcagcaggtgtgcagccgtaggttaaagaagaagagccggagaaaaccggccagcgtgatcaccagcggtgggatttacaaaaaagcccagcatccccagaaaactcaccacgggaaatatgagatccctgcccagtcgcccacctgcgtgtgaacagggctggagggaagggcacaggggcgcccggagctaagatgtggtgcttttcttggttgtgtttttctttcttcttcttctttttttttttttataaaagcaaaagagaaatacataaaaaagtgtttaccctgaaattcaggatgctgtgatacactgaaaggaaaaatgtacttaaagggttttgttttgttttggttttccagcgaagggaagctcctccagtgaagtagcctcttgtgtaactaatttgtggtaaagtagttgattcagccctcagaagaaaacttttgtttagagccctccctaaatatacatctgtgtatttgagttggctttgctacccatttacaaataagaggacagataactgctttgcaaattcaagagcctcccctgggttaacaaatgagccatccccagggcccacccccaggaaggccacagtgctgggcggcatccctgcagaggaaagacaggacccggggcccgcctcacaccccagtggatttggagttgcttaaaatagactccggccttcaccaatagtctctctgcaagacagaaacctccatcaaacctcacatttgtgaactcaaacgatgtgcaatacatttttttctctttccttgaaaataaaaagagaaacaagtattttgctatatataaagacaacaaaagaaatctcctaacaaaagaactaagaggcccagccctcagaaacccttcagtgctacattttgtggctttttaatggaaaccaagccaatgttatagacgtttggactgatttgtggaaaggaggggggaagagggagaaggatcattcaaaagttacccaaagggcttattgactctttctattgttaaacaaatgatttccacaaacagatcaggaagcactaggttggcagagacactttgtctagtgtattctcttcacagtgccaggaaagagtggtttctgcgtgtgtatatttgtaatatatgatatttttcatgctccactattttattaaaaataaaatatgttctttagtttgctgcta

SEQ ID NO: 11252 - DNA, 1983 bp, Homo sapiens
cgagtaaagtttgcaaagaggcgcgggaggcggcagccgcagcgaggaggcggcggggaagaagcgcagtctccgggttgggggcgggggcggggggggcgccaaggagccgggtggggggcggcggccagcatgcggccccgcagcgccctgccccgcctgctgctgccgctgctgctgctgcccgccgccgggccggcccagttccacggggagaagggcatctccatcccggaccacggcttctgccagcccatctccatcccgctgtgcacggacatcgcctacaaccagaccatcatgcccaaccttctgggccacacgaaccaggaggacgcaggcctagaggtgcaccagttctatccgctggtgaaggtgcagtgctcgcccgaactgcgcttcttcctgtgctccatgtacgcacccgtgtgcaccgtgctggaacaggccatcccgccgtgccgctctatctgtgagcgcgcgcgccagggctgcgaagccctcatgaacaagttcggttttcagtggcccgagcgcctgcgctgcgagcacttcccgcgccacggcgccgagcagatctgcgtcggccagaaccactccgaggacggagctcccgcgctactcaccaccgcgccgccgccgggactgcagccgggtgccgggggcaccccgggtggcccgggcggcggcggcgctcccccgcgctacgccacgctggagcaccccttccactgcccgcgcgtcctcaaggtgccatcctatctcagctacaagtttctgggcgagcgtgattgtgctgcgccctgcgaacctgcgcggcccgatggttccatgttcttctcacaggaggagacgcgtttcgcgcgcctctggatcctcacctggtcggtgctgtgctgcgcttccaccttcttcactgtcaccacgtacttggtagacatgcagcgcttccgctacccagagcggcctatcatttttctgtcgggctgctacaccatggtgtcggtggcctacatcgcgggcttcgtgctccaggagcgcgtggtgtgcaacgagcgcttctccgaggacggttaccgcacggtggtgcagggcaccaagaaggagggctgcaccatcctcttcatgatgctctacttcttcagcatggccagctccatctggtgggtcatcctgtcgctcacctggttcctggcagccggcatgaagtggggccacgaggccatcgaggccaactctcagtacttccacctggccgcctgggccgtgccggccgtcaagaccatcaccatcctggccatgggccagatcgacggcgacctgctgagcggcgtgtgcttcgtaggcctcaacagcctggacccgctgcggggcttcgtgctagcgccgctcttcgtgtacctgttcatcggcacgtccttcctcctggccggcttcgtgtcgctcttccgcatccgcaccatcatgaagcacgacggcaccaagaccgaaaagctggagcggctcatggtgcgcatcggcgtcttctccgtgctctacacagtgcccgccaccatcgtcatcgcttgctacttctacgagcaggccttccgcgagcactgggagcgctcgtgggtgagccagcactgcaagagcctggccatcccgtgcccggcgcactacacgccgcgcatgtcgcccgacttcacggtctacatgatcaaatacctcatgacgctcatcgtgggcatcacgtcgggcttctggatctggtcgggcaagacgctgcactcgtggaggaagttctacactcgcctcaccaacagccgacacggtgagaccaccgtgtgagggacgcccccaggccggaaccgcgcggcgctttcctccgcccggggtggggcccctacagactccgtattttatttttttaaataaaaaacgatcgaaaccatttcacttttaggttgctttttaaaagagaactctctgcccaacaccccc

SEQ ID NO: 11253 - DNA, 2030 bp, Homo sapiens
cagcgcgcggtgtctccggctgctcagtccgaccgcggcaagcaagcgggcaggcgcaccgccccctcccccgcccggcctccccaactctgcggccgcgagtaaagtttgcaaagaggcgcgggaggcggcagccgcagcgaggaggcggcggggaagaagcgcagtctccgggttgggggcgggggcggggggggcgccaaggagccgggtggggggcggcggccagcatgcggccccgcagcgccctgccccgcctgctgctgccgctgctgctgctgcccgccgccgggccggcccagttccacggggagaagggcatctccatcccggaccacggcttctgccagcccatctccatcccgctgtgcacggacatcgcctacaaccagaccatcatgcccaaccttctgggccacacgaaccaggaggacgcaggcctagaggtgcaccagttctatccgctggtgaaggtgcagtgctcgcccgaactgcgcttcttcctgtgctccatgtacgcacccgtgtgcaccgtgctggaacaggccatcccgccgtgccgctctatctgtgagcgcgcgcgccagggctgcgaagccctcatgaacaagttcggttttcagtggcccgagcgcctgcgctgcgagcacttcccgcgccacggcgccgagcagatctgcgtcggccagaaccactccgaggacggagctcccgcgctactcaccaccgcgccgccgccgggactgcagccgggtgccgggggcaccccgggtggcccgggcggcggcggcgctcccccgcgctacgccacgctggagcaccccttccactgcccgcgcgtcctcaaggtgccatcctatctcagctacaagtttctgggcgagcgtgattgtgctgcgccctgcgaacctgcgcggcccgatggttccatgttcttctcacaggaggagacgcgtttcgcgcgcctctggatcctcacctggtcggtgctgtgctgcgcttccaccttcttcactgtcaccacgtacttggtagacatgcagcgcttccgctacccagagcggcctatcatttttctgtcgggctgctacaccatggtgtcggtggcctacatcgcgggcttcgtgctccaggagcgcgtggtgtgcaacgagcgcttctccgaggacggttaccgcacggtggtgcagggcaccaagaaggagggctgcaccatcctcttcatgatgctctacttcttcagcatggccagctccatctggtgggtcatcctgtcgctcacctggttcctggcagccggcatgaagtggggccacgaggccatcgaggccaactctcagtacttccacctggccgcctgggccgtgccggccgtcaagaccatcaccatcctggccatgggccagatcgacggcgacctgctgagcggcgtgtgcttcgtaggcctcaacagcctggacccgctgcggggcttcgtgctagcgccgctcttcgtgtacctgttcatcggcacgtccttcctcctggccggcttcgtgtcgctcttccgcatccgcaccatcatgaagcacgacggcaccaagaccgaaaagctggagcggctcatggtgcgcatcggcgtcttctccgtgctctacacagtgcccgccaccatcgtcatcgcttgctacttctacgagcaggccttccgcgagcactgggagcgctcgtgggtgagccagcactgcaagagcctggccatcccgtgcccggcgcactacacgccgcgcatgtcgcccgacttcacggtctacatgatcaaatacctcatgacgctcatcgtgggcatcacgtcgggcttctggatctggtcgggcaagacgctgcactcgtggaggaagttctacactcgcctcaccaacagccgacacggtgagaccaccgtgtgagggacgcccccaggccggaaccgcgcggcgctttcctccgcccggggtggggcccctacagactccgtattttatttttttaaataaaaaacgatcgaaacc

SEQ ID NO: 11254 - DNA, 13726 bp, Homo sapiens
gccgctccgggtacctgagggacgcgcggccgcccgcggcaggcggtgcagcccccccaccccttggagccaggcgccggggtctgaggatagcatttctcaagacctgacttatggagcacttgtaacctgagatatttcagttgaaggaagaaatagctcttctcctaagatggaatctgtggtttgggaatgtggttgatcaacttgatatgttggccaaatgtgccccatgtaataaaatgaaaagaagagacaagatgatgtcattttcccatattgtgaaaccaaaaacaaacgccttttgtgagaccaagctaacaaacctctgacggtgcgaagagtatttaactgtttgaagaatttaacagtaagatacagaagaagtaccttcgagctgagacctgcaggtgtataaatatctaaaatacatattgaataggcctgatcatctgaatctccttcagacccaggaaggatggctatgacttggattgtcttctctctttggcccttgactgtgttcatggggcatataggtgggcacagtttgttttcttgtgaacctattaccttgaggatgtgccaagatttgccttataatactaccttcatgcctaatcttctgaatcattatgaccaacagacagcagctttggcaatggagccattccaccctatggtgaatctggattgttctcgggatttccggccttttctttgtgcactctacgctcctatttgtatggaatatggacgtgtcacacttccctgtcgtaggctgtgtcagcgggcttacagtgagtgttcgaagctcatggagatgtttggtgttccttggcctgaagatatggaatgcagtaggttcccagattgtgatgagccatatcctcgacttgtggatctgaatttagctggagaaccaactgaaggagccccagtggcagtgcagagagactatggtttttggtgtccccgagagttaaaaattgatcctgatctgggttattcttttctgcatgtgcgtgattgttcacctccttgtccaaatatgtacttcagaagagaagaactgtcatttgctcgctatttcataggattgatttcaatcatttgcctctcggccacattgtttacttttttaacttttttgattgatgtcacaagattccgttatcctgaaaggcctattatattttatgcagtctgctacatgatggtatccttaattttcttcattggatttttgcttgaagatcgagtagcctgcaatgcatccatccctgcacaatataaggcttccacagtgacacaaggatctcataataaagcctgtaccatgctttttatgatactctatttttttactatggctggcagtgtatggtgggtaattcttaccatcacatggtttttagcagctgtgccaaagtggggtagtgaagctattgagaagaaagcattgctgtttcacgccagtgcatggggcatccccggaactctaaccatcatccttttagcgatgaataaaattgaaggtgacaatattagtggcgtgtgttttgttggcctctacgatgttgatgcattgagatattttgttcttgctcccctctgcctgtatgtggtagttggggtttctctcctcttagctggcattatatccctaaacagagttcgaattgagattccattagaaaaggagaaccaagataaattagtgaagtttatgatccggatcggtgttttcagcattctttatctcgtaccactcttggttgtaattggatgctacttttatgagcaagcttaccggggcatctgggaaacaacgtggatacaagaacgctgcagagaatatcacattccatgtccatatcaggttactcaaatgagtcgtccagacttgattctctttctgatgaaatacctgatggctctcatagttggcattccctctgtattttgggttggaagcaaaaagacatgctttgaatgggccagtttttttcatggtcgtaggaaaaaagagatagtgaatgagagccgacaggtactccaggaacctgattttgctcagtctctcctgagggatccaaatactcctatcataagaaagtcaaggggaacttccactcaaggaacatccacccatgcttcttcaactcagctggctatggtggatgatcaaagaagcaaagcaggaagcatccacagcaaagtgagcagctaccacggcagcctccacagatcacgtgatggcaggtacacgccctgcagttacagaggaatggaggagagactacctcatggcagcatgtcacgactaacagatcactccaggcatagtagttctcatcggctcaatgaacagtcacgacatagcagcatcagagatctcagtaataatcccatgactcatatcacacatggcaccagcatgaatcgggttattgaagaagatggaaccagtgcttaatttgtcttgtctaaggtggaaatcttgtgctgtttaaaaagcagattttattctttgccttttgcatgactgatagctgtaactcacagttaacatgctttcagtcaagtacagattgtgtccactggaaaggtaaatgattgcttttttatattgcatcaaacttggaacatcaaggcatccaaaacactaagaattctatcatcacaaaaataattcgtctttctaggttatgaagagataattatttgtctggtaagcatttttataaacccactcattttatatttagaaaaatcctaaatgtgtggtgactgctttgtagtgaactttcatatactataaactagttgtgagataacattctggtagctcagttaataaaacaatttcagaattaaagaaattttctatgcaaggtttacttctcagatgaacagtaggactttgtagttttatttccactaagtgaaaaaagaactgtgtttttaaactgtaggagaatttaataaatcagcaagggtattttagctaatagaataaaagtgcaacagaagaatttgattagtctatgaaaggttctcttaaaattctatcgaaataatcttcatgcagagatattcagggtttggattagcagtggaataaagagatgggcattgtttcccctataattgtgctgtttttataacttttgtaaatattactttttctggctgtgtttttataacttatccatatgcatgatggaaaaattttaatttgtagccatcttttcccatgtaatagtattgattcatagagaacttaatgttcaaaatttgctttgtggaggcatgtaataagataaacatcatacattataaggtaaccacaattacaaaatggcaaaacattttctctgtattcattgttgtatttttctacagtgagatgtgatcttgccaaagccaccagaccttggcttccaggccctcctgtagtgagttgattgtctgcacttgccttgcccaatagccagtaggctacagcttttgccccacacccttattttcagattctggatcattcttgtttacaactgaaatatatataacctcagtccaaagtggtgattgatttgagtatttgaaaattgttgtagctaaatgaagcatgattagtcttagtatgaatatcatttaatctttaaaaaatcaagtaaaaatgtttatctgataatgtttaaataatttacaatataaactgtaaaacttattaggcatgaaatcaatcagaagagaaagaaaaatgctggaacatgcttgatgtattatgtaaaaagcatatttaaacaagggtcctcaaccctgactgcagataagaatcacttgggttacttcagatgcctaacaccttcctctcatacaaataagaattggtagctttcttaaaaaaaaaaaaaaaaaaaaaaagcgctccaggtgattctaatctgcagcctggcttgaaactcactactttaacttgcccctgatgatctgtcggcatcatatatcacatgaacatccacatggattctgtctttcgcttttatatcattatctaatattcagttgttctgcacctgatgccaaattctgggctgtactcctagagagacttactcagtaaggccaaagtgataggactttaaaatctgtagttataaaaataccgcaggtgattcttacggaggtaatccaagaatcatactttgaagaattattctagactctgaagaggcctggctctgccttatgctattatagtttatgacctttaacaatttaactctccgagcctcagttcccttgtttgtaaatgaagatagaagataaatacgtactctacctacctcacaaagctgtcagattaagatcaagtgaaaaaaattatgtgaaagctctttgaaaactgtaaagcattatgaatgataagggattaggttattgtggatttaagaggtgtgaggactgctatagtacattccttgacgtgtgttgaattcatgtatactttctttcttaccctttaaaacaaactgccaagaaattaggtgttgaaaaagaatattctcatcaggcagcaaagtcagttttctgatagtaataatttgtctattatgttatatatttcaaagtacatgtatgataatatgacttattcttcatgagagatatttgaatatttggcccaaaatgtttttcatttttctctgtgttcattgcctttctccttggagctggagttaatgctcaaagcaggcaggtctgaattccctcataaccgacaattagtaaacattttctctgaaagccaaacatataacaacttatttatcaataattcatgaagcttttgtctgagaatctctcctgcaaacagcatgagagaactaaaacaaacattcacaaacaaaaataagttaaaatagaaggtaccagtttgggctcgaagatgttgtcatccattgccatctgcattatattatcaactgccaaaatgttaattggttttcttttacaagtgggccaagtatagacagttaagtgaacatcactatgaaaatcttaactttgtgcttctagatttttagataatcatttgtattttctctattaaattgtgggtatgtatgggaatactatattgacttttcagttactttcagtaagtatcttaattttgtcccacaaaatttatgtaatattaatccatggttttaaacaacagtattcagtttgggcagcagttttaagtctaactagcttaaaccaatctgaataagtctggacagttttcctaccatatgtttaactttgattggcatatgataatgtttagtgttttcttttttcagttgacaactgagaaaataatagttctctctaacatgttaatatattatcaaaaggttttcaaaaagtactttgatttcagcaactttttttattcaataactagacaaaagatctaagataatattaaactcaaaacagtttgtttcaaagaacaattggttaataactcagctggcacagggattcatacacagtttttcaataaatatttaaatgaacaattcatgtcacacaacttgcttttaccctagtactgagtctcacatcaaagaaatttgaaagatctataacctatgtgaaatgaagtctctgctttaccagaataatatgtggcaggtaataaatatgtaaagtacaccaaatgaaacatattttgcatagataacagtccatatcactattataattaaagaaatatatgtacagacatgtaccaatccttttaattaattttagaagatgaacagtgattcttagaagtgagtaattagactccttttagtcttatgctgttagatctttgtggaccagctgagtaaatgaatcttcaaatcaacctttctttttctgctgctcttagagcagatttataaaaatcctaagaatgtcttcaaattagaaaaatttactacattttaacctacctcatcagtttctttgtgataatagctgaaaataactcaaactgtacccatcttagttaggctatatctctgtgaaatgaaaggaaccacttaattttttttatataaattagtgaatcatttgctggagcttagaaaatattaacataccaaaatttcattatgatgatatttatattgctttttgacatgccaaaggtacatttacatattaccatatttggatgacttacatagtctggtgtaatgaaaattcccctgggattggaattttaagactcatgatgtcaactgggctggtcattttatttctctgagtctttgtttcttcaatgtaaaatgtggataaggtaatttttggttttagcctccctcactggatattgtaaggatcaaatgaaatagtatttattataatgctctgtaacccataaattattctacttaaaaaaattttttatagagacagggtcttgctctgtcacacaggctggagagcagtggcataatcatagttcattataaccttgaactcctaggctcaagcagtcctccagcttcagcctcccaagtagctaagactgtaggcatgcaccactacacctggctaattttaatttttttttctttttttgagacggagtctggctttgttgcccaggctggagtgcagtggcacaatctcagctcactgcaacctccacctcccaggttcaagtgattcttctgtctcagcctcccgagtaactgggactacaggtgcgtgccaccacatccagctagtttttgtatttttagtggagatggagttttgccatgttggtctcaaactcctgacctcaagtgatctgcccacctcagcctcccaaagtgctaggattacaggcatgagtcactgcacctggcttaattttaatttttttaattttttgtagagatgagtctcactatgttgaccaggctggtcttgaactcctggcctcctaaagcactgggattacaagcatgagccaccatgcctgatccataaattgttctactgataccatttggttttgttagaatttgggggggctatagaaaacaaggttacagtcttcattagtatttctttttagcaataacaacaaaataggcaattagaccagtgttcatttggtacagtctttaaatcggtcatccaattaacctttaaaaagtaggttatgctcttaaattgtattggttctttaatatgtgttataccagagtatgcctcaaattttatgtagttgaatttgtagaacaaatttggggatattcattttatttttccttttatatgaaattgtataagtacattagcttgacttaaattataaaaaaaaatatatatgaagaagaatgtagaccctataatgttttttgtctttgactttttggcttttatgtacctcattttttctgattgagaaaaagttttgaaaaagtgattcacttgttggttttcattgtggcaaaactttaaattttaagtcatcacactatgagaattgtttgtacacatttataatttttttaaagtatgtaaagtaaggattttttctccattcttcactcacaaaggatagcatttttatggaacctagatttacaaaggaacttgtgattcttttcaatgcttttgtgtcgttttacagctgattaagaaaaaatgtttacatttaattcagctgtatttcctagtagctgtataatcttacacattattcttatataattttgacctattttatatgaaaataattgtattggcatctcttcataatttaattctcttctctccttcttttgttccgattagatgaatttgggaaaggagtaggaagactaggtatcgcatgccttccgtctgattgtaatcagtctcctgggttttttactaatttaatcttaatcctgtgcttctttagtcatcaaattgatataggattacaattttctctcaggatccaagtcttctaagaatgaaaatgttgaagtctacccagaaccagccatccttgtagacatttctatttggttgatttataaagatttaatatataaagatttaatatgagttaaacatgtttcttattctgtgatctctaattagaaagtaaaattctgttgccataaatataaaagaaagttttcacttatattttagtcaaacaccaaaccactgcattacttacttcctataagacacagtagttcaatctgttgaaaggcattgaaggataatttccttcagattactttttaaatcatcatctgcctcaggaaattctttcttgaatttttttgttggtgtgaaagcgttgcttatactttatgctcattttattggtcactgtcaccagtttttcccgataaagattaaaaatgttttttaccttgaaataattcagattttgaagattcactgtttcattattttgctaattaccattaactagtaaagttagtttttaaagtttttttaaggttgatattttatcatattcctggagtaggatggattactttattattattgtagctttaaggttttttgttgtataagtcagcttgtttgtatatgctaaattgcagatatttctttgtgttgtgcttattggtttttttttttaacttagagcttaataatttctattttctatcctggagtctaaaattaaacaaaaaaatctattttctaaattggcaggatttttttaatgattagtaaaactgtattattttatttttaaaaatacaataggattttgagtcaggaaacttgacttctactcttgcctctcttttgcagttagctgtgtaactttggataaggcattttatctcgtggtgcctccatttttctcattctctagggaacaagagaattagtttaggtagcgtctaaaattccgcccagctctcatttggttctcatttgaccattttataatcattattttggtctcatttttattcttcttattcatcccatgaactagatcaacttgtattattttactagatcaacctgtattattaacgtcatttacatgtaaattgatgggattcagatattttatcaactgtttttccattagtgattttaagtaattttaaagaaggaaaattatattacagataataaaaatgaaagaaagttataaatattggacatggcttttttaaatgggaaagtcttcttaagcaccaatataagcaccttaaattgatacatagaaaagaatgacataacgttttgtggtctttgttctcttaaatatgaatatagctagttagcctaaaatttacacaaaatgtattcaagatcaaattagtgaacaaagcaatggttcgtatggctaatttaaaagcaattcaatttaccaatattaaaataattataaaatgtaaaagaaatttcagaggagttgattgaaaattttttgttcagtaattattcttaaactgcattcttaggtttattacataaatatagttgccagattgccatgggcaagtgaatgtcttcatttgaaatattattagagatcaatgtggcttgttatttttaatttttttctggctatacagaaaatgtttctggaaaaattccttaattgtcatctgatataatgtagagattgaggccagacgcagtggctcacgcctgtaatcccagcactttgggaggccaaggtgggcagatcacctgaggtcaggagttcgagaccagcctgatgaacatggcaaatccccttctgtactaaaaatacaaaaattagccaggcgcagtggctcacgcctgtaatcccaacactttgggaggccgaggcgggcggatcacgaggtcaggagatcaagaccgtcctggctaacatggtgagaccctgtctctactaaaaacaaaaaaattagttgggcatggtggcgggcacctgtagtcccagccactcgggaggctgaggcaggagaatggcgtgaacccgggaggcggagcttgcagtgagctgagatcgcaccgctgcactccagcctgggcaacggagcgagactctatctcaaaaaaaaaaaaagaaaaaaaaaaaagtagagattgcattagttccatatctccgcagagttctctggtagattaaatgttctctgtgcactaggccaaggaagttcctgttacctttgaaaatcattgtgtttgctctgattgtctacattagctcatatcagtcttttgaacactggttcaaatctgggtgttgggttaggatctgatgagtagagaatagtggaaagttgatataggaaggtatactggtttctggtgtgattctttagctacatttattccttgtcttatgtcatttcactggatcatgtaactgtcctggctttcagaaattatattagatgcccagcctttctcattcagagatgcctgtattattatgttatttcgattgcctaccaaaaaaaaaaaaaaaagaaaaggtttgtttttagttctctgcctctgcaagtctttgtgatcacatttgttaaattgaatctgagattcaaatatttcatttaatattttctgggttttgataatgggatattctgtaagataaagcaagtaatcctagagtgatttactttatgtttagccatccaccattttcctatttctctactcctcccattctccatttttaaaaggaaattaacaaatgtcttcctttatccctgcctcagataatttttccctgaactcatcttgtcagcagaaacatttaatgtgaaataattctgtatttctgagacaagatcaacacagtagttctttacattgagctgaggtgaatgtatacttaaaaatactctattttctttttatatgaacttaaaatttttaaaatcatatatgggactccccaatgtgaaaatattagtctggacattctcttgccatcaggtgctatttctaccttagctgtgagttagactaaatccaaatttcgtatcattcatctttttataatatttaacttccctagaatcaccccatttcatgtctttaaccccaacttccaacaacttttctgcttttattttcaaatgtcaaattgtatttttgtgttttattttctcattgaagtgtaaaagtatcacatatatgaaggaatggctggtttagacatttactttggcatagtaaagattgatattgataccacccaccatcctttcctctagccccagaaagaaaagtttgacaactcaaaaacgattaaattatcttatcttgttatttaatagaacaatggaagctgtttcgtcaaaattaaaatactttaccaaaaaaatacttttttgtattttaatctgatagtgaatttggggattatttatgtaaatgtatcataattaatagtaattatgagttatttcactctctgtaatttgtgatacccaagattcatatttatttaatgtgaggtgttttttgaggcttttttgttttatcttgttttcttaactttttacagtgttgttagattatcgcggtcatctcggcatgtggatcgctcctcctgtagatcagctgttctctcttagagtcaggacaaggaggtttttgctacatggtcgtagttggataatacagcattattctgaactatctgaaattgctggttttattggtcaaaaatgatcagatgctagcaatttcataatagatatattcaagaaggaaccaaactttaaaagatcttttagaataggtatgttaacttctcatcctaaccctatcaatatatcagaggctttatgaaggagactctacagataaccacaaatcttatcaagaaaattctccttaaaaaaagttatcctttattttgttgttaaatttcccagtttttaaaagtgttttatcaaaatgacttcataattgaagcaaataccttttggaagtatatatgttacataagactttcactaaatctgtgcgtaaagcttttataatctgagatattgttatgtattaggtttgtgcaaacctaatataaaagggttcatctgtaagtatcatttagaggcaaaataatttccccctcacatctaatgtggactcaaattttggcaactggaatgttatcctcttggtaggcattctaaattaatgaatactgctatgtggtgtagtaaacaaatttgccataaaatgccatttaaggattttctttttacctttatttcattataaaagtatatgagttgaagatcatataaaaaatatgaaactcctacacaggaaatccccaattttgtgatttaataggttgtaaaaagagttgttccaaattcagactacatctcatcatataaataatattatgaataataagggtaaaagattagccaacaaaagctaatctagtacaccccatagaggtactccaggtgtcttggttttggataaatttttatagtggagaaaggttactttgatctctcaataattgcttggtacacttcttcctaggcaatatgctcatgataccctcttcatgtgacctattcctcaaatgctgcattctccaaaacttccttacctgccttctatcccctagtcattcttatcaatacttccaaaatataacctatctcaagtgttagaaatttgctttaactaatttatattaaagtgttagtgactatagcccttttatctctcttaaagagaaatctgcattaaaagcaaacacattgctgttagctcaaattaatgtcagtgagtagaatcttaagctttaaaacaaaagtggaaataatttaaattagtgttgatgggactattttgaggcaagagataccattaagtgacctagcttggaaatctgccccctttgcccaaacccatgtgatgtctgaaactactgtatattttcaatgaccttgagaaagggagctagtcatttgtatttatgggccttatgaagtcagggcctgctgatcctgttttttaagttcaagcgcaatgcctgaagcatcctagatctccttcaccctcattctacctgacagacagctaggtctgtcttccagctctttctcattgatactacctttacatatgaatactatccatgcttgttaaaaaaaaaaaaagtctttccccattttactgttacaatttttcaagagctataaaggtagaaaaagtattccttttcattattctaaaaaatatgtcatttttaaatagctggcacttagcagtttagttttccaaactttattctgaatcaaattgctgaggtgattctaaatgtctaatgttgatttatcatataaacatctaattagaaagtgtttatgctaaagacttgtattttgtggcattagttcttcatgtttcttttttatatgtttattaaaattgttcacttccaaatgagtggaaaagttgctgttgttgggatgtacagggcaagtgcacttggttagagcatgaactgggaatttcacattctctgatgtgctttgcactctgctcttgtagatttattttgtttacagtagactgatgtcagtttttgtaaatgttttttcttagcactttaactgtgagtgtacaaactgattttaaatgtagtggttgtatattttggttataaattggagatttttaataaaattaaataattctc

SEQ ID NO: 11255 - DNA, 580 bp, Homo sapiens
gaaagctcgctgtcgctgggaggcgcgcgccggcgttcctcggccgctccgggtacctgagggacgcgcggccgcccgcggcaggcggtgcagcccccccaccccttggagccaggcgccggggtctgagatatttcagttgaaggaagaaatagctcttctcctaagatggaatctgtggtttgggaatgtggttgatcaacttgatatgttggccaaatgtgccccatgtaataaaatgaaaagaagagacaagatgatgtcattttcccatattgtgaaaccaaaaacaaacgccttttgtgagaccaagctaacaaacctctgacggtgcgaagagtatttaactgtttgaagaatttaacagtaagatacagaagaagtaccttcgagctgagacctgcaggtgtataaatatctaaaatacatattgaataggcctgatcatctgaatctccttcagacccaggaaggatggctatgacttggattgtcttctctctttggcccttgactgtgttcatggggcatataggtgggcacagtttgttttcttgtgaacctattaccttgaggatgt

SEQ ID NO: 11256 - DNA, 3101 bp, Homo sapiens
gcgaaagctcgctgtcgctgggaggcgcgcgccggcgttcctcggccgctccgggtacctgagggacgcgcggccgcccgcggcaggcggtgcagcccccccaccccttggagccaggcgccggggtctgagatatttcagttgaaggaagaaatagctcttctcctaagatggaatctgtggtttgggaatgtggttgatcaacttgatatgttggccaaatgtgccccatgtaataaaatgaaaagaagagacaagatgatgtcattttcccatattgtgaaaccaaaaacaaacgccttttgtgagaccaagctaacaaacctctgacggtgcgaagagtatttaactgtttgaagaatttaacagtaagatacagaagaagtaccttcgagctgagacctgcaggtgtataaatatctaaaatacatattgaataggcctgatcatctgaatctccttcagacccaggaaggatggctatgacttggattgtcttctctctttggcccttgactgtgttcatggggcatataggtgggcacagtttgttttcttgtgaacctattaccttgaggatgtgccaagatttgccttataatactaccttcatgcctaatcttctgaatcattatgaccaacagacagcagctttggcaatggagccattccaccctatggtgaatctggattgttctcgggatttccggccttttctttgtgcactctacgctcctatttgtatggaatatggacgtgtcacacttccctgtcgtaggctgtgtcagcgggcttacagtgagtgttcgaagctcatggagatgtttggtgttccttggcctgaagatatggaatgcagtaggttcccagattgtgatgagccatatcctcgacttgtggatctgaatttagctggagaaccaactgaaggagccccagtggcagtgcagagagactatggtttttggtgtccccgagagttaaaaattgatcctgatctgggttattcttttctgcatgtgcgtgattgttcacctccttgtccaaatatgtacttcagaagagaagaactgtcatttgctcgctatttcataggattgatttcaatcatttgcctctcggccacattgtttacttttttaacttttttgattgatgtcacaagattccgttatcctgaaaggcctattatattttatgcagtctgctacatgatggtatccttaattttcttcattggatttttgcttgaagatcgagtagcctgcaatgcatccatccctgcacaatataaggcttccacagtgacacaaggatctcataataaagcctgtaccatgctttttatgatactctatttttttactatggctggcagtgtatggtgggtaattcttaccatcacatggtttttagcagctgtgccaaagtggggtagtgaagctattgagaagaaagcattgctgtttcacgccagtgcatggggcatccccggaactctaaccatcatccttttagcgatgaataaaattgaaggtgacaatattagtggcgtgtgttttgttggcctctacgatgttgatgcattgagatattttgttcttgctcccctctgcctgtatgtggtagttggggtttctctcctcttagctggcattatatccctaaacagagttcgaattgagattccattagaaaaggagaaccaagataaattagtgaagtttatgatccggatcggtgttttcagcattctttatctcgtaccactcttggttgtaattggatgctacttttatgagcaagcttaccggggcatctgggaaacaacgtggatacaagaacgctgcagagaatatcacattccatgtccatatcaggttactcaaatgagtcgtccagacttgattctctttctgatgaaatacctgatggctctcatagttggcattccctctgtattttgggttggaagcaaaaagacatgctttgaatgggccagtttttttcatggtcgtaggaaaaaagagatagtgaatgagagccgacaggtactccaggaacctgattttgctcagtctctcctgagggatccaaatactcctatcataagaaagtcaaggggaacttccactcaaggaacatccacccatgcttcttcaactcagctggctatggtggatgatcaaagaagcaaagcaggaagcatccacagcaaagtgagcagctaccacggcagcctccacagatcacgtgatggcaggtacacgccctgcagttacagaggaatggaggagagactacctcatggcagcatgtcacgactaacagatcactccaggcatagtagttctcatcggctcaatgaacagtcacgacatagcagcatcagagatctcagtaataatcccatgactcatatcacacatggcaccagcatgaatcgggttattgaagaagatggaaccagtgcttaatttgtcttgtctaaggtggaaatcttgtgctgtttaaaaagcagattttattctttgccttttgcatgactgatagctgtaactcacagttaacatgctttcagtcaagtacagattgtgtccactggaaaggtaaatgattgcttttttatattgcatcaaacttggaacatcaaggcatccaaaacactaagaattctatcatcacaaaaataattcgtctttctaggttatgaagagataattatttgtctggtaagcatttttataaacccactcattttatatttagaaaaatcctaaatgtgtggtgactgctttgtagtgaactttcatatactataaactagttgtgagataacattctggtagctcagttaataaaacaatttcagaattaaagaaattttctatgcaaggtttacttctcagatgaacagtaggactttgtagttttatttccactaagtgaaaaaagaactgtgtttttaaactgtaggagaatttaataaatcagcaagggtattttagctaatagaataaaagtgcaacagaagaatttgattagtctatgaaaggttctcttaaaattctatcgaaataatcttcatgcagagatattca

SEQ ID NO: 11257 - DNA, 7383 bp, Homo sapiens
gctgcgcagcgctggctgctggctggcctcgcggagacgccgaacggacgcggccggcgccggcttgtgggctcgccgcctgcagccatgaccctcgcagcctgtccctcggcctcggcccgggacgtctaaaatcccacacagtcgcgcgcagctgctggagagccggccgctgccccctcgtcgccgcatcacactcccgtcccgggagctgggagcagcgcgggcagccggcgcccccgtgcaaactgggggtgtctgccagagcagccccagccgctgccgctgctacccccgatgctggccatggcctggcggggcgcagggccgagcgtcccgggggcgcccgggggcgtcggtctcagtctggggttgctcctgcagttgctgctgctcctggggccggcgcggggcttcggggacgaggaagagcggcgctgcgaccccatccgcatctccatgtgccagaacctcggctacaacgtgaccaagatgcccaacctggttgggcacgagctgcagacggacgccgagctgcagctgacaactttcacaccgctcatccagtacggctgctccagccagctgcagttcttcctttgttctgtttatgtgccaatgtgcacagagaagatcaacatccccattggcccatgcggcggcatgtgtctttcagtcaagagacgctgtgaacccgtcctgaaggaatttggatttgcctggccagagagtctgaactgcagcaaattcccaccacagaacgaccacaaccacatgtgcatggaagggccaggtgatgaagaggtgcccttacctcacaaaacccccatccagcctggggaagagtgtcactctgtgggaaccaattctgatcagtacatctgggtgaaaaggagcctgaactgtgtgctcaagtgtggctatgatgctggcttatacagccgctcagccaaggagttcactgatatctggatggctgtgtgggccagcctgtgtttcatctccactgccttcacagtactgaccttcctgatcgattcttctaggttttcctaccctgagcgccccatcatatttctcagtatgtgctataatatttatagcattgcttatattgtcaggctgactgtaggccgggaaaggatatcctgtgattttgaagaggcagcagaacctgttctcatccaagaaggacttaagaacacaggatgtgcaataattttcttgctgatgtacttttttggaatggccagctccatttggtgggttattctgacactcacttggtttttggcagcaggactcaaatggggtcatgaagccattgaaatgcacagctcttatttccacattgcagcctgggccatccccgcagtgaaaaccattgtcatcttgattatgagactggtggatgcagatgaactgactggcttgtgctatgttggaaaccaaaatctcgatgccctcaccgggttcgtggtggctcccctctttacttatttggtcattggaactttgttcattgctgcaggtttggtggccttgttcaaaattcggtcaaatcttcaaaaggatgggacaaagacagacaagttagaaagactgatggtcaagattggggtgttctcagtactgtacacagttcctgcaacgtgtgtgattgcctgttatttttatgaaatctccaactgggcactttttcggtattctgcagatgattccaacatggctgttgaaatgttgaaaatttttatgtctttgttggtgggcatcacttcaggcatgtggatttggtctgccaaaactcttcacacgtggcagaagtgttccaacagattggtgaattctggaaaggtaaagagagagaagagaggaaatggttgggtgaagcctggaaaaggcagtgagactgtggtataaggctagtcagcctccatgctttcttcattttgaaggggggaatgccagcattttggaggaaattctactaaaagttttatgcagtgaatctcagtttgaacaaactagcaacaattaagtgacccccgtcaacccactgcctcccaccccgaccccagcatcaaaaaaccaatgattttgctgcagactttggaatgatccaaaatggaaaagccagttagaggctttcaaagctgtgaaaaatcaaaacgttgatcactttagcaggttgcagcttggagcgtggaggtcctgcctagattccaggaagtccagggcgatactgttttcccctgcagggtgggatttgagctgtgagttggtaactagcagggagaaatattaacttttttaaccctttaccattttaaatactaactgggtctttcagatagcaaagcaatctataaacactggaaacgctgggttcagaaaagtgttacaagagttttatagtttggctgatgtaacataaacatcttctgtggtgcgctgtctgctgtttagaactttgtggactgcactcccaagaagtggtgttagaatctttcagtgcctttgtcataaaacagttatttgaacaaacaaaagtactgtactcacacacataaggtatccagtggatttttcttctctgtcttcctctcttaaatttcaacatctctcttcttggctgctgctgttttcttcattttatgttaatgactcaaaaaaggtatttttatagaatttttgtactgcagcatgcttaaagaggggaaaaggaagggtgattcactttctgacaatcacttaattcagaggaaaatgagatttactaagttgacttacctgacggaccccagagacctattgcattgagcagtggggacttaatatattttacttgtgtgattgcatctatgcagacgccagtctggaagagctgaaatgttaagtttcttggcaactttgcattcacacagattagctgtgtaatttttgtgtgtcaattacaattaaaagcacattgttggaccatgacatagtatactcaactgactttaaaactatggtcaacttcaacttgcattctcagaatgatagtgcctttaaaaatttttttattttttaaagcataagaatgttatcagaatctggtctacttaggacaatggagactttttcagttttataaagggaactgaggacagctaatccaactacttggtgcgtaattgtttcctagtaattggcaaaggctccttgtaagatttcactggaggcagtgtggcctggagtatttatatggtgcttaatgaatctccagaatgccagccagaagcctgattggttagtagggaataaagtgtagaccatatgaaatgaactgcaaactctaatagcccaggtcttaattgcctttagcagaggtatccaaagcttttaaaatttatgcatacgttcttcacaagggggtacccccagcagcctctcgaaaattgcacttctcttaaaactgtaactggcctttctcttaccttgccttaggcgttctaatcatgagatcttggggacaaattgactatgtcacaggttgctctccttgtaactcatacctgtctgcttcagcaactgctttgcaatgacatttatttattaattcatgccttaaaaaaataggaagggaagcttttttttttctttttttttttttcaatcacactttgtggaaaaacatttccagggactcaaaattccaaaaaggtggtcaaattctggaagtaagcatttcctcttttttaaaaatttggtttgagccttatgcccatagtttgacatttccctttcttctttcctttttgtttttgtgtggttcttgagctctctgacatcaagatgcatgtaaagtcgattgtatgttttggaaggcaaagtcttggcttttgagactgaagttaagtgggcacaggtggcccctgctgctgtgcccagtctgagtaccttggctagactctaggtcaggctccaggagcatgagaattgatccccagaagaaccattttaactccatctgatactccattgcctatgaaatgtaaaatgtgaactccctgtgctgcttgtagacagttcccataactgtccacggccctggagcacgcacccaggggcagagcctgcccttactcacgctctgctctggtgtcttgggagttgtgcagggactctggcccaggcaggggaaggaagaccaggcggtaggggactggtcttgctgttagagtatagaggtttgtaatgcagttttcttcataatgtgtcagtgattgtgtgaccaaggcagcatctagcagaaagccaggcatggagtaggtgatcgatacttgtcaatgactaaataataacaataaaagagcacttgggtgaatctgggcacctgatttctgagttttgagttctggagctagtgttttgacaatgctttgggttttgacatgccttttccacaaatctcttgccttttcagggcaaagtgtatttgatcagaagtggccatttggattagtagccttagcaatgctacagggttataggcctctcctttcacattccagacaatggagagtgtttatggtttcaggaaaagaactttgtggctgaggggtcagttaccagtgaccttcaatcaactccatcacttcttaaatcggtatttgttaaaaaaatcagttattttatttattgagtgccgactgtagtaaagccctgaaatagataatctctgttcttctaactgatctaggatggggacgcacccaggtctgctgaactttactgttcctctgggaaaggagcagggacctctggaattcccatctgtttcactgtctccattccataaatctcttcctgtgtgagccaccacacccagcctgggtctctctacttttaacacatctctcatccctttcccaggattccttccaagtcagttacaggtggttttaacagaaagcatcagctctgcttcgtgacagtctctggagaaatcccttaggaagactatgagagtaggccacaaggacatgggcccacacatctgctttggctttgccggcaattcagggcttggggtattccatgtgacttgtataggtatatttgaggacagcatcttgctagagaaaaggtgagggttgtttttctttctctgaaacctacagtaaatgggtatgattgtagcttcctcagaaatcccttggcctccagagattaaacatggtgcaatggcacctctgtccaacctcctttctggtagattcctttctcctgcttcatataggccaaacctcagggcaagggaacatgggggtagagtggtgctggccagaaccatctgcttgagctacttggttgattcatatcctctttcctttatggagacccatttcctgatctctgagactgttgctgaactggcaacttacttgggcctgaaactggagaaggggtgacatttttttaatttcagagatgctttctgattttcctctcccaggtcactgtctcacctgcactctccaaactcaggttccgggaagcttgtgtgtctagatactgaattgagattctgttcagcaccttttagctctatactctctggctcccctcatcctcatggtcactgaattaaatgcttattgtattgagaaccaagatgggacctgaggacacaaagatgagctcaacagtctcagccctagaggaatagactcagggatttcaccaggtcggtgcagtatttgatttctggtgaggtgaccacagctgcagttagggaagggagccattgagcacagactttggaaggaaccttttttttgttgtttgtttgtttgtttgtttgtttgtttgtttgagacagggtcttgctctgtcacccaggctggggcgcaatggcacgatcttggctcactgcaacctctgcctcctgggttcaagtgattctcctgccacagcctcctgaggagctgggactacaggtgcgtgctaccacgcccagctacttctgtatttttagtagagacggggtttcactgtgttggccaggctggtctcgaactcctgacctcatgatctgcccgcctcagcctcccaaagtgctgggattacaagtgtgagccaccacacctggcctggaaggaacctcttaaaatcagtttacgtcttgtattttgttctgtgatggaggacactggagagagttgctattccagtcaatcatgtcgagtcactggactctgaaaatcctattggttcctttattttatttgagtttagagttcccttctgggtttgtattatgtctggcaaatgacctgggttatcacttttcctccagggttagatcatagatcttggaaactccttagagagcattttgctcctaccaaggatcagatactggagccccacataatagatttcatttcactctagcctacatagagctttctgttgctgtctcttgccatgcacttgtgcggtgattacacacttgacagtaccaggagacaaatgacttacagatcccccgacatgcctcttccccttggcaagctcagttgccctgatagtagcatgtttctgtttctgatgtaccttttttctcttcttctttgcatcagccaattcccagaatttccccaggcaatttgtagaggacctttttggggtcctatatgagccatgtcctcaaagcttttaaacctccttgctctcctacaatattcagtacatgaccactgtcatcctagaaggcttctgaaaagaggggcaagagccactctgcgccacaaaggttgggtccatcttctctccgaggttgtgaaagttttcaaattgtactaataggctggggccctgacttggctgtgggctttgggaggggtaagctgctttctagatctctcccagtgaggcatggaggtgtttctgaattttgtctacctcacagggatgttgtgaggcttgaaaaggtcaaaaaatgatggccccttgagctctttgtaagaaaggtagatgaaatatcggatgtaatctgaaaaaaagataaaatgtgacttcccctgctctgtgcagcagtcgggctggatgctctgtggcctttcttgggtcctcatgccaccccacagctccaggaaccttgaagccaatctgggggactttcagatgtttgacaaagaggtaccaggcaaacttcctgctacacatgccctgaatgaattgctaaatttcaaaggaaatggaccctgcttttaaggatgtacaaaagtatgtctgcatcgatgtctgtactgtaaatttctaatttatcactgtacaaagaaaaccccttgctatttaattttgtattaaaggaaaataaagttttgtttgtta

SEQ ID NO: 11258 - DNA, 3788 bp, Homo sapiens
gacctggcggcgcagtctcgcgggatcgctcagctctcgctccccgtgcggctctcgaggcagctccagtcccggacgcaaccccggagccgtctcaggtccctggggggaacggtgggttagacggggacgggaagggacagcggccttcgaccgccccccgagtaattgacccaggactcattttcaggaaagcctgaaaatgagtaaaatagtgaaatgaggaatttgaacattttatctttggatggggatcttctgaggatgcaaagagtgattcatccaagccatgtggtaaaatcaggaatttgaagaaaatggaaatgtttacatttttgttgacgtgtatttttctacccctcctaagagggcacagtctcttcacctgtgaaccaattactgttcccagatgtatgaaaatggcctacaacatgacgtttttccctaatctgatgggtcattatgaccagagtattgccgcggtggaaatggagcattttcttcctctcgcaaatctggaatgttcaccaaacattgaaactttcctctgcaaagcatttgtaccaacctgcatagaacaaattcatgtggttccaccttgtcgtaaactttgtgagaaagtatattctgattgcaaaaaattaattgacacttttgggatccgatggcctgaggagcttgaatgtgacagattacaatactgtgatgagactgttcctgtaacttttgatccacacacagaatttcttggtcctcagaagaaaacagaacaagtccaaagagacattggattttggtgtccaaggcatcttaagacttctgggggacaaggatataagtttctgggaattgaccagtgtgcgcctccatgccccaacatgtattttaaaagtgatgagctagagtttgcaaaaagttttattggaacagtttcaatattttgtctttgtgcaactctgttcacattccttacttttttaattgatgttagaagattcagatacccagagagaccaattatatattactctgtctgttacagcattgtatctcttatgtacttcattggatttttgctaggcgatagcacagcctgcaataaggcagatgagaagctagaacttggtgacactgttgtcctaggctctcaaaataaggcttgcaccgttttgttcatgcttttgtattttttcacaatggctggcactgtgtggtgggtgattcttaccattacttggttcttagctgcaggaagaaaatggagttgtgaagccatcgagcaaaaagcagtgtggtttcatgctgttgcatggggaacaccaggtttcctgactgttatgcttcttgctatgaacaaagttgaaggagacaacattagtggagtttgctttgttggcctttatgacctggatgcttctcgctactttgtactcttgccactgtgcctttgtgtgtttgttgggctctctcttcttttagctggcattatttccttaaatcatgttcgacaagtcatacaacatgatggccggaaccaagaaaaactaaagaaatttatgattcgaattggagtcttcagcggcttgtatcttgtgccattagtgacacttctcggatgttacgtctatgagcaagtgaacaggattacctgggagataacttgggtctctgatcattgtcgtcagtaccatatcccatgtccttatcaggcaaaagcaaaagctcgaccagaattggctttatttatgataaaatacctgatgacattaattgttggcatctctgctgtcttctgggttggaagcaaaaagacatgcacagaatgggctgggttttttaaacgaaatcgcaagagagatccaatcagtgaaagtcgaagagtactacaggaatcatgtgagtttttcttaaagcacaattctaaagttaaacacaaaaagaagcactataaaccaagttcacacaagctgaaggtcatttccaaatccatgggaaccagcacaggagctacagcaaatcatggcacttctgcagtagcaattactagccatgattacctaggacaagaaactttgacagaaatccaaacctcaccagaaacatcaatgagagaggtgaaagcggacggagctagcacccccaggttaagagaacaggactgtggtgaacctgcctcgccagcagcatccatctccagactctctggggaacaggtcgacgggaagggccaggcaggcagtgtatctgaaagtgcgcggagtgaaggaaggattagtccaaagagtgatattactgacactggcctggcacagagcaacaatttgcaggtccccagttcttcagaaccaagcagcctcaaaggttccacatctctgcttgttcacccggtttcaggagtgagaaaagagcagggaggtggttgtcattcagatacttgaagaacattttctctcgttactcagaagcaaatttgtgttacactggaagtgacctatgcactgttttgtaagaatcactgttacattcttcttttgcacttaaagttgcattgcctactgttatactggaaaaaatagagttcaagaataatatgactcatttcacacaaaggttaatgacaacaatatacctgaaaacagaaaatgtgcaggttaataatatttttttaatagtgtgggaggacagagttagaggaatcttccttttctatttatgaagattctactcttggtaagagtattttaagatgtactatgctattttacttttttgatataaaatcaagatatttctttgctgaagtatttaaatcttatccttgtatctttttatacatatttgaaaataagcttatatgtatttgaacttttttgaaatcctattcaagtatttttatcatgctattgtgatattttagcactttggtagcttttacactgaatttctaagaaaattgtaaaatagtcttcttttatactgtaaaaaaagatataccaaaaagtcttataataggaatttaactttaaaaacccacttattgataccttaccatctaaaatgtgtgatttttatagtctcgttttaggaatttcacagatctaaattatgtaactgaaataaggtgcttactcaaagagtgtccactattgattgtattatgctgctcactgatccttctgcatatttaaaataaaatgtcctaaagggttagtagacaaaatgttagtcttttgtatattaggccaagtgcaattgacttcccttttttaatgtttcatgaccacccattgattgtattataaccacttacagttgcttatattttttgttttaacttttgttttttaacatttagaatattacattttgtattatacagtacctttctcagacattttgtagaattcatttcggcagctcactaggattttgctgaacattaaaaagtgtgatagcgatattagtgccaatcaaatggaaaaaaggtagttttaataaacaagacacaacgtttttatacaacatactttaaaatattaaggagttttcttaattttgtttcctattaagtattattctttgggcaagattttctgatgcttttgattttctctcaatttagcatttgcttttggtttttttctctatttagcattctgttaaggcacaaaaactatgtactgtatgggaaatgttgtaaatattaccttttccacattttaaacagacaactttgaatacaaaaactttgttttgtgtgatcttttcattaataaaattatctttgt

SEQ ID NO: 11259 - DNA, 3719 bp, Homo sapiens
cctttcgaactcaagtcacttgggcaattggctttacaaagcaaattggctccgtttaaggattcttgactcctgaaatccgcaaggaagtgggttcttttagagccagcgccaagagcttcaaaaaatccttctaagtaattgacccaggactcattttcaggaaagcctgaaaatgagtaaaatagtgaaatgaggaatttgaacattttatctttggatggggatcttctgaggatgcaaagagtgattcatccaagccatgtggtaaaatcaggaatttgaagaaaatggaaatgtttacatttttgttgacgtgtatttttctacccctcctaagagggcacagtctcttcacctgtgaaccaattactgttcccagatgtatgaaaatggcctacaacatgacgtttttccctaatctgatgggtcattatgaccagagtattgccgcggtggaaatggagcattttcttcctctcgcaaatctggaatgttcaccaaacattgaaactttcctctgcaaagcatttgtaccaacctgcatagaacaaattcatgtggttccaccttgtcgtaaactttgtgagaaagtatattctgattgcaaaaaattaattgacacttttgggatccgatggcctgaggagcttgaatgtgacagattacaatactgtgatgagactgttcctgtaacttttgatccacacacagaatttcttggtcctcagaagaaaacagaacaagtccaaagagacattggattttggtgtccaaggcatcttaagacttctgggggacaaggatataagtttctgggaattgaccagtgtgcgcctccatgccccaacatgtattttaaaagtgatgagctagagtttgcaaaaagttttattggaacagtttcaatattttgtctttgtgcaactctgttcacattccttacttttttaattgatgttagaagattcagatacccagagagaccaattatatattactctgtctgttacagcattgtatctcttatgtacttcattggatttttgctaggcgatagcacagcctgcaataaggcagatgagaagctagaacttggtgacactgttgtcctaggctctcaaaataaggcttgcaccgttttgttcatgcttttgtattttttcacaatggctggcactgtgtggtgggtgattcttaccattacttggttcttagctgcaggaagaaaatggagttgtgaagccatcgagcaaaaagcagtgtggtttcatgctgttgcatggggaacaccaggtttcctgactgttatgcttcttgctatgaacaaagttgaaggagacaacattagtggagtttgctttgttggcctttatgacctggatgcttctcgctactttgtactcttgccactgtgcctttgtgtgtttgttgggctctctcttcttttagctggcattatttccttaaatcatgttcgacaagtcatacaacatgatggccggaaccaagaaaaactaaagaaatttatgattcgaattggagtcttcagcggcttgtatcttgtgccattagtgacacttctcggatgttacgtctatgagcaagtgaacaggattacctgggagataacttgggtctctgatcattgtcgtcagtaccatatcccatgtccttatcaggcaaaagcaaaagctcgaccagaattggctttatttatgataaaatacctgatgacattaattgttggcatctctgctgtcttctgggttggaagcaaaaagacatgcacagaatgggctgggttttttaaacgaaatcgcaagagagatccaatcagtgaaagtcgaagagtactacaggaatcatgtgagtttttcttaaagcacaattctaaagttaaacacaaaaagaagcactataaaccaagttcacacaagctgaaggtcatttccaaatccatgggaaccagcacaggagctacagcaaatcatggcacttctgcagtagcaattactagccatgattacctaggacaagaaactttgacagaaatccaaacctcaccagaaacatcaatgagagaggtgaaagcggacggagctagcacccccaggttaagagaacaggactgtggtgaacctgcctcgccagcagcatccatctccagactctctggggaacaggtcgacgggaagggccaggcaggcagtgtatctgaaagtgcgcggagtgaaggaaggattagtccaaagagtgatattactgacactggcctggcacagagcaacaatttgcaggtccccagttcttcagaaccaagcagcctcaaaggttccacatctctgcttgttcacccggtttcaggagtgagaaaagagcagggaggtggttgtcattcagatacttgaagaacattttctctcgttactcagaagcaaatttgtgttacactggaagtgacctatgcactgttttgtaagaatcactgttacattcttcttttgcacttaaagttgcattgcctactgttatactggaaaaaatagagttcaagaataatatgactcatttcacacaaaggttaatgacaacaatatacctgaaaacagaaaatgtgcaggttaataatatttttttaatagtgtgggaggacagagttagaggaatcttccttttctatttatgaagattctactcttggtaagagtattttaagatgtactatgctattttacttttttgatataaaatcaagatatttctttgctgaagtatttaaatcttatccttgtatctttttatacatatttgaaaataagcttatatgtatttgaacttttttgaaatcctattcaagtatttttatcatgctattgtgatattttagcactttggtagcttttacactgaatttctaagaaaattgtaaaatagtcttcttttatactgtaaaaaaagatataccaaaaagtcttataataggaatttaactttaaaaacccacttattgataccttaccatctaaaatgtgtgatttttatagtctcgttttaggaatttcacagatctaaattatgtaactgaaataaggtgcttactcaaagagtgtccactattgattgtattatgctgctcactgatccttctgcatatttaaaataaaatgtcctaaagggttagtagacaaaatgttagtcttttgtatattaggccaagtgcaattgacttcccttttttaatgtttcatgaccacccattgattgtattataaccacttacagttgcttatattttttgttttaacttttgttttttaacatttagaatattacattttgtattatacagtacctttctcagacattttgtagaattcatttcggcagctcactaggattttgctgaacattaaaaagtgtgatagcgatattagtgccaatcaaatggaaaaaaggtagttttaataaacaagacacaacgtttttatacaacatactttaaaatattaaggagttttcttaattttgtttcctattaagtattattctttgggcaagattttctgatgcttttgattttctctcaatttagcatttgcttttggtttttttctctatttagcattctgttaaggcacaaaaactatgtactgtatgggaaatgttgtaaatattaccttttccacattttaaacagacaactttgaatacaaaaa

SEQ ID NO: 11260 - DNA, 2774 bp, Homo sapiens
tctcgctccccgtgcggctctcgaggcagctccagtcccggacgcaaccccggagccgtctcaggtccctggggggaacggtgggttagacggggacgggaagggacagcggccttcgaccgccccccgagtaattgacccaggactcattttcaggaaagcctgaaaatgagtaaaatagtgaaatgaggaatttgaacattttatctttggatggggatcttctgaggatgcaaagagtgattcatccaagccatgtgatgtatgaaaatggcctacaacatgacgtttttccctaatctgatgggtcattatgaccagagtattgccgcggtggaaatggagcattttcttcctctcgcaaatctggaatgttcaccaaacattgaaactttcctctgcaaagcatttgtaccaacctgcatagaacaaattcatgtggttccaccttgtcgtaaactttgtgagaaagtatattctgattgcaaaaaattaattgacacttttgggatccgatggcctgaggagcttgaatgtgacagattacaatactgtgatgagactgttcctgtaacttttgatccacacacagaatttcttggtcctcagaagaaaacagaacaagtccaaagagacattggattttggtgtccaaggcatcttaagacttctgggggacaaggatataagtttctgggaattgaccagtgtgcgcctccatgccccaacatgtattttaaaagtgatgagctagagtttgcaaaaagttttattggaacagtttcaatattttgtctttgtgcaactctgttcacattccttacttttttaattgatgttagaagattcagatacccagagagaccaattatatattactctgtctgttacagcattgtatctcttatgtacttcattggatttttgctaggcgatagcacagcctgcaataaggcagatgagaagctagaacttggtgacactgttgtcctaggctctcaaaataaggcttgcaccgttttgttcatgcttttgtattttttcacaatggctggcactgtgtggtgggtgattcttaccattacttggttcttagctgcaggaagaaaatggagttgtgaagccatcgagcaaaaagcagtgtggtttcatgctgttgcatggggaacaccaggtttcctgactgttatgcttcttgctatgaacaaagttgaaggagacaacattagtggagtttgctttgttggcctttatgacctggatgcttctcgctactttgtactcttgccactgtgcctttgtgtgtttgttgggctctctcttcttttagctggcattatttccttaaatcatgttcgacaagtcatacaacatgatggccggaaccaagaaaaactaaagaaatttatgattcgaattggagtcttcagcggcttgtatcttgtgccattagtgacacttctcggatgttacgtctatgagcaagtgaacaggattacctgggagataacttgggtctctgatcattgtcgtcagtaccatatcccatgtccttatcaggcaaaagcaaaagctcgaccagaattggctttatttatgataaaatacctgatgacattaattgttggcatctctgctgtcttctgggttggaagcaaaaagacatgcacagaatgggctgggttttttaaacgaaatcgcaagagagatccaatcagtgaaagtcgaagagtactacaggaatcatgtgagtttttcttaaagcacaattctaaagttaaacacaaaaagaagcactataaaccaagttcacacaagctgaaggtcatttccaaatccatgggaaccagcacaggagctacagcaaatcatggcacttctgcagtagcaattactagccatgattacctaggacaagaaactttgacagaaatccaaacctcaccagaaacatcaatgagagaggtgaaagcggacggagctagcacccccaggttaagagaacaggactgtggtgaacctgcctcgccagcagcatccatctccagactctctggggaacaggtcgacgggaagggccaggcaggcagtgtatctgaaagtgcgcggagtgaaggaaggattagtccaaagagtgatattactgacactggcctggcacagagcaacaatttgcaggtccccagttcttcagaaccaagcagcctcaaaggttccacatctctgcttgttcacccggtttcaggagtgagaaaagagcagggaggtggttgtcattcagatacttgaagaacattttctctcgttactcagaagcaaatttgtgttacactggaagtgacctatgcactgttttgtaagaatcactgttacattcttcttttgcacttaaagttgcattgcctactgttatactggaaaaaatagagttcaagaataatatgactcatttcacacaaaggttaatgacaacaatatacctgaaaacagaaaatgtgcaggttaataatatttttttaatagtgtgggaggacagagttagaggaatcttccttttctatttatgaagattctactcttggtaagagtattttaagatgtactatgctattttacttttttgatataaaatcaagatatttctttgctgaagtatttaaatcttatccttgtatctttttatacatatttgaaaataagcttatatgtatttgaacttttttgaaatcctattcaagtatttttatcatgctattgtgatattttagcacttt

SEQ ID NO: 11261 - DNA, 2721 bp, Homo sapiens
agtcccggacgcaaccccggagccgtctcaggtccctggggtaattgacccaggactcattttcaggaaagcctgaaaatgagtaaaatagtgaaatgaggaatttgaacattttatctttggatggggatcttctgaggatgcaaagagtgattcatccaagccatgtggtaaaatcaggaatttgaagaaaatggaaatgtttacatttttgttgacgtgtatttttctacccctcctaagagggcacagtctcttcacctgtgaaccaattactgttcccagatgtatgaaaatggcctacaacatgacgtttttccctaatctgatgggtcattatgaccagagtattgccgcggtggaaatggagggtacccagactggttaagcagaaaaggaattgattataagagtagcaggtagctcatagaatcgccaggtgggctagaattcaagctcaggctgtaaggaaacatgctacagctaagatgctggcacagcattttcttcctctcgcaaatctggaatgttcaccaaacattgaaactttcctctgcaaagcatttgtaccaacctgcatagaacaaattcatgtggttccaccttgtcgtaaactttgtgagaaagtatattctgattgcaaaaaattaattgacacttttgggatccgatggcctgaggagcttgaatgtgacagattacaatactgtgatgagactgttcctgtaacttttgatccacacacagaatttcttggtcctcagaagaaaacagaacaagtccaaagagacattggattttggtgtccaaggcatcttaagacttctgggggacaaggatataagtttctgggaattgaccagtgtgcgcctccatgccccaacatgtattttaaaagtgatgagctagagtttgcaaaaagttttattggaacagtttcaatattttgtctttgtgcaactctgttcacattccttacttttttaattgatgttagaagattcagatacccagagagaccaattatatattactctgtctgttacagcattgtatctcttatgtacttcattggatttttgctaggcgatagcacagcctgcaataaggcagatgagaagctagaacttggtgacactgttgtcctaggctctcaaaataaggcttgcaccgttttgttcatgcttttgtattttttcacaatggctggcactgtgtggtgggtgattcttaccattacttggttcttagctgcaggaagaaaatggagttgtgaagccatcgagcaaaaagcagtgtggtttcatgctgttgcatggggaacaccaggtttcctgactgttatgcttcttgctatgaacaaagttgaaggagacaacattagtggagtttgctttgttggcctttatgacctggatgcttctcgctactttgtactcttgccactgtgcctttgtgtgtttgttgggctctctcttcttttagctggcattatttccttaaatcatgttcgacaagtcatacaacatgatggccggaaccaagaaaaactaaagaaatttatgattcgaattggagtcttcagcggcttgtatcttgtgccattagtgacacttctcggatgttacgtctatgagcaagtgaacaggattacctgggagataacttgggtctctgatcattgtcgtcagtaccatatcccatgtccttatcaggcaaaagcaaaagctcgaccagaattggctttatttatgataaaatacctgatgacattaattgttggcatctctgctgtcttctgggttggaagcaaaaagacatgcacagaatgggctgggttttttaaacgaaatcgcaagagagatccaatcagtgaaagtcgaagagtactacaggaatcatgtgagtttttcttaaagcacaattctaaagttaaacacaaaaagaagcactataaaccaagttcacacaagctgaaggtcatttccaaatccatgggaaccagcacaggagctacagcaaatcatggcacttctgcagtagcaattactagccatgattacctaggacaagaaactttgacagaaatccaaacctcaccagaaacatcaatgagagaggtgaaagcggacggagctagcacccccaggttaagagaacaggactgtggtgaacctgcctcgccagcagcatccatctccagactctctggggaacaggtcgacgggaagggccaggcaggcagtgtatctgaaagtgcgcggagtgaaggaaggattagtccaaagagtgatattactgacactggcctggcacagagcaacaatttgcaggtccccagttcttcagaaccaagcagcctcaaaggttccacatctctgcttgttcacccggtttcaggagtgagaaaagagcagggaggtggttgtcattcagatacttgaagaacattttctctcgttactcagaagcaaatttgtgttacactggaagtgacctatgcactgttttgtaagaatcactgttacattcttcttttgcacttaaagttgcattgcctactgttatactggaaaaaatagagttcaagaataatatgactcatttcacacaaaggttaatgacaacaatatacctgaaaacagaaaatgtgcaggttaataatatttttttaatagtgtgggaggacagagttagaggaatcttccttttctatttatg

SEQ ID NO: 11262 - DNA, 2006 bp, Homo sapiens
gtgcggctctcgaggcagctccagtcccggacgcaaccccggagccgtctcaggtccctggggggaacggtgggttagacggggacgggaagggacagcggccttcgaccgccccccgagtaattgacccaggactcattttcaggaaagcctgaaaatgagtaaaatagtgaaatgaggaatttgaacattttatctttggatggggatcttctgaggatgcaaagagtgattcatccaagccatgtggtaaaatcaggaatttgaagaaaatggaaatgtttacatttttgttgacgtgtatttttctacccctcctaagagggcacagtctcttcacctgtgaaccaattactgttcccagatgtatgaaaatggcctacaacatgacgtttttccctaatctgatgggtcattatgaccagagtattgccgcggtggaaatggagttgtgaagccatcgagcaaaaagcagtgtggtttcatgctgttgcatggggaacaccaggtttcctgactgttatgcttcttgctatgaacaaagttgaaggagacaacattagtggagtttgctttgttggcctttatgacctggatgcttctcgctactttgtactcttgccactgtgcctttgtgtgtttgttgggctctctcttcttttagctggcattatttccttaaatcatgttcgacaagtcatacaacatgatggccggaaccaagaaaaactaaagaaatttatgattcgaattggagtcttcagcggcttgtatcttgtgccattagtgacacttctcggatgttacgtctatgagcaagtgaacaggattacctgggagataacttgggtctctgatcattgtcgtcagtaccatatcccatgtccttatcaggcaaaagcaaaagctcgaccagaattggctttatttatgataaaatacctgatgacattaattgttggcatctctgctgtcttctgggttggaagcaaaaagacatgcacagaatgggctgggttttttaaacgaaatcgcaagagagatccaatcagtgaaagtcgaagagtactacaggaatcatgtgagtttttcttaaagcacaattctaaagttaaacacaaaaagaagcactataaaccaagttcacacaagctgaaggtcatttccaaatccatgggaaccagcacaggagctacagcaaatcatggcacttctgcagtagcaattactagccatgattacctaggacaagaaactttgacagaaatccaaacctcaccagaaacatcaatgagagaggtgaaagcggacggagctagcacccccaggttaagagaacaggactgtggtgaacctgcctcgccagcagcatccatctccagactctctggggaacaggtcgacgggaagggccaggcaggcagtgtatctgaaagtgcgcggagtgaaggaaggattagtccaaagagtgatattactgacactggcctggcacagagcaacaatttgcaggtccccagttcttcagaaccaagcagcctcaaaggttccacatctctgcttgttcacccggtttcaggagtgagaaaagagcagggaggtggttgtcattcagatacttgaagaacattttctctcgttactcagaagcaaatttgtgttacactggaagtgacctatgcactgttttgtaagaatcactgttacattcttcttttgcacttaaagttgcattgcctactgttatactggaaaaaatagagttcaagaataatatgactcatttcacacaaaggttaatgacaacaatatacctgaaaacagaaaatgtgcaggttaataatatttttttaatagtgtgggaggacagagttagaggaatcttccttttctatttatgaagattctactcttggtaagagtattttaagatgtactatgctattttacttttttgatataaaatcaagatatttctttgctgaagtatttaaatcttatccttg

SEQ ID NO: 11263 - DNA, 3186 bp, Homo sapiens
acagcatggagtggggttacctgttggaagtgacctcgctgctggccgccttggcgctgctgcagcgctctagcggcgctgcggccgcctcggccaaggagctggcatgccaagagatcaccgtgccgctgtgtaagggcatcggctacaactacacctacatgcccaatcagttcaaccacgacacgcaagacgaggcgggcctggaggtgcaccagttctggccgctggtggagatccagtgctcgcccgatctcaagttcttcctgtgcagcatgtacacgcccatctgcctagaggactacaagaagccgctgccgccctgccgctcggtgtgcgagcgcgccaaggccggctgcgcgccgctcatgcgccagtacggcttcgcctggcccgaccgcatgcgctgcgaccggctgcccgagcaaggcaaccctgacacgctgtgcatggactacaaccgcaccgacctaaccaccgccgcgcccagcccgccgcgccgcctgccgccgccgccgcccggcgagcagccgccttcgggcagcggccacggccgcccgccgggggccaggcccccgcaccgcggcggcggcaggggcggtggcggcggggacgcggcggcgcccccagctcgcggcggcggcggtggcgggaaggcgcggccccctggcggcggcgcggctccctgcgagcccgggtgccagtgccgcgcgcctatggtgagcgtgtccagcgagcgccacccgctctacaaccgcgtcaagacaggccagatcgctaactgcgcgctgccctgccacaacccctttttcagccaggacgagcgcgccttcaccgtcttctggatcggcctgtggtcggtgctctgcttcgtgtccaccttcgccaccgtctccaccttccttatcgacatggagcgcttcaagtacccggagcggcccattatcttcctctcggcctgctacctcttcgtgtcggtgggctacctagtgcgcctggtggcgggccacgagaaggtggcgtgcagcggtggcgcgccgggcgcggggggcgctgggggcgcgggcggcgcggcggcgggcgcgggcgcggcgggcgcgggcgcgggcggcccgggcgggcgcggcgagtacgaggagctgggcgcggtggagcagcacgtgcgctacgagaccaccggccccgcgctgtgcaccgtggtcttcttgctggtctacttcttcggcatggccagctccatctggtgggtgatcttgtcgctcacatggttcctggcggccggtatgaagtggggcaacgaagccatcgccggctactcgcagtacttccacctggccgcgtggcttgtgcccagcgtcaagtccatcgcggtgctggcgctcagctcggtggacggcgacccggtggcgggcatctgctacgtgggcaaccagagcctggacaacctgcgcggcttcgtgctggcgccgctggtcatctacctcttcatcggcaccatgttcctgctggccggcttcgtgtccctcttccgcatccgctcggtcatcaagcaacaggacggccccaccaagacgcacaagctggagaagctgatgatccgcctgggcctgttcaccgtgctctacaccgtgcccgccgcggtggtggtcgcctgcctcttctacgagcagcacaaccgcccgcgctgggaggccacgcacaactgcccgtgcctgcgggacctgcagcccgaccaggcacgcaggcccgactacgccgtcttcatgctcaagtacttcatgtgcctagtggtgggcatcacctcgggcgtgtgggtctggtccggcaagacgctggagtcctggcgctccctgtgcacccgctgctgctgggccagcaagggcgccgcggtgggcgggggcgcgggcgccacggccgcggggggtggcggcgggccggggggcggcggcggcgggggacccggcggcggcggggggccgggcggcggcgggggctccctctacagcgacgtcagcactggcctgacgtggcggtcgggcacggcgagctccgtgtcttatccaaagcagatgccattgtcccaggtctgagcggaggggagggggcgcccaggaggggtggggaggggggcgaggagagccaagtgcagcgaagggacacttgatgggctgaggttcccaccccttcacagtgttgattgctattagcatgataatgaactcttaatggtatccattagctgggacttaaatgactcacttagaacaaagtacctggcattgaagcctcccagacccagccccttttcctccattgatgtgcggggagctcctcccgccacgcgttaatttctgttggctgaggagggtggactctgcggcgtttccagaacccgagatttggagccctccctggctgcacttggctgggtttgcagtcagatacacagatttcacctgggagaacctctttttctccctcgactcttcctacgtaaactcccacccctgacttaccctggaggaggggtgaccgccacctgatgggattgcacggtttgggtattcttaatgaccaggcaaatgccttaagtaaacaaacaagaaatgtcttaattatacaccccacgtaaatacgggtttcttacattagaggatgtatttatataattatttgttaaattgtaaaaaaaaaagtgtaaaatatgtatatatccaaagatatagtgtgtacatttttttgtaaaaagtttagaggcttacccctgtaagaacagatataagtattctattttgtcaataaaatgacttttgataaatgatttaaccattgccctctcccccgcctcttctgagctgtcacctttaaagtgcttgctaaggacgcatggggaaaatggacattttctggcttgtcattctgtacactgaccttaggcatggagaaaattacttgttaaactctagttcttaagttgttagccaagtaaatatcattgttgaactgaaatcaaaattgagtttttgcaccttccccaaagacggtgtttttcatgggagctcttttctgatccatggataacaactctcactttagtggatgtaaatggaacttctgcaaggcagtaattccccttaggccttgttatttatcctgcatggtatcactaaaggtttcaaaaccctg

SEQ ID NO: 11264 - DNA, 2342 bp, Homo sapiens
gctctggctcagcggcggctccggtggcagcggcggtggcggctaggcgggctcggcggctcctgtccctcgggcggctgcccgctcgctgcccagggcgcccggacacacgtgggcggctcagcgatggcccgcgccccgcgacgtggcgggcaggcaccggggcgcgggaccgctgagcccgagtgagccggggccgcgctcccgccttcggcccgggcctcccgggatggccgtggcgcctctgcggggggcgctgctgctgtggcagctgctggcggcgggcggcgcggcactggagatcggccgcttcgacccggagcgcgggcgcggggctgcgccgtgccaggcggtggagatccccatgtgccgcggcatcggctacaacctgacccgcatgcccaacctgctgggccacacgtcgcagggcgaggcggctgccgagctagcggagttcgcgccgctggtgcagtacggctgccacagccacctgcgcttcttcctgtgctcgctctacgcgcccatgtgcaccgaccaggtctcgacgcccattcccgcctgccggcccatgtgcgagcaggcgcgcctgcgctgcgcgcccatcatggagcagttcaacttcggctggccggactcgctcgactgcgcccggctgcccacgcgcaacgacccgcacgcgctgtgcatggaggcgcccgagaacgccacggccggccccgcggagccccacaagggcctgggcatgctgcccgtggcgccgcggcccgcgcgccctcccggagacctgggcccgggcgcgggcggcagtggcacctgcgagaaccccgagaagttccagtacgtggagaagagccgctcgtgcgcaccgcgctgcgggcccggcgtcgaggtgttctggtcccggcgcgacaaggacttcgcgctggtctggatggccgtgtggtcggcgctgtgcttcttctccaccgccttcactgtgctcaccttcttgctggagccccaccgcttccagtaccccgagcgccccatcatcttcctctccatgtgctacaacgtctactcgctggccttcctgatccgtgcggtggccggagcgcagagcgtggcctgtgaccaggaggcgggcgcgctctacgtgatccaggagggcctggagaacacgggctgcacgctggtcttcctactgctctactacttcggcatggccagctcgctctggtgggtggtcctgacgctcacctggttcctggctgccgggaagaaatggggccacgaggccatcgaggcccacggcagctatttccacatggctgcctggggcctgcccgcgctcaagaccatcgtcatcctgaccctgcgcaaggtggcgggtgatgagctgactgggctttgctacgtggccagcacggatgcagcagcgctcacgggcttcgtgctggtgcccctctctggctacctggtgctgggcagtagtttcctcctgaccggcttcgtggccctcttccacatccgcaagatcatgaagacgggcggcaccaacacagagaagctggagaagctcatggtcaagatcggggtcttctccatcctctacacggtgcccgccacctgcgtcatcgtttgctatgtctacgaacgcctcaacatggacttctggcgccttcgggccacagagcagccatgcgcagcggccgcggggcccggaggccggagggactgctcgctgccagggggctcggtgcccaccgtggcggtcttcatgctcaaaattttcatgtcactggtggtggggatcaccagcggcgtctgggtgtggagctccaagactttccagacctggcagagcctgtgctaccgcaagatagcagctggccgggcccgggccaaggcctgccgcgcccccgggagctacggacgtggcacgcactgccactataaggctcccaccgtggtcttgcacatgactaagacggacccctctttggagaaccccacacacctctagccacacaggcctggcgcggggtggctgctgccccctccttgccctccacgccctgccccctgcatcccctagagacagctgactagcagctgcccagctgtcaaggtcaggcaagtgagcaccggggactgaggatcagggcgggaccccgtgaggctcattaggggagatgggggtctcccctaatgcgggggctggaccaggctgagtccccacagggtcctagtggaggatgtggaggggcggggcagaggggtccagccggagtttatttaatgatgtaatttattgttgcgttcctctggaagctgtgactggaataaacccccgcgtggca

SEQ ID NO: 11265 - DNA, 3162 bp, Homo sapiens
acagacgtccctgcggggctcctcctgagcgtccctcctgccagccagggtcgcagccgcagcggcggccgcagctcttagcccacacaggacttgtaaactcttactgcacccttctctcccattaggagcttttcctccctccttccccccaacccctctgtcctcctcactttggggaatttaatgctttctttagcatctttttgtgtgcgtgatctaggggaggagacaccccagagctccaactagctctcagctgaattctacttttgtttttatgtcttcctcgcctcctctcgtgtccctcttatctgactgatctgcgaagtctgatgcttctgccagagggagaggaataaatagatgttgctgcttccgaaggcttagacgttgggaaagagcagcctgggcggcaggggcggtggctggagctcggtaaagctcgtgggaccccattgggggaatttgatccaaggaagcggtgattgccgggggaggagaagctcccagatccttgtgtccacttgcagcgggggaggcggagacggcggagcgggccttttggcgtccactgcgcggctgcaccctgccccatcctgccgggatcatggtctgcggcagcccgggagggatgctgctgctgcgggccgggctgcttgccctggctgctctctgcctgctccgggtgcccggggctcgggctgcagcctgtgagcccgtccgcatccccctgtgcaagtccctgccctggaacatgactaagatgcccaaccacctgcaccacagcactcaggccaacgccatcctggccatcgagcagttcgaaggtctgctgggcacccactgcagccccgatctgctcttcttcctctgtgccatgtacgcgcccatctgcaccattgacttccagcacgagcccatcaagccctgtaagtctgtgtgcgagcgggcccggcagggctgtgagcccatactcatcaagtaccgccactcgtggccggagaacctggcctgcgaggagctgccagtgtacgacaggggcgtgtgcatctctcccgaggccatcgttactgcggacggagctgattttcctatggattctagtaacggaaactgtagaggggcaagcagtgaacgctgtaaatgtaagcctattagagctacacagaagacctatttccggaacaattacaactatgtcattcgggctaaagttaaagagataaagactaagtgccatgatgtgactgcagtagtggaggtgaaggagattctaaagtcctctctggtaaacattccacgggacactgtcaacctctataccagctctggctgcctctgccctccacttaatgttaatgaggaatatatcatcatgggctatgaagatgaggaacgttccagattactcttggtggaaggctctatagctgagaagtggaaggatcgactcggtaaaaaagttaagcgctgggatatgaagcttcgtcatcttggactcagtaaaagtgattctagcaatagtgattccactcagagtcagaagtctggcaggaactcgaacccccggcaagcacgcaactaaatcccgaaatacaaaaagtaacacagtggacttcctattaagacttacttgcattgctggactagcaaaggaaaattgcactattgcacatcatattctattgtttactataaaaatcatgtgataactgattattacttctgtttctcttttggtttctgcttctctcttctctcaacccctttgtaatggtttgggggcagactcttaagtatattgtgagttttctatttcactaatcatgagaaaaactgttcttttgcaataataataaattaaacatgctgttaccagagcctctttgctggagtctccagatgttaatttactttctgcaccccaattgggaatgcaatattggatgaaaagagaggtttctggtattcacagaaagctagatatgccttaaaacatactctgccgatctaattacagccttatttttgtatgccttttgggcattctcctcatgcttagaaagttccaaatgtttataaaggtaaaatggcagtttgaagtcaaatgtcacataggcaaagcaatcaagcaccaggaagtgtttatgaggaaacaacacccaagatgaattatttttgagactgtcaggaagtaaaataaataggagcttaagaaagaacattttgcctgattgagaagcacaactgaaaccagtagccgctggggtgttaatggtagcattcttcttttggcaatacatttgatttgttcatgaatatattaatcagcattagagaaatgaattataactagacatctgctgttatcaccatagttttgtttaatttgcttccttttaaataaacccattggtgaaagtctttttttttctcttcttttaaaataaatcagaattgccgtattgaccaggaaaagattatgtatgcacgtgcaccagggttagtttttaaaagtacatggctccataaaaatgctgtagattacagagtgataaaatatgcaggtttttttgtttttgttttttctgttgtgtgtgtgtctgtatttgtgtacatgtgtgtccttgcactcacacccaaggtggattaaaatacaggcctgcaaactggcctgcactttatcatttggatttgtgctgcttaatgctcagcgaaaaatgtctagtaaaatgaattatggttgtcaggagagaggttatttcgacttttgaaccaattgcacatttctcattacccaagctgtggtgagatcccaggggctgtggtgaacaaatgatgcttttatagatggtccctagcttacaatgattcaatttacaatgcttcaatttaacaatttgttgacttacaatgggtttatcaggatgtaacccaatgcatttcaacttacgatattttcagtttcgaatgggtttatccagatgtaaccccatcgtaaatggcggagcatctgtacttccttcctctggcagagttccttagagcctgtgccaattacttgaaagtttcattctctgccatttacatgtgtgctattagtagaaccaaatttctaagctgtggcgtgctgaaaataaaatgcttatgaagcaaaaa

SEQ ID NO: 11266 - DNA, 1825 bp, Homo sapiens
ctctcgagtctccgccagatccggggcgggtccgcggccgcggcgggaacatggaggagctcctgaggcgcgagctgggctgcagctctgtcagggccacgggccactcggggggcgggtgcatcagccagggccggagctacgacacggatcaaggacgagtgttcgtgaaagtgaaccccaaggcggaggccagaagaatgtttgaaggtgagatggcaagtttaactgccatcctgaaaacaaacacggtgaaagtgcccaagcccatcaaggttctggatgccccaggcggcgggagcgtgctggtgatggagcacatggacatgaggcatctgagcagtcatgctgcaaagcttggagcccagctggccgatttacaccttgataacaagaagcttggagagatgcgcctgaaggaggcgggcacagtggggagaggaggtgggcaggaggaacggccctttgtggcccggtttggatttgacgtggtgacgtgctgtggatacctcccccaggtgaatgactggcaggaggactgggtcgtgttctatgcccggcagcgcattcagccccagatggacatggtggagaaggagtctggggacagggaggccctccagctttggtctgctctgcagttaaagatccctgacctgttccgtgacctggagatcatcccagccttactccacggggacctctggggtggaaacgtagcagaggattcctctgggccggtgatttttgacccagcttctttctacggccactcggaatatgagctggcaatagctggcatgtttgggggctttagcagctccttttactccgcctaccacggcaaaatccccaaggccccaggattcgagaagcgccttcagttgtatcagctctttcactacttgaaccactggaatcattttggatcggggtacagaggatcctccctgaacatcatgaggaatctggtcaagtgagcgggccttactctggaaggaggcctcagaggtttctccacagtcctcttctgggcaaattcttgtttcttcacatgctggactagcttaagaccaatgcagtagcttatttccaagccttgcaaagtatataatatctaagaggaaaggttttgtcatcccagcgttgtccactttgtggggctttgtaggtagacggagccacactacaggcagggtatgagcagagggatgtatggagtgtgggtgactctgagcctcactgctgctgcaaggtggggaaactgtaagtgaacccctgtgggtgcgggggagggtatccggtgcgcagggaggtggccagcgcccccgggcactgctgctcataggtacctttccactgcctcctccctgctctcctgtgcaggaatgtctctgagctgttcacgttgatgcttcttggttggcaagacttgggtgtagacatgaaaccatcttactaaaagcgtcttaaaatgaccaattccagaatcaagcgtattccgttttcttcctgcatgatccctgggccctcccgcaggctgagcaagtctgtaaactgattctgggagaaaccaagctgctggccatagggtgtccttgggtacatccaggagtcttcattgcttctgttattaccccgtctcctctgccattttctacagcttgctgagttgtcattcctttgcaacattaaaatacatgctgaactcatatttttccttccttcactgttgtagtaaagagacatatttcatgaatggcattgatgctaataaatcctttgcacaaaaatttgaataaacttccagtggtttcgataacgt

SEQ ID NO: 11267 - DNA, 1422 bp, Homo sapiens
agatccggggcgggtccgcggccgcggcgggaacatggaggagctcctgaggcgcgagctgggctgcagctctgtcagggccacgggccactcggggggcgggtgcatcagccagggccggagctacgacacggatcaaggacgagtgttcgtgaaagtgaaccccaaggcggaggtgaaaagtgaccccaggtcactggcataggcagccagggtgccgcctgcacctgagaggtcgggtgagtctgtgtcctgtaggtggaacaggactgcagttgaggtgtcgtctgaggacactgacaggccagaagaatgtttgaaggtgagatggcaagtttaactgccatcctgaaaacaaacacggtgaaagtgcccaagcccatcaaggttctggatgccccaggcggcgggagcgtgctggtgatggagcacatggacatgaggcatctgagcagtcatgctgcaaagcttggagcccagctggccgatttacaccttgataacaagaagcttggagagatgcgcctgaaggaggcgggcacagtggggagaggaggtgggcaggaggaacggccctttgtggcccggtttggatttgacgtggtgacgtgctgtggatacctcccccaggtgaatgactggcaggaggactgggtcgtgttctatgcccggcagcgcattcagccccagatggacatggtggagaaggagtctggggacagggaggccctccagctttggtctgctctgcagttaaagatccctgacctgttccgtgacctggagatcatcccagccttactccacggggacctctggggtggaaacgtagcagaggattcctctgggccggtgatttttgacccagcttctttctacggccactcggaatatgagctggcaatagctggcatgtttgggggctttagcagctccttttactccgcctaccacggcaaaatccccaaggccccaggattcgagaagcgccttcagttgtatcagctctttcactacttgaaccactggaatcattttggatcggggtacagaggatcctccctgaacatcatgaggaatctggtcaagtgagcgggccttactctggaaggaggcctcagaggtttctccacagtcctcttctgggcaaattcttgtttcttcacatgctggactagcttaagaccaatgcagtagcttatttccaagccttgcaaagtatataatatctaagaggaaaggttttgtcatcccagcgttgtccactttgtggggctttgtaggtagacggagccacactacaggcagggtatgagcagagggatgtatggagtgtgggtgactctgagcctcactgctgctgcaaggtggggaaactgtaagtgaacccctgtgggtgcgggggagggtatccggtgcgca

SEQ ID NO: 11268 - DNA, 1462 bp, Homo sapiens
gcaccacgagcgctgcggacactcggggcggcagtcggtctgtcagtcctcccgccaggtcccgcggcccgcacctgccgcccgcacctgcagctccgcacctgcggccagtgcctactgccctctcttgccgcccgcacctgcagccccgcacctgccgcttgcacctgcagccccgcgctctacccggttcaagcatggctgaccaggcgcccttcgacacggacgtcaacaccctgacccgcttcgtcatggaggagggcaggaaggcccgcggcacgggcgagttgacccagctgctcaactcgctctgcacagcagtcaaagccatctcttcggcggtgcgcaaggcgggcatcgcgcacctctatggcattgctggttctaccaacgtgacaggtgatcaagttaagaagctggacgtcctctccaacgacctggttatgaacatgttaaagtcatcctttgccacgtgtgttctcgtgtcagaagaagataaacacgccatcatagtggaaccggagaaaaggggtaaatatgtggtctgttttgatccccttgatggatcttccaacatcgattgccttgtgtccgttggaaccatttttggcatctatagaaagaaatcaactgatgagccttctgagaaggatgctctgcaaccaggccggaacctggtggcagccggctacgcactgtatggcagtgccaccatgctggtccttgccatggactgtggggtcaactgcttcatgctggacccggccatcggggagttcattttggtggacaaggatgtgaagataaaaaagaaaggtaaaatctacagccttaacgagggctacgccagggactttgaccctgccgtcactgagtacatccagaggaagaagttccccccagataattcagctccttatggggcccggtatgtgggctccatggtggctgatgttcatcgcactctggtctacggagggatatttctgtaccccgctaacaagaagagccccaatggaaagctgagactgctgtacgaatgcaaccccatggcctacgtcatggagaaggctgggggaatggccaccactgggaaggaggccgtgttagacgtcattcccacagacattcaccagagggcgccggtgatcttgggatcccccgacgacgtgctcgagttcctgaaggtgtatgagaagcactctgcccagtgagcacctgccctgcctgcatccggagaattgcctctacctggaccttttgtctcacacagcagtaccctgacctgctgtgcaccttacattcctagagagcagaaataaaaagcatgactatttccaccatcaaatgctgtagaatgcttggcactccctaaccaaatgctgtctccataatgccactggtgttaagatatattttgagtggatggaggagaaataaacttattcctccttaaaaaaaa

SEQ ID NO: 11269 - DNA, 629 bp, Homo sapiens
acatcttggaaattcaaatactcaatagctctcgaattctaggaatcttgagaagaggcctggattaaggattcagacgtgggccctcagatggctatggcattgctggttctaccaacgtgacaggtgatcaagttaagaagctggacgtcctctccaacgacctggttatgaacatgttaaagtcatcctttgccacgtgtgttctcgtgtcagaagaagataaacacgccatcatagtggaaccggagaaaaggggtaaatatgtggtctgttttgatccccttgatggatcttccaacatcgattgccttgtgtccgttggaaccatttttggcatctatagaaagaaatcaactgatgagccttctgagaaggatgctctgcaaccaggccggaacctggtggcagccggctacgcactgtatggcagtgccaccatgctggtccttgccatggactgtggggtcaactgcttcatgctggacccggccatcggggagttcattttggtggacaaggatgtgaagataaaaaagaaaggtaaaatctacagccttaacgagggctacgccagggactttgaccctgccgtcactgagtacatccagaggaagaagttcccccca

SEQ ID NO: 11270 - DNA, 1487 bp, Homo sapiens
attgtggctaccagggggtcaggatgcgggcggtggagccctctggcctttgtgtggtagccgaggactctgtgtcagcgaccgttttccgggaaacttccgggcgagactcacatcttggaaattcaaatactcaatagctctcgaattctaggaatcttgagaagaggcctggattaaggattcagacgtgggccctcagatggccccgcgctctacccggttcaagcatggctgaccaggcgcccttcgacacggacgtcaacaccctgacccgcttcgtcatggaggagggcaggaaggcccgcggcacgggcgagttgacccagctgctcaactcgctctgcacagcagtcaaagccatctcttcggcggtgcgcaaggcgggcatcgcgcacctctatggcattgctggttctaccaacgtgacaggtgatcaagttaagaagctggacgtcctctccaacgacctggttatgaacatgttaaagtcatcctttgccacgtgtgttctcgtgtcagaagaagataaacacgccatcatagtggaaccggagaaaaggggtaaatatgtggtctgttttgatccccttgatggatcttccaacatcgattgccttgtgtccgttggaaccatttttggcatctatagaaagaaatcaactgatgagccttctgagaaggatgctctgcaaccaggccggaacctggtggcagccggctacgcactgtatggcagtgccaccatgctggtccttgccatggactgtggggtcaactgcttcatgctggacccggccatcggggagttcattttggtggacaaggatgtgaagataaaaaagaaaggtaaaatctacagccttaacgagggctacgccagggactttgaccctgccgtcactgagtacatccagaggaagaagttccccccagataattcagctccttatggggcccggtatgtgggctccatggtggctgatgttcatcgcactctggtctacggagggatatttctgtaccccgctaacaagaagagccccaatggaaagctgagactgctgtacgaatgcaaccccatggcctacgtcatggagaaggctgggggaatggccaccactgggaaggaggccgtgttagacgtcattcccacagacattcaccagagggcgccggtgatcttgggatcccccgacgacgtgctcgagttcctgaaggtgtatgagaagcactctgcccagtgagcacctgccctgcctgcatccggagaattgcctctacctggaccttttgtctcacacagcagtaccctgacctgctgtgcaccttacattcctagagagcagaaataaaaagcatgactatttccaccatcaaatgctgtagaatgcttggcactccctaaccaaatgctgtctccataatgccactggtgttaagatatattttgagtggatggaggagaaataaacttattcctcctt

SEQ ID NO: 11271 - DNA, 1305 bp, Homo sapiens
gctgcagccctcagaagtaagcaaggtttcctgccgggagaaaaggatttgaagcattccagccaaaatgacggacagaagccccttcgaaaccgacatgctcaccctgacccgctacgttatggaaaaggggcgtcaggccaaagggactggggagctcacccagctgctgaactcaatgctgacggccatcaaagccatctcctcggctgtgcgcaaggccggtctggcccacctgtatggaatcgcaggaagcgttaacgtgacgggagatgaggtgaagaaactggatgtgctatccaattccctggtgatcaacatggtccaatcctcctatagtacctgcgtcctggtctcagaagagaataaggacgccatcatcaccgccaaggagaagcgggggaaatacgtggtctgctttgacccactggatggatcttccaatattgactgcctggcctccatcggaaccatctttgccatctatagaaagacctcagaggatgagccttctgaaaaggatgccctgcagtgtggccgcaatattgtggccgcaggttatgcgctgtacggtagtgcaaccctggtggctctctccacagggcaaggcgtggacctcttcatgcttgacccggctcttggtgaatttgtcctggtggaaaaagatgtcaagattaagaagaaaggaaagatttacagcctgaatgagggctatgccaagtattttgatgcggccaccactgaatatgtgcagaaaaagaaattccctgaggatggcagtgctccctatggggccaggtatgtgggctccatggtggctgacgtgcaccgcaccctggtctatggaggaatcttcctgtacccagccaaccagaagagccctaagggcaagctccggctcctgtatgaatgcaatcccgtggcctacatcattgagcaggcaggaggcttggcgaccacggggacccagcctgtactggacgtgaagcccgaggcaattcaccagcgagtccccctcattctggggtcaccagaggatgtgcaggaatatctcacctgtgtgcagaaaaatcaggcaggcagctagcgagtttgaccccacatgccctcttctgtttgtcttgcaccttgtctaaggaccctaaatgaacgataaacagagatggtagctatgagtatacaaaaggtaaatccacttaatcacatacagaagagcaacaacaaactgcttacgacaggtttggaagccacaggcgattctatggtcaatgtgaaggactagaaataaaaacccacatgtggaaa

SEQ ID NO: 11272 - DNA, 2084 bp, Homo sapiens
cacactctgcctttggacgtgagagagagcgcacctttcacttgagcttcaacatgggaaagggaaatgaagactccgatctccactgctcctccatccagtgctccactgaccagccccctttccaacagatctcctttacagaaaagggctcagatgagaagaaaccattcaaagaaaaaggcaagaccgccttctcccattccagtgagaagcacatacaaaggcaaggatcggagcccaatccaaacaaggagaattctgaggaaaccaagctcaaggccgggaacagcactgctggatcagaaccagagtccagctcatatcgggaaaactgcaggaaaagaaaaatgagttccaaggacagctgccaagacacagcagggaactgtccagaaaaggagtgcagcttgtcattgaataaaaaatcaagatcctccactgctgtgcacaacagtgaaatccaggagacctgtgatgcccaccataggggacattccagggcttgcactgggcacagcaagcggcataggtctcgggccctaggagtccaaacaccgtcaattcgaaaaagcttggtgacttctgtgcgagctatgtcagaggctgtttatcaagacctagcccaggtgtgggcacagcagatccattctccacttacctgtgagcagctgacactgctcactcggctccgggggcctctgtgtgcccaggtgcagaccttgtattccatggccacccaggcagcttatgtcttccctgctgagagctggcttgtcccagccacactgccaggtcctggggaatcagccctggatagagaagcccatcccttccctgggcaggagataactgagactgtcagtggatcagatgaggctaagctgtgagcaccctgaccctattcagcagagatgcagctctgggaatgagaacaaggatctgcttcttctcagattcttccagatgaccagcagtgacaattttagacacactgtgttaataaatgacagaacctgaagaagtcataggaaagaaacttgagcggtatactcagaatggtgagagccctgaattttgcagaccgctaagactatagacaaattttatatttcatgttagacatttgatgccttttggatgtctgatgacagtcatgcatttctatataatcagaaaaacattagaatgtaatcgtgaatttgcatattttagattgtagaaaagtaaatataaaattatgtgctccttttttgtttttttttttttttgagacagtcttgctatgttacccaggctggagtgcagtggcacaatcttagctcactgcaacctctgcttcctgggttcaaacaattctcatgcctcagcctcccaagcagctgggactacaggcatgtactgctatgcctggctaattttttttttcctgtattgttagtagagacagagttttgtcactttggccaggttggcctcgaactcaggtgatctgccagcctccgcctcccaacgtgctgggattacaggcatgagccgccttaccaagaaattgcttctcttttaatccagaaaaggttgtaggctctcactcttccagcctgaacccatggagtactaatatccacaaaccattaatagcactccctgtgggaaaatgtctatatatttttagtttgatataattatagtaaaattactatgcaagctgtttacttttaatatttctacataaaatttaagtcaagatatagtaaatggtaaatgattgtacttatttattgacctgcctcatgtttcatttcattttaaacatcctaaatttatattttattatattttatacatttcaattgattgtactatattgcaggatatggagatttcatcacgtactacaatacagtgtattttgttatatttgacgtatattctacttgtattttgtactgagatcatacactatttcattatctaagtgtattaattgtttggttgctttataattttcattttatgtaatgaaataaacaatgttgtttggaattttaaatttctttcatatggaatttgtatttaataaa

SEQ ID NO: 11273 - DNA, 1986 bp, Homo sapiens
ggatacgtcgacaatagatgacggggctcacgttgtacgttcacatcaggtcccggcccgccggaacctgggcgatccacgatgccgagtttgccacgctgcgacagcccataggcttgcccccccgggcattcgggtggactacgaacacaaactgaagccctaggacttgtcgcccgtttgcgctctcgccgaggcacaggctgctcgcggaccaccctgctccgaaaactaagaaggggaccagtagacggggtggattcgaggtggggacatgggacgcagcggtcggagccgcctggaggggtacccggtggtcccgatggagctatcatctttgagaggtaggtggtagcccattcatctggttactgatactggccggcatcagtggactgtcggcaggtccttgagcaactggtgtgtgaaatgggacggacgtcaaaggacaagcgggatgtctactaccgcctggccaaggagaatggctggcgtgctcgcagcgccttcaaactgctacaactggataaggaattccaactcttccaaggcgtgacacgggcagttgacctgtgtgcagccccaggcagctggagccaggtgctgagccagaagatcgggggccaagggtccggccacgtggtggctgtggacctgcaggctatggctccactaccaggtgtggtacagatccagggggacatcacccagctgtccactgccaaggagatcatccagcactttaagggctgccctgcggacctagtggtgtgtgacggggctcctgatgtaaccggtctccatgatgttgatgagtatatgcaggcccagctcctcctagctgctctgaacattgctacacatgtcctgaagccagggggctgctttgtggccaagatattccgaggccgggatgtgacgctcctctacagccagctgcaggtcttcttctccagcgtgctgtgtgccaagcccaggagcagccggaactctagcatcgaggccttcgctgtctgtcagggctatgaccctcccgagggcttcatcccggacctgagcaaacccctgctggaccattcttacgatttcaaccagctggatggtcccacccgcatcattgtgccttttgtgacctgtggggacctgagctcctatgattcggaccgcagttacccactggacctagagggcggctcagagtacaagtacactccacccacacagccccccatctcgccaccataccaggaggcctgcacgttgaagaggaaggggcagctggccaaggagatccgcccccaggactgccccatcagcagagtggacacgtttccccagcccctggccgcccctcagtgccacaccctgctggcccctgagatggaagacaatgaaatgagttgttcaccttaacccattacgctggcaaactgatacaactcagaaactgctcaatgtcaggaaaaccggaacttgttgatgaacttgttttcaaaatatcatctcatcaacgaggcctggacaaacaagccctgaggagggatctgcaacaaccctgaagacaacaaggaaagaaaccatgaaagtctgtctgtactgcagtgggaattcttgagtgaggtcttacctcttctttaaacctcttcaggagtgtcctgattatgtccagaattttccctaaaggcagggattcttaacctggatagaagccaggggtaaccatgaacttgatggaagaaaatgttacatctttattttcagcaatgaaactgaaatttagccttactcccaagttataaatgctggcaacaaatcacagtagtaaaagcagtacctgggattttcccaccaatacaaaccagttacagcaactgtaatgtaacataaaaagggcatcttgaagtattgttcatatttgtcacctcttggaatgatagcagatcctgtaagttgatgtattaattaaaaagcccatatattactgca

SEQ ID NO: 11274 - DNA, 1892 bp, Homo sapiens
ggatacgtcgacaatagatgacggggctcacgttgtacgttcacatcaggtcccggcccgccggaacctgggcgatccacgatgccgagtttgccacgctgcgacagcccataggcttgcccccccgggcattcgggtggactacgaacacaaactgaagccctaggacttgtcgcccgtttgcgctctcgccgaggcacaggctgctcgcggaccaccctgctccgaaaactaagaggtaggtggtagcccattcatctggttactgatactggccggcatcagtggactgtcggcaggtccttgagcaactggtgtgtgaaatgggacggacgtcaaaggacaagcgggatgtctactaccgcctggccaaggagaatggctggcgtgctcgcagcgccttcaaactgctacaactggataaggaattccaactcttccaaggcgtgacacgggcagttgacctgtgtgcagccccaggcagctggagccaggtgctgagccagaagatcgggggccaagggtccggccacgtggtggctgtggacctgcaggctatggctccactaccaggtgtggtacagatccagggggacatcacccagctgtccactgccaaggagatcatccagcactttaagggctgccctgcggacctagtggtgtgtgacggggctcctgatgtaaccggtctccatgatgttgatgagtatatgcaggcccagctcctcctagctgctctgaacattgctacacatgtcctgaagccagggggctgctttgtggccaagatattccgaggccgggatgtgacgctcctctacagccagctgcaggtcttcttctccagcgtgctgtgtgccaagcccaggagcagccggaactctagcatcgaggccttcgctgtctgtcagggctatgaccctcccgagggcttcatcccggacctgagcaaacccctgctggaccattcttacgacccagatttcaaccagctggatggtcccacccgcatcattgtgccttttgtgacctgtggggacctgagctcctatgattcggaccgcagttacccactggacctagagggcggctcagagtacaagtacactccacccacacagccccccatctcgccaccataccaggaggcctgcacgttgaagaggaaggggcagctggccaaggagatccgcccccaggactgccccatcagcagagtggacacgtttccccagcccctggccgcccctcagtgccacaccctgctggcccctgagatggaagacaatgaaatgagttgttcaccttaacccattacgctggcaaactgatacaactcagaaactgctcaatgtcaggaaaaccggaacttgttgatgaacttgttttcaaaatatcatctcatcaacgaggcctggacaaacaagccctgaggagggatctgcaacaaccctgaagacaacaaggaaagaaaccatgaaagtctgtctgtactgcagtgggaattcttgagtgaggtcttacctcttctttaaacctcttcaggagtgtcctgattatgtccagaattttccctaaaggcagggattcttaacctggatagaagccaggggtaaccatgaacttgatggaagaaaatgttacatctttattttcagcaatgaaactgaaatttagccttactcccaagttataaatgctggcaacaaatcacagtagtaaaagcagtacctgggattttcccaccaatacaaaccagttacagcaactgtaatgtaacataaaaagggcatcttgaagtattgttcatatttgtcacctcttggaatgatagcagatcctgtaagttgatgtattaattaaaaagcccatatattactgcatctcaa

SEQ ID NO: 11275 - DNA, 1427 bp, Homo sapiens
acgttcacatcaggtcccggcccgccggaacctgggcgatccacgatgccgagtttgccacgctgcgacagcccataggcttgcccccccgggcattcgggtggactacgaacacaaactgaagccctaggacttgtcgcccgtttgcgctctcgccgaggcacaggctgctcgcggaccaccctgctccgaaaactaagctgtccactgccaaggagatcatccagcactttaagggctgccctgcggacctagtggtgtgtgacggggctcctgatggctctgaacattgctacacatgtcctgaagccagggggctgctttgtggccaagatattccgaggccgggatgtgacgctcctctacagccagctgcaggtcttcttctccagcgtgctgtgtgccaagcccaggagcagccggaactctagcatcgaggccttcgctgtctgtcagggctatgaccctcccgagggcttcatcccggacctgagcaaacccctgctggaccattcttacgacccagatttcaaccagctggatggtcccacccgcatcattgtgccttttgtgacctgtggggacctgagctcctatgattcggaccgcagttacccactggacctagagggcggctcagagtacaagtacactccacccacacagccccccatctcgccaccataccaggaggcctgcacgttgaagaggaaggggcagctggccaaggagatccgcccccaggactgccccatcagcagagtggacacgtttccccagcccctggccgcccctcagtgccacaccctgctggcccctgagatggaagacaatgaaatgagttgttcaccttaacccattacgctggcaaactgatacaactcagaaactgctcaatgtcaggaaaaccggaacttgttgatgaacttgttttcaaaatatcatctcatcaacgaggcctggacaaacaagccctgaggagggatctgcaacaaccctgaagacaacaaggaaagaaaccatgaaagtctgtctgtactgcagtgggaattcttgagtgaggtcttacctcttctttaaacctcttcaggagtgtcctgattatgtccagaattttccctaaaggcagggattcttaacctggatagaagccaggggtaaccatgaacttgatggaagaaaatgttacatctttattttcagcaatgaaactgaaatttagccttactcccaagttataaatgctggcaacaaatcacagtagtaaaagcagtacctgggattttcccaccaatacaaaccagttacagcaactgtaatgtaacataaaaagggcatcttgaagtattgttcatatttgtcacctcttggaatgatagcagatcctgtaagttgatgtattaattaaaaagcccatatattactgc

SEQ ID NO: 11276 - DNA, 1678 bp, Homo sapiens
gatactggccggcatcagtggactgtcggcaggtccttgagcaactggtgtgtgaaatgggacggacgtcaaaggacaagcgggatgtctactaccgcctggccaaggagaatggctggcgtgctcgcagcgccttcaaactgctacaactggataaggaattccaactcttccaaggcgtgacacgggcagttgacctgtgtgcagccccaggcagctggagccaggtgctgagccagaagatcgggggccaagggtccggccacgtggtggctgtggacctgcaggctatggctccactaccaggtgtggtacagatccagggggacatcacccagctgtccactgccaaggagatcatccagcactttaagggctgccctgcggacctagtggtgtgtgacggggctcctgatgtaaccggtctccatgatgttgatgagtatatgcaggcccagctcctcctagctgctctgaacattgctacacatgtcctgaagccagggggctgctttgtggccaagatattccgaggccgggatgtgacgctcctctacagccagctgcaggtcttcttctccagcgtgctgtgtgccaagcccaggagcagccggaactctagcatcgaggccttcgctgtctgtcagggctatgaccctcccgagggcttcatcccggacctgagcaaacccctgctggaccattcttacgatttcaaccagctggatggtcccacccgcatcattgtgccttttgtgacctgtggggacctgagctcctatgattcggaccgcagttacccactggacctagagggcggctcagagtacaagtacactccacccacacagccccccatctcgccaccataccaggaggcctgcacgttgaagaggaaggggcagctggccaaggagatccgcccccaggactgccccatcagcagagtggacacgtttccccagcccctggccgcccctcagtgccacaccctgctggcccctgagatggaagacaatgaaatgagttgttcaccttaacccattacgctggcaaactgatacaactcagaaactgctcaatgtcaggaaaaccggaacttgttgatgaacttgttttcaaaatatcatctcatcaacgaggcctggacaaacaagccctgaggagggatctgcaacaaccctgaagacaacaaggaaagaaaccatgaaagtctgtctgtactgcagtgggaattcttgagtgaggtcttacctcttctttaaacctcttcaggagtgtcctgattatgtccagaattttccctaaaggcagggattcttaacctggatagaagccaggggtaaccatgaacttgatggaagaaaatgttacatctttattttcagcaatgaaactgaaatttagccttactcccaagttataaatgctggcaacaaatcacagtagtaaaagcagtacctgggattttcccaccaatacaaaccagttacagcaactgtaatgtaacataaaaagggcatcttgaagtattgttcatatttgtcacctcttggaatgatagcagatcctgtaagttgatgtattaattaaaaagcccatatattactgcatctcaattttgtttcaatttaatatatagtaataattgtaattcaatgtaattggcttccattgt

SEQ ID NO: 11277 - DNA, 1601 bp, Homo sapiens
gcggcgcgctgcaggcgcggggaacaccaatggcggggtacttgaagctggtgtgtgtttcctttcagcgtcaagggttccacactgttgggagtcgctgcaagaatcggacaggcgctgagcacctgtggctgacccgacatctcagggacccatttgtgaaggctgcgaaggtggagagttaccggtgtcgaagcgccttcaagctcctggaggtgaacgagaggcaccagattctgcggcccggccttcgggtgttagactgtggggcagctcctggggcctggagtcaggtggcggtgcagaaggtcaacgccgcaggcacagatcccagctctcctgttggcttcgtgcttggggtagatcttcttcacatattccccctggaaggagcaacttttctgtgccctgctgacgtgactgacccgagaacctcacagagaatcctcgaggtgcttcctggcaggagagcagatgtgattctgagcgacatggcgcccaatgccacagggttccgggacctcgatcatgacaggctcatcagcctgtgcctgacccttctcagcgtgaccccagacatcctgcaacctggggggacattcctttgtaaaacctgggctggaagtcaaagccgtcggttacagaggagactgacagaggaattccagaatgtaaggatcatcaaacctgaagccagcaggaaagagtcatcagaagtgtacttcttggccacacagtaccacggaaggaagggcactgtgaagcagtgaggatttcttgtgccattttcataatggtcattagctccttttaagctagaaacgtagcctgagctcctgaagagttcctgggagatttgagctgattttggagatggagcaggacaagtggggagtctctctctctctttctctctctctctttttaaccaaaaagagatgacaaaactaagttcaggggccatggaaaatgaaaaagtccgctatattgtgatttgggaagagaaagttatcaagagaaagaggtgaggatggaaggatggagaaaaacagactgtgggaaggatcagaaggaatccgccgaggcagggatgggtgtgcccatgtgtgccttgacgggacttcatcttatagactgttaaactgtcacacacaaacaggctttccacccctgctctgagagcaccacgcacagatttccagttcttagtgtggctgtttaaagtagaaaatctgggggctgggtgaggccactcatgcctgtaaacccagggctttagaaggctgaggctgggggattgcttgaagtcaggagttcaagaccaacctgggcaacatagcaacaccccccatgtctacaaaaatgaaaaaccaaaaagcaaaccaaaagaaaaatctgaaatttccatctggggattaacttctgtctttctggtgaacaatatagcaattcacgcattcttcaagcagcaaaagttcccggaacaattagggaagacgtatggtctgaatttatccaggcagtgggtctgctttggtttttgctggaaatttatatcagtgtctgggctcccaagaacataaatgtaattgccaaagcaa

SEQ ID NO: 11278 - DNA, 1628 bp, Homo sapiens
acttccggcggcgcgctgcaggcgcggggaacaccaatggcggggtacttgaagctggtgtgtgtttcctttcagcgtcaagggttccacactgttgggagtcgctgcaagaatcggacaggcgctgagcacctgtggctgacccgacatctcagggacccatttgtgaaggctgcgaaggtggagagttaccggtgtcgaagcgccttcaagctcctggaggtgaacgagaggcaccagattctgcggcccggccttcgggtgttagactgtggggcagctcctggggcctggagtcaggtggcggtgcagaaggtcaacgccgcaggcacagatggagtctcactcttgcccaggctgcagtgcaatggtgtgatctcggctcactgcaacctctgcctacctggttcaagcgattctcctgcctcagcctcccaaatcccagctctcctgttggcttcgtgcttggggtagatcttcttcacatattccccctggaaggagcaacttttctgtgccctgctgacgtgactgacccgagaacctcacagagaatcctcgaggtgcttcctggcaggagagcagatgtgattctgagcgacatggcgcccaatgccacagggttccgggacctcgatcatgacaggctcatcagcctgtgcctgacccttctcagcgtgaccccagacatcctgcaacctggggggacattcctttgtaaaacctgggctggaagtcaaagccgtcggttacagaggagactgacagaggaattccagaatgtaaggatcatcaaacctgaagccagcaggaaagagtcatcagaagtgtacttcttggccacacagtaccacggaaggaagggcactgtgaagcagtgaggatttcttgtgccattttcataatggtcattagctccttttaagctagaaacgtagcctgagctcctgaagagttcctgggagatttgagctgattttggagatggagcaggacaagtggggagtctctctctctctttctctctctctctttttaaccaaaaagagatgacaaaactaagttcaggggccatggaaaatgaaaaagtccgctatattgtgatttgggaagagaaagttatcaagagaaagaggtgaggatggaaggatggagaaaaacagactgtgggaaggatcagaaggaatccgccgaggcagggatgggtgtgcccatgtgtgccttgacgggacttcatcttatagactgttaaactgtcacacacaaacaggctttccacccctgctctgagagcaccacgcacagatttccagttcttagtgtggctgtttaaagtagaaaatctgggggctgggtgaggccactcatgcctgtaaacccagggctttagaaggctgaggctgggggattgcttgaagtcaggagttcaagaccaacctgggcaacatagcaacaccccccatgtctacaaaaatgaaaaaccaaaaagcaaaccaaaagaaaaatctgaaatttccatctggggattaacttctgtctttctggtgaacaatatagcaattcacgcattcttcaagcagcaaaagttcccggaacaattagggaagacgtatggtctgaatttatcc

SEQ ID NO: 11279 - DNA, 1541 bp, Homo sapiens
agcgatgcgggctccggggatgaggtcgcggccgagtcggtgcgtcgggcccagcctccgcgccgctacaccccagactggccgagcctggattctcggccgctgccggcctggttcgacgaagccaagttcggggtgttcatccactggggcgtgttctcggtgcccgcctggggcagcgagtggttctggtggcactggcagggcgaggggcggccgcagtaccagcgcttcatgcgcgacaactacccgcccggcttcagctacgccgacttcggaccgcagttcactgcgcgcttcttccacccggaggagtgggccgacctcttccaggccgcgggcgccaagtatgtagttttgacgacaaagcatcacgaaggcttcacaaactggccgagtcctgtgtcttggaactggaactccaaagacgtggggcctcatcgggatttggttggtgaattgggaacagctctccggaagaggtgagtgtccagggatggttactctgttatctctttgataagaaaaatggcttcaaaacacagcattttgtcagtgcaaaaacaatgccagagctgtacgaccttgttaacagctataaacctgatctgatctggtctgatggggagtgggaatgtcctgatacttactggaactccacaaattttctttcatggctctacaatgacagccctgtcaaggatgaggtggtagtaaatgaccgatggggtcagaactgttcctgtcaccatggaggatactataactgtgaagataaattcaagccacagagcttgccagatcacaagtgggagatgtgcaccagcattgacaagttttcctggggctatcgtcgtgacatggcattgtctgatgttacagaagaatctgaaatcatttcggaactggttcagacagtaagtttgggaggcaactatcttctgaacattggaccaactaaagatggactgattgttcccatcttccaagaaaggcttcttgctgttgggaaatggctgagcatcaatggggaggctatctatgcctccaaaccatggcgggtgcaatgggaaaagaacacaacatctgtatggtatacctcaaagggatcggctgtttatgccatttttctgcactggccagaaaatggagtcttaaaccttgaatcccccataactacctcaactacaaagataacaatgctgggaattcaaggagatctgaagtggtccacagatccagataaaggtctcttcatctctctaccccagttgccaccctctgctgtccccgcagagtttgcttggactataaagctgacaggagtgaagtaatcatttgagtgcaagaagaaagaggcgctgctcactgttttcctgcttcagtttttctcttatagtaccatcactataatcaacgaacttctcttctccacccagagatggcttttccaacacattttaattaaaggaactgagtacattaccctgatgtctaaatggaccaaagatctgagatccattgtgattatatctgtatca

SEQ ID NO: 11280 - DNA, 2047 bp, Homo sapiens
gggtagcgatgcgggctccggggatgaggtcgcggccggcgggtcccgcgctgttgctgctgctgctcttcctcggagcggccgagtcggtgcgtcgggcccagcctccgcgccgctacaccccagactggccgagcctggattctcggccgctgccggcctggttcgacgaagccaagttcggggtgttcatccactggggcgtgttctcggtgcccgcctggggcagcgagtggttctggtggcactggcagggcgaggggcggccgcagtaccagcgcttcatgcgcgacaactacccgcccggcttcagctacgccgacttcggaccgcagttcactgcgcgcttcttccacccggaggagtgggccgacctcttccaggccgcgggcgccaagtatgtagttttgacgacaaagcatcacgaaggcttcacaaactggccgagtcctgtgtcttggaactggaactccaaagacgtggggcctcatcgggatttggttggtgaattgggaacagctctccggaagaggaacatccgctatggactataccactcactcttagagtggttccatccactctatctacttgataagaaaaatggcttcaaaacacagcattttgtcagtgcaaaaacaatgccagagctgtacgaccttgttaacagctataaacctgatctgatctggtctgatggggagtgggaatgtcctgatacttactggaactccacaaattttctttcatggctctacaatgacagccctgtcaaggatgaggtggtagtaaatgaccgatggggtcagaactgttcctgtcaccatggaggatactataactgtgaagataaattcaagccacagagcttgccagatcacaagtgggagatgtgcaccagcattgacaagttttcctggggctatcgtcgtgacatggcattgtctgatgttacagaagaatctgaaatcatttcggaactggttcagacagtaagtttgggaggcaactatcttctgaacattggaccaactaaagatggactgattgttcccatcttccaagaaaggcttcttgctgttgggaaatggctgagcatcaatggggaggctatctatgcctccaaaccatggcgggtgcaatgggaaaagaacacaacatctgtatggtatacctcaaagggatcggctgtttatgccatttttctgcactggccagaaaatggagtcttaaaccttgaatcccccataactacctcaactacaaagataacaatgctgggaattcaaggagatctgaagtggtccacagatccagataaaggtctcttcatctctctaccccagttgccaccctctgctgtccccgcagagtttgcttggactataaagctgacaggagtgaagtaatcatttgagtgcaagaagaaagaggcgctgctcactgttttcctgcttcagtttttctcttatagtaccatcactataatcaacgaacttctcttctccacccagagatggcttttccaacacattttaattaaaggaactgagtacattaccctgatgtctaaatggaccaaagatctgagatccattgtgattatatctgtatcaggtcagcagaagaaggaactgagcagttgaactctgagttcatcaattgtaatatttggaaattatctacaatggaatcttccctctgttctctgataacctacttgcttactcaatgcctttaagccaagtcaccctgttgcctatgggaggaggtggaaggatttggcaagctcaaccacatgctatttagttagcatcagttgtcaccaacagtctttctgcaaagggcaggagagctttgggggaaaggaaaaggcttaccaggctgctatggtcaactcttcagaaattttcagagcaatctaaaagcgccaaaattcgctatgtttacagtgatactattaagaaaatgaatgtgattctgctctgtctttttaagtatgatcaaataaaaaatttgtacatcacaatcatttctaccaaaaaaa

SEQ ID NO: 11281 - DNA, 1690 bp, Homo sapiens
cagcgctcccgaggccgcgggagcctgcagagaggacagccggcctgcgccgggacatgcggccccaggagctccccaggctcgcgttcccgttgctgctgttgctgttgctgctgctgccgccgccgccgtgccctgcccacagcgccacgcgcttcgaccccacctgggagtccctggacgcccgccagctgcccgcgtggtttgaccaggccaagttcggcatcttcatccactggggagtgttttccgtgcccagcttcggtagcgagtggttctggtggtattggcaaaaggaaaagataccgaagtatgtggaatttatgaaagataattaccctcctagtttcaaatatgaagattttggaccactatttacagcaaaattttttaatgccaaccagtgggcagatatttttcaggcctctggtgccaaatacattgtcttaacttccaaacatcatgaaggctttaccttgtgggggtcagaatattcgtggaactggaatgccatagatgaggggcccaagagggacattgtcaaggaacttgaggtagccattaggaacagaactgacctgcgttttggactgtactattccctttttgaatggtttcatccgctcttccttgaggatgaatccagttcattccataagcggcaatttccagtttctaagacattgccagagctctatgagttagtgaacaactatcagcctgaggttctgtggtcggatggtgacggaggagcaccggatcaatactggaacagcacaggcttcttggcctggttatataatgaaagcccagttcggggcacagtagtcaccaatgatcgttggggagctggtagcatctgtaagcatggtggcttctatacctgcagtgatcgttataacccaggacatcttttgccacataaatgggaaaactgcatgacaatagacaaactgtcctggggctataggagggaagctggaatctctgactatcttacaattgaagaattggtgaagcaacttgtagagacagtttcatgtggaggaaatcttttgatgaatattgggcccacactagatggcaccatttctgtagtttttgaggagcgactgaggcaaatggggtcctggctaaaagtcaatggagaagctatttatgaaacccatacctggcgatcccagaatgacactgtcaccccagatgtgtggtacacatccaagcctaaagaaaaattagtctatgccatttttcttaaatggcccacatcaggacagctgttccttggccatcccaaagctattctgggggcaacagaggtgaaactactgggccatggacagccacttaactggatttctttggagcaaaatggcattatggtagaactgccacagctaaccattcatcagatgccgtgtaaatggggctgggctctagccctgactaatgtgatctaaagtgcagcagagtggctgatgctgcaagttatgtctaaggctaggaactatcaggtgtctataattgtagcacatggagaaagcaaatgtaaaactggataagaaaattattttggcagttcagccctttccctttttcccactaaattttttcttaaattacccatgtaaccattttaactctccagtgcactttgccattaaagtctcttcacattgatttgtttcca

SEQ ID NO: 11282 - DNA, 646 bp, Homo sapiens
cagcgctcccgaggccgcgggagcctgcagagaggacagccggcctgcgccgggacatgcggccccaggagctccccaggctcgcgttcccgttgctgctgttgctgttgctgctgctgccgccgccgccgtgccctgcccacagcgccacgcgcttcgaccccacctgggagtccctggacgcccgccagctgcccgcgtggtttgaccaggccaagttcggcatcttcatccactggggagtgttttccgtgcccagcttcggtagcgagtggttctggtggtattggcaaaaggaaaagataccgaagtatgtggaatttatgaaagataattaccctcctagtttcaaatatgaagattttggaccactatttacagcaaaattttttaatgccaaccagtgggcagatatttttcaggcctctggtgccaaatacattgtcttaacttccaaacatcatgaagcaacttgtagagacagtttcatgtggaggaaatcttttgatgaatattgggcccacactagatggcaccatttctgtagtttttgaggagcgactgaggcaaatggggtcctggctaaaagtcaatggagaagctatttatgaaacccatacctggcgatcccagaatgacactgtca

SEQ ID NO: 11283 - DNA, 1503 bp, Homo sapiens
agagaggacagccggcctgcgccgggacatgcggccccaggagctccccaggctcgcgttcccgttgctgctgttgctgttgctgctgctgccgccgccgccgtgccctgcccacagcgccacgcgcttcgaccccacctgggagtccctggacgcccgccagctgcccgcgtggtttgaccaggccaagttcggcatcttcatccactggggagtgttttccgtgcccagcttcggtagcgagtggttctggtggtattggcaaaaggaaaagataccgaagtatgtggaatttatgaaagataattaccctcctagtttcaaatatgaagattttggaccactatttacagcaaaattttttaatgccaaccagtgggcagatatttttcaggcctctggtgccaaatacattgtcttaacttccaaacatcatgaagcaacttgtagagacagtttcatgtggaggaaatcttttgatgaatattgggcccacactagatggcaccatttctgtagtttttgaggagcgactgaggcaaatggggtcctggctaaaagtcaatggagaagctatttatgaaacccatacctggcgatcccagaatgacactgtcaccccagatgtgtggtacacatccaagcctaaagaaaaattagtctatgccatttttcttaaatggcccacatcaggacagctgttccttggccatcccaaagctattctgggggcaacagaggtaagagggaattttaccttattcctttaaattgctgattagaacatcttgatgcaaacattaacttttaaggggagccttataactgtttcacttatacttcataaaaggaattgtaaatgagctccagccaagcattgtggctcacactgtaattccagcactttgggaggctaaggcaggaggatgtcttgaggccagaagtttgagactagcctgggcaacatagcaagacccctgtctacaaaaattttttttaaagttagctgagcatggtggcacgcacctgtagtcctagttactcaggaggctgaggcaggaggattgcttgagcccagtaggtcaagactacagtaagctatgactgcaccacttcagcctgtctctgaaaaaataaaataaaatataataaaataaaatgaatttcaccaatgacagtgtttggtcaaaatctttgaaactttttgtttcccagaaaactaagctgataaaacagctgcagtatctctatgcatatcactgtaaaatagacattattcttcacagtcattttacgttgttcaagttcactgcatgcatccaaaatgattcttctcataaaactagaattcggatgctttccctgacaccccaccccagaacatatctgaatacaagatgtcatgactctactattttatgtttataaaacattttggagaaagttagagattaatctaactgttgaaaccaccagatctggcattgagttcattctgatata

SEQ ID NO: 11284 - DNA, 737 bp, Homo sapiens
caacttgtagagacagtttcatgtggaggaaatcttttgatgaatattgggcccacactagatggcaccatttctgtagtttttgaggagcgactgaggcaaatggggtcctggctaaaagtcaatggagaagctatttatgaaacccatacctggcgatcccagaatgacactgtcaccccagatgtgtggtacacatccaagcctaaagaaaaattagtctatgccatttttcttaaatggcccacatcaggacagctgttccttggccatcccaaagctattctgggggcaacagaggtaagagggaattttaccttattcctttaaattgctgattagaacatcttgatgcaaacattaacttttaaggggagccttataactgtttcacttatacttcataaaaggaattgtaaatgagctccagccaagcattgtggctcacactgtaattccagcactttgggaggctaaggcaggaggatgtcttgaggccagaagtttgagactagcctgggcaacatagcaagacccctgtctacaaaaattttttttaaagttagctgagcatggtggcacgcacctgtagtcctagttactcaggaggctgaggcaggaggattgcttgagcccagtaggtcaagactacagtaagctatgactgcaccacttcagcctgtctctgaaaaaataaaataaaatataataaaataaaatgaatttcaccaatgaca

SEQ ID NO: 11285 - DNA, 4246 bp, Homo sapiens
gaaagtccctgactggagttggcagccaagccaggccctggagtgggcacccagagggaagacaggttggctaatttcctggagcccctaagggtgcaagggggaagaacacccacccgcaaagccccgtagggctggaccctacgttagcctgccctgctcggggttggcgatgctggaggtgggccttggaccagagaaaatgctttaattaggtgacaagcgggcagaggcctttgtctctggcgccggcagccacggcccccgctgacggcgtgggaaacagaccctgttccactccggtctccagccttggaatggttgccttcgtgcagtgcaggaggacgcggcagagggcggacgatcgctccactcgccgggaccaggtgcgggggccctgcccagccgctggggcgtggccaggctcgaagcacccaggtgtcgggggccgactctaagccctggcaccggaagagagagggcggcggattggacctcccggctccagcattgcaactgggcgctccgtctcctggtccacgcaatgatgctgcggctgctcagaagccaggtagcctgccctgggtgaagccttcgcgcaggtcaatgacggggcggaggggcagggcgcggtcccctgcatccccgatctggggagcggtgggcccaggggccatcgccttagcccctggcgctggggctcggcgccaagtgacgggcggggctccaccttccagccatccgcccggcccgggagggcggacgctgcgagactcccggccgcgccctctccttcctctcctccccaagccctcgctgccagtccggacaggctgcgcggaggggagggctgccgggccggatagccggacgcctggcgttccaggggcggccggatgtggcctgcctttgcggagggtgcgctccggccacgaaaagcggactgtggatctgccacctgcaagcagctcggccatgtggctccggagccatcgtcagctctgcctggccttcctgctagtctgtgtcctctctgtaatcttcttcctccatatccatcaagacagctttccacatggcctaggcctgtcgatcctgtgtccagaccgccgcctggtgacacccccagtggccatcttctgcctgccgggtactgcgatgggccccaacgcctcctcttcctgtccccagcaccctgcttccctctccggcacctggactgtctaccccaatggccggtttggtaatcagatgggacagtatgccacgctgctggctctggcccagctcaacggccgccgggcctttatcctgcctgccatgcatgccgccctggccccggtattccgcatcaccctgcccgtgctggccccagaagtggacagccgcacgccgtggcgggagctgcagcttcacgactggatgtcggaggagtacgcggacttgagagatcctttcctgaagctctctggcttcccctgctcttggactttcttccaccatctccgggaacagatccgcagagagttcaccctgcacgaccaccttcgggaagaggcgcagagtgtgctgggtcagctccgcctgggccgcacaggggaccgcccgcgcacctttgtcggcgtccacgtgcgccgtggggactatctgcaggttatgcctcagcgctggaagggtgtggtgggcgacagcgcctacctccggcaggccatggactggttccgggcacggcacgaagcccccgttttcgtggtcaccagcaacggcatggagtggtgtaaagaaaacatcgacacctcccagggcgatgtgacgtttgctggcgatggacaggaggctacaccgtggaaagactttgccctgctcacacagtgcaaccacaccattatgaccattggcaccttcggcttctgggctgcctacctggctggcggagacactgtctacctggccaacttcaccctgccagactctgagttcctgaagatctttaagccggaggcggccttcctgcccgagtgggtgggcattaatgcagacttgtctccactctggacattggctaagccttgagagccagggagactttctgaagtagcctgatctttctagagccagcagtacgtggcttcagaggcctggcatcttctggagaagcttgtggtgttcctgaagcaaatgggtgcccgtatccagagtgattctagttgggagagttggagagaagggggacgtttctggaactgtctgaatattctagaactagcaaaacatcttttcctgatggctggcaggcagttctagaagccacagtgcccacctgctcttcccagcccatatctacagtacttccagatggctgcccccaggaatggggaactctccctctggtctactctagaagaggggttacttctcccctgggtcctccaaagactgaaggagcatatgattgctccagagcaagcattcaccaagtccccttctgtgtttctggagtgattctagagggagacttgttctagagaggaccaggtttgatgcctgtgaagaaccctgcagggcccttatggacaggatggggttctggaaatccagataactaaggtgaagaatctttttagttttttttttttttttttggagacagggtctcgctctgttgcccaggctggagtgcagtggcgtgatcttggctcactgcaacttccgcctcctgtgttcaagcgattctcctgtctcagcctcctgagtagatgggactacaggcacaggccattatgcctggctaatttttgtatttttagtagagacagggtttcaccatgttggccaggatggtctcgatctcctgaccttgtcatccacctgtcttggcctcccaaagtgctgggattactggcatgagccactgtgcccagcccggatattttttttttaattatttatttatttatttatttattgagacggagtcttgctctgtagcccaggccagagtgcagtggcgcgatctcagctcactgcaagctctgcctcccgggttcatgccattctgcctcagcctcctgagtagctgggactacaggcgcccgccaccacgcccggctaattttttttgtatttttagtagagacggggtttcatcgtgttaaccaggatggtctcgatctcctgacctcgtgatctgcccacctcggcctcccacagtgctgggattaccggcgtgagccaccatgcctggcccggataattttttttaatttttgtagagacgaggtcttgtgatattgcccaggctgttcttcaactcctgggctcaagcagtcctcccaccttggcctcccagaatgctgggtttatagatgtgagccagcacaccgggccaagtgaagaatctaatgaatgtgcaacctaattgtagcatctaatgaatgttccaccattgctggaaaaattgagatggaaaacaaaccatctctagttggccagcgtcttgctctgttcacagtctctggaaaagctggggtagttggtgagcagagcgggactctgtccaacaagccccacagcccctcaaagacttttttttgtttgttttgagcagacaggctaaaatgtgaacgtggggtgagggatcactgccaaaatggtacagcttctggagcagaactttccagggatccagggacacttttttttaaagctcataaactgccaagagctccatatattgggtgtgagttcaggttgcctctcacaatgaaggaagttggtctttgtctgcaggtgggctgctgagggtctgggatctgttttctggaagtgtgcaggtataaacacaccctctgtgcttgtgacaaactggcaggtaccgtgctcattgctaaccactgtctgtccctgaactcccagaaccactacatctggctttgggcaggtctgagataaaacgatctaaaggtaggcagaccctggacccagcctcagatccaggcaggagcacgaggtctggccaaggtggacggggttgtcgagatctcaggagccccttgctgttttttggagggtgaaagaagaaaccttaaacatagtcagctctgatcacatcccctgtctactcatccagaccccatgcctgtaggcttatcagggagttacagttacaattgttacagtactgttcccaactcagctgccacgggtgagagagcaggaggtatgaattaaaagtctacagcactaa

SEQ ID NO: 11286 - DNA, 1068 bp, Homo sapiens
atgtggctccggagccatcgtcagctctgcctggccttcctgctagtctgtgtcctctctgtaatcttcttcctccatatccatcaagacagctttccacatggcctaggcctgtcgatcctgtgtccagaccgccgcctggtgacacccccagtggccatcttctgcctgccgggtactgcgatgggccccaacgcctcctcttcctgtccccagcaccctgcttccctctccggcacctggactgtctaccccaatggccggtttggtaatcagatgggacagtatgccacgctgctggctctggcccagctcaacggccgccgggcctttatcctgcctgccatgcatgccgccctggccccgccagaagtggacagccgcacgccgtggcgggagctgcagcttcacgactggatgtcggaggagtacgcggacttgagagatcctttcctgaagctctctggcttcccctgctcttggactttcttccaccatctccgggaacagatccgcagagagttcaccctgcacgaccaccttcgggaagaggcgcagagtgtgctgggtcagctccgcctgggccgcacaggggaccgcccgcgcacctttgtcggcgtccacgtgcgccgtggggactatctgcaggttatgcctcagcgctggaagggtgtggtgggcgacagcgcctacctccggcaggccatggactggttccgggcacggcacgaagcccccgttttcgtggtcaccagcaacggcatggagtggtgtaaagaaaacatcgacacctcccagggcgatgtgacgtttgctggcgatggacaggaggctacaccgtggaaagactttgccctgctcacacagtgcaaccacaccattatgaccattggcaccttcggcttctgggctgcctacctggctggcggagacactgtctacctggccaacttcaccctgccagactctgagttcctgaagatctttaagccggaggcggccttcctgcccgagtgggtgggcattaatgcagacttgtctccactctggacattggctaagccttga

SEQ ID NO: 11287 - DNA, 1468 bp, Homo sapiens
accgatgctggaagggtttctttggccctgagtgaagagagacccagagggaacactgaggtgcctgcccaaccactctgtcccggtttccttcagcaggaccagccatgctggtcgttcagatgcctttctcctttcccatggcccacttcatcctctttgtctttacggtttccactatatttcacgttcagcagcggctagcgaagattcaagccatgtgggagttaccggtgcagataccagtgctagcctcaacatcaaaggcactgggacccagccagctcagggggatgtggacgatcaatgcaataggccgcctggggaaccagatgggcgagtacgccacactgtacgccctggccaagatgaacgggcggcccgccttcatcccggcccagatgcacagcaccctggcccccatcttcagaatcaccctgccggtgctgcacagcgccacggccagcaggatcccctggcagaactaccacctgaacgactggatggaggaggaataccgccacatcccgggggagtacgtccgcttcaccggctacccctgctcctggaccttctaccaccacctccgccaggagatcctccaggagttcaccctgcacgaccacgtgcgggaggaggcccagaagttcctgcggggcctgcaggtgaacgggagccggccgggcacctttgtaggggtccatgttcgccgaggggactatgtccatgtcatgccaaaagtgtggaagggggtggtggccgaccggcgatacctacagcaggccctggactggttccgagctcgctacagctccctcatcttcgtggtcaccagtaatggcatggcctggtgtcgggagaacattgacacctcccacggtgatgtggtgtttgctggcgatggcattgagggctcacctgccaaagattttgctctactcacacagtgtaaccacaccatcatgaccattgggacgttcgggatctgggccgcatacctcacgggcggagacaccatctacctggccaattacaccctccccgactcccctttcctcaaaatctttaagccagaggcagccttcctgccggagtggacagggattgccgcagacctgtcccccttactcaagcactaatgctggcccattctttgagaccttttctccttctctgcctccctcaaggtgctgggattacaggtgttagccactgcgcccggccctagagctcactgttttctagttagtccatctggaagtggagcctttttccagtttgcacaaatgtgccatattggcttgtagctggcatgcatccaagtccataggtcctgcctcttcaatcctggctttctagggcctgggatgatcattgctagaactgagagaccagcctggctcagtgaacttcagggcgttccgttcattctttcagtaaatgtttgcagcacatgtgttacatgtca

SEQ ID NO: 11288 - DNA, 3111 bp, Homo sapiens
accgatgctggaagggtttctttggccctgagtgaagagagacccagagggaacactgaggtgcctgcccaaccactctgtcccggtttccttcagcaggaccaggtgagagaagccatgctggtcgttcagatgcctttctcctttcccatggcccacttcatcctctttgtctttacggtttccactatatttcacgttcagcagcggctagcgaagattcaagccatgtgggagttaccggtgcagataccagtgctagcctcaacatcaaaggcactgggacccagccagctcagggggatgtggacgatcaatgcaataggccgcctggggaaccagatgggcgagtacgccacactgtacgccctggccaagatgaacgggcggcccgccttcatcccggcccagatgcacagcaccctggcccccatcttcagaatcaccctgccggtgctgcacagcgccacggccagcaggatcccctggcagaactaccacctgaacgactggatggaggaggaataccgccacatcccgggggagtacgtccgcttcaccggctacccctgctcctggaccttctaccaccacctccgccaggagatcctccaggagttcaccctgcacgaccacgtgcgggaggaggcccagaagttcctgcggggcctgcaggtgaacgggagccggccgggcacctttgtaggggtccatgttcgccgaggggactatgtccatgtcatgccaaaagtgtggaagggggtggtggccgaccggcgatacctacagcaggccctggactggttccgagctcgctacagctccctcatcttcgtggtcaccagtaatggcatggcctggtgtcgggagaacattgacacctcccacggtgatgtggtgtttgctggcgatggcattgagggctcacctgccaaagattttgctctactcacacagtgtaaccacaccatcatgaccattgggacgttcgggatctgggccgcatacctcacgggcggagacaccatctacctggccaattacaccctccccgactcccctttcctcaaaatctttaagccagaggcagccttcctgccggagtggacagggattgccgcagacctgtcccccttactcaagcactaatgctggcccattctttgagaccttttctccttctctgcctccctcaagatgagtgcccgggcatgagaagcacatggttccatgagcaggacccatctctcttctgtgaagatgcgttgggctgcaagtaacagaaatctcagtgaacagtggcctggcgtggtggctcatgcctgtaatgctcgcactttgtgaggccagggtgggtggatcacttgaggtcaggagttcaagactagcctggccaacatggtgaaaccccatctcgactaaaaatacaaaaattagccaggcgtggtggtgcacacctgtaatcccagctactcgggaggctgaggcaagagaatcacttgaacccaggaggcggaggttgcagtgagccaagatggtgccgctgcactccagtctgggtgacacagcaagactccatctcaaaaaaaaaaaaaaaaaaaagaaaagaaaaagaaatgaatgggttcaaagaccataatcatgcatatcacataagaccagaagtggcccaggtccagggtcagttaatttagcggctccacaaagtcatcagtcacctgagctccatccatcttcacatgctgtgctaccatttcttagctgtatcatcccatggtcccaaaagggctgctacacatccagccatcacatgcagataattcctttcaaaaacagcagaaagaggctcgttcttgtcttggtcccttttgaagaatgaatgaaaccttcctaagccttccagcaatttccccccaactccgatgggtaggaattgtcacatacccatgtgacccgataggaggcaaaagaaatgagacttctgggattagtttagcctcagattctgcagctgagaagttgatcagccacctctgaaggacatgcagcttgcagaaaattagggtggtgttaccaaggtgaaaaggggaaatggctttagagtagacaacagagatgccctgaggggttgtgtaggttgttcactgcaggaagtcccctggttaagaaggcaagtggggtttaaacagacccacagtctactcatcaaaccaggtgtccttggcattgtgtccacccagagagctcactgttttcttttctttttcttttctttttttttttttttttgagatggagtcttgctgcatcccccaggctggagtgcagtggcatgatcttggctcactgcagcctccgcctcccaggttcaagcgattctcctgcctcagcctcccgagtagctaggattacaggtgcgtgccaccacgcccagctaatttttatatgtttagtggaaatggagtttcaccatgttggtcaggctggtctcaaactcctgacctcatgatccgccttcctcggcctcccaaagtgctgggattacaggtgttagccactgcgcccggccctagagctcactgttttctagttagtccatctggaagtggagcctttttccagtttgcacaaatgtgccatattggcttgtagctggcatgcatccaagtccataggtcctgcctcttcaatcctggctttctagggcctgggatgatcattgctagaactgagagaccagcctggctcagtgaacttcagggcgttccgttcattctttcagtaaatgtttgcagcacatgtgttacatgtcaggcagtgaaaccccccacagcagccttccctctcagaggatacatttgtaaccattacacagtcatcaaaggaataattttttttaatcaccagtgtgcatacagtcatggagttgggtattcccagctaccagggaggctgaggtgggaggattgcttgatgccaggagttagggaatatagtgcaccgtgattggacttgcgaatagccactgcactgcggcctggacgacgtagtgataccctgactcttataaataaataaatgaataaacacaattatgactttgcggatggg

SEQ ID NO: 11289 - DNA, 771 bp, Homo sapiens
agtcaccgatgctggaagggtttctttggccctgagtgaagagagacccagagggaacactgaggtgcctgcccaaccactctgtcccggtttccttcagcaggaccagccatgctggtcgttcagatgcctttctcctttcccatggcccacttcatcctctttgtctttacggtttccactatatttcacgttcagcagcggctagcgaagattcaagccatgtgggagttaccggtgcagataccagtgctagcctcaacatcaaaggcactgggacccagccagctcagggggatgtggacgatcaatgcaataggccgcctggggaaccagatgggcgagtacgccacactgtacgccctggccaagatgaacgggcggcccgccttcatcccggcccagatgcacagcaccctggcccccatcttcagaatcaccctgccggtgctgcacagcgccacggccagcaggatcccctggcagaactaccacctgaacgactggatggaggaggaataccgccacatcccgggggagtacgtccgcttcaccggctacccctgctcctggaccttctaccaccacctccgccaggagatcctccaggagttcaccctgcacgaccacgtgcgggaggaggcccagaagttcctgcggggcctgcaggtgaacgggagccggccgggcacctttgtaggggtccatgttcgccgaggggactatgtccatgtcatgccaaaagtgtggaagggggtggtggccgaccgg

SEQ ID NO: 11290 - DNA, 2239 bp, Homo sapiens
tctgttcccacttcctccccgccccaggaaacctgccatggcctcctggtgagctgtcctcatccactgctcgctgcctctccagaaccttggtgtgaacttaggtcttggcgtcgggatcccttttcgtcacactcaggtgacctacagggagctccgctcgacactgcaaggcttagaccagttcggtccaacagagaaagcaggcaaccaccatgtcatttgaaaacagtttcatcgggatataattcgcaacccatacagtgaatccatttaagatactctgacccatggatcccctgggtgcagccaagccacaatggccatggcgccgctgtctggccgcactgctatttcagctgctggtggctgtgtgtttcttctcctacctgcgtgtgtcccgagacgatgccactggatcccctagggctcccagtgggtcctcccgacaggacaccactcccacccgccccaccctcctgatcctgctacggacatggcctttccacatccctgtggctctgtcccgctgttcagagatggtgcccggcacagccgactgccacatcactgccgaccgcaaggtgtacccacaggcagacatggtcatcgtgcaccactgggatatcatgtccaaccctaagtcacgcctcccaccttccccgaggccgcaggggcagcgctggatctggttcaacttggagccaccccctaactgccagcacctggaagccctggacagatacttcaatctcaccatgtcctaccgcagcgactccgacatcttcacgccctacggctggctggagccgtggtccggccagcctgcccacccaccgctcaacctctcggccaagaccgagctggtggcctgggcggtgtccaactggaagccggactcagccagggtgcgctactaccagagcctgcaggctcatctcaaggtggacgtgtacggacgctcccacaagcccctgcccaaggggaccatgatggagacgctgtcccggtacaagttctacctggccttcgagaactccttgcaccccgactacatcaccgagaagctgtggaggaacgccctggaggcctgggccgtgcccgtggtgctgggccccagcagaagcaactacgagaggttcctgccacccgacgccttcatccacgtggacgacttccagagccccaaggacctggcccggtacctgcaggagctggacaaggaccacgcccgctacctgagctactttcgctggcgggagacgctgcggcctcgctccttcagctgggcactggatttctgcaaggcctgctggaaactgcagcaggaatccaggtaccagacggtgcgcagcatagcggcttggttcacctgagaggccggcatggtgcctgggctgccgggaacctcatctgcctggggcctcacctgctggagtcctttgtggccaaccctctctcttacctgggacctcacacgctgggcttcacggctgccaggagcctctcccctccagaagacttgcctgctagggacctcgcctgctggggacctcgcctgttggggacctcacctgctggggacctcacctgctggggaccttggctgctggaggctgcacctactgaggatgtcggcggtcggggactttacctgctgggacctgctcccagagaccttgccacactgaatctcacctgctggggacctcaccctggagggccctgggccctggggaactggcttacttggggccccacccgggagtgatggttctggctgatttgtttgtgatgttgttagccgcctgtgaggggtgcagagagatcatcacggcacggtttccagatgtaatactgcaaggaaaaatgatgacgtgtctcctcactctagaggggttggtcccatgggttaagagctcaccccaggttctcacctcaggggttaagagctcagagttcagacaggtccaagttcaagcccaggaccaccacttatagggtacaggtgggatcgactgtaaatgaggacttctggaacattccaaatattctggggttgagggaaattgctgctgtctacaaaatgccaagggtggacaggcgctgtggctcacgcctgtaatcccagcactttgggaggctgaggtaggaggattgattgaggccaagagttaaagaccagcctggtcaatatagcaagaccacgtctctaaataaaaaataataggccggccag

SEQ ID NO: 11291 - DNA, 2182 bp, Homo sapiens
gttcccacttcctccccgccccaggaaacctgccatggcctcctggtgagctgtcctcatccactgctcgctgcctctccaggtgacctacagggagctccgctcgacactgcaaggcttagaccagttcggtccaacagagaaagcaggcaaccaccatgtcatttgaaaacagtttcatcgggatataattcgcaacccatacagtgaatccatttaagatactctgacccatggatcccctgggtgcagccaagccacaatggccatggcgccgctgtctggccgcactgctatttcagctgctggtggctgtgtgtttcttctcctacctgcgtgtgtcccgagacgatgccactggatcccctagggctcccagtgggtcctcccgacaggacaccactcccacccgccccaccctcctgatcctgctacggacatggcctttccacatccctgtggctctgtcccgctgttcagagatggtgcccggcacagccgactgccacatcactgccgaccgcaaggtgtacccacaggcagacatggtcatcgtgcaccactgggatatcatgtccaaccctaagtcacgcctcccaccttccccgaggccgcaggggcagcgctggatctggttcaacttggagccaccccctaactgccagcacctggaagccctggacagatacttcaatctcaccatgtcctaccgcagcgactccgacatcttcacgccctacggctggctggagccgtggtccggccagcctgcccacccaccgctcaacctctcggccaagaccgagctggtggcctgggcggtgtccaactggaagccggactcagccagggtgcgctactaccagagcctgcaggctcatctcaaggtggacgtgtacggacgctcccacaagcccctgcccaaggggaccatgatggagacgctgtcccggtacaagttctacctggccttcgagaactccttgcaccccgactacatcaccgagaagctgtggaggaacgccctggaggcctgggccgtgcccgtggtgctgggccccagcagaagcaactacgagaggttcctgccacccgacgccttcatccacgtggacgacttccagagccccaaggacctggcccggtacctgcaggagctggacaaggaccacgcccgctacctgagctactttcgctggcgggagacgctgcggcctcgctccttcagctgggcactggatttctgcaaggcctgctggaaactgcagcaggaatccaggtaccagacggtgcgcagcatagcggcttggttcacctgagaggccggcatggtgcctgggctgccgggaacctcatctgcctggggcctcacctgctggagtcctttgtggccaaccctctctcttacctgggacctcacacgctgggcttcacggctgccaggagcctctcccctccagaagacttgcctgctagggacctcgcctgctggggacctcgcctgttggggacctcacctgctggggacctcacctgctggggaccttggctgctggaggctgcacctactgaggatgtcggcggtcggggactttacctgctgggacctgctcccagagaccttgccacactgaatctcacctgctggggacctcaccctggagggccctgggccctggggaactggcttacttggggccccacccgggagtgatggttctggctgatttgtttgtgatgttgttagccgcctgtgaggggtgcagagagatcatcacggcacggtttccagatgtaatactgcaaggaaaaatgatgacgtgtctcctcactctagaggggttggtcccatgggttaagagctcaccccaggttctcacctcaggggttaagagctcagagttcagacaggtccaagttcaagcccaggaccaccacttatagggtacaggtgggatcgactgtaaatgaggacttctggaacattccaaatattctggggttgagggaaattgctgctgtctacaaaatgccaagggtggacaggcgctgtggctcacgcctgtaatcccagcactttgggaggctgaggtaggaggattgattgaggccaagagttaaagaccagcctggtcaatatagcaagaccacgtctctaaataaaaaataataggccggccag

SEQ ID NO: 11292 - DNA, 2589 bp, Homo sapiens
tctgttcccacttcctccccgccccaggaaacctgccatggcctcctggtgagctgtcctcatccactgctcgctgcctctccagatcttcagttgcttcaggccatttgaacgtatatgagccggtcgtaggggatatgatggcttagcttgggctcagaggcctgaaaatcgcccccaccaatcacctgtttcccccaatctaccctcctgaaggtcactgacaaagacttcattgtctcctaggagaggctgccatatatccagggctgacgtaattccatcttaatatcagttacattataaaaatttacctcgtgcctgaggccccagagcccaagggtgcaaagcagtaattggtcaaagttcaacttccctcccactctgggctcaggctgtcccctgagggcctgtgttttgagtctctttccagaaccttggtgtgaacttaggtcttggcgtcgggatcccttttcgtcacactcaggtgacctacagggagctccgctcgacactgcaaggcttagaccagttcggtccaacagagaaagcaggcaaccaccatgtcatttgaaaacagtttcatcgggatataattcgcaacccatacagtgaatccatttaagatactctgacccatggatcccctgggtgcagccaagccacaatggccatggcgccgctgtctggccgcactgctatttcagctgctggtggctgtgtgtttcttctcctacctgcgtgtgtcccgagacgatgccactggatcccctagggctcccagtgggtcctcccgacaggacaccactcccacccgccccaccctcctgatcctgctacggacatggcctttccacatccctgtggctctgtcccgctgttcagagatggtgcccggcacagccgactgccacatcactgccgaccgcaaggtgtacccacaggcagacatggtcatcgtgcaccactgggatatcatgtccaaccctaagtcacgcctcccaccttccccgaggccgcaggggcagcgctggatctggttcaacttggagccaccccctaactgccagcacctggaagccctggacagatacttcaatctcaccatgtcctaccgcagcgactccgacatcttcacgccctacggctggctggagccgtggtccggccagcctgcccacccaccgctcaacctctcggccaagaccgagctggtggcctgggcggtgtccaactggaagccggactcagccagggtgcgctactaccagagcctgcaggctcatctcaaggtggacgtgtacggacgctcccacaagcccctgcccaaggggaccatgatggagacgctgtcccggtacaagttctacctggccttcgagaactccttgcaccccgactacatcaccgagaagctgtggaggaacgccctggaggcctgggccgtgcccgtggtgctgggccccagcagaagcaactacgagaggttcctgccacccgacgccttcatccacgtggacgacttccagagccccaaggacctggcccggtacctgcaggagctggacaaggaccacgcccgctacctgagctactttcgctggcgggagacgctgcggcctcgctccttcagctgggcactggatttctgcaaggcctgctggaaactgcagcaggaatccaggtaccagacggtgcgcagcatagcggcttggttcacctgagaggccggcatggtgcctgggctgccgggaacctcatctgcctggggcctcacctgctggagtcctttgtggccaaccctctctcttacctgggacctcacacgctgggcttcacggctgccaggagcctctcccctccagaagacttgcctgctagggacctcgcctgctggggacctcgcctgttggggacctcacctgctggggacctcacctgctggggaccttggctgctggaggctgcacctactgaggatgtcggcggtcggggactttacctgctgggacctgctcccagagaccttgccacactgaatctcacctgctggggacctcaccctggagggccctgggccctggggaactggcttacttggggccccacccgggagtgatggttctggctgatttgtttgtgatgttgttagccgcctgtgaggggtgcagagagatcatcacggcacggtttccagatgtaatactgcaaggaaaaatgatgacgtgtctcctcactctagaggggttggtcccatgggttaagagctcaccccaggttctcacctcaggggttaagagctcagagttcagacaggtccaagttcaagcccaggaccaccacttatagggtacaggtgggatcgactgtaaatgaggacttctggaacattccaaatattctggggttgagggaaattgctgctgtctacaaaatgccaagggtggacaggcgctgtggctcacgcctgtaatcccagcactttgggaggctgaggtaggaggattgattgaggccaagagttaaagaccagcctggtcaatatagcaagaccacgtctctaaataaaaaataataggccggccaggc

SEQ ID NO: 11293 - DNA, 2048 bp, Homo sapiens
tctgttcccacttcctccccgccccaggaaacctgccatggcctcctggtgagctgtcctcatccactgctcgctgcctctccagatactctgacccatggatcccctgggtgcagccaagccacaatggccatggcgccgctgtctggccgcactgctatttcagctgctggtggctgtgtgtttcttctcctacctgcgtgtgtcccgagacgatgccactggatcccctagggctcccagtgggtcctcccgacaggacaccactcccacccgccccaccctcctgatcctgctacggacatggcctttccacatccctgtggctctgtcccgctgttcagagatggtgcccggcacagccgactgccacatcactgccgaccgcaaggtgtacccacaggcagacatggtcatcgtgcaccactgggatatcatgtccaaccctaagtcacgcctcccaccttccccgaggccgcaggggcagcgctggatctggttcaacttggagccaccccctaactgccagcacctggaagccctggacagatacttcaatctcaccatgtcctaccgcagcgactccgacatcttcacgccctacggctggctggagccgtggtccggccagcctgcccacccaccgctcaacctctcggccaagaccgagctggtggcctgggcggtgtccaactggaagccggactcagccagggtgcgctactaccagagcctgcaggctcatctcaaggtggacgtgtacggacgctcccacaagcccctgcccaaggggaccatgatggagacgctgtcccggtacaagttctacctggccttcgagaactccttgcaccccgactacatcaccgagaagctgtggaggaacgccctggaggcctgggccgtgcccgtggtgctgggccccagcagaagcaactacgagaggttcctgccacccgacgccttcatccacgtggacgacttccagagccccaaggacctggcccggtacctgcaggagctggacaaggaccacgcccgctacctgagctactttcgctggcgggagacgctgcggcctcgctccttcagctgggcactggatttctgcaaggcctgctggaaactgcagcaggaatccaggtaccagacggtgcgcagcatagcggcttggttcacctgagaggccggcatggtgcctgggctgccgggaacctcatctgcctggggcctcacctgctggagtcctttgtggccaaccctctctcttacctgggacctcacacgctgggcttcacggctgccaggagcctctcccctccagaagacttgcctgctagggacctcgcctgctggggacctcgcctgttggggacctcacctgctggggacctcacctgctggggaccttggctgctggaggctgcacctactgaggatgtcggcggtcggggactttacctgctgggacctgctcccagagaccttgccacactgaatctcacctgctggggacctcaccctggagggccctgggccctggggaactggcttacttggggccccacccgggagtgatggttctggctgatttgtttgtgatgttgttagccgcctgtgaggggtgcagagagatcatcacggcacggtttccagatgtaatactgcaaggaaaaatgatgacgtgtctcctcactctagaggggttggtcccatgggttaagagctcaccccaggttctcacctcaggggttaagagctcagagttcagacaggtccaagttcaagcccaggaccaccacttatagggtacaggtgggatcgactgtaaatgaggacttctggaacattccaaatattctggggttgagggaaattgctgctgtctacaaaatgccaagggtggacaggcgctgtggctcacgcctgtaatcccagcactttgggaggctgaggtaggaggattgattgaggccaagagttaaagaccagcctggtcaatatagcaagaccacgtctctaaataaaaaataataggccggccaggc

SEQ ID NO: 11294 - DNA, 6047 bp, Homo sapiens
aatccctccctccggcgggcgtcgctggcgggtggctaggcccaacggcaggaagccgacgctatcctccgttccgcggcgccgggtccgccttccgtctgttctagggcctgctcctgcgcggcagctgctttagaaggtctcgagcctcctgtaccttcccagggatgaaccgggccttccctctggaaggcgagggttcgggccacagtgagcgagggccagggcggtgggcgcgcgcagagggaaaccggatcagttgagagagaatcaagagtagcggatgaggcgcttgtggggcgcggcccggaagccctcgggcgcgggctgggagaaggagtgggcggaggcgccgcaggaggctcccggggcctggtcgggccggctgggccccgggcgcagtggaagaaagggacgggcggtgcccggttgggcgtcctggccagctcaccttgccctggcggctcgccccgcccggcacttgggaggagcagggcagggcccgcggcctttgcattctgggaccgcccccttccattcccgggccagcggcgagcggcagcgacggctggagccgcagctacagcatgagagccggtgccgctcctccacgcctgcggacgcgtggcgagcggaggcagcgctgcctgttcgcgccatgggggcaccgtggggctcgccgacggcggcggcgggcgggcggcgcgggtggcgccgaggccgggggctgccatggaccgtctgtgtgctggcggccgccggcttgacgtgtacggcgctgatcacctacgcttgctgggggcagctgccgccgctgccctgggcgtcgccaaccccgtcgcgaccggtgggcgtgctgctgtggtgggagcccttcggggggcgcgatagcgccccgaggccgccccctgactgccggctgcgcttcaacatcagcggctgccgcctgctcaccgaccgcgcgtcctacggagaggctcaggccgtgcttttccaccaccgcgacctcgtgaaggggccccccgactggcccccgccctggggcatccaggcgcacactgccgaggaggtggatctgcgcgtgttggactacgaggaggcagcggcggcggcagaagccctggcgacctccagccccaggcccccgggccagcgctgggtttggatgaacttcgagtcgccctcgcactccccggggctgcgaagcctggcaagtaacctcttcaactggacgctctcctaccgggcggactcggacgtctttgtgccttatggctacctctaccccagaagccaccccggcgacccgccctcaggcctggccccgccactgtccaggaaacaggggctggtggcatgggtggtgagccactgggacgagcgccaggcccgggtccgctactaccaccaactgagccaacatgtgaccgtggacgtgttcggccggggcgggccggggcagccggtgcccgaaattgggctcctgcacacagtggcccgctacaagttctacctggctttcgagaactcgcagcacctggattatatcaccgagaagctctggcgcaacgcgttgctcgctggggcggtgccggtggtgctgggcccagaccgtgccaactacgagcgctttgtgccccgcggcgccttcatccacgtggacgacttcccaagtgcctcctccctggcctcgtacctgcttttcctcgaccgcaaccccgcggtctatcgccgctacttccactggcgccggagctacgctgtccacatcacctccttctgggacgagccttggtgccgggtgtgccaggctgtacagagggctggggaccggcccaagagcatacggaacttggccagctggttcgagcggtgaagccgcgctcccctggaagcgacccaggggaggccaagttgtcagctttttgatcctctactgtgcatctccttgactgccgcatcatgggagtaagttcttcaaacacccatttttgctctatgggaaaaaaacgatttaccaattaatattactcagcacagagatgggggcccggtttccatattttttgcacagctagcaattgggctccctttgctgctgatgggcatcattgtttaggggtgaaggagggggttcttcctcaccttgtaaccagtgcagaaatgaaatagcttagcggcaagaagccgttgaggcggtttcctgaatttccccatctgccacaggccatatttgtggcccgtgcagcttccaaatctcatacacaactgttcccgattcacgtttttctggaccaaggtgaagcaaatttgtggttgtagaaggagccttgttggtggagagtggaaggactgtggctgcaggtgggactttgttgtttggattcctcacagccttggctcctgagaaaggtgaggagggcagtccaagaggggccgctgacttctttcacaagtactatctgttcccctgtcctgtgaatggaagcaaagtgctggattgtccttggaggaaacttaagatgaatacatgcgtgtacctcactttacataagaaatgtattcctgaaaagctgcatttaaatcaagtcccaaattcattgacttaggggagttcagtatttaatgaaaccctatggagaatttatccctttacaatgtgaatagtcatctcctaatttgtttcttctgtctttatgtttttctataacctggattttttaaatcatattaaaattacagatgtgaaaataaagcagaagcaacctttttccctcttcccagaaaaccagtctgtgtttacagacagaagagaaggaagccatagtgtcacttccacacaattatttatttcatgtctttactggacctgaaatttaaactgcaatgccagtcctgcaggagtgctggcattaccctctgcagaacagtgaaaggtattgcactacattatggaatcatgcaaaaggaaaaaaagtttcatgatatctgttgttggcagtttttgtttatctctgacagtttttagttaaatgtttagatcctcagaactacattagtgcctactattaacttactctgtctcttgttaaaggctaaatctgcgcttctccctggtgccagcaggttcccctcacagtcaatgcagtggtatagcatatcctcacatttctagtgcccttgagactgtgctatggaaccaatcttgaacatacatgcattgacttgacaagttactgagtaagcagcatattcagcaggtgccactacatgcctactctgccagacactgagcttggggccctagggaagatagagaattatacaaggcaaagtccttctctttagggctcttacaatctatcacttccaaaaagtaaatggtgactgataaaacaattggcagaacctgtttgattactgtgacagtcttaatgataccataaatcaatattagaaagctagttgacttaaagcctgaaataatgggagttttctcctccacttattagaataaggaccctcagtgactaattattgtgggtagggtcaagattaactagttttatacagagttctgctgtaaatagtcattttgcatttgattagtgcagttctctgaatcataaagcaagttttacctctctgtacatgtttttgcagacatacttgaaaagctcacttaaatctaggtgcttcaattcactttcttgagaggacaaatgaaaagctgtggagaaaatgtcctcattaaagtattaaagtgtgggcagaattacaattacaaagtgccagccaccgaataaagataaaagttcagttcttaaaatgagtttttatgagataacagtcagtgatcttggtgttaccgggattccacatggggcagtgggaaagagttcaggttttgaaggtaacctagtttagatttgaattccagctatgtgacattgggtaaattagtagtagtcctgagcctcagcgtcctcatctataaaatgactggcgaaaatacttcacaagctcattttgagcactttaggaagtaagtgaaagtacctaaaatagcaggcacccaattgatgattttatatcttccttctttgcttgcagtgatttcaggatgtcctcatatctatttataggtctaaaattatatcttaaggtatgttgtagaataaattaaaaggataatctaaatcaccatttagattaagcttgacttgcaaactaggaagaagcacctaggctttctttgaaaatatttttttggttcgttttggtaaagctctataaattggtatctattattttaccaatttttttttagtattaagtccatttagaactaaccatattatttatggaataattagcatgaggaaggtataattgcatttttttttttttgagacggagtcttgcactgtagccccagctggactgcagtggcgtgatcttggctcactgcaacctccgcctcccaggttcaagcgattctcctgcctcagcctcccgagcagctgagactacaggcgcctgccaccacgcctggccaattttttgtatttttagtagagactgcgtttcaccatgttgggcaggctggtcttgaactcctgaccttgtgatccacctgcctcggcctctcagagagctgggattacaggtgtgagccgccgtgcccagccattgcatttttattcacatacacattgttaatgtggaacaatttaacactaatctcatcagagagcgagatgaatgtggcaattgctcattttattttgcatatattaaattgagtaggttcagctctaacataccttaagaaaaatgcatatcggtgcactgtatgtatttcaaaatgcctttcctatgattgtcatgtcctcctttaaggcttttccctcaaatttattacaaatttagtatttttagtacttgatgactctaattacatgaatgcacctggaatgacatttgtaacagaagacggtctgacttgctttcagtattcacaagttctttccagtttccaagtcttttcctagcagtaatttaggggagacagaggagtttcatgtaaagagcatgcagtttggagtcagaacctgggtatgactctgtggccttgatgaagcaagttacttaaactcttgagttttagctttctcctttacaatgcatgaatgcctatccccctacaaaacaaagattaaatgtgatgatgtatgccaaggtgctttgtatattgtaaagtgctatataattataagatgttctaaattttcaaggatctaaaccagggattggcaaacgtttttccagggagtaaatattttacgctttgcatatataatttatggaggtgttgagaggatagattagacacttgaagtactcaggatagtgcctggcatgtaggaagcacctggaaaatattcgctgtgattaccatcagtccattttaccgaggaaggagccaaggtccaggcccactgaaggacttgcataacattacaatagcagtggcagaaccagccatgcttctgcaaatcacaacctctttgagcctctgtcacctgaactgcaaaatgagtgggttagacaaaatcatctgttgggacctcctagttccacgtgctatcattctactaactggcaccctaaggttgaaagtgcttatctgctttccaatgtggcttccttacagtctggaactgacaatatgcaggagcagtaaactggcagaaaaccaggaatcagagaaagaaaatataatttaactttaaagatgtaaattatatatatagtatattatatatatttttaaagctttatatgcctcaaatatcagggaaaggagccaagtccttggtatttagtttggtgaatacttgcattgaatacatgtcaagatgtcaagtcatttttgaatgtgtctcagggatttctatgctacacattcttttaacaaatcaagtatttatgtacacatgttcagattttttgacaaaatgattaaaataatgagatggaaaatg

SEQ ID NO: 11295 - DNA, 1988 bp, Homo sapiens
gattacagacatgagccacctcgcccagccttttcatggctgagtgatattccattgtgtggatggatcacactagctactctgacccatggatcccctgggcccagccaagccacagtggctgtggcgccgctgtctggccgggctgctgtttcagctgctggtggctgtgtgtttcttctcctacctgcgtgtgtcccgagacgatgccactggatcccctaggccagggcttatggcagtggaacctgtcaccggggctcccaatgggtcccgctgccaggacagcatggcgacccctgcccaccccaccctactgatcctgctgtggacgtggccttttaacacacccgtggctctgccccgctgctcagagatggtgcccggcgcggccgactgcaacatcactgccgactccagtgtgtacccacaggcagacgcggtcatcgtgcaccactgggatatcatgtacaaccccagtgccaacctcccgccccccaccaggccgcaggggcagcgctggatctggttcagcatggagtcccccagcaactgccggcacctggaagccctggacggatacttcaatctcaccatgtcctaccgcagcgactccgacatcttcacgccctacggctggctggagccgtggtccggccagcctgcccacccaccgctcaacctctcggccaagaccgagctggtggcctgggcggtgtccaactggaagccggactcggccagggtgcgctactaccagagcctgcaggctcatctcaaggtggacgtgtacggacgctcccacaagcccctgcccaaggggaccatgatggagacgctgtcccggtacaagttctatctggccttcgagaactccttgcaccccgactacatcaccgagaagctgtggaggaacgccctggaggcctgggccgtgcccgtggtgctgggccccagcagaagcaactacgagaggttcctgccacccgacgccttcatccacgtggacgacttccagagccccaaggacctggcccggtacctgcaggagctggacaaggaccacgcccgctacctgagctactttcactggcgggagacgctgcggcctcgctccttcagctgggcactggctttctgcaaggcctgctggaagctgcagcaggaatctaggtaccagacggtgcgcagcatagcggcttggttcacctgagaggccggcatggggcctgggctgccgggacctcactttcccagggcctcacctacctagggtctcactagtcgggggatttacctacctggggcctcggctgcctggggcctcggctgcctggggtctcacctgcctggggcctcacctgctggagtctttggtggccaggcatgtgacttacctgggatttcacttgccgggcttcactgccaggagcctcccctgctggggaccttgccagctggggctggggatggtgcctactggggaccttgctttctggaggctgcacctactgaggatctcggctgttggggactttacctgctgggacctgctcccagagaccttgccacactgaatgtcacctgctaggagcctcacccgctgggaggcacagggcccaagggagctggatgtgttgcccaaggtgtgcagggcaggtcagggaagggcagggtcccctaaggaggagggcgaagggtatgtgtgtgaccatcagcagtggtgtgcacatggctgggggacactcggtttgaccgccagcggatgggtgtcacaaatgcatcactatgggtgtgacctcggcgtgactctgatagtgcctgtggatgtgttgcgatgcctcaccctggagggcactgggccctgagaacgggtgcccttgaggccctgcccccgggcgatggtgcaggctggtttgcttgtggttttattgctgttgttaaccacccatgaggggtgcaaacagataatgctgttaacattttca

SEQ ID NO: 11296 - DNA, 2118 bp, Homo sapiens
tctcgcgatagccagccgcggctgcccttgcgcttcccgagctggcggggtccgtggtgcgggatcgagattgcgggctatggcgccgaaggtttttcgtcagtactgggatatccccgatggcaccgattgccaccgcaaagcctacagcaccaccagtattgccagcgtcgctggcctgaccgccgctgcctacagagtcacactcaatcctccgggcaccttccttgaaggagtggctaaggttggacaatacacgttcactgcagctgctgtcggggccgtgtttggcctcaccacctgcatcagcgcccatgtccgcgagaagcccgacgaccccctgaactacttcctcggtggctgcgccggaggcctgactctgggagcacgcaagactgggtttcaccgtgttagccaggatggtcttgatctcctgacctcgtgatctacctgcctcggcctcccaaagtgctgggattacagacatgagccacctcgcccagccttttcatggctgagtgatattccattgtgtggatggatcacactagctactctgacccatggatcccctgggcccagccaagccacagtggctgtggcgccgctgtctggccgggctgctgtttcagctgctggtggctgtgtgtttcttctcctacctgcgtgtgtcccgagacgatgccactggatcccctaggccagggcttatggcagtggaacctgtcaccggggctcccaatgggtcccgctgccaggacagcatggcgacccctgcccaccccaccctactgatcctgctgtggacgtggccttttaacacacccgtggctctgccccgctgctcagagatggtgcccggcgcggccgactgcaacatcactgccgactccagtgtgtacccacaggcagacgcggtcatcgtgcaccactgggatatcatgtacaaccccagtgccaacctcccgccccccaccaggccgcaggggcagcgctggatctggttcagcatggagtcccccagcaactgccggcacctggaagccctggacggatacttcaatctcaccatgtcctaccgcagcgactccgacatcttcacgccctacggctggctggagccgtggtccggccagcctgcccacccaccgctcaacctctcggccaagaccgagctggtggcctgggcggtgtccaactggaagccggactcggccagggtgcgctactaccagagcctgcaggctcatctcaaggtggacgtgtacggacgctcccacaagcccctgcccaaggggaccatgatggagacgctgtcccggtacaagttctatctggccttcgagaactccttgcaccccgactacatcaccgagaagctgtggaggaacgccctggaggcctgggccgtgcccgtggtgctgggccccagcagaagcaactacgagaggttcctgccacccgacgccttcatccacgtggacgacttccagagccccaaggacctggcccggtacctgcaggagctggacaaggaccacgcccgctacctgagctactttcactggcgggagacgctgcggcctcgctccttcagctgggcactggctttctgcaaggcctgctggaagctgcagcaggaatctaggtaccagacggtgcgcagcatagcggcttggttcacctgagaggccggcatggggcctgggctgccgggacctcactttcccagggcctcacctacctagggtctcactagtcgggggatttacctacctggggcctcggctgcctggggcctcggctgcctggggtctcacctgcctggggcctcacctgctggagtctttggtggccaggcatgtgacttacctgggatttcacttgccgggcttcactgccaggagcctcccctgctggggaccttgccagctggggctggggatggtgcctactggggaccttgctttctggaggctgcacctactgaggatctcggctgttggggactttacctgctgggacctgctcccagagaccttgccacactgaatgtcacctgctaggagcctcacccgctgggaggcacagggcccaagggagctggatgtgttgccc

SEQ ID NO: 11297 - DNA, 2847 bp, Homo sapiens
agatcatttctctccattccaggaagtttgcatagctccctggacttctgctttgcactgccctgcaggagtgggtggggaaaggaagtggctttgaggcacacagaggggcttgttgaggccaccggaggaagcttctgccaccaatatgggacctgtgcccagcctaccagaagagagcatctgaaaacatgtatcgacatggtaacccctctgcttgaagcctcacatggctccctattgccttggtgctgaacaccctatggctgaccgtggcccagcctctgcaacagctctgcctcctctccagtggtgaagacccagcctgctgagactcctcctgcagttcctcaacatgcctgcatttctgctgcctcagggcctttgcgaaggttgttccttgtaactggaatgcccttccatcccttttttattcaaaaggctgcaattttaattgaagaaagttcccttccaaggttcatgagttgcctgacttgcccaccggtttcctgcaagatcccttggcctggcacttagtgctcaggaaatatttggtgatgggccaactgagtgagaaggtgggatctggtgggaaggaaagcggaaaggtagaaattctgctcacttcctcattcccacctcccaaggaacccctggtgtccctgtggaacccgctttgggaaccggtggttcaggtcagccttttcactttgtactcaaagccacatcgcattgaagccacaggtggggcaaggtcatgcatgacctgagtctccaaatcccttcaccctgtttggttctgcaacggggattaggggagccccacgatttgttttcaaaggatgtccgggctccaggacaggatgccctgggtcacctgatgacaggtgtggtggttggaaagggcctggtttcagctccgggtacacttcctccttccttctgctgcgtggtgtggcctcttccacgtcctcagaatccagctgttactccgtccgcggcctctcagctctagggccctctgcacactggcccccccagatactctgacccatggatcccctgggcccggccaagccacagtggtcgtggcgctgctgtctgaccacgctgctgtttcagctgctgatggctgtgtgtttcttctcctatctgcgtgtgtctcaagacgatcccactgtgtaccctaatgggtcccgcttcccagacagcacagggacccccgcccactccatccccctgatcctgctgtggacgtggccttttaacaaacccatagctctgccccgctgctcagagatggtgcctggcacggctgactgcaacatcactgccgaccgcaaggtgtatccacaggcagacgcggtcatcgtgcaccaccgagaggtcatgtacaaccccagtgcccagctcccacgctccccgaggcggcaggggcagcgatggatctggttcagcatggagtccccaagccactgctggcagctgaaagccatggacggatacttcaatctcaccatgtcctaccgcagcgactccgacatcttcacgccctacggctggctggagccgtggtccggccagcctgcccacccaccgctcaacctctcggccaagaccgagctggtggcctgggcagtgtccaactgggggccaaactccgccagggtgcgctactaccagagcctgcaggcccatctcaaggtggacgtgtacggacgctcccacaagcccctgccccagggaaccatgatggagacgctgtcccggtacaagttctatctggccttcgagaactccttgcaccccgactacatcaccgagaagctgtggaggaacgccctggaggcctgggccgtgcccgtggtgctgggccccagcagaagcaactacgagaggttcctgccacccgacgccttcatccacgtggacgacttccagagccccaaggacctggcccggtacctgcaggagctggacaaggaccacgcccgctacctgagctactttcgctggcgggagacgctgcggcctcgctccttcagctgggcactcgctttctgcaaggcctgctggaaactgcaggaggaatccaggtaccagacacgcggcatagcggcttggttcacctgagaggctggtgtggggcctgggctgccaggaacctcattttcctggggcctcacctgagtgggggcctcatctacctaaggactcgtttgcctgaagcttcacctgcctgaggactcacctgcctgggacggtcacctgttgcagcttcacctgcctggggattcacctacctgggtcctcactttcctggggcctcacctgctggagtcttcggtggccaggtatgtcccttacctgggatttcacatgctggcttccaggagcgtcccctgcggaagcctggcctgctggggatgtctcctggggactttgcctactggggacctcggctgttggggactttacctgctgggacctgctcccagagaccttccacactgaatctcacctgctaggagcctcacctgctggggacctcaccctggagggcactgggccctgggaactggcacccatggggccccacccatgagtgatggttctggctgatttgtttgtgatgttgttagccgcctgtgaggggtgcagagagataatcaccgcaccgtttccagatgtaatactgcaaagaaaaccgatgatgaggccgggtgcggtggctcacacctgtaatcccagcactttgggaggccgaggcaggcggatcacaaggtcaggagatcgagaccatcctggccaatatggtgaaacccgtctctactaaaaatacaaaaa

SEQ ID NO: 11298 - DNA, 3137 bp, Homo sapiens
aaaaccagtattccagatcatttctctccattccaggaagtttgcatagctccctggacttctgctttgcactgccctgcaggagtgggtggggaaaggaagtggctttgaggcacacagaggggcttgttgaggccaccggaggaagcttctgccaccaatatgggacctgtgcccagcctaccagaagagagcatctgaaaacatgtatcgacatggtaacccctctgcttgaagcctcacatggctccctattgccttggtgctgaacaccctatggctgaccgtggcccagcctctgcaacagctctgcctcctctccagtggtgaagacccagcctgctgagactcctcctgcagttcctcaacatgcctgcatttctgctgcctcagggcctttgcgaaggttgttccttgtaactggaatgcccttccatcccttttttattcaaaaggctgcaattttaattgaagaaagttcccttccaaggttcatgagttgcctgacttgcccaccggtttcctgcaagatcccttggcctggcacttagtgctcaggaaatatttggtgatgggccaactgagtgagaaggtgggatctggtgggaaggaaagcggaaaggtagaaattctgctcacttcctcattcccacctcccaaggaacccctggtgtccctgtggaacccgctttgggaaccggtggttcaggtcagccttttcactttgtactcaaagccacatcgcattgaagccacaggtggggcaaggtcatgcatgacctgagtctccaaatcccttcaccctgtttggttctgcaacggggattaggggagccccacgatttgttttcaaaggatgtccgggctccaggacaggatgccctgggtcacctgatgacaggtgtggtggttggaaagggcctggtttcagctccgggtacacttcctccttccttctgctgcgtggtgtggcctcttccacgtcctcagaatccagctgttactccgtccgcggcctctcagctctagggccctctgcacactggcccccccagtgtcacgggcatccagacgggatccagtgcatcctcttttagaagaaaggcctgtctccagatccccgagtccctctagcatctcccagaaggtgtcagacgcagcagtgtccagggagcggcagcagatactctgacccatggatcccctgggcccggccaagccacagtggtcgtggcgctgctgtctgaccacgctgctgtttcagctgctgatggctgtgtgtttcttctcctatctgcgtgtgtctcaagacgatcccactgtgtaccctaatgggtcccgcttcccagacagcacagggacccccgcccactccatccccctgatcctgctgtggacgtggccttttaacaaacccatagctctgccccgctgctcagagatggtgcctggcacggctgactgcaacatcactgccgaccgcaaggtgtatccacaggcagacgcggtcatcgtgcaccaccgagaggtcatgtacaaccccagtgcccagctcccacgctccccgaggcggcaggggcagcgatggatctggttcagcatggagtccccaagccactgctggcagctgaaagccatggacggatacttcaatctcaccatgtcctaccgcagcgactccgacatcttcacgccctacggctggctggagccgtggtccggccagcctgcccacccaccgctcaacctctcggccaagaccgagctggtggcctgggcagtgtccaactgggggccaaactccgccagggtgcgctactaccagagcctgcaggcccatctcaaggtggacgtgtacggacgctcccacaagcccctgccccagggaaccatgatggagacgctgtcccggtacaagttctatctggccttcgagaactccttgcaccccgactacatcaccgagaagctgtggaggaacgccctggaggcctgggccgtgcccgtggtgctgggccccagcagaagcaactacgagaggttcctgccacccgacgccttcatccacgtggacgacttccagagccccaaggacctggcccggtacctgcaggagctggacaaggaccacgcccgctacctgagctactttcgctggcgggagacgctgcggcctcgctccttcagctgggcactcgctttctgcaaggcctgctggaaactgcaggaggaatccaggtaccagacacgcggcatagcggcttggttcacctgagaggctggtgtggggcctgggctgccaggaacctcattttcctggggcctcacctgagtgggggcctcatctacctaaggactcgtttgcctgaagcttcacctgcctgaggactcacctgcctgggacggtcacctgttgcagcttcacctgcctggggattcacctacctgggtcctcactttcctggggcctcacctgctggagtcttcggtggccaggtatgtcccttacctgggatttcacatgctggcttccaggagcgtcccctgcggaagcctggcctgctggggatgtctcctggggactttgcctactggggacctcggctgttggggactttacctgctgggacctgctcccagagaccttccacactgaatctcacctgctaggagcctcacctgctggggacctcaccctggagggcactgggccctgggaactggcacccatggggccccacccatgagtgatggttctggctgatttgtttgtgatgttgttagccgcctgtgaggggtgcagagagataatcaccgcaccgtttccagatgtaatactgcaaagaaaaccgatgatgaggccgggtgcggtggctcacacctgtaatcccagcactttgggaggccgaggcaggcggatcacaaggtcaggagatcgagaccatcctggccaatatggtgaaacccgtctctactaaaaatacaaaaatttgccgggcgtggtggtgcatgcctgtaatcccagctacttgggaagctgaggcaggagaatcgcttgaaccagagagtcggaggttgcagtaagccgagatcgcgccactgcactccagcctggcgacagagcgagactctgtctc

SEQ ID NO: 11299 - DNA, 1098 bp, Homo sapiens
atggatcccctgggcccggccaagccacagtggtcgtggcgctgctgtctgaccacgctgctgtttcagctgctgatggctgtgtgtttcttctcctatctgcgtgtgtctcaagacgatcccactgtgtaccctaatgggtcccgcttcccagacagcacagggacccccgcccactccatccccctgatcctgctgtggacgtggccttttaacaaacccatagctctgccccgctgctcagagatggtgcctggcacggctgactgcaacatcactgccgaccgcaaggtgtatccacaggcagacgcggtcatcgtgcaccaccgagaggtcatgtacaaccccagtgcccagctcccacgctccccgaggcggcaggggcagcgatggatctggttcagcatggagtccccaagccactgctggcagctgaaagccatggacggatacttcaatctcaccatgtcctaccgcagcgactccgacatcttcacgccctacggctggctggagccgtggtccggccagcctgcccacccaccgctcaacctctcggccaagaccgagctggtggcctgggcagtgtccaactgggggccaaactccgccagggtgcgctactaccagagcctgcaggcccatctcaaggtggacgtgtacggacgctcccacaagcccctgccccagggaaccatgatggagacgctgtcccggtacaagttctatctggccttcgagaactccttgcaccccgactacatcaccgagaagctgtggaggaacgccctggaggcctgggccgtgcccgtggtgctgggccccagcagaagcaactacgagaggttcctgccacccgacgccttcatccacgtggacgacttccagagccccaaggacctggcccggtacctgcaggagctggacaaggaccacgcccgctacctgagctactttcgctggcgggagacgctgcggcctcgctccttcagctgggcactcgctttctgcaaggcctgctggaaactgcaggaggaatccaggagtgggggcctcatctacctaaggactcgtttgcctgaagcttcacctgcctga

SEQ ID NO: 11300 - DNA, 2598 bp, Homo sapiens
gtttgcatagctccctggacttctgctttgcactgccctgcaggagtgggtggggaaaggaagtggctttgaggcacacagaggggcttgttgaggccaccggaggaagcttctgccaccaatatgggacctgtgcccagcctaccagaagagagcatctgaaaacatgtatcgacatggtaacccctctgcttgaagcctcacatggctccctattgccttggtgctgaacaccctatggctgaccgtggcccagcctctgcaacagctctgcctcctctccagtgccttttcactttgtactcaaagccacatcgcattgaagccacaggtggggcaaggtcatgcatgacctgagtctccaaatcccttcaccctgtttggttctgcaacggggattaggggagccccacgatttgttttcaaaggatgtccgggctccaggacaggatgccctgggtcacctgatgacaggtgtggtggttggaaagggcctggtttcagctccgggtacacttcctccttccttctgctgcgtggtgtggcctcttccacgtcctcagaatccagctgttactccgtccgcggcctctcagctctagggccctctgcacactggcccccccagatactctgacccatggatcccctgggcccggccaagccacagtggtcgtggcgctgctgtctgaccacgctgctgtttcagctgctgatggctgtgtgtttcttctcctatctgcgtgtgtctcaagacgatcccactgtgtaccctaatgggtcccgcttcccagacagcacagggacccccgcccactccatccccctgatcctgctgtggacgtggccttttaacaaacccatagctctgccccgctgctcagagatggtgcctggcacggctgactgcaacatcactgccgaccgcaaggtgtatccacaggcagacgcggtcatcgtgcaccaccgagaggtcatgtacaaccccagtgcccagctcccacgctccccgaggcggcaggggcagcgatggatctggttcagcatggagtccccaagccactgctggcagctgaaagccatggacggatacttcaatctcaccatgtcctaccgcagcgactccgacatcttcacgccctacggctggctggagccgtggtccggccagcctgcccacccaccgctcaacctctcggccaagaccgagctggtggcctgggcagtgtccaactgggggccaaactccgccagggtgcgctactaccagagcctgcaggcccatctcaaggtggacgtgtacggacgctcccacaagcccctgccccagggaaccatgatggagacgctgtcccggtacaagttctatctggccttcgagaactccttgcaccccgactacatcaccgagaagctgtggaggaacgccctggaggcctgggccgtgcccgtggtgctgggccccagcagaagcaactacgagaggttcctgccacccgacgccttcatccacgtggacgacttccagagccccaaggacctggcccggtacctgcaggagctggacaaggaccacgcccgctacctgagctactttcgctggcgggagacgctgcggcctcgctccttcagctgggcactcgctttctgcaaggcctgctggaaactgcaggaggaatccaggtaccagacacgcggcatagcggcttggttcacctgagaggctggtgtggggcctgggctgccaggaacctcattttcctggggcctcacctgagtgggggcctcatctacctaaggactcgtttgcctgaagcttcacctgcctgaggactcacctgcctgggacggtcacctgttgcagcttcacctgcctggggattcacctacctgggtcctcactttcctggggcctcacctgctggagtcttcggtggccaggtatgtcccttacctgggatttcacatgctggcttccaggagcgtcccctgcggaagcctggcctgctggggatgtctcctggggactttgcctactggggacctcggctgttggggactttacctgctgggacctgctcccagagaccttccacactgaatctcacctgctaggagcctcacctgctggggacctcaccctggagggcactgggccctgggaactggcacccatggggccccacccatgagtgatggttctggctgatttgtttgtgatgttgttagccgcctgtgaggggtgcagagagataatcaccgcaccgtttccagatgtaatactgcaaagaaaaccgatgatgaggccgggtgcggtggctcacacctgtaatcccagcactttgggaggccgaggcaggcggatcacaaggtcaggagatcgagaccatcctggccaatatggtgaaacccgtctctactaaaaatacaaaaatttgccgggcgtggtggtgcatgcctgtaatcccagctacttgggaagctgaggcaggagaatcgcttgaaccagagagtcggaggttgcagtaagccgagatcgcgccactgcactccagcctggcgacagagcgagactctgtctcaaaaaaaaaaaaaaaa

SEQ ID NO: 11301 - DNA, 2211 bp, Homo sapiens
gcctcttccacgtcctcagaatccagctgttactccgtccgcggcctctcagctctagggccctctgcacactggcccccccagtgtcacgggcatccagacgggatccagtgcatcctcttttagaagaaaggcctgtctccagatccccgagtccctctagcatctcccagaaggtgtcagacgcagcagtgtccagggagcggcagcagattgaggaagagtctggggacacaccagaaaaggacaggatcaagatactctgacccatggatcccctgggcccggccaagccacagtggtcgtggcgctgctgtctgaccacgctgctgtttcagctgctgatggctgtgtgtttcttctcctatctgcgtgtgtctcaagacgatcccactgtgtaccctaatgggtcccgcttcccagacagcacagggacccccgcccactccatccccctgatcctgctgtggacgtggccttttaacaaacccatagctctgccccgctgctcagagatggtgcctggcacggctgactgcaacatcactgccgaccgcaaggtgtatccacaggcagacgcggtcatcgtgcaccaccgagaggtcatgtacaaccccagtgcccagctcccacgctccccgaggcggcaggggcagcgatggatctggttcagcatggagtccccaagccactgctggcagctgaaagccatggacggatacttcaatctcaccatgtcctaccgcagcgactccgacatcttcacgccctacggctggctggagccgtggtccggccagcctgcccacccaccgctcaacctctcggccaagaccgagctggtggcctgggcagtgtccaactgggggccaaactccgccagggtgcgctactaccagagcctgcaggcccatctcaaggtggacgtgtacggacgctcccacaagcccctgccccagggaaccatgatggagacgctgtcccggtacaagttctatctggccttcgagaactccttgcaccccgactacatcaccgagaagctgtggaggaacgccctggaggcctgggccgtgcccgtggtgctgggccccagcagaagcaactacgagaggttcctgccacccgacgccttcatccacgtggacgacttccagagccccaaggacctggcccggtacctgcaggagctggacaaggaccacgcccgctacctgagctactttcgctggcgggagacgctgcggcctcgctccttcagctgggcactcgctttctgcaaggcctgctggaaactgcaggaggaatccaggtaccagacacgcggcatagcggcttggttcacctgagaggctggtgtggggcctgggctgccaggaacctcattttcctggggcctcacctgagtgggggcctcatctacctaaggactcgtttgcctgaagcttcacctgcctgaggactcacctgcctgggacggtcacctgttgcagcttcacctgcctggggattcacctacctgggtcctcactttcctggggcctcacctgctggagtcttcggtggccaggtatgtcccttacctgggatttcacatgctggcttccaggagcgtcccctgcggaagcctggcctgctggggatgtctcctggggactttgcctactggggacctcggctgttggggactttacctgctgggacctgctcccagagaccttccacactgaatctcacctgctaggagcctcacctgctggggacctcaccctggagggcactgggccctgggaactggcacccatggggccccacccatgagtgatggttctggctgatttgtttgtgatgttgttagccgcctgtgaggggtgcagagagataatcaccgcaccgtttccagatgtaatactgcaaagaaaaccgatgatgaggccgggtgcggtggctcacacctgtaatcccagcactttgggaggccgaggcaggcggatcacaaggtcaggagatcgagaccatcctggccaatatggtgaaacccgtctctactaaaaatacaaaaatttgccgggcgtggtggtgcatgcctgtaatcccagctacttgggaagctgaggcaggagaatcgcttgaaccagagagtcggaggttgcagtaagccgagatcgcgccactgcactccagcctggcgacagagcgagactctgtctc

SEQ ID NO: 11302 - DNA, 527 bp, Homo sapiens
ctcagaatccagctgttactccgtccgcggcctctcagctctagggccctctgcacactggcccccccagtgggtgtctgtctgtctctcttgcagagctctgcggtagaatcccgtgccccccgaccccatcagcagcctacaccccttcatccttcctggccccggattttctctgcctctgccactcccggtggtaaaagagggcttagaatgcggtttgctttctggctttgtttttttgcatcctgatctttgtggcgtggatcgatcattttccagggaaagtaccttggtgtcacgggcatccagacgggatccagtgcatcctcttttagaagaaaggcctgtctccagatccccgagtccctctagcatctcccagaaggtgtcagacgcagcagtgtccagggagcggcagcagatactctgacccatggatcccctgggcccggccaagccacagtggtcgtggcgctgctgtctgaccacgctgctgtttcagctgctgatggctgtgtgtttct

SEQ ID NO: 11303 - DNA, 700 bp, Homo sapiens
gtggttggaaagggcctggtttcagctccgggtacacttcctccttccttctgctgcgtggtgtggcctcttccacgtcctcagaatccagctgttactccgtccgcggcctctcagctctagggccctctgcacactggcccccccagtgtcacgggcatccagacgggatccagtgcatcctcttttagaagaaaggcctgtctccagatccccgagtccctctagcatctcccagaaggtgtcagacgcagcagtgtccagggagcggcagcagatactctgacccatggatcccctgggcccggccaagccacagtggtcgtggcgctgctgtctgaccacgctgctgtttcagctgctgatggctgtgtgtttcttctcctatctgcgtgtgtctcaagacgatcccactgtgtaccctaatgggtcccgcttcccagacagcacagggacccccgcccactccatccccctgatcctgctgtggacgtggccttttaacaaacccatagctctgccccgctgctcagagatggtgcctggcacggctgactgcaacatcactgccgaccgcaaggtgtatccacaggcagacgcggtcatcgtgcaccaccgagaggtcatgtacaaccccagtgcccagctcccacgctccccgaggcggcaggggcagcgatggatctggttcagcatggag

SEQ ID NO: 11304 - DNA, 682 bp, Homo sapiens
tgtcacgggcatccagacgggatccagtgcatcctcttttagaagaaaggcctgtctccagatccccgagtccctctagcatctcccagaaggtgtcagacgcagcagtgtccagggagcggcagcaggtccttatcatggtccaagggtccctcccagcctccaagtctcaccccatacatgaaaaaaggtggccccggtttcccgccacctcctccacagcaccatctctttgaagacccagtgcccacactccgggggatttgggccctcccctgtctccctccagccccctggggccagtccgctgctgggtatctccaggacgggccaggctcagcaagttccaccaaagcctgcttctctcctgggggttccccatgtctctgggtggccccactgccctcctggtcagcatattgaggaagagtctggggacacaccagaaaaggacaggatcaagatactctgacccatggatcccctgggcccggccaagccacagtggtcgtggcgctgctgtctgaccacgctgctgtttcagctgctgatggctgtgtgtttcttctcctatctgcgtgtgtctcaagacgatcccactgtgtaccctaatgggtcccgcttcccagacagcacagggacccccgcccactccatccccctgatcctgctgtggacgtgg

SEQ ID NO: 11305 - DNA, 564 bp, Homo sapiens
acttcctccttccttctgctgcgtggtgtggcctcttccacgtcctcagaatccagctgttactccgtccgcggcctctcagctctagggccctctgcacactggcccccccagtgtcacgggcatccagacgggatccagtgcatcctcttttagaagaaaggcctgtctccagatccccgagtccctctagcatctcccagaaggtgtcagacgcagcagtgtccagggagcggcagcaggtccttatcatggtccaagggtccctcccagcctccaagtctcaccccatacatgaaaaaaggtggccccggtttcccgccacctcctccacagcaccatctctttgaagatactctgacccatggatcccctgggcccggccaagccacagtggtcgtggcgctgctgtctgaccacgctgctgtttcagctgctgatggctgtgtgtttcttctcctatctgcgtgtgtctcaagacgatcccactgtgtaccctaatgggtcccgcttcccagacagcacagggacccccgcccactccatccccctgatcctgctgtg

SEQ ID NO: 11306 - DNA, 530 bp, Homo sapiens
gttactccgtccgcggcctctcagctctagggccctctgcacactggcccccccagagctctgcggtagaatcccgtgccccccgaccccatcagcagcctacaccccttcatccttcctggccccggattttctctgcctctgccactcccggtggtaaaagagggcttagaatgcggtttgctttctggctttgtttttttgcatcctgatctttgtggcgtggatcgatcattttccagggaaagtaccttggtgtcacgggcatccagacgggatccagtgcatcctcttttagaagaaaggcctgtctccagatccccgagtccctctagcatctcccagaaggtgtcagacgcagcagtgtccagggagcggcagcagatactctgacccatggatcccctgggcccggccaagccacagtggtcgtggcgctgctgtctgaccacgctgctgtttcagctgctgatggctgtgtgtttcttctcctatctgcgtgtgtctcaagacgatcccactgtgtaccc

SEQ ID NO: 11307 - DNA, 2584 bp, Homo sapiens
ccaggctccaggccctggcttagagggagcggggagtctggacttcaggctggatcccttcctcttcctggagcgggtgctggcccccaacccgcttgcgtcagggacaaaaggactccttccctttccagcctggaaagcccctctgctgcaggctggaggaagggaccctgggcccagcctatagtcagcggtgtctatgggcatggatctggacggggaaaaggacaaagcagcctccatccacagttcattccgggaccaggcccttgcaggcacgcgctgggctcctgtgggaagacactaagggccccaggacagacctcctctccgggcatctgggttcctagatggcagaggtggcagagtggggtgggatggcccaattgggagctttagcttccggcaaagagctgagcacagtacatcttcaatgtgtaagattctcctgggagaccagggcccagctggtggtgagctgggggaagtgggtgatactgccgtgggaggagccacctggccctctggggaagtgcactcgctgtctgcagcgcccaggcctgggtagctgggtgggggctggggggccatctgtgctcagggtgcctgcacctgggccttctctgccctgggccaagcctgcccgagcctctctgtcctctgcctgcccagctggacatctctgggcctctctggagaccagtggggtgggctgtgggggcgtcatattgccctggcttggcatccctcttgtggctgtacccctcccagcagccccaggactagcaagtccccgagatgggggtggggacagtggttgatgccaaaggttgtgggggcaggggcggggcaggagcaggaaggtcccctgagttccctcaccttgggcagagataaaaggagcacagttccaggcggggctgagctagggcgtagctgtgatttcaggggcacctctggcggctgccgtgatttgagaatctcgggtctcttggctgactgatcctgggagactgtggatgaataatgctgggcacggccccacccggaggctgcgaggcttgggggtcctggccggggtggctctgctcgctgccctctggctcctgtggctgctggggtcagcccctcggggtaccccggcaccccagcccacgatcaccatccttgtctggcactggcccttcactgaccagcccccagagctgcccagcgacacctgcacccgctacggcatcgcccgctgccacctgagtgccaaccgaagcctgctggccagcgccgacgccgtggtcttccaccaccgcgagctgcagacccggcggtcccacctgcccctggcccagcggccgcgagggcagccctgggtgtgggcctccatggagtctcctagccacacccacggcctcagccacctccgaggcatcttcaactgggtgctgagctaccggcgcgactcggacatctttgtgccctatggccgcctggagccccactgggggccctcgccaccgctgccagccaagagcagggtggccgcctgggtggtcagcaacttccaggagcggcagctgcgtgccaggctgtaccggcagctggcgcctcatctgcgggtggatgtctttggccgtgccaatggacggccactgtgcgccagctgcctggtgcccaccgtggcccagtaccgcttctacctgtcctttgagaactctcagcaccgcgactacattacggagaaattctggcgcaacgcactggtggctggcactgtgccagtggtgctggggcccccacgggccacctatgaggccttcgtgccggctgacgccttcgtgcatgtggatgactttggctcagcccgagagctggcggctttcctcactggcatgaatgagagccgataccaacgcttctttgcctggcgtgacaggctccgcgtgcgactgttcaccgactggcgggaacgtttctgtgccatctgtgaccgctacccacacctaccccgcagccaagtctatgaggaccttgagggttggtttcaggcctgagatccgctggccgggggaggtgggtgtgggtggaagggctgggtgtcgaaatcaaaccaccaggcatccggcccttaccggcaagcagcgggctaacgggaggctgggcacagaggtcaggaagcaggggtggggggtgcaggtgggcactggagcatgcagaggaggtgagagtgggagggaggtaacgggtgcctgctgcggcagacgggaggggaaaggctgccgaggaccctccccaccctgaacaaatcttgggtgggtgaaggcctggctggaagagggtgaaaggcagggcccttggggctggggggcaccccagcctgaagtttgtgggggccaaacctgggaccccgagcttcctcggtagcagaggccctgtggtccccgagacacaggcacgggtccctgccacgtccatagttctgaggtccctgtgtgtaggctggggcggggcccaggagaccacggggagcaaaccagcttgttctgggctcagggagggagggcggtggacaataaacatctgagcagtg

SEQ ID NO: 11308 - DNA, 5166 bp, Homo sapiens
tttcagttggaaggaggtagggaaaataagtgctttaattcctaggattttggaagtaaaaatggaacaccagacaaaaatggaatttttaggcaaatgtaaagctttgtacttgggtatctcaaagtattatacagtgtaaactatcatgattattaaccaactagaagtagttcttttttttaaattttatttttaattttagacatgagggtcttgctatgttgcccaggctgaagtggctactgacaggcacgatgtggcactgcagcctggaactcttgggcttaagtgatccttcctgcttcttctatcttaaaaaaaaaaagttacgcttgcttgttaaaatatttttaaaatgctgtgtttaaactaagaagtaaatatccaccccacctctgacttctaaaaattatctaaagtatgactggtaagatttttacctttaatcccacataagtctaaaatttgtgttcatttccaacaaccaaagtgtgtcacttttataccagaattttgtcctgcttatacgtttagtacagaaatctcatgggagagagcatccatgcatttacaaattgttattgaattattttattgaatgatgacacccaaactgagctagaacataattctggctctgctagtacatcttctgtgtgatcttggacaagtcactctactttcctttcaattttcttttctcacagggagataatcataaaaacgactgtaaagtacagcacttcatagagtgctttttgtttaaagagctgacaataaatacgagtctcaaggtctaggaaagcctccctcacaacctgagctgcttgaggacaagggattttcttttgaatcagcagtaccttatttgtgtatctgtgatagagttcctggtacataagaaggtctcaataaatatgtgaatttatgaatattaggcagattgcaaccttgacaggccactgcctcttaaatctcctttctgtgatcttttaatatttaacatctaaaaggccgccgctacttgctttgggataagtatccccggtatgtactttaaaatgcccaagcctagagaaatgattcttgtcttaagggcaccatttcgctctcccaccgtaaagcgccccaggcttgggatctgggtcccaaggctacagggaagagtttggaacgggaagctcatcttccggccctctgattggccggctcgcactccactcacgcggcgcgcagctctgattggcctcggcggcacccctcgtcccgcgactactttgtgtgctggggcggcgcgctccggtcctcccgctcagctggcggtctgggctgctctggggcagcccttcggtccactgctctgcatcgcgggcgccgggaattttccgagtccgagcgggttgctgcttttgctcagaggacatccatgaccctaatggtctttttgttcaagataaagtgattttttgcctttgttgattaactggacaaattcagcatgtagagcgcatgaagtacaggacaataaagcttcctacacatatcaccaggaggatctctttgaaagattcactgcaggactaccagagagaataatttgtctgaagcatcatgtgttgaaacaacagaagtctattcacctgtgcactaactagaaacagagttacaatgttttcaattctttgagctccaggactccagggaagtgagttgaaaatctgaaaatgcggccatggactggttcctggcgttggattatgctcattctttttgcctgggggaccttgctgttttatataggtggtcacttggtacgagataatgaccatcctgatcactctagccgagaactgtccaagattctggcaaagcttgaacgcttaaaacaacagaatgaagacttgaggcgaatggccgaatctctccggataccagaaggccctattgatcaggggccagctataggaagagtacgcgttttagaagagcagcttgttaaggccaaagaacagattgaaaattacaagaaacagaccagaaatggtctggggaaggatcatgaaatcctgaggaggaggattgaaaatggagctaaagagctctggtttttcctacagagtgaattgaagaaattaaagaacttagaaggaaatgaactccaaagacatgcagatgaatttcttttggatttaggacatcatgaaaggtctataatgacggatctatactacctcagtcagacagatggagcaggtgattggcgggaaaaagaggccaaagatctgacagaactggttcagcggagaataacatatcttcagaatcccaaggactgcagcaaagccaaaaagctggtgtgtaatatcaacaaaggctgtggctatggctgtcagctccatcatgtggtctactgcttcatgattgcatatggcacccagcgaacactcatcttggaatctcagaattggcgctatgctactggtggatgggagactgtatttaggcctgtaagtgagacatgcacagacagatctggcatctccactggacactggtcaggtgaagtgaaggacaaaaatgttcaagtggtcgagcttcccattgtagacagtcttcatccccgtcctccatatttacccttggctgtaccagaagacctcgcagatcgacttgtacgagtgcatggtgaccctgcagtgtggtgggtgtctcagtttgtcaaatacttgatccgcccacagccttggctagaaaaagaaatagaagaagccaccaagaagcttggcttcaaacatccagttattggagtccatgtcagacgcacagacaaagtgggaacagaagctgccttccatcccattgaagagtacatggtgcatgttgaagaacattttcagcttcttgcacgcagaatgcaagtggacaaaaaaagagtgtatttggccacagatgacccttctttattaaaggaggcaaaaacaaagtaccccaattatgaatttattagtgataactctatttcctggtcagctggactgcacaatcgatacacagaaaattcacttcgtggagtgatcctggatatacattttctctctcaggcagacttcctagtgtgtactttttcatcccaggtctgtcgagttgcttatgaaattatgcaaacactacatcctgatgcctctgcaaacttccattctttagatgacatctactattttgggggccagaatgcccacaatcaaattgccatttatgctcaccaaccccgaactgcagatgaaattcccatggaacctggagatatcattggtgtggctggaaatcattgggatggctattctaaaggtgtcaacaggaaattgggaaggacgggcctatatccctcctacaaagttcgagagaagatagaaacggtcaagtaccccacatatcctgaggctgagaaataaagctcagatggaagagataaacgaccaaactcagttcgaccaaactcagttcaaaccatttcagccaaactgtagatgaagagggctctgatctaacaaaataaggttatatgagtagatactctcagcaccaagagcagctgggaactgacataggcttcaattggtggaattcctctttaacaagggctgcaatgccctcatacccatgcacagtacaataatgtactcacatataacatgcaaacaggttgttttctactttgcccctttcagtatgtccccataagacaaacactgccatattgtgtaatttaagtgacacagacattttgtgtgagacttaaaacatggtgcctatatctgagagacctgtgtgaactattgagaagatcggaacagctccttactctgaggaagttgattcttatttgatggtggtattgtgaccactgaattcactccagtcaacagattcagaatgagaatggacgtttggtttttttttgtttttgtttttgttttttcctttataaggttgtctgtttttttttttttaaataattgcatcagttcattgacctcatcattaataagtgaagaatacatcagaaaataaaatattcactctccattagaaaattttgtaaaacaatgccatgaacaaattctttagtactcaatgtttctggacattctctttgataacaaaaaataaattttaaaaaggaattttgtaaagtttctagaattttatatcattggatgatatgttgatcagccttatgtggaagaactgtgataaaaagaggagctttttagtttttcagcttatttactttgttttttttcctgtttctgatatagtaactaattcttaactcagagacattggtccattttaatactgaaaaccaattttcattggtacacattacaaaattgctaagaacactgtttgggagctttcattctcatattttggacattgttttaattgagtgaaataatcataactccttgctcccagagaagctatcacctccatttctaaaaccatttcaggtttgtttggtagtctttcttaatgtatttattatcgctttttgtgagtagggtcctgttttatccaggaaccaatttctgccctagcctatcatgccctgcttttgagagtaccaggtatctttgggattgggaagctggctgtttcagaagtatatgtctcatagtgtgcagaacttggtgaccaagtgagaagcgggaccaatgggagactcacaatggactgagtcttgggattatcttttccaaattcttccatgttagaatcacttcagaaaataagactttgatgctttgtctctgagcatcatttttctcctcataaaaacacttccttattgtatgtagcctgcctcctacagaggcctggtaggtgttactgcattctaaaagaaaaatgtcatctctgtaggagcgactatcaggcctagtgtgaaatattagggatcctaggcagaagagctattagtcctggccttcatatcttcaccaaatgaaaatactgtatataaaatttcaccaccaaacttaactaaattctttttctcaagtcaagcctcccaaagaaaaaagaaattaacttcctacagtgtcagcaagcaattttccatttagttttggtacaaataaaagtcatttgaaacaa

SEQ ID NO: 11309 - DNA, 3284 bp, Homo sapiens
ggccgacccgagcagccggttccctcctctccaggccccctccccatcccacccccgccgcctggccccagccgacccgtcccttcgtctccccgcggaatggggccggcactgctcagggtcgcgcgccctggacccagctcgctctcggtctcgcgctgtcagcgactgcccggctcgcgccgcctcgcgctctgcctcagtcagtggcgccgaaggctccgttaagcggcggcggcggttcctgtttccgtttcttcctctccgttcggtcgggagtagcatcctccactcagccacccttcccactcccccatcgtggggcagctgcggctgagggctgtggctttggcagctgcgacggggagcggcggagaccgcctctgctcccgcctggggttgctgcttttgctcagaggacatccatgaccctaatggtctttttgttcaagataaagtgattttttgcctttgttgattaactggacaaattcagcatgtagagcgcatgaagtacaggacaataaagcttcctacacatatcaccaggaggatctctttgaaagattcactgcaggactaccagagagaataatttgtctgaagcatcatgtgttgaaacaacagaagtctattcacctgtgcactaactagaaacagagttacaatgttttcaattctttgagctccaggactccagggaagtgagttgaaaatctgaaaatgcggccatggactggttcctggcgttggattatgctcattctttttgcctgggggaccttgctgttttatataggtggtcacttggtacgagataatgaccatcctgatcactctagccgagaactgtccaagattctggcaaagcttgaacgcttaaaacaacagaatgaagacttgaggcgaatggccgaatctctccggataccagaaggccctattgatcaggggccagctataggaagagtacgcgttttagaagagcagcttgttaaggccaaagaacagattgaaaattacaagaaacagaccagaaatggtctggggaaggatcatgaaatcctgaggaggaggattgaaaatggagctaaagagctctggtttttcctacagagtgaattgaagaaattaaagaacttagaaggaaatgaactccaaagacatgcagatgaatttcttttggatttaggacatcatgaaaggtctataatgacggatctatactacctcagtcagacagatggagcaggtgattggcgggaaaaagaggccaaagatctgacagaactggttcagcggagaataacatatcttcagaatcccaaggactgcagcaaagccaaaaagctggtgtgtaatatcaacaaaggctgtggctatggctgtcagctccatcatgtggtctactgcttcatgattgcatatggcacccagcgaacactcatcttggaatctcagaattggcgctatgctactggtggatgggagactgtatttaggcctgtaagtgagacatgcacagacagatctggcatctccactggacactggtcaggtgaagtgaaggacaaaaatgttcaagtggtcgagcttcccattgtagacagtcttcatccccgtcctccatatttacccttggctgtaccagaagacctcgcagatcgacttgtacgagtgcatggtgaccctgcagtgtggtgggtgtctcagtttgtcaaatacttgatccgcccacagccttggctagaaaaagaaatagaagaagccaccaagaagcttggcttcaaacatccagttattggagtccatgtcagacgcacagacaaagtgggaacagaagctgccttccatcccattgaagagtacatggtgcatgttgaagaacattttcagcttcttgcacgcagaatgcaagtggacaaaaaaagagtgtatttggccacagatgacccttctttattaaaggaggcaaaaacaaagtaccccaattatgaatttattagtgataactctatttcctggtcagctggactgcacaatcgatacacagaaaattcacttcgtggagtgatcctggatatacattttctctctcaggcagacttcctagtgtgtactttttcatcccaggtctgtcgagttgcttatgaaattatgcaaacactacatcctgatgcctctgcaaacttccattctttagatgacatctactattttgggggccagaatgcccacaatcaaattgccatttatgctcaccaaccccgaactgcagatgaaattcccatggaacctggagatatcattggtgtggctggaaatcattgggatggctattctaaaggtgtcaacaggaaattgggaaggacgggcctatatccctcctacaaagttcgagagaagatagaaacggtcaagtaccccacatatcctgaggctgagaaataaagctcagatggaagagataaacgaccaaactcagttcgaccaaactcagttcaaaccatttcagccaaactgtagatgaagagggctctgatctaacaaaataaggttatatgagtagatactctcagcaccaagagcagctgggaactgacataggcttcaattggtggaattcctctttaacaagggctgcaatgccctcatacccatgcacagtacaataatgtactcacatataacatgcaaacaggttgttttctactttgcccctttcagtatgtccccataagacaaacactgccatattgtgtaatttaagtgacacagacattttgtgtgagacttaaaacatggtgcctatatctgagagacctgtgtgaactattgagaagatcggaacagctccttactctgaggaagttgattcttatttgatggtggtattgtgaccactgaattcactccagtcaacagattcagaatgagaatggacgtttggtttttttttgtttttgtttttgttttttcctttataaggttgtctgtttttttttttttaaataattgcatcagttcattgacctcatcattaataagtgaagaatacatcagaaaataaaatattcactctccattagaaaattttgtaaaacaatgccatgaacaaattctttagtactcaatgtttctggacattctctttgataacaaaaaataaattttaaaaaggaattttgtaaagtttctagaattttatatcattggatgatatgttgatcagccttatgtggaagaactgtgataaaaagaggagctttttagtttttcagctt

SEQ ID NO: 11310 - DNA, 3559 bp, Homo sapiens
cgtttagtacagaaatctcatgggagagagcatccatgcatttacaaattgttattgaattattttattgaatgatgacacccaaactgagctagaacataattctggctctgctagtacatcttctgtgtgatcttggacaagtcactctactttcctttcaattttcttttctcacagggagataatcataaaaacgactgtaaagtacagcacttcatagagtgctttttgtttaaagagctgacaataaatacgagtctcaaggtctaggaaagcctccctcacaacctgagctgcttgaggacaagggattttcttttgaatcagcagtaccttatttgtgtatctgtgatagagttcctggtacataagaaggtctcaataaatatgtgaatttatgaatattaggcagattgcaaccttgacaggccactgcctcttaaatctcctttctgtgatcttttaatatttaacatctaaaaggccgccgctacttgctttgggataagtatccccggtatgtactttaaaatgcccaagcctagagaaatgattcttgtcttaagggcaccatttcgctctcccaccgtaaagcgccccaggcttgggatctgggtcccaaggctacagggaagagtttggaacgggaagctcatcttccggccctctgattggccggctcgcactccactcacgcggcgcgcagctctgattggcctcggcggcacccctcgtcccgcgactactttgtgtgctggggcggcgcgctccggtcctcccgctcagctggcggtctgggctgctctggggcagcccttcggtccactgctctgcatcgcgggcgccgggaattttccgagtccgagcggcatgtagagcgcatgaagtacaggacaataaagcttcctacacatatcaccaggaggatctctttgaaagattcactgcaggactaccagagagaataatttgtctgaagcatcatgtgttgaaacaacagaagtctattcacctgtgcactaactagaaacagagttacaatgttttcaattctttgagctccaggactccagggaagtgagttgaaaatctgaaaatgcggccatggactggttcctggcgttggattatgctcattctttttgcctgggggaccttgctgttttatataggtggtcacttggtacgagataatgaccatcctgatcactctagccgagaactgtccaagattctggcaaagcttgaacgcttaaaacaacagaatgaagacttgaggcgaatggccgaatctctccggataccagaaggccctattgatcaggggccagctataggaagagtacgcgttttagaagagcagcttgttaaggccaaagaacagattgaaaattacaagaaacagaccagaaatggtctggggaaggatcatgaaatcctgaggaggaggattgaaaatggagctaaagagctctggtttttcctacagagtgaattgaagaaattaaagaacttagaaggaaatgaactccaaagacatgcagatgaatttcttttggatttaggacatcatgaaaggtctataatgacggatctatactacctcagtcagacagatggagcaggtgattggcgggaaaaagaggccaaagatctgacagaactggttcagcggagaataacatatcttcagaatcccaaggactgcagcaaagccaaaaagctggtgtgtaatatcaacaaaggctgtggctatggctgtcagctccatcatgtggtctactgcttcatgattgcatatggcacccagcgaacactcatcttggaatctcagaattggcgctatgctactggtggatgggagactgtatttaggcctgtaagtgagacatgcacagacagatctggcatctccactggacactggtcaggtgaagtgaaggacaaaaatgttcaagtggtcgagcttcccattgtagacagtcttcatccccgtcctccatatttacccttggctgtaccagaagacctcgcagatcgacttgtacgagtgcatggtgaccctgcagtgtggtgggtgtctcagtttgtcaaatacttgatccgcccacagccttggctagaaaaagaaatagaagaagccaccaagaagcttggcttcaaacatccagttattggagtccatgtcagacgcacagacaaagtgggaacagaagctgccttccatcccattgaagagtacatggtgcatgttgaagaacattttcagcttcttgcacgcagaatgcaagtggacaaaaaaagagtgtatttggccacagatgacccttctttattaaaggaggcaaaaacaaagtaccccaattatgaatttattagtgataactctatttcctggtcagctggactgcacaatcgatacacagaaaattcacttcgtggagtgatcctggatatacattttctctctcaggcagacttcctagtgtgtactttttcatcccaggtctgtcgagttgcttatgaaattatgcaaacactacatcctgatgcctctgcaaacttccattctttagatgacatctactattttgggggccagaatgcccacaatcaaattgccatttatgctcaccaaccccgaactgcagatgaaattcccatggaacctggagatatcattggtgtggctggaaatcattgggatggctattctaaaggtgtcaacaggaaattgggaaggacgggcctatatccctcctacaaagttcgagagaagatagaaacggtcaagtaccccacatatcctgaggctgagaaataaagctcagatggaagagataaacgaccaaactcagttcgaccaaactcagttcaaaccatttcagccaaactgtagatgaagagggctctgatctaacaaaataaggttatatgagtagatactctcagcaccaagagcagctgggaactgacataggcttcaattggtggaattcctctttaacaagggctgcaatgccctcatacccatgcacagtacaataatgtactcacatataacatgcaaacaggttgttttctactttgcccctttcagtatgtccccataagacaaacactgccatattgtgtaatttaagtgacacagacattttgtgtgagacttaaaacatggtgcctatatctgagagacctgtgtgaactattgagaagatcggaacagctccttactctgaggaagttgattcttatttgatggtggtattgtgaccactgaattcactccagtcaacagattcagaatgagaatggacgtttggtttttttttgtttttgtttttgttttttcctttataaggttgtctgtttttttttttttaaataattgcatcagttcattgacctcatcattaataagtgaagaatacatcagaaaataaaatattcactctccattagaaaattttgtaaaacaatgccatgaacaaattctttagtactcaatgtttctggacattctctttgataacaaaaaataaattttaaaaaggaa

SEQ ID NO: 11311 - DNA, 1368 bp, Homo sapiens
ctgtatttaggcctgtaagtgagacatgcacagacagatctggcatctccactggacactggtcaggtaccccaattatgaatttattagtgataactctatttcctggtcagctggactgcacaatcgatacacagaaaattcacttcgtggagtgatcctggatatacattttctctctcaggcagacttcctagtgtgtactttttcatcccaggtctgtcgagttgcttatgaaattatgcaaacactacatcctgatgcctctgcaaacttccattctttagatgacatctactattttgggggccagaatgcccacaatcaaattgccatttatgctcaccaaccccgaactgcagatgaaattcccatggaacctggagatatcattggtgtggctggaaatcattgggatggctattctaaaggtgtcaacaggaaattgggaaggacgggcctatatccctcctacaaagttcgagagaagatagaaacggtcaagtaccccacatatcctgaggctgagaaataaagctcagatggaagagataaacgaccaaactcagttcgaccaaactcagttcaaaccatttcagccaaactgtagatgaagagggctctgatctaacaaaataaggttatatgagtagatactctcagcaccaagagcagctgggaactgacataggcttcaattggtggaattcctctttaacaagggctgcaatgccctcatacccatgcacagtacaataatgtactcacatataacatgcaaacaggttgttttctactttgcccctttcagtatgtccccataagacaaacactgccatattgtgtaatttaagtgacacagacattttgtgtgagacttaaaacatggtgcctatatctgagagacctgtgtgaactattgagaagatcggaacagctccttactctgaggaagttgattcttatttgatggtggtattgtgaccactgaattcactccagtcaacagattcagaatgagaatggacgtttggtttttttttgtttttgtttttgttttttcctttataaggttgtctgtttttttttttttaaataattgcatcagttcattgacctcatcattaataagtgaagaatacatcagaaaataaaatattcactctccattagaaaattttgtaaaacaatgccatgaacaaattctttagtactcaatgtttctggacattctctttgataacaaaaaataaattttaaaaaggaattttgtaaagtttctagaattttatatcattggatgatatgttgatcagccttatgtggaagaactgtgataaaaagaggagctttttagtttttcagctt

SEQ ID NO: 11312 - DNA, 727 bp, Homo sapiens
gcgctctgcctcagtcagtggcgccgaaggctccgttaagcggcggcggcggttcctgtttccgtttcttcctctccgttcggtcgggagtagcatcctccactcagccacccttcccactcccccatcgtggggcagctgcggctgagggctgtggctttggcagctgcgacggggagcggcggagaccgcctctgctcccgcctggggttgctgcttttgctcagaggacatccatgaccctaatggtctttttgttcaagataaagtgattttttgcctttgttgattaactggacaaattcagctccttatttgaccctgaaaatgttgcagtgagaatagcctttgcatgcatagtccttaaccctgaagaaaaggataaaagaaaataaaatcaaaacttagttgaaaatcaggaagtgcggacaagcttctgtcgagaaaatggagcatgtagagcgcatgaagtacaggacaataaagcttcctacacatatcaccaggaggatctctttgaaagattcactgcaggactaccagagagaataatttgtctgaagcatcatgtgttgaaacaacagaagtctattcacctgtgcactaactagaaacagagttacaatgttttcaattctttgagctccaggactccagggaagtgagttgaaaatctgaaaatgcggccatggactggttcctggcgttggattatgctcattctttt

SEQ ID NO: 11313 - DNA, 554 bp, Homo sapiens
agtggcgccgaaggctccgttaagcggcggcggcggttcctgtttccgtttcttcctctccgttcggtcgggagtagcatcctccactcagccacccttcccactcccccatcgtggggcagctgcggctgagggctgtggctttggcagctgcgacggggagcggcggagaccgcctctgctcccgcctgggcatgtagagcgcatgaagtacaggacaataaagcttcctacacatatcaccaggaggatctctttgaaagattcactgcaggactaccagagagaataatttgtctgaagcatcatgtgttgaaacaacagaagtctattcacctgtgcactaactagaaacagagttacaatgttttcaattctttgagctccaggactccagggaagtgagttgaaaatctgaaaatgcggccatggactggttcctggcgttggattatgctcattctttttgcctgggggaccttgctgttttatataggtggtcacttggtacgagataatgaccatcctgatcactctagccgagaactgtccaa

SEQ ID NO: 11314 - DNA, 632 bp, Homo sapiens
gatgatcctagtagaagtcaaatgagatcatttttgatagttggtttgcaggcttcggtgtatgcacccaacctttcaaagactgcctgtgcttttcagggagctcagttttgtgactgaaaggatcagctattctcttctacctttttaatgcactactggtttctagcagctgctgcttaacgctgttcattcttgagtttggtgaattgttttctgtgctccatgtgatttctttgtctttatgaggtacattttgactacagcatgtagagcgcatgaagtacaggacaataaagcttcctacacatatcaccaggaggatctctttgaaagattcactgcaggactaccagagagaataatttgtctgaagcatcatgtgttgaaacaacagaagtctattcacctgtgcactaactagaaacagagttacaatgttttcaattctttgagctccaggactccagggaagtgagttgaaaatctgaaaatgcggccatggactggttcctggcgttggattatgctcattctttttgcctgggggaccttgctgttttatataggtggtcacttggtacgagataatgaccatcctgatcactctagccgagaactgtccaagattc

SEQ ID NO: 11315 - DNA, 583 bp, Homo sapiens
agcccttcggtccactgctctgcatcgcgggcgccgggaattttccgagtccgagcgggttgctgcttttgctcagaggacatccatgaccctaatggtctttttgttcaagataaagtgattttttgcctttgttgattaactggacaaattcagattctattttgaccagcaataagttgaattatggggctagaagataaggactaaaaacaagaattggtgtccagaaagcatgtagagcgcatgaagtacaggacaataaagcttcctacacatatcaccaggaggatctctttgaaagattcactgcaggactaccagagagaataatttgtctgaagcatcatgtgttgaaacaacagaagtctattcacctgtgcactaactagaaacagagttacaatgttttcaattctttgagctccaggactccagggaagtgagttgaaaatctgaaaatgcggccatggactggttcctggcgttggattatgctcattctttttgcctgggggaccttgctgttttatataggtggtcacttggtacgagataatgaccatcctgatcactctagccg

SEQ ID NO: 11316 - DNA, 639 bp, Homo sapiens
gcgactactttgtgtgctggggcggcgcgctccggtcctcccgctcagctggcggtctgggctgctctggggcagcccttcggtccactgctctgcatcgcgggcgccgggaattttccgagtccgagcggagacagggtttctctgtgttgcccaggctggtctcgaactctgagctcaagcgacctgcccacctcggccacccaaaatgttgggattacaggggttgctgcttttgctcagaggacatccatgaccctaatggtctttttgttcaagataaagtgattttttgcctttgttgattaactggacaaattcagcatgtagagcgcatgaagtacaggacaataaagcttcctacacatatcaccaggaggatctctttgaaagattcactgcaggactaccagagagaataatttgtctgaagcatcatgtgttgaaacaacagaagtctattcacctgtgcactaactagaaacagagttacaatgttttcaattctttgagctccaggactccagggaagtgagttgaaaatctgaaaatgcggccatggactggttcctggcgttggattatgctcattctttttgcctgggggaccttgctgttttatataggtggtcacttggt

SEQ ID NO: 11317 - DNA, 2269 bp, Homo sapiens
gtgtgctggggcggcgcgctccggtcctcccgctcagctggcggtctgggctgctctggggcagcccttcggtccactgctctgcatcgcgggcgccgggaattttccgagtccgagcgggttgctgcttttgctcagaggacatccatgaccctaatggtctttttgttcaagataaagtgattttttgcctttgttgattaactggacaaattcaggataccagaaggccctattgatcaggggccagctataggaagagtacgcgttttagaagagcagcttgttaaggccaaagaacagattgaaaattacaagaaacagaccagaaatggtctggggaaggatcatgaaatcctgaggaggaggattgaaaatggagctaaagagctctggtttttcctacagagtgaattgaagaaattaaagaacttagaaggaaatgaactccaaagacatgcagatgaatttcttttggatttaggacatcatgaaaggtctataatgacggatctatactacctcagtcagacagatggagcaggtgattggcgggaaaaagaggccaaagatctgacagaactggttcagcggagaataacatatcttcagaatcccaaggactgcagcaaagccaaaaagctggtgtgtaatatcaacaaaggctgtggctatggctgtcagctccatcatgtggtctactgcttcatgattgcatatggcacccagcgaacactcatcttggaatctcagaattggcgctatgctactggtggatgggagactgtatttaggcctgtaagtgagacatgcacagacagatctggcatctccactggacactggtcaggtgaagtgaaggacaaaaatgttcaagtggtcgagcttcccattgtagacagtcttcatccccgtcctccatatttacccttggctgtaccagaagacctcgcagatcgacttgtacgagtgcatggtgaccctgcagtgtggtgggtgtctcagtttgtcaaatacttgatccgcccacagccttggctagaaaaagaaatagaagaagccaccaagaagcttggcttcaaacatccagttattggagtccatgtcagacgcacagacaaagtgggaacagaagctgccttccatcccattgaagagtacatggtgcatgttgaagaacattttcagcttcttgcacgcagaatgcaagtggacaaaaaaagagtgtatttggccacagatgacccttctttattaaaggaggcaaaaacaaagtaccccaattatgaatttattagtgataactctatttcctggtcagctggactgcacaatcgatacacagaaaattcacttcgtggagtgatcctggatatacattttctctctcaggcagacttcctagtgtgtactttttcatcccaggtctgtcgagttgcttatgaaattatgcaaacactacatcctgatgcctctgcaaacttccattctttagatgacatctactattttgggggccagaatgcccacaatcaaattgccatttatgctcaccaaccccgaactgcagatgaaattcccatggaacctggagatatcattggtgtggctggaaatcattgggatggctattctaaaggtgtcaacaggaaattgggaaggacgggcctatatccctcctacaaagttcgagagaagatagaaacggtcaagtaccccacatatcctgaggctgagaaataaagctcagatggaagagataaacgaccaaactcagttcgaccaaactcagttcaaaccatttcagccaaactgtagatgaagagggctctgatctaacaaaataaggttatatgagtagatactctcagcaccaagagcagctgggaactgacataggcttcaattggtggaattcctctttaacaagggctgcaatgccctcatacccatgcacagtacaataatgtactcacatataacatgcaaacaggttgttttctactttgcccctttcagtatgtccccataagacaaacactgccatattgtgtaatttaagtgacacagacattttgtgtgagacttaaaacatggtgcctatatctgagagacctgtgtgaactattgagaagatcggaacagctccttactctgaggaagttgattcttatttgatggtggtattgtgaccactgaattcactccagtcaacagattcagaatgagaatggacgtttggtttttttttgtttttgtttttgttttt

SEQ ID NO: 11318 - DNA, 751 bp, Homo sapiens
gtcagtggcgccgaaggctccgttaagcggcggcggcggttcctgtttccgtttcttcctctccgttcggtcgggagtagcatcctccactcagccacccttcccactcccccatcgtggggcagctgcggctgagggctgtggctttggcagctgcgacggggagcggcggagaccgcctctgctcccgcctggggttgctgcttttgctcagaggacatccatgaccctaatggtctttttgttcaagataaagtgattttttgcctttgttgattaactggacaaattcagattctattttgaccagcaataagttgaattatggggctagaagataaggactaaaaacaagaattggtgtccagaaagcatgtagagcgcatgaagtacaggacaataaagcttcctacacatatcaccaggaggatctctttgaaagattcactgcaggactaccagagagaataatttgtctgaagcatcatgtgttgaaacaacagaagtctattcacctgtgcactaactagaaacagagttacaatgttttcaattctttgagctccaggactccagggaagtgagttgaaaatctgaaaatgcggccatggactggttcctggcgttggattatgctcattctttttgcctgggggaccttgctgttttatataggtggtcacttggtacgagataatgaccatcctgatcactctagccgagaactgtccaagattctggcaaagcttga

SEQ ID NO: 11319 - DNA, 2715 bp, Homo sapiens
gcagcttcagcgaagccggagatgggcagagagcgcgcgcggcgcagcagctccagattcactgctctcccctgcagctccccgcgcccccgccgctgtcgctgcctcggtgtcccccagccccagtcgcgctcttaggacagcgccgccaccgccgcctggccctgcctgcctcctgcgccgcgcagccctcgcgagcgccccggatggcgctttacccctaggaccgatttagaatgtaataactcaaggatttgataatacagtgaagtagtataacaactgtctacgtgcttcccatgatatgttctctatattgaaaaattatgacatcaacatccaaaggaattcttcgcccatttttaattgtctgcattatcctgggctgtttcatggcatgtcttctcatttacatcaaacctaccaacagctggatcttcagtccaatggaatcagccagctctgtgctgaaaatgaaaaacttcttttccaccaaaactgattattttaatgaaactactattctggtgtgggtgtggccatttgggcagacctttgaccttacatcctgccaagcaatgttcaacatccaaggatgccatctcacaacggaccgttcactgtacaacaaatcccatgcagttctgatccatcaccgagacatcagttgggatctgacaaatttacctcagcaagctaggccacccttccagaaatggatttggatgaatttggaatcaccaactcacactccccaaaagagtggcattgagcacttgtttaacctgactctgacttaccgccgtgattcagatatccaagtgccttatggcttcttgacggtaagcacaaatcccttcgtgtttgaagtgccaagcaaagagaaattggtgtgctgggttgtgagtaactggaaccctgagcatgccagagtcaagtattacaatgagctaagcaaaagcattgaaatccatacctacgggcaagcatttggagaatatgtcaatgataaaaatttgattcctaccatatctacttgtaaattttatctttcctttgaaaattcaatccacaaggattacatcacggaaaagctatacaatgcttttctggctggctctgtacctgttgttctgggaccatctagggaaaactatgagaattatattccagcagattcattcattcatgtggaagattataactctcccagtgagctagcaaagtatctgaaggaagtcgacaaaaacaataagttataccttagttactttaactggaggaaggatttcactgtaaatcttccacgattttgggaatcacatgcatgtttggcttgcgatcatgtgaaaaggcatcaagaatataagtctgttggtaatttagagaaatggttttggaattaaaatttttcatcacttgcacacttgataaatattttgatgagatatcatccaagtattgaggataagaagagatgcaacatactacttttgtgtcacaatttatttttatcaccctctctagggtaacgtgtatattttggtggagatttttaaaagctcagcatgagcaatcattccattcggttttaaattatcctgtatatacctaattatgtgcactggagagtaatttattcttcattatcatttgtaaacattgttttttcacatttttgtagttgtccataatgtaagcttgtggtttgattattgtttccacactgatcagctgtttaatctatttgggaaatgaagatgcacatcttaaagtatgaaaaattttcactaagtattacaatgtctagttccaactttgcatactataacagaggaagaacatgttgcgattgaattctaacctctttgactccgaagatgaatgaagtgtataactgtctctatttgatctattttttttacctgtttatcacatttgtgaaggtgaaattattcatggagtgaataagaaagatatgaagcagaactgttctattcgggaagctattagacttctcatttattttcattaagctgatttgcagctacttattctcatggtcttaaattaaattattcaagtatttttaaatatccaatttgttgtgattttcagcacctgggaagtaatcccaataatactttagaaaatctaagacagttctttctgctactgatgacactcattgtcataataaaacaaataatttcctcaaataacaaagaaaaatgatacctataaatatatttataaatggtgtcatttatgaacaatgtttaattatgtatcaatttaagatttttttctgaagccctaatatttaaaatggtcttattttaccatatggatataagatttggctcataatgatgagccctatcatttgatttgagttctatcatttaagagagcctaaataaaattatcatcaaggtattaaatataagacgttaaatataataaagtggggatatatagaaaacacacagtgttagcacacagtaagatctcaatgcacatttgttggatgaataaataaatgcaattgaattcccagaaaaatgattgtttcaaggaagtgacagttctactttagaagtactaattggagatgacttttatatcccattttggtaattattcatacatagcacatatgaccatgatgttcagggctttatagaaccaaataaacctaccattacatgaaaa

SEQ ID NO: 11320 - DNA, 7364 bp, Homo sapiens
gtaaagcggagcggctgcagcctgctgttgagtgagaaaacaaaattatcttcctttccaaatccaaaaagatgaaaacgactgagatactttcaaaagacaaccaagtgagcagcacagactaatgagtagaatcaataagaacgtggttttggcccttttaacgctgacaagttctgcatttctgctgtttcagttgtactactacaagcactatttatcaacaaagaatggagctggtttgtcaaaatccaaaggaagccgaattggatttgatagcacacagtggcgtgcagttaaaaaatttattatgttaacatccaaccaaaatgtaccagtgtttcttattgatcctttgatactggaattgattaataagaactttgaacaagtcaaaaatacttctcatggctctacttcacaatgcaagtttttctgtgttccaagagactttactgcatttgcactgcagtatcacctatggaagaatgaggaaggctggtttcggatagctgagaatatgggatttcagtgcctaaagattgagagtaaagatccccggctagacgggatagactcactctctggaactgaaatccccctgcactatatctgcaaactggccactcatgcgatccacttggtagtctttcatgagaggagtggcaactacctctggcacggccacttgagacttaaagaacacattgacaggaaatttgttcccttccgaaagttacagtttggtcgttatccaggagcttttgacaggccagagttacagcaagttactgttgatggactggaagttctcattccaaaggatccaatgcactttgtagaagaagtaccacactctaggtttattgagtgtaggtataaagaagctcgagcattctttcagcagtaccttgatgataacactgtggaagctgtggcctttcggaagagtgcaaaggaattactgcaactagcagcgaaaacattaaacaaattgggagtaccattctggctgagcagtggaacttgtctaggatggtatcgacaatgcaacattattccttatagcaaagatgttgacctaggaatttttatacaagattacaaatctgatattattttagcatttcaggatgcaggacttccgctcaaacacaaatttgggaaggtagaagacagcttggaactatccttccagggaaaagatgatgtaaaacttgatgtttttttcttctatgaagaaactgatcacatgtggaatggaggcactcaggccaaaacaggaaaaaaattcaaatacctgtttccgaagtttacactgtgctggactgagtttgtagacatgaaggtccatgtaccctgtgaaaccctcgaatacattgaagccaactatggtaagacctggaagattcctgtaaagacgtgggactggaagcgctctcctcccaatgtgcaacccaatggaatctggcctatttctgagtgggatgaggttatccagttatattgagatagtaggttgaaatgggagaatttctcttttggaaaaaaaggtagataactgtttaaaaaatacatgtctatttgtcaaacataagtgggaaccaaagaaaaaatgtgacaagtttgaagacacagaaagagtcatctgatgtaattctctcacttagtactgaggaattttcatgtgccacatacaatgctaggttacagtggagaagcctagatgaatgagacaaatacctacttcttttattcctccttttggtaaacaactcaattttcctttgagggaaccctcccccaccctttgaagagttcaagttctgtacaggtttttaaaacgtgaagtaatgtttgaactggaagatgagctcaccaggcaaagctaaggaaggatatactagttgaaaagaataacccactcctcttctgggcatttaagctggtatgttagtgctacttttaagattgtggagtctgagttaatattcaagtgatcagactttgagtgacatcaagaaaagatgatatcaggttcatttttcaactaatcttatgtggaattgaattagagaacaaggcattattcttttagggaaggtgagagcttatttgtatcagagcttattacttgtcaggataagtaaatttctgtacatgtactgttttcatatgtgaagtgagaagaaactttatgcttgtttaatgcttaaatttccatccattgtgagaatattttcactgacctctgatggcacttgttgacaaatcattcaagtgagaccatgttactagacatgatcttgaaagaggccatgatttcacaaaactcatttttattttattctcagacagtctgttaggtaaaaatatgagaaattcatgtacattttatattttctgaatttataatctgtgcactcccaattttaatgacactaaaatattaatagaattttttaaatatactctaatttttaaaacatactctttattatcttcatttatcaattacagcttcgtatctctaatttatggtctatataccaatttaaatggcatgtaaacctgcctgtttcttctcctcttctaatatatcagatctccaaaatggaagctaaatggtggacttgacaactattcaccctacctcagatcatagagtttgtaaagtttgtgtccctccccagtttttcagtctgttgaatgtcgatggggcaagaactcagacttctactttaccaagtaccacacactctggaatgctttagtttccttttcccctcaagatgtctgagtcagctaggatgctgtttaccccatctctctcttatatcacttgaatgatatattgtaagtgagaggtaaaggaaaatgtaggcacaataagcactgctatttttctctttgtctaggaaaggaagctgaatcttatatcttatctatgctatttaggactactttctggagcttggcagattttcctctgacaccagagaacaatagtagtctcaagaatggaaacctgaatgtctgagggaatgggctggtagactttttcgaaaacaaattagagaaagtaacttacaaccacccattccggatttgtaaagcaacatgaaaacctttgataaatgataaccaacagtcttctgtcctaatttgcattctcaatgcagaattattgggtctttcataaataacatgagtggtttctggagacatttaagattgtcagcaaacttgtcccaaaatggcacatcatcataatccattttctctttgctagaaaatcagcccatagagtgcattcccaaattctaaatagctgaccctaaattcatttttcatgcttaaaaataatagaacaaataataatactatttttgggcaaaatccaccctacttgatgaggaccatttgcttgtgctcagtatttagaaatgcatacactccacatttctccccatttccaattgggactcccattctttgccaggagatcttacccatcccttttcagattaatcttttatcctttcctgaagtacaaagtcttaagagtgtctgaaatccaagacatcttggcccaattgacacaggttctatattcttccctacatagaccactggctgctgaaatacttttcttgtcttctggtttcacaggcttcagctcatgggttccaccctaacttggggaaacaaaagccttctctagaatctgaaggccaggcttacctctgattctgattcatccatacttcatcttatgtattttaacagttgggttctgtggagtgtccagagaccttgggttaggtatatccatcttcagtacctcattggatcacttttctttcatcacttgagtattctagcagtcattctcctaatctgaccactttcaggtttagtttacctggcttacctggggaagttgacaacttgttggtagttaggcacccatgaatgtctccagagacatcctgagaggcaagattcctcttaattgataaccaggacaaccaggtagtcacccagtcctctctaagcagggagcacttgtccttctctcctctgctgcagctactgatatctggcccctggaataaaaccatagttcctaaaattgagcatccctaagagtagctgcttggtgggacagctgatttctttgattccctagctgcaaaacctgaaattgaccactaggtgacagaatgtttgccagtatccccacaaaacaagttaaaacttaagtgaaaatcattctgcttttgaatcttaaaagctagaaaaaccataatgtaatattctttttaaaccctcttattttataactaaataaataatcacagaaaagaatgatctgaacaagaacagctgaggctaaaacccaagactgccgtgactcctagtccaatgtctgtttcgcatcacaacacagtatctttaacagtgcttgagatgcttaacagagaaggcatccagtgcttcattgaggctaagtctcagggtgtttctgccgcttagtatctttttgttcagattgagaacctaaggcgacagagaggtcaaggggaagtattttctagttcagaattcagaattcttaggcaaccttcatacctttatctggaaaatgccttctctccagacaataagacagttcacatctggagacatcagcctttggtacctaattctctaagctcaagatgcatcccattgccactttaccattctatttcccaagggaaccatcagcaccaacctgctaaatgcctgtatttgaagtctctccccttcctgaagtgaccttttatgaggctctttccttcctaagggacctttccctggtagtagtggtctcattcacaaaaaagaataatagatgtaactggagtcactttgcagttttcaagattttttttttatctgcttggctggaaaggagactagagtatctagtttttagtatttaaactacttttaattatttatattgatactctctgataaatgcaggtagttaagaatagattgtactcattcctttttgagtttgtgacctcaaaccattgtttttattcttacacgactacagtacttcaaatggcacatagataggcaggatattacataggtaagcaggaatttatacattgggtaccagagctaaatctggaaaacacatttggaatgagcttccacacttcagtctaaaatctcacccaaacttatggctacatatttttctaagtttcccccctagtttcactttctggaaagtgaacagttttttaaatcctaaatgttataaatccttaggagaaatattccctcaaaacctagtcaagaaagtgccacattcccaccttctaacaggtaattattagttgtaatagctttaatgcatggaaaaacttcagttactgaccagtcaagagaatttctcaagaaaaatcccagcaacgttccctctttcctccttgtcttccactatcattaagacctgggctagatcacctctaacatctcactcagggaaggcaatgtgttgccataaaaagaccacaagcttttgagttaggcctgaatttgaatttcagcttaatcatgtgggatttatggtgggggccctttcagtctcaatttccacattagtgaactggggaaatgatacatacttctaagggtttttagggggattaaatgaagtatacagttcttagcctcaggcctaggattaagtaagtactcaagaaatgtgcaattttctagttccatgtttcttttctaatcttcaaatggaattatagaaaccatgggtcagaacatattcctttactcaaaagattgcatgactgaatttgcttaagaaaaaaaaaattgtatcaagtcattaatacaattatacattaattatattacattaatacaatatatggtttgtgaattcagagacattaccagtttgcctccttctctcaatagaacttgtattttcattttcttggttaagcagttgtctcctaatattatcccatatgctacctagtttgctggtcccaagcagtttactgtacttcactagatttggtacctgctctcccctggacttctttttcaatattctagcctttcctagatgtaaatctttacctccttgttagtgaaattagatataagccatgatttggagagggaagaaatctggaatacttaatttcatttaattatctatgctgatgaatgcctgtatcattgttaataaaggagaattgaaaatactcatttctactttctgccctcaaatttctgtttctatctcaactaggcaagaatcagcagggtgcatgatgccattttaagctgcttcacatcagactgaaatcctaattacagttcataagtgaaacagactaattcaatggcaataccttttgtataggtcctgtgcttaaaggaggcaagtataaattttctaataagaaatccctgcttcttttgggtgcagtggctcacacctgtaataccagcagtttgagaagctaaggcaggtggatcacttgaggccaggagttcgagaccagcctggccaacatagtgaaaccccgtctcttctaaaaatacaaaaaaattagctgggcatggtggtgcacgcctatagtcccagctacacaggaggctgaggcaggagaatcacttgaacccgggaagcagagtctgcagtgagccaagatcgcggcattgcacttcagcctgggcgatagagcaagactctgtctcagaaaaaaaaaaaaaggaaagaaagaaatctctgcttccgtactatcaaaacttctaccctagaataccccctggcaccttctaacccaacctaatacagagattttgtagggacccattaacaagctcctatataattataagcagctctcacagtagggttgaaagagaatataaggaaaattagaagtactgtatttttgctattggaaatgaaatattgtttcatgcacctttgaaaaaaataacaggattttacagccttctgatgattcattcaaagcatggggaatagttcatatgtttgttaaatgaaaatcttatgtagctatttgtgtgtccctcccacttcataactacaaaaacatatatatgaatttctaaacaaagtgatattttaaagatgaattgattcaatgtgtacttaccagtttactgtgtggttttatcttcaggtacagatagtttgtggtactacttgaaaatacctttaatattattttcatcagaatttgtaatatataatccagtttgggatgatgaataaaatttttctaatctcttga

SEQ ID NO: 11321 - DNA, 1602 bp, Homo sapiens
tctttaaaaatatcttttttgttcacagaaaacaaaattatcttcctttccaaatccaaaaagatgaaaacgactgagatactttcaaaagacaaccaagtgagcagcacagactaatgagtagaatcaataagaacgtggttttggcccttttaacgctgacaagttctgcatttctgctgtttcagttgtactactacaagcactatttatcaacaaagaatggagctggtttgtcaaaatccaaaggaagccgaattggatttgatagcacacagtggcgtgcagttaaaaaatttattatgttaacatccaaccaaaatgtaccagtgtttcttattgatcctttgatactggaattgattaataagaactttgaacaagtcaaaaatacttctcatggctctacttcacaatgcaagtttttctgtgttccaagagactttactgcatttgcactgcagtatcacctatggaagaatgaggaaggctggtttcggatagctgagaatatgggatttcagtgcctaaagattgagagtaaagatccccggctagacgggatagactcactctctggaactgaaatccccctgcactatatctgcaaactggccactcatgcgatccacttggtagtctttcatgagaggagtggcaactacctctggcacggccacttgagacttaaagaacacattgacaggaaatttgttcccttccgaaagttacagtttggtcgttatccaggagcttttgacaggccagagttacagcaagttactgttgatggactggaagttctcattccaaaggatccaatgcactttgtagaagaagtaccacactctaggtttattgagtgtaggtataaagaagctcgagcattctttcagcagtaccttgatgataacactgtggaagctgtggcctttcggaagagtgcaaaggaattactgcaactagcagcgaaaacattaaacaaattgggagtaccattctggctgagcagtggaacttgtctaggatggtatcgacaatgcaacattattccttatagcaaagatgttgacctaggaatttttatacaagattacaaatctgatattattttagcatttcaggatgcaggacttccgctcaaacacaaatttgggaaggtagaagacagcttggaactatccttccagggaaaagatgatgtaaaacttgatgtttttttcttctatgaagaaactgatcacatgtggaatggaggcactcaggccaaaacaggaaaaaaattcaaatacctgtttccgaagtttacactgtgctggactgagtttgtagacatgaaggtccatgtaccctgtgaaaccctcgaatacattgaagccaactatggcaagaatcagcagggtgcatgatgccattttaagctgcttcacatcagactgaaatcctaattacagttcataagtgaaacagactaattcaatggcaataccttttgtataggtcctgtgcttaaaggaggcaagtataaattttctaataagaaatccctgcttcttttgggtgcagtggctcacacctgtaataccagcagtttgagaagct

SEQ ID NO: 11322 - DNA, 786 bp, Homo sapiens
cactatttatcaacaaagaatggagctggtttgtcaaaatccaaaggaagccgaattggatttgatagcacacagtggaaatgatccttgaggtgggagaaaataatggatttttttcaaagtctttacttccacggtacgcaagcaaaaagttgaagagcagcttaccacattcacgtgcagttaaaaaatttattatgttaacatccaaccaaaatgtaccagtgtttcttattgatcctttgatactggaattgattaataagaactttgaacaagtcaaaaatacttctcatggctctacttcacaatgcaagtttttctgtgttccaagagactttactgcatttgcactgcagtatcacctatggaagaatgaggaaggctggtttcggatagctgagaatatgggatttcagtgcctaaagattgagagtaaagatccccggctagacgggatagactcactctctggaactgaaatccccctgcactatatctgcaaactggccactcatgcgatccacttggtagtctttcatgagaggagtggcaactacctctggcacggccacttgagacttaaagaacacattgacaggaaatttgttcccttccgaaagttacagtttggtcgttatccaggagcttttgacaggccagagttacagcaagttactgttgatggactggaagttctcattccaaaggatccaatgcactttgtagaagaagtaccacactctaggtttattgagtgtaggtataaagaagctcgagcattct

SEQ ID NO: 11323 - DNA, 764 bp, Homo sapiens
aaagcggagcggctgcagcctgctgttgagtgagattgaaaggaaacacactgaatgaggaaaaactaacatacggtcatcaacatccttgtataacctagtttttaaaaaaattggatttcaaagaaaacaaaattatcttcctttccaaatccaaaaagatgaaaacgactgagatactttcaaaagacaaccaagtgagcagcacagactaatgagtagaatcaataagaacgtggttttggcccttttaacgctgacaagttctgcatttctgctgtttcagttgtactactacaagcactatttatcaacaaagaatggagctggtttgtcaaaatccaaaggaagccgaattggatttgatagcacacagtggcgtgcagttaaaaaatttattatgttaacatccaaccaaaatgtaccagtgtttcttattgatcctttgatactggaattgattaataagaactttgaacaagtcaaaaatacttctcatggctctacttcacaatgcaagtttttctgtgttccaagagactttactgcatttgcactgcagtatcacctatggaagaatgaggaaggctggtttcggatagctgagaatatgggatttcagtgcctaaagattgagagtaaagatccccggctagacgggatagactcactctctggaactgaaatccccctgcactatatctgcaaactggccactcatgcgatccacttggtagtctttcatgagaggagtggcaactacc

SEQ ID NO: 11324 - DNA, 606 bp, Homo sapiens
gatggtatcgacaatgcaacattattccttatagcaaagatgttgacctaggaatttttatacaagattacaaatctgatattattttagcatttcaggatgcaggacttccgctcaaacacaaatttgggaaggtagaagacagcttggaactatccttccagggaaaagatgatgtaaaacttgatgtttttttcttctatgaagaaactgatcacatgtggaatggaggcactcaggccaaaacaggaaaaaaattcaaatacctgtttccgaagtttacactgtgctggactgagtttgtagacatgaaggtccatgtaccctgtgaaaccctcgaatacattgaagccaactatggaaaggaagctgaatcttatatcttatctatgctatttaggactactttctggagcttggcagattttcctctgacaccagagaacaatagtagtctcaagaatggaaacctgaatgtctgagggaatgggctggtagactttttcgaaaacaaattagagaaagtaacttacaaccacccattccggatttgtaaagcaacatgaaaacctttgataaatgataaccaacagtcttctgtcctaa

SEQ ID NO: 11325 - DNA, 1152 bp, Homo sapiens
aaagcggagcggctgcagcctgctgttgagtgagaaaacaaaattatcttcctttccaaatccaaaaagatgaaaacgactgagatactttcaaaagacaaccaagtgagcagcacagactaatgagtagaatcaataagaacgtggttttggcccttttaacgctgacaagttctgcatttctgctgtttcagttgtactactacaagcactatttatcaacaaagaatggagctggtttgtcaaaatccaaaggaagccgaattggatttgatagcacacagtggcgtgcagttaaaaaatttattatgttaacatccaaccaaaatgtaccagtgtttcttattgatcctttgatactggaattgattaataagaactttgaacaagtcaaaaatacttctcatggctctacttcacaatgcaagtttttctgtgttccaagagactttactgcatttgcactgcagtatcacctatggaagaatgaggaaggctggtttcggatagctgagaatatgggatttcagtgcctaaagattgagagtaaagatccccggctagacgggatagactcactctctggaactgaaatccccctgcactatatctgcaaactggccactcatgcgatccacttggtagtctttcatgagaggagtggcaactacctctggcacggccacttgagacttaaagaacacattgacaggaaatttgttcccttccgaaagttacagtttggtcgttatccaggagcttttgacaggccagagttacagcaagttactgttgatggactggaagttctcattccaaaggatccaatgcactttgtagaagaagtaccacactctaggtttattgagtgtaggtataaagaagctcgagcattctttcagatacctgtttccgaagtttacactgtgctggactgagtttgtagacatgaaggtccatgtaccctgtgaaaccctcgaatacattgaagccaactatggtaagacctggaagattcctgtaaagacgtgggactggaagcgctctcctcccaatgtgcaacccaatggaatctggcctatttctgagtgggatgaggttatccagttatattgagatagtaggttgaaatgggagaatttctcttttgga

SEQ ID NO: 11326 - DNA, 3422 bp, Homo sapiens
gtcccggcggccattgctccaagatggcggcggcggcggcagcgggagcgcagctcagctgggctggaactgccctcctggaactcccccagcctacaacctaggaggtgcagggactgaggctcaggccaaatcgcaactcagacccagtgaacccaaggcctgaagagaatttggattcatttaccttgttttgtggggactggagagacaagtaaactctcagagtaactgtcccctctgactaccatttctaaggatgccccggaggcccagctagccccagacttcggccccatgcggctcacccgctgccaggctgccctggcggccgccatcaccctcaaccttctggtcctcttctatgtctcgtggctgcagcaccagcctaggaattcccgggcccgggggccccgtcgtgcctctgctgccggcccccgtgtcaccgtcctggtgcgggagttcgaggcatttgacaacgcggtgcccgagctggtagactccttcctgcagcaagacccagcccagcccgtggtggtggcagccgacacgctcccctacccgcccctggccctgccccgcatccccaacgtgcgtctggcgctgctccagcccgccctggaccggccagccgcagcctcgcgcccggagacctacgtggccaccgagtttgtggccctagtacctgatggggcgcgggctgaggcacctggcctgctggagcgcatggtggaggcgctccgcgcaggaagcgcacgtctggtggccgccccggttgccacggccaaccctgccaggtgcctggccctgaacgtcagcctgcgagagtggaccgcccgctatggcgcagcccccgccgcgccccgctgcgacgccctggacggagatgctgtggtgctcctgcgcgcccgcgacctcttcaacctctcggcgcccctggcccggccggtgggcaccagcctctttctgcagaccgcccttcgcggctgggcggtgcagctgctggacttgaccttcgccgcggcgcgccagcccccgctggccacggcccacgcgcgctggaaggctgagcgcgagggacgcgctcggcgggcggcgctgctccgcgcgctgggcatccgcctagtgagctgggaaggcgggcggctggagtggttcggctgcaacaaggagaccacgcgctgcttcggaaccgtggtgggcgacacgcccgcctacctctacgaggagcgctggacgcccccctgctgcctgcgcgcgctgcgcgagaccgcccgctatgtggtgggcgtgctggaggctgcgggcgtgcgctactggctcgagggcggctcactgctgggggccgcccgccacggggacatcatcccatgggactacgacgtggacctgggcatctacttggaggacgtgggcaactgcgagcagctgcggggggcagaggccggctcggtggtggatgagcgcggcttcgtatgggagaaggcggtcgagggcgactttttccgcgtgcagtacagcgaaagcaaccacttgcacgtggacctgtggcccttctacccccgcaatggcgtcatgaccaaggacacgtggctggaccaccggcaggatgtggagtttcccgagcacttcctgcagccgctggtgcccctgccctttgccggcttcgtggcgcaggcgcctaacaactaccgccgcttcctggagctcaagttcgggcccggggtcatcgagaacccccagtaccccaacccggcactgctgagtctgacgggaagcggctgaagccctgataacctcgcctttgtttttcgggggtctgtctggatgtggagaagctctgtgtgagcggtgaggggtggagggatgtcgcggagaggggaagggggaaactgaccaagaaagaaattctaaggagagcatgagagaaggctggcattggcaggaggagagcaccaggacgaggatgggaagcgacctccagatttatcaaatggtcatgcccactgggagccgtggatatgcgtggggacatcctgggtcatctcagtcatggagggagacggggatgtcacgccgtcccgcagggcccagcacagccccagacccgaaaaaagtgttctgcccaagattccgagagccctgcgctctagggcaggggcagagttttggaaacagtgcaggctctggagccagactggcgagattcaaatcctggctctatcgcttcggagccaggtgggcctgggggggcgtcgcagtctctctgtgcctcagttgcttccaggatgcgggacccttggctgcaggggttgcttccgccactagagggcgcgccggtcccgctcctggtggcccactgtggctgcccgggcgacagtacgcccagggcctgtgttccatagccatctactctcttgagcctttggacttctctccaagcccctgtgggaggcggacagcagtgaccacctccccttcttttggactgcgacctccttccctcctgggagagccctgtgacctgcatgctactcttaactgttctattcaagactgaatagaagtatttcagtcttgcagaggaggaaatgctcagagctccgaggtgcggctgtggtcgagaaccgggtgctgggccgggcgcgggggctcacgcctgtaatcccagcactttgggaggccgaggtgggaggatcgcttgagcccaggagtctgagaccagcctcggcaacatgccaagaccccgtctctatttttaaaaaagaaaaagaaccgacttctgaatcgcagctccactcatgactaatacctcattatttcagctgtctgcacctaattccccacttgcacggcagtgtagacaataaccatagctcacactcactgagcacctactgggtaccaggcaccattctcagtgtttcacctggatcaactaatgcgtccctcacctcagccctctgaagtgacagctgctattattttcattacacagatgaaaaagctgaggccagaatcgtgaagtcacttgctcaaggtcaggcagcttaggaaggggcagatcgggggcttgaacccaggtggtcaggctctggagcccacaattgtcttacccactatgcccctctctagtcatggtccccaagaggggcttggagacccacttagcaggtgaaagcaatggcagccttccttatttgattatgcacctaagaataaatggtatttgggcatgtattcccaatatgtgtatatttatttataaatatatacagatactattatctgtatgttagtaataaagcttaaattattccattttaaaattatgaatatgaatagggttttttttatgtttcttgcctcatcccaatgacttttgcacacccaggtgtgagcacccagcattcaagaccacg

SEQ ID NO: 11327 - DNA, 3474 bp, Homo sapiens
gtcccggcggccattgctccaagatggcggcggcggcggcagcgggagcgcagctcagctgggctggaactgccctcctggaactcccccagcctacaacctaggaggtgcagggactgaggctcaggccaaatcgcaactcagacccagtgaacccaaggcctgaagagaatttggattcatttaccttgttttgtggggactggagagacaagtaaactctcagagtaactgtcccctctgactaccatttctaaggcaagccccctgtttctactcttgcgccccctgctggtttcctgccctgtctgatgccccggaggcccagctagccccagacttcggccccatgcggctcacccgctgccaggctgccctggcggccgccatcaccctcaaccttctggtcctcttctatgtctcgtggctgcagcaccagcctaggaattcccgggcccgggggccccgtcgtgcctctgctgccggcccccgtgtcaccgtcctggtgcgggagttcgaggcatttgacaacgcggtgcccgagctggtagactccttcctgcagcaagacccagcccagcccgtggtggtggcagccgacacgctcccctacccgcccctggccctgccccgcatccccaacgtgcgtctggcgctgctccagcccgccctggaccggccagccgcagcctcgcgcccggagacctacgtggccaccgagtttgtggccctagtacctgatggggcgcgggctgaggcacctggcctgctggagcgcatggtggaggcgctccgcgcaggaagcgcacgtctggtggccgccccggttgccacggccaaccctgccaggtgcctggccctgaacgtcagcctgcgagagtggaccgcccgctatggcgcagcccccgccgcgccccgctgcgacgccctggacggagatgctgtggtgctcctgcgcgcccgcgacctcttcaacctctcggcgcccctggcccggccggtgggcaccagcctctttctgcagaccgcccttcgcggctgggcggtgcagctgctggacttgaccttcgccgcggcgcgccagcccccgctggccacggcccacgcgcgctggaaggctgagcgcgagggacgcgctcggcgggcggcgctgctccgcgcgctgggcatccgcctagtgagctgggaaggcgggcggctggagtggttcggctgcaacaaggagaccacgcgctgcttcggaaccgtggtgggcgacacgcccgcctacctctacgaggagcgctggacgcccccctgctgcctgcgcgcgctgcgcgagaccgcccgctatgtggtgggcgtgctggaggctgcgggcgtgcgctactggctcgagggcggctcactgctgggggccgcccgccacggggacatcatcccatgggactacgacgtggacctgggcatctacttggaggacgtgggcaactgcgagcagctgcggggggcagaggccggctcggtggtggatgagcgcggcttcgtatgggagaaggcggtcgagggcgactttttccgcgtgcagtacagcgaaagcaaccacttgcacgtggacctgtggcccttctacccccgcaatggcgtcatgaccaaggacacgtggctggaccaccggcaggatgtggagtttcccgagcacttcctgcagccgctggtgcccctgccctttgccggcttcgtggcgcaggcgcctaacaactaccgccgcttcctggagctcaagttcgggcccggggtcatcgagaacccccagtaccccaacccggcactgctgagtctgacgggaagcggctgaagccctgataacctcgcctttgtttttcgggggtctgtctggatgtggagaagctctgtgtgagcggtgaggggtggagggatgtcgcggagaggggaagggggaaactgaccaagaaagaaattctaaggagagcatgagagaaggctggcattggcaggaggagagcaccaggacgaggatgggaagcgacctccagatttatcaaatggtcatgcccactgggagccgtggatatgcgtggggacatcctgggtcatctcagtcatggagggagacggggatgtcacgccgtcccgcagggcccagcacagccccagacccgaaaaaagtgttctgcccaagattccgagagccctgcgctctagggcaggggcagagttttggaaacagtgcaggctctggagccagactggcgagattcaaatcctggctctatcgcttcggagccaggtgggcctgggggggcgtcgcagtctctctgtgcctcagttgcttccaggatgcgggacccttggctgcaggggttgcttccgccactagagggcgcgccggtcccgctcctggtggcccactgtggctgcccgggcgacagtacgcccagggcctgtgttccatagccatctactctcttgagcctttggacttctctccaagcccctgtgggaggcggacagcagtgaccacctccccttcttttggactgcgacctccttccctcctgggagagccctgtgacctgcatgctactcttaactgttctattcaagactgaatagaagtatttcagtcttgcagaggaggaaatgctcagagctccgaggtgcggctgtggtcgagaaccgggtgctgggccgggcgcgggggctcacgcctgtaatcccagcactttgggaggccgaggtgggaggatcgcttgagcccaggagtctgagaccagcctcggcaacatgccaagaccccgtctctatttttaaaaaagaaaaagaaccgacttctgaatcgcagctccactcatgactaatacctcattatttcagctgtctgcacctaattccccacttgcacggcagtgtagacaataaccatagctcacactcactgagcacctactgggtaccaggcaccattctcagtgtttcacctggatcaactaatgcgtccctcacctcagccctctgaagtgacagctgctattattttcattacacagatgaaaaagctgaggccagaatcgtgaagtcacttgctcaaggtcaggcagcttaggaaggggcagatcgggggcttgaacccaggtggtcaggctctggagcccacaattgtcttacccactatgcccctctctagtcatggtccccaagaggggcttggagacccacttagcaggtgaaagcaatggcagccttccttatttgattatgcacctaagaataaatggtatttgggcatgtattcccaatatgtgtatatttatttataaatatatacagatactattatctgtatgttagtaataaagcttaaattattccattttaaaattatgaatatgaatagggttttttttatgtttcttgcctcatcccaatgacttttgcacacccaggtgtgagcacccagcattcaagaccacg

SEQ ID NO: 11328 - DNA, 4244 bp, Homo sapiens
agaactggaagggccccgccctgtgaagggataggagcctgactgttgcagctgcagtgagtggcggggaagcagcagcggccaggatgaatcccaggtgctctggagctggatggtgaaggtcggcactcttcaccctcccgagccctgcccgtctcggccccatgcccccaccagtcagccccgggccacaggcagtgagcaggcacctgggagccgaggccctgtgaccaggccaaggagacgggcgctccagggtcccagccacctgtcccccccatggagctgaggccctggttgctatgggtggtagcagcaacaggaaccttggtcctgctagcagctgatgctcagggccagaaggtcttcaccaacacgtgggctgtgcgcatccctggaggcccagcggtggccaacagtgtggcacggaagcatgggttcctcaacctgggccagatcttcggggactattaccacttctggcatcgaggagtgacgaagcggtccctgtcgcctcaccgcccgcggcacagccggctgcagagggagcctcaagtacagtggctggaacagcaggtggcaaagcgacggactaaacgggacgtgtaccaggagcccacagaccccaagtttcctcagcagtggtacctgtctggtgtcactcagcgggacctgaatgtgaaggcggcctgggcgcagggctacacagggcacggcattgtggtctccattctggacgatggcatcgagaagaaccacccggacttggcaggcaattatgatcctggggccagttttgatgtcaatgaccaggaccctgacccccagcctcggtacacacagatgaatgacaacaggcacggcacacggtgtgcgggggaagtggctgcggtggccaacaacggtgtctgtggtgtaggtgtggcctacaacgcccgcattggaggggtgcgcatgctggatggcgaggtgacagatgcagtggaggcacgctcgctgggcctgaaccccaaccacatccacatctacagtgccagctggggccccgaggatgacggcaagacagtggatgggccagcccgcctcgccgaggaggccttcttccgtggggttagccagggccgaggggggctgggctccatctttgtctgggcctcggggaacgggggccgggaacatgacagctgcaactgcgacggctacaccaacagtatctacacgctgtccatcagcagcgccacgcagtttggcaacgtgccgtggtacagcgaggcctgctcgtccacactggccacgacctacagcagtggcaaccagaatgagaagcagatcgtgacgactgacttgcggcagaagtgcacggagtctcacacgggcacctcagcctctgcccccttagcagccggcatcattgctctcaccctggaggccaataagaacctcacatggcgggacatgcaacacctggtggtacagacctcgaagccagcccacctcaatgccaacgactgggccaccaatggtgtgggccggaaagtgagccactcatatggctacgggcttttggacgcaggcgccatggtggccctggcccagaattggaccacagtggccccccagcggaagtgcatcatcgacatcctcaccgagcccaaagacatcgggaaacggctcgaggtgcggaagaccgtgaccgcgtgcctgggcgagcccaaccacatcactcggctggagcacgctcaggcgcggctcaccctgtcctataatcgccgtggcgacctggccatccacctggtcagccccatgggcacccgctccaccctgctggcagccaggccacatgactactccgcagatgggtttaatgactgggccttcatgacaactcattcctgggatgaggatccctctggcgagtgggtcctagagattgaaaacaccagcgaagccaacaactatgggacgctgaccaagttcaccctcgtactctatggcaccgcccctgaggggctgcccgtacctccagaaagcagtggctgcaagaccctcacgtccagtcaggcctgtgtggtgtgcgaggaaggcttctccctgcaccagaagagctgtgtccagcactgccctccagggttcgccccccaagtcctcgatacgcactatagcaccgagaatgacgtggagaccatccgggccagcgtctgcgccccctgccacgcctcatgtgccacatgccaggggccggccctgacagactgcctcagctgccccagccacgcctccttggaccctgtggagcagacttgctcccggcaaagccagagcagccgagagtccccgccacagcagcagccacctcggctgcccccggaggtggaggcggggcaacggctgcgggcagggctgctgccctcacacctgcctgaggtggtggccggcctcagctgcgccttcatcgtgctggtcttcgtcactgtcttcctggtcctgcagctgcgctctggctttagttttcggggggtgaaggtgtacaccatggaccgtggcctcatctcctacaaggggctgccccctgaagcctggcaggaggagtgcccgtctgactcagaagaggacgagggccggggcgagaggaccgcctttatcaaagaccagagcgccctctgatgagcccactgcccaccccctcaagccaatcccctccttgggcactttttaattcaccaaagtatttttttatcttgggactgggtttggaccccagctgggaggcaagaggggtggagactgcttcccatcctaccctcgggcccacctggccacctgaggtgggcccaggaccagctggggcgtggggagggccgtaccccaccctcagcaccccttccatgtggagaaaggagtgaaacctttagggcagcttgccccggccccggccccagccagagttcctgcggagtgaagaggggcagcccttgcttgttgggattcctgacccaggccgcagctcttgcccttccctgtccctctaaagcaataatggtcccatccaggcagtcgggggctggcctaggagatatctgagggaggaggccacctctccaagggcttctgcaccctccaccctgtcccccagctctggtgagtcttggcggcagcagccatcataggaagggaccaaggcaaggcaggtgcctccaggtgtgcacgtggcatgtggcctgtggcctgtgtcccatgacccacccctgtgctccgtgcctccaccaccactggccaccaggctggcgcagccaaggccgaagctctggctgaaccctgtgctggtgtcctgaccaccctcccctctcttgcacccgcctctcccgtcagggcccaagtccctgttttctgagcccgggctgcctgggctgttggcactcacagacctggagcccctgggtgggtggtggggaggggcgctggcccagccggcctctctggcctcccacccgatgctgctttcccctgtggggatctcaggggctgtttgaggatatattttcactttgtgattatttcactttagatgctgatgatttgtttttgtatttttaatgggggtagcagctggactacccacgttctcacacccaccgtccgccctgctcctccctggctgccctggccctgaggtgtgggggctgcagcatgttgctgaggagtgaggaatagttgagccccaagtcctgaagaggcgggccagccaggcgggctcaaggaaagggggtcccagtgggaggggcaggctgacatctgtgtttcaagtggggctcgccatgccgggggttcataggtcactggctctccaagtgccagaggtgggcaggtggtggcactgagcccccccaacactgtgccctggtggagaaagcactgacctgtcatgcccccctcaaacctcctcttctgacgtgccttttgcacccctcccattaggacaatcagtcccctcccatctgggagtccccttttcttttctaccctagccattcctggtacccagccatctgcccaggggtgccccctcctctcccatccccctgccctcgtggccagcccggctggttttgtaagatgctgggttggtgcacagtgatttttttcttgtaatttaaacaggcccagcattgctggttctatttaatggacatgagataatgttagaggttttaaagtgattaaacgtgcagactatgcaaaccagg

SEQ ID NO: 11329 - DNA, 224 bp, Homo sapiens
aagccagcccacctcaatgccaacgactgggccaccaatggtgtgggccggaaagtgagccactcatatggctacgggctttggacgcaggcgccatggtggccctggcccagaattggaccacagtggccccccagcggaagtgcatcatcgacatcctcaccgagcccaaagacatcgggaaacggctcgaggtgcggaagaccgtgaccgcgtgcctgggc

SEQ ID NO: 11330 - DNA, 587 bp, Homo sapiens
aaacagcagtcggtcctggggtgaggcgcaatttgagtggcccagagtggctctctgtgtcaggaggttctggtgctggagaaaagggctttgcccaagaacacagccaggaagagcacccacagctctctctggccacagcctggaacagagtcccatgtgaaacaagaccatgagaaatacagcaagcctccaggtttgagacaaactgggactagaggggtcggcactcttcaccctcccgagccctgcccgtctcggccccatgcccccaccagtcagccccgggccacaggcagtgagcaggcacctgggagccgaggccctgtgaccaggccaaggagacgggcgctccagggtcccagccacctgtcccccccatggagctgaggccctggttgctatgggtggtagcagcaacaggaaccttggtcctgctagcagctgatgctcagggccagaaggtcttcaccaacacgtgggctgtgcgcatccctggaggcccagcggtggccaacagtgtggcacggaagcatgggttcctcaacctgggccagatcttcggggactattaccacttctggcat

SEQ ID NO: 11331 - DNA, 2040 bp, Homo sapiens
gcaggaggcggggctgctcagtcctccaggcgtcggtactcagcggtgttggaacttcgttgcttgcttgcctgtgcgcgcgtgcgcggacatggcctcaaacgattatacccaacaagcaacccaaagctatggggcctaccccacccagcccgggcagggctattcccagcagagcagtcagccctacggacagcagagttacagtggttatagccagtccacggacacttcaggctatggccagagcagctattcttcttatggccagagccagaacacaggctatggaactcagtcaactccccagggatatggctcgactggcggctatggcagtagccagagctcccaatcgtcttacgggcagcagtcctcctaccctggctatggccagcagccagctcccagcagcacctcgggaagttacggtagcagttctcagagcagcagctatgggcagccccagagtgggagctacagccagcagcctagctatggtggacagcagcaaagctatggacagcagcaaagctataatccccctcagggctatggacagcagaaccagtacaacagcagcagtggtggtggaggtggaggtggaggtggaggtaactatggccaagatcaatcctccatgagtagtggtggtggcagtggtggcggttatggcaatcaagaccagagtggtggaggtggcagcggtggctatggacagcaggaccgtggaggccgcggcaggggtggcagtggtggcggcggcggcggcggcggtggtggttacaaccgcagcagtggtggctatgaacccagaggtcgtggaggtggccgtggaggcagaggtggcatgggcggaagtgaccgtggtggcttcaataaatttggtggccctcgggaccaaggatcacgtcatgactccgaacaggataattcagacaacaacaccatctttgtgcaaggcctgggtgagaatgttacaattgagtctgtggctgattacttcaagcagattggtattattaagacaaacaagaaaacgggacagcccatgattaatttgtacacagacagggaaactggcaagctgaagggagaggcaacggtctcttttgatgacccaccttcagctaaagcagctattgactggtttgatggtaaagaattctccggaaatcctatcaaggtctcatttgctactcgccgggcagactttaatcggggtggtggcaatggtcgtggaggccgagggcgaggaggacccatgggccgtggaggctatggaggtggtggcagtggtggtggtggccgaggaggatttcccagtggaggtggtggcggtggaggacagcagcgagctggtgactggaagtgtcctaatcccacctgtgagaatatgaacttctcttggaggaatgaatgcaaccagtgtaaggcccctaaaccagatggcccaggagggggaccaggtggctctcacatggggggtaactacggggatgatcgtcgtggtggcagaggaggctatgatcgaggcggctaccggggccgcggcggggaccgtggaggcttccgagggggccggggtggtggggacagaggtggctttggccctggcaagatggattccaggggtgagcacagacaggatcgcagggagaggccgtattaattagcctggctccccaggttctggaacagctttttgtcctgtacccagtgttaccctcgttattttgtaaccttccaattcctgatcacccaagggtttttttgtgtcggactatgtaattgtaactatacctctggttcccattaaaagtgaccattttagttaaattttgttcctcttcccccttttcactttcctggaagatcgatgtcccgatcaggaaggtagagagttttcctgttcagattaccctgcccagcaggaactggaatacagtgttcggggagaaggccaaatgatatccttgagagcagagattaaacttttctgtcatggggaaagttggtgtataaatgagaaatgaagaa

SEQ ID NO: 11332 - DNA, 1717 bp, Homo sapiens
gctcagtcctccaggcgtcggtactcagcggtgttggaacttcgttgcttgcttgcctgtgcgcgcgtgcgcggacatggcctcaaacgattatacccaacaagcaacccaaagctatggggcctaccccacccagcccgggcagggctattcccagcagagcagtcagccctacggacagcagagttacagtggttatagccagtccacggacacttcaggctatggccagagcagctattcttcttatggccagagccagaacacaggctatggaactcagtcaactccccagggatatggctcgactggcggctatggcagtagccagagctcccaatcgtcttacgggcagcagtcctcctaccctggctatggccagcagccagctcccagcagcacctcgggaagttacggtagcagttctcagagcagcagctatgggcagccccagagtgggagctacagccagcagcctagctatggtggacagcagcaaagctatggacagcagcaaagctataatccccctcagggctatggacagcagaaccagtacaacagcagcagtggtggtggaggtggaggtggaggtggaggtaactatggccaagatcaatcctccatgagtagtggtggtggcagtggtggcggttatggcaatcaagaccagagtggtggaggtggcagcggtggctatggacagcaggaccgtggaggccgcggcaggggtggcagtggtggcggcggcggcggcggcggtggtggttacaaccgcagcagtggtggctatgaacccagaggtcgtggaggtggccgtggaggcagaggtggcatgggcggaagtgaccgtggtggcttcaataaatttggtggccctcgggaccaaggatcacgtcatgactccgacaaacaagaaaacgggacagcccatgattaatttgtacacagacagggaaactggcaagctgaagggagaggcaacggtctcttttgatgacccaccttcagctaaagcagctattgactggtttgatggtaaagaattctccggaaatcctatcaaggtctcatttgctactcgccgggcagactttaatcggggtggtggcaatggtcgtggaggccgagggcgaggaggacccatgggccgtggaggctatggaggtggtggcagtggtggtggtggccgaggaggatttcccagtggaggtggtggcggtggaggacagcagcgagctggtgactggaagtgtcctaatcccacctgtgagaatatgaacttctcttggaggaatgaatgcaaccagtgtaaggcccctaaaccagatggcccaggagggggaccaggtggctctcacatggggggtaactacggggatgatcgtcgtggtggcagaggaggctatgatcgaggcggctaccggggccgcggcggggaccgtggaggcttccgagggggccggggtggtggggacagaggtggctttggccctggcaagatggattccaggggtgagcacagacaggatcgcagggagaggccgtattaattagcctggctccccaggttctggaacagctttttgtcctgtacccagtgttaccctcgttattttgtaaccttccaattcctgatcacccaagggtttttttgtgtcggactatgtaattgtaactatacctctggttcccattaaaagtgaccattttagtt

SEQ ID NO: 11333 - DNA, 1528 bp, Homo sapiens
tcagtcctccaggcgtcggtactcagcggtgttggaacttcgttgcttgcttgcctgtgcgcgcgtgcgcggacatggcctcaaacgattatacccaacaagcaacccaaagctatggggcctaccccacccagcccgggcagggctattcccagcagagcagtcagccctacggacagcagagttacagtggttatagccagtccacggacacttcaggctatggccagagcagctattcttcttatggccagagccagaacacaggctatggaactcagtcaactccccagggatatggctcgactggcggctatggcagtagccagagctcccaatcgtcttacgggcagcagtcctcctaccctggctatggccagcagccagctcccagcagcacctcgggaagttacggtagcagttctcagagcagcagctatgggcagccccagagtgggagctacagccagcagcctagctatggtggacagcagcaaagctatggacagcagcaaagctataatccccctcagggctatggacagcagaaccagtacaacagcagcagtggtggctatgaacccagaggtcgtggaggtggccgtggaggcagaggtggcatgggcggaagtgaccgtggtggcttcaataaatttggtggccctcgggaccaaggatcacgtcatgactccgaacaggataattcagacaacaacaccatctttgtgcaaggcctgggtgagaatgttacaattgagtctgtggctgattacttcaagcagattggtattattaagacaaacaagaaaacgggacagcccatgattaatttgtacacagacagggaaactggcaagctgaagggagaggcaacggtctcttttgatgacccaccttcagctaaagcagctattgactggtttgatggtaaagaattctccggaaatcctatcaaggtctcatttgctactcgccgggcagactttaatcggggtggtggcaatggtcgtggaggccgagggcgaggaggacccatgggccgtggaggctatggaggtggtggcagtggtggtggtggccgaggaggatttcccagtggaggtggtggcggtggaggacagcagcgagctggtgactggaagtgtcctaatcccacctgtgagaatatgaacttctcttggaggaatgaatgcaaccagtgtaaggcccctaaaccagatggcccaggagggggaccaggtggctctcacatggggggtaactacggggatgatcgtcgtggtggggacagaggtggctttggccctggcaagatggattccaggggtgagcacagacaggatcgcagggagaggccgtattaattagcctggctccccaggttctggaacagctttttgtcctgtacccagtgttaccctcgttattttgtaaccttccaattcctgatcacccaagggtttttttgtgtcggactatgtaattgtaactatacctctggttcccattaaaagtgaccattttagtt

SEQ ID NO: 11334 - DNA, 1675 bp, Homo sapiens
tgtttgagttgggtgaagaaggcgggaagttaatcctcttccaatcagctccccatctcgccctctggcggctccggaccacaggccgagttactctgattaccgccatgctccaagacccgcactgacagtccccacgtgagggaccgcggtgggagtcctaaatgggggaggaggggacgggcggcactgtgcatctgctgtgcctcgcggcctccagcggggtccccctattctgcaggagcagtcgcggcggcgcccccgcccgtcagcagctcccgttctctgtcatcggttccctcaatggagtccacatgtttgggcagaatctggaggtgcagctgagctctgcgaggaccgagaacacgactgtggtgtggaaaagcttccatgacagcatcaccctcattgttctgtcatctgaggtgggcatctctgagctgaggctggagagactactccaaatggtgtttggagccatggtccttcttgtgggacttgaagaactgaccaatatccgcaacgtggagagactgaagaaggacttgagggccagttattgcctcatcgacagcttcctgggggactcggagctcatcggggacctgacccagtgtgtggactgcgtgattcctccagaggggtccctcttgcaggaagccctctccgggttcgctgaggccgcgggcacgaccttcgtcagtctggtggtgtccggccgggtggtggcagcaacagagggttggtggcggctggggacgcccgaggccgtgctgctcccctggctggtggggtccctgccgccgcagaccgctcgcgactacccggtgtacctgccgcacgggagccccacggtcccacaccggctcctgaccctgactctgctgccgagcctggagctgtgtctactctgcgggccgagcccacccctcagccagttgtatccacagcttctggagcgctggtggcagccactgctggacccgttgcgggcctgtctgccgttgggaccccgggcgctgcccagtggcttcccccttcacacagacatcctcgggctgctgctcctccacctggaactgaagcgctgcctcttcaccgtggagcccttgggggataaagagccttcaccagaacagcgccggcgcctcctccgaaacttctataccctggtcacctccacgcacttcccaccagagccagggccaccagagaagacagaagatgaggtctaccaggcccagctgcccagagcttgctacctggtgttggggactgaggaaccaggcacaggagtgcgtctggtggccttgcagctggggcttcggcggctgctgctgctgctgtctccccagagtcccacccatgggctgcgaagcctggccacccacactctgcatgccctcaccccacttctttgactacctagcagtgggtgatggacacagacatggggctgttagcgtctctctgtttattcgctcacaataatacacagcccctggatggggagggggtaggaggggctacaacagggtggggtgggaggggaggagacatccacttccctggcccctctcccctctgtgcttgggggggaaagggagggagggggactccccctaaccccccagaatgtaaacagcagcagatgaacaaaaataaaaatacaaaa

SEQ ID NO: 11335 - DNA, 1021 bp, Homo sapiens
atgggtttgggggaggtgcctgaatagggtttgagggtctgtttgagttgggtgaagaaggcgggaagttaatcctcttccaatcagctccccatctcgccctctggcggctccggaccacaggccgagttactctgattaccgccatgctccaagacccgcactgacagtccccacgtgagggaccgcggtgggagtcctaaatgggggaggaggggacgggcggcactgtgcatctgctgtgcctcgcggcctccagcggggtccccctattctgcaggagcagtcgcggcggcgcccccgcccgtcagcagctcccgttctctgtcatcggttccctcaatggagtccacatgtttgggcagaatctggaggtgcagctgagctctgcgaggaccgagaacacgactgtggtgtggaaaagcttccatgacagcatcaccctcattgttctgtcatctgaggtgggcatctctgagctgaggctggagagactactccaaatggtgtttggagccatggtccttcttgtgggacttgaagaactgaccaatatccgcaacgtggagagactgaagaaggacttgagggccagttattgcctcatcgacagcttcctgggggactcggagctcatcggggacctgacccagtgtgtggactgcgtgattcctccagaggggtccctcttgcaggtactggggatgctatggaaactcttacacctgttctgctggccctggctcagtcctcatcctctttcttctggaccattgtcccaacctcctcctatcctctcagcttccagtcctatccccacctggtcccagaagaatcttttttctttttttttttcttttctttctctttcttttcttttttcttttctttctctctttttatttgagacgtagtttcactcttgttgcccaggctggagtacaatggcaccatctcggctcactgcagcctgcgcctcccgggttcaagtaattctcctgcctcagcttcccgagcagct

SEQ ID NO: 11336 - DNA, 1368 bp, Homo sapiens
aatgggtttgggggaggtgcctgaatagggtttgagggtctgtttgagttgggtgaagaaggcgggaagttaatcctcttccaatcagctccccatctcgccctctggcggctccggaccacaggccgagttactctgattaccgccatgctccaagacccgcactgacagtccccacgtgagggaccgcggtgggagtcctaaatgggggaggaggggacgggcggcactgtgcatctgctgtgcctcgcggcctccagcggggtccccctattctgcaggagcagtcgcggcggcgcccccgcccgtcagcagctcccgttctctgtcatcggttccctcaatggagtccacatgtttgggcagaatctggaggtgcagctgagctctgcgaggaccgagaacacgactgtggtgtggaaaagcttccatgacagcatcaccctcattgttctgtcatctgaggtgggcatctctgagctgaggctggagagactactccaaatggtgtttggagccatggtccttcttgtgggacttgaagaactgaccaatatccgcaacgtggagagactgaagaaggacttgagggccagttattgcctcatcgacagcttcctgggggactcggagctcatcggggacctgacccagtgtgtggactgcgtgattcctccagaggggtccctcttgcaggaagccctctccgggttcgctgaggccgcgggcacgaccttcgtcagtctggtggtgtccggccgggtggtggcagcaacagagggttggtggcggctggggacgcccgaggccgtgctgctcccctggctggtggggtccctgccgccgcagaccgctcgcgactacccggtgtacctgccgcacgggagccccacggtcccacaccggctcctgaccctgactctgctgccgagcctggagctgtgtctactctgcgggccgagcccacccctcagccagttgtatccacagcttctggagcgctggtggcagccactgctggacccgttgcgggcctgtctgccgttgggaccccgggcgctgcccagtggcttcccccttcacacagacatcctcgggctgctgctcctccacctggaactgaagcgctgcctcttcaccgtggagcccttgggggataaagagccttcaccagaacagcgccggcgcctcctccgaaacttctataccctggtcacctccacgcacttcccaccagagccagggccaccagagaagacagaagatgaggtctaccaggcccagctgcccagagcttgctacctggtgatgggtgatggacacagacatggggctgttagcgtctctctgtttattcgctcacaataa

SEQ ID NO: 11337 - DNA, 1479 bp, Homo sapiens
ctgattaccgccatgctccaagacccgcactgacagtccccacgtgagggaccgcggtgggagtcctaaatgggggaggaggggacgggcggcactgtgcatctgctgtgcctcgcggcctccagcggggtccccctattctgcaggagcagtcgcggcggcgcccccgcccgtcagcagctcccgttctctgtcatcggttccctcaatggagtccacatgtttgggcagaatctggaggtgcagctgagctctgcgaggaccgagaacacgactgtggtccttcttgtgggacttgaagaactgaccaatatccgcaacgtggagagactgaagaaggacttgagggccagttattgcctcatcgacagcttcctgggggactcggagctcatcggggacctgacccagtgtgtggactgcgtgattcctccagaggggtccctcttgcaggaagccctctccgggttcgctgaggccgcgggcacgaccttcgtcagtctggtggtgtccggccgggtggtggcagcaacagagggttggtggcggctggggacgcccgaggccgtgctgctcccctggctggtggggtccctgccgccgcagaccgctcgcgactacccggtgtacctgccgcacgggagccccacggtcccacaccggctcctgaccctgactctgctgccgagcctggagctgtgtctactctgcgggccgagcccacccctcagccagttgtatccacagcttctggagcgctggtggcagccactgctggacccgttgcgggcctgtctgccgttgggaccccgggcgctgcccagtggcttcccccttcacacagacatcctcgggctgctgctcctccacctggaactgaagcgctgcctcttcaccgtggagcccttgggggataaagagccttcaccagaacagcgccggcgcctcctccgaaacttctataccctggtcacctccacgcacttcccaccagagccagggccaccagagaagacagaagatgaggtctaccaggcccagctgcccagagcttgctacctggtgttggggactgaggaaccaggcacaggagtgcgtctggtggccttgcagctggggcttcggcggctgctgctgctgctgtctccccagagtcccacccatgggctgcgaagcctggccacccacactctgcatgccctcaccccacttctttgactacctagcagtgggtgatggacacagacatggggctgttagcgtctctctgtttattcgctcacaataatacacagcccctggatggggagggggtaggaggggctacaacagggtggggtgggaggggaggagacatccacttccctggcccctctcccctctgtgcttgggggggaaagggagggagggggactccccctaaccccccagaatgtaaacagcagcagatgaacaaaaataaaaatacaaaaggccgga

SEQ ID NO: 11338 - DNA, 576 bp, Homo sapiens
aaagtgctcagcccccggggcacagcaggacgtttgggggccttctttcagcaggggacagcccgattggggacaatggcgtctcttggccacatcttggttttctgtgtgggtctcctcaccatggccaaggcagaaagtccaaaggaacacgacccgttcacttacgactaccagtccctgcagatcggaggcctcgtcatcgccgggatcctcttcatcctgggcatcctcatcgtgctgagcagaagatgccggtgcaagttcaaccagcagcagaggactggggaacccgatgaagaggagggaactttccgcagctccatccgccgtctgtccacccgcaggcggtagaaacacctggagcgatggaatccggccaggactcccctggcacctgacatctcccacgctccacctgcgcgcccaccgccccctccgccgccccttccccagccctgcccccgcagactccccctgccgccaagacttccaataaaacgtgcgttcctctcgacagcactttgtcggtctcggtccctcagcgcgaaacgccagcgccactgggccccagca

SEQ ID NO: 11339 - DNA, 547 bp, Homo sapiens
gtggcagctgggcctcaccccggcagggctgtgcgtgaccccctgagtgggggaaggcaggctgttgccatggtggcctgagcgagcagaattcctccagggacaatggcgtctcttggccacatcttggttttctgtgtgggtctcctcaccatggccaaggcagaaagtccaaaggaacacgacccgttcacttacgactaccagtccctgcagatcggaggcctcgtcatcgccgggatcctcttcatcctgggcatcctcatcgtgctgagcagaagatgccggtgcaagttcaaccagcagcagaggactggggaacccgatgaagaggagggaactttccgcagctccatccgccgtctgtccacccgcaggcggtagaaacacctggagcgatggaatccggccaggactcccctggcacctgacatctcccacgctccacctgcgcgcccaccgccccctccgccgccccttccccagccctgcccccgcagactccccctgccgccaagacttccaataaaacgtgcgttcctctcga

SEQ ID NO: 11340 - DNA, 513 bp, Homo sapiens
gccactctccatccaggccccaggcaagcagcacctccctgctctcctgcactcctggacacaaccagcagctcctgccatggacaggtggtacctgggcggcagccccaagggggacgtggacccgttctactatgactatgagaccgttcgcaatgggggcctgatcttcgctggactggccttcatcgtggggctcctcatcctcctcagcagaagattccgctgtgggggcaataagaagcgcaggcaaatcaatgaagatgagccgtaacagcagcctcggcggtgccacccactgcactggggccagctgggaagccaagcatggccctgcctctggcgcctccccttcttccctgggctttagacctttgtccccgtcactgccagcgcttgggctgaaggaagctccagactcaatgtgacccccaggtggcatcgccaactcctgcctcgtgccacctcatgcttataataaagccggcgtcagagaccgctgcttccctcacc

SEQ ID NO: 11341 - DNA, 571 bp, Homo sapiens
agacactctccaaaaagcagagacagcaggaagaggggagtggaggcagcccattcacctggggaaatgactgggttgtcgatggacggtggcggcagccccaagggggacgtggacccgttctactatgactatgagaccgttcgcaatgggggcctgatcttcgctggactggccttcatcgtggggctcctcatcctcctcagcagaagattccgctgtgggggcaataagaagcgcaggcaaatcaatgaagatgagccgtaacagcagcctcggcggtgccacccactgcactggggccagctgggaagccaagcatggccctgcctctggcgcctccccttcttccctgggctttagacctttgtccccgtcactgccagcgcttgggctgaaggaagctccagactcaatgtgacccccaggtggcatcgccaactcctgcctcgtgccacctcatgcttataataaagccggcgtcagagaccgctgcttccctcacctgcctgcctgtctccctcctctgtcaccaccagcctctccaagctcaagtacaaatacagccggg

SEQ ID NO: 11342 - DNA, 672 bp, Homo sapiens
ccagccccgcagctgctccccatctctctgccaactgccagaacgacacaggaagctggggccggtgcctcagtgtgaagagggggagtgccactctccatccaggccccaggcaagcagcacctccctgctctcctgcactcctggacacaaccagcagctcctgccatggacaggtggtacctgggcggcagccccaagggggacgtggacccgttctactatgactatgagaccgttcgcaatgggggcctgatcttcgctggactggccttcatcgtggggctcctcatcctcctcagcagaagattccgctgtgggggcaataagaagcgcaggcaaatcaatgaagatgagccgtaacagcagcctcggcggtgccacccactgcactggggccagctgggaagccaagcatggccctgcctctggcgcctccccttcttccctgggctttagacctttgtccccgtcactgccagcgcttgggctgaaggaagctccagactcaatgtgacccccaggtggcatcgccaactcctgcctcgtgccacctcatgcttataataaagccggcgtcagagaccgctgcttccctcacctgcctgcctgtctccctcctctgtcaccaccagcctctccaagctcaagtacaaatacagccgggtctca

SEQ ID NO: 11343 - DNA, 1326 bp, Homo sapiens
aggtttgcttagggcgtggcagcttcggataaacgcaggactccgcctggcagcccgatttctcccggaacctctgctcagcctggtgaaccacacaggcccgagtttcacccagtccccactccacggtgcagctgcggcttatctctcagcccagcgagatgccagccttcctgtcccgggccagcgctctgacatgcagaaggtgaccctgggcctgcttgtgttcctggcaggctttcctgtcctggacgccaatgacctagaagataaaaacagtcctttctactatgactggcacagcctccaggttggcgggctcatctgcgctggggttctgtgcgccatgggcatcatcatcgtcatgagtgcaaaatgcaaatgcaagtttggccagaagtccggtcaccatccaggggagactccacctctcatcaccccaggctcagcccaaagctgatgaggacagaccagctgaaattgggtggaggaccgttctctgtccccaggtcctgtctctgcacagaaacttgaactccaggatggaattcttcctcctctgctgggactcctttgcatggcagggcctcatctcacctctcgcaagagggtctctttgttcaattttttttaatctaaaatgattgtgcctctgcccaagcagcctggagacttcctatgtgtgcattggggtggggcttggggcaccatgagaaggttggcgtgccctggaggctgacacagaggctggcactgagcctgcttgttgggaaaagcccacaggcctgttcccttgtggcttgggacatggcacaggcccgccctctgcctcctcagccatgggaacctcatatgcaatttgggatttactagtagccaaaaggaatgaaagagagctctaaccagatggaacactggaacattccagtggaccctggaccattccaggaaaactgggacataggatcgtcccgctatgatggaagtgttcagacagtttataatagtaagcccctgtgaccctctcacttaccccgagacctcactttattacaagatctttccaaatacccaaatgtccctgcaagcccgttaaataattccctatgctacccttaataacatacaatgaccacatagtgtgagaacttccaacaagcctcaaagtcccttgagactccccaatacctaataaggcatgcgaaatgttctcatgaactaccccacaacacgcctaaaactcaaaacacccaaaaatatctcctccaatgtcctgaaacatgaacccaaaaagagacccacaataaactcgtgacttgtcccctc

SEQ ID NO: 11344 - DNA, 1320 bp, Homo sapiens
aggtttgcttagggcgtggcagcttcggataaacgcaggactccgcctggcagcccgatttctcccggaacctctgctcagcctggtgaaccacacaggccagcgctctgacatgcagaaggtgaccctgggcctgcttgtgttcctggcaggctttcctgtcctggacgccaatgacctagaagataaaaacagtcctttctactatgactggcacagcctccaggttggcgggctcatctgcgctggggttctgtgcgccatgggcatcatcatcgtcatgagtgagtggaggagctcgggggagcaggcgggccggggctggggctcccctcccctgaccactcagctctccccaacaggtgcaaaatgcaaatgcaagtttggccagaagtccggtcaccatccaggggagactccacctctcatcaccccaggctcagcccaaagctgatgaggacagaccagctgaaattgggtggaggaccgttctctgtccccaggtcctgtctctgcacagaaacttgaactccaggatggaattcttcctcctctgctgggactcctttgcatggcagggcctcatctcacctctcgcaagagggtctctttgttcaattttttttaatctaaaatgattgtgcctctgcccaagcagcctggagacttcctatgtgtgcattggggtggggcttggggcaccatgagaaggttggcgtgccctggaggctgacacagaggctggcactgagcctgcttgttgggaaaagcccacaggcctgttcccttgtggcttgggacatggcacaggcccgccctctgcctcctcagccatgggaacctcatatgcaatttgggatttactagtagccaaaaggaatgaaagagagctctaaccagatggaacactggaacattccagtggaccctggaccattccaggaaaactgggacataggatcgtcccgctatgatggaagtgttcagacagtttataatagtaagcccctgtgaccctctcacttaccccgagacctcactttattacaagatctttccaaatacccaaatgtccctgcaagcccgttaaataattccctatgctacccttaataacatacaatgaccacatagtgtgagaacttccaacaagcctcaaagtcccttgagactccccaatacctaataaggcatgcgaaatgttctcatgaactaccccacaacacgcctaaaactcaaaacacccaaaaatatctcctccaatgtcctgaaacatgaacccaaaaagagacccacaataaactcgtgacttgtcccctc

SEQ ID NO: 11345 - DNA, 778 bp, Homo sapiens
cgctagcatcttctgctgatcctgaaattgtaccagcggcaagatgtggcctggaaggggactttaagttctccacaactgccagcaatccttccaccaggcaaaacacatcatctaaggaaaagaagtgaggtttgcttagggcgtggcagcttcggataaacgcaggactccgcctggcagcccgatttctcccggaacctctgctcagcctggtgaaccacacaggccagcgctctgacatgcagaaggtgaccctgggcctgcttgtgttcctggcaggctttcctgtcctggacgccaatgacctagaagataaaaacagtcctttctactatgactggcacagcctccaggttggcgggctcatctgcgctggggttctgtgcgccatgggcatcatcatcgtcatgagtgagtggaggagctcgggggagcaggcgggccggggctggggctcccctcccctgaccactcagctctccccaacaggtgcaaaatgcaaatgcaagtttggccagaagtccgggtaagatactgttccggcatgcccgcctcaggctgactggacgcttttcagggtgaaagggctaactctcccagcaggagaggcctcggggctctgccctttagagttcctgccgctaagatttccaggtttattgtttctagctggtaatccccagggggccccaaatcctgaaatgctttggcccctgggattgcacaaccccccaaatggaaaggcagccaggaagacatgtctgggcaggctaag

SEQ ID NO: 11346 - DNA, 516 bp, Homo sapiens
gatttctcccggaacctctgctcagcctggtgaaccacacaggccagcgctctgacatgcagaaggtgaccctgggcctgcttgtgttcctggcaggctttcctgtcctggacgccaatgacctagaagataaaaacagtcctttctactatgactggcacagcctccaggttggcgggctcatctgcgctggggttctgtgcgccatgggcatcatcatcgtcatgagtgcaaaatgcaaatgcaagtttggccagaagtccggtcaccatccaggggagactccacctctcatcaccccaggctcagcccaaagctgatgaggacagaccagctgaaattgggtggaggaccgttctctgtccccaggtcctgtctctgcacagaaacttgaactccaggatggaattcttcctcctctgctgggactcctttgcatggcagggcctcatctcacctctcgcaagagggtctctttgttcaattttttttaatctaaaatgattgtgcctctgc

SEQ ID NO: 11347 - DNA, 1448 bp, Homo sapiens
aggtttgcttagggcgtggcagcttcggataaacgcaggactccgcctggcagcccgatttctcccggaacctctgctcagcctggtgaaccacacagaggctggggcgaggaggataccatctgtcagtcttggctggatgacatcatgggaagggggtatagtggggccttgcaggccagaggtggcttggaggagcccctggaaagaggcttaagaggcccgagtttcacccagtccccactccacggtgcagctgcggcttatctctcagcccagcgagatgccagccttcctgtcccgggccagcgctctgacatgcagaaggtgaccctgggcctgcttgtgttcctggcaggctttcctgtcctggacgccaatgacctagaagataaaaacagtcctttctactatgactggcacagcctccaggttggcgggctcatctgcgctggggttctgtgcgccatgggcatcatcatcgtcatgagtgcaaaatgcaaatgcaagtttggccagaagtccggtcaccatccaggggagactccacctctcatcaccccaggctcagcccaaagctgatgaggacagaccagctgaaattgggtggaggaccgttctctgtccccaggtcctgtctctgcacagaaacttgaactccaggatggaattcttcctcctctgctgggactcctttgcatggcagggcctcatctcacctctcgcaagagggtctctttgttcaattttttttaatctaaaatgattgtgcctctgcccaagcagcctggagacttcctatgtgtgcattggggtggggcttggggcaccatgagaaggttggcgtgccctggaggctgacacagaggctggcactgagcctgcttgttgggaaaagcccacaggcctgttcccttgtggcttgggacatggcacaggcccgccctctgcctcctcagccatgggaacctcatatgcaatttgggatttactagtagccaaaaggaatgaaagagagctctaaccagatggaacactggaacattccagtggaccctggaccattccaggaaaactgggacataggatcgtcccgctatgatggaagtgttcagacagtttataatagtaagcccctgtgaccctctcacttaccccgagacctcactttattacaagatctttccaaatacccaaatgtccctgcaagcccgttaaataattccctatgctacccttaataacatacaatgaccacatagtgtgagaacttccaacaagcctcaaagtcccttgagactccccaatacctaataaggcatgcgaaatgttctcatgaactaccccacaacacgcctaaaactcaaaacacccaaaaatatctcctccaatgtcctgaaacatgaacccaaaaagagacccacaataaactcgtgacttgtcccctc

SEQ ID NO: 11348 - DNA, 759 bp, Homo sapiens
cgctagcatcttctgctgatcctgaaattgtaccagcggcaagatgtggcctggaaggggactttaagttctccacaactgccagcaatccttccaccaggcaaaacacatcatctaaggaaaagaagtgaggtttgcttagggcgtggcagcttcggataaacgcaggactccgcctggcagcccgatttctcccggaacctctgctcagcctggtgaaccacacaggccagcgctctgacatgcagaaggtgaccctgggcctgcttgtgttcctggcaggctttcctgtcctggacgccaatgacctagaagataaaaacagtcctttctactatggtgagagcccgtgccccctttcccctccccacaaccccacatactgcttggtgccaagggttcccatacagggttggggcctgacgtgagcatcacaggacaaagatacgaagggactaggatggggttactgaatatgccacacagtggattaaaggaactagaggcagcaacctggcctttgggaaggttctattccagcaagatagacacacgcaggaggtgaggacagtttgcaagaagccattggttggttcagatcaactgctgggagaagtgttgacttgagaaaacttcctggaggtggtgagctattggatcaaaaccctcatctggcctccaggttccaatgacctgctccctactccccgctctgccctcacctctccacgctcctcattccttctgctccaagcctct

SEQ ID NO: 11349 - DNA, 631 bp, Homo sapiens
atgggaagggggtatagtggggccttgcaggccagaggtggcttggaggagcccctggaaagaggcttaagaggcccgagtttcacccagtccccactccacggtgcagctgcggcttatctctcagcccagcgagatgccagccttcctgtcccgggccagcgctctgacatgcagaaggtgaccctgggcctgcttgtgttcctggcaggctttcctgtcctggacgccaatgacctagaagataaaaacagtcctttctactatgactggcacagcctccaggttggcgggctcatctgcgctggggttctgtgcgccatgggcatcatcatcgtcatgagtgcaaaatgcaaatgcaagtttggccagaagtccggtcaccatccaggggagactccacctctcatcaccccaggctcagcccaaagctgatgaggacagaccagctgaaattgggtggaggaccgttctctgtccccaggtcctgtctctgcacagaaacttgaactccaggatggaattcttcctcctctgctgggactcctttgcatggcagggcctcatctcacctctcgcaagagggtctctttgttcaattttttttaatctaaaatgattgtgcctctgc

SEQ ID NO: 11350 - DNA, 1926 bp, Homo sapiens
agccagcccgactcctaggaggaggggaggcgggaaagcagctcaagcctcacccaccgccctgcccccagccccgccactcccaggctcctcgggactcggcgggtcctcctgggagtctcggaggggaccggctgtgcagagaacttcagccaaagcatctgagacgggaagcagaaaaaggagggacagtttggagaagaaaaacgcagctgtgtgtttgggccttgacgtggctgtggatgcagtcgttctgacccctggtggccgagaggtgaagtgcagtggcggctgcttgctcaaggccggaggaagacgccatggagttggtgctggtcttcctctgcagcctgctggcccccatggtcctggccagtgcagctgaaaaggagaaggaaatggacccttttcattatgattaccagaccctgaggattgggggactggtgttcgctgtggtcctcttctcggttgggatcctccttatcctaagtcgcaggtgcaagtgcagtttcaatcagaagccccgggccccaggagatgaggaagcccaggtggagaacctcatcaccgccaatgcaacagagccccagaaagcagagaactgaagtgcagccatcaggtggaagcctctggaacctgaggcggctgcttgaacctttggatgcaaatgtcgatgcttaagaaaaccggccacttcagcaacagccctttccccaggagaagccaagaacttgtgtgtcccccaccctatcccctctaacaccattcctccacctgatgatgcaactaacacttgcctccccactgcagcctgcggtcctgcccacctcccgtgatgtgtgtgtgtgtgtgtgtgtgtgtgactgtgtgtgtttgctaactgtggtctttgtggctacttgtttgtggatggtattgtgtttgttagtgaactgtggactcgctttcccaggcaggggctgagccacatggccatctgctcctccctgcccccgtggccctccatcaccttctgctcctaggaggctgcttgttgcccgagaccagccccctcccctgatttagggatgcgtagggtaagagcacgggcagtggtcttcagtcgtcttgggacctgggaaggtttgcagcactttgtcatcattcttcatggactcctttcactcctttaacaaaaaccttgcttccttatcccacctgatcccagtctgaaggtctcttagcaactggagatacaaagcaaggagctggtgagcccagcgttgacgtcaggcaggctatgcccttccgtggttaatttcttcccaggggcttccacgaggagtccccatctgccccgccccttcacagagcgcccggggattccaggcccagggcttctactctgcccctggggaatgtgtcccctgcatatcttctcagcaataactccatgggctctgggaccctaccccttccaaccttccctgcttctgagacttcaatctacagcccagctcatccagatgcagactacagtccctgcaattgggtctctggcaggcaatagttgaaggactcctgttccgttggggccagcacaccgggatggatggagggagagcagaggcctttgcttctctgcctacgtccccttagatgggcagcagaggcaactcccgcatcctttgctctgcctgtcagtggtcagagcggtgagcgaggtgggttggagactcagcaggctccgtgcagcccttgggaacagtgagaggttgaaggtcataacgagagtgggaactcaacccagatcccgcccctcctgtcctctgtgttcccgcggaaaccaaccaaaccgtgcgctgtgacccattgctgttctctgtatcgtgatctatcctcaacaacaacagaaaaaaggaataaaatatcctttgtttccta

SEQ ID NO: 11351 - DNA, 1033 bp, Homo sapiens
agtctcctcctcgactcctctctggaacattgctggctgggcggggcgggcaatcatttcaagttaggtgatttaacaataattgatgcttaattgtttatttgatgggcatttaaaatgcaaattgagggaactggttgcattttccactgatggatctgtggcctctggtcgacccaaagcacttgttttaaaaggcagctttaaaagcccttgatggttgtttgtttgctctgaggctctgaaccagagaagcccagctcctgttacagattcatcaaatgccggaaagacgccatggagttggtgctggtcttcctctgcagcctgctggcccccatggtcctggccagtgcagctgaaaaggagaaggaaatggacccttttcattatgattaccagaccctgaggattgggggactggtgttcgctgtggtcctcttctcggttgggatcctccttatcctaagtcgcaggtgcaagtgcagtttcaatcagaagccccgggccccaggagatgaggaagcccaggtggagaacctcatcaccgccaatgcaacagagccccagaaagcagagaactgaagtgcagccatcaggtggaagcctctggaacctgaggcggctgcttgaacctttggatgcaaatgtcgatgcttaagaaaaccggccacttcagcaacagccctttccccaggagaagccaagaacttgtgtgtcccccaccctatcccctctaacaccattcctccacctgatgatgcaactaacacttgcctccccactgcagcctgcggtcctgcccacctcccgtgatgtgtgtgtgtgtgtgtgtgtgtgtgactgtgtgtgtttgctaactgtggtctttgtggctacttgtttgtggatggtattgtgtttgttagtgaactgtggactcgctttcccaggcaggggctgagccacatggccatctgctcctccctgcccccgtggccctccatcaccttctgctcctaggaggctgcttgttgcccgagaccagccccct

SEQ ID NO: 11352 - DNA, 2171 bp, Homo sapiens
aattaccaaggctcccaattaacgtgggctgctgtgtctggtgctgggttattttctcctatttttccgttcctcggggtttactattgcagagagacaccaggtctgtcattgtgcctgtcttgctcccttcccaccctaaccagagggaaaccgaaaagcaacagctgatggcaaatccgctccggcgcttgcacgcctcctcggcggcagtctcctgttgcttctcggagcttgactgccctttggaaaaatctctccgcccctcgagaggagagaggagcagaggacgcgcgcgagcacagagcgggaggacggacagggagaggaggagagggggtctgcgcgcggccgctacccagaagccagcggacggcagcacggagtgggctgtccccgagcccagccccgagcgagccccccccccgcccccgcaggacgcgcctcccagccagcccgactcctaggaggaggggaggcgggaaagcagctcaagcctcacccaccgccctgcccccagccccgccactcccaggctcctcgggactcggcgggtcctcctgggagtctcggaggggaccggctgtgcagacgccatggagttggtgctggtcttcctctgcagcctgctggcccccatggtcctggccagtgcagctgaaaaggagaaggaaatggacccttttcattatgattaccagaccctgaggattgggggactggtgttcgctgtggtcctcttctcggttgggatcctccttatcctaagtcgcaggtgcaagtgcagtttcaatcagaagccccgggccccaggagatgaggaagcccaggtggagaacctcatcaccgccaatgcaacagagccccagaaagcagagaactgaagtgcagccatcaggtggaagcctctggaacctgaggcggctgcttgaacctttggatgcaaatgtcgatgcttaagaaaaccggccacttcagcaacagccctttccccaggagaagccaagaacttgtgtgtcccccaccctatcccctctaacaccattcctccacctgatgatgcaactaacacttgcctccccactgcagcctgcggtcctgcccacctcccgtgatgtgtgtgtgtgtgtgtgtgtgtgtgactgtgtgtgtttgctaactgtggtctttgtggctacttgtttgtggatggtattgtgtttgttagtgaactgtggactcgctttcccaggcaggggctgagccacatggccatctgctcctccctgcccccgtggccctccatcaccttctgctcctaggaggctgcttgttgcccgagaccagccccctcccctgatttagggatgcgtagggtaagagcacgggcagtggtcttcagtcgtcttgggacctgggaaggtttgcagcactttgtcatcattcttcatggactcctttcactcctttaacaaaaaccttgcttccttatcccacctgatcccagtctgaaggtctcttagcaactggagatacaaagcaaggagctggtgagcccagcgttgacgtcaggcaggctatgcccttccgtggttaatttcttcccaggggcttccacgaggagtccccatctgccccgccccttcacagagcgcccggggattccaggcccagggcttctactctgcccctggggaatgtgtcccctgcatatcttctcagcaataactccatgggctctgggaccctaccccttccaaccttccctgcttctgagacttcaatctacagcccagctcatccagatgcagactacagtccctgcaattgggtctctggcaggcaatagttgaaggactcctgttccgttggggccagcacaccgggatggatggagggagagcagaggcctttgcttctctgcctacgtccccttagatgggcagcagaggcaactcccgcatcctttgctctgcctgtcagtggtcagagcggtgagcgaggtgggttggagactcagcaggctccgtgcagcccttgggaacagtgagaggttgaaggtcataacgagagtgggaactcaacccagatcccgcccctcctgtcctctgtgttcccgcggaaaccaaccaaaccgtgcgctgtgacccattgctgttctctgtatcgtgatctatcctcaacaacaacag

SEQ ID NO: 11353 - DNA, 1799 bp, Homo sapiens
atgctccaagtcgcgtcacaggcagggttgccgagccaggatttatttacatcttcacattcaaagttcgtcatcatgaattttgactcttggggactgggctgaggacggggtggtactgctcctggcagggccagaggtggatggggcttgaaaagggggttcaaggcagcagatctatggttcagacgccatggagttggtgctggtcttcctctgcagcctgctggcccccatggtcctggccagtgcagctgaaaaggagaaggaaatggacccttttcattatgattaccagaccctgaggattgggggactggtgttcgctgtggtcctcttctcggttgggatcctccttatcctaagtcgcaggtgcaagtgcagtttcaatcagaagccccgggccccaggagatgaggaagcccaggtggagaacctcatcaccgccaatgcaacagagccccagaaagcagagaactgaagtgcagccatcaggtggaagcctctggaacctgaggcggctgcttgaacctttggatgcaaatgtcgatgcttaagaaaaccggccacttcagcaacagccctttccccaggagaagccaagaacttgtgtgtcccccaccctatcccctctaacaccattcctccacctgatgatgcaactaacacttgcctccccactgcagcctgcggtcctgcccacctcccgtgatgtgtgtgtgtgtgtgtgtgtgtgtgactgtgtgtgtttgctaactgtggtctttgtggctacttgtttgtggatggtattgtgtttgttagtgaactgtggactcgctttcccaggcaggggctgagccacatggccatctgctcctccctgcccccgtggccctccatcaccttctgctcctaggaggctgcttgttgcccgagaccagccccctcccctgatttagggatgcgtagggtaagagcacgggcagtggtcttcagtcgtcttgggacctgggaaggtttgcagcactttgtcatcattcttcatggactcctttcactcctttaacaaaaaccttgcttccttatcccacctgatcccagtctgaaggtctcttagcaactggagatacaaagcaaggagctggtgagcccagcgttgacgtcaggcaggctatgcccttccgtggttaatttcttcccaggggcttccacgaggagtccccatctgccccgccccttcacagagcgcccggggattccaggcccagggcttctactctgcccctggggaatgtgtcccctgcatatcttctcagcaataactccatgggctctgggaccctaccccttccaaccttccctgcttctgagacttcaatctacagcccagctcatccagatgcagactacagtccctgcaattgggtctctggcaggcaatagttgaaggactcctgttccgttggggccagcacaccgggatggatggagggagagcagaggcctttgcttctctgcctacgtccccttagatgggcagcagaggcaactcccgcatcctttgctctgcctgtcagtggtcagagcggtgagcgaggtgggttggagactcagcaggctccgtgcagcccttgggaacagtgagaggttgaaggtcataacgagagtgggaactcaacccagatcccgcccctcctgtcctctgtgttcccgcggaaaccaaccaaaccgtgcgctgtgacccattgctgttctctgtatcgtgatctatcctcaacaacaacagaaaaaaggaataaaatatcctttgtttccta

SEQ ID NO: 11354 - DNA, 2130 bp, Homo sapiens
aaccgaaaagcaacagctgatggcaaatccgctccggcgcttgcacgcctcctcggcggcagtctcctgttgcttctcggagcttgactgccctttggaaaaatctctccgcccctcgagaggagagaggagcagaggacgcgcgcgagcacagagcgggaggacggacagggagaggaggagagggggtctgcgcgcggccgctacccagaagccagcggacggcagcacggagtgggctgtccccgagcccagccccgagcgagccccccccccgcccccgcaggacgcgcctcccagccagcccgactcctaggaggaggggaggcgggaaagcagctcaagcctcacccaccgccctgcccccagccccgccactcccaggctcctcgggactcggcgggtcctcctgggagtctcggaggggaccggctgtgcagagaacttcagccaaagcatctgagacgggaagcagaaaaaggagggacagtttggagaagaaaaacgcagctgtgtacgccatggagttggtgctggtcttcctctgcagcctgctggcccccatggtcctggccagtgcagctgaaaaggagaaggaaatggacccttttcattatgattaccagaccctgaggattgggggactggtgttcgctgtggtcctcttctcggttgggatcctccttatcctaagtcgcaggtgcaagtgcagtttcaatcagaagccccgggccccaggagatgaggaagcccaggtggagaacctcatcaccgccaatgcaacagagccccagaaagcagagaactgaagtgcagccatcaggtggaagcctctggaacctgaggcggctgcttgaacctttggatgcaaatgtcgatgcttaagaaaaccggccacttcagcaacagccctttccccaggagaagccaagaacttgtgtgtcccccaccctatcccctctaacaccattcctccacctgatgatgcaactaacacttgcctccccactgcagcctgcggtcctgcccacctcccgtgatgtgtgtgtgtgtgtgtgtgtgtgtgactgtgtgtgtttgctaactgtggtctttgtggctacttgtttgtggatggtattgtgtttgttagtgaactgtggactcgctttcccaggcaggggctgagccacatggccatctgctcctccctgcccccgtggccctccatcaccttctgctcctaggaggctgcttgttgcccgagaccagccccctcccctgatttagggatgcgtagggtaagagcacgggcagtggtcttcagtcgtcttgggacctgggaaggtttgcagcactttgtcatcattcttcatggactcctttcactcctttaacaaaaaccttgcttccttatcccacctgatcccagtctgaaggtctcttagcaactggagatacaaagcaaggagctggtgagcccagcgttgacgtcaggcaggctatgcccttccgtggttaatttcttcccaggggcttccacgaggagtccccatctgccccgccccttcacagagcgcccggggattccaggcccagggcttctactctgcccctggggaatgtgtcccctgcatatcttctcagcaataactccatgggctctgggaccctaccccttccaaccttccctgcttctgagacttcaatctacagcccagctcatccagatgcagactacagtccctgcaattgggtctctggcaggcaatagttgaaggactcctgttccgttggggccagcacaccgggatggatggagggagagcagaggcctttgcttctctgcctacgtccccttagatgggcagcagaggcaactcccgcatcctttgctctgcctgtcagtggtcagagcggtgagcgaggtgggttggagactcagcaggctccgtgcagcccttgggaacagtgagaggttgaaggtcataacgagagtgggaactcaacccagatcccgcccctcctgtcctctgtgttcccgcggaaaccaaccaaaccgtgcgctgtgacccattgctgttctctgtatcgtgatctatcctcaacaacaacagaaaaaaggaataaaatatcctttgtttcctagtg

SEQ ID NO: 11355 - DNA, 2151 bp, Homo sapiens
aaccgaaaagcaacagctgatggcaaatccgctccggcgcttgcacgcctcctcggcggcagtctcctgttgcttctcggagcttgactgccctttggaaaaatctctccgcccctcgagaggagagaggagcagaggacgcgcgcgagcacagagcgggaggacggacagggagaggaggagagggggtctgcgcgcggccgctacccagaagccagcggacggcagcacggagtgggctgtccccgagcccagccccgagcgagccccccccccgcccccgcaggacgcgcctcccagccagcccgactcctaggaggaggggaggcgggaaagcagctcaagcctcacccaccgccctgcccccagccccgccactcccaggctcctcgggactcggcgggtcctcctgggagtctcggaggggaccggctgtgcaggtttgggccttgacgtggctgtggatgcagtcgttctgacccctggtggccgagaggtgaagtgcagtggcggctgcttgctcaaggccggaggaagacgccatggagttggtgctggtcttcctctgcagcctgctggcccccatggtcctggccagtgcagctgaaaaggagaaggaaatggacccttttcattatgattaccagaccctgaggattgggggactggtgttcgctgtggtcctcttctcggttgggatcctccttatcctaagtcgcaggtgcaagtgcagtttcaatcagaagccccgggccccaggagatgaggaagcccaggtggagaacctcatcaccgccaatgcaacagagccccagaaagcagagaactgaagtgcagccatcaggtggaagcctctggaacctgaggcggctgcttgaacctttggatgcaaatgtcgatgcttaagaaaaccggccacttcagcaacagccctttccccaggagaagccaagaacttgtgtgtcccccaccctatcccctctaacaccattcctccacctgatgatgcaactaacacttgcctccccactgcagcctgcggtcctgcccacctcccgtgatgtgtgtgtgtgtgtgtgtgtgtgtgactgtgtgtgtttgctaactgtggtctttgtggctacttgtttgtggatggtattgtgtttgttagtgaactgtggactcgctttcccaggcaggggctgagccacatggccatctgctcctccctgcccccgtggccctccatcaccttctgctcctaggaggctgcttgttgcccgagaccagccccctcccctgatttagggatgcgtagggtaagagcacgggcagtggtcttcagtcgtcttgggacctgggaaggtttgcagcactttgtcatcattcttcatggactcctttcactcctttaacaaaaaccttgcttccttatcccacctgatcccagtctgaaggtctcttagcaactggagatacaaagcaaggagctggtgagcccagcgttgacgtcaggcaggctatgcccttccgtggttaatttcttcccaggggcttccacgaggagtccccatctgccccgccccttcacagagcgcccggggattccaggcccagggcttctactctgcccctggggaatgtgtcccctgcatatcttctcagcaataactccatgggctctgggaccctaccccttccaaccttccctgcttctgagacttcaatctacagcccagctcatccagatgcagactacagtccctgcaattgggtctctggcaggcaatagttgaaggactcctgttccgttggggccagcacaccgggatggatggagggagagcagaggcctttgcttctctgcctacgtccccttagatgggcagcagaggcaactcccgcatcctttgctctgcctgtcagtggtcagagcggtgagcgaggtgggttggagactcagcaggctccgtgcagcccttgggaacagtgagaggttgaaggtcataacgagagtgggaactcaacccagatcccgcccctcctgtcctctgtgttcccgcggaaaccaaccaaaccgtgcgctgtgacccattgctgttctctgtatcgtgatctatcctcaacaacaacagaaaaaaggaataaaatatcctttgtttcctagtg

SEQ ID NO: 11356 - DNA, 713 bp, Homo sapiens
ccccacatcggtccgtcctgcttccagctgctgcagcgcgccttcgccgccaaagcatccagcagccccctgctccggcccagcatggcgaccccgacccagacccccacaaaggctcctgaggaacctgacccattttactatgactacaacacggtgcagactgtgggcatgactctggcaaccatcttgttcctgctgggtatcctcatcgtcatcagcaagaaggtgaagtgcaggaaggcggactccaggtctgagagcccaacctgcaaatcctgtaagtctgagcttccctcttcagcccctggtggcggcggcgtgtaacaccttcccgaggaaactccgctgccgaccctgcctgagcgcgggagcctgaggaccgggtggaggcggtggggacccagccgcgcgccgggagcgctccccggaatgagccgccccacccaccccaaggctggagccgctgcaccctgctgtccctctccaggccttggcaatgacgatcccccaaagagcccgtctgcaccccagacccagggcctcaggcctccagctcctgggatccgggagtccatcccggcccagcacccccagcatccccgtgtatggcccccctgcacctccttgtctcatccccgaagatccgtccccctggcccctcagtgtccatgtcttgagcttaataaatgtgcatttggttttttcctctg

SEQ ID NO: 11357 - DNA, 1111 bp, Homo sapiens
atcggtccgtcctgcttccagctgctgcagcgcgccttcgccgccaaagcatccagcagccccctgctccggcccagcatggcgaccccgacccagacccccacaaaggctcctgaggaacctgacccattttactatggtgagtgttggatttggggatagggctggactggggagtagctgcaggtgctcacagatcactccggacatggcttcagctgtggccacacgatacgtgctgggccactggccacgggaccatatatgtgggtgtggttcacatcagctgagttcatggagggcagaaccagatgggggagtggggatgcctcacactctctctgagcccccttcaggtctcaccgggatctgggctggtgccttggtgtcgccagagaagcagatgaaggaaaaccttagaagcaatgactctgagcccaggctgcctggatttgaatcctgccttatccactcactagctgtatggccttgggcaagcaactttgcctctctgggcccttctgtaaacaagggatagtaatagttcccacctatgaggactgtgggaaagatacctgactggtggcattaaatctcctccatggcactgaagctcaaataagctaccccaggcctggtagatcgggctccagtttcccctctgaacaccctcctcttgcccccaccccacccctttgctcattcatactttttccctaggtgtcaatttctctcccatctcaggacctttgcgtgtgctatgattctgcagtaatgcttctcctttgtacacgaccggctaaggctcccccttattcaggcctcagatcaaacatagactactctactgggataggccctcctgactccctggcaaggaagagccacaccatactcagctggtgtcgcatgacttgtttttgagggggattgtttctttaatgttttatcacaatacgaaagtcaactccttgctggtagaggcctggaccactactggtacagagtgagtgctccataaattcatatctcaacaaatacttagcgggcacaggctctatttctggcaatgttccaagcagctggagacactgcaatgaaccacacagac

SEQ ID NO: 11358 - DNA, 2482 bp, Homo sapiens
gccgcgctggtggcggcggcgcgtcgttgcagttgcgccatctgtcaggagcggagccggcgaggagggggctgccgcgggcgaggaggaggggtcgccgcgagccgaaggccttcgagacccgcccgccgcccggcggcgagagtagaggcgaggttgttgtgcgagcggcgcgtcctctcccgcccgggcgcgccgcgcttctcccagcgcaccgaggaccgcccgggcgcacacaaagccgccgcccgcgccgcaccgcccggcggccgccgcccgcgccagggagggattcggccgccgggccggggacaccccggcgccgccccctcggtgctctcggaaggcccaccggctcccgggcccgccggggaccccccggagccgcctcggccgcgccggaggagggcggggagaggaccatgtgagtgggctccggagcctcagcgccgcgcagtttttttgaagaagcaggatgctgatctaaacgtggaaaaagaccagtcctgcctctgttgtagaagacatgtggtgtatataaagtttgtgatcgttggcggacattttggaatttagataatgggctgtgtgcaatgtaaggataaagaagcaacaaaactgacggaggagagggacggcagcctgaaccagagctctgggtaccgctatggcacagaccccacccctcagcactaccccagcttcggtgtgacctccatccccaactacaacaacttccacgcagccgggggccaaggactcaccgtctttggaggtgtgaactcttcgtctcatacggggaccttgcgtacgagaggaggaacaggagtgacactctttgtggccctttatgactatgaagcacggacagaagagtggtactttggaaaacttggccgaaaagatgctgagcgacagctattgtcctttggaaacccaagaggtacctttcttatccgcgagagtgaaaccaccaaaggtgcctattcactttctatccgtgattgggatgatatgaaaggagaccatgtcaaacattataaaattcgcaaacttgacaatggtggatactacattaccacccgggcccagtttgaaacacttcagcagcttgtacaacattactcagagaaagctgatggtttgtgttttaacttaactgtgattgcatcgagttgtaccccacaaacttctggattggctaaagatgcttgggaagttgcacgtcgttcgttgtgtctggagaagaagctgggtcaggggtgtttcgctgaagtgtggcttggtacctggaatggaaacacaaaagtagccataaagactcttaaaccaggcacaatgtcccccgaatcattccttgaggaagcgcagatcatgaagaagctgaagcacgacaagctggtccagctctatgcagtggtgtctgaggagcccatctacatcgtcaccgagtatatgaacaaaggaagtttactggatttcttaaaagatggagaaggaagagctctgaaattaccaaatcttgtggacatggcagcacaggtggctgcaggaatggcttacatcgagcgcatgaattatatccatagagatctgcgatcagcaaacattctagtggggaatggactcatatgcaagattgctgacttcggattggcccgattgatagaagacaatgagtacacagcaagacaaggtgcaaagttccccatcaagtggacggcccccgaggcagccctgtacgggaggttcacaatcaagtctgacgtgtggtcttttggaatcttactcacagagctggtcaccaaaggaagagtgccatacccaggcatgaacaaccgggaggtgctggagcaggtggagcgaggctacaggatgccctgcccgcaggactgccccatctctctgcatgagctcatgatccactgctggaaaaaggaccctgaagaacgccccacttttgagtacttgcagagcttcctggaagactactttaccgcgacagagccccagtaccaacctggtgaaaacctgtaaggcccgggtctgcggagagaggccttgtcccagaggctgccccacccctccccattagctttcaattccgtagccagctgctccccagcagcggaaccgcccaggatcagattgcatgtgactctgaagctgacgaacttccatggccctcattaatgacacttgtccccaaatccgaacctcctctgtgaagcattcgagacagaaccttgttatttctcagactttggaaaatgcattgtatcgatgttatgtaaaaggccaaacctctgttcagtgtaaatagttactccagtgccaacaatcctagtgctttccttttttaaaaatgcaaatcctatgtgattttaactctgtcttcacctgattcaactaaaaaaaaaaaagtattattttccaaaagtggcctctttgtctaaaacaataaaattttttttcatgtttt

SEQ ID NO: 11359 - DNA, 2009 bp, Homo sapiens
aaatgatcaagtgttgggtataagccaaggagctgagagagggggagaccagcgcaggtctgaggagctgagaagggaggcttacgtgaagggaatttagataatgggctgtgtgcaatgtaaggataaagaagcaacaaaactgacggaggagagggacggcagcctgaaccagagctctgggtaccgctatggcacagaccccacccctcagcactaccccagcttcggtgtgacctccatccccaactacaacaacttccacgcagccgggggccaaggactcaccgtctttggaggtgtgaactcttcgtctcatacggggaccttgcgtacgagaggaggaacaggagtgacactctttgtggccctttatgactatgaagcacggacagaagatgacctgagttttcacaaaggagaaaaatttcaaatattgaacagctcggaaggagattggtgggaagcccgctccttgacaactggagagacaggttacattcccagcaattatgtggctccagttgactctatccaggcagaagagtggtactttggaaaacttggccgaaaagatgctgagcgacagctattgtcctttggaaacccaagaggtacctttcttatccgcgagagtgaaaccaccaaaggtgcctattcactttctatccgtgattgggatgatatgaaaggagaccatgtcaaacattataaaattcgcaaacttgacaatggtggatactacattaccacccgggcccagtttgaaacacttcagcagcttgtacaacattactcaggtacctggaatggaaacacaaaagtagccataaagactcttaaaccaggcacaatgtcccccgaatcattccttgaggaagcgcagatcatgaagaagctgaagcacgacaagctggtccagctctatgcagtggtgtctgaggagcccatctacatcgtcaccgagtatatgaacaaaggaagtttactggatttcttaaaagatggagaaggaagagctctgaaattaccaaatcttgtggacatggcagcacaggtggctgcaggaatggcttacatcgagcgcatgaattatatccatagagatctgcgatcagcaaacattctagtggggaatggactcatatgcaagattgctgacttcggattggcccgattgatagaagacaatgagtacacagcaagacaaggtgcaaagttccccatcaagtggacggcccccgaggcagccctgtacgggaggttcacaatcaagtctgacgtgtggtcttttggaatcttactcacagagctggtcaccaaaggaagagtgccatacccaggcatgaacaaccgggaggtgctggagcaggtggagcgaggctacaggatgccctgcccgcaggactgccccatctctctgcatgagctcatgatccactgctggaaaaaggaccctgaagaacgccccacttttgagtacttgcagagcttcctggaagactactttaccgcgacagagccccagtaccaacctggtgaaaacctgtaaggcccgggtctgcggagagaggccttgtcccagaggctgccccacccctccccattagctttcaattccgtagccagctgctccccagcagcggaaccgcccaggatcagattgcatgtgactctgaagctgacgaacttccatggccctcattaatgacacttgtccccaaatccgaacctcctctgtgaagcattcgagacagaaccttgttatttctcagactttggaaaatgcattgtatcgatgttatgtaaaaggccaaacctctgttcagtgtaaatagttactccagtgccaacaatcctagtgctttccttttttaaaaatgcaaatcctatgtgattttaactctgtcttcacctgattcaactaaaaaaaaaaaagtattattttccaaaagtggcctctttgtctaaaacaataaaattttttttcatgttttaacaaaaaccaa

SEQ ID NO: 11360 - DNA, 3628 bp, Homo sapiens
agagcatcagcaagagtagcagcgagcagccgcgctggtggcggcggcgcgtcgttgcagttgcgccatctgtcaggagcggagccggcgaggagggggctgccgcgggcgaggaggaggggtcgccgcgagccgaaggccttcgagacccgcccgccgcccggcggcgagagtagaggcgaggttgttgtgcgagcggcgcgtcctctcccgcccgggcgcgccgcgcttctcccagcgcaccgaggaccgcccgggcgcacacaaagccgccgcccgcgccgcaccgcccggcggccgccgcccgcgccagggagggattcggccgccgggccggggacaccccggcgccgccccctcggtgctctcggaaggcccaccggctcccgggcccgccggggaccccccggagccgcctcggccgcgccggaggagggcggggagaggaccatgtgagtgggctccggagcctcagcgccgcgcagtttttttgaagaagcaggatgctgatctaaacgtggaaaaagaccagtcctgcctctgttgtagaagacatgtggtgtatataaagtttgtgatcgttggcggacattttggaatttagataatgggctgtgtgcaatgtaaggataaagaagcaacaaaactgacggaggagagggacggcagcctgaaccagagctctgggtaccgctatggcacagaccccacccctcagcactaccccagcttcggtgtgacctccatccccaactacaacaacttccacgcagccgggggccaaggactcaccgtctttggaggtgtgaactcttcgtctcatacggggaccttgcgtacgagaggaggaacaggagtgacactctttgtggccctttatgactatgaagcacggacagaagatgacctgagttttcacaaaggagaaaaatttcaaatattgaacagctcggaaggagattggtgggaagcccgctccttgacaactggagagacaggttacattcccagcaattatgtggctccagttgactctatccaggcagaagagtggtactttggaaaacttggccgaaaagatgctgagcgacagctattgtcctttggaaacccaagaggtacctttcttatccgcgagagtgaaaccaccaaaggtgcctattcactttctatccgtgattgggatgatatgaaaggagaccatgtcaaacattataaaattcgcaaacttgacaatggtggatactacattaccacccgggcccagtttgaaacacttcagcagcttgtacaacattactcagagagagctgcaggtctctgctgccgcctagtagttccctgtcacaaagggatgccaaggcttaccgatctgtctgtcaaaaccaaagatgtctgggaaatccctcgagaatccctgcagttgatcaagagactgggaaatgggcagtttggggaagtatggatgggtacctggaatggaaacacaaaagtagccataaagactcttaaaccaggcacaatgtcccccgaatcattccttgaggaagcgcagatcatgaagaagctgaagcacgacaagctggtccagctctatgcagtggtgtctgaggagcccatctacatcgtcaccgagtatatgaacaaaggaagtttactggatttcttaaaagatggagaaggaagagctctgaaattaccaaatcttgtggacatggcagcacaggtggctgcaggaatggcttacatcgagcgcatgaattatatccatagagatctgcgatcagcaaacattctagtggggaatggactcatatgcaagattgctgacttcggattggcccgattgatagaagacaatgagtacacagcaagacaaggtgcaaagttccccatcaagtggacggcccccgaggcagccctgtacgggaggttcacaatcaagtctgacgtgtggtcttttggaatcttactcacagagctggtcaccaaaggaagagtgccatacccaggcatgaacaaccgggaggtgctggagcaggtggagcgaggctacaggatgccctgcccgcaggactgccccatctctctgcatgagctcatgatccactgctggaaaaaggaccctgaagaacgccccacttttgagtacttgcagagcttcctggaagactactttaccgcgacagagccccagtaccaacctggtgaaaacctgtaaggcccgggtctgcggagagaggccttgtcccagaggctgccccacccctccccattagctttcaattccgtagccagctgctccccagcagcggaaccgcccaggatcagattgcatgtgactctgaagctgacgaacttccatggccctcattaatgacacttgtccccaaatccgaacctcctctgtgaagcattcgagacagaaccttgttatttctcagactttggaaaatgcattgtatcgatgttatgtaaaaggccaaacctctgttcagtgtaaatagttactccagtgccaacaatcctagtgctttccttttttaaaaatgcaaatcctatgtgattttaactctgtcttcacctgattcaactaaaaaaaaaaaagtattattttccaaaagtggcctctttgtctaaaacaataaaattttttttcatgttttaacaaaaaccaatcaggacaggtgtttgtttttgttttcttttttataaatatgaatatatataatatatatgtccctgtacatatacaatgtgggtgctaatgtggagactgtggccggcctgagccaccaagctgcgggacccagagggaggattttactgcaagtcagcatcaaagcaccggtgttattctgaaaacaccagtggcctcatttttggcttttgcaaagcatgaattttttcatttggattgcactttcctggttcatgactgtacctgtaggtggttgttactttgactcttttcaggaaccaccccccaagctgaatttacaagttctgttagcactatttgcttcaacttactgcgatttgttctcaaaacttaaaaataagcaagcaaatggctgatactaccaagagaactggaagatggataccacacaaacttcttgtataaaaatatgaatgctgaaatgtttcagacatttttaatttaataaacctgtaaccacatttaagtgatctaaaacccatagcattgtagtcatggcaacccgctaaactttctcatgcaactaaaatttctgggggaaatgagggtgggggttgtacatttcccattgtaaaataagtgttttaaatgtcctgtactgctaacgaatgactttctatatgtccaggagttctccagtggaataactatgcactactttacatttcatggggatgcacaaaaacaaaaaagtattacatttttagttgctgtttgtaccaaccttaaattacatatgtttaacaacaacaaatcaaaaatcctatttctattgagtttttaatactgactagcaactctgaagtcttaattccttttttgttatgatttatttgtgagtttacatttttaaattgtttaactttcttaatttagtaattaaaaagagagcattttacatttgaa

SEQ ID NO: 11361 - DNA, 2473 bp, Homo sapiens
gccgcgctggtggcggcggcgcgtcgttgcagttgcgccatctgtcaggagcggagccggcgaggagggggctgccgcgggcgaggaggaggggtcgccgcgagccgaaggccttcgagacccgcccgccgcccggcggcgagagtagaggcgaggttgttgtgcgagcggcgcgtcctctcccgcccgggcgcgccgcgcttctcccagcgcaccgaggaccgcccgggcgcacacaaagccgccgcccgcgccgcaccgcccggcggccgccgcccgcgccagggagggattcggccgccgggccggggacaccccggcgccgccccctcggtgctctcggaaggcccaccggctcccgggcccgccggggaccccccggagccgcctcggccgcgccggaggagggcggggagaggaccatgtgagtgggctccggagcctcagcgccgcgcagtttttttgaagaagcaggatgctgatctaaacgtggaaaaagaccagtcctgcctctgttgtagaagacatgtggtgtatataaagtttgtgatcgttggcggacattttggaatttagataatgggctgtgtgcaatgtaaggataaagaagcaacaaaactgacggaggagagggacggcagcctgaaccagagctctgggtaccgctatggcacagaccccacccctcagcactaccccagcttcggtgtgacctccatccccaactacaacaacttccacgcagccgggggccaaggactcaccgtctttggaggtgtgaactcttcgtctcatacggggaccttgcgtacgagaggaggaacaggagtgacactctttgtggccctttatgactatgaagcacggacagaagatgacctgagttttcacaaaggagaaaaatttcaaatattgaacagctcggaaggagattggtgggaagcccgctccttgacaactggagagacaggttacattcccagcaattatgtggctccagttgactctatccaggcagaagagtggtactttggaaaacttggccgaaaagatgctgagcgacagctattgtcctttggaaacccaagaggtacctttcttatccgcgagagtgaaaccaccaaaggtgcctattcactttctatccgtgattgggatgatatgaaaggagaccatgtcaaacattataaaattcgcaaacttgacaatggtggatactacattaccacccgggcccagtttgaaacacttcagcagcttgtacaacattactcaggtacctggaatggaaacacaaaagtagccataaagactcttaaaccaggcacaatgtcccccgaatcattccttgaggaagcgcagatcatgaagaagctgaagcacgacaagctggtccagctctatgcagtggtgtctgaggagcccatctacatcgtcaccgagtatatgaacaaaggaagtttactggatttcttaaaagatggagaaggaagagctctgaaattaccaaatcttgtggacatggcagcacaggtggctgcaggaatggcttacatcgagcgcatgaattatatccatagagatctgcgatcagcaaacattctagtggggaatggactcatatgcaagattgctgacttcggattggcccgattgatagaagacaatgagtacacagcaagacaaggtgcaaagttccccatcaagtggacggcccccgaggcagccctgtacgggaggttcacaatcaagtctgacgtgtggtcttttggaatcttactcacagagctggtcaccaaaggaagagtgccatacccaggcatgaacaaccgggaggtgctggagcaggtggagcgaggctacaggatgccctgcccgcaggactgccccatctctctgcatgagctcatgatccactgctggaaaaaggaccctgaagaacgccccacttttgagtacttgcagagcttcctggaagactactttaccgcgacagagccccagtaccaacctggtgaaaacctgtaaggcccgggtctgcggagagaggccttgtcccagaggctgccccacccctccccattagctttcaattccgtagccagctgctccccagcagcggaaccgcccaggatcagattgcatgtgactctgaagctgacgaacttccatggccctcattaatgacacttgtccccaaatccgaacctcctctgtgaagcattcgagacagaaccttgttatttctcagactttggaaaatgcattgtatcgatgttatgtaaaaggccaaacctctgttcagtgtaaatagttactccagtgccaacaatcctagtgctttccttttttaaaaatgcaaatcctatgtgattttaactctgtcttcacctgattcaactaaaaaaaaaaaagtattattttccaaaagtggcctctttgtctaaaacaataaaattttttttcatgtttt

SEQ ID NO: 11362 - DNA, 2416 bp, Homo sapiens
aagagaacaaaagtgtctgagaaagccagagtgtgaccacgcggtttctatgctccaagggatttatttcagtggtaggtggagcagctctgtggagcacatggctaatgataatggattgactgaccagaagcaggagaggacctagcagaagccggaggtcaagctgccccaagactgggggacagcctgggtgaagactctggacctcatgaccatgtatattccagagggggatctaaagagccccagaaattcacaaaggaccagtcctgcctctgttgtagaagacatgtggtgtatataaagtttgtgatcgttggcggacattttggaatttagataatgggctgtgtgcaatgtaaggataaagaagcaacaaaactgacggaggagagggacggcagcctgaaccagagctctgggtaccgctatggcacagaccccacccctcagcactaccccagcttcggtgtgacctccatccccaactacaacaacttccacgcagccgggggccaaggactcaccgtctttggaggtgtgaactcttcgtctcatacggggaccttgcgtacgagaggaggaacaggagtgacactctttgtggccctttatgactatgaagcacggacagaagatgacctgagttttcacaaaggagaaaaatttcaaatattgaacagctcggaaggagattggtgggaagcccgctccttgacaactggagagacaggttacattcccagcaattatgtggctccagttgactctatccaggcagaagagtggtactttggaaaacttggccgaaaagatgctgagcgacagctattgtcctttggaaacccaagaggtacctttcttatccgcgagagtgaaaccaccaaaggtgcctattcactttctatccgtgattgggatgatatgaaaggagaccatgtcaaacattataaaattcgcaaacttgacaatggtggatactacattaccacccgggcccagtttgaaacacttcagcagcttgtacaacattactcagagagagctgcaggtctctgctgccgcctagtagttccctgtcacaaagggatgccaaggcttaccgatctgtctgtcaaaaccaaagatgtctgggaaatccctcgagaatccctgcagttgatcaagagactgggaaatgggcagtttggggaagtatggatgggtacctggaatggaaacacaaaagtagccataaagactcttaaaccaggcacaatgtcccccgaatcattccttgaggaagcgcagatcatgaagaagctgaagcacgacaagctggtccagctctatgcagtggtgtctgaggagcccatctacatcgtcaccgagtatatgaacaaaggaagtttactggatttcttaaaagatggagaaggaagagctctgaaattaccaaatcttgtggacatggcagcacaggtggctgcaggaatggcttacatcgagcgcatgaattatatccatagagatctgcgatcagcaaacattctagtggggaatggactcatatgcaagattgctgacttcggattggcccgattgatagaagacaatgagtacacagcaagacaaggtgcaaagttccccatcaagtggacggcccccgaggcagccctgtacgggaggttcacaatcaagtctgacgtgtggtcttttggaatcttactcacagagctggtcaccaaaggaagagtgccatacccaggcatgaacaaccgggaggtgctggagcaggtggagcgaggctacaggatgccctgcccgcaggactgccccatctctctgcatgagctcatgatccactgctggaaaaaggaccctgaagaacgccccacttttgagtacttgcagagcttcctggaagactactttaccgcgacagagccccagtaccaacctggtgaaaacctgtaaggcccgggtctgcggagagaggccttgtcccagaggctgccccacccctccccattagctttcaattccgtagccagctgctccccagcagcggaaccgcccaggatcagattgcatgtgactctgaagctgacgaacttccatggccctcattaatgacacttgtccccaaatccgaacctcctctgtgaagcattcgagacagaaccttgttatttctcagactttggaaaatgcattgtatcgatgttatgtaaaaggccaaacctctgttcagtgtaaatagttactccagtgccaacaatcctagtgctttccttttttaaaaatgcaaatcctatgtgattttaactctgtcttcacctgattcaactaaaaaaaaaaaagtattattttccaaaagtggcctctttgtctaaaacaataaaattttttttcatgttttaacaaaaaccaa

SEQ ID NO: 11363 - DNA, 2573 bp, Homo sapiens
cgagcagccgcgctggtggcggcggcgcgtcgttgcagttgcgccatctgtcaggagcggagccggcgaggagggggctgccgcgggcgaggaggaggggtcgccgcgagccgaaggccttcgagacccgcccgccgcccggcggcgagagtagaggcgaggttgttgtgcgagcggcgcgtcctctcccgcccgggcgcgccgcgcttctcccagcgcaccgaggaccgcccgggcgcacacaaagccgccgcccgcgccgcaccgcccggcggccgccgcccgcgccagggagggattcggccgccgggccggggacaccccggcgccgccccctcggtgctctcggaaggcccaccggctcccgggcccgccggggaccccccggagccgcctcggccgcgccggaggagggcggggagaggaccatgtgagtgggctccggagcctcagcgccgcgcagtttttttgaagaagcaggatgctgatctaaacgtggaaaaagaatttagataatgggctgtgtgcaatgtaaggataaagaagcaacaaaactgacggaggagagggacggcagcctgaaccagagctctgggtaccgctatggcacagaccccacccctcagcactaccccagcttcggtgtgacctccatccccaactacaacaacttccacgcagccgggggccaaggactcaccgtctttggaggtgtgaactcttcgtctcatacggggaccttgcgtacgagaggaggaacaggagtgacactctttgtggccctttatgactatgaagcacggacagaagatgacctgagttttcacaaaggagaaaaatttcaaatattgaacagctcggaaggagattggtgggaagcccgctccttgacaactggagagacaggttacattcccagcaattatgtggctccagttgactctatccaggcagaagagtggtactttggaaaacttggccgaaaagatgctgagcgacagctattgtcctttggaaacccaagaggtacctttcttatccgcgagagtgaaaccaccaaaggtgcctattcactttctatccgtgattgggatgatatgaaaggagaccatgtcaaacattataaaattcgcaaacttgacaatggtggatactacattaccacccgggcccagtttgaaacacttcagcagcttgtacaacattactcagagaaagctgatggtttgtgttttaacttaactgtgattgcatcgagttgtaccccacaaacttctggattggctaaagatgcttgggaagttgcacgtcgttcgttgtgtctggagaagaagctgggtcaggggtgtttcgctgaagtgtggcttggtacctggaatggaaacacaaaagtagccataaagactcttaaaccaggcacaatgtcccccgaatcattccttgaggaagcgcagatcatgaagaagctgaagcacgacaagctggtccagctctatgcagtggtgtctgaggagcccatctacatcgtcaccgagtatatgaacaaaggaagtttactggatttcttaaaagatggagaaggaagagctctgaaattaccaaatcttgtggacatggcagcacaggtggctgcaggaatggcttacatcgagcgcatgaattatatccatagagatctgcgatcagcaaacattctagtggggaatggactcatatgcaagattgctgacttcggattggcccgattgatagaagacaatgagtacacagcaagacaaggtgcaaagttccccatcaagtggacggcccccgaggcagccctgtacgggaggttcacaatcaagtctgacgtgtggtcttttggaatcttactcacagagctggtcaccaaaggaagagtgccatacccaggcatgaacaaccgggaggtgctggagcaggtggagcgaggctacaggatgccctgcccgcaggactgccccatctctctgcatgagctcatgatccactgctggaaaaaggaccctgaagaacgccccacttttgagtacttgcagagcttcctggaagactactttaccgcgacagagccccagtaccaacctggtgaaaacctgtaaggcccgggtctgcggagagaggccttgtcccagaggctgccccacccctccccattagctttcaattccgtagccagctgctccccagcagcggaaccgcccaggatcagattgcatgtgactctgaagctgacgaacttccatggccctcattaatgacacttgtccccaaatccgaacctcctctgtgaagcattcgagacagaaccttgttatttctcagactttggaaaatgcattgtatcgatgttatgtaaaaggccaaacctctgttcagtgtaaatagttactccagtgccaacaatcctagtgctttccttttttaaaaatgcaaatcctatgtgattttaactctgtcttcacctgattcaactaaaaaaaaaaaagtattattttccaaaagtggcctctttgtctaaaacaataaaattttttttcatgttttaacaaaaa

SEQ ID NO: 11364 - DNA, 3234 bp, Homo sapiens
cccgggcccgccggggaccccccggagccgcctcggccgcgccggaggagggcggggagaggaccatgtgagtgggctccggagcctcagcgccgcgcagtttttttgaagaagcaggatgctgatctaaacgtggaaaaagaccagtcctgcctctgttgtagaagacatgtggtgtatataaagtttgtgatcgttggcggacattttggaatttagataatgggctgtgtgcaatgtaaggataaagaagcaacaaaactgacggaggagagggacggcagcctgaaccagagctctgggtaccgctatggcacagaccccacccctcagcactaccccagcttcggtgtgacctccatccccaactacaacaacttccacgcagccgggggccaaggactcaccgtctttggaggtgtgaactcttcgtctcatacggggaccttgcgtacgagaggaggaacaggagtgacactctttgtggccctttatgactatgaagcacggacagaagatgacctgagttttcacaaaggagaaaaatttcaaatattgaacagctcggaaggagattggtgggaagcccgctccttgacaactggagagacaggttacattcccagcaattatgtggctccagttgactctatccaggcagaagagtggtactttggaaaacttggccgaaaagatgctgagcgacagctattgtcctttggaaacccaagaggtacctttcttatccgcgagagtgaaaccaccaaaggtgcctattcactttctatccgtgattgggatgatatgaaaggagaccatgtcaaacattataaaattcgcaaacttgacaatggtggatactacattaccacccgggcccagtttgaaacacttcagcagcttgtacaacattactcagagaaagctgatggtttgtgttttaacttaactgtgattgcatcgagttgtaccccacaaacttctggattggctaaagatgcttgggaagttgcacgtcgttcgttgtgtctggagaagaagctgggtcaggggtgtttcgctgaagtgtggcttggtacctggaatggaaacacaaaagtagccataaagactcttaaaccaggcacaatgtcccccgaatcattccttgaggaagcgcagatcatgaagaagctgaagcacgacaagctggtccagctctatgcagtggtgtctgaggagcccatctacatcgtcaccgagtatatgaacaaaggaagtttactggatttcttaaaagatggagaaggaagagctctgaaattaccaaatcttgtggacatggcagcacaggtggctgcaggaatggcttacatcgagcgcatgaattatatccatagagatctgcgatcagcaaacattctagtggggaatggactcatatgcaagattgctgacttcggattggcccgattgatagaagacaatgagtacacagcaagacaaggtgcaaagttccccatcaagtggacggcccccgaggcagccctgtacgggaggttcacaatcaagtctgacgtgtggtcttttggaatcttactcacagagctggtcaccaaaggaagagtgccatacccaggcatgaacaaccgggaggtgctggagcaggtggagcgaggctacaggatgccctgcccgcaggactgccccatctctctgcatgagctcatgatccactgctggaaaaaggaccctgaagaacgccccacttttgagtacttgcagagcttcctggaagactactttaccgcgacagagccccagtaccaacctggtgaaaacctgtaaggcccgggtctgcggagagaggccttgtcccagaggctgccccacccctccccattagctttcaattccgtagccagctgctccccagcagcggaaccgcccaggatcagattgcatgtgactctgaagctgacgaacttccatggccctcattaatgacacttgtccccaaatccgaacctcctctgtgaagcattcgagacagaaccttgttatttctcagactttggaaaatgcattgtatcgatgttatgtaaaaggccaaacctctgttcagtgtaaatagttactccagtgccaacaatcctagtgctttccttttttaaaaatgcaaatcctatgtgattttaactctgtcttcacctgattcaactaaaaaaaaaaaagtattattttccaaaagtggcctctttgtctaaaacaataaaattttttttcatgttttaacaaaaaccaatcaggacaggtgtttgtttttgttttcttttttataaatatgaatatatataatatatatgtccctgtacatatacaatgtgggtgctaatgtggagactgtggccggcctgagccaccaagctgcgggacccagagggaggattttactgcaagtcagcatcaaagcaccggtgttattctgaaaacaccagtggcctcatttttggcttttgcaaagcatgaattttttcatttggattgcactttcctggttcatgactgtacctgtaggtggttgttactttgactcttttcaggaaccaccccccaagctgaatttacaagttctgttagcactatttgcttcaacttactgcgatttgttctcaaaacttaaaaataagcaagcaaatggctgatactaccaagagaactggaagatggataccacacaaacttcttgtataaaaatatgaatgctgaaatgtttcagacatttttaatttaataaacctgtaaccacatttaagtgatctaaaacccatagcattgtagtcatggcaacccgctaaactttctcatgcaactaaaatttctgggggaaatgagggtgggggttgtacatttcccattgtaaaataagtgttttaaatgtcctgtactgctaacgaatgactttctatatgtccaggagttctccagtggaataactatgcactactttacatttcatggggatgcacaaaaacaaaaaagtattacatttttagttgctgtttgtaccaaccttaaattacatatgtttaacaacaacaaatcaaaaatcctatttctattgagtttttaatactgactagcaactctgaagtcttaattccttttttgttatgatttatttgtgagtttacatttttaaattgtttaactttcttaatttagtaattaaaaagagagcattttacatttgaa

SEQ ID NO: 11365 - DNA, 975 bp, Homo sapiens
agatctcctcccctcccagagggtccaagagaacaaaagtgtctgagaaagccagagtgtgaccacgcggtttctatgctccaagggatttatttcagtggtaggtggagcagctctgtggagcacatggctaatgataatggattgactgaccagaagcaggagaggacctagcagaagccggaggtcaagctgccccaagactgggggacagcctgggtgaagactctggacctcatgaccatgtatattccagagggggatctaaagagccccagaaattcacaaaggaccagtcctgcctctgttgtagaagacatgtggtgtatataaagtttgtgatcgttggcggacattttggaaagcaaatgagaatgagcgactgtaacccttgcctgttgttcataagcatgtacaccaggatctgtgtgatccttttcctgaagataaacagcatactgctcaaggaaggaaaacaacgcatagcaacaaatttcctgttttttaaagaaagatccaacttggtttagaaattatgctggcttgctttctatgtttctaatagagaataaggagaaacttgcttctcatttgccgacatgaggaatttagataatgggctgtgtgcaatgtaaggataaagaagcaacaaaactgacggaggagagggacggcagcctgaaccagagctctgggtaccgctatggcacagaccccacccctcagcactaccccagcttcggtgtgacctccatccccaactacaacaacttccacgcagccgggggccaaggactcaccgtctttggaggtgtgaactcttcgtctcatacggggaccttgcgtacgagaggaggaacaggagtgacactctttgtggccctttatgactatgaagcacggacagaagatgacctgagttttcacaaaggagaaaaatttcaaatattgaacagctcggaaggagattggtgg

SEQ ID NO: 11366 - DNA, 989 bp, Homo sapiens
gtataagccaaggagctgagagagggggagaccagcgcaggtctgaggagctgagaagggaggcttacgtgaagggtaagactcgcatgggcctggccggtggacaagatgtgggaactgcatggacagttatgtggaggtgcattccatcctggctggagagtgtgtgaggggcagtgggagattggtggaaaagatataggccactggtgtggaaggctgggaagccacgcttcagatcggagaaagttgctaatcagagaagcggcgttctggaggtggaatttagataatgggctgtgtgcaatgtaaggataaagaagcaacaaaactgacggaggagagggacggcagcctgaaccagagctctgggtaccgctatggcacagaccccacccctcagcactaccccagcttcggtgtgacctccatccccaactacaacaacttccacgcagccgggggccaaggactcaccgtctttggaggtgtgaactcttcgtctcatacggggaccttgcgtacgagaggaggaacaggagtgacactctttgtggccctttatgactatgaagcacggacagaagatgacctgagttttcacaaaggagaaaaatttcaaatattgaacagctcggaaggagattggtgggaagcccgctccttgacaactggagagacaggttacattcccagcaattatgtggctccagttgactctatccaggcagaagagtggtactttggaaaacttggccgaaaagatgctgagcgacagctattgtcctttggaaacccaagaggtacctttcttatccgcgagagtgaaaccaccaaaggtgcctattcactttctatccgtgattgggatgatatgaaaggagaccatgtcaaacattataaaattcgcaaacttgacaatggtggatactacattaccacccgggcccagtttgaaacacttcagcagcttgtacaacattactcag

SEQ ID NO: 11367 - DNA, 712 bp, Homo sapiens
gcccgccgcccggcggcgagagtagaggcgaggaccgcccgggcgcacacaaagccgccgcccgcgccgcaccgcccggcggccgccgcccgcgccagggagggattcggccgccgggccggggacaccccggcgccgccccctcggtgctctcggaaggcccaccggctcccgggcccgccggggaccccccggagccgcctcggccgcgccggaggagggcggggagaggaccatgtgagtgggctccggagcctcagcgccgcgcagtttttttgaagaagcaggatgctgatctaaacgtggaaaaagaccagtcctgcctctgttgtagaagacatgtggtgtatataaagtttgtgatcgttggcggacattttggaatttagataatgggctgtgtgcaatgtaaggataaagaagcaacaaaactgacggaggagagggacggcagcctgaaccagagctctgggtaccgctatggcacagaccccacccctcagcactaccccagcttcggtgtgacctccatccccaactacaacaacttccacgcagccgggggccaaggactcaccgtctttggaggtgtgaactcttcgtctcatacggggaccttgcgtacgagaggaggaacaggagtgacactctttgtggccctttatgactatgaagcacggacagaagatgacctgagttttcacaaaggaga

SEQ ID NO: 11368 - DNA, 518 bp, Homo sapiens
caggatgctgatctaaacgtggaaaaaagtgaacataagtcaagacagcagtgaggcactctggcgctgggacacagtgagaaattaagatttgctagtgctggttccagggcggcctgaactcttgtacttcagctcatgtcatgctgggacagatctgaaggaagatccatctccctcgggtttcttgatacttctgtgccttctgtctggcaagggcgtcagagccacgggaacttagaggaccagtcctgcctctgttgtagaagacatgtggtgtatataaagtttgtgatcgttggcggacattttggaatttagataatgggctgtgtgcaatgtaaggataaagaagcaacaaaactgacggaggagagggacggcagcctgaaccagagctctgggtaccgctatggcacagaccccacccctcagcactaccccagcttcggtgtgacctccatccccaactacaacaacttccacgcagccgggggccaaggactcaccgtctttgg

SEQ ID NO: 11369 - DNA, 610 bp, Homo sapiens
acagcggagagaataatcgaatgaaaactgaagctttctgctttattccttttctccttctcctttcagtcaggaatttagataatgggctgtgtgcaatgtaaggataaagaagcaacaaaactgacggaggagagggacggcagcctgaaccagagctctgggtaccgctatggcacagaccccacccctcagcactaccccagcttcggtgtgacctccatccccaactacaacaacttccacgcagccgggggccaaggactcaccgtctttggaggtgtgaactcttcgtctcatacggggaccttgcgtacgagaggaggaacaggagtgacactctttgtggccctttatgactatgaagcacggacagaagatgacctgagttttcacaaaggagaaaaatttcaaatattgaacagctcggaaggagattggtgggaagcccgctccttgacaactggagagacaggttacattcccagcaattatgtggctccagttgactctatccaggcagaagagtggtactttggaaaacttggccgaaaagatgctgagcgacagctattgtcctttggaaacccaagaggtacctttcttatcc

SEQ ID NO: 11370 - DNA, 1012 bp, Homo sapiens
agtagaggcgaggttgttgtgcgagcggcgcgtcctctcccgcccgggcgcgccgcgcttctcccagcgcaccgaggaccgcccgggcgcacacaaagccgccgcccgcgccgcaccgcccggcggccgccgcccgcgccagggagggattcggccgccgggccggggacaccccggcgccgccccctcggtgctctcggaaggcccaccggctcccgggcccgccggggaccccccggagccgcctcggccgcgccggaggagggcggggagaggaccatgtgagtgggctccggagcctcagcgccgcgcagtttttttgaagaagcaggatgctgatctaaacgtggaaaaagaccagtcctgcctctgttgtagaagacatgtggtgtatataaagtttgtgatcgttggcggacattttgacagggtctcactctgtcacccaggctgacacgatcatggctcactacaatctctgccttcctgcctcaagggttcttccttgagcacctcagcctcccaagtagctgggaccacaggaatttagataatgggctgtgtgcaatgtaaggataaagaagcaacaaaactgacggaggagagggacggcagcctgaaccagagctctgggtaccgctatggcacagaccccacccctcagcactaccccagcttcggtgtgacctccatccccaactacaacaacttccacgcagccgggggccaaggactcaccgtctttggaggtgtgaactcttcgtctcatacggggaccttgcgtacgagaggaggaacaggagtgacactctttgtggccctttatgactatgaagcacggacagaagatgacctgagttttcacaaaggagaaaaatttcaaatattgaacagctcggaaggagattggtgggaagcccgctccttgacaactggagagacaggttacattcccagcaattatgtggctccagttgactctatccaggcagaagagtggtactttggaaaa

SEQ ID NO: 11371 - DNA, 571 bp, Homo sapiens
attccagggttaagaaatggatgggtcactgagatctagcacccagttgtcctgggcttctgcttacggggttattgagatgatagaaggcccagtttttttgaagaagcaggatgctgatctaaacgtggaaaaagaccagtcctgcctctgttgtagaagacatgtggtgtatataaagtttgtgatcgttggcggacattttggaatttagataatgggctgtgtgcaatgtaaggataaagaagcaacaaaactgacggaggagagggacggcagcctgaaccagagctctgggtaccgctatggcacagaccccacccctcagcactaccccagcttcggtgtgacctccatccccaactacaacaacttccacgcagccgggggccaaggactcaccgtctttggaggtgtgaactcttcgtctcatacggggaccttgcgtacgagaggaggaacaggagtgacactctttgtggccctttatgactatgaagcacggacagaagatgacctgagttttcacaaaggagaaaaatttcaaatattgaacagctcggaaggagat

SEQ ID NO: 11372 - DNA, 864 bp, Homo sapiens
cctcggccgcgccggaggagggcggggagaggaccatgtgagtgggctccggagcctcagcgccgcgcagtttttttgaagaagcaggatgctgatctaaacgtggaaaaagaccagtcctgcctctgttgtagaagacatgtggtgtatataaagtttgtgatcgttggcggacattttgggtctcactctgtcacccaggctgacacgatcatggctcactacaatctctgccttcctgcctcaagggttcttccttgagcacctcagcctcccaagtagctgggaccacaggaatttagataatgggctgtgtgcaatgtaaggataaagaagcaacaaaactgacggaggagagggacggcagcctgaaccagagctctgggtaccgctatggcacagaccccacccctcagcactaccccagcttcggtgtgacctccatccccaactacaacaacttccacgcagccgggggccaaggactcaccgtctttggaggtgtgaactcttcgtctcatacggggaccttgcgtacgagaggaggaacaggagtgacactctttgtggccctttatgactatgaagcacggacagaagatgacctgagttttcacaaaggagaaaaatttcaaatattgaacagctcggaaggagattggtgggaagcccgctccttgacaactggagagacaggttacattcccagcaattatgtggctccagttgactctatccaggcagaagagtggtactttggaaaacttggccgaaaagatgctgagcgacagctattgtcctttggaaacccaagaggtacctttcttatccgcgagagtgaaaccaccaaaggtgcctattcac

SEQ ID NO: 11373 - DNA, 609 bp, Homo sapiens
atcatctgatagccataggatgtcatccaaacttgtgtcatggtcctgtaatgttcccgggtttgtggagtgaagaaaataacacttgggtatttggaatttattcttaagctgtttttgtcagggatggatgagtttctcattcttgagttgaaatgaaacttttaaatattcttaataactgtcttatcgccagaccctctgcatgagacaccaagggaccagtcctgcctctgttgtagaagacatgtggtgtatataaagtttgtgatcgttggcggacattttggaatttagataatgggctgtgtgcaatgtaaggataaagaagcaacaaaactgacggaggagagggacggcagcctgaaccagagctctgggtaccgctatggcacagaccccacccctcagcactaccccagcttcggtgtgacctccatccccaactacaacaacttccacgcagccgggggccaaggactcaccgtctttggaggtgtgaactcttcgtctcatacggggaccttgcgtacgagaggaggaacaggagtgacactctttgtggccctttatgactatgaagcacggacagaagatgacctgagtttt

SEQ ID NO: 11374 - DNA, 1012 bp, Homo sapiens
agagtagcagcgagcagccgcgctggtggcggcggcgcgtcgttgcagttgcgccatctgtcaggagcggagccggcgaggagggggctgccgcgggcgaggaggaggggtcgccgcgagccgaaggccttcgagacccgcccgccgcccggcggcgagagtagaggcgaggttgttgtgcgagcggcgcgtcctctcccgcccgggcgcgccgcgcttctcccagcgcaccgaggaccgcccgggcgcacacaaagccgccgcccgcgccgcaccgcccggcggccgccgcccgcgccagggagggattcggccgccgggccggggacaccccggcgccgccccctcggtgctctcggaaggcccaccggctcccgggcccgccggggaccccccggagccgcctcggccgcgccggaggagggcggggagaggaccatgtgagtgggctccggagcctcagcgccgcgcaggaccagtcctgcctctgttgtagaagacatgtggtgtatataaagtttgtgatcgttggcggacattttggaatttagataatgggctgtgtgcaatgtaaggataaagaagcaacaaaactgacggaggagagggacggcagcctgaaccagagctctgggtaccgctatggcacagaccccacccctcagcactaccccagcttcggtgtgacctccatccccaactacaacaacttccacgcagccgggggccaaggactcaccgtctttggaggtgtgaactcttcgtctcatacggggaccttgcgtacgagaggaggaacaggagtgacactctttgtggccctttatgactatgaagcacggacagaagatgacctgagttttcacaaaggagaaaaatttcaaatattgaacagctcggaaggagattggtgggaagcccgctccttgacaactggagagacaggttacattcccagcaattatgtggctccagttgactctatccaggcagaagagtggtactttggaaa

SEQ ID NO: 11375 - DNA, 597 bp, Homo sapiens
atttttcttatcagtaaagtggtccctttcacaggaccaagtaaaattactcgcttttaaattgaaaaacacaaaccaaatacattttgtttttgtttttgttttctgacttgggtcttgaattaaaatggaaaaagggctgttggccaccagtctaaagaatgccaggaccagtcctgcctctgttgtagaagacatgtggtgtatataaagtttgtgatcgttggcggacattttggaatttagataatgggctgtgtgcaatgtaaggataaagaagcaacaaaactgacggaggagagggacggcagcctgaaccagagctctgggtaccgctatggcacagaccccacccctcagcactaccccagcttcggtgtgacctccatccccaactacaacaacttccacgcagccgggggccaaggactcaccgtctttggaggtgtgaactcttcgtctcatacggggaccttgcgtacgagaggaggaacaggagtgacactctttgtggccctttatgactatgaagcacggacagaagatgacctgagttttcacaaaggagaaaaatttcaaatattgaacagctcggaa

SEQ ID NO: 11376 - DNA, 569 bp, Homo sapiens
aaaatgtgtcatctcatcctggggactgcccttggccactgctgaatctgttttgaaacctctttgcaggaccagtcctgcctctgttgtagaagacatgtggtgtatataaagtttgtgatcgttggcggacattttggaatttagataatgggctgtgtgcaatgtaaggataaagaagcaacaaaactgacggaggagagggacggcagcctgaaccagagctctgggtaccgctatggcacagaccccacccctcagcactaccccagcttcggtgtgacctccatccccaactacaacaacttccacgcagccgggggccaaggactcaccgtctttggaggtgtgaactcttcgtctcatacggggaccttgcgtacgagaggaggaacaggagtgacactctttgtggccctttatgactatgaagcacggacagaagatgacctgagttttcacaaaggagaaaaatttcaaatattgaacagctcggaaggagattggtgggaagcccgctccttgacaactggagagacaggttacattcccagcaattatgtggctcc

SEQ ID NO: 11377 - DNA, 541 bp, Homo sapiens
acataataaagcctagaaaagaaaggaccagtcctgcctctgttgtagaagacatgtggtgtatataaagtttgtgatcgttggcggacattttggaatttagataatgggctgtgtgcaatgtaaggataaagaagcaacaaaactgacggaggagagggacggcagcctgaaccagagctctgggtaccgctatggcacagaccccacccctcagcactaccccagcttcggtgtgacctccatccccaactacaacaacttccacgcagccgggggccaaggactcaccgtctttggaggtgtgaactcttcgtctcatacggggaccttgcgtacgagaggaggaacaggagtgacactctttgtggccctttatgactatgaagcacggacagaagatgacctgagttttcacaaaggagaaaaatttcaaatattgaacagctcggaaggagattggtgggaagcccgctccttgacaactggagagacaggttacattcccagcaattatgtggctccagttgactctatccag

SEQ ID NO: 11378 - DNA, 2061 bp, Homo sapiens
gaatttagataatgggctgtgtgcaatgtaaggataaagaagcaacaaaactgacggaggagagggacggcagcctgaaccagagctctgggtaccgctatggcacagaccccacccctcagcactaccccagcttcggtgtgacctccatccccaactacaacaacttccacgcagccgggggccaaggactcaccgtctttggaggtgtgaactcttcgtctcatacggggaccttgcgtacgagaggaggaacaggagtgacactctttgtggccctttatgactatgaagcacggacagaagatgacctgagttttcacaaaggagaaaaatttcaaatattgaacagctcggaaggagattggtgggaagcccgctccttgacaactggagagacaggttacattcccagcaattatgtggctccagttgactctatccaggcagaagagtggtactttggaaaacttggccgaaaagatgctgagcgacagctattgtcctttggaaacccaagaggtacctttcttatccgcgagagtgaaaccaccaaaggtgcctattcactttctatccgtgattgggatgatatgaaaggagaccatgtcaaacattataaaattcgcaaacttgacaatggtggatactacattaccacccgggcccagtttgaaacacttcagcagcttgtacaacattactcagagaaagctgatggtttgtgttttaacttaactgtgattgcatcgagttgtaccccacaaacttctggattggctaaagatgcttgggaagttgcacgtcgttcgttgtgtctggagaagaagctgggtcaggggtgtttcgctgaagtgtggcttggtacctggaatggaaacacaaaagtagccataaagactcttaaaccaggcacaatgtcccccgaatcattccttgaggaagcgcagatcatgaagaagctgaagcacgacaagctggtccagctctatgcagtggtgtctgaggagcccatctacatcgtcaccgagtatatgaacaaaggaagtttactggatttcttaaaagatggagaaggaagagctctgaaattaccaaatcttgtggacatggcagcacaggtggctgcaggaatggcttacatcgagcgcatgaattatatccatagagatctgcgatcagcaaacattctagtggggaatggactcatatgcaagattgctgacttcggattggcccgattgatagaagacaatgagtacacagcaagacaaggtgcaaagttccccatcaagtggacggcccccgaggcagccctgtacgggaggttcacaatcaagtctgacgtgtggtcttttggaatcttactcacagagctggtcaccaaaggaagagtgccatacccaggcatgaacaaccgggaggtgctggagcaggtggagcgaggctacaggatgccctgcccgcaggactgccccatctctctgcatgagctcatgatccactgctggaaaaaggaccctgaagaacgccccacttttgagtacttgcagagcttcctggaagactactttaccgcgacagagccccagtaccaacctggtgaaaacctgtaaggcccgggtctgcggagagaggccttgtcccagaggctgccccacccctccccattagctttcaattccgtagccagctgctccccagcagcggaaccgcccaggatcagattgcatgtgactctgaagctgacgaacttccatggccctcattaatgacacttgtccccaaatccgaacctcctctgtgaagcattcgagacagaaccttgttatttctcagactttggaaaatgcattgtatcgatgttatgtaaaaggccaaacctctgttcagtgtaaatagttactccagtgccaacaatcctagtgctttccttttttaaaaatgcaaatcctatgtgattttaactctgtcttcacctgattcaactaaaaaaaaaaaagtattattttccaaaagtggcctctttgtctaaaacaataaaattttttttcatgtttt

SEQ ID NO: 11379 - DNA, 2172 bp, Homo sapiens
aacaaaagtgtctgagaaagccagagtgtgaccacgcggtttctatgctccaagggatttatttcagtggtaggtggagcagctctgtggagcacatggctaatgataatggattgactgaccagaagcaggagaggacctagcagaagccggaggtcaagctgccccaagactgggggacagcctgggtgaagactctggacctcatgaccatgtatattccagagggggatctaaagagccccagaaattcacaaaggaccagtcctgcctctgttgtagaagacatgtggtgtatataaagtttgtgatcgttggcggacattttggaatttagataatgggctgtgtgcaatgtaaggataaagaagcaacaaaactgacggaggagagggacggcagcctgaaccagagctctgggtaccgctatggcacagaccccacccctcagcactaccccagcttcggtgtgacctccatccccaactacaacaacttccacgcagccgggggccaaggactcaccgtctttggaggtgtgaactcttcgtctcatacggggaccttgcgtacgagaggaggaacaggagtgacactctttgtggccctttatgactatgaagcacaggcagaagagtggtactttggaaaacttggccgaaaagatgctgagcgacagctattgtcctttggaaacccaagaggtacctttcttatccgcgagagtgaaaccaccaaaggtgcctattcactttctatccgtgattgggatgatatgaaaggagaccatgtcaaacattataaaattcgcaaacttgacaatggtggatactacattaccacccgggcccagtttgaaacacttcagcagcttgtacaacattactcagagaaagctgatggtttgtgttttaacttaactgtgattgcatcgagttgtaccccacaaacttctggattggctaaagatgcttgggaagttgcacgtcgttcgttgtgtctggagaagaagctgggtcaggggtgtttcgctgaagtgtggcttggtacctggaatggaaacacaaaagtagccataaagactcttaaaccaggcacaatgtcccccgaatcattccttgaggaagcgcagatcatgaagaagctgaagcacgacaagctggtccagctctatgcagtggtgtctgaggagcccatctacatcgtcaccgagtatatgaacaaaggaagtttactggatttcttaaaagatggagaaggaagagctctgaaattaccaaatcttgtggacatggcagcacaggtggctgcaggaatggcttacatcgagcgcatgaattatatccatagagatctgcgatcagcaaacattctagtggggaatggactcatatgcaagattgctgacttcggattggcccgattgatagaagacaatgagtacacagcaagacaaggtgcaaagttccccatcaagtggacggcccccgaggcagccctgtacgggaggttcacaatcaagtctgacgtgtggtcttttggaatcttactcacagagctggtcaccaaaggaagagtgccatacccaggcatgaacaaccgggaggtgctggagcaggtggagcgaggctacaggatgccctgcccgcaggactgccccatctctctgcatgagctcatgatccactgctggaaaaaggaccctgaagaacgccccacttttgagtacttgcagagcttcctggaagactactttaccgcgacagagccccagtaccaacctggtgaaaacctgtaaggcccgggtctgcggagagaggccttgtcccagaggctgccccacccctccccattagctttcaattccgtagccagctgctccccagcagcggaaccgcccaggatcagattgcatgtgactctgaagctgacgaacttccatggccctcattaatgacacttgtccccaaatccgaacctcctctgtgaagcattcgagacagaaccttgttatttctcagactttggaaaatgcattgtatcgatgttatgtaaaaggccaaacctctgttcagtgtaaatagttactccagtgccaacaatcctagtgctttccttttttaaaaatgcaaatcctatgtgattttaactctgtcttcacctgattcaact

SEQ ID NO: 11380 - DNA, 8504 bp, Homo sapiens
gtgtgcgcgtcatggccgtcagcaccgcgttcccgtcctcttccgcttggccccagaaagtttcggttctgcccggcggtggacccacgagcgcgtgccaccatggagtctgaccactgctgagcagacagccaccgagggccgaaattctgagccttcctctggacccaggcaggagacatacagacaagaaaggcaaactcaccatggcctccaccaatgcagagagccagctccagagaatcatccgagacttgcaagatgctgtgacagaactaagcaaagaatttcaggaagcaggggaacccatcacggatgacagcaccagcttgcataaattttcttataaacttgagtatctcctgcaatttgatcagaaagagaaggccaccctcctgggcaacaagaaggactactgggattacttctgtgcctgcctggccaaggtgaaaggagccaatgatgggatccgctttgtcaagtctatctcagagctccgaacatccttggggaaaggaagagcatttattcgctactccttggtgcaccagaggttggcagacaccttacagcagtgcttcatgaacaccaaagtgaccagtgactggtactatgcaagaagcccctttctgcagccaaagctgagctcggacattgtgggccaactctatgagctgactgaggttcagtttgacctggcgtcgaggggctttgacttggatgctgcctggccaacatttgccaggaggacgctgaccactggctcttctgcttacctgtggaaaccccctagccgcagctccagcatgagcagcttggtgagcagctacctgcagactcaagagatggtgtccaactttgacctgaacagccccctaaacaacgaggcattggagggctttgatgagatgcgactagagctggaccagttggaggtgcgggagaagcagctacgggagcgcatgcagcagctggacagagagaaccaggagctgagggcagctgtcagccagcaaggggagcaactgcagacagagagggagagggggcgcactgcagcggaggacaacgttcgcctcacttgcttggtagctgagctccagaagcagtgggaggtcacccaggccacccagaacactgtgaaggagctgcagacatgcctgcagggcctggagctaggagcagcagagaaggaggaggactaccacacagccctgcggcggctggagtccatgctgcagcccttggcacaggagcttgaggccacacgggactcactggacaagaaaaaccagcatttagccagcttcccaggctggctagccatggctcagcagaaggcagatacggcatcagacacaaagggccggcaagaacctattcccagtgatgcggcccaggagatgcaggagctaggggagaagcttcaagccctagaaagggagagaaccaaggtcgaggaggtcaacagacagcagagtgcccaactggaacagctggtcaaggagcttcagctgaaagaggatgcccgggccagcctggagcgcctggtgaaggagatggccccactccaggaggagttgtctgggaagggacaggaggcagaccagctctggcgacggctgcaggagttgctggcccacacgagctcctgggaggaggagctagcagagttgaggcgggagaaaaaacagcaacaggaggagaaggagctgctggagcaggaggtcaggtctctgacccggcagctgcagttcctggagacccagctggcacaggtgagccaacatgtgagtgacctggaggagcagaagaagcagctcattcaggacaaagaccacctcagccagcaggtgggtatgctcgagcggcttgctgggccgcctggcccagaactgccagtggcaggtgagaagaatgaggccctggtccctgtgaactccagtctgcaagaggcctgggggaagccagaggaggagcagaggggcctgcaggaggcacagttagacgataccaaggtgcaagagggcagccaggaggaagagctccggcaggccaacagggagctggagaaggagctacagaatgtggtcgggcgtaaccagctcctggagggcaagctgcaagccctgcaggccgattaccaggctttgcagcagcgggaatcagccatccagggctccttggcctccctggaggccgagcaggccagcatccggcacttgggtgaccagatggaggcgagcttgctggctgtaaggaaggccaaggaggccatgaaagcccagatggcagagaaggaggccattctacagagcaaggagggcgagtgtcagcagctgcgggaggaggtggagcagtgccagcaactggcagaagcccggcacagagagcttagggctctcgagagccagtgccagcagcagacccagctgattgaggtcctcacagcagagaaaggccaacagggagttggcccacccactgacaatgaagcccgtgagctggctgcccagctagccctgtctcaggcgcagctggaagtccatcagggggaggtccaacggctgcaggctcaggtggtggacctccaggccaagatgcgggcagccctggatgaccaggacaaggtgcagagccagctaagcatggctgaggccgtcctgagggagcacaaaacccttgtgcagcagctgaaggagcagaatgaagcccttaacagagcccatgtccaggagctgctgcaatgctcggagcgtgaaggggcactgcaggaggagagggccgatgaggcccagcagagggaggaggagctgcgggccctgcaggaggagctgtcccaggccaaatgcagctccgaggaagcacagctggagcacgctgagctgcaagagcagctgcaccgggccaacacagacacagctgagctgggcatccaggtttgcgcactgaccgtggaaaaggagcgagtggaggaggcactggcctgtgctgtccaggagctccaggacgccaaagaggcagcctcaagggagcgagagggcctggagcgccaagtagctgggctgcagcaagagaaggagagcttgcaggagaagctgaaggcggccaaggcagcagccggctcactgcctggcctgcaggcccagctcgcccaggcagagcagcgggcccagagcctccaagaggctgcacaccaggagctcaacaccctcaagttccagctgagtgctgaaatcatggactaccagagcagacttaagaatgctggtgaagagtgcaagagcctcaggggccagcttgaggagcaaggccggcagctgcaggctgctgaggaagctgtggagaagctgaaggccacccaagcagacatgggagagaagctgagctgcactagcaaccatcttgcagagtgccaggcggccatgctgaggaaggacaaggagggggctgccctgcgtgaagacctagaaaggacccagaaggaactcgaaaaagccacaacaaaaatccaagagtattacaacaaactctgccaggaggtgacaaatcgtgagaggaatgaccagaagatgcttgctgacctggatgacctcaacagaaccaagaagtatctcgaggagcggctgatagagctgctcagggacaaggatgctctctggcagaagtcagatgccctggaattccagcagaagctcagtgctgaggagagatggctcggagacacagaggcaaaccactgcctcgactgtaagcgggagttcagctggatggtgcggcggcaccactgcaggatatgtggccgcatcttctgttactactgctgcaacaactacgtcctgagcaagcacggtggcaaaaaggagcgctgctgccgagcctgtttccagaagctcagtgaaggccctggctcccctgatagcagtggctcaggcactagccagggagagcccagccctgcactgtcaccagcctcacctgggccccaggccacaggaggccaaggagcaaatacagactacaggccaccggacgacgctgtgtttgatatcatcacagatgaggaattgtgccagatacaggagtccggctcctctttgcctgaaacacccactgaaactgattctctcgacccaaatgcggctgaacaggatactacatcaacctcgctaacgcctgaggacactgaagacatgcccgtggggcaggattcggaaatctgcctgctgaagtctggagaactgatgatcaaagtacccctcacagtggatgagatcgccagcttcggggagggtagcagggagctgtttgtgaggtccagcacctacagcctgatccccatcactgtggccgaggcaggcctcaccatcagctgggtcttctcctctgaccccaagagcatctccttcagtgtggtcttccaggaggccgaggacacaccgctggatcagtgtaaggtcctcattcccacgacccgatgcaactcccacaaggagaacatccagggccagctcaaggttcgcacacccggcatctacatgctcatcttcgacaataccttctcaaggtttgtctctaaaaaggtattttatcacttgacggttgatcggcctgtgatctacgatggaagtgatttcctgtagcttcagcacctcagtaacttcacttcatccacaggaaacactgctcttcctcacctgtcacataaagcatttttttaaaaagtcagctgctccaaaatcatcaactcagcccctgggctgcccctcagaggcggtgtctggggaggactttgtgctcagcactctgcaccggccactcttagcccccgaggcgttgaagggctcaggcaatgtttccattaagtagagactcagctgttgtcacacccaaagggatgctctgccaaaggtttaaacacccaggagaccatcagcctctcctgggagcacagttggctacaggcctcttgtggagagtttcacgggcaggggtgattccaacttctgcctgtggagagattttctgccctgccccaccagggccctgcatgttggagactgagctgggtgcactggccatgccctgtgaatcctcaggctgtgacgccctcaggtactcctgggaaaaggaggtacacagccatcatgcgagtcggtgccaggggaccccccggagatcctgaccagctcctccagtcatgctcttgtccctcactgccccagtaagctggaggctgctccagaactcagcagtgttggaggggcctctaagctgcactctctttctggcccttttgtctgggtgattctgtcctcaaataaagcccttcactcagccagacctctccacagctcaaagcattgccctaagaatcagaagtaaagataatccaagagcaaaacccactgtacttggggcctgcaatggctgtgtgtacactacatctaatgcccaaatgccagccagtgtggatgttgtgaccacagagcaggattgtgcattggctttagagctactcctcagctgatggcccacttttgtttatataaataagagcttctgccccacctgcagacatgtttactaatgatcatagccaggattagaaccactttcaaacattggggccttcttaacaaaagtctttgataacttaagaaccaaagtaacagagtaaacagaggcatgatggatccctgggccccactcccctcctgacaggttccccaacagcccatttgcccacttcccactgctcagcccacaccagacctccaggagacatccccccttgaggcagagagatcctgttccctattcccagacaagaattatttaatcttccctgttctctgtggtccttttcttccccaacaacagatagctcaccttggacagctcttcgtcccttgttcatggaaccagctgcctgcagtcaggccccaggttcttccatgggtgaacagagcatctgacaaaaggtcccagtttggccaggggtgagggagagagcaccagacaggctatccgagaatctgagagctgggcccggcagttcctccagctacccttgtgacctaagtccagtcacacatttcccaaagtttctctttgtcataaccctggtctggctggttttgagggcttgagaatgggtcagggactccaggccaagtccaacagagaccccaaacccaccacacaccagcagccacaacctcaccaccaacaaagaggacttttgtggggccacaagtaagaggtcatttctggaatggactcagacctttaaacaggagagttgagcacttccagtcagtttttaagcaaggcatggggaacagggaatagaacctttcaaagaggttgcccagagaaaagctgggcctcttgcattcggcttccttggagcagcctcttctggcagaaagccatcaggtgctcaatcatcttctcctggccaaggctctgaccatgcttagtactggaatagaggtggccaggcccccagcgactcttcttggcctgatgtttgtcctcacaggcatgccacgtggcctgagatgattcagaacaaatcatgctaactttgaatccatccagccacttgcaaatgataatcagaagtcagcttgttcactgttagaaagaaactaacaaaagagaacccagagcaatctagaatctttgagtgcttggctttccaaggatactgcggagactctggccaagctgatgaccttctgaagtgtcactggcaccatatgcaacaagaaccaccattcactgagtagctaatgggtttggggcctgggacattccatctgaggtccttcctgaacatgtcactccacagcagaggaccggttgcagcttacccagaaccactcctccaggagagctggatgttttgcgtgcaacaccttgagcactgactgctattgttcaaaaaaagcctttgctgcattcggaggactgccccgtgccctgaggtgacttcctaactatgtggtttcattagcgaatttattttttgtgctgggtggacatttgtattttgttaggttgctgtttaagctcaagtttgctgtgctctctgcagctacaaaacatcttggcatatttaagagtggcttttataaatagctttattctgatattaatcagattcccaactttactgagaattaaggactggggtactttaaagaaatgcaaatagcaattgaagaaccactgctgcaggtggtagccctggctagactgaattacactagaaatcagccagaaggaagcgtccttgggatcccagatcactctttttttttttttttaaaaggggcagccccttgatggctcatctctctgaataacagttacgtcttcatatcgataccagatgccttcttcatcatgccactgaagccactcaccaccttcaagaacatgccaacctctgtcagattcacttacccacaaacaaggaggcacgtttggcacaaagtgttgtcctccaggtccaagtggactctacagagtgcttgacctcaacacactggattccaggtggactggaccaagagcaggcaaagacacgggaactgaaaaactccacagggtttggagaatagaaatgaaaagccacgtcatataactcaagaataaatggtgttttggaaattttaaaattatcatcgaaggtggtgaaactatttcaggcccaaatgaaaggaaatcgccagttggggatgaaatcacagagcctgtgttttatgatatggttggatgtccactgatgaaattttaaaggagtttcagttttaaaagtgcgcatgattctacatatgagaattctttaggccaagaaactgtccttggctcagaggtgttgggaattaaagcagagagaagccattcgtgatgcttagaaccaaggatggtcatgtacacaaagaccatcgagacggccattcttgtttacaaaacacttaccaagaaagcactttgtaggggaactttagtaagttcttctcatttcattatgtttcttccaaggaaacaggagagactgaattaataattctctctttcctcttaagcacttttaaaataataaagtacatcttgaaatttggggaggcatctctgatttaaaaaaagaaaaaggctgcttgatgtatgttatgcagagacactctgcctctggtggctgcagagcaatacccaagcctcatttggaaggctcaacatttggaattgcactttaattgattaatcctcaattcatgtggccttacgggatggtgggtctgggaccccaattcattcttatctgccaaagaattatctagaagcacatcaaataccagcaccccacctgctcaatgggggtggaaaacttttgtatccctaagcatattattttatagtgtctgccatgccatgtggaaatactttatttttaacctcaggatttaaataaagtaaacactatgacattt

SEQ ID NO: 11381 - DNA, 4317 bp, Homo sapiens
tgagcaagcacggtggcaaaaaggagcgctgctgccgagcctgtttccagaagctcagtgaaggccctggctcccctgatagcagtggctcaggcactagccagggagagcccagccctgcactgtcaccagcctcacctgggccccaggccacaggaggccaaggagcaaatacagactacaggccaccggacgacgctgtgtttgatatcatcacagatgaggaattgtgccagatacaggagtccggctcctctttgcctgaaacacccactgaaactgattctctcgacccaaatgcggctgaacaggatactacatcaacctcgctaacgcctgaggacactgaagacatgcccgtggggcaggattcggaaatctgcctgctgaagtctggagaactgatgatcaaagtacccctcacagtggatgagatcgccagcttcggggagggtagcagggagctgtttgtgaggtccagcacctacagcctgatccccatcactgtggccgaggcaggcctcaccatcagctgggtcttctcctctgaccccaagagcatctccttcagtgtggtcttccaggaggccgaggacacaccgctggatcagtgtaaggtcctcattcccacgacccgatgcaactcccacaaggagaacatccagggccagctcaaggttcgcacacccggcatctacatgctcatcttcgacaataccttctcaaggtttgtctctaaaaaggtattttatcacttgacggttgatcggcctgtgatctacgatggaagtgatttcctgtagcttcagcacctcagtaacttcacttcatccacaggaaacactgctcttcctcacctgtcacataaagcatttttttaaaaagtcagctgctccaaaatcatcaactcagcccctgggctgcccctcagaggcggtgtctggggaggactttgtgctcagcactctgcaccggccactcttagcccccgaggcgttgaagggctcaggcaatgtttccattaagtagagactcagctgttgtcacacccaaagggatgctctgccaaaggtttaaacacccaggagaccatcagcctctcctgggagcacagttggctacaggcctcttgtggagagtttcacgggcaggggtgattccaacttctgcctgtggagagattttctgccctgccccaccagggccctgcatgttggagactgagctgggtgcactggccatgccctgtgaatcctcaggctgtgacgccctcaggtactcctgggaaaaggaggtacacagccatcatgcgagtcggtgccaggggaccccccggagatcctgaccagctcctccagtcatgctcttgtccctcactgccccagtaagctggaggctgctccagaactcagcagtgttggaggggcctctaagctgcactctctttctggcccttttgtctgggtgattctgtcctcaaataaagcccttcactcagccagacctctccacagctcaaagcattgccctaagaatcagaagtaaagataatccaagagcaaaacccactgtacttggggcctgcaatggctgtgtgtacactacatctaatgcccaaatgccagccagtgtggatgttgtgaccacagagcaggattgtgcattggctttagagctactcctcagctgatggcccacttttgtttatataaataagagcttctgccccacctgcagacatgtttactaatgatcatagccaggattagaaccactttcaaacattggggccttcttaacaaaagtctttgataacttaagaaccaaagtaacagagtaaacagaggcatgatggatccctgggccccactcccctcctgacaggttccccaacagcccatttgcccacttcccactgctcagcccacaccagacctccaggagacatccccccttgaggcagagagatcctgttccctattcccagacaagaattatttaatcttccctgttctctgtggtccttttcttccccaacaacagatagctcaccttggacagctcttcgtcccttgttcatggaaccagctgcctgcagtcaggccccaggttcttccatgggtgaacagagcatctgacaaaaggtcccagtttggccaggggtgagggagagagcaccagacaggctatccgagaatctgagagctgggcccggcagttcctccagctacccttgtgacctaagtccagtcacacatttcccaaagtttctctttgtcataaccctggtctggctggttttgagggcttgagaatgggtcagggactccaggccaagtccaacagagaccccaaacccaccacacaccagcagccacaacctcaccaccaacaaagaggacttttgtggggccacaagtaagaggtcatttctggaatggactcagacctttaaacaggagagttgagcacttccagtcagtttttaagcaaggcatggggaacagggaatagaacctttcaaagaggttgcccagagaaaagctgggcctcttgcattcggcttccttggagcagcctcttctggcagaaagccatcaggtgctcaatcatcttctcctggccaaggctctgaccatgcttagtactggaatagaggtggccaggcccccagcgactcttcttggcctgatgtttgtcctcacaggcatgccacgtggcctgagatgattcagaacaaatcatgctaactttgaatccatccagccacttgcaaatgataatcagaagtcagcttgttcactgttagaaagaaactaacaaaagagaacccagagcaatctagaatctttgagtgcttggctttccaaggatactgcggagactctggccaagctgatgaccttctgaagtgtcactggcaccatatgcaacaagaaccaccattcactgagtagctaatgggtttggggcctgggacattccatctgaggtccttcctgaacatgtcactccacagcagaggaccggttgcagcttacccagaaccactcctccaggagagctggatgttttgcgtgcaacaccttgagcactgactgctattgttcaaaaaaagcctttgctgcattcggaggactgccccgtgccctgaggggcagccccttgatggctcatctctctgaataacagttacgtcttcatatcgataccagatgccttcttcatcatgccactgaagccactcaccaccttcaagaacatgccaacctctgtcagattcacttacccacaaacaaggaggcacgtttggcacaaagtgttgtcctccaggtccaagtggactctacagagtgcttgacctcaacacactggattccaggtggactggaccaagagcaggcaaagacacgggaactgaaaaactccacagggtttggagaatagaaatgaaaagccacgtcatataactcaagaataaatggtgttttggaaattttaaaattatcatcgaaggtggtgaaactatttcaggcccaaatgaaaggaaatcgccagttggggatgaaatcacagagcctgtgttttatgatatggttggatgtccactgatgaaattttaaaggagtttcagttttaaaagtgcgcatgattctacatatgagaattctttaggccaagaaactgtccttggctcagaggtgttgggaattaaagcagagagaagccattcgtgatgcttagaaccaaggatggtcatgtacacaaagaccatcgagacggccattcttgtttacaaaacacttaccaagaaagcactttgtaggggaactttagtaagttcttctcatttcattatgtttcttccaaggaaacaggagagactgaattaataattctctctttcctcttaagcacttttaaaataataaagtacatcttgaaatttggggaggcatctctgatttaaaaaaagaaaaaggctgcttgatgtatgttatgcagagacactctgcctctggtggctgcagagcaatacccaagcctcatttggaaggctcaacatttggaattgcactttaattgattaatcctcaattcatgtggccttacgggatggtgggtctgggaccccaattcattcttatctgccaaagaattatctagaagcacatcaaataccagcaccccacctgctcaatgggggtggaaaacttttgtatccctaagcatattattttatagtgtctgccatgccatgtggaaatactttatttttaacctcaggatttaaataaagtaaacactatgacattt

SEQ ID NO: 11382 - DNA, 4635 bp, Homo sapiens
gagcagacagccaccgagggccgaaattctgagccttcctctggacccaggcaggagacatacagacaagaaaggcaaactcaccatggcctccaccaatgcagagagccagctccagagaatcatccgagacttgcaagatgctgtgacagaactaagcaaagaatttcaggaagcaggggaacccatcacggatgacagcaccagcttgcataaattttcttataaacttgagtatctcctgcaatttgatcagaaagagaaggccaccctcctgggcaacaagaaggactactgggattacttctgtgcctgcctggccaaggtgaaaggagccaatgatgggatccgctttgtcaagtctatctcagagctccgaacatccttggggaaaggaagagcatttattcgctactccttggtgcaccagaggttggcagacaccttacagcagtgcttcatgaacaccaaagtgaccagtgactggtactatgcaagaagcccctttctgcagccaaagctgagctcggacattgtgggccaactctatgagctgactgaggttcagtttgacctggcgtcgaggggctttgacttggatgctgcctggccaacatttgccaggaggacgctgaccactggctcttctgcttacctgtggaaaccccctagccgcagctccagcatgagcagcttggtgagcagctacctgcagactcaagagatggtgtccaactttgacctgaacagccccctaaacaacgaggcattggagggctttgatgagatgcgactagagctggaccagttggaggtgcgggagaagcagctacgggagcgcatgcagcagctggacagagagaaccaggagctgagggcagctgtcagccagcaaggggagcaactgcagacagagagggagagggggcgcactgcagcggaggacaacgttcgcctcacttgcttggtagctgagctccagaagcagtgggaggtcacccaggccacccagaacactgtgaaggagctgcagacatgcctgcagggcctggagctaggagcagcagagaaggaggaggactaccacacagccctgcggcggctggagtccatgctgcagcccttggcacaggagcttgaggccacacgggactcactggacaagaaaaaccagcatttagccagcttcccaggctggctagccatggctcagcagaaggcagatacggcatcagacacaaagggccggcaagaacctattcccagtgatgcggcccaggagatgcaggagctaggggagaagcttcaagccctagaaagggagagaaccaaggtcgaggaggtcaacagacagcagagtgcccaactggaacagctggtcaaggagcttcagctgaaagaggatgcccgggccagcctggagcgcctggtgaaggagatggccccactccaggaggagttgtctgggaagggacaggaggcagaccagctctggcgacggctgcaggagttgctggcccacacgagctcctgggaggaggagctagcagagttgaggcgggagaaaaaacagcaacaggaggagaaggagctgctggagcaggaggtcaggtctctgacccggcagctgcagttcctggagacccagctggcacaggtgagccaacatgtgagtgacctggaggagcagaagaagcagctcattcaggacaaagaccacctcagccagcaggtgggtatgctcgagcggcttgctgggccgcctggcccagaactgccagtggcaggtgagaagaatgaggccctggtccctgtgaactccagtctgcaagaggcctgggggaagccagaggaggagcagaggggcctgcaggaggcacagttagacgataccaaggtgcaagagggcagccaggaggaagagctccggcaggccaacagggagctggagaaggagctacagaatgtggtcgggcgtaaccagctcctggagggcaagctgcaagccctgcaggccgattaccaggctttgcagcagcgggaatcagccatccagggctccttggcctccctggaggccgagcaggccagcatccggcacttgggtgaccagatggaggcgagcttgctggctgtaaggaaggccaaggaggccatgaaagcccagatggcagagaaggaggccattctacagagcaaggagggcgagtgtcagcagctgcgggaggaggtggagcagtgccagcaactggcagaagcccggcacagagagcttagggctctcgagagccagtgccagcagcagacccagctgattgaggtcctcacagcagagaaaggccaacagggagttggcccacccactgacaatgaagcccgtgagctggctgcccagctagccctgtctcaggcgcagctggaagtccatcagggggaggtccaacggctgcaggctcaggtggtggacctccaggccaagatgcgggcagccctggatgaccaggacaaggtgcagagccagctaagcatggctgaggccgtcctgagggagcacaaaacccttgtgcagcagctgaaggagcagaatgaagcccttaacagagcccatgtccaggagctgctgcaatgctcggagcgtgaaggggcactgcaggaggagagggccgatgaggcccagcagagggaggaggagctgcgggccctgcaggaggagctgtcccaggccaaatgcagctccgaggaagcacagctggagcacgctgagctgcaagagcagctgcaccgggccaacacagacacagctgagctgggcatccaggtttgcgcactgaccgtggaaaaggagcgagtggaggaggcactggcctgtgctgtccaggagctccaggacgccaaagaggcagcctcaagggagcgagagggcctggagcgccaagtagctgggctgcagcaagagaaggagagcttgcaggagaagctgaaggcggccaaggcagcagccggctcactgcctggcctgcaggcccagctcgcccaggcagagcagcgggcccagagcctccaagaggctgcacaccaggagctcaacaccctcaagttccagctgagtgctgaaatcatggactaccagagcagacttaagaatgctggtgaagagtgcaagagcctcaggggccagcttgaggagcaaggccggcagctgcaggctgctgaggaagctgtggagaagctgaaggccacccaagcagacatgggagagaagctgagctgcactagcaaccatcttgcagagtgccaggcggccatgctgaggaaggacaaggagggggctgccctgcgtgaagacctagaaaggacccagaaggaactcgaaaaagccacaacaaaaatccaagagtattacaacaaactctgccaggaggtgacaaatcgtgagaggaatgaccagaagatgcttgctgacctggatgacctcaacagaaccaagaagtatctcgaggagcggctgatagagctgctcagggacaaggatgctctctggcagaagtcagatgccctggaattccagcagaagctcagtgctgaggagagatggctcggagacacagaggcaaaccactgcctcgactgtaagcgggagttcagctggatggtgcggcggcaccactgcaggatatgtggccgcatcttctgttactactgctgcaacaactacgtcctgagcaagcacggtggcaaaaaggagcgctgctgccgagcctgtttccagaagctcagtgaaggccctggctcccctgatagcagtggctcaggcactagccagggagagcccagccctgcactgtcaccagcctcacctgggccccaggccacaggaggccaaggagcaaatacagactacaggccaccggacgacgctgtgtttgatatcatcacagatgaggaattgtgccagatacaggagtccggctcctctttgcctgaaacacccactgaaactgattctctcgacccaaatgcggctgaacaggcgtctgtcggggccagcaagggtctgggaaacctgctctgtgaatcatctgcttgcagggatactacatcaacctcgctaacgcctgaggacactgaagacatgcccgtggggcaggattcggaaatctgcctgctgaagtctggagaactgatgatcaaagtacccctcacagtggatgagatcgccagcttcggggagggtagcagggagctgtttgtgaggtccagcacctacagcctgatccccatcactgtggccgaggcaggcctcaccatcagctgggtcttctcctctgaccccaagagcatctccttcagtgtggtcttccaggaggccgaggacacaccgctggatcagtgtaaggtcctcattcccacgacccgatgcaactcccacaaggagaacatccagggccagctcaaggttcgcacacccggcatctacatgctcatcttcgacaataccttctcaaggtttgtctctaaaaaggtattttatcacttgacggttgatcggcctgtgatctacgatggaagtgatttcctgtagcttcagcacctcagtaacttcacttcatccacaggaaacactgctcttcctca

SEQ ID NO: 11383 - DNA, 4275 bp, Homo sapiens
cagggctccttcccgcccgccgccgccgagacccaggctgaagctggggaggacggtggagcccggcccaggccgttctcctgcccccgcggctggagcatcgtctgggactactggctgaaggcgagccccgcagcccaagcgcagcgcacacgcgcgcccccggccaccgccgttctctcttccctcccctcctctcccctcccctctcctccgcccccggcctcggctgcggcgggaggaagaacgcttcccaaccagccaggagagcccagatctattcccattcggggagaaagaagagaccccgcacttggatccgaccgacttctcgccccggggccacggaagtggctcgccgtccaccggagagtccccgccgagcgtagccctccaaccctcgcccaaccgcagccgcatagacagcgctccccagcgggcccccggccccgccgagcccactccccgcgcggggccggggccggggccggcgatgcctggcacggcagcggcggtggccgcggctgctgctgctgctactgccaccgctgccacggctgctggcccgggcccgggctgggggcttgagtctctgcagtggggctgagcccgcagtcccgccccccgatcctgaggccgctgctccgccgggcgccgggcctcctccgcccgcgcctccgccccaggagctggagccaagcggggagctcgggccccgcgcccaggcccggaccatgcatggccaccgagccccggggggcgccgggccttcggagcccgaacacccggccacgaacccgccgggcgccgctccgccggcctgtgccgactcggaccctggagcctcggaacccggactgctggcgcgcaggggctcaggttcggctcttggcggcccactggatccccagtttgtcggaccctcggacaccagcctgggcgctgctccaggccaccgggtcttgccctgcggtcccagtccacagcaccaccgggccctgcgcttctcttaccacctggagggctcgcagcctcggcctgggctgcaccagggaaaccggatcctggttaaaagtttgtcccttgaccctggccaaagcctagagcctcatccagaaggtccccagcggcttcgctcagacccaggtcccccgactgaaacccctagccagcgtccttcaccactgaagcgggcaccgggcccgaagccacaggtgcccccaaagcccagctacctgcagatgccccggatgccccccccactggagcccatcccccctccaccatcacgcccactgcctgccgacccccgagtggccaagggcctggctcccagggcagaggccagccccagttctgcagcagtatcctcactgattgagaagtttgaaagagagcctgtgattgtcgcctcggatagaccagtccctggccccagcccaggtcccccagagccagtcatgttgccacagccaacctcgcagccaccagtgccccagctccccgagggtgaggcctcccgctgcctgtttctgctggctcctgggccccgggacggtgagaaggtgcccaaccgggacagcggcattgatagcatcagctcgccatccaacagcgaggagacctgcttcgtcagtgatgacgggccccccagccacagcctctgccctgggccccctgccctggctagtgtgcctgttgccttggccgacccccaccggcctggctcccaagaggttgacagtgacctggaggaggaggacgacgaggaggaggaggaagagaaggacagagaaatcccagtgcccctgatggagagacaggagtctgtggagttgactgtgcagcaaaaggtgtttcacattgccaatgagctcctgcaaactgagaaggcctacgtttccaggctccatctcctggatcaggtgttctgtgcccggctgctggaagaagctcggaaccgcagttccttcccggccgacgttgtccacggcatcttctctaacatctgctccatctattgcttccaccagcagttcctgctgcctgagctagagaagcgcatggaggaatgggaccgctatccacgcattggagacatcctgcagaaactggcccccttcctcaagatgtatggtgagtatgtgaagaactttgaccgggccgtggagctggtcaacacctggacagagcgctccacccagtttaaagtcatcatccatgaggtgcagaaggaggaagcctgtggcaacctgacattgcagcaccacatgctggagcctgtgcagcgcatcccccgctatgagcttcttctcaaggactatctgttaaagctgccccatggctccccggacagcaaggatgcccaaaagtctctggagctgatcgccacagcagcagagcactcgaatgctgccatccgcaaaatggagcgaatgcataagctgctgaaggtatatgagctgttagggggcgaggaggacattgtcagccccaccaaagagctcataaaagaaggccacatccttaagctgtcagcaaagaatgggaccactcaagaccgatacctcatactattcaacgaccgcctcctttactgcgtgcccaggctgcggctccttggccagaagtttagcgtgcgggcacgcattgatgtagatggcatggagctaaaggagagctccaacctcaatctgcctcgaaccttcctggtgtcaggaaagcagcgctccctcgagctccaggccaggactgaggaggagaagaaagactgggtccaggccatcaactccaccctcctgaagcatgaacagacgctggagactttcaaactgttgaactcaacaaacagggaagatgaagacaccccacccaactctccaaacgtggatcttgggaagcgggcacctacgcccatccgggaaaaggaagtcaccatgtgcatgcgctgccaggagcccttcaattctatcaccaaacgcaggcaccactgcaaggcctgcgggcatgtggtttgtgggaagtgctccgagttccgggcccgcctcgtctatgacaacaaccgctccaaccgtgtgtgcactgattgctatgtggccttgcacggggtgcctgggagcagtccagcctgcagccagcatacaccccagcgccggaggtccatcctggagaaacaggcctcagtggctgcagagaacagcgtcatctgcagcttcctgcactacatggagaagggtggcaaaggatggcacaaggcatggttcgtggtccctgaaaatgaacccttggtgctgtatatctacggagcccctcaggatgtgaaagcccagcgcagcctgcccctcattggcttcgaggtgggaccgcccgaggcaggggagcggcctgacagaaggcatgtcttcaagatcacccagagccacctcagctggtacttcagccctgagacagaggaactacagcgacgctggatggctgtgcttggccgggcgggccgaggggacacgttctgcccggggcccacactgtctgaggacagggagatggaggaggcaccggtggctgctttaggagccactgctgaaccccccgaatccccccagacccgagacaagacctagagggtttgggacaaactgggagcccccaccccacactctagttgcccatgtctgattgggggctctagccccttccctcccagctcagtcaatacttgaactcccatcacgggcactttcaatcccgaatgctgggtcttgggttttttaattcatcttttcacaaaacgtgggcttttaaaaaatatattcctacagtgatgtcaatttttattaatccctgtccccagggagggtgggagccgttgccagtcctacctgaattaggtcgtttttctccctcatccctcaataccctaccacagatcctgcctccacccagttccccacaaagcaccagaggtaggagacctggattcaagtgccagctctgccactgaccctggggccccgacccagccctgcctcctcagccagtgtcttcacacgtacaactccacgtggggtggcaactagacctctcctgcctctcccatggcttacagcttctacccggccccaaggctacccagtattttatcgtccagacccatggcagggccagcgggcaggacagggaaacaggggggaggacaatggatactcagttttttgtgtttttttgtgtgtttttttttttttaagaaaaatacagtttatttcaggcttacagtaa

SEQ ID NO: 11384 - DNA, 3046 bp, Homo sapiens
ctttcttcactctgaagccaagagccgaccttctgagccctcaagaaagatcagaacagattcatgggtgatttagcctatctgtcccaggccagcgtggctgagtgtgctggctggaggcctctctctctgcttcgagggtagctgagatccaccccggaaaccggcaggatgaagggggcaagtgaggagaagctggcatctgtgtccaacctggtcactgtgtttgagaatagcaggaccccagaagcagcacccagaggccagaggctagaggacgtgcatcaccgccctgagtgcaggcctcccgagtccccaggaccacgggagaagacgaatgtcggggaggccgtggggtctgagcccaggacagtcagcaggaggtacctgaactccctgaagaacaagctgtccagcgaagcctggaggaaatcttgccagcctgtgaccctctcaggatcggggacgcaggagccagagaagaagatcgtccaggagctgctggagacagagcaggcctatgtggcgcgcctccacctgctagaccaggtgtttttccaggagctgctgaagacagcccgcagcagcaaggccttcccagaggatgtggtcagggtcatcttctccaacatctcctccatctatcagttccattctcagttcttcctcccagagctgcagcggcgcctggacgactggacagctaacccccgcatcggtgacgtgatccagaagctggcccccttcctgaagatgtacagtgagtatgtcaagaactttgagcgagcggctgagctgctggccacctggaccgacaagtctccactcttccaggaggttctcactcgcatccagagcagcgaggcttcgggcagcctgaccctgcagcaccacatgctggaaccagtgcagagaattccacgttacgagctgctgctcaaggagtacatccagaagctgccagcccaggccccagaccaggccgatgcccagaaagccctggacatgatcttctcagctgcccagcactccaatgcagccatcactgagatggagcggctgcaggacctgtgggaggtgtaccagcgcctgggcctcgaggacgacatagtagacccctctaacaccctgctccgtgagggcccggtcctcaagatctccttccgccgcaacgaccccatggagcgctaccttttcttgttcaacaacatgctgctctactgtgtgcccagggtgatccaggtgggcgcccagttccaggtgaggacccgcatcgatgtggccgggatgaaggtgcgggagctgatggatgctgagtttccccactccttcctggtgtccgggaagcagcgcaccctggagctgcaagcccggtcccaggaggaaatgatttcctggatgcaggccttccaagcagccattgaccaaatcgagaagcggaatgaaaccttcaaggctgcggcccaggggcctgagggagacatccaggagcaggagctgcagtctgaggagctgggcctccgggcaccgcagtgggtccgggacaagatggtgaccatgtgcatgcgctgccaggagcccttcaacgctctgacgcgccgtcgccaccactgccgggcctgcggctatgtggtgtgtgccaggtgctccgactaccgggccgaactgaaatacgacgacaacaggcccaaccgagtctgcctccactgctacgcattcctcactggaaatgtgctgcctgaggccaaggaggacaagaggcggggcatcctggagaaagggtcctcagccacgcctgaccagagcctgatgtgcagcttcctgcagctcatcggggacaagtggggcaagagcggcccccggggctggtgtgtgatccctcgggatgaccccctcgtgctctatgtctatgctgcccctcaggacatgagggctcacacctccatccccctgctgggctaccaggtgactgttgggccccagggggaccctcgggtcttccagctacagcagtcaggccagctctacaccttcaaggccgagacggaggagctgaagggccgctgggtgaaggccatggagcgggcggccagtggctggagccccagctggcccaacgatggggacctgtccgactgagccactgccagccgctctcctgcccacctctccccaccctgaacccagctcctgccacagactgaccctgtggcctcagtgacccactgccccaagtggtgctttcagagaattgattcagccatctgcgcccaggccacgtgtcccgatctgggattagaaaatatgggtccattcctttctagaaaggggacaaccaagtgtctcagtttgccttgcggggagggggctcctgggccatgggacttccagtgctaaaactgggaaagccccaggtaaccccggactggtggtcaccatagtatggtttttcatttgtatctcctggggagcttttaaagagtactggtgaaaaacacatagtaaattaattttaaaaatgtaaaaaacaatgcctgtactgaagtaccaccaccgatttaaatgggctgagttgggggaggcatggggtctttttttttttttttttgagacagagtcttactctgtttcccaggctggagtgcacaaacatggctcactacagcctcgctctcccgggctccagtgatcctcccgcctcagcctcccaagtagctgggattataggtgtgtgccactgtgccaagctaatttttttattttttgtagagatgggatttcaccatgttactcaggctggtctcaaactcccagcctcaagcgatgctcccacctccacctcccaaagtgctgggattacaggcgtgagccaccatacctggcgcatgcatattttttaagagtacccactggagtctaatatatagcctgggttacctgggatgaagaataaagagagcaaactaccacaaccaatggttgagcccctgtcaagtgccagtcatgatagtagtaataataataataaacatctattggaccaggc

SEQ ID NO: 11385 - DNA, 2280 bp, Homo sapiens
actctgaagccaagagccgaccttctgagccctcaagaaagatcagaacagattcatgggtgatttagcctatctgtcccaggccagcgtggctgagtgtgctggctggaggcctctctctctgcttcgagggtagctgagatccaccccggaaaccggcaggatgaagggggcaagtgaggagaagctggcatctgtgtccaacctggtcactgtgtttgagaatagcaggaccccagaagcagcacccagaggccagaggctagaggacgtgcatcaccgccctgagtgcaggcctcccgagtccccaggaccacgggagaagacgaatgtcggggaggccgtggggtctgagcccaggacagtcagcaggaggtacctgaactccctgaagaacaagctgtccagcgaagcctggaggaaatcttgccagcctgtgaccctctcaggatcggggacgcaggacagctaacccccgcatcggtgacgtgatccagaagctggcccccttcctgaagatgtacagtgagtatgtcaagaactttgagcgagcggctgagctgctggccacctggaccgacaagtctccactcttccaggaggttctcactcgcatccagagcagcgaggcttcgggcagcctgaccctgcagcaccacatgctggaaccagtgcagagaattccacgttacgagctgctgctcaaggagtacatccagaagctgccagcccaggccccagaccaggccgatgcccagaaagccctggacatgatcttctcagctgcccagcactccaatgcagccatcactgagatggagcggctgcaggacctgtgggaggtgtaccagcgcctgggcctcgaggacgacatagtagacccctctaacaccctgctccgtgagggcccggtcctcaagatctccttccgccgcaacgaccccatggagcgctaccttttcttgggtgatccaggtgggcgcccagttccaggtgaggacccgcatcgatgtggccgggatgaaggtgcgggagctgatggatgctgagtttccccactccttcctggtgtccgggaagcagcgcaccctggagctgcaagcccggtcccaggaggaaatgatttcctggatgcaggccttccaagcagccattgaccaaatcgagaagcggaatgaaaccttcaaggctgcggcccaggggcctgagggagacatccaggagcaggagctgcagtctgaggagctgggcctccgggcaccgcagtgggtccgggacaagatggtgaccatgtgcatgcgctgccaggagcccttcaacgctctgacgcgccgtcgccaccactgccgggcctgcggctatgtggtgtgtgccaggtgctccgactaccgggccgaactgaaatacgacgacaacaggcccaaccgagtctgcctccactgctacgcattcctcactggaaatgtgctgcctgaggccaaggaggacaagaggcggggcatcctggagaaagggtcctcagccacgcctgaccagagcctgatgtgcagcttcctgcagctcatcggggacaagtggggcaagagcggcccccggggctggtgtgtgatccctcgggatgaccccctcgtgctctatgtctatgctgcccctcaggacatgagggctcacacctccatccccctgctgggctaccaggtgactgttgggccccagggggaccctcgggtcttccagctacagcagtcaggccagctctacaccttcaaggccgagacggaggagctgaagggccgctgggtgaaggccatggagcgggcggccagtggctggagccccagctggcccaacgatggggacctgtccgactgagccactgccagccgctctcctgcccacctctccccaccctgaacccagctcctgccacagactgaccctgtggcctcagtgacccactgccccaagtggtgctttcagagaattgattcagccatctgcgcccaggccacgtgtcccgatctgggattagaaaatatgggtccattcctttctagaaaggggacaaccaagtgtctcagtttgccttgcggggagggggctcctgggccatgggacttccagtgctaaaactgggaaagccccaggtaaccccggactggtggtcaccatagtatggtttttcatttgtatctcccaagtagctgggattataggtgtgtgccactgtgccaagctaatttttttattttttgtagagatgggatttcaccatgttac

SEQ ID NO: 11386 - DNA, 3303 bp, Homo sapiens
gagcactcaggagactgtgtgtggtgggggtgctccaccatagagctggtcggcatccacagccaccaggacgctgccagagcccaggcctgcgccacgccctgcccagaggcacacctgcctgctcaaggcaaccagggcaggctcaaggcagccagggccagctcactgtgtgcctgtcactgtgtgaagcctgcttcttctttatttcgcttagcaagtgaggcaggagcatgtaaagctgctggcagaggaatatctaatttacctcctaaatggctctactttgaacctgctgggcaaggaagagattttcaaggaaaccatctaccgtgtgcaagctcctgccggccaaccccagaccccagcacggagccaggcgcctgtgcccgccgaccctcagcatcctcctcagaaaggctggtggcatcaggaagcccctggccagcctccacctgagcccagtgagctcagctttaaggatggagtcaggcagggggtcctcaacccctccaggacccattgctgccctagggatgccagacactgggcctggcagttcctccctagggaagcttcaggcgctccctgttgggcccagagcccactgtggggaccctgtcagcctggctgcagcaggggacggctctccagacataggccccacgggagagctgagtggtagcttaaagatccccaaccgggacagcgggatcgacagtccctcctccagtgtggctggagagaactttccctgcgaggagggcttggaggctggcccaagccccactgtactgggggcgcacgcagagatggccctggacagccaggtcccgaaggtcaccccccaggaggaggcggacagcgacgtgggtgaggaacctgactctgagaacaccccccagaaggctgacaaggatgccggcctggcccagcactctggcccccagaagcttctccacattgcccaggagctcctgcacaccgaggagacctatgtgaagcggctgcacctgctggaccaggttttctgcaccaggctgacggatgcggggatccctccagaagtcatcatgggcatattctctaacatctcctccatccaccgcttccacgggcagttcctgctgccggagctgaagacgcggatcacggaggagtgggacacaaacccacggctcggggacatcctgcagaagctggccccattcctgaagatgtacggcgagtatgtcaagaactttgaccgagccgtagggctggtgagcacgtggacccagcgctccccactgtttaaagacgtcgtccacagcatccagaagcaggaggtatgcgggaacctgacgctgcagcaccacatgctggagcccgtgcagagggtcccccggtacgagctgctgctcaaggactatctgaagaggctcccgcaggacgccccagaccggaaggatgcggagaggtccttggagctcatctccacagccgccaaccactccaatgctgccattcggaaagtggagaaaatgcacaagctcttggaggtgtacgagcagctgggtggggaagaagacattgtcaacccggccaatgaactgatcaaggagggccaaatccagaaactgtcagccaagaacggcaccccccaggaccgccacctcttcctgttcaacagcatgatcctttactgtgtgcccaagctgcggctcatgggccagaagttcagcgtccgggagaagatggacatctcaggcctccaggtgcaggatatcgtcaagccaaacacagcacatacattcatcataacaggaagaaaaaggtccctggagctgcagacgcggacagaggaagagaagaaagaatggattcagatcatccaggccaccatcgagaagcacaaacagaacagcgaaaccttcaaggcttttggtggcgccttcagccaggatgaggaccccagcctctctccagacatgcctatcacgagcaccagccctgtggagcctgtggtgaccaccgaaggcagttcgggtgcagcagggctcgagcccagaaaactatcctctaagaccagacgtgacaaggagaagcagagctgtaagagctgtggtgagaccttcaactccatcaccaagaggaggcatcactgcaagctgtgtggggcggtcatctgtgggaagtgctccgagttcaaggccgagaacagccggcagagccgtgtctgcagagattgtttcctgacacagccagtggcccctgagagcacagagaagacacccactgcagacccccagcccagcctgctctgcggccccctgcggctgtcagagagcggtgagacctggagcgaggtgtgggccgccatccccatgtcagatccccaggtgctgcacctgcagggaggcagccaggacggccggctgccccgcaccatccctctccccagctgcaaactgagtgtgccggaccctgaggagaggctggactcggggcatgtgtggaagctgcagtgggccaagcagtcctggtacctgagcgcctcctccgcagagctgcagcagcagtggctggaaaccctaagcactgctgcccatggggacacggcccaggacagcccgggggccctgcagcttcaggtccctatgggcgcagctgctccgtgagctgagtctcccactgccctgcacaccaccacattggacctgtgctgtcctgggaggtggtgttggaggccccatgaagagcgccctggactgctgagggtgggccaacagcccagagctcaggacacttggctttggggggaaggaaactgaggcccagagaggggcaaccactggccaagggtcacccagcaagttttggctaagagcctggcctccagccccagcagtgtggcccagagcaggggccgactgccaaagtaaccatcatccatatgggccgtgtggtgatgctggcccggaaggcagaaagaggcagcatgggcactgccagggacagccacatcctgctggtctgcagcgtggtccaccccgcctctgcccagcctgtctacaccgtgtgagctgaatcgtgacttgcttcccacctcctttctctgtcctctcctgaggttctgcctgcagcccccaggaggtgggcctgccccatcctagctggactcatggttcctaaataaccacgctcagaagctctgctaggacttaccccagccactgagtggcaggcgcatgagatttgtggctgttcctgatgctagtggcacacagtgcttatctgcataaataaacactggccaccagc

SEQ ID NO: 11387 - DNA, 3321 bp, Homo sapiens
tgcctgtgggtgccgcggaccttcggggcgggccagggaggcgggaccgctcctcagaaccccaggggcttcagtcctgggctgattggcgcgggaagcacagcccggccctccaggtccccaaggagaccccagcctcctgctgcccactgtgagcgacctccccggggctcctctggaagcggctccggcaagtatcgagtttgcctgtgcggagctgggggagcctccggctttcctgtttgctttgttaattattttcgtccccagaggaaggcgtacctcctaaatggctctactttgaacctgctgggcaaggaagagattttcaaggaaaccatctaccgtgtgcaagctcctgccggccaaccccagaccccagcacggagccaggcgcctgtgcccgccgaccctcagcatcctcctcagaaaggctggtggcatcaggaagcccctggccagcctccacctgagcccagtgagctcagctttaaggatggagtcaggcagggggtcctcaacccctccaggacccattgctgccctagggatgccagacactgggcctggcagttcctccctagggaagcttcaggcgctccctgttgggcccagagcccactgtggggaccctgtcagcctggctgcagcaggggacggctctccagacataggccccacgggagagctgagtggtagcttaaagatccccaaccgggacagcgggatcgacagtccctcctccagtgtggctggagagaactttccctgcgaggagggcttggaggctggcccaagccccactgtactgggggcgcacgcagagatggccctggacagccaggtcccgaaggtcaccccccaggaggaggcggacagcgacgtgggtgaggaacctgactctgagaacaccccccagaaggctgacaaggatgccggcctggcccagcactctggcccccagaagcttctccacattgcccaggagctcctgcacaccgaggagacctatgtgaagcggctgcacctgctggaccaggttttctgcaccaggctgacggatgcggggatccctccagaagtcatcatgggcatattctctaacatctcctccatccaccgcttccacgggcagttcctgctgccggagctgaagacgcggatcacggaggagtgggacacaaacccacggctcggggacatcctgcagaagctggccccattcctgaagatgtacggcgagtatgtcaagaactttgaccgagccgtagggctggtgagcacgtggacccagcgctccccactgtttaaagacgtcgtccacagcatccagaagcaggaggtatgcgggaacctgacgctgcagcaccacatgctggagcccgtgcagagggtcccccggtacgagctgctgctcaaggactatctgaagaggctcccgcaggacgccccagaccggaaggatgcggagaggtccttggagctcatctccacagccgccaaccactccaatgctgccattcggaaagtggagaaaatgcacaagctcttggaggtgtacgagcagctgggtggggaagaagacattgtcaacccggccaatgaactgatcaaggagggccaaatccagaaactgtcagccaagaacggcaccccccaggaccgccacctcttcctgttcaacagcatgatcctttactgtgtgcccaagctgcggctcatgggccagaagttcagcgtccgggagaagatggacatctcaggcctccaggtgcaggatatcgtcaagccaaacacagcacatacattcatcataacaggaagaaaaaggtccctggagctgcagacgcggacagaggaagagaagaaagaatggattcagatcatccaggccaccatcgagaagcacaaacagaacagcgaaaccttcaaggcttttggtggcgccttcagccaggatgaggaccccagcctctctccagacatgcctatcacgagcaccagccctgtggagcctgtggtgaccaccgaaggcagttcgggtgcagcagggctcgagcccagaaaactatcctctaagaccagacgtgacaaggagaagcagagctgtaagagctgtggtgagaccttcaactccatcaccaagaggaggcatcactgcaagctgtgtggggcggtcatctgtgggaagtgctccgagttcaaggccgagaacagccggcagagccgtgtctgcagagattgtttcctgacacagccagtggcccctgagagcacagagaagacacccactgcagacccccagcccagcctgctctgcggccccctgcggctgtcagagagcggtgagacctggagcgaggtgtgggccgccatccccatgtcagatccccaggtgctgcacctgcagggaggcagccaggacggccggctgccccgcaccatccctctccccagctgcaaactgagtgtgccggaccctgaggagaggctggactcggggcatgtgtggaagctgcagtgggccaagcagtcctggtacctgagcgcctcctccgcagagctgcagcagcagtggctggaaaccctaagcactgctgcccatggggacacggcccaggacagcccgggggccctgcagcttcaggtccctatgggcgcagctgctccgtgagctgagtctcccactgccctgcacaccaccacattggacctgtgctgtcctgggaggtggtgttggaggccccatgaagagcgccctggactgctgagggtgggccaacagcccagagctcaggacacttggctttggggggaaggaaactgaggcccagagaggggcaaccactggccaagggtcacccagcaagttttggctaagagcctggcctccagccccagcagtgtggcccagagcaggggccgactgccaaagtaaccatcatccatatgggccgtgtggtgatgctggcccggaaggcagaaagaggcagcatgggcactgccagggacagccacatcctgctggtctgcagcgtggtccaccccgcctctgcccagcctgtctacaccgtgtgagctgaatcgtgacttgcttcccacctcctttctctgtcctctcctgaggttctgcctgcagcccccaggaggtgggcctgccccatcctagctggactcatggttcctaaataaccacgctcagaagctctgctaggacttaccccagccactgagtggcaggcgcatgagatttgtggctgttcctgatgctagtggcacacagtgcttatctgcataaataaacactggccaccagcagtg

SEQ ID NO: 11388 - DNA, 3221 bp, Homo sapiens
attccctgctgggcccctcctccctgaagatctacacagcagatctactcacaaaagtccacccagcagaagcaggaggatggtggttgtgggtcctctgtgagcagccctgttaacctttaaaccagcacggccgccgcagctgtgagcctagcacctgatcagtggagagctgtggattgcatgtttgtttgccattgcccccgccaccctgcaagttgcaccttctagaatcagcaagccaagctcctctcacccagcgtaatgatgcggaaatgcaaatgcaccatcatgttgtgacccatattgcgaaaattagaaaaaaggaagttgtgtttcgctattgcacgaagttcagcccagaggagaaactcgctcgccttcagaagacagtacctcctaaatggctctactttgaacctgctgggcaaggaagagattttcaaggaaaccatctaccgtgtgcaagctcctgccggccaaccccagaccccagcacggagccaggcgcctgtgcccgccgaccctcagcatcctcctcagaaaggctggtggcatcaggaagcccctggccagcctccacctgagcccagtgagctcagctttaaggatggagtcaggcagggggtcctcaacccctccaggacccattgctgccctagggatgccagacactgggcctggcagttcctccctagggaagcttcaggcgctccctgttgggcccagagcccactgtggggaccctgtcagcctggctgcagcaggggacggctctccagacataggccccacgggagagctgagtggtagcttaaagatccccaaccgggacagcgggatcgacagtccctcctccagtgtggctggagagaactttccctgcgaggagggcttggaggctggcccaagccccactgtactgggggcgcacgcagagatggccctggacagccaggtcccgaaggtcaccccccaggaggaggcggacagcgacgtgggtgaggaacctgactctgagaacaccccccagaaggctgacaaggatgccggcctggcccagcactctggcccccagaagcttctccacattgcccaggagctcctgcacaccgaggagacctatgtgaagcggctgcacctgctggaccaggttttctgcaccaggctgacggatgcggggatccctccagaagtcatcatgggcatattctctaacatctcctccatccaccgcttccacgggcagttcctgctgccggagctgaagacgcggatcacggaggagtgggacacaaacccacggctcggggacatcctgcagaagctggccccattcctgaagatgtacggcgagtatgtcaagaactttgaccgagccgtagggctggtgagcacgtggacccagcgctccccactgtttaaagacgtcgtccacagcatccagaagcaggaggtatgcgggaacctgacgctgcagcaccacatgctggagcccgtgcagagggtcccccggtacgagctgctgctcaaggactatctgaagaggctcccgcaggacgccccagaccggaaggatgcggagaggtccttggagctcatctccacagccgccaaccactccaatgctgccattcggaaagtggagaaaatgcacaagctcttggaggtgtacgagcagctgggtggggaagaagacattgtcaacccggccaatgaactgatcaaggagggccaaatccagaaactgtcagccaagaacggcaccccccaggaccgccacctcttcctgttcaacagcatgatcctttactgtgtgcccaagctgcggctcatgggccagaagttcagcgtccgggagaagatggacatctcaggcctccaggtgcaggatatcgtcaagccaaacacagcacatacattcatcataacaggaagaaaaaggtccctggagctgcagacgcggacagaggaagagaagaaagaatggattcagatcatccaggccaccatcgagaagcacaaacagaacagcgaaaccttcaaggcttttggtggcgccttcagccaggatgaggaccccagcctctctccagacatgcctatcacgagcaccagccctgtggagcctgtggtgaccaccgaaggcagttcgggtgcagcagggctcgagcccagaaaactatcctctaagaccagacgtgacaaggagaagcagagctgtaagagctgtggtgagaccttcaactccatcaccaagaggaggcatcactgcaagctgtgtggggcggtcatctgtgggaagtgctccgagttcaaggccgagaacagccggcagagccgtgtctgcagagattgtttcctgacacagccagtggcccctgagagcacagagacacccactgcagacccccagcccagcctgctctgcggccccctgcggctgtcagagagcggtgagacctggagcgaggtgtgggccgccatccccatgtcagatccccaggtgctgcacctgcagggaggcagccaggacggccggctgccccgcaccatccctctccccagctgcaaactgagtgtgccggaccctgaggagaggctggactcggggcatgtgtggaagctgcagtgggccaagcagtcctggtacctgagcgcctcctccgcagagctgcagcagcagtggctggaaaccctaagcactgctgcccatggggacacggcccaggacagcccgggggccctgcagcttcaggtccctatgggcgcagctgctccgtgagctgagtctcccactgccctgcacaccaccacattggacctgtgctgtcctgggaggtggtgttggaggccccatgaagagcgccctggactgctgagggtgggccaacagcccagagctcaggacacttggctttggggggaaggaaactgaggcccagagaggggcaaccactggccaagggtcacccagcaagttttggctaagagcctggcctccagccccagcagtgtggcccagagcaggggccgactgccaaagtaaccatcatccatatgggccgtgtggtgatgctggcccggaaggcagaaagaggcagcatgggcactgccagggacagccacatcctgctggtctgcagcgtggtccaccccgcctctgcccagcctgtctacaccgtgtgagctgaatcgtgacttgcttcccacctcctttc

SEQ ID NO: 11389 - DNA, 1342 bp, Homo sapiens
aaatgtcacatcaatgccatgagatgagtctggctcctttagctcaccatgtgggtttgagagattcatccatgttggtgaatgtatcagtagctcattcaaaagatttggtttggctggacgtggtggctcatacctgtaatcccagcactttgggaggctgagttcaacagcatgatcctttactgtgtgcccaagctgcggctcatgggccagaagttcagcgtccgggagaagatggacatctcaggcctccaggtgcaggatatcgtcaagccaaacacagcacatacattcatcataacaggaagaaaaaggtccctggagctgcagacgcggacagaggaagagaagaaagaatggattcagatcatccaggccaccatcgagaagcacaaacagaacagcgaaaccttcaaggcttttggtggcgccttcagccaggatgaggaccccagcctctctccagacatgcctatcacgagcaccagccctgtggagcctgtggtgaccaccgaaggcagttcgggtgcagcagggctcgagcccagaaaactatcctctaagaccagacgtgacaaggagaagcagagctgtaagagctgtggtgagaccttcaactccatcaccaagaggaggcatcactgcaagctgtgtggggcggtcatctgtgggaagtgctccgagttcaaggccgagaacagccggcagagccgtgtctgcagagattgtttcctgacacagccagtggcccctgagagcacagagaagacacccactgcagacccccagcccagcctgctctgcggccccctgcggctgtcagagagcggtgagacctggagcgaggtgtgggccgccatccccatgtcagatccccaggtgctgcacctgcagggaggcagccaggacggccggctgccccgcaccatccctctccccagctgcaaactgagtgtgccggaccctgaggagaggctggactcggggcatgtgtggaagctgcagtgggccaagcagtcctggtacctgagcgcctcctccgcagagctgcagcagcagtggctggaaaccctaagcactgctgcccatggggacacggcccaggacagcccgggggccctgcagcttcaggtccctatgggcgcagctgctccgtgagctgagtctcccactgccctgcacaccaccacattggacctgtgctgtcctgggaggtggtgttggaggccccatgaagagcgccctggactgctgagggtgggccaacagcccagagctcaggacacttggctttggggggaaggaaactgaggcccagagaggggcaaccactggccaa

SEQ ID NO: 11390 - DNA, 2679 bp, Homo sapiens
ctgggctgggaagtggggaaagcaggggagcctgtgctgggtgagattatctgcaatggaccgggttaatgggaggcttgctttggctcgctggaagaacaaatgaagggagttttacttcaaccatttgtgacttctggccaagaggaataaattcagcttttataaggcagcagtacctgtccaaagatcgctttagttccaccttgctccacaagcagcacaaccacactggttggtgagaatgtatctgaagaagaggctcagggaataaatgggaacaggccagcaaaacactcagctgcaagtccaaagccacaagtgcctccaaagccattacacctgcagaattcaccttcgtccaatatacaccaaacccccaggcataaagctttacctagtgcaaaaccaaggatggaggaaattaaacctgcctctgcttcttgtgtctcaaaagaaaaacccagtaaggtatcagatctcatcagtcgctttgaaggaggcagctcattatcaaattatagtgatttgaagaaagagtctgctgtgaacctaaatgctcctagaaccccaggaaggcatggattgacaaccacacctcaacaaaaactcctctcccagcacttgccacagaggcagggaaatgatacagataagactcagggtgcacagacttgtgtggccaacggtgtaatggcagcacaaaaccagatggaatgtgaggaggagaaagctgccactcttagctcagatacttctattcaagcttctgaacccttgcttgatacgcacatagtgaatggagaaagagatgaaactgccacagctcctgcatcacccacaacagacagctgtgatggaaatgcttctgacagtagctacaggactccaggcataggcccagtgctccccctagaagaaagaggggcagaaacagaaaccaaggtacaagagagggaaaatggggaaagccctctggaactggagcagctggaccagcaccatgagatgaaggagactaatgagcaaaaacttcacaaaatagccaatgaacttttgcttactgaaagagcttatgtcaaccgacttgacctcttagatcagaaaatagagtggaggtgaatttagaaaattaacaaccatctggacattatgaaggaatagacctccttctgcctacatgtaacagaatggcaattaagaggtattttattgcaaactgttggaagaagcaaaccgaggctcgtttccagcagagatggtgaataaaatcttttctaatatttcatcaataaatgccttccatagtaaattcctcttgccagagctggagaaacgaatgcaagaatgggaaactactcctagaattggagacatccttcagaaattggcaccattccttaagatgtatggagaatatgtgaaaggatttgataatgcaatggaattggttaaaaacatgacagaacgtattccccagttcaaatcagtggttgaagaaattcagaaacagaaaatctgtgggagcttaactttgcagcatcacatgctagaacctgttcagcggattccccggtatgagatgctccttaaggactatctaaggaaattgcctcctgattccctggactggaatgatgctaaaaaatcacttgaaattatatctacagcagcaagccattctaatagtgcaataaggaaaatggagaacctaaagaaactcttagagatttatgaaatgttgggagaagaagaagacattgtaaacccttcaaatgaactaataaaagaaggacagatcctcaaactagctgctcggaacacttcagcacaagaacgctaccttttcttattcaacaacatgttgctgtactgtgtgcccaaattcagcttggtaggctctaaattcacagttcgaaccagggttggcattgatggaatgaaaattgtagagactcaaaatgaagaatatccacatactttccaggtgtctgggaaagagagaacactggaactgcaggccagttctgcgcaagacaaagaagaatggatcaaggcccttcaagaaaccatcgatgcttttcatcaaaggcatgaaaccttcagaaatgcaattgcaaaggataatgacattcactcagaggtttctactgctgagctagggaaaagagccccaagatggatccgagataatgaagtgacaatgtgtatgaaatgtaaagaacctttcaatgcactgacacgaaggaggcatcattgtcgagcatgtggatatgtggtttgttggaaatgctccgactacaaagctcaacttgaatatgatggtggtaaattgagcaaagtttgtaaagactgttatcaaatcataagtggattcacagacagtgaagaaaagaaaagaaaaggaattttagagattgaatcagcagaagtatctggaaacagtgtggtgtgcagctttcttcagtatatggagaagtcaaaaccttggcagaaagcttggtgtgtgatccccaagcaagaccctcttgtgctgtacatgtatggtgccccccaggtatctaaaccacatctgtctgaagggacagatgcccttgggggcaaggggaagcgagtggacagcggactcaaaatctgtagaacaagagttcaggcagtttcactgtttcattaaaattg

SEQ ID NO: 11391 - DNA, 958 bp, Homo sapiens
agccaatgaacttttgcttactgaaagagcttatgtcaaccgacttgacctcttagatcaggtattttattgcaaactgttggaagaagcaaaccgaggctcgtttccagcagagatggtgaataaaatcttttctaatatttcatcaataaatgccttccatagtaaattcctcttgccagagctggagaaacgaatgcaagaatgggaaactactcctagaattggagacatccttcagaaattggcaccattccttaagatgtatggagaatatgtgaaaggatttgataatgcaatggaattggttaaaaacatgacagaacgtattccccagttcaaatcagtggttgaagaaattcagaaacagaaaatctgtgggagcttaactttgcagcatcacatgctagaacctgttcagcggattccccggtatgagatgctccttaaggactatctaaggaaattgcctcctgattccctggactggaatgatgctaaaaaatcacttgaaattatatctacagcagcaagccattctaatagtgcaataaggaaaatggagaacctaaagaaactcttagagatttatgaaatgttgggagaagaagaagacattgtaaacccttcaaatgaactaataaaagaaggacagatcctcaaactagctgctcggaacacttcagcacaagaacgctaccttttcttattcaacaacatgttgctgtactgtgtgcccaaattcagcttggtaggctctaaattcacagttcgaaccagggttggcattgatggaatgaaaattgtagagactcaaaatgaagaatatccacatactttccaggtgtctgggaaagagagaacactggaactgcaggccagttctgcgcaagacaaagaagaatggatcaagagacgaggttttgccatgctgcccaggctgatctcgaactcctga

SEQ ID NO: 11392 - DNA, 1833 bp, Homo sapiens
gtgatggagagtgctgttatgatagatgaatctaggaaagcctctttggagatgtgatacctgaacagaaccccgaatgataagaagaaataccagtgttttaggagagattgtcctaagcagagaacagcagctgcaaagaccccaagacacatacacttggttattaagaatgggagcagcaaggagtatggcaagaacacagtgagttttcccttgagtgtgtgaggaagccctcagagtttgtgactgacttgtagaggttctagtggaggggatcagagtggaaacaaagagaccagttaaaaaggtatggcagcatgaataaaaaagttttgagagtattcattatgccttccaaataaaaaactctttggttcataatttgttcataaattaaggactggctacactgtactatttaaaaatgttaagaaacatcaataagtaaaaatgttaggaagagatgataaatacgtaagtattatatctaactaagtctttactaactagtcacattattaaacagtgcaaggatcaagaaaagttaagcgttgaaaaataaataaataagttataaataaaataaacagcccaaggaaatgttccagtccccataggtagactcggggtcatcttctttatttaaatctttatttaaatgtggatagcatcccaagagacttgggtctacactaagaatattcaaatccatgtttctgaaaccatcagagatagaaaaaaaaagtagcgaatatcccttttcaactggaataaacttgtcttaattctagaacttttccataccaatgttttcatgcttcctttgtattttatcttttagctcattatcaaattatagtgatttgaagaaagagtctgctgtgaacctaaatgctcctagaaccccaggaaggcatggattgacaaccacacctcaacaaaaactcctctcccagcacttgccacagaggcagggaaatgatacagataagactcagggtgcacagacttgtgtggccaacggtgtaatggcagcacaaaaccagatggaatgtgaggaggagaaagctgccactcttagctcagatacttctattcaagcttctgaacccttgcttgatacgcacatagtgaatggagaaagagatgaaactgccacagctcctgcatcacccacaacagacagctgtgatggaaatgcttctgacagtagctacaggactccaggcataggcccagtgctccccctagaagaaagaggggcagaaacagaaaccaaggtacaagagagggaaaatggggaaagccctctggaactggagcagctggaccagcaccatgagatgaaggtagagcatgagactagctcatgagcagggaaaaccctgcctattcgattgttgtcttaaaactctttatttattgcacccctgaaatgtatgaatcagatcacccacactggcagttaaacgattttcaagctctggctgctgattagcatttcccctatgctctaagcagatatttcactttttcttttcatgtagtttctgttaatatctctgttgtaatttcaggagtcagaacagtgtggaaactttaatataggaaatccacaaatgtattgtttttacatagaaagaaaatgttccttgttgctctagatgttggtgctgtatccctaatacttacgggccaagcaagaagaaattgtataatctttgttgttcagaagtttctaatagaataaataggcctgtaagatgaacttgccactagtaaatgttacttttaaggacatgaatatggaagtattaaattattcaacag

SEQ ID NO: 11393 - DNA, 8242 bp, Homo sapiens
attatccttgctgggctgggaagtggggaaagcaggggagcctgtgctgggtgagattatctgcaatggaccgggttaatgggaggcttgctttggctcgctggaagaacaaatgaagggagttttacttcaaccatttgtgacttctggccaagaggaataaattcagcttttataaggcagcagtacctgtccaaagatcgctttagttccaccttgctccacaagcagcacaaccacactggttggtgagaatgtatctgaagaagaggctcagggaataaatgggaacaggccagcaaaacactcagctgcaagtccaaagccacaagtgcctccaaagccattacacctgcagaattcaccttcgtccaatatacaccaaacccccaggcataaagctttacctagtgcaaaaccaaggatggaggaaattaaacctgcctctgcttcttgtgtctcaaaagaaaaacccagtaaggtatcagatctcatcagtcgctttgaaggaggcagctcattatcaaattatagtgatttgaagaaagagtctgctgtgaacctaaatgctcctagaaccccaggaaggcatggattgacaaccacacctcaacaaaaactcctctcccagcacttgccacagaggcagggaaatgatacagataagactcagggtgcacagacttgtgtggccaacggtgtaatggcagcacaaaaccagatggaatgtgaggaggagaaagctgccactcttagctcagatacttctattcaagcttctgaacccttgcttgatacgcacatagtgaatggagaaagagatgaaactgccacagctcctgcatcacccacaacagacagctgtgatggaaatgcttctgacagtagctacaggactccaggcataggcccagtgctccccctagaagaaagaggggcagaaacagaaaccaaggtacaagagagggaaaatggggaaagccctctggaactggagcagctggaccagcaccatgagatgaaggagactaatgagcaaaaacttcacaaaatagccaatgaacttttgcttactgaaagagcttatgtcaaccgacttgacctcttagatcaggtattttattgcaaactgttggaagaagcaaaccgaggctcgtttccagcagagatggtgaataaaatcttttctaatatttcatcaataaatgccttccatagtaaattcctcttgccagagctggagaaacgaatgcaagaatgggaaactactcctagaattggagacatccttcagaaattggcaccattccttaagatgtatggagaatatgtgaaaggatttgataatgcaatggaattggttaaaaacatgacagaacgtattccccagttcaaatcagtggttgaagaaattcagaaacagaaaatctgtgggagcttaactttgcagcatcacatgctagaacctgttcagcggattccccggtatgagatgctccttaaggactatctaaggaaattgcctcctgattccctggactggaatgatgctaaaaaatcacttgaaattatatctacagcagcaagccattctaatagtgcaataaggaaaatggagaacctaaagaaactcttagagatttatgaaatgttgggagaagaagaagacattgtaaacccttcaaatgaactaataaaagaaggacagatcctcaaactagctgctcggaacacttcagcacaagaacgctaccttttcttattcaacaacatgttgctgtactgtgtgcccaaattcagcttggtaggctctaaattcacagttcgaaccagggttggcattgatggaatgaaaattgtagagactcaaaatgaagaatatccacatactttccaggtgtctgggaaagagagaacactggaactgcaggccagttctgcgcaagacaaagaagaatggatcaaggcccttcaagaaaccatcgatgcttttcatcaaaggcatgaaaccttcagaaatgcaattgcaaaggataatgacattcactcagaggtttctactgctgagctagggaaaagagccccaagatggatccgagataatgaagtgacaatgtgtatgaaatgtaaagaacctttcaatgcactgacacgaaggaggcatcattgtcgagcatgtggatatgtggtttgttggaaatgctccgactacaaagctcaacttgaatatgatggtggtaaattgagcaaagtttgtaaagactgttatcaaatcataagtggattcacagacagtgaagaaaagaaaagaaaaggaattttagagattgaatcagcagaagtatctggaaacagtgtggtgtgcagctttcttcagtatatggagaagtcaaaaccttggcagaaagcttggtgtgtgatccccaagcaagaccctcttgtgctgtacatgtatggtgccccccaggacgtcagagcccaggccaccattccacttctgggctatgtggtggatgaaatgccaaggagcgcagacctgccacacagtttcaaactgacccagtctaagtccgtgcacagctttgctgcagacagtgaggaactgaagcagaagtggctgaaagtcatccttttagctgtcacaggtgagacaccaggtggtccaaatgagcatccagccaccttggatgatcatcctgaacctaagaaaaaatcagaatgctgaactcctccaggaccagccatggtgtggaggtctcaggacttacagctcaagacattcccagctcttcttacacatctgctagcactttatgttgaaaaatataggcccataaatgcatcttttgaggactattttcctatgtttatgtactcttagtgaaattagtgtgcagagtcattctaccgataaagttttgaaataatgtgaaaactggagcattttttgagctattccttgaatatgtgcttttttgtcttgaagaaatggtgtatcaattgattctgtcaccgtcaggttagaatgagcacttccatttaagaaatcctttcatgtcttcttctctttcacatgtaggacctggaacagtttgaaagatatacctccatgttgccaaaatagatccatggtgaaaaatacagggacagttgaggctattgtattaacttatttaatttagtttataaatctctagctgcataaatgatgtctgttcttttaaaacaaaagaaaaaggacaaattgttggtgttcagatttccgatttataaagaaaagataacttgtttttgtagaaatactcctaagaatgtcttaagtatatagcaattatgtatatatagtattaaatatatatattatacatgcttttaggttcacattcatctctaatttattttttaaatataaagcatggtttatcgtggaattgagcaatgttctaaactgaagaaatgttttggtgatttatgttttgctgattggcatttgagggtattgatatttttataataagcggtaatttatgtggcatgggatatatttgtgaattccaacagtacttttaaagtaccattttttgtttctgtgcctatttaaaacagtgcctctcttagaaggtgctattaatataagatgagggttcagttaatgcttcagtcttgattattctaagattaaagtgcattttggtcactgggacagtcaaagtcatacaggttattttaccgtttacaatcctataattattgcagtagttaacatcagcatgtacaaacattttcaccaaaacccaaactttatgagacacctgaccttttacagaactaggatatgtggaaaccacatttatcgtaatgtttttcttttccgtaagataatcgagcatggttaaataaggtctctatataatgaacacttaagataactgtatgggccttttcctttgtcggaatgaaacaaaatccacatgtgataacctatgtttggggtgggggctggtcacatgattccttgtcatgaaggctgctcttcactcttttgtacttgtgattaaaatctcacactaagtttactatttaacttaatcctttttctcaaattaaacctttttttatactgtcataccccaaacattgtcactttttaatgtaccagtctgctagaaatctacaagaatgatcccactatctttagtatgtaaggattacaccttagatatagaatagaatttgagactgccacacatttattcaggccttgttactttaagaaatatcttattttttccaccccaaaggagcaagtgaaccaattattgctgacataataggttcccttcctccataaaaggattatcagccatgatcattaacattaaaccaaatagatggagccaaaaagagataaaagtagcttcttaggccctattaaatcagggaaagactagaagaaaatttacattgcttctcttttttaatggccagcggggtatgtgtgtgatgtatactcagagtggttttttggaaaattaaactgtagctatagatgatgctttggttttcttaatctcaagaaaagagaagcaatggaaatacagaatgattaactggggaagaggacttttgtaagtgtgactagaacaatggtaatgtatgggccaatgggaagatttataagtcagattatttttgaaaactatttttaaaagcaagaagactacactttccctaccaaaacagaagtaacatggacacacttaagttttggctcaataaatatcaatgttatttaacttagatcattgaaagaatactcatgtaaagataatgtttattatcatgctcttaacagtcattatctttaattttttaaatgagaagcattaatactagaagagaatttctggttatccggtcaccatattcactttccaccccacattcttcagctaaacgcaaagagaagcagtgaaacagccttacccgcttctctcttattaaagaatcactgatgtttttactcaatgaaaggtaaagtaatacccttagccatttattaaacaattcaaccaagagacctcaaagtgtgattgatgataagaataatcaatgccttttcccttccaacatacttgagcagtcatgacaacctaaaaatatcattggttgctttcccattaaaaccaacgttccctgtgggtcttaattctttattttcactcatttggtgctttccaagtcatcttttctttaaagtgcccttcctccaaactttaaaaagtacttccttgacaaaatttctattcattataaaacatttcaatattttaagcttaaattttgcttttgctgaaagcctaccatttggcgtgttaagtatgaaatatagtgcagacttttatcttggttttaagtggggctcaataaaaaacaccagccacttttgtaataatggcatcacagtgtcatcatgtatgcaagcaataaaactctttagggtatggttttatactgaaaatttaatatgaaggccccttcccacaagaatatagataattattaactttctagatgtgatacggtaattcgaattgcagagtataaggaagggaaatgggaaggggcatcattccttggattttaaataactatcaagaacatttttactttaacaaagaaaatggatagaaaaagcacattttgttttccctgaagtttaatttgacatcaggtttgtgtacttatcttcactaggtgacttaacttaccccaatttttttaaaaattattaaactttttacagaaactaaccttttaaatgtaccctttccccatatatatatacgcacacgtttggattttttttttttaagaacacttgttctagttataaatatataaagaaaacgataaagtttgtggtactgcagggttgttaaagattctttgatgccttctaaaaacttttgtcaaaaatacttttgagttcacaattctgttttacttttccttgtccttactttttggaaacagggtggttgcttttatttgttttctggttatattcaaagccttaagttcttaatctgagcatattgtctgtgataaatttctgatgatctttctggactagatacaacctgagtagcaagcaccaaccggagcaagtaaacttctagggaacaagcgtcttgggttttataggtatctttgctataatgcagaatagattaatgaagatttcctatatcatatgatatttgtgttagtgggtctaagattaagcacatgatatttataagctaaaattaactcaaaagtcaagaatgtcttaatgttttcattcttaaattttgtattctccaagaatgtattagtatatgaactgtggccaaccagttcctattcttcagactgtattgacatctgtagtggatcatgttgcttcttcattcttaccaattttattagaatcaaacttcttgttatttgcatactattatctactatagattctcagctttagaaaatgactatgatacataaagaccactaggtcaacttaaaaaaccctttctgtgaatttatacatgtatgtatatatgtaaaaacactgttgatttgcaattctgtctttccatagaaatgaactttttctatcgaaattgtttaacttaaatattttaacataaattatttacatggatctttatgtataattcatccttatatataccccttaatcacgtagtcatgagaagataactttgctttctttacagaaagggcagagaggaataagataagaaactgaaacaagcaagaatgaagagagatgtgggggagagactgctggtctccagaccacagcaatgtgttttaagataagatgaaatattttaactgcagaagggatataaaatctatgtaattacatgctgatgggatccattgcacccaggtttttgaccttggcctgtaaatgctagactatgatatcttgttattctttttctcctttgggcttttaaaaaataatttcattctcagatcattttctgtactgtttactgaggcaaaaaaaaaaaaaatctgaagtcaatcatggtcttctactttctggactgagcatttggcagaatgcagtatcttttcctgtattttgacatgaaatagcacatggcttctacaagatagttttaacttgttggggtcaccgggagttatatgatggtcaaccccttttcccaaaattcattgtggtagttttagtggaaaacgtaaatcaagaaatctcatatcatactttaataaataaataccaaatacatagtgacatataggtttgggaagaaactagtctgtggggaccattataagagaatcacattatatattacacagtatatggatattggaatgtatcacttgtggggggttctcttcattagcaaaacagtcatgtctgtctgtatataagacttttttttttttaaccaaactagcatttcattttgtgagtgacaattgacattttaaaataagcataggccgggcatagtggctcatgcctgtaatcccagcccttgggaggccgaggtgggcagatcacttcaggtcaggagtttgagaccagcctggccaacatggtgaaaccctgtctctactaaataaaaataaaacaaaataagtgtatctgggccaggcacggtagcccatgcctgtaatcccagcactttgggaggccgaggagttcgagaccagcctggccaacatggcaaaaccctgtctctacaaaaattagccaggtgtggtggcacatgcctgtaatcccagctactcgggaggttgaggcaggagaattgcttgaacccgggagacagaggttgcagtgagccgagattgcaccactgcactccggcctgggtgacagagcaagacttcgactcaaaaaataaaataagcgtatctggatttttcttttgaattcttgactgataagtttgagaatgtatgtttttggaattttacagttgactcaagtgtgaaagtatacacaagtaatttttcttttctagctatgtgaatgtaaaatacttgcagataatgtatatattgtgtaatatatgtatatttggtcataaaagcagataattggaaacattgtaaaattaagcactttaattcctattaaatattaaacatttgtatcttgtaaataaacacatccttaaattaa

SEQ ID NO: 11394 - DNA, 1629 bp, Homo sapiens
ggagcacaaagacagcgattgttacccaataagcagtagtcacacacttctaccaatcgccttaggagggctggttaccatggaatccaccatctgttcactccccaccggaatgtgattatccttgctgggctgggaagtggggaaagcaggggagcctgtgctgggtgagattatctgcaatggaccgggttaatgggaggcttgctttggctcgctggaagaacaaatgaagggagttttacttcaaccatttgtgacttctggccaagaggaataaattcagcttttataaggcagcagtacctgtccaaagatcgctttagttccaccttgctccacaagcagcacaaccacactggttggtgagaatgtatctgaagaagaggctcagggaataaatgggaacaggccagcaaaacactcagctgcaagtccaaagccacaagtgcctccaaagccattacacctgcagaattcaccttcgtccaatatacaccaaacccccaggcataaagctttacctagtgcaaaaccaaggatggaggaaattaaacctgcctctgcttcttgtgtctcaaaagaaaaacccagtaaggtatcagatctcatcagtcgctttgaaggaggcagctcattatcaaattatagtgatttgaagaaagagtctgctgtgaacctaaatgctcctagaaccccaggaaggcatggattgacaaccacacctcaacaaaaactcctctcccagcacttgccacagaggcagggaaatgatacagataagactcagggtgcacagacttgtgtggccaacggtgtaatggcagcacaaaaccagatggaatgtgaggaggagaaagctgccactcttagctcagatacttctattcaagcttctgaacccttgcttgatacgcacatagtgaatggagaaagagatgaaactgccacagctcctgcatcacccacaacagacagctgtgatggaaatgcttctgacagtagctacaggactccaggcataggcccagtgctccccctagaagaaagaggggcagaaacagaaaccaaggtacaagagagggaaaatggggaaagccctctggaactggagcagctggaccagcaccatgagatgaaggtagagcatgagactagctcatgagcagggaaaaccctgcctattcgattgttgtcttaaaactctttatttattgcacccctgaaatgtatgaatcagatcacccacactggcagttaaacgattttcaagctctggctgctgattagcatttcccctatgctctaagcagatatttcactttttcttttcatgtagtttctgttaatatctctgttgtaatttcaggagtcagaacagtgtggaaactttaatataggaaatccacaaatgtattgtttttacatagaaagaaaatgttccttgttgctctagatgttggtgctgtatccctaatacttacgggccaagcaagaagaaattgtataatctttgttgttcagaagtttctaatagaataaataggcctgtaagatgaacttgccactagtaaatgttacttttaaggacatgaatatggaagtattaaattattcaacagattataa

SEQ ID NO: 11395 - DNA, 2925 bp, Homo sapiens
agtgcattggtctgagctcctggcagatcctgtgtaatcttcagcctccctgaagctttacagccaggagtgagattttatcacatgaactttaaaagagtaaagccaaatatctttttattaaaccagagtagattaattatcagtatatgtgaaatcatgtccactgatcaaggcagcagtacctgtccaaagatcgctttagttccaccttgctccacaagcagcacaaccacactggttggtgagaatgtatctgaagaagaggctcagggaataaatgggaacaggccagcaaaacactcagctgcaagtccaaagccacaagtgcctccaaagccattacacctgcagaattcaccttcgtccaatatacaccaaacccccaggcataaagctttacctagtgcaaaaccaaggatggaggaaattaaacctgcctctgcttcttgtgtctcaaaagaaaaacccagtaaggtatcagatctcatcagtcgctttgaaggaggcagctcattatcaaattatagtgatttgaagaaagagtctgctgtgaacctaaatgctcctagaaccccaggaaggcatggattgacaaccacacctcaacaaaaactcctctcccagcacttgccacagaggcagggaaatgatacagataagactcagggtgcacagacttgtgtggccaacggtgtaatggcagcacaaaaccagatggaatgtgaggaggagaaagctgccactcttagctcagatacttctattcaagcttctgaacccttgcttgatacgcacatagtgaatggagaaagagatgaaactgccacagctcctgcatcacccacaacagacagctgtgatggaaatgcttctgacagtagctacaggactccaggcataggcccagtgctccccctagaagaaagaggggcagaaacagaaaccaaggtacaagagagggaaaatggggaaagccctctggaactggagcagctggaccagcaccatgagatgaaggagactaatgagcaaaaacttcacaaaatagccaatgaacttttgcttactgaaagagcttatgtcaaccgacttgacctcttagatcaggtattttattgcaaactgttggaagaagcaaaccgaggctcgtttccagcagagatggtgaataaaatcttttctaatatttcatcaataaatgccttccatagtaaattcctcttgccagagctggagaaacgaatgcaagaatgggaaactactcctagaattggagacatccttcagaaattggcaccattccttaagatgtatggagaatatgtgaaaggatttgataatgcaatggaattggttaaaaacatgacagaacgtattccccagttcaaatcagtggttgaagaaattcagaaacagaaaatctgtgggagcttaactttgcagcatcacatgctagaacctgttcagcggattccccggtatgagatgctccttaaggactatctaaggaaattgcctcctgattccctggactggaatgatgctaaaaaatcacttgaaattatatctacagcagcaagccattctaatagtgcaataaggaaaatggagaacctaaagaaactcttagagatttatgaaatgttgggagaagaagaagacattgtaaacccttcaaatgaactaataaaagaaggacagatcctcaaactagctgctcggaacacttcagcacaagaacgctaccttttcttattcaacaacatgttgctgtactgtgtgcccaaattcagcttggtaggctctaaattcacagttcgaaccagggttggcattgatggaatgaaaattgtagagactcaaaatgaagaatatccacatactttccaggtgtctgggaaagagagaacactggaactgcaggccagttctgcgcaagacaaagaagaatggatcaaggcccttcaagaaaccatcgatgcttttcatcaaaggcatgaaaccttcagaaatgcaattgcaaaggataatgacattcactcagaggtttctactgctgagctagggaaaagagccccaagatggatccgagataatgaagtgacaatgtgtatgaaatgtaaagaacctttcaatgcactgacacgaaggaggcatcattgtcgagcatgtggatatgtggtttgttggaaatgctccgactacaaagctcaacttgaatatgatggtggtaaattgagcaaagtttgtaaagactgttatcaaatcataagtggattcacagacagtgaagaaaagaaaagaaaaggaattttagagattgaatcagcagaagtatctggaaacagtgtggtgtgcagctttcttcagtatatggagaagtcaaaaccttggcagaaagcttggtgtgtgatccccaagcaagaccctcttgtgctgtacatgtatggtgccccccaggacgtcagagcccaggccaccattccacttctgggctatgtggtggatgaaatgccaaggagcgcagacctgccacacagtttcaaactgacccagtctaagtccgtgcacagctttgctgcagacagtgaggaactgaagcagaagtggctgaaagtcatccttttagctgtcacaggtgagacaccaggtggtccaaatgagcatccagccaccttggatgatcatcctgaacctaagaaaaaatcagaatgctgaactcctccaggaccagccatggtgtggaggtctcaggacttacagctcaagacattcccagctcttcttacacatctgctagcactttatgttgaaaaatataggcccataaatgcatcttttgaggactattttcctatgtttatgtactcttagtgaaattagtgtgcagagtcattctaccgataaagttttgaaataatg

SEQ ID NO: 11396 - DNA, 2924 bp, Homo sapiens
agttagttctttatcatgttgaacactagatgtgtatgtgtctagtgtctaaatacagaatgcctatagtttctaccaacaaattatggatccaaatccttgctccagaagcaggaaataggttaatcagaagattgctggatgttatgaaaagaatcttttatggggggctgcagcagtacctgtccaaagatcgctttagttccaccttgctccacaagcagcacaaccacactggttggtgagaatgtatctgaagaagaggctcagggaataaatgggaacaggccagcaaaacactcagctgcaagtccaaagccacaagtgcctccaaagccattacacctgcagaattcaccttcgtccaatatacaccaaacccccaggcataaagctttacctagtgcaaaaccaaggatggaggaaattaaacctgcctctgcttcttgtgtctcaaaagaaaaacccagtaaggtatcagatctcatcagtcgctttgaaggaggcagctcattatcaaattatagtgatttgaagaaagagtctgctgtgaacctaaatgctcctagaaccccaggaaggcatggattgacaaccacacctcaacaaaaactcctctcccagcacttgccacagaggcagggaaatgatacagataagactcagggtgcacagacttgtgtggccaacggtgtaatggcagcacaaaaccagatggaatgtgaggaggagaaagctgccactcttagctcagatacttctattcaagcttctgaacccttgcttgatacgcacatagtgaatggagaaagagatgaaactgccacagctcctgcatcacccacaacagacagctgtgatggaaatgcttctgacagtagctacaggactccaggcataggcccagtgctccccctagaagaaagaggggcagaaacagaaaccaaggtacaagagagggaaaatggggaaagccctctggaactggagcagctggaccagcaccatgagatgaaggagactaatgagcaaaaacttcacaaaatagccaatgaacttttgcttactgaaagagcttatgtcaaccgacttgacctcttagatcaggtattttattgcaaactgttggaagaagcaaaccgaggctcgtttccagcagagatggtgaataaaatcttttctaatatttcatcaataaatgccttccatagtaaattcctcttgccagagctggagaaacgaatgcaagaatgggaaactactcctagaattggagacatccttcagaaattggcaccattccttaagatgtatggagaatatgtgaaaggatttgataatgcaatggaattggttaaaaacatgacagaacgtattccccagttcaaatcagtggttgaagaaattcagaaacagaaaatctgtgggagcttaactttgcagcatcacatgctagaacctgttcagcggattccccggtatgagatgctccttaaggactatctaaggaaattgcctcctgattccctggactggaatgatgctaaaaaatcacttgaaattatatctacagcagcaagccattctaatagtgcaataaggaaaatggagaacctaaagaaactcttagagatttatgaaatgttgggagaagaagaagacattgtaaacccttcaaatgaactaataaaagaaggacagatcctcaaactagctgctcggaacacttcagcacaagaacgctaccttttcttattcaacaacatgttgctgtactgtgtgcccaaattcagcttggtaggctctaaattcacagttcgaaccagggttggcattgatggaatgaaaattgtagagactcaaaatgaagaatatccacatactttccaggtgtctgggaaagagagaacactggaactgcaggccagttctgcgcaagacaaagaagaatggatcaaggcccttcaagaaaccatcgatgcttttcatcaaaggcatgaaaccttcagaaatgcaattgcaaaggataatgacattcactcagaggtttctactgctgagctagggaaaagagccccaagatggatccgagataatgaagtgacaatgtgtatgaaatgtaaagaacctttcaatgcactgacacgaaggaggcatcattgtcgagcatgtggatatgtggtttgttggaaatgctccgactacaaagctcaacttgaatatgatggtggtaaattgagcaaagtttgtaaagactgttatcaaatcataagtggattcacagacagtgaagaaaagaaaagaaaaggaattttagagattgaatcagcagaagtatctggaaacagtgtggtgtgcagctttcttcagtatatggagaagtcaaaaccttggcagaaagcttggtgtgtgatccccaagcaagaccctcttgtgctgtacatgtatggtgccccccaggacgtcagagcccaggccaccattccacttctgggctatgtggtggatgaaatgccaaggagcgcagacctgccacacagtttcaaactgacccagtctaagtccgtgcacagctttgctgcagacagtgaggaactgaagcagaagtggctgaaagtcatccttttagctgtcacaggtgagacaccaggtggtccaaatgagcatccagccaccttggatgatcatcctgaacctaagaaaaaatcagaatgctgaactcctccaggaccagccatggtgtggaggtctcaggacttacagctcaagacattcccagctcttcttacacatctgctagcactttatgttgaaaaatataggcccataaatgcatcttttgaggactattttcctatgtttatgtactcttagtgaaattagtgtgcagagtcattctaccgataaagttttgaaataatgtg

SEQ ID NO: 11397 - DNA, 2977 bp, Homo sapiens
ggtagcggctttgagtgagtgcgggagctgcagataccgagacgctgcgactgccgcaggagtcgccgcagccaaactcgccgcgacgccgggagggagcgtaccgggaaggagagggagaggaggcactcgctgaggagacgccgcagtagagggcgcccccggagtcgcgccgaacctgggcatgcaggcgacgccccccaggggccgctcgcggctggacgggagcgggaggagtcggggagcggcggtcgagcccggcaggatgagcgacgagggcggctccaacttcaggcgggtggcgatccggcggaagtccaacccctcctacctgccgcccggggtgccccggccctggagcaggcccgcgtcgcacctgggacgtgtagggaccgctgccttcaagggccaggtgccctcaggagccacaggcagcagtacctgtccaaagatcgctttagttccaccttgctccacaagcagcacaaccacactggttggtgagaatgtatctgaagaagaggctcagggaataaatgggaacaggccagcaaaacactcagctgcaagtccaaagccacaagtgcctccaaagccattacacctgcagaattcaccttcgtccaatatacaccaaacccccaggcataaagctttacctagtgcaaaaccaaggatggaggaaattaaacctgcctctgcttcttgtgtctcaaaagaaaaacccagtaaggtatcagatctcatcagtcgctttgaaggaggcagctcattatcaaattatagtgatttgaagaaagagtctgctgtgaacctaaatgctcctagaaccccaggaaggcatggattgacaaccacacctcaacaaaaactcctctcccagcacttgccacagaggcagggaaatgatacagataagactcagggtgcacagacttgtgtggccaacggtgtaatggcagcacaaaaccagatggaatgtgaggaggagaaagctgccactcttagctcagatacttctattcaagcttctgaacccttgcttgatacgcacatagtgaatggagaaagagatgaaactgccacagctcctgcatcacccacaacagacagctgtgatggaaatgcttctgacagtagctacaggactccaggcataggcccagtgctccccctagaagaaagaggggcagaaacagaaaccaaggtacaagagagggaaaatggggaaagccctctggaactggagcagctggaccagcaccatgagatgaaggagactaatgagcaaaaacttcacaaaatagccaatgaacttttgcttactgaaagagcttatgtcaaccgacttgacctcttagatcaggtattttattgcaaactgttggaagaagcaaaccgaggctcgtttccagcagagatggtgaataaaatcttttctaatatttcatcaataaatgccttccatagtaaattcctcttgccagagctggagaaacgaatgcaagaatgggaaactactcctagaattggagacatccttcagaaattggcaccattccttaagatgtatggagaatatgtgaaaggatttgataatgcaatggaattggttaaaaacatgacagaacgtattccccagttcaaatcagtggttgaagaaattcagaaacagaaaatctgtgggagcttaactttgcagcatcacatgctagaacctgttcagcggattccccggtatgagatgctccttaaggactatctaaggaaattgcctcctgattccctggactggaatgatgctaaaaaatcacttgaaattatatctacagcagcaagccattctaatagtgcaataaggaaaatggagaacctaaagaaactcttagagatttatgaaatgttgggagaagaagaagacattgtaaacccttcaaatgaactaataaaagaaggacagatcctcaaactagctgctcggaacacttcagcacaagaacgctaccttttcttattcaacaacatgttgctgtactgtgtgcccaaattcagcttggtaggctctaaattcacagttcgaaccagggttggcattgatggaatgaaaattgtagagactcaaaatgaagaatatccacatactttccaggtgtctgggaaagagagaacactggaactgcaggccagttctgcgcaagacaaagaagaatggatcaaggcccttcaagaaaccatcgatgcttttcatcaaaggcatgaaaccttcagaaatgcaattgcaaaggataatgacattcactcagaggtttctactgctgagctagggaaaagagccccaagatggatccgagataatgaagtgacaatgtgtatgaaatgtaaagaacctttcaatgcactgacacgaaggaggcatcattgtcgagcatgtggatatgtggtttgttggaaatgctccgactacaaagctcaacttgaatatgatggtggtaaattgagcaaagtttgtaaagactgttatcaaatcataagtggattcacagacagtgaagaaaagaaaagaaaaggaattttagagattgaatcagcagaagtatctggaaacagtgtggtgtgcagctttcttcagtatatggagaagtcaaaaccttggcagaaagcttggtgtgtgatccccaagcaagaccctcttgtgctgtacatgtatggtgccccccaggacgtcagagcccaggccaccattccacttctgggctatgtggtggatgaaatgccaaggagcgcagacctgccacacagtttcaaactgacccagtctaagtccgtgcacagctttgctgcagacagtgaggaactgaagcagaagtggctgaaagtcatccttttagctgtcacaggtgagacaccaggtggtccaaatgagcatccagccaccttggatgatcatcctgaacctaagaaaaaatcagaatgctga

SEQ ID NO: 11398 - DNA, 3129 bp, Homo sapiens
ctgcccggccccttcgcccacgtgaagaacgccagggagctgtgaggcagtgctgtgtggttcctgccgtccggactctttttcctctactgagattcatctgtgtgaaatatgagttggcgaggaagatcgacctattattggcctagaccaaggcgctatgtacagcctcctgaaatgattgggcctatgcggcccgagcagttcagtgatgaagtggaaccagcaacacctgaagaaggggaaccagcaactcaacgtcaggatcctgcagctgctcaggagggagaggatgagggagcatctgcaggtcaagggccgaagcctgaagctgatagccaggaacagggtcacccacagactgggtgtgagtgtgaagatggtcctgatgggcaggagatggacccgccaaatccagaggaggtgaaaacgcctgaagaagagatgaggtctcactatgttgcccagactgggattctctggcttttaatgaacaattgcttcttaaatctttccccacggaaaccttgagtgactgaaatatcaaatggcaagagaccgtttagttcctatcatctgtggcatgtgaagggcaatcacagtgttaaaagaagacatgctgaaatgttgcaggctgctcctatgttggaaaattcttcattgaagttctcccaataaagctttacagccttctgcaaagaagtcttgtgaatcttttgtcaattttatttctagctatttgatgctgtgaaatgtttcattctttgcaattttgtattctatctccttgagctgtgtgtagaggcataattctcatgtattgattttctatccagcaaccttgttaaatatgcttatgaattttaaaagtttacttctaggttttttcagttttcaacctacagaatcatatcatttttgaataagaacaattttgtttctgccttttttgtttgttttttcttttgtatttttcgtagaggtgggattttggcctgtgtcctaggctttttttgaactcctgagcgcaagtaatccactctccttggcctttcaaagtgttgggattacaggcatgggccaccgtgctggtcctgtttttgccattttaaacccttttatttccttttctgattttatggcattgagcagatctaccggatacaattgtgatagtggaaatttttgtgttattcctgatgagaaatggaaaaatttcaacatttcacgacaatatttagtgtactttttttgtagatggactttttcagagtaagtcaagccattctgttttagtttgttgagagtgttcattttgaatatatgttgaatttcatcaaacactgacctgagtcatcttaaaacatgtgaattgagatttctttgctactaagaaagtgagcgggcactctgcttcatgtttacttttgtcatgttgcatgaaaaacattttgcttcatgtttgattctgtatgttgaaaactgaaatcatctattgtgattaccacagggttttttcccccagtaatctgtttatgtagtcaattacgttgataaatctgtactttttaaattttaacaattgagacaggtctcactctgtcacccatgctgactgcagtagtgtgatcacagcttactgcaacctcaacctcctgggctcaggcgatcctcccacctcaccctcctcagtagctaggactataggtacatgccaccatgccaagctaatttttctgttttagagatggtattttttcatgttgcccaggctggttttatactcctaatctcaagccatccactagcctcagcctcccaaagtgctgggattacaggaatgagtcacggtgcctggaaattttgtacatttaaaccaacaatttggtcatgggtaatctatgtcctaataatttatttaaggatttttatgtatatcctcatgagtgacattacctgtacttttatttcatatgctcatttgttggacgttgttatcaaggttcctctagcttcataaaacgggttggtatgtaaaacctctttttccattcactggaactcaagtctcctcaaggctgtgagtaatgcagggctaggctttcccataatgagcttttctagaatgcttctctcagatttggaccctacttaaacagcagtgaccaaacgggcagctccaggtacctatcccctcaaactttgtgagggtcgcgttctctgaagatgcctcttcaatttgaaagctatctgttcctgtttctctgctgatattaactctctgtgcacagaaagttaaacgtcactggttattaatttccctagattttgatctgtgctgtgtggctgagaatgggctgactgaccctagatctgtgtataattatgacaatggctccatttatttttaaaataagaggaattattataaaattcctatttactggatgtgtactatctatgaattacttctttgtgctaggttgtgtacatgtatgacctctttagatcctcacaagataaggcagaattttcatgaaattgatgactgactccagtaagaagcagatttggggggatttcaatttctaagctcaaagcccttgcacttttctcaaagtaaagcttttgaaagtgttaaatgtacacgaactgatggtgtatatgatgattttagttgtaatctgatgttttctttaaaaatttacatatacaaaagtgtttgactcaaaaggctttgttcttcccttaaaggaagcatctaccaaaatgtggcacacaaaccttgcatggtgtctctagggcctcctaccccgcatttcccctgctttttctcttgttctgactgaaaaacaaagtgctttgactgtgctgtgacccagccagctgcatgtttacccagcatgcttgaacccaagctggagccttgaacataaaggtgtttaagttgttgctcaaaatatggaaagaatctagctctggccttgaaccaaatcccttaaactctcctataaaactccataacctgaccccctcagtgcggatatacctaggcatgacattcttgttgcctgttgcgaggatgctttagcctactctaagttctcccaataaatgctttggactgat

SEQ ID NO: 11399 - DNA, 538 bp, Homo sapiens
cacgtggagaacgccagggagctgtgagggtgtgtggtctcgttcctgtcgtctggaatatttttcctctactgagattcatctgtgtgaaatatgagttggcgaggaagatcgacctatcggtctagaccaagactctatgtagagccccctgaaatgattgggcctatgctgcccgagcagttcagtgatgaagtggaaccagcaacacctgaagaaggggaaccagcaactcaacgtcaggatcctgcagctgctcaggagggagaggatgagggagcatctgcaggtcaagggccgaagcctgaagctgatagccaggaacaggttcacccaaagactgggtgtgagtgtggagatggtcctgatggccaggagatgggcctgccaaatccagaggaggtgaaaaggcctgaagaaggtgaaaagcaatcacagtgttaaaagaagacacgttgaaatgatgcaggctgctcctatgttggaaatttgttcattaaaattctcccaataaagctttacagccttctgcaaagaa

SEQ ID NO: 11400 - DNA, 527 bp, Homo sapiens
cgccagggagctgtgaggcagtgctgtgtggttcctgccgtccggactctttttcctctactgagattcatctgtgtgaaatatgagttggcgaggaagatcgacctattattggcctagaccaaggcgctatgtacagcctcctgaaatgattgggcctatgcggcccgagcagttcagtgatgaagtggaaccagcaacacctgaagaaggggaaccagcaactcaatgtcaggatcctgcagctgctcaggagggagaggatgagggagcatctgcaggtcaagggccgaagcctgaagctcatagccaggaacagggtcacccacagactgggtgtgagtgtgaagatggtcctgatgggcaggagatggacccgccaaatccagaggaggtgaaaacgcctgaagaaggtgaaaagcaatcacagtgttaaaagaagacacgttgaaatgatgcaggctgctcctatgttggaaatttgttcattaaaattctcccaataaagctttacagccttctgcaaa

SEQ ID NO: 11401 - DNA, 527 bp, Homo sapiens; identical to SEQ ID NO: 11400

SEQ ID NO: 11402 - DNA, 520 bp, Homo sapiens
ctgtgaggcagtgctgtgtggttcctgccgtccggactctttttcctctactgagattcatctgtgtgaaatatgagttggcgaggaagatcgacctattattggcctagaccaaggcgctatgtacagcctcctgaaatgattgggcctatgcggcccgagcagttcagtgatgaagtggaaccagcaacacctgaagaaggggaaccagcaactcaatgtcaggatcctgcagctgctcaggagggagaggatgagggagcatctgcaggtcaagggccgaagcctgaagctcatagccaggaacagggtcacccacagactgggtgtgagtgtgaagatggtcctgatgggcaggagatggacccgccaaatccagaggaggtgaaaacgcctgaagaaggtgaaaagcaatcacagtgttaaaagaagacacgttgaaatgatgcaggctgctcctatgttggaaatttgttcattaaaattctcccaataaagctttacagccttctgcaaagaa

SEQ ID NO: 11403 - DNA, 527 bp, Homo sapiens
cgccagggagctgtgaggcagtgctgtgtggttcctgccgtccggactctttttcctctactgagattcatctgtgtgaaatatgagttggcgaggaagatcgacctattattggcctagaccaaggcgctatgtacagcctcctgaaatgattgggcctatgcggcccgagcagttcagtgatgaagtggaaccagcaacacctgaagaaggggaaccagcaactcaacgtcaggatcctgcagctgctcaggagggagaggatgagggagcatctgcaggtcaagggccgaagcctgaagctcatagccaggaacagggtcacccacagactgggtgtgagtgtgaagatggtcctgatgggcaggagatggacccgccaaatccagaggaggtgaaaacgcctgaagaaggtgaaaagcaatcacagtgttaaaagaagacacgttgaaatgatgcaggctgctcctatgttggaaatttgttcattaaaattctcccaataaagctttacagccttctgcaaa

SEQ ID NO: 11404 - DNA, 527 bp, Homo sapiens; identical to SEQ ID NO: 11403

SEQ ID NO: 11405 - DNA, 527 bp, Homo sapiens
cgccagggagctgtgaggcagtgctgtgtggttcctgccgtccggactctttttcctctactgagattcatctgtgtgaaatatgagttggcgaggaagatcgacctattattggcctagaccaaggcgctatgtacagcctcctgaaatgattgggcctatgcggcccgagcagttcagtgatgaagtggaaccagcaacacctgaagaaggggaaccagcaactcaatgtcaggatcctgcagctgctcagaagggagaggatgagggagcatctgcaggtcaagggccgaagcctgaagctcatagccaggaacagggtcacccacagactgggtgtgagtgtgaagatggtcctgatgggcaggagatggacccgccaaatccagaggaggtgaaaacgcctgaagaaggtgaaaagcaatcacagtgttaaaagaagacacgttgaaatgatgcaggctgctcctatgttggaaatttgttcattaaaattctcccaataaagctttacagccttctgcaaa

SEQ ID NO: 11406 - DNA, 541 bp, Homo sapiens
gcccacgtgaagaacgccagggagctgtgaggcagtgctgtgtggttcctgccgtccggactctttttcctctactgagattcatctgtgtgaaatatgagttggcgaggaagatcgacctattattggcctagaccaagaccctatgtacagcctcctgaaatgattgggcctatgcggcccgagcagttcagtgatgaagtggaaccagcaacacctgaagaaggggaaccagcaactcaacgtcaggatcctgcagctgctcaggagggagaggatgagggagcatctgcaggtcaagggccgaagcctgaagctgatagccaggaacagggtcacccacagactgggtgtgagtgtgaagatggtcctgatgggcaggagatggacccgccaaatccagaggaggtgaaaacgcctgaagaaggtaaaaagcaatcacagtgttaaaagaagacacgttgaaatgatgcaggctgctcctatgttggaaatttgttcattaaaattctcccaataaagctttacagccttctgcaaa

SEQ ID NO: 11407 - DNA, 527 bp, Homo sapiens
cgccagggagctgtgaggcagtgctgtgtggttcctgccgtccggactctttttcctctactgagattcatctgtgtgaaatatgagttggcgaggaagatcgacctattatcggcctagaccaagacgctacgtagagcctcctgaaatgattgggcctatgcggcccgagcagttcagtgatgaagtggaaccagcaacacctgaagaaggggaaccagcaactcaatgtcaggatcctgcagctgctcaggagggagaggatgagggagcatctgcaggtcaagggccgaagcctgaagctgatagccaggaacagggtcacccacagactgggtgtgagtgtgaagatggtcctgatgggcaggagatggacccgccaaatccagaggaggtgaaaacgcctgaagaaggtaaaaagcaatcacagtgttaaaagaagacacgttgaaatgatgcaggctgctcctatgttggaaatttgttcattaaaattctcccaataaagctttacagccttctgcaaa

SEQ ID NO: 11408 - DNA, 528 bp, Homo sapiens
acgccagggagctgtgaggcagtgctgtgtggttcctgccgtccggactctttttcctctactgagattcatctgtgtgaaatatgagttggcgaggaagatcgacctatcggcctagaccaagacgctacgtagagcctcctgaaatgattgggcctatgcggcccgagcagttcagtgatgaagtggaaccagcaacacctgaagaaggggaaccagcaactcaacgtcaggatcctgcagctgctcaggagggacaggatgagggagcatctgcaggtcaagggccgaagcctgaagctcatagccaggaacagggtcacccacagactgggtgtgagtgtgaagatggtcctgatgggcaggagatggacccgccaaatccagaggaggtgaaaacgcctgaagaaggtgaaaagcaatcacagtgttaaaagaagacacgttgaaatgatgcaggctgctcctatgttggaaatttgttcattaaaattctcccaataaagctttacagccttctgcaaagaa

SEQ ID NO: 11409 - DNA, 509 bp, Homo sapiens
acgccagggagctgtgaggcagtgctgtgtggttcctgccgtccggactctttttcctctattgagattcatctgtgtgaaatatgagttggcgaggaagatcgacctatcggcctagaccaagacgctacgtagagcctcctgaaatgattgggcctatgcggcccgagcagttcagtgatgaagtggaaccagcaacacctgaagaaggggaaccagcaactcaacgtcaggatcctgcagctgctcaggagggagaggatgagggagcatctgcaggtcaagggccgaagcctgaagctcatagccaggaacagggtcacccacagactgggtgtgagtgtgaagatggtcctgatgggcaggagatggacccgccaaatccagaggaggtgaaaacgcctgaagaaggtgaaaagcaatcacagtgttaaaagaaggcacgttgaaatgatgcaggctgctcctatgttggaaatttgttcattaaaattctcccaataaagctt

SEQ ID NO: 11410 - DNA, 517 bp, Homo sapiens
ctgtgaggcagtgctgtgtggttcctgccgtccggactctttttcctctactgagattcatctgtgtgaaatatgagttggcgaggaagatcgacctatcggcctagaccaagacgctacgtagagcctcctgaaatgattgggcctatgcggcccgagcagttcagtgatgaagtggaaccagcaacacctgaagaaggggaaccagcaactcaacgtcaggatcctgcagctgctcaggagggagaggatgagggagcatctgcaggtcaagggccgaagcctgaagctcatagccaggaacagggtcacccacagactgggtgtgagtgtgaagatggtcctgatgggcaggagatggacccgccaaatccagaggaggtgaaaacgcctgaagaaggtgaaaagcaatcacagtgttaaaagaaggcacgttgaaatgatgcaggctgctcctatgttggaaatttgttcattaaaattctcccaataaagctttacagccttctgcaaagaa

SEQ ID NO: 11411 - DNA, 517 bp, Homo sapiens
ctgtgaggcagtgctgtgtggttcctgccgtccggactctttttcctctactgagattcatctgtgtgaaatatgagttggcgaggaagatcgacctatcggcctagaccaagacgctacgtagagcctcctgaaatgattgggcctatgcggcccgagcagttcagtgatgaagtggaaccagcaacacctgaagaaggggaaccagcaactcaacgtcaggatcctgcagctgctcaggagggagaggatgagggagcatctgcaggtcaagggccgaagcctgaagctgatagccaggaacagggtcacccacagactgggtgtgagtgtgaagatggtcctgatgggcaggagatggacccgccaaatccagaggaggtgaaaacgcctgaagaaggtgaaaagcaatcacagtgttaaaagaaggcacgttgaaatgatgcaggctgctcctatgttggaaatttgttcattaaaattctcccaataaagctttacagccttctgcaaagaa

SEQ ID NO: 11412 - DNA, 517 bp, Homo sapiens
ctgtgaggcagtgctgtgtggttcctgccgtccggactctttttcctctactgagattcatctgtgtgaaatatgagttggcgaggaagatcgacctatcggcctagaccaagacgctacgtagagcctcctgaaatgattgggcctatgcggcccgagcagttcagtgatgaagtggaaccagcaacacctgaagaaggggaaccagcaactcaacgtcaggatcctgcagctgctcaggagggagaggatgagggagcatctgcaggtcaagggccgaagcctgaagctgatagccaggaacagggtcacccacagactgggtgtgagtgtgaagatggtcctgatgggcaggagatggacccgccaaatccagaggaggtgaaaacgcctgaagaaggtaaaaagcaatcacagtgttaaaagaagacacgttgaaatgatgcaggctgctcctatgttggaaatttgttcattaaaattctcccaataaagctttacagccttctgcaaagaa

SEQ ID NO: 11413 - DNA, 2006 bp, Homo sapiens
tggtgagatgtttctggaagaaaaaatcccctcgatttctgatttaaagctagcaattcgaagagctactctgaaaagatcatttactcctgtatttttgggaagcgccttgaagaacaaaggagttcagcctcttttagatgctgttttagaatacctcccaaatccatctgaagtccagaactatgctattctcaataaagaggatgactcaaaagagaaaaccaaaatcctaatgaactccagtagagacaattcccacccatttgtaggcctggcttttaaactggagtttttgtctaggtcctttttccgtctcactagacagaaggaccacagaaggcccatccagaggaccacgttatatttgattgtcatgtctccttatgatctcctaggctgtaatagtttcttagactttccttgtttctcacgagattgatatttttgagaagtattggtcagctcttttgtagagtgtccctcaatttgggtttattatttgatgcttttcacatgattagattggagtcatgtgtttttaggaggactgccatcgaggtgaagtgttattcttgtcacatcatatccaaggtacagacttgcagcatgatttatcattgtttttgtttttttttgtttttatttttatttttttgagatgagatttcgctcttgttgcccaggctggagtgcaatggcacaatctcggctcgctgcagcctccacctcccaggttcaagcgagtctcctgcctcagcctcccaagtagctgggattacaggcatgcgccaccacgcccagctaattttgtatttttagtagagacatagtttctccctgttggtcaggccggtctcgaactcctgacctcaggtgatccgagtgtcttggcctcccaaagtgctgggattacaggcatgagccaccgcacccggctgatttatcattgttaatgctaacctcaatcaccacacctggctgagatagtgtttgacaggtttctctgctgtaaagttactgtactctttttattccccttttcatagtgtactttttagaaggaagtcacttggctcagccaacacttgaggggggaattatgttccacccccttgaagggggcactatctacataagttatttggaattcttctgaaagggagatttgtctttcttccctgcttatttatctatttggacaatcacttatttaatatcagcgtggactcacgtatatgtattttgaactttgagttataactatgactttgagtatgtcatttgttgttcagattggctgggtttggcgattgggaactctcagttggctcctgtgttcctttaacatcttccaatgttttgcctttttgaatacttccttacttgctggcactacaagacgcctcaggcttatcttgtatattccatgccctaaccctagaatcagccgttctccaaggagcactggttcctttttaagtaaaatggtattagaaaccaagatttggggactggatgggctttttgttgaaatgctgttgcttctgtacataatattttaagtggggaaaaatggtagataagttggaagtgttaagagtggttatttctgggatgggattatattttgggggctttttcttactttaaaaatattttacagtatatttattacctccaaaatgaggggaaaatttttttaattaaaaagtggaaataacattacagtaaaagtatttacacataaagcttttaaaaatacatatataagaatattttcttaggattcccagaatagtgattattgagttaaaggcatagaatgttttcatagttaatggtttatattgccagattgcgttcatactctccaaattaatgtattggattatttcaatgaatatcatcattgagtattgtttaaaaatcattactgatttaacaaatgaagaattctattgtaatcttttatcttgatgaaataaattttgatttttaaaagc

SEQ ID NO: 11414 - DNA, 3721 bp, Homo sapiens
ttctgtatcttcatacagaggtaatatttaaaaaagaagacgaagacaaaaggactcccttccctcacccatatacctatgccgtcttactgggagcaaacacttctttagctccgcaaagcgattgcactttctcttccaagtcggcagacggcgcgcgagcagcgtaggcactgctccgcctccaatccagttgctcttctttcttttcctcactctctttttcctcgcgtcctttgccccggaagtgctcttacaacattggctgccggcgtgactttgaccgcttcccggtgcgttaccggcagctgaacccacccggcgccacgggactttgacgcgtgctctgcgcttgccatgagactcctgggagctgcagccgtcgcggctctggggcgcggaagggcccccgcctccctaggctggcagaggaagcaggttaattggaaggcctgccgatggtcttcatcaggggtgattcctaatgaaaaaatacgaaatattggaatctcagctcacattgattctgggaaaactacattaacagaacgagtcctttactacactggcagaattgcaaagatgcatgaggtgaaaggtaaagatggagttggtgctgtcatggattccatggaactagagagacaaagaggaatcactattcagtcagcagccacttacaccatgtggaaagatgtcaatattaacattatagatactcctgggcatgtggacttcacaatagaagtggaaagggccctgagagtgttggatggtgcagtccttgttctctgtgctgttggaggggtacagtgccagaccatgactgtcaatcgtcagatgaagcgctacaacgttccgtttctaacttttattaacaaattggaccgaatgggctccaacccagccagggccctgcagcaaatgaggtctaaactaaatcataatgcagcgtttatgcagatacccatgggtttggagggtaattttaaaggtattgtagatcttattgaggaacgagccatctattttgatggagactttggtcagattgttcgatatggtgagattccagctgaattaagggcggcggccactgaccaccggcaggagctaattgaatgtgttgccaattcagatgaacagcttggtgagatgtttctggaagaaaaaatcccctcgatttctgatttaaagctagcaattcgaagagctactctgaaaagatcatttactcctgtatttttgggaagcgccttgaagaacaaaggagttcagcctcttttagatgctgttttagaatacctcccaaatccatctgaagtccagaactatgctattctcaataaagaggatgactcaaaagagaaaaccaaaatcctaatgaactccagtagagacaattcccacccatttgtaggcctggcttttaaactggaggtaggtcgatttggacaattaacttatgttcgcagttatcagggagagctaaagaagggtgacaccatctataacacaaggacaagaaagaaagtacggttgcaacggctggctcgcatgcatgccgacatgatggaggatgttgaggaagtatatgccggagacatctgtgcattgtttggcattgactgtgctagtggagacacattcacagacaaagccaacagcggcctttctatggagtcaattcatgttcctgatcctgtcatttcaatagcaatgaagccttctaacaagaacgatctggaaaaattttcaaaaggtattggcaggtttacaagagaagatcccacatttaaagtatactttgacactgagaacaaagagacagttatatctggaatgggagaattacacctggaaatctatgctcagaggctggaaagagagtatggctgtccttgtatcacaggaaagccaaaagttgcctttcgagagaccattactgcccctgtcccgtttgactttacacataaaaaacaatcaggtggtgcaggccagtatggaaaagtaataggtgtcctggagcctctggacccagaggactacactaaattggaattttcagatgaaacattcggatcaaatattccaaagcagtttgtgcctgctgtagaaaaggggtttttagatgcctgcgagaagggccctctttctggtcacaagctctctgggctccggtttgtcctgcaagatggagcacaccacatggttgattctaatgaaatctctttcatccgagcaggagaaggtgctcttaaacaagccttggcaaatgcaacattatgtattcttgaacctattatggctgtggaagttgtagctccaaatgaatttcagggacaagtaattgcaggaattaaccgacgccatggggtaatcactgggcaagatggagttgaggactattttacactgtatgcagatgtccctctaaatgatatgtttggttattccactgaacttaggtcatgcacagagggaaagggagaatacacaatggagtatagcaggtatcagccatgtttaccatccacacaagaagacgtcattaataagtatttggaagctacaggtcaacttcctgttaaaaaaggaaaagccaagaactaactttgcttactgtgagttgactgactctaattgaatctgcgtggttttgatactttgatggattccagtggaataaattcaggctgctgaaacaagaaattctgagcccaggaagcgggctcttctttcttcaaaagaagcccttcttgttcatattcaggagcttctgttatattcaaaggtaattctatgtctatctcaactctattgattggttttatagttcattgaaaatcctcaaataaaatataattattactgaaatatgtttaatatttaaggggaaaagagactaatttcagttatacttttaagcttagaatgtatgttcatttccaaattttgtatcataagagttttcaacatagagaaaagctgaaaaaatgcaaagaataaccacatactttccatctaccttcctttgttaacgggttgtttatcatataataatttgttttgtcatatttgctttcactgtctattatctgtttaagtctcataactctatttttagtttgctgaagacttgaaagtgaatcgcatatatcatgacacttcttggagtgtcattaatgggcaggcttttctgttgaagagtggattccgtatgttcttcatagagagtgtttttcagattcttcattgggatattaaaatattagccaaatttctctctgttttatatatgtctgtttatttcagtttgtggtttctgcaaatttgtaactgcctctgttttaggagtataagtattacttccttgtggtctattgtgaagtaaaaagtagacccttgcatatactattcttgtttgtgttcatcttaatgtttttgtacagctaaatcaaatgtaatttatagagttagtttcatcaacctaatgaatgctagttaaatttgaattccttggaatttatcgtatattgtattcactgagattatgaagggacaaatgttaatcttttgtttccagaaaaagttgggctttcccaagcagttctattacccggttcagaattgcttcatccaaaaatcatctgatggtatagatggatcctagtccttttcattacctgatggtagaaataaaataattgattttaaattc

SEQ ID NO: 11415 - DNA, 2793 bp, Homo sapiens
cacatcaaagtccggagaccccatgtgccgctcccagcgacaagggactcggagcagcgacgacttcagactcaccggctggacggggaccaggactggggtggggtagggaagttgctacttccagggaacggcggcgaccgctacagcgcaggccgcggacccgaccgcggcaggcgaagtggggtggggggagtggaaattagggagggtggggaagagggcaacacgcaagcgccaagggtcaggtgccgcggtggatgccgggacacggagtccccggtagagaaagaaactggctaaatgagagaaagcgaactaccaatcccaggatgacccgcgcacgacctggctgtcacgaaggcccggaggagggcgcttgcgggcggggcacaacgagaagccaccggaagcggaagccagaatggcgccattttgcggtacggaagctacacagcaacacgtataggagactctccccgagatcttctagggagtgacccatctatttttgtttgggaagaggaaactccgaaatgggatcgcggaagacttaaagggccaggctgatttttttttcctactggtctctgaggctgtggttgctacagggtcaccacgagcttggcttacttgtctcatccttcccttgcctggtatcattttctcagttctcccaaaagccatgtcccggcccttgctcatcaccttcaccccagccactgaccccagcgacctctggaaggatgggcagcagcagccacagcccgagaagccagagtccaccctggatggggctgcagccctagctttctatgaggccctgattggggatgagagcagcgctcctgactcccagagatctcagactgaacctgccagagaaagaaagagaaagaaaagaagaataatgaaggcaccagcagcagaagcagtggcagaaggagcatcaggaagacatggacaagggagatcccttgaggctgaggataagatgactcaccggatactgagggcagcccaggagggggacctgccagaacttaggagactgctggaaccgcatgaggcaggaggagctggggggaatatcaacgcccgggatgccttctggtggaccccactgatgtgtgctgctcgagcgggccagggggcagctgtgagctatctcctgggccgtggggctgcctgggtgggggtctgtgagctgagtggcagggatgcggctcagctcgctgaagaagctggcttccctgaggtagcccgcatggtcagggagagccatggagagacaaggagcccggaaaaccggtctcctactccctccctccagtactgcgagaactgtgacacccacttccaagattccaaccaccgcacatccactgctcacctgctgtcactgtcgcagggtcctcagcctcccaaccttccacttggggtgcccatctccagcccgggcttcaaactgctgctgagggggggctgggagccaggaatggggctgggaccccggggtgagggccgtgccaatcccatccccactgtcctcaagagggaccaggaaggactaggctacagatcagcaccccagccccgagtgacacatttcccagcttgggatacccgagctgtggctgggagggagagaccccctcgggtggccacactgagctggagggaggagagaaggagggaggagaaagacagggcttgggagcgggatctaaggacttacatgaacctcgagttctgactttggtaaagtctgaccctagtctgctgctgaagtctgaacttgggcctctgacctgggccctttgacttccccttcctgggatctgctcagatgcagatcctgaagtttttggtcaataggctctgtcttcgtgagagacgggctgagagtcagaaataaatcaaccatttgtggtttattcacttttctggaagctattttgaggaagccaaacagaagcctgggagccacatgcaagtcccacctgagtcagaaggggcagcctctccaggtggcatgataaggtcacctccctgccaatctgggttcactttcaggtcccagaccctcctgggagtcccccacctattctttcaacccccctggaccaagaattgcccagcttcgtgcaagtctcacttcccccaggaggagttccctgactacagccaattcactgatttcacaaacataagtccatatactatgtgccaagaatacaggtaaagacattcccaaccctcaaagagttcacagctggagagggaaagtgccatgttatcaatttttttcttttttttttgagatgcagtttcgctctcattgcccaggctggagtgcaatggcatgatctcggctcaccacaacctctgccccccgagttcaagggattctcctgcctcagcctccccagtagctgggattacaggcatgccccaccacgcccagctaattttgtatttttagtagagacggggtttctccatgttggccaagctggtcttgaactcccgacctcaggtgatccgccggcctcggcttcccaaagtgctggggttgcaggcatgagccaccactcccggcccatgttatcaaatattataatgcagggtgataagggaagtcaaggcctctagagatgagaatgggtagggttttgctggaagaggccagtgtgataggaaggcccacgattatcaagcttgtacacttagttgaactgggaccagaactctagcccccaaatctaaactttaaacttctttgttccaccc

SEQ ID NO: 11416 - DNA, 1598 bp, Homo sapiens
cagagacccttgacgggcatactgtttcctccgggctcctgcctcatgaggggagaggtgcggcttggctccaatggcgccattttgcggtacggaagctacacagcaacacgtataggagactctccccgagatcttctagggagtgacccatctatttttgtttgggaagaggaaactccgaaatgggatcgcggaagacttaaagggccaggctgatttttttttcctactgcaggtctctgaggctgtggttgctacagggtcaccacgagcttggcttacttgtctcatccttcccttgcctggtatcattttctcagttctcccaaaagccatgtcccggcccttgctcatcaccttcaccccagccactgaccccagcgacctctggaaggatgggcagcagcagccacagcccgagaagccagagtccaccctggatggggctgcagcccgagctttctatgaggccctgattggggatgagagcagcgctcctgactcccagagatctcagactgaacctgccagagaaagaaagagaaagaaaagaagaataatgaaggcaccagcagcagaagcagtggcagaaggagcatcaggaagacatggacaagggagatcccttgaggctgaggataagatgactcaccggatactgagggcagcccaggagggggacctgccagaacttaggagactgctggaaccgcatgaggcaggaggagctggggggaatatcaacgcccgggatgccttctggtggaccccactgatgtgtgctgctcgagcgggccagggggcagctgtgagctatctcctgggccgtggggctgcctgggtgggggtctgtgagctgagtggcagggatgcggctcagctcgctgaagaagctggcttccctgaggtagcccgcatggtcagggagagccatggagagacaaggagcccggaaaaccggtctcctactccctccctccagtactgcgagaactgtgacacccacttccaagattccaaccaccgcacatccactgctcacctgctgtcactgtcgcagggtcctcagcctcccaaccttccacttggggtgcccatctccagcccgggcttcaaactgctgctgagggggggctgggagccaggaatggggctgggaccccggggtgagggccgtgccaatcccatccccactgtcctcaagagggaccaggaaggactaggctacagatcagcaccccagccccgagtgacacatttcccagcttgggatacccgagctgtggctgggagggagagaccccctcgggtggccacactgagctggagggaggagagaaggagggaggagaaagacagggcttgggagcgggatctaaggacttacatgaacctcgagttctgactttggtaaagtctgaccctagtctgctgctgaagtctgaacttgggcctctgacctgggccctttgacttccccttcctgggatctgctcagatgcagatcctgaagtttttggtcaataggctctgtcttcgtgagagacgggctgagagtcagaaataaatcaaccatttgtggtttattcactttt

SEQ ID NO: 11417 - DNA, 1800 bp, Homo sapiens
cggggcccgggagtctgggcaatacagttttgtgctcactgggtgaagaggctgacttagggcggggaaaggagggagccaggctggatctctttccgcagctctcctcacgttcccctctagtcccggcgcggcgctgctgcccaggggactggcctatcctcggccaatccgctgggtccttattgcctgttgggcccctagtgcgaatcagtcccgccagagacccttgacgggcatactgtttcctccgggctcctgcctcatgaggggagagaatggcgccattttgcggtacggaagctacacagcaacacgtataggagactctccccgagatcttctagggagtgacccatctatttttgtttgggaagaggaaactccgaaatgggatcgcggaagacttaaagggccaggctgatttttttttcctactggtctctgaggctgtggttgctacagggtcaccacgagcttggcttacttgtctcatccttcccttgcctggtatcattttctcagttctcccaaaagccatgtcccggcccttgctcatcaccttcaccccagccactgaccccagcgacctctggaaggatgggcagcagcagccacagcccgagaagccagagtccaccctggatggggctgcagcccgagctttctatgaggccctgattggggatgagagcagcgctcctgactcccagagatctcagactgaacctgccagagaaagaaagagaaagaaaagaagaataatgaaggcaccagcagcagaagcagtggcagaaggagcatcaggaagacatggacaagggagatcccttgaggctgaggataagatgactcaccggatactgagggcagcccaggagggggacctgccagaacttaggagactgctggaaccgcatgaggcaggaggagctggggggaatatcaacgcccgggatgccttctggtggaccccactgatgtgtgctgctcgagcgggccagggggcagctgtgagctatctcctgggccgtggggctgcctgggtgggggtctgtgagctgagtggcagggatgcggctcagctcgctgaagaagctggcttccctgaggtagcccgcatggtcagggagagccatggagagacaaggagcccggaaaaccggtctcctactccctccctccagtactgcgagaactgtgacacccacttccaagattccaaccaccgcacatccactgctcacctgctgtcactgtcgcagggtcctcagcctcccaaccttccacttggggtgcccatctccagcccgggcttcaaactgctgctgagggggggctgggagccaggaatggggctgggaccccggggtgagggccgtgccaatcccatccccactgtcctcaagagggaccaggaaggactaggctacagatcagcaccccagccccgagtgacacatttcccagcttgggatacccgagctgtggctgggagggagagaccccctcgggtggccacactgagctggagggaggagagaaggagggaggagaaagacagggcttgggagcgggatctaaggacttacatgaacctcgagttctgactttggtaaagtctgaccctagtctgctgctgaagtctgaacttgggcctctgacctgggccctttgacttccccttcctgggatctgctcagatgcagatcctgaagtttttggtcaataggctctgtcttcgtgagagacgggctgagagtcagaaataaatcaaccatttgtggtttattcactttt

SEQ ID NO: 11418 - DNA, 1910 bp, Homo sapiens
aggcgtgacgttatttcattacacggcttctcggcattccacaggtttccctccgcctcctgagggcctttcctaacccacagagtggattcctggctccagaaaatgggcttggagcgggggccacgttgaggaaggcgaagggcattgtgggggcgttatgtaaaagtaggaccccaaccgacagatcctagtgctcgcgccacctgggcgcgcggagctttgctcgtttactattgaaaaagttccagcgcgggaaactgaacccggagctttgcgcacgcccgagccctcaagtaatgtgggttgtggtttttgttgttgttgtcgccacgcatgcgtcttcgtgccgtgtggctatttgattgtgtcaactcttctgattagaatggcgccattttgcggtacggaagctacacagcaacacgtataggagactctccccgagatcttctagggagtgacccatctatttttgtttgggaagaggaaactccgaaatgggatcgcggaagacttaaagggccaggctgatttttttttcctactggtctctgaggctgtggttgctacagggtcaccacgagcttggcttacttgtctcatccttcccttgcctggtatcattttctcagttctcccaaaagccatgtcccggcccttgctcatcaccttcaccccagccactgaccccagcgacctctggaaggatgggcagcagcagccacagcccgagaagccagagtccaccctggatggggctgcagcccgagctttctatgaggccctgattggggatgagagcagcgctcctgactcccagagatctcagactgaacctgccagagaaagaaagagaaagaaaagaagaataatgaaggcaccagcagcagaagcagtggcagaaggagcatcaggaagacatggacaagggagatcccttgaggctgaggataagatgactcaccggatactgagggcagcccaggagggggacctgccagaacttaggagactgctggaaccgcatgaggcaggaggagctggggggaatatcaacgcccgggatgccttctggtggaccccactgatgtgtgctgctcgagcgggccagggggcagctgtgagctatctcctgggccgtggggctgcctgggtgggggtctgtgagctgagtggcagggatgcggctcagctcgctgaagaagctggcttccctgaggtagcccgcatggtcagggagagccatggagagacaaggagcccggaaaaccggtctcctactccctccctccagtactgcgagaactgtgacacccacttccaagattccaaccaccgcacatccactgctcacctgctgtcactgtcgcagggtcctcagcctcccaaccttccacttggggtgcccatctccagcccgggcttcaaactgctgctgagggggggctgggagccaggaatggggctgggaccccggggtgagggccgtgccaatcccatccccactgtcctcaagagggaccaggaaggactaggctacagatcagcaccccagccccgagtgacacatttcccagcttgggatacccgagctgtggctgggagggagagaccccctcgggtggccacactgagctggagggaggagagaaggagggaggagaaagacagggcttgggagcgggatctaaggacttacatgaacctcgagttctgactttggtaaagtctgaccctagtctgctgctgaagtctgaacttgggcctctgacctgggccctttgacttccccttcctgggatctgctcagatgcagatcctgaagtttttggtcaataggctctgtcttcgtgagagacgggctgagagtcagaaataaatcaaccatttgtggtttattcactttt

SEQ ID NO: 11419 - DNA, 1814 bp, Homo sapiens
ggtatggcgttcggggcccgggagtctgggcaatacagttttgtgctcactgggtgaagaggctgacttagggcggggaaaggagggagccaggctggatctctttccgcagctctcctcacgttcccctctagtcccggcgcggcgctgctgcccaggggactggcctatcctcggccaatccgctgggtccttattgcctgttgggcccctagtgcgaatcagtcccgccagagacccttgacgggcatactgtttcctccgggctcctgcctcatgaggggagagaatggcgccattttgcggtacggaagctacacagcaacacgtataggagactctccccgagatcttctagggagtgacccatctatttttgtttgggaagaggaaactccgaaatgggatcgcggaagacttaaagggccaggctgatttttttttcctactgcaggtctctgaggctgtggttgctacagggtcaccacgagcttggcttacttgtctcatccttcccttgcctggtatcattttctcagttctcccaaaagccatgtcccggcccttgctcatcaccttcaccccagccactgaccccagcgacctctggaaggatgggcagcagcagccacagcccgagaagccagagtccaccctggatggggctgcagcccgagctttctatgaggccctgattggggatgagagcagcgctcctgactcccagagatctcagactgaacctgccagagaaagaaagagaaagaaaagaagaataatgaaggcaccagcagcagaagcagtggcagaaggagcatcaggaagacatggacaagggagatcccttgaggctgaggataagatgactcaccggatactgagggcagcccaggagggggacctgccagaacttaggagactgctggaaccgcatgaggcaggaggagctggggggaatatcaacgcccgggatgccttctggtggaccccactgatgtgtgctgctcgagcgggccagggggcagctgtgagctatctcctgggccgtggggctgcctgggtgggggtctgtgagctgagtggcagggatgcggctcagctcgctgaagaagctggcttccctgaggtagcccgcatggtcagggagagccatggagagacaaggagcccggaaaaccggtctcctactccctccctccagtactgcgagaactgtgacacccacttccaagattccaaccaccgcacatccactgctcacctgctgtcactgtcgcagggtcctcagcctcccaaccttccacttggggtgcccatctccagcccgggcttcaaactgctgctgagggggggctgggagccaggaatggggctgggaccccggggtgagggccgtgccaatcccatccccactgtcctcaagagggaccaggaaggactaggctacagatcagcaccccagccccgagtgacacatttcccagcttgggatacccgagctgtggctgggagggagagaccccctcgggtggccacactgagctggagggaggagagaaggagggaggagaaagacagggcttgggagcgggatctaaggacttacatgaacctcgagttctgactttggtaaagtctgaccctagtctgctgctgaagtctgaacttgggcctctgacctgggccctttgacttccccttcctgggatctgctcagatgcagatcctgaagtttttggtcaataggctctgtcttcgtgagagacgggctgagagtcagaaataaatcaaccatttgtggtttattcactttt

SEQ ID NO: 11420 - DNA, 2793 bp, Homo sapiens
cacatcaaagtccggagaccccatgtgccgctcccagcgacaagggactcggagcagcgacgacttcagactcaccggctggacggggaccaggactggggtggggtagggaagttgctacttccagggaacggcggcgaccgctacagcgcaggccgcggacccgaccgcggcaggcgaagtggggtggggggagtggaaattagggagggtggggaagagggcaacacgcaagcgccaagggtcaggtgccgcggtggatgccgggacacggagtccccggtagagaaagaaactggctaaatgagagaaagcgaactaccaatcccaggatgacccgcgcacgacctggctgtcacgaaggcccggaggagggcgcttgcgggcggggcacaacgagaagccaccggaagcggaagccagaatggcgccattttgcggtacggaagctacacagcaacacgtataggagactctccccgagatcttctagggagtgacccatctatttttgtttgggaagaggaaactccgaaatgggatcgcggaagacttaaagggccaggctgatttttttttcctactggtctctgaggctgtggttgctacagggtcaccacgagcttggcttacttgtctcatccttcccttgcctggtatcattttctcagttctcccaaaagccatgtcccggcccttgctcatcaccttcaccccagccactgaccccagcgacctctggaaggatgggcagcagcagccacagcccgagaagccagagtccaccctggatggggctgcagcccgagctttctatgaggccctgattggggatgagagcagcgctcctgactcccagagatctcagactgaacctgccagagaaagaaagagaaagaaaagaagaataatgaaggcaccagcagcagaagcagtggcagaaggagcatcaggaagacatggacaagggagatcccttgaggctgaggataagatgactcaccggatactgagggcagcccaggagggggacctgccagaacttaggagactgctggaaccgcatgaggcaggaggagctggggggaatatcaacgcccgggatgccttctggtggaccccactgatgtgtgctgctcgagcgggccagggggcagctgtgagctatctcctgggccgtggggctgcctgggtgggggtctgtgagctgagtggcagggatgcggctcagctcgctgaagaagctggcttccctgaggtagcccgcatggtcagggagagccatggagagacaaggagcccggaaaaccggtctcctactccctccctccagtactgcgagaactgtgacacccacttccaagattccaaccaccgcacatccactgctcacctgctgtcactgtcgcagggtcctcagcctcccaaccttccacttggggtgcccatctccagcccgggcttcaaactgctgctgagggggggctgggagccaggaatggggctgggaccccggggtgagggccgtgccaatcccatccccactgtcctcaagagggaccaggaaggactaggctacagatcagcaccccagccccgagtgacacatttcccagcttgggatacccgagctgtggctgggagggagagaccccctcgggtggccacactgagctggagggaggagagaaggagggaggagaaagacagggcttgggagcgggatctaaggacttacatgaacctcgagttctgactttggtaaagtctgaccctagtctgctgctgaagtctgaacttgggcctctgacctgggccctttgacttccccttcctgggatctgctcagatgcagatcctgaagtttttggtcaataggctctgtcttcgtgagagacgggctgagagtcagaaataaatcaaccatttgtggtttattcacttttctggaagctattttgaggaagccaaacagaagcctgggagccacatgcaagtcccacctgagtcagaaggggcagcctctccaggtggcatgataaggtcacctccctgccaatctgggttcactttcaggtcccagaccctcctgggagtcccccacctattctttcaacccccctggaccaagaattgcccagcttcgtgcaagtctcacttcccccaggaggagttccctgactacagccaattcactgatttcacaaacataagtccatatactatgtgccaagaatacaggtaaagacattcccaaccctcaaagagttcacagctggagagggaaagtgccatgttatcaatttttttcttttttttttgagatgcagtttcgctctcattgcccaggctggagtgcaatggcatgatctcggctcaccacaacctctgccccccgagttcaagggattctcctgcctcagcctccccagtagctgggattacaggcatgccccaccacgcccagctaattttgtatttttagtagagacggggtttctccatgttggccaagctggtcttgaactcccgacctcaggtgatccgccggcctcggcttcccaaagtgctggggttgcaggcatgagccaccactcccggcccatgttatcaaatattataatgcagggtgataagggaagtcaaggcctctagagatgagaatgggtagggttttgctggaagaggccagtgtgataggaaggcccacgattatcaagcttgtacacttagttgaactgggaccagaactctagcccccaaatctaaactttaaacttctttgttccaccc

SEQ ID NO: 11421 - DNA, 1598 bp, Homo sapiens
cagagacccttgacgggcatactgtttcctccgggctcctgcctcatgaggggagaggtgcggcttggctccaatggcgccattttgcggtacggaagctacacagcaacacgtataggagactctccccgagatcttctagggagtgacccatctatttttgtttgggaagaggaaactccgaaatgggatcgcggaagacttaaagggccaggctgatttttttttcctactgcaggtctctgaggctgtggttgctacagggtcaccacgagcttggcttacttgtctcatccttcccttgcctggtatcattttctcagttctcccaaaagccatgtcccggcccttgctcatcaccttcaccccagccactgaccccagcgacctctggaaggatgggcagcagcagccacagcccgagaagccagagtccaccctggatggggctgcagccctagctttctatgaggccctgattggggatgagagcagcgctcctgactcccagagatctcagactgaacctgccagagaaagaaagagaaagaaaagaagaataatgaaggcaccagcagcagaagcagtggcagaaggagcatcaggaagacatggacaagggagatcccttgaggctgaggataagatgactcaccggatactgagggcagcccaggagggggacctgccagaacttaggagactgctggaaccgcatgaggcaggaggagctggggggaatatcaacgcccgggatgccttctggtggaccccactgatgtgtgctgctcgagcgggccagggggcagctgtgagctatctcctgggccgtggggctgcctgggtgggggtctgtgagctgagtggcagggatgcggctcagctcgctgaagaagctggcttccctgaggtagcccgcatggtcagggagagccatggagagacaaggagcccggaaaaccggtctcctactccctccctccagtactgcgagaactgtgacacccacttccaagattccaaccaccgcacatccactgctcacctgctgtcactgtcgcagggtcctcagcctcccaaccttccacttggggtgcccatctccagcccgggcttcaaactgctgctgagggggggctgggagccaggaatggggctgggaccccggggtgagggccgtgccaatcccatccccactgtcctcaagagagaccaggaaggactaggctacagatcagcaccccagccccgagtgacacatttcccagcttgggatacccgagctgtggctgggagggagagaccccctcgggtggccacactgagctggagggaggagagaaggagggaggagaaagacagggcttgggagcgggatctaaggacttacatgaacctcgagttctgactttggtaaagtctgaccctagtctgctgctgaagtctgaacttgggcctctgacctgggccctttgacttccccttcctgggatctgcccagatgcagatcctgaagtttttggtcaataggctctgtcttcgtgagagacgggctgagagtcagaaataaatcaaccatttgtggtttattcactttt

SEQ ID NO: 11422 - DNA, 1814 bp, Homo sapiens
ggtatggcgttcggggcccgggagtctgggcaatacagttttgtgctcactgggtgaagaggctgacttagggcggggaaaggagggagccaggctggatctctttccgcagctctcctcacgttcccctctagtcccggcgaggcgctgctgcccaggggactggcctatcctcggccaatccgctgggtccttattgcctgttgggcccctagtgcgaatcagtcccgccagagacccttgacgggcatactgtttcctccgggctcctgcctcatgaggggagagaatggcgccattttgcggtacggaagctacacagcaacacgtataggagactctccccgagatcttctagggagtgacccatctatttttgtttgggaagaggaaactccgaaatgggatcgcggaagacttaaagggccaggctgatttttttttcctactgcaggtctctgaggctgtggttgctacagggtcaccacgagcttggcttacttgtctcatccttcccttgcctggtatcattttctcagttctcccaaaagccatgtcccggcccttgctcatcaccttcaccccagccactgaccccagcgacctctggaaggatgggcagcagcagccacagcccgagaagccagagtccaccctggatggggctgcagccctagctttctatgaggccctgattggggatgagagcagcgctcctgactcccagagatctcagactgaacctgccagagaaagaaagagaaagaaaagaagaataatgaaggcaccagcagcagaagcagtggcagaaggagcatcaggaagacatggacaagggagatcccttgaggctgaggataagatgactcaccggatactgagggcagcccaggagggggacctgccagaacttaggagactgctggaaccgcatgaggcaggaggagctggggggaatatcaacgcccgggatgccttctggtggaccccactgatgtgtgctgctcgagcgggccagggggcagctgtgagctatctcctgggccgtggggctgcctgggtgggggtctgtgagctgagtggcagggatgcggctcagctcgctgaagaagctggcttccctgaggtagcccgcatggtcagggagagccatggagagacaaggagcccggaaaaccggtctcctactccctccctccagtactgcgagaactgtgacacccacttccaagattccaaccaccgcacatccactgctcacctgctgtcactgtcgcagggtcctcagcctcccaaccttccacttggggtgcccatctccagcccgggcttcaaactgctgctgagggggggctgggagccaggaatggggctgggaccccggggtgagggccgtgccaatcccatccccactgtcctcaagagagaccaggaaggactaggctacagatcagcaccccagccccgagtgacacatttcccagcttgggatacccgagctgtggctgggagggagagaccccctcgggtggccacactgagctggagggaggagagaaggagggaggagaaagacagggcttgggagcgggatctaaggacttacatgaacctcgagttctgactttggtaaagtctgaccctagtctgctgctgaagtctgaacttgggcctctgacctgggccctttgacttccccttcctgggatctgcccagatgcagatcctgaagtttttggtcaataggctctgtcttcgtgagagacgggctgagagtcagaaataaatcaaccatttgtggtttattcactttt

SEQ ID NO: 11423 - DNA, 1910 bp, Homo sapiens
aggcgtgacgttatttcattacacggcttctcggcattccacaggtttccctccgcctcctgagggcctttcctaacccacagagtggattcctggctccagaaaatgggcttggagcgggggccacgttgaggaaggcgaagggcattgtgggggcgttatgtaaaagtaggaccccaaccgacagatcctagtgctcgcgccacctgggcgcgcggagctttgctcgtttactattgaaaaagttccagcgcgggaaactgaacccggagctttgcgcacgcccgagccctcaagtaatgtgggttgtggtttttgttgttgttgtcgccacgcatgcgtcttcgtgccgtgtggctatttgattgtgtcaactcttctgattagaatggcgccattttgcggtacggaagctacacagcaacacgtataggagactctccccgagatcttctagggagtgacccatctatttttgtttgggaagaggaaactccgaaatgggatcgcggaagacttaaagggccaggctgatttttttttcctactggtctctgaggctgtggttgctacagggtcaccacgagcttggcttacttgtctcatccttcccttgcctggtatcattttctcagttctcccaaaagccatgtcccggcccttgctcatcaccttcaccccagccactgaccccagcgacctctggaaggatgggcagcagcagccacagcccgagaagccagagtccaccctggatggggctgcagccctagctttctatgaggccctgattggggatgagagcagcgctcctgactcccagagatctcagactgaacctgccagagaaagaaagagaaagaaaagaagaataatgaaggcaccagcagcagaagcagtggcagaaggagcatcaggaagacatggacaagggagatcccttgaggctgaggataagatgactcaccggatactgagggcagcccaggagggggacctgccagaacttaggagactgctggaaccgcatgaggcaggaggagctggggggaatatcaacgcccgggatgccttctggtggaccccactgatgtgtgctgctcgagcgggccagggggcagctgtgagctatctcctgggccgtggggctgcctgggtgggggtctgtgagctgagtggcagggatgcggctcagctcgctgaagaagctggcttccctgaggtagcccgcatggtcagggagagccatggagagacaaggagcccggaaaaccggtctcctactccctccctccagtactgcgagaactgtgacacccacttccaagattccaaccaccgcacatccactgctcacctgctgtcactgtcgcagggtcctcagcctcccaaccttccacttggggtgcccatctccagcccgggcttcaaactgctgctgagggggggctgggagccaggaatggggctgggaccccggggtgagggccgtgccaatcccatccccactgtcctcaagagagaccaggaaggactaggctacagatcagcaccccagccccgagtgacacatttcccagcttgggatacccgagctgtggctgggagggagagaccccctcgggtggccacactgagctggagggaggagagaaggagggaggagaaagacagggcttgggagcgggatctaaggacttacatgaacctcgagttctgactttggtaaagtctgaccctagtctgctgctgaagtctgaacttgggcctctgacctgggccctttgacttccccttcctgggatctgcccagatgcagatcctgaagtttttggtcaataggctctgtcttcgtgagagacgggctgagagtcagaaataaatcaaccatttgtggtttattcactttt

SEQ ID NO: 11424 - DNA, 1800 bp, Homo sapiens
cggggcccgggagtctgggcaatacagttttgtgctcactgggtgaagaggctgacttagggcggggaaaggagggagccaggctggatctctttccgcagctctcctcacgttcccctctagtcccggcgaggcgctgctgcccaggggactggcctatcctcggccaatccgctgggtccttattgcctgttgggcccctagtgcgaatcagtcccgccagagacccttgacgggcatactgtttcctccgggctcctgcctcatgaggggagagaatggcgccattttgcggtacggaagctacacagcaacacgtataggagactctccccgagatcttctagggagtgacccatctatttttgtttgggaagaggaaactccgaaatgggatcgcggaagacttaaagggccaggctgatttttttttcctactggtctctgaggctgtggttgctacagggtcaccacgagcttggcttacttgtctcatccttcccttgcctggtatcattttctcagttctcccaaaagccatgtcccggcccttgctcatcaccttcaccccagccactgaccccagcgacctctggaaggatgggcagcagcagccacagcccgagaagccagagtccaccctggatggggctgcagccctagctttctatgaggccctgattggggatgagagcagcgctcctgactcccagagatctcagactgaacctgccagagaaagaaagagaaagaaaagaagaataatgaaggcaccagcagcagaagcagtggcagaaggagcatcaggaagacatggacaagggagatcccttgaggctgaggataagatgactcaccggatactgagggcagcccaggagggggacctgccagaacttaggagactgctggaaccgcatgaggcaggaggagctggggggaatatcaacgcccgggatgccttctggtggaccccactgatgtgtgctgctcgagcgggccagggggcagctgtgagctatctcctgggccgtggggctgcctgggtgggggtctgtgagctgagtggcagggatgcggctcagctcgctgaagaagctggcttccctgaggtagcccgcatggtcagggagagccatggagagacaaggagcccggaaaaccggtctcctactccctccctccagtactgcgagaactgtgacacccacttccaagattccaaccaccgcacatccactgctcacctgctgtcactgtcgcagggtcctcagcctcccaaccttccacttggggtgcccatctccagcccgggcttcaaactgctgctgagggggggctgggagccaggaatggggctgggaccccggggtgagggccgtgccaatcccatccccactgtcctcaagagagaccaggaaggactaggctacagatcagcaccccagccccgagtgacacatttcccagcttgggatacccgagctgtggctgggagggagagaccccctcgggtggccacactgagctggagggaggagagaaggagggaggagaaagacagggcttgggagcgggatctaaggacttacatgaacctcgagttctgactttggtaaagtctgaccctagtctgctgctgaagtctgaacttgggcctctgacctgggccctttgacttccccttcctgggatctgcccagatgcagatcctgaagtttttggtcaataggctctgtcttcgtgagagacgggctgagagtcagaaataaatcaaccatttgtggtttattcactttt

SEQ ID NO: 11425 - DNA, 2798 bp, Homo sapiens
cacatcaaagtccggagaccccatgtgccgctcccagcgacaagggactcggagcagcgacgacttcagactcaccggctggacggggaccaggactggggtggggtagggaagttgctacttccagggaacggcggcgaccgctacagcgcaggccgcggacccgaccgcggcaggcgaagtggggtggggggagtggaaattagggagggtggggaagagggcaacacgcaagcgccaagggtcaggtgccgcggtggatgccgggacacggagtccccggtagagaaagaaactggctaaatgagagaaagcgaactaccaatcccaggatgacccgcgcacgacctggctgtcacgaaggcccggaggagggcgcttgcgggcggggcacaacgagaagccaccggaagcggaagccagaatggcgccattttgcggtacggaagctacacagcaacacgtataggagactctccccgagatcttctagggagtgacccatctatttttgtttgggaagaggaaactccgaaatgggatcgcggaagacttaaagggccaggctgatttttttttcctactggtctctgaggctgtggttgctacagggtcaccacgagcttggcttacttgtctcatccttcccttgcctggtatcattttctcagttctcccaaaagccatgtcccggcccttgctcatcaccttcaccccagccactgaccccagcgacctctggaaggatgggcagcagcagccacagcccgagaagccagagtccaccctggatggggctgcagccctagctttctatgaggccctgattggggatgagagcagcgctcctgactcccagagatctcagactgaacctgccagagaaagaaagagaaagaaaagaagaataatgaaggcaccagcagcagaagcagtggcagaaggagcatcaggaagacatggacaagggagatcccttgaggctgaggataagatgactcaccggatactgagggcagcccaggagggggacctgccagaacttaggagactgctggaaccgcatgaggcaggaggagctggggggaatatcaacgcccgggatgccttctggtggaccccactgatgtgtgctgctcgagcgggccagggggcagctgtgagctatctcctgggccgtggggctgcctgggtgggggtctgtgagctgagtggcagggatgcggctcagctcgctgaagaagctggcttccctgaggtagcccgcatggtcagggagagccatggagagacaaggagcccggaaaaccggtctcctactccctccctccagtactgcgagaactgtgacacccacttccaagattccaaccaccgcacatccactgctcacctgctgtcactgtcgcagggtcctcagcctcccaaccttccacttggggtgcccatctccagcccgggcttcaaactgctgctgagggggggctgggagccaggaatggggctgggaccccggggtgagggccgtgccaatcccatccccactgtcctcaagagagaccaggaaggactaggctacagatcagcaccccagccccgagtgacacatttcccagcttgggatacccgagctgtggctgggagggagagaccccctcgggtggccacactgagctggagggaggagagaaggagggaggagaaagacagggcttgggagcgggatctaaggacttacatgaacctcgagttctgactttggtaaagtctgaccctagtctgctgctgaagtctgaacttgggcctctgacctgggccctttgacttccccttcctgggatctgcccagatgcagatcctgaagtttttggtcaataggctctgtcttcgtgagagacgggctgagagtcagaaataaatcaaccatttgtggtttattcacttttctggaagctattttgaggaagccaaacagaagcctgggagccacatgcaagtcccacctgagtcagaaggggcagcctctccaggtggcatgataaggtcacctccctgccaatctgggttcactttcaggtcccagaccctcctgggagtcccccacctattctttcaacccccctggaccaagaattgcccagcttcgtgcaagtctcacttcccccaggaggagttccctgactacagccaattcactgattcacaaacataagtccatatactatgtgccaagaatacaggtaaagacattcccaaccctcaaagagttcacagctggagagggaaagtgccatgttatcaatttttttctttttttttttgagatgcagtttcgctctcattgcccaggctggagtgcaatggcatgatctcggctcaccacaacctctgccccccgagttcaagggattctcctgcctcagcctccccagtagctgggattacaggcatgccccaccacgcccagctaattttgtatttttagtagagacggggtttctccatgttggccaagctggtcttgaactcccgacctcaggtgatccgccggcctcggcttcccaaagtgctggggttgcaggcatgagccaccactcccggcccatgttatcaaatattataatgcagggtgataagggaagtcaaggcctctagagatgagaatgggtagggttttgctggaagaggccagtgtgataggagggcccacgattatcaagcttgtacacttagttgaactgggaccagaactctagcccccaaatctaaactttaagtcaaacttctttgttccaccc

SEQ ID NO: 11426 - DNA, 802 bp, Homo sapiens
cttaggctctaagtgtgaccttcgaaccctggtcagagtaatgaatggcgccattttgcggtacggaagctacacagcaacacgtataggagactctccccgagatcttctagggagtgacccatctatttttgtttgggaagaggaaactccgaaatgggatcgcggaagacttaaagggccaggctgatttttttttcctactgcaggtctctgaggctgtggttgctacagggtcaccacgagcttggcttacttgtctcatccttcccttgcctggtatcattttctcagttctcccaaaagccatgtcccggcccttgctcatcaccttcaccccagccactgaccccagcgacctctggaaggatgggcagcagcagccacagcccgagaagccagagtccaccctggatggggctgcagcccgagctttctatgaggccctgattggggatgagagcagcgctcctgactcccagagatctcagactgaacctgccagagaaagaaagagaaagaaaagaagaataatgaaggcaccagcagcagaagcagtggcagaaggagcatcaggaagacatggacaagggagatcccttgaggctgaggataagatgactcaccggatactgagggcagcccaggagggggacctgccagaacttaggagactgctggaaccgcatgaggcaggaggagctggggggaatatcaacgcccgggatgccttctggtggaccccactgatgtgtgctgctcgagcgggccagggggcagctgtgagctatctcctgggccg

SEQ ID NO: 11427 - DNA, 822 bp, Homo sapiens
cgccacctgggcgcgcggagctttgctcgtttactattgaaaaagttccagcgcgggaaactgaacccggagctttgcgcacgcccgagccctcaagtaataatggcgccattttgcggtacggaagctacacagcaacacgtataggagactctccccgagatcttctagggagtgacccatctatttttgtttgggaagaggaaactccgaaatgggatcgcggaagacttaaagggccaggctgatttttttttcctactgcaggtctctgaggctgtggttgctacagggtcaccacgagcttggcttacttgtctcatccttcccttgcctggtatcattttctcagttctcccaaaagccatgtcccggcccttgctcatcaccttcaccccagccactgaccccagcgacctctggaaggatgggcagcagcagccacagcccgagaagccagagtccaccctggatggggctgcagccctagctttctatgaggccctgattggggatgagagcagcgctcctgactcccagagatctcagactgaacctgccagagaaagaaagagaaagaaaagaagaataatgaaggcaccagcagcagaagcagtggcagaaggagcatcaggaagacatggacaagggagatcccttgaggctgaggataagatgactcaccggatactgagggcagcccaggagggggacctgccagaacttaggagactgctggaaccgcatgaggcaggaggagctggggggaatatcaacgcccgggatgccttctggtggaccccactgatgtgtgctgctcga

SEQ ID NO: 11428 - DNA, 1814 bp, Homo sapiens; identical to SEQ ID NO: 11422

SEQ ID NO: 11429 - DNA, 822 bp, Homo sapiens
cgccacctgggcgcgcggagctttgctcgtttactattgaaaaagttccagcgcgggaaactgaacccggagctttgcgcacgcccgagccctcaagtaataatggcgccattttgcggtacggaagctacacagcaacacgtataggagactctccccgagatcttctagggagtgacccatctatttttgtttgggaagaggaaactccgaaatgggatcgcggaagacttaaagggccaggctgatttttttttcctactgcaggtctctgaggctgtggttgctacagggtcaccacgagcttggcttacttgtctcatccttcccttgcctggtatcattttctcagttctcccaaaagccatgtcccggcccttgctcatcaccttcaccccagccactgaccccagcgacctctggaaggatgggcagcagcagccacagcccgagaagccagagtccaccctggatggggctgcagcccgagctttctatgaggccctgattggggatgagagcagcgctcctgactcccagagatctcagactgaacctgccagagaaagaaagagaaagaaaagaagaataatgaaggcaccagcagcagaagcagtggcagaaggagcatcaggaagacatggacaagggagatcccttgaggctgaggataagatgactcaccggatactgagggcagcccaggagggggacctgccagaacttaggagactgctggaaccgcatgaggcaggaggagctggggggaatatcaacgcccgggatgccttctggtggaccccactgatgtgtgctgctcga

SEQ ID NO: 11430 - DNA, 802 bp, Homo sapiens
cttaggctctaagtgtgaccttcgaaccctggtcagagtaatgaatggcgccattttgcggtacggaagctacacagcaacacgtataggagactctccccgagatcttctagggagtgacccatctatttttgtttgggaagaggaaactccgaaatgggatcgcggaagacttaaagggccaggctgatttttttttcctactgcaggtctctgaggctgtggttgctacagggtcaccacgagcttggcttacttgtctcatccttcccttgcctggtatcattttctcagttctcccaaaagccatgtcccggcccttgctcatcaccttcaccccagccactgaccccagcgacctctggaaggatgggcagcagcagccacagcccgagaagccagagtccaccctggatggggctgcagccctagctttctatgaggccctgattggggatgagagcagcgctcctgactcccagagatctcagactgaacctgccagagaaagaaagagaaagaaaagaagaataatgaaggcaccagcagcagaagcagtggcagaaggagcatcaggaagacatggacaagggagatcccttgaggctgaggataagatgactcaccggatactgagggcagcccaggagggggacctgccagaacttaggagactgctggaaccgcatgaggcaggaggagctggggggaatatcaacgcccgggatgccttctggtggaccccactgatgtgtgctgctcgagcgggccagggggcagctgtgagctatctcctgggccg

SEQ ID NO: 11431 - DNA, 627 bp, Homo sapiens
cctgggcgcgcggagctttgctcgtttactattgaaaaagttccagcgcgggaaactgaacccggagctttgcgcacgcccgagccctcaagtaataatggcgccattttgcggtacggaagctacacagcaacacgtataggagactctccccgagatcttctagggagtgacccatctatttttgtttgggaagaggaaactccgaaatgggatcgcggaagacttaaagggccaggctgatttttttttcctactggtctctgaggctgtggttgctacagggtcaccacgagcttggcttacttgtctcatccttcccttgcctggtatcattttctcagttctcccaaaagccatgtcccggcccttgctcatcaccttcaccccagccactgaccccagcgacctctggaaggatgggcagcagcagccacagcccgagaagccagagtccaccctggatggggctgcagccctagctttctatgaggccctgattggggatgagagcagcgctcctgactcccagagatctcagactgaacctgccagagaaagaaagagaaagaaaagaagaataatgaaggcaccagcagcagaagcagtggcagaaggagcatcagg

SEQ ID NO: 11432 - DNA, 2793 bp, Homo sapiens; identical to SEQ ID NO: 11420

SEQ ID NO: 11433 - DNA, 1814 bp, Homo sapiens; identical to SEQ ID NO: 11419

SEQ ID NO: 11434 - DNA, 751 bp, Homo sapiens
gggcaatacagttttgtgctcactgggtgaagaggctgacttagggcggggaaaggagggagccaggctggatctctttccgcagctctcctcacgttcccctctagtcccggcgcggcgctgctgcccaggggactggcctatcctcggccaatccgctgggtccttattgcctgttgggcccctagtgcgaatcagtcccgccagagacccttgacgggcatactgtttcctccgggctcctgcctcatgaggggagaggaagaggaaactccgaaatgggatcgcggaagacttaaagggccaggctgatttttttttcctactgcaggtctctgaggctgtggttgctacagggtcaccacgagcttggcttacttgtctcatccttcccttgcctggtatcattttctcagttctcccaaaagccatgtcccggcccttgctcatcaccttcaccccagccactgaccccagcgacctctggaaggatgggcagcagcagccacagcccgagaagccagagtccaccctggatggggctgcagcccgagctttctatgaggccctgattggggatgagagcagcgctcctgactcccagagatctcagactgaacctgccagagaaagaaagagaaagaaaagaagaataatgaaggcaccagcagcagaagcagtggcagaaggagcatcaggaagacatggacaagggagatcccttgaggctgaggataagatgactcaccgg

SEQ ID NO: 11435 - DNA, 751 bp, Homo sapiens
gggcaatacagttttgtgctcactgggtgaagaggctgacttagggcggggaaaggagggagccaggctggatctctttccgcagctctcctcacgttcccctctagtcccggcgaggcgctgctgcccaggggactggcctatcctcggccaatccgctgggtccttattgcctgttgggcccctagtgcgaatcagtcccgccagagacccttgacgggcatactgtttcctccgggctcctgcctcatgaggggagaggaagaggaaactccgaaatgggatcgcggaagacttaaagggccaggctgatttttttttcctactgcaggtctctgaggctgtggttgctacagggtcaccacgagcttggcttacttgtctcatccttcccttgcctggtatcattttctcagttctcccaaaagccatgtcccggcccttgctcatcaccttcaccccagccactgaccccagcgacctctggaaggatgggcagcagcagccacagcccgagaagccagagtccaccctggatggggctgcagccctagctttctatgaggccctgattggggatgagagcagcgctcctgactcccagagatctcagactgaacctgccagagaaagaaagagaaagaaaagaagaataatgaaggcaccagcagcagaagcagtggcagaaggagcatcaggaagacatggacaagggagatcccttgaggctgaggataagatgactcaccgg

SEQ ID NO: 11436 - DNA, 1910 bp, Homo sapiens; identical to SEQ ID NO: 11418

SEQ ID NO: 11437 - DNA, 1598 bp, Homo sapiens
cagagacccttgacgggcatactgtttcctccgggctcctgcctcatgaggggagaggtgcggcttggctccaatggcgccattttgcggtacggaagctacacagcaacacgtataggagactctccccgagatcttctagggagtgacccatctatttttgtttgggaagaggaaactccgaaatgggatcgcggaagacttaaagggccaggctgatttttttttcctactgcaggtctctgaggctgtggttgctacagggtcaccacgagcttggcttacttgtctcatccttcccttgcctggtatcattttctcagttctcccaaaagccatgtcccggcccttgctcatcaccttcaccccagccactgaccccagcgacctctggaaggatgggcagcagcagccacagcccgagaagccagagtccaccctggatggggctgcagcccgagctttctatgaggccctgattggggatgagagcagcgctcctgactcccagagatctcagactgaacctgccagagaaagaaagagaaagaaaagaagaataatgaaggcaccagcagcagaagcagtggcagaaggagcatcaggaagacatggacaagggagatcccttgaggctgaggataagatgactcaccggatactgagggcagcccaggagggggacctgccagaacttaggagactgctggaaccgcatgaggcaggaggagctggggggaatatcaacgcccgggatgccttctggtggaccccactgatgtgtgctgctcgagcgggccagggggcagctgtgagctatctcctgggccgtggggctgcctgggtgggggtctgtgagctgagtggcagggatgcggctcagctcgctgaagaagctggcttccctgaggtagcccgcatggtcagggagagccatggagagacaaggagcccggaaaaccggtctcctactccctccctccagtactgcgagaactgtgacacccacttccaagattccaaccaccgcacatccactgctcacctgctgtcactgtcgcagggtcctcagcctcccaaccttccacttggggtgcccatctccagcccgggcttcaaactgctgctgaggcggggctgggagccaggaatggggctgggaccccggggtgagggccgtgccaatcccatccccactgtcctcaagagggaccaggaaggactaggctacagatcagcaccccagccccgagtgacacatttcccagcttgggatacccgagctgtggctgggagggagagaccccctcgggtggccacactgagctggagggaggagagaaggagggaggagaaagacagggcttgggagcgggatctaaggacttacatgaacctcgagttctgactttggtaaagtctgaccctagtctgctgctgaagtctgaacttgggcctctgacctgggccctttgacttccccttcctgggatctgctcagatgcagatcctgaagtttttggtcaataggctctgtcttcgtgagagacgggctgagagtcagaaataaatcaaccatttgtggtttattcactttt

SEQ ID NO: 11438 - DNA, 2794 bp, Homo sapiens
cacatcaaagtccggagaccccatgtgccgctcccagcgacaagggactcggagcagcgacgacttcagactcaccggctggacggggaccaggactggggtggggtagggaagttgctacttccagggaacggcggcgaccgctacagcgcaggccgcggacccgaccgcggcaggcgaagtggggtggggggagtggaaattagggagggtggggaagagggcaaacacgcaagcgccaagggtcaggtgccgcggtggatgccgggacacggagtccccggtagagaaagaaactggctaaatgagagaaagcgaactaccaatcccaggatgacccgcgcacgacctggctgtcacgaaggcccggaggagggcgcttgcgggcggggcacaacgagaagccaccggaagcggaagccagaatggcgccattttgcggtacggaagctacacagcaacacgtataggagactctccccgagatcttctagggagtgacccatctatttttgtttgggaagaggaaactccgaaatgggatcgcggaagacttaaagggccaggctgatttttttttcctactggtctctgaggctgtggttgctacagggtcaccacgagcttggcttacttgtctcatccttcccttgcctggtatcattttctcagttctcccaaaagccatgtcccggcccttgctcatcaccttcaccccagccactgaccccagcgacctctggaaggatgggcagcagcagccacagcccgagaagccagagtccaccctggatggggctgcagcccgagctttctatgaggccctgattggggatgagagcagcgctcctgactcccagagatctcagactgaacctgccagagaaagaaagagaaagaaaagaagaataatgaaggcaccagcagcagaagcagtggcagaaggagcatcaggaagacatggacaagggagatcccttgaggctgaggataagatgactcaccggatactgagggcagcccaggagggggacctgccagaacttaggagactgctggaaccgcatgaggcaggaggagctggggggaatatcaacgcccgggatgccttctggtggaccccactgatgtgtgctgctcgagcgggccagggggcagctgtgagctatctcctgggccgtggggctgcctgggtgggggtctgtgagctgagtggcagggatgcggctcagctcgctgaagaagctggcttccctgaggtagcccgcatggtcagggagagccatggagagacaaggagcccggaaaaccggtctcctactccctccctccagtactgcgagaactgtgacacccacttccaagattccaaccaccgcacatccactgctcacctgctgtcactgtcgcagggtcctcagcctcccaaccttccacttggggtgcccatctccagcccgggcttcaaactgctgctgaggcggggctgggagccaggaatggggctgggaccccggggtgagggccgtgccaatcccatccccactgtcctcaagagggaccaggaaggactaggctacagatcagcaccccagccccgagtgacacatttcccagcttgggatacccgagctgtggctgggagggagagaccccctcgggtggccacactgagctggagggaggagagaaggagggaggagaaagacagggcttgggagcgggatctaaggacttacatgaacctcgagttctgactttggtaaagtctgaccctagtctgctgctgaagtctgaacttgggcctctgacctgggccctttgacttccccttcctgggatctgctcagatgcagatcctgaagtttttggtcaataggctctgtcttcgtgagagacgggctgagagtcagaaataaatcaaccatttgtggtttattcacttttctggaagctattttgaggaagccaaacagaagcctgggagccacatgcaagtcccacctgagtcagaaggggcagcctctccaggtggcatgataaggtcacctccctgccaatctgggttcactttcaggtcccagaccctcctgggagtcccccacctattctttcaacccccctggaccaagaattgcccagcttcgtgcaagtctcacttcccccaggaggagttccctgactacagccaattcactgatttcacaaacataagtccatatactatgtgccaagaatacaggtaaagacattcccaaccctcaaagagttcacagctggagagggaaagtgccatgttatcaatttttttcttttttttttgagatgcagtttcgctctcattgcccaggctggagtgcaatggcatgatctcggctcaccacaacctctgccccccgagttcaagggattctcctgcctcagcctccccagtagctgggattacaggcatgccccaccacgcccagctaattttgtatttttagtagagacggggtttctccatgttggccaagctggtcttgaactcccgacctcaggtgatccgccggcctcggcttcccaaagtgctggggttgcaggcatgagccaccactcccggcccatgttatcaaatattataatgcagggtgataagggaagtcaaggcctctagagatgagaatgggtagggttttgctggaagaggccagtgtgataggaaggcccacgattatcaagcttgtacacttagttgaactgggaccagaactctagcccccaaatctaaactttaaacttctttgttccaccc

SEQ ID NO: 11439 - DNA, 802 bp, Homo sapiens; identical to SEQ ID NO: 11426

SEQ ID NO: 11440 - DNA, 1814 bp, Homo sapiens; identical to SEQ ID NO: 11419

SEQ ID NO: 11441 - DNA, 986 bp, Homo sapiens
gacttagggcggggaaaggagggagccaggctggatctctttccgcagctctcctcacgttcccctctagtcccggcgcggcgctgctgcccaggggactggcctatcctcggccaatccgctgggtccttattgcctgttgggcccctagtgcgaatcagtcccgccagagacccttgacgggcatactgtttcctccgggctcctgcctcatgaggggagaggaagaggaaactccgaaatgggatcgcggaagacttaaagggccaggctgatttttttttcctactggtctctgaggctgtggttgctacagggtcaccacgagcttggcttacttgtctcatccttcccttgcctggtatcattttctcagttctcccaaaagccatgtcccggcccttgctcatcaccttcaccccagccactgaccccagcgacctctggaaggatgggcagcagcagccacagcccgagaagccagagtccaccctggatggggctgcagcccgagctttctatgaggccctgattggggatgagagcagcgctcctgactcccagagatctcagactgaacctgccagagaaagaaagagaaagaaaagaagaataatgaaggcaccagcagcagaagcagtggcagaaggagcatcaggaagacatggacaagggagatcccttgaggctgaggataagatgactcaccggatactgagggcagcccaggagggggacctgccagaacttaggagactgctggaaccgcatgaggcaggaggagctggggggaatatcaacgcccgggatgccttctggtggaccccactgatgtgtgctgctcgagcgggccagggggcagctgtgagctatctcctgggccgtggggctgcctgggtgggggtctgtgagctgagtggcagggatgcggctcagctcgctgaagaagctggcttccctgaggtagcccgcatggtcagggagag

SEQ ID NO: 11442 - DNA, 1800 bp, Homo sapiens
cggggcccgggagtctgggcaatacagttttgtgctcactgggtgaagaggctgacttagggcggggaaaggagggagccaggctggatctctttccgcagctctcctcacgttcccctctagtcccggcgcggcgctgctgcccgggggactggcctatcctcggccaatccgctgggtccttattgcctgttgggcccctagtgcgaatcagtcccgccagagacccttgacgggcatactgtttcctccgggctcctgcctcatgaggggagagaatggcgccattttgcggtacggaagctacacagcaacacgtataggagactctccccgagatcttctagggagtgacccatctatttttgtttgggaagaggaaactccgaaatgggatcgcggaagacttaaagggccaggctgatttttttttcctactggtctctgaggctgtggttgctacagggtcaccacgagcttggcttacttgtctcatccttcccttgcctggtatcattttctcagttctcccaaaagccatgtcccggcccttgctcatcaccttcaccccagccactgaccccagcgacctctggaaggatgggcagcagcagccacagcccgagaagccagagtccaccctggatggggctgcagcccgagctttctatgaggccctgattggggatgagagcagcgctcctgactcccagagatctcagactgaacctgccagagaaagaaagagaaagaaaagaagaataatgaaggcaccagcagcagaagcagtggcagaaggagcatcaggaagacatggacaagggagatcccttgaggctgaggataagatgactcaccggatactgagggcagcccaggagggggacctgccagaacttaggagactgctggaaccgcatgaggcaggaggagctggggggaatatcaacgcccgggatgccttctggtggaccccactgatgtgtgctgctcgagcgggccagggggcagctgtgagctatctcctgggccgtggggctgcctgggtgggggtctgtgagctgagtggcagggatgcggctcagctcgctgaagaagctggcttccctgaggtagcccgcatggtcagggagagccatggagagacaaggagcccggaaaaccggtctcctactccctccctccagtactgcgagaactgtgacacccacttccaagattccaaccaccgcacatccactgctcacctgctgtcactgtcgcagggtcctcagcctcccaaccttccacttggggtgcccatctccagcccgggcttcaaactgctgctgaggcggggctgggagccaggaatggggctgggaccccggggtgagggccgtgccaatcccatccccactgtcctcaagagggaccaggaaggactaggctacagatcagcaccccagccccgagtgacacatttcccagcttgggatacccgagctgtggctgggagggagagaccccctcgggtggccacactgagctggagggaggagagaaggagggaggagaaagacagggcttgggagcgggatctaaggacttacatgaacctcgagttctgactttggtaaagtctgaccctagtctgctgctgaagtctgaacttgggcctctgacctgggccctttgacttccccttcctgggatctgctcagatgcagatcctgaagtttttggtcaataggctctgtcttcgtgagagacgggctgagagtcagaaataaatcaaccatttgtggtttattcactttt

SEQ ID NO: 11443 - DNA, 802 bp, Homo sapiens; identical to SEQ ID NO: 11430

SEQ ID NO: 11444 - DNA, 822 bp, Homo sapiens; identical to SEQ ID NO: 11427

SEQ ID NO: 11445 - DNA, 822 bp, Homo sapiens; identical to SEQ ID NO: 11427

SEQ ID NO: 11446 - DNA, 986 bp, Homo sapiens
gacttagggcggggaaaggagggagccaggctggatctctttccgcagctctcctcacgttcccctctagtcccggcgaggcgctgctgcccaggggactggcctatcctcggccaatccgctgggtccttattgcctgttgggcccctagtgcgaatcagtcccgccagagacccttgacgggcatactgtttcctccgggctcctgcctcatgaggggagaggaagaggaaactccgaaatgggatcgcggaagacttaaagggccaggctgatttttttttcctactggtctctgaggctgtggttgctacagggtcaccacgagcttggcttacttgtctcatccttcccttgcctggtatcattttctcagttctcccaaaagccatgtcccggcccttgctcatcaccttcaccccagccactgaccccagcgacctctggaaggatgggcagcagcagccacagcccgagaagccagagtccaccctggatggggctgcagccctagctttctatgaggccctgattggggatgagagcagcgctcctgactcccagagatctcagactgaacctgccagagaaagaaagagaaagaaaagaagaataatgaaggcaccagcagcagaagcagtggcagaaggagcatcaggaagacatggacaagggagatcccttgaggctgaggataagatgactcaccggatactgagggcagcccaggagggggacctgccagaacttaggagactgctggaaccgcatgaggcaggaggagctggggggaatatcaacgcccgggatgccttctggtggaccccactgatgtgtgctgctcgagcgggccagggggcagctgtgagctatctcctgggccgtggggctgcctgggtgggggtctgtgagctgagtggcagggatgcggctcagctcgctgaagaagctggcttccctgaggtagcccgcatggtcagggagag

SEQ ID NO: 11447 - DNA, 986 bp, Homo sapiens; identical to SEQ ID NO: 11446

SEQ ID NO: 11448 - DNA, 1814 bp, Homo sapiens
ggtatggcgttcggggcccgggagtctgggcaatacagttttgtgctcactgggtgaagaggctgacttagggcggggaaaggagggagccaggctggatctctttccgcagctctcctcacgttcccctctagtcccggcgcggcgctgctgcccgggggactggcctatcctcggccaatccgctgggtccttattgcctgttgggcccctagtgcgaatcagtcccgccagagacccttgacgggcatactgtttcctccgggctcctgcctcatgaggggagagaatggcgccattttgcggtacggaagctacacagcaacacgtataggagactctccccgagatcttctagggagtgacccatctatttttgtttgggaagaggaaactccgaaatgggatcgcggaagacttaaagggccaggctgatttttttttcctactgcaggtctctgaggctgtggttgctacagggtcaccacgagcttggcttacttgtctcatccttcccttgcctggtatcattttctcagttctcccaaaagccatgtcccggcccttgctcatcaccttcaccccagccactgaccccagcgacctctggaaggatgggcagcagcagccacagcccgagaagccagagtccaccctggatggggctgcagcccgagctttctatgaggccctgattggggatgagagcagcgctcctgactcccagagatctcagactgaacctgccagagaaagaaagagaaagaaaagaagaataatgaaggcaccagcagcagaagcagtggcagaaggagcatcaggaagacatggacaagggagatcccttgaggctgaggataagatgactcaccggatactgagggcagcccaggagggggacctgccagaacttaggagactgctggaaccgcatgaggcaggaggagctggggggaatatcaacgcccgggatgccttctggtggaccccactgatgtgtgctgctcgagcgggccagggggcagctgtgagctatctcctgggccgtggggctgcctgggtgggggtctgtgagctgagtggcagggatgcggctcagctcgctgaagaagctggcttccctgaggtagcccgcatggtcagggagagccatggagagacaaggagcccggaaaaccggtctcctactccctccctccagtactgcgagaactgtgacacccacttccaagattccaaccaccgcacatccactgctcacctgctgtcactgtcgcagggtcctcagcctcccaaccttccacttggggtgcccatctccagcccgggcttcaaactgctgctgaggcggggctgggagccaggaatggggctgggaccccggggtgagggccgtgccaatcccatccccactgtcctcaagagggaccaggaaggactaggctacagatcagcaccccagccccgagtgacacatttcccagcttgggatacccgagctgtggctgggagggagagaccccctcgggtggccacactgagctggagggaggagagaaggagggaggagaaagacagggcttgggagcgggatctaaggacttacatgaacctcgagttctgactttggtaaagtctgaccctagtctgctgctgaagtctgaacttgggcctctgacctgggccctttgacttccccttcctgggatctgctcagatgcagatcctgaagtttttggtcaataggctctgtcttcgtgagagacgggctgagagtcagaaataaatcaaccatttgtggtttattcactttt

SEQ ID NO: 11449 - DNA, 1910 bp, Homo sapiens; identical to SEQ ID NO: 11423

SEQ ID NO: 11450 - DNA, 986 bp, Homo sapiens; identical to SEQ ID NO: 11446

SEQ ID NO: 11451 - DNA, 1598 bp, Homo sapiens
cagagacccttgacgggcatactgtttcctccgggctcctgcctcatgaggggagaggtgcggcttggctccaatggcgccattttgcggtacggaagctacacagcaacacgtataggagactctccccgagatcttctagggagtgacccatctatttttgtttgggaagaggaaactccgaaatgggatcgcggaagacttaaagggccaggctgatttttttttcctactgcaggtctctgaggctgtggttgctacagggtcaccacgagcttggcttacttgtctcatccttcccttgcctggtatcattttctcagttctcccaaaagccatgtcccggcccttgctcatcaccttcaccccagccactgaccccagcgacctctggaaggatgggcagcagcagccacagcccgagaagccagagtccaccctggatggggctgcagccctagctttctatgaggccctgattggggatgagagcagcgctcctgactcccagagatctcagactgaacctgccagagaaagaaagagaaagaaaagaagaataatgaaggcaccagcagcagaagcagtggcagaaggagcatcaggaagacatggacaagggagatcccttgaggctgaggataagatgactcaccggatactgagggcagcccaggagggggacctgccagaacttaggagactgctggaaccgcatgaggcaggaggagctggggggaatatcaacgcccgggatgccttctggtggaccccactgatgtgtgctgctcgagcgggccagggggcagctgtgagctatctcctgggccgtggggctgcctgggtgggggtctgtgagctgagtggcagggatgcggctcagctcgctgaagaagctggcttccctgaggtagcccgcatggtcagggagagccatggagagacaaggagcccggaaaaccggtctcctactccctccctccagtactgcgagaactgtgacacccacttccaagattccaaccaccgcacatccactgctcacctgctgtcactgtcgcagggtcctcagcctcccaaccttccacttggggtgcccatctccagcccgggcttcaaactgctgctgagggggggctgggagccaggaatggggctgggaccccggggtgagggccgtgccaatcccatccccactgtcctcaagagggaccaggaaggactaggctacagatcagcaccccagccccgagtgacacatttcccagcttgggatacccgagctgtggctgggagggagagaccccctcgggtggccacactgagctggagggaggagagaaggagggaggagaaagacagggcttgggagcgggatctaaggacttacatgaacctcgagttctgactttggtaaagtctgaccctagtctgctgctgaagtctgaacttgggcctctgacctgggccctttgacttccccttcctgggatctgctcagatgcagatcctgaagtttttggtcaataggctctgtcttcgtgagagacgggctgagagtcagaaataaatcaaccatttgtggtttattcactttt

SEQ ID NO: 11452 - DNA, 986 bp, Homo sapiens; identical to SEQ ID NO: 11441

SEQ ID NO: 11453 - DNA, 1598 bp, Homo sapiens; identical to SEQ ID NO: 11416

SEQ ID NO: 11454 - DNA, 751 bp, Homo sapiens; identical to SEQ ID NO: 11434

SEQ ID NO: 11455 - DNA, 1910 bp, Homo sapiens
aggcgtgacgttatttcattacacggcttctcggcattccacaggtttccctccgcctcctgagggcctttcctaacccacagagtggattcctggctccagaaaatgggcttggagcgggggccacgttgaggaaggcgaagggcattgtgggggcgttatgtaaaagtaggaccccaaccgacagatcctagtgctcgcgccacctgggcgcgcggagctttgctcgtttactattgaaaaagttccagcgcgggaaactgaacccggagctttgcgcacgcccgagccctcaagtaatgtgggttgtggtttttgttgttgttgtcgccacgcatgcgtcttcgtgccgtgtggctatttgattgtgtcaactcttctgattagaatggcgccattttgcggtacggaagctacacagcaacacgtataggagactctccccgagatcttctagggagtgacccatctatttttgtttgggaagaggaaactccgaaatgggatcgcggaagacttaaagggccaggctgatttttttttcctactggtctctgaggctgtggttgctacagggtcaccacgagcttggcttacttgtctcatccttcccttgcctggtatcattttctcagttctcccaaaagccatgtcccggcccttgctcatcaccttcaccccagccactgaccccagcgacctctggaaggatgggcagcagcagccacagcccgagaagccagagtccaccctggatggggctgcagcccgagctttctatgaggccctgattggggatgagagcagcgctcctgactcccagagatctcagactgaacctgccagagaaagaaagagaaagaaaagaagaataatgaaggcaccagcagcagaagcagtggcagaaggagcatcaggaagacatggacaagggagatcccttgaggctgaggataagatgactcaccggatactgagggcagcccaggagggggacctgccagaacttaggagactgctggaaccgcatgaggcaggaggagctggggggaatatcaacgcccgggatgccttctggtggaccccactgatgtgtgctgctcgagcgggccagggggcagctgtgagctatctcctgggccgtggggctgcctgggtgggggtctgtgagctgagtggcagggatgcggctcagctcgctgaagaagctggcttccctgaggtagcccgcatggtcagggagagccatggagagacaaggagcccggaaaaccggtctcctactccctccctccagtactgcgagaactgtgacacccacttccaagattccaaccaccgcacatccactgctcacctgctgtcactgtcgcagggtcctcagcctcccaaccttccacttggggtgcccatctccagcccgggcttcaaactgctgctgaggcggggctgggagccaggaatggggctgggaccccggggtgagggccgtgccaatcccatccccactgtcctcaagagggaccaggaaggactaggctacagatcagcaccccagccccgagtgacacatttcccagcttgggatacccgagctgtggctgggagggagagaccccctcgggtggccacactgagctggagggaggagagaaggagggaggagaaagacagggcttgggagcgggatctaaggacttacatgaacctcgagttctgactttggtaaagtctgaccctagtctgctgctgaagtctgaacttgggcctctgacctgggccctttgacttccccttcctgggatctgctcagatgcagatcctgaagtttttggtcaataggctctgtcttcgtgagagacgggctgagagtcagaaataaatcaaccatttgtggtttattcactttt

SEQ ID NO: 11456 - DNA, 751 bp, Homo sapiens; identical to SEQ ID NO: 11434

SEQ ID NO: 11457 - DNA, 822 bp, Homo sapiens; identical to SEQ ID NO: 11429

SEQ ID NO: 11458 - DNA, 1814 bp, Homo sapiens
ggtatggcgttcggggcccgggagtctgggcaatacagttttgtgctcactgggtgaagaggctgacttagggcggggaaaggagggagccaggctggatctctttccgcagctctcctcacgttcccctctagtcccggcgaggcgctgctgcccaggggactggcctatcctcggccaatccgctgggtccttattgcctgttgggcccctagtgcgaatcagtcccgccagagacccttgacgggcatactgtttcctccgggctcctgcctcatgaggggagagaatggcgccattttgcggtacggaagctacacagcaacacgtataggagactctccccgagatcttctagggagtgacccatctatttttgtttgggaagaggaaactccgaaatgggatcgcggaagacttaaagggccaggctgatttttttttcctactgcaggtctctgaggctgtggttgctacagggtcaccacgagcttggcttacttgtctcatccttcccttgcctggtatcattttctcagttctcccaaaagccatgtcccggcccttgctcatcaccttcaccccagccactgaccccagcgacctctggaaggatgggcagcagcagccacagcccgagaagccagagtccaccctggatggggctgcagccctagctttctatgaggccctgattggggatgagagcagcgctcctgactcccagagatctcagactgaacctgccagagaaagaaagagaaagaaaagaagaataatgaaggcaccagcagcagaagcagtggcagaaggagcatcaggaagacatggacaagggagatcccttgaggctgaggataagatgactcaccggatactgagggcagcccaggagggggacctgccagaacttaggagactgctggaaccgcatgaggcaggaggagctggggggaatatcaacgcccgggatgccttctggtggaccccactgatgtgtgctgctcgagcgggccagggggcagctgtgagctatctcctgggccgtggggctgcctgggtgggggtctgtgagctgagtggcagggatgcggctcagctcgctgaagaagctggcttccctgaggtagcccgcatggtcagggagagccatggagagacaaggagcccggaaaaccggtctcctactccctccctccagtactgcgagaactgtgacacccacttccaagattccaaccaccgcacatccactgctcacctgctgtcactgtcgcagggtcctcagcctcccaaccttccacttggggtgcccatctccagcccgggcttcaaactgctgctgagggggggctgggagccaggaatggggctgggaccccggggtgagggccgtgccaatcccatccccactgtcctcaagagggaccaggaaggactaggctacagatcagcaccccagccccgagtgacacatttcccagcttgggatacccgagctgtggctgggagggagagaccccctcgggtggccacactgagctggagggaggagagaaggagggaggagaaagacagggcttgggagcgggatctaaggacttacatgaacctcgagttctgactttggtaaagtctgaccctagtctgctgctgaagtctgaacttgggcctctgacctgggccctttgacttccccttcctgggatctgctcagatgcagatcctgaagtttttggtcaataggctctgtcttcgtgagagacgggctgagagtcagaaataaatcaaccatttgtggtttattcactttt

SEQ ID NO: 11459 - DNA, 2798 bp, Homo sapiens; identical to SEQ ID NO: 11425

SEQ ID NO: 11460 - DNA, 802 bp, Homo sapiens; identical to SEQ ID NO: 11426

SEQ ID NO: 11461 - DNA, 627 bp, Homo sapiens; identical to SEQ ID NO: 11431

SEQ ID NO: 11462 - DNA, 1800 bp, Homo sapiens; identical to SEQ ID NO: 11417

SEQ ID NO: 11463 - DNA, 627 bp, Homo sapiens; identical to SEQ ID NO: 11431

SEQ ID NO: 11464 - DNA, 1800 bp, Homo sapiens; identical to SEQ ID NO: 11417

SEQ ID NO: 11465 - DNA, 986 bp, Homo sapiens; identical to SEQ ID NO: 11441

SEQ ID NO: 11466 - DNA, 751 bp, Homo sapiens; identical to SEQ ID NO: 11435

SEQ ID NO: 11467 - DNA, 751 bp, Homo sapiens; identical to SEQ ID NO: 11435

SEQ ID NO: 11468 - DNA, 627 bp, Homo sapiens
cctgggcgcgcggagctttgctcgtttactattgaaaaagttccagcgcgggaaactgaacccggagctttgcgcacgcccgagccctcaagtaataatggcgccattttgcggtacggaagctacacagcaacacgtataggagactctccccgagatcttctagggagtgacccatctatttttgtttgggaagaggaaactccgaaatgggatcgcggaagacttaaagggccaggctgatttttttttcctactggtctctgaggctgtggttgctacagggtcaccacgagcttggcttacttgtctcatccttcccttgcctggtatcattttctcagttctcccaaaagccatgtcccggcccttgctcatcaccttcaccccagccactgaccccagcgacctctggaaggatgggcagcagcagccacagcccgagaagccagagtccaccctggatggggctgcagcccgagctttctatgaggccctgattggggatgagagcagcgctcctgactcccagagatctcagactgaacctgccagagaaagaaagagaaagaaaagaagaataatgaaggcaccagcagcagaagcagtggcagaaggagcatcagg

SEQ ID NO: 11469 - DNA, 627 bp, Homo sapiens; identical to SEQ ID NO: 11468

SEQ ID NO: 11470 - DNA, 822 bp, Homo sapiens; identical to SEQ ID NO: 11429

SEQ ID NO: 11471 - DNA, 986 bp, Homo sapiens
gacttagggcggggaaaggagggagccaggctggatctctttccgcagctctcctcacgttcccctctagtcccggcgcggcgctgctgcccgggggactggcctatcctcggccaatccgctgggtccttattgcctgttgggcccctagtgcgaatcagtcccgccagagacccttgacgggcatactgtttcctccgggctcctgcctcatgaggggagaggaagaggaaactccgaaatgggatcgcggaagacttaaagggccaggctgatttttttttcctactggtctctgaggctgtggttgctacagggtcaccacgagcttggcttacttgtctcatccttcccttgcctggtatcattttctcagttctcccaaaagccatgtcccggcccttgctcatcaccttcaccccagccactgaccccagcgacctctggaaggatgggcagcagcagccacagcccgagaagccagagtccaccctggatggggctgcagcccgagctttctatgaggccctgattggggatgagagcagcgctcctgactcccagagatctcagactgaacctgccagagaaagaaagagaaagaaaagaagaataatgaaggcaccagcagcagaagcagtggcagaaggagcatcaggaagacatggacaagggagatcccttgaggctgaggataagatgactcaccggatactgagggcagcccaggagggggacctgccagaacttaggagactgctggaaccgcatgaggcaggaggagctggggggaatatcaacgcccgggatgccttctggtggaccccactgatgtgtgctgctcgagcgggccagggggcagctgtgagctatctcctgggccgtggggctgcctgggtgggggtctgtgagctgagtggcagggatgcggctcagctcgctgaagaagctggcttccctgaggtagcccgcatggtcagggagag

SEQ ID NO: 11472 - DNA, 1910 bp, Homo sapiens
aggcgtgacgttatttcattacacggcttctcggcattccacaggtttccctccgcctcctgagggcctttcctaacccacagagtggattcctggctccagaaaatgggcttggagcgggggccacgttgaggaaggcgaagggcattgtgggggcgttatgtaaaagtaggaccccaaccgacagatcctagtgctcgcgccacctgggcgcgcggagctttgctcgtttactattgaaaaagttccagcgcgggaaactgaacccggagctttgcgcacgcccgagccctcaagtaatgtgggttgtggtttttgttgttgttgtcgccacgcatgcgtcttcgtgccgtgtggctatttgattgtgtcaactcttctgattagaatggcgccattttgcggtacggaagctacacagcaacacgtataggagactctccccgagatcttctagggagtgacccatctatttttgtttgggaagaggaaactccgaaatgggatcgcggaagacttaaagggccaggctgatttttttttcctactggtctctgaggctgtggttgctacagggtcaccacgagcttggcttacttgtctcatccttcccttgcctggtatcattttctcagttctcccaaaagccatgtcccggcccttgctcatcaccttcaccccagccactgaccccagcgacctctggaaggatgggcagcagcagccacagcccgagaagccagagtccaccctggatggggctgcagccctagctttctatgaggccctgattggggatgagagcagcgctcctgactcccagagatctcagactgaacctgccagagaaagaaagagaaagaaaagaagaataatgaaggcaccagcagcagaagcagtggcagaaggagcatcaggaagacatggacaagggagatcccttgaggctgaggataagatgactcaccggatactgagggcagcccaggagggggacctgccagaacttaggagactgctggaaccgcatgaggcaggaggagctggggggaatatcaacgcccgggatgccttctggtggaccccactgatgtgtgctgctcgagcgggccagggggcagctgtgagctatctcctgggccgtggggctgcctgggtgggggtctgtgagctgagtggcagggatgcggctcagctcgctgaagaagctggcttccctgaggtagcccgcatggtcagggagagccatggagagacaaggagcccggaaaaccggtctcctactccctccctccagtactgcgagaactgtgacacccacttccaagattccaaccaccgcacatccactgctcacctgctgtcactgtcgcagggtcctcagcctcccaaccttccacttggggtgcccatctccagcccgggcttcaaactgctgctgagggggggctgggagccaggaatggggctgggaccccggggtgagggccgtgccaatcccatccccactgtcctcaagagggaccaggaaggactaggctacagatcagcaccccagccccgagtgacacatttcccagcttgggatacccgagctgtggctgggagggagagaccccctcgggtggccacactgagctggagggaggagagaaggagggaggagaaagacagggcttgggagcgggatctaaggacttacatgaacctcgagttctgactttggtaaagtctgaccctagtctgctgctgaagtctgaacttgggcctctgacctgggccctttgacttccccttcctgggatctgctcagatgcagatcctgaagtttttggtcaataggctctgtcttcgtgagagacgggctgagagtcagaaataaatcaaccatttgtggtttattcactttt

SEQ ID NO: 11473 - DNA, 2793 bp, Homo sapiens
cacatcaaagtccggagaccccatgtgccgctcccagcgacaagggactcggagcagcgacgacttcagactcaccggctggacggggaccaggactggggtggggtagggaagttgctacttccagggaacggcggcgaccgctacagcgcaggccgcggacccgaccgcggcaggcgaagtggggtggggggagtggaaattagggagggtggggaagagggcaacacgcaagcgccaagggtcaggtgccgcggtggatgccgggacacggagtccccggtagagaaagaaactggctaaatgagagaaagcgaactaccaatcccaggatgacccgcgcacgacctggctgtcacgaaggcccggaggagggcgcttgcgggcggggcacaacgagaagccaccggaagcggaagccagaatggcgccattttgcggtacggaagctacacagcaacacgtataggagactctccccgagatcttctagggagtgacccatctatttttgtttgggaagaggaaactccgaaatgggatcgcggaagacttaaagggccaggctgatttttttttcctactggtctctgaggctgtggttgctacagggtcaccacgagcttggcttacttgtctcatccttcccttgcctggtatcattttctcagttctcccaaaagccatgtcccggcccttgctcatcaccttcaccccagccactgaccccagcgacctctggaaggatgggcagcagcagccacagcccgagaagccagagtccaccctggatggggctgcagcccgagctttctatgaggccctgattggggatgagagcagcgctcctgactcccagagatctcagactgaacctgccagagaaagaaagagaaagaaaagaagaataatgaaggcaccagcagcagaagcagtggcagaaggagcatcaggaagacatggacaagggagatcccttgaggctgaggataagatgactcaccggatactgagggcagcccaggagggggacctgccagaacttaggagactgctggaaccgcatgaggcaggaggagctggggggaatatcaacgcccgggatgccttctggtggaccccactgatgtgtgctgctcgagcgggccagggggcagctgtgagctatctcctgggccgtggggctgcctgggtgggggtctgtgagctgagtggcagggatgcggctcagctcgctgaagaagctggcttccctgaggtagcccgcatggtcagggagagccatggagagacaaggagcccggaaaaccggtctcctactccctccctccagtactgcgagaactgtgacacccacttccaagattccaaccaccgcacatccactgctcacctgctgtcactgtcgcagggtcctcagcctcccaaccttccacttggggtgcccatctccagcccgggcttcaaactgctgctgagggggggctgggagccaggaatggggctgggaccccggggtgagggccgtgccaatcccatccccactgtcctcaagagggaccaggaaggactaggctacagatcagcaccccagccccgagtgacacatttcccagcttgggatacccgagctgtggctgggagggagagaccccctcgggtggccacactgagctggagggaggagagaaggagggaggagaaagacagggcttgggagcgggatctaaggacttacatgaacctcgagttctgactttggtaaagtctgaccctagtctgctgctgaagtctgaacttgggcctctgacctgggccctttgacttccccttcctgggatctgctcagatgcagatcctgaagtttttggtcaataggctctgtcttcgtgagagacgggctgagagtcagaaataaatcaaccatttgtggtttattcacttttctggaagctattttgaggaagccaaacagaagcctgggagccacatgcaagtcccacctgagtcagaaggggcagcctctccaggtggcatgataaggtcacctccctgccaatctgggttcactttcaggtcccagaccctcctgggagtcccccacctattctttcaacccccctggaccaagaattgcccagcttcgtgcaagtctcacttcccccaggaggagttccctgactacagccaattcactgatttcacaaacataagtccatatactatgtgccaagaatacaggtaaagacattcccaaccctcaaagagttcacagctggagagggaaagtgccatgttaccaatttttttcttttttttttgagatgcagtttcgctctcattgcccaggctggagtgcaatggcatgatctcggctcaccacaacctctgccccccgagttcaagggattctcctgcctcagcctccccagtagctgggattacaggcatgccccaccacgcccagctaattttgtatttttagtagagacggggtttctccatgttggccaagctggtcttgaactcccgacctcaggtgatccgccggcctcggcttcccaaagtgctggggttgcaggcatgagccaccactcccggcccatgttatcaaatattataatgcagggtgataagggaagtcaaggcctctagagatgagaatgggtagggttttgctggaagaggccagtgtgataggaaggcccacgattatcaagcttgtacacttagttgaactgggaccagaactctagcccccaaatctaaactttaaacttctttgttccaccc

SEQ ID NO: 11474 - DNA, 1910 bp, Homo sapiens; identical to SEQ ID NO: 11418

SEQ ID NO: 11475 - DNA, 802 bp, Homo sapiens; identical to SEQ ID NO: 11430

SEQ ID NO: 11476 - DNA, 627 bp, Homo sapiens; identical to SEQ ID NO: 11468

SEQ ID NO: 11477 - DNA, 751 bp, Homo sapiens
gggcaatacagttttgtgctcactgggtgaagaggctgacttagggcggggaaaggagggagccaggctggatctctttccgcagctctcctcacgttcccctctagtcccggcgcggcgctgctgcccgggggactggcctatcctcggccaatccgctgggtccttattgcctgttgggcccctagtgcgaatcagtcccgccagagacccttgacgggcatactgtttcctccgggctcctgcctcatgaggggagaggaagaggaaactccgaaatgggatcgcggaagacttaaagggccaggctgatttttttttcctactgcaggtctctgaggctgtggttgctacagggtcaccacgagcttggcttacttgtctcatccttcccttgcctggtatcattttctcagttctcccaaaagccatgtcccggcccttgctcatcaccttcaccccagccactgaccccagcgacctctggaaggatgggcagcagcagccacagcccgagaagccagagtccaccctggatggggctgcagcccgagctttctatgaggccctgattggggatgagagcagcgctcctgactcccagagatctcagactgaacctgccagagaaagaaagagaaagaaaagaagaataatgaaggcaccagcagcagaagcagtggcagaaggagcatcaggaagacatggacaagggagatcccttgaggctgaggataagatgactcaccgg

SEQ ID NO: 11478 - DNA, 1598 bp, Homo sapiens; identical to SEQ ID NO: 11416

SEQ ID NO: 11479 - DNA, 1598 bp, Homo sapiens; identical to SEQ ID NO: 11421

SEQ ID NO: 11480 - DNA, 1800 bp, Homo sapiens
cggggcccgggagtctgggcaatacagttttgtgctcactgggtgaagaggctgacttagggcggggaaaggagggagccaggctggatctctttccgcagctctcctcacgttcccctctagtcccggcgaggcgctgctgcccaggggactggcctatcctcggccaatccgctgggtccttattgcctgttgggcccctagtgcgaatcagtcccgccagagacccttgacgggcatactgtttcctccgggctcctgcctcatgaggggagagaatggcgccattttgcggtacggaagctacacagcaacacgtataggagactctccccgagatcttctagggagtgacccatctatttttgtttgggaagaggaaactccgaaatgggatcgcggaagacttaaagggccaggctgatttttttttcctactggtctctgaggctgtggttgctacagggtcaccacgagcttggcttacttgtctcatccttcccttgcctggtatcattttctcagttctcccaaaagccatgtcccggcccttgctcatcaccttcaccccagccactgaccccagcgacctctggaaggatgggcagcagcagccacagcccgagaagccagagtccaccctggatggggctgcagccctagctttctatgaggccctgattggggatgagagcagcgctcctgactcccagagatctcagactgaacctgccagagaaagaaagagaaagaaaagaagaataatgaaggcaccagcagcagaagcagtggcagaaggagcatcaggaagacatggacaagggagatcccttgaggctgaggataagatgactcaccggatactgagggcagcccaggagggggacctgccagaacttaggagactgctggaaccgcatgaggcaggaggagctggggggaatatcaacgcccgggatgccttctggtggaccccactgatgtgtgctgctcgagcgggccagggggcagctgtgagctatctcctgggccgtggggctgcctgggtgggggtctgtgagctgagtggcagggatgcggctcagctcgctgaagaagctggcttccctgaggtagcccgcatggtcagggagagccatggagagacaaggagcccggaaaaccggtctcctactccctccctccagtactgcgagaactgtgacacccacttccaagattccaaccaccgcacatccactgctcacctgctgtcactgtcgcagggtcctcagcctcccaaccttccacttggggtgcccatctccagcccgggcttcaaactgctgctgagggggggctgggagccaggaatggggctgggaccccggggtgagggccgtgccaatcccatccccactgtcctcaagagggaccaggaaggactaggctacagatcagcaccccagccccgagtgacacatttcccagcttgggatacccgagctgtggctgggagggagagaccccctcgggtggccacactgagctggagggaggagagaaggagggaggagaaagacagggcttgggagcgggatctaaggacttacatgaacctcgagttctgactttggtaaagtctgaccctagtctgctgctgaagtctgaacttgggcctctgacctgggccctttgacttccccttcctgggatctgctcagatgcagatcctgaagtttttggtcaataggctctgtcttcgtgagagacgggctgagagtcagaaataaatcaaccatttgtggtttattcactttt

SEQ ID NO: 11481 - DNA, 627 bp, Homo sapiens; identical to SEQ ID NO: 11468

SEQ ID NO: 11482 - DNA, 1800 bp, Homo sapiens; identical to SEQ ID NO: 11424

SEQ ID NO: 11483 - DNA, 802 bp, Homo sapiens; identical to SEQ ID NO: 11426

SEQ ID NO: 11484 - DNA, 822 bp, Homo sapiens; identical to SEQ ID NO: 11429

SEQ ID NO: 11485 - DNA, 6857 bp, Homo sapiens
gggtgtcgcaggagggaaggagcgaaccggagagcgtcgtcctgagaggagtgaaggcggcaaaatggcggaccgcttctcccgcttcaacgaagaccgagactttcagggtaatcactttgatcagtatgaggaaggacacttggaaattgaacaagcgtcacttgacaagcctatagaatcggataatattggacaccgcttactccagaaacatgggtggaagctgggccagggattgggaaaatctcttcaggggagaacagatcccattccaatcgttgtcaagtatgatgtcatgggcatgggtcgcatggaaatggagcttgattatgctgaagatgctaccgaacggcgccgtgtcctagaagtagaaaaagaagacacagaagagctgagacaaaagtacaaggattatgttgacaaagagaaggcaattgccaaagccttggaagacctcagagccaacttttattgtgaactgtgtgataagcaatatcagaaacatcaggaatttgataaccatatcaactcctatgatcatgcacacaagcagagattaaaagatctgaagcagagagagtttgctcgaaatgtctcttcaagatcccgcaaggatgagaaaaaacaggaaaaagcccttcggcggctccatgagttggcagagcaaagaaaacaagctgaatgtgcacctggaagtggtcccatgttcaaaccaaccacagtggctgtagatgaagaaggtggagaagatgataaagatgaatcagctacaaatagtggcacaggtgccactgcttcttgtggcctgggatctgaattctccacagataaaggaggccctttcactgcagtacaaatcactaataccactggactggcccaggctcctgggttagcctcccaaggcatcagctttggcattaagaataatctggggaccccattgcaaaaattgggagtgtcattttcttttgccaaaaaggctcctgtcaaactcgaatcaatagcatcagttttcaaggaccatgcggaggaagggacctctgaagatggaacaaaacccgatgagaagagttctgaccaaggactgcagaaggtaggagactctgatgggagcagtaatcttgatggtaaaaaagaggatgaagaccctcaggatggagggtcccttgcctcaacattatccaaattaaaaaggatgaaacgagaagaaggagctggggctacagagcctgagtattaccactacatccccccagcacactgcaaagtaaaacctaattttccctttctactttttatgagagccagtgaacaaatggatggtgataatactacacacccaaagaatgccccagagagtaaaaaaggcagttctcccaagcctaaaagctgcatcaaggcggcagcaagccaaggagcagaaaagacagttagtgaagtctctgagcagccgaaggaaaccagcatgaccgagccctcagaaccaggaagcaaagctgaggcaaagaaggccttaggaggggatgtaagtgatcagagtttagaaagtcatagtcagaaggtttcagagacccaaatgtgtgagtccaactcttctaaagaaacctctctggccaccccagcagggaaagaaagccaagaaggacccaaacatcctactggtcccttcttcccagttttgagcaaagatgaaagcactgccctccagtggccatcagaactattaattttcaccaaggcagaaccctccatttcatacagttgtaaccctttatattttgactttaaactttcaaggaacaaagatgccagaactaaaggaacagaaaaaccaaaggatataggaagctcctcaaaggaccatctccaaggcctagatcctggtgagccaaataaaagcaaggaagtgggcggagagaaaatagtacgttcctcaggaggcagaatggacgcacctgcttcagggtctgcctgtagcggcctgaacaagcaggagcctgggggtagccatgggtctgagacagaagacacagggagaagccttcccagcaagaaagaacgatctgggaagtcccaccggcacaaaaagaaaaagaagcacaaaaaatccagcaaacacaaacgtaaacacaaggctgacacagaagagaaaagctctaaggcagagtcaggggagaaatctaagaagcgcaagaaacgaaaacgaaagaagaataagtcatcagccccagcagattctgaacgaggacccaaaccagaaccccctgggagtggcagtcccgcaccaccaagaagaaggcggagagctcaagatgactcccagcggagatccctcccagctgaagaggggagcagtggcaaaaaggatgaaggtgggggtggtagcagctcccaagaccatggtgggaggaaacacaaaggtgaacttccaccttcatcctgccagcgaagagcaggcaccaaacggagcagccggtctagccatcggagccaacccagtagtggagatgaggatagtgatgatgcttcctcacaccggctgcaccagaagtctccatcccagtacagtgaggaagaagaagaggaagattcaggcagtgagcattcccgcagccgctcaaggtctggccggcgccattcctcgcatcgttcctcccggcgttcttactcaagtagctcagatgcctcttcagaccagagctgctatagtagacagcgcagttactctgatgacagctacagtgactacagtgacagatcacgaaggcactccaagcgctcccatgactcagatgactcagactatgccagctccaaacaccgatcaaaacggcacaaatattcatcttctgatgatgactatagcctcagttgcagccagtcccgaagccgatctcggagtcataccagagagcgctcaagatcccggggccgcagccgcagcagcagttgtagtcgtagtcgaagcaagcggagaagccgtagcaccacagcccacagctggcaacggagccggagctatagccgggaccgcagccgcagcaccaggagcccttcccagagatcaggctccaggaagagatcatggggtcacgagagccctgaggagaggcattctgggcgtcgggacttcattcgttctaagatctaccgctcccagtccccccactatttccgatcaggccggggagaaggtcctgggaagaaagatgatggcagaggagatgacagtaaagcaacaggtccaccttcccagaacagcaacattggcacaggaagagggtcagaaggtgactgcagtcctgaagacaagaactctgtcactgccaaactgctactggagaagatccagtcaaggaaagtggagaggaaacctagtgtgagtgaggaggtgcaggccacccctaataaagctgggcccaagctcaaggaccccccacaaggttactttgggcccaagctccccccatctcttggcaataagcctgtccttccactgatagggaagctcccagctacccgaaagcccaataagaagtgtgaagagtctggcttggaaaggggggaagagcaagaacagtcagagacagaagaggggcccccagggagtagtgatgccctatttgggcatcagttcccttcagaggaaacaactggccccttattagacccacccccagaagagtcaaagtctggagaagctactgctgatcaccctgtggctccactaggcaccccagcacattctgactgctaccctggggacccaaccatctcccataactacctccccgaccccagtgatggggacaccctggagtccctggatagcagcagtcagccaggccctgtggagtccagcttgctgcctatagcaccagaccttgagcatttccccagttatgcacctcccagtggggatcctagtattgagtcaacagatggggctgaggatgcttcactggcccccctggaaagccagcccatcaccttcacccctgaggagatggagaagtacagcaagctccagcaggctgctcagcaacacatccagcagcagcttctggccaagcaagtaaaggcctttccagcctcagctgccctggccccagccacaccagccctgcaacccatccacattcagcagccagctacagcctctgccacctccatcacaactgttcagcatgccatcctacaacatcatgctgccgcagctgctgccgccatcggcattcaccctcacccccatccccaaccacttgcccaggtgcatcatattccccagccccatctgacccccatttctttgtcccacctcactcactcaatcatccctggccaccctgccacctttctcgctagccatcccatccacatcattcccgcctcagccatccatcctgggcccttcacctttcaccctgtcccacatgctgccctctaccccaccctacttgctccacggcctgctgcagcagctgccactgcacttcaccttcacccactacttcaccccatcttctcaggtcaggacctgcaacatccccccagccatggcacgtgagttgggggatgggatcctaggtagggccaggggaggagacccataaatgttcccttgggggtgttgagccattaataccagcaagtagaagctgggatgggcagtgtctgacagccaaagaattgagttttggcttgcaggggtgggtttagatttgaagtttgctttcagtttactatcagggatttctttttcctgtcctcctctcaatttgtccctccctcttctgtgtttctaagctagggaacaccagtaagtgctacccacccctctgcagcaacatctccaaactgtcaagtttagataatcccctcctccctctgcttttttcctctgctcttcccttctgtaaattttaaaacattttcctcccctctggccagtgggttgtcaccagagcacttgctgtgggcccatctggtcttgccttctcagcgccacagggaaggccaagctgttctagtggtggaagtgccaccattttggggtagtatctttgaccatctttggtgacgttacgttatcccaggtgaggtggaaagcgtctcacctggaacctgatataactcaggctgcaattccatccagttcccacatcaacggagccacacatttggcactgttatcttggtatccctcatcccagaagaggcatctccatatcccagaaaagaagatcctatcatgaataaaagctgtatggcccagagaggagctcatgtgtctaaagtgaagggtatattttcttctgttgtgttgatgtttccttcttaatttataggatttttttaatgtaaaaaattgcactgaactctataaacgtaaatgctgctttttgtagctcatataaaaaaggttccatatttgtagtatactgcaataatattttttacatccagctctttaagtgatcctcgttctggtggctttgtgtaaatatgtttgccctagttgaattaagaaactctaaaggttataaaatgaaaacaaaaaataaaatatttgttttctgctagatgcaaaactgactaagcatgtatattttaccaaacttatgtattttttgaagttatgaactataaaatgttaaaacattttttgctgggacaaaatgttaagtaatttgcagtatgtagtgcccccagtattgggatttttgagctaatgggcagcagtcagctgggggcttctgagggatgctcatctttaacagtctccctcatgtacttttgctgttttacacagagaaacaggtagaccccacagaggagaaggaggggattcaacagctttattgtctggaagcagtgagatttggtgattgtctggggggattcctgggtttccctgggtaccttgttccaggcagtcagtccatttgccttcctagtacttagccccctctgacaattttttttttaatgtgccttttgggttggtagaaacggaagtagaagtaggctggaggatgagttgggacagtcttccttttgttgggaggtgagcacatttacagatattttgcttcatagtttccatgccctctgcccagctcagtttagacagtaaacgttccttgtttcttttctcccatgacactgacaagaggaattaccacctcagcctcttttgcccctcttcttgcctttcacccaggctctcagccctaattaacacactgacccaaaggtgcttgtgttgcaggtcccatctcctttgatgaggttaacaattcccactttggcattttcctaactattcgtgtggctagaattggttggttggtcacttgacaagaaaaaccatacttacctgggccaaggctctgttcctgccttcgcaaattctcaaaagagtaaagtttatgaaaagaaagtggcaggcaaacacaactcttgactgccctcccaccctcctacctgttcagtactcatctgattcagaagcatcacttcttggataactagcactggaaaaatgaaatcatctgtgtaagtgaagggactcatttttctttgctttcagcccatgtaaataaataatacagtattaacattttcgtgctgcttcccattagcttgtagattgagccatactctggctgcctctttgccttcctaggggcattttctttaacttccagaatagtgattttaaaagtaaaaataaaaataaaccttacttacaagcataacagattgtatttaactttatcacatatgatagagatatatatgctgtaaaatgagggaaaggaactttctaataaaccaatgatttgtgg

SEQ ID NO: 11486 - DNA, 4710 bp, Homo sapiens
gcgtcgtcctgagaggagtgaaggcggcaaaatggcggaccgcttctcccgcttcaacgaagaccgagactttcagggtaatcactttgatcagtatgaggaaggacacttggaaattgaacaagcgtcacttgacaagcctatagaatcgcccagtttttaaagccaggataatattggacaccgcttactccagaaacatgggtggaagctgggccagggattgggaaaatctcttcaggggagaacagatcccattccaatcgttgtcaagtatgatgtcatgggcatgggtcgcatggaaatggagcttgattatgctgaagatgctaccgaacggcgccgtgtcctagaagtagaaaaagaagacacagaagagctgagacaaaagtacaaggattatgttgacaaagagaaggcaattgccaaagccttggaagacctcagagccaacttttattgtgaactgtgtgataagcaatatcagaaacatcaggaatttgataaccatatcaactcctatgatcatgcacacaagcagagattaaaagatctgaagcagagagagtttgctcgaaatgtctcttcaagatcccgcaaggatgagaaaaaacaggaaaaagcccttcggcggctccatgagttggcagagcaaagaaaacaagctgaatgtgcacctggaagtggtcccatgttcaaaccaaccacagtggctgtagatgaagaaggtggagaagatgataaagatgaatcagctacaaatagtggcacaggtgccactgcttcttgtggcctgggatctgaattctccacagataaaggaggccctttcactgcagtacaaatcactaataccactggactggcccaggctcctgggttagcctcccaaggcatcagctttggcattaagaataatctggggaccccattgcaaaaattgggagtgtcattttcttttgccaaaaaggctcctgtcaaactcgaatcaatagcatcagttttcaaggaccatgcggaggaagggacctctgaagatggaacaaaacccgatgagaagagttctgaccaaggactgcagaaggtaggagactctgatgggagcagtaatcttgatggtaaaaaagaggatgaagaccctcaggatggagggtcccttgcctcaacattatccaaattaaaaaggatgaaacgagaagaaggagctggggctacagagcctgagtattaccactacatccccccagcacactgcaaagtaaaacctaattttccctttctactttttatgagagccagtgaacaaatggatggtgataatactacacacccaaagaatgccccagagagtaaaaaaggcagttctcccaagcctaaaagctgcatcaaggcggcagcaagccaaggagcagaaaagacagttagtgaagtctctgagcagccgaaggaaaccagcatgaccgagccctcagaaccaggaagcaaagctgaggcaaagaaggccttaggaggggatgtaagtgatcagagtttagaaagtcatagtcagaaggtttcagagacccaaatgtgtgagtccaactcttctaaagaaacctctctggccaccccagcagggaaagaaagccaagaaggacccaaacatcctactggtcccttcttcccagttttgagcaaagatgaaagcactgccctccagtggccatcagaactattaattttcaccaaggcagaaccctccatttcatacagttgtaaccctttatattttgactttaaactttcaaggaacaaagatgccagaactaaaggaacagaaaaaccaaaggatataggaagctcctcaaaggaccatctccaaggcctagatcctggtgagccaaataaaagcaaggaagtgggcggagagaaaatagtacgttcctcaggaggcagaatggacgcacctgcttcagggtctgcctgtagcggcctgaacaagcaggagcctgggggtagccatgggtctgagacagaagacacagggagaagccttcccagcaagaaagaacgatctgggaagtcccaccggcacaaaaagaaaaagaagcacaaaaaatccagcaaacacaaacgtaaacacaaggctgacacagaagagaaaagctctaaggcagagtcaggggagaaatctaagaagcgcaagaaacgaaaacgaaagaagaataagtcatcagccccagcagattctgaacgaggacccaaaccagaaccccctgggagtggcagtcccgcaccaccaagaagaaggcggagagctcaagatgactcccagcggagatccctcccagctgaagaggggagcagtggcaaaaaggatgaaggtgggggtggtagcagctcccaagaccatggtgggaggaaacacaaaggtgaacttccaccttcatcctgccagcgaagagcaggcaccaaacggagcagccggtctagccatcggagccaacccagtagtggagatgaggatagtgatgatgcttcctcacaccggctgcaccagaagtctccatcccagtacagtgaggaagaagaagaggaagattcaggcagtgagcattcccgcagccgctcaaggtctggccggcgccattcctcgcatcgttcctcccggcgttcttactcaagtagctcagatgcctcttcagaccagagctgctatagtagacagcgcagttactctgatgacagctacagtgactacagtgacagatcacgaaggcactccaagcgctcccatgactcagatgactcagactatgccagctccaaacaccgatcaaaacggcacaaatattcatcttctgatgatgactatagcctcagttgcagccagtcccgaagccgatctcggagtcataccagagagcgctcaagatcccggggccgcagccgcagcagcagttgtagtcgtagtcgaagcaagcggagaagccgtagcaccacagcccacagctggcaacggagccggagctatagccgggaccgcagccgcagcaccaggagcccttcccagagatcaggctccaggaagagatcatggggtcacgagagccctgaggagaggcattctgggcgtcgggacttcattcgttctaagatctaccgctcccagtccccccactatttccgatcaggccggggagaaggtcctgggaagaaagatgatggcagaggagatgacagtaaagcaacaggtccaccttcccagaacagcaacattggcacaggaagagggtcagaaggtgactgcagtcctgaagacaagaactctgtcactgccaaactgctactggagaagatccagtcaaggaaagtggagaggaaacctagtgtgagtgaggaggtgcaggccacccctaataaagctgggcccaagctcaaggaccccccacaaggttactttgggcccaagctccccccatctcttggcaataagcctgtccttccactgatagggaagctcccagctacccgaaagcccaataagaagtgtgaagagtctggcttggaaaggggggaagagcaagaacagtcagagacagaagaggggcccccagggagtagtgatgccctatttgggcatcagttcccttcagaggaaacaactggccccttattagacccacccccagaagagtcaaagtctggagaagctactgctgatcaccctgtggctccactaggcaccccagcacattctgactgctaccctggggacccaaccatctcccataactacctccccgaccccagtgatggggacaccctggagtccctggatagcagcagtcagccaggccctgtggagtccagcttgctgcctatagcaccagaccttgagcatttccccagttatgcacctcccagtggggatcctagtattgagtcaacagatggggctgaggatgcttcactggcccccctggaaagccagcccatcaccttcacccctgaggagatggagaagtacagcaagctccagcaggctgctcagcaacacatccagcagcagcttctggccaagcaagtaaaggcctttccagcctcagctgccctggccccagccacaccagccctgcaacccatccacattcagcagccagctacagcctctgccacctccatcacaactgttcagcatgccatcctacaacatcatgctgccgcagctgctgccgccatcggcattcaccctcacccccatccccaaccacttgcccaggtgcatcatattccccagccccatctgacccccatttctttgtcccacctcactcactcaatcatccctggccaccctgccacctttctcgctagccatcccatccacatcattcccgcctcagccatccatcctgggcccttcacctttcaccctgtcccacatgctgccctctaccccaccctacttgctccacggcctgctgcagcagctgccactgcacttcaccttcacccactacttcaccccatcttctcaggtcaggacctgcaacatccccccagccatggcacgtgagttgggggatgggatcctaggtagggccaggggaggagacccataaatgttcccttgggggtgttgagccattaataccagcaagtagaagctgggatgggcagtgtctgacagccaaagaattgagttttggcttgcaggggtgggtttag

SEQ ID NO: 11487 - DNA, 163 bp, Homo sapiens
agagcgtcgtcctgagaggagtgaaggcggcaaaatggcggaccgcttctcccgcttcaacgaagaccgagactttcagggtaatcactttgatcagtatgaggaaggacacttggaaattgaacaagcgtcacttgacaagcctatagaatcgagttgtttt

SEQ ID NO: 11488 - DNA, 4692 bp, Homo sapiens
gcgtcgtcctgagaggagtgaaggcggcaaaatggcggaccgcttctcccgcttcaacgaagaccgagactttcagggtaatcactttgatcagtatgaggaaggacacttggaaattgaacaagcgtcacttgacaagcctatagaatcggataatattggacaccgcttactccagaaacatgggtggaagctgggccagggattgggaaaatctcttcaggggagaacagatcccattccaatcgttgtcaagtatgatgtcatgggcatgggtcgcatggaaatggagcttgattatgctgaagatgctaccgaacggcgccgtgtcctagaagtagaaaaagaagacacagaagagctgagacaaaagtacaaggattatgttgacaaagagaaggcaattgccaaagccttggaagacctcagagccaacttttattgtgaactgtgtgataagcaatatcagaaacatcaggaatttgataaccatatcaactcctatgatcatgcacacaagcagagattaaaagatctgaagcagagagagtttgctcgaaatgtctcttcaagatcccgcaaggatgagaaaaaacaggaaaaagcccttcggcggctccatgagttggcagagcaaagaaaacaagctgaatgtgcacctggaagtggtcccatgttcaaaccaaccacagtggctgtagatgaagaaggtggagaagatgataaagatgaatcagctacaaatagtggcacaggtgccactgcttcttgtggcctgggatctgaattctccacagataaaggaggccctttcactgcagtacaaatcactaataccactggactggcccaggctcctgggttagcctcccaaggcatcagctttggcattaagaataatctggggaccccattgcaaaaattgggagtgtcattttcttttgccaaaaaggctcctgtcaaactcgaatcaatagcatcagttttcaaggaccatgcggaggaagggacctctgaagatggaacaaaacccgatgagaagagttctgaccaaggactgcagaaggtaggagactctgatgggagcagtaatcttgatggtaaaaaagaggatgaagaccctcaggatggagggtcccttgcctcaacattatccaaattaaaaaggatgaaacgagaagaaggagctggggctacagagcctgagtattaccactacatccccccagcacactgcaaagtaaaacctaattttccctttctactttttatgagagccagtgaacaaatggatggtgataatactacacacccaaagaatgccccagagagtaaaaaaggcagttctcccaagcctaaaagctgcatcaaggcggcagcaagccaaggagcagaaaagacagttagtgaagtctctgagcagccgaaggaaaccagcatgaccgagccctcagaaccaggaagcaaagctgaggcaaagaaggccttaggaggggatgtaagtgatcagagtttagaaagtcatagtcagaaggtttcagagacccaaatgtgtgagtccaactcttctaaagaaacctctctggccaccccagcagggaaagaaagccaagaaggacccaaacatcctactggtcccttcttcccagttttgagcaaagatgaaagcactgccctccagtggccatcagaactattaattttcaccaaggcagaaccctccatttcatacagttgtaaccctttatattttgactttaaactttcaaggaacaaagatgccagaactaaaggaacagaaaaaccaaaggatataggaagctcctcaaaggaccatctccaaggcctagatcctggtgagccaaataaaagcaaggaagtgggcggagagaaaatagtacgttcctcaggaggcagaatggacgcacctgcttcagggtctgcctgtagcggcctgaacaagcaggagcctgggggtagccatgggtctgagacagaagacacagggagaagccttcccagcaagaaagaacgatctgggaagtcccaccggcacaaaaagaaaaagaagcacaaaaaatccagcaaacacaaacgtaaacacaaggctgacacagaagagaaaagctctaaggcagagtcaggggagaaatctaagaagcgcaagaaacgaaaacgaaagaagaataagtcatcagccccagcagattctgaacgaggacccaaaccagaaccccctgggagtggcagtcccgcaccaccaagaagaaggcggagagctcaagatgactcccagcggagatccctcccagctgaagaggggagcagtggcaaaaaggatgaaggtgggggtggtagcagctcccaagaccatggtgggaggaaacacaaaggtgaacttccaccttcatcctgccagcgaagagcaggcaccaaacggagcagccggtctagccatcggagccaacccagtagtggagatgaggatagtgatgatgcttcctcacaccggctgcaccagaagtctccatcccagtacagtgaggaagaagaagaggaagattcaggcagtgagcattcccgcagccgctcaaggtctggccggcgccattcctcgcatcgttcctcccggcgttcttactcaagtagctcagatgcctcttcagaccagagctgctatagtagacagcgcagttactctgatgacagctacagtgactacagtgacagatcacgaaggcactccaagcgctcccatgactcagatgactcagactatgccagctccaaacaccgatcaaaacggcacaaatattcatcttctgatgatgactatagcctcagttgcagccagtcccgaagccgatctcggagtcataccagagagcgctcaagatcccggggccgcagccgcagcagcagttgtagtcgtagtcgaagcaagcggagaagccgtagcaccacagcccacagctggcaacggagccggagctatagccgggaccgcagccgcagcaccaggagcccttcccagagatcaggctccaggaagagatcatggggtcacgagagccctgaggagaggcattctgggcgtcgggacttcattcgttctaagatctaccgctcccagtccccccactatttccgatcaggccggggagaaggtcctgggaagaaagatgatggcagaggagatgacagtaaagcaacaggtccaccttcccagaacagcaacattggcacaggaagagggtcagaaggtgactgcagtcctgaagacaagaactctgtcactgccaaactgctactggagaagatccagtcaaggaaagtggagaggaaacctagtgtgagtgaggaggtgcaggccacccctaataaagctgggcccaagctcaaggaccccccacaaggttactttgggcccaagctccccccatctcttggcaataagcctgtccttccactgatagggaagctcccagctacccgaaagcccaataagaagtgtgaagagtctggcttggaaaggggggaagagcaagaacagtcagagacagaagaggggcccccagggagtagtgatgccctatttgggcatcagttcccttcagaggaaacaactggccccttattagacccacccccagaagagtcaaagtctggagaagctactgctgatcaccctgtggctccactaggcaccccagcacattctgactgctaccctggggacccaaccatctcccataactacctccccgaccccagtgatggggacaccctggagtccctggatagcagcagtcagccaggccctgtggagtccagcttgctgcctatagcaccagaccttgagcatttccccagttatgcacctcccagtggggatcctagtattgagtcaacagatggggctgaggatgcttcactggcccccctggaaagccagcccatcaccttcacccctgaggagatggagaagtacagcaagctccagcaggctgctcagcaacacatccagcagcagcttctggccaagcaagtaaaggcctttccagcctcagctgccctggccccagccacaccagccctgcaacccatccacattcagcagccagctacagcctctgccacctccatcacaactgttcagcatgccatcctacaacatcatgctgccgcagctgctgccgccatcggcattcaccctcacccccatccccaaccacttgcccaggtgcatcatattccccagccccatctgacccccatttctttgtcccacctcactcactcaatcatccctggccaccctgccacctttctcgctagccatcccatccacatcattcccgcctcagccatccatcctgggcccttcacctttcaccctgtcccacatgctgccctctaccccaccctacttgctccacggcctgctgcagcagctgccactgcacttcaccttcacccactacttcaccccatcttctcaggtcaggacctgcaacatccccccagccatggcacgtgagttgggggatgggatcctaggtagggccaggggaggagacccataaatgttcccttgggggtgttgagccattaataccagcaagtagaagctgggatgggcagtgtctgacagccaaagaattgagttttggcttgcaggggtgggtttag

SEQ ID NO: 11489 - DNA, 1506 bp, Homo sapiens
gacggcacgccgcggcggggtgggtgcaagatgccgctgccggttcaggtgtttaacttgcagggggccgtggagcccatgcagatcgacgtggacccccaggaagacccgcagaatgcacctgacgtcaactacgtggtggagaaccccagcctggatctggaacagtacgcggccagctacagcggcctgatgcgcatcgaacggctgcagttcattgctgatcactgccccacgctgcgggtggaggccctgaagatggccctctccttcgtgcagagaacctttaacgtggacatgtacgaggagatccaccgcaagctctcagaggccaccaggtcctctctcagggagctgcagaacgcacccgacgccatccctgagagcggcgtggagcccccagccctggacacggcctgggtggaggccacgcggaagaaggcgctgctgaagctggagaagctggacacagacctgaagaactacaagggcaactccatcaaagagagcatccggcgcggccacgacgacctgggcgaccactacctggactgtggggacctcagcaacgccctcaagtgctattcccgggcccgggactactgcaccagcgccaaacacgtcatcaacatgtgcctcaatgtcatcaaggtcagcgtctacttgcagaattggtctcatgtgctcagctacgtcagcaaggctgagtccaccccagagattgccgagcagcgaggagagcgtgacagccagacccaggccatcctcaccaagctcaagtgtgccgcaggcttggcagagctggccgccaggaagtacaagcaggctgccaagtgcctcctgctggcttcctttgatcactgtgacttccctgagctgctgtcccccagcaacgtggccatctacggtggcctgtgcgccttggctacctttgaccggcaggagctgcagcgcaatgtcatctccagcagctccttcaagttgttcttggagctggagccacaggtccgagacatcatcttcaaattctacgagtccaagtacgcctcatgtctcaagatgctggacgagatgaaggacaacctgctcctggacatgtatctggccccccatgtcaggaccctgtacacccagattcgcaaccgtgccctcatccagtatttcagcccctacgtgtcagccgacatgcataggatggcggcagccttcaataccacggtggccgccctggaggacgagctgacgcagctaatcctggaggggctgatcagtgcccgtgtggactcacacagcaagatcctatacgcccgggacgtggatcagcgcagcaccacctttgagaagtctctgttgatgggcaaggagttccagcgccgcgccaaggccatgatgctgcgggcagctgtgctccgcaaccagatccatgtcaagtccccgcccagagaagggagccagggggagctgactccagccaacagccagtcccggatgagcaccaacatgtga

SEQ ID NO: 11490 - DNA, 1700 bp, Homo sapiens
gacggcacgccgcggcggggtgggtgcaagatgccgctgccggttcaggtgtttaacttgcagcagccagccagctctgtgtcagggtcggggggtgcagaaagtcaggacagaatgagggatagctcggcccccagctcggcctcctcgtcagtgacagatctgtactgcacccctcacagcagtaggtcagacctcgtcctgcccggcacggccggggacttcagcctgagcgccagcctgtcggcctgtacgctgctctacgagggggccgtggagcccatgcagatcgacgtggacccccaggaagacccgcagaatgcacctgacgccatccctgagagcggcgtggagcccccagccctggacacggcctgggtggaggccacgcggaagaaggcgctgctgaagctggagaagctggacacagacctgaagaactacaagggcaactccatcaaagagagcatccggcgcggccacgacgacctgggcgaccactacctggactgtggggacctcagcaacgccctcaagtgctattcccgggcccgggactactgcaccagcgccaaacacgtcatcaacatgtgcctcaatgtcatcaaggtcagcgtctacttgcagaattggtctcatgtgctcagctacgtcagcaaggctgagtccaccccagagattgccgagcagcgaggagagcgtgacagccagacccaggccatcctcaccaagctcaagtgtgccgcaggcttggcagagctggccgccaggaagtacaagcaggctgccaagtgcctcctgctggcttcctttgatcactgtgacttccctgagctgctgtcccccagcaacgtggccatctacggtggcctgtgcgccttggctacctttgaccggcaggagctgcagcgcaatgtcatctccagcagctccttcaagttgttcttggagctggagccacaggtccgagacatcatcttcaaattctacgagtccaagtacgcctcatgtctcaagatgctggacgagatgaaggacaacctgctcctggacatgtatctggccccccatgtcaggaccctgtacacccagattcgcaaccgtgccctcatccagtatttcagcccctacgtgtcagccgacatgcataggatggcggcagccttcaataccacggtggccgccctggaggacgagctgacgcagctaatcctggaggggctgatcagtgcccgtgtggactcacacagcaagatcctatacgcccgggacgtggatcagcgcagcaccacctttgagaagtctctgttgatgggcaaggagttccagcgccgcgccaaggccatgatgctgcgggcagctgtgctccgcaaccagatccatgtcaagcccctccccacctccacggacctcggacctccaggcggctcagtgctgcctgcggcccagctaaggggcctggccactgggtgccacccagcctgtgtgccctccctggggctgaggaggcaggcggctgctagttgtggcccttcctggaaggagaggcctgcagggctcgaccctgtgggtttctgtccccagggagcagactgtgcggcacccaggcccagtggcaccatttcccagacccctcctgttcccgcctcagtcaggtgcagacaagtgggcggtgtccattaaagagcagactcagcgtt

SEQ ID NO: 11491 - DNA, 1695 bp, Homo sapiens
gacggcacgccgcggcggggtgggtgcaagatgccgctgccggttcaggtgtttaacttgcagccagccagctctgtgtcagggtcggggggtgcagaaagtcaggacagaatgagggatagctcggcccccagctcggcctcctcgtcagtgacagatctgtactgcacccctcacagcagtaggtcagacctcgtcctgcccggcacggccggggacttcagcctgagcgccagcctgtcggcctgtacgctgctctacgagggggccgtggagcccatgcagatcgacgtggacccccaggaagacccgcagaatgcacctgacgtcaactacgtggtggagaaccccagcctggatctggaacagtacgcggccagctacagcggcctgatgcgcatcgaacggctgcagttcattgctgatcactgccccacgctgcgggtggaggccctgaagatggccctctccttcgtgcagagaacctttaacgtggacatgtacgaggagatccaccgcaagctctcagaggccaccagggagctgcagaacgcacccgacgccatccctgagagcggcgtggagcccccagccctggacacggcctgggtggaggccacgcggaagaaggcgctgctgaagctggagaagctggacacagacctgaagaactacaagggcaactccatcaaagagagcatccggcgcggccacgacgacctgggcgaccactacctggactgtggggacctcagcaacgccctcaagtgctattcccgggcccgggactactgcaccagcgccaaacacgtcatcaacatgtgcctcaatgtcatcaaggtcagcgtctacttgcagaattggtctcatgtgctcagctacgtcagcaaggctgagtccaccccagagattgccgagcagcgaggagagcgtgacagccagacccaggccatcctcaccaagctcaagtgtgccgcaggcttggcagagctggccgccaggaagtacaagcaggctgccaagtgcctcctgctggcttcctttgatcactgtgacttccctgagctgctgtcccccagcaacgtggccatctacggtggcctgtgcgccttggctacctttgaccggcaggagctgcagcgcaatgtcatctccagcagctccttcaagttgttcttggagctggagccacaggtccgagacatcatcttcaaattctacgagtccaagtacgcctcatgtctcaagatgctggacgagatgaaggacaacctgctcctggacatgtatctggccccccatgtcaggaccctgtacacccagattcgcaaccgtgccctcatccagtatttcagcccctacgtgtcagccgacatgcataggatggcggcagccttcaataccacggtggccgccctggaggacgagctgacgcagctaatcctggaggggctgatcagtgcccgtgtggactcacacagcaagatcctatacgcccgggacgtggatcagcgcagcaccacctttgagaagtctctgttgatgggcaaggagttccagcgccgcgccaaggccatgatgctgcgggcagctgtgctccgcaaccagatccatgtcaagtccccgcccagagaagggagccagggggagctgactccagccaacagccagtcccggatgagcaccaacatgtga

SEQ ID NO: 11492 - DNA, 4076 bp, Homo sapiens
gccaagcgcaggaggggagggagccccggtgggcccggggcctgcggagggagccgagctcttggtgcttttcccgaaggagcgcgggaggcccacgggtccggcgagtgcccggcatggcggcttttccagcctgctttgtgttaagccgaggtcctggcttctctgtgtctcccagctgggggccatgaggctccctgagatgactcttttccccttctcccaactccgtggcgtgactctcagcccagtattgctgctccgctgctcaggacagattccgggggctggtcctcctgcctcctggggttgaggtggcgtcccgttcttctccgtggcttggaggaaactacatcaggatggtggctgggaacgtgtaggggccctcagaggcccctgtgtagttggttgtcccctgtctgctttctggctttcagagatgagcggctagaatcaggcgaggggtttctgcttctgagccttagagtcttgtgaggagacccctccctgatgtggtggcacaggagcctgggtgggggcgggggtgactgggagggcacacctgggggacagcagcggcgggagtgtggtccgactggcctggaagatcttgggcagagctgacctcagagaacagtgcgggtctctcgccctcctggggcagtccccaggacgaggtgccaggtgcctggcccatgttgcagggggccgtggagcccatgcagatcgacgtggacccccaggaagacccgcagaatgcacctgacgtcaactacgtggtggagaaccccagcctggatctggaacagtacgcggccagctacagcggcctgatgcgcatcgaacggctgcagttcattgctgatcactgccccacgctgcgggtggaggccctgaagatggccctctccttcgtgcagagaacctttaacgtggacatgtacgaggagatccaccgcaagctctcagaggccaccaggtgaggccaggggcttggcgagaggaagcagaggccaccaagggagcgcgggtgtctgggactgggcccccttcctgtgccctgcatctcccacccctgtgctgggaagtcgggcgggtagagctctcgctctcttttggccagcagtggaagtgccctgtgtgtgtgtggcttctgtgtgtgtgcatgcagggctttgattccaaggggagctgttggagactgtggctcaggggccgcctccctgctggtttccccacccggctgtaggctcctggggcagcagttctctctgtggccctggtgcagactggtccctagaggtggggtttgaggccagcgggaggtgcccacctgtgtgccggttgggcctttgagggcagcctgagattggcggcttcctcccctcctccctggcccccgtgaccgccgccatcctgatggccaggtcctctctcagggagctgcagaacgcacccgacgccatccctgagagcggcgtggagcccccagccctggacacggcctgggtggaggccacgcggaagaaggcgctgctgaagctggagaagctggacacagacctgaagaactacaagggcaactccatcaaagagagcatccggcgcggccacgacgacctgggcgaccactacctggactgtggggacctcagcaacgccctcaagtgctattcccgggcccgggactactgcaccagcgccaaacacgtcatcaacatgtgcctcaatgtcatcaaggtcagcgtctacttgcagaattggtctcatgtgctcagctacgtcagcaaggctgagtccaccccagagattgccgaggtacgggccacctcctcagagaccttgcccccaggattcctgaccactgctggcccctcctgtcctcccccacctcattctcccccagatctgaatctgccttcatcccctctcagtctgggggctgggcatcgagctctaggaaatgtggagcatgggcctcacgcatgtggcttcctcctacagcagcgaggagagcgtgacagccagacccaggccatcctcaccaagctcaagtgtgccgcaggtgagggcctgggtcacgcccagctgaccccacgttcccctgttgctaagtcctcccagcccagggcagtaggctggtccctgcctcagccagggaaaacttccctggcagggcgcaggatgttgtgggcacatgtacaggtgtaggtggtgcctaaagtctgccccggggaagccagtgggtgacgtgtggtcagggtctggctgctgtcactgtgggcgtgaggcaggtctgccagcccgagctgctctgaactggggtgtcctttgcagccctgctagcacctagggcttccctgcatgcctggcttcagggagcctcctcagcattggtggggctctttccacccgtgactagagtatctgtccccagcgctgaggaacagctcccggggcaggagaggccagcgagccggctggtggtcgcgttctccctggtttccaggcgttagcggcttccccaggctctggggtcttaccccctctcccccctccccgcccccggctccttccactaggcttggcagagctggccgccaggaagtacaagcaggctgccaagtgcctcctgctggcttcctttgatcactgtgacttccctgaggtgaggagccctctggggacttgggaggcagagcatgggctcatgggtcaggctgcttctgtaggagggtgaggtctctcacaaatggggtcttaggcattctccgagcgggtgatgggcaggcaggggtggcctggcccttcactgcctgtgacgccaggtctctgctcctcagctgctgtcccccagcaacgtggccatctacggtggcctgtgcgccttggctacctttgaccggcaggagctgcagcgcaatgtcatctccagcaggtaggtgccccggtcctgcagccctgaaggctgtccccgtccctctccgtggctgctgcttcggccttgcatgtcctggccccctggccccagcgttttctcaggtgtttgtctggggactggtgtcccactggccacttggagggaggggcaggcagaggacagagttctgaggggtctgcctcaccagctccttcaagttgttcttggagctggagccacaggtccgagacatcatcttcaaattctacgagtccaagtacgcctcatgtctcaagatgctggacgagatgaagtatttcagcccctacgtgtcagccgacatgcataggatggcggcagccttcaataccacggtggccgccctggaggacgagctgacgcagctaatcctggaggggctgatcagtgcccgtgtggactcacacagcaaggtggctgtgggctgcggggcggtgggggcagctgggggtgagcctgggccccgctgagcttgtgcctgcacagatcctatacgcccgggacgtggatcagcgcagcaccacctttgagaagtctctgttgatgggcaaggagttccagcgccgcgccaaggccatgatgctgcgggcagctgtgctccgcaaccagatccatgtcaaggtgggctggcttgagggggggcaggcgcacggcgtgtggggcctggtggctgtgagctgctccttgtctcccctgcagtccccgcccagagaagggagccagggggagctgactccagccaacagccagtcccggatgagcaccaacatgtgaggggtgaaccttggcctccaggacatctgcaccccctccccacctccacggacctcggacctccaggcggctcagtgctgcctgcggcccagctaaggggcctggccactgggtgccacccagcctgtgtgccctccctggggctgaggaggcaggcggctgctagttgtggcccttcctggaaggagaggcctgcagggctcgaccctgtgggtttctgtccccagggagcagactgtgcggcacccaggcccagtggcaccatttcccagacccctcctgttcccgcctcagtcaggtgcagacaagtgggcggtgtccattaaagagcagactcagcgtt

SEQ ID NO: 11493 - DNA, 2347 bp, Homo sapiens
gctgccccggaagtggacggcacgccgcggcggggtgggtgcaagatgccgctgccggttcaggtgtttaacttgcaggtaacgagccgaggccgccccgggcctccgcgcccccgcgccccccgccactggggccgggctgaggtcgagcaggggcgcggggcctgcgccaggagtcggtcgggcacgctccgtgccgggcctccgcgggcagcgcgcgtcgggggctgcagggccgagggcgcgtctccgccgtggctgcgcgctgcgatcgggggccgccgggccgcgcccgccccgcctcccctcccagcagctcacgggagaggttcccggccgccccgacgctaacgctctttctcccttcagcagccagccagctctgtgtcagggtcggggggtgcagaaagtcaggacagaatgagggatagctcggcccccagctcggcctcctcgtcagtgacagatctgtactgcacccctcacagcagtaggtcagacctcgtcctgcccggcacggccggggacttcagcctgagcgccagcctgtcggcctgtacgctgctctacgagggggccgtggagcccatgcagatcgacgtggacccccaggaagacccgcagaatgcacctgacgtcaactacgtggtggagaaccccagcctggatctggaacagtacgcggccagctacagcggcctgatgcgcatcgaacggctgcagttcattgctgatcactgccccacgctgcgggtggaggccctgaagatggccctctccttcgtgcagagaacctttaacgtggacatgtacgaggagatccaccgcaagctctcagaggccaccagggagctgcagaacgcacccgacgccatccctgagagcggcgtggagcccccagccctggacacggcctgggtggaggccacgcggaagaaggcgctgctgaagctggagaagctggacacagacctgaagaactacaagggcaactccatcaaagagagcatccggcgcggccacgacgacctgggcgaccactacctggactgtggggacctcagcaacgccctcaagtgctattcccgggcccgggactactgcaccagcgccaaacacgtcatcaacatgtgcctcaatgtcatcaaggtcagcgtctacttgcagaattggtctcatgtgctcagctacgtcagcaaggctgagtccaccccagagattgccgagcagcgaggagagcgtgacagccagacccaggccatcctcaccaagctcaagtgtgccgcaggcttggcagagctggccgccaggaagtacaagcaggctgccaagtgcctcctgctggcttcctttgatcactgtgacttccctgagctgctgtcccccagcaacgtggccatctacggtggcctgtgcgccttggctacctttgaccggcaggagctgcagcgcaatgtcatctccagcagctccttcaagttgttcttggagctggagccacaggtccgagacatcatcttcaaattctacgagtccaagtacgcctcatgtctcaagatgctggacgagatgaaggacaacctgctcctggacatgtatctggccccccatgtcaggaccctgtacacccagattcgcaaccgtgccctcatccagtatttcagcccctacgtgtcagccgacatgcataggatggcggcagccttcaataccacggtggccgccctggaggacgagctgacgcagctaatcctggaggggctgatcagtgcccgtgtggactcacacagcaagatcctatacgcccgggacgtggatcagcgcagcaccacctttgagaagtctctgttgatgggcaaggagttccagcgccgcgccaaggccatgatgctgcgggcagctgtgctccgcaaccagatccatgtcaagtccccgcccagagaagggagccagggggagctgactccagccaacagccagtcccggatgagcaccaacatgtgaggggtgaaccttggcctccaggacatctgcaccccctccccacctccacggacctcggacctccaggcggctcagtgctgcctgcggcccagctaaggggcctggccactgggtgccacccagcctgtgtgccctccctggggctgaggaggcaggcggctgctagttgtggcccttcctggaaggagaggcctgcagggctcgaccctgtgggtttctgtccccagggagcagactgtgcggcacccaggcccagtggcaccatttcccagacccctcctgttcccgcctcagtcaggtgcagacaagtgggcggtgtccattaaagagcagactcagcgtt

SEQ ID NO: 11494 - DNA, 1869 bp, Homo sapiens
cccgaccagatcccgtggttctgaggaccggccctggaaccctgcgtccttccgacccaccagctccctcgaggatggacttgaggctggatgctttcctcttcccactttttgtcccaacagaagtccctgatctccaggatccctgactggctgtgcagagctggcacagccacactccacgggcttccagcccttcaggcccagctctcccggagagcaccagagtccctttgctccatttacttgcgctcttcagccagcaagtgtttcctaatgtctcacccccagtcccagctttcctgctgcaatttccgcctgttccctcccatttcaggccttaagggagtgtggctgggcttctctcctccccctcactccaaagccgcacttgatacaaggtggaaatcaaagcaccacttctggcttcccagccttgaacttgcccttccctctcaatgtatctggtttcctcagcttccctgtgcagcaagagtgtcactcccctcttgcttttcccaagctccccatgcgcccctctcagcagatctgtcttagaggggccaggtgcagagaaaggcagaaatcctaataatgttcccagcgatcgctgcctgtcgcggagtgctgaagggccaagtgttgatctgagtcctcatcacacgggacttcatttagtctcacgataggcatgccggctgccgctccaggactcccctgtccccaggaccaagatgacgcccaacagcactggcgaggtgcccagccccattcccaagggggctttggggctctccctggccctggcaagcctcatcatcaccgcgaacctgctcctagccctgggcatcgcctgggaccgccgcctgcgcagcccacctgctggctgcttcttcctgagcctactgctggctgggctgctcacgggtctggcattgcccacattgccagggctgtggaaccagagtcgccggggttactggtcctgcctcctcgtctacttggctcccaacttctccttcctctccctgcttgccaacctcttgctggtgcacggggagcgctacatggcagtcctgaggccactccagccccctgggagcattcggctggccctgctcctcacctgggctggtcccctgctctttgccagtctgcccgctctggggtggaaccactggacccctggtgccaactgcagctcccaggctatcttcccagccccctacctgtacctcgaagtctatgggctcctgctgcccgccgtgggtgctgctgccttcctctctgtccgcgtgctggccactgcccaccgccagctgcaggacatctgccggctggagcgggcagtgtgccgcgatgagccctccgccctggcccgggcccttacctggaggcaggcaagggcacaggctggagccatgctgctcttcgggctgtgctgggggccctacgtggccacactgctcctctcagtcctggcctatgagcagcgcccgccactggggcctgggacactgttgtccctcctctccctaggaagtgccagtgcagcggcagtgcccgtagccatggggctgggcgatcagcgctacacagccccctggagggcagccgcccaaaggtgcctgcaggggctgtggggaagagcctcccgggacagtcccggccccagcattgcctaccacccaagcagccaaagcagtgtcgacctggacttgaactaaaggaagggcctctgctgactcctaccagagcatccgtccagctcagccatccagcctgtctctaccgggccccacttctctggatcagagaccctgcctctgtttgaccccgcactgactgaataaagctcctctggccgtt

SEQ ID NO: 11495 - DNA, 1382 bp, Homo sapiens
gagaacccagacgggcagagcctgggtaggagagcctggccccgctgtccccactgggtggagacaccatgcacttggtccacttgtgctcttcagccaggacaccagacatggtccaaaccgctgcagggctggctgcagcaactccctgacactcaggaaggcccaggctgggcaggcaatacctgctcccaacagccatgcatgccggctgccgctccaggactcccctgtccccaggaccaagatgacgcccaacagcactggcgaggtgcccagccccattcccaagggggctttggggctctccctggccctggcaagcctcatcatcaccgcgaacctgctcctagccctgggcatcgcctgggaccgccgcctgcgcagcccacctgctggctgcttcttcctgagcctactgctggctgggctgctcacgggtctggcattgcccacattgccagggctgtggaaccagagtcgccggggttactggtcctgcctcctcgtctacttggctcccaacttctccttcctctccctgcttgccaacctcttgctggtgcacggggagcgctacatggcagtcctgaggccactccagccccctgggagcattcggctggccctgctcctcacctgggctggtcccctgctctttgccagtctgcccgctctggggtggaaccactggacccctggtgccaactgcagctcccaggctatcttcccagccccctacctgtacctcgaagtctatgggctcctgctgcccgccgtgggtgctgctgccttcctctctgtccgcgtgctggccactgcccaccgccagctgcaggacatctgccggctggagcgggcagtgtgccgcgatgagccctccgccctggcccgggcccttacctggaggcaggcaagggcacaggctggagccatgctgctcttcgggctgtgctgggggccctacgtggccacactgctcctctcagtcctggcctatgagcagcgcccgccactggggcctgggacactgttgtccctcctctccctaggaagtgccagtgcagcggcagtgcccgtagccatggggctgggcgatcagcgctacacagccccctggagggcagccgcccaaaggtgcctgcaggggctgtggggaagagcctcccgggacagtcccggccccagcattgcctaccacccaagcagccaaagcagtgtcgacctggacttgaactaaaggaagggcctctgctgactcctaccagagcatccgtccagctcagccatccagcctgtctctaccgggccccacttctctggatcagagaccctgcctctgtttgaccccgcactgactgaataaagctcctctggccgtt

SEQ ID NO: 11496 - DNA, 1465 bp, Homo sapiens
gcctgggtaggagagcctggccccgctgtccccactgggtggagacaccatgcacttggtccacttgtgctcttcagccaggacaccagacatggtccaaaccgctgcagggctggctgcagcaactccctgacactcaggaaggcccaggctgggcaggcaatacctgctcccaacagccatcgaacatgatacagcccacagcctgcgggtctgcgcccctggattaacatgctgccctgccaggaggacacgacctgcagccccatcctaactctggccaccccatcctgcaggcatgccggctgccgctccaggactcccctgtccccaggaccaagatgacgcccaacagcactggcgaggtgcccagccccattcccaagggggctttggggctctccctggccctggcaagcctcatcatcaccgcgaacctgctcctagccctgggcatcgcctgggaccgccgcctgcgcagcccacctgctggctgcttcttcctgagcctactgctggctgggctgctcacgggtctggcattgcccacattgccagggctgtggaaccagagtcgccggggttactggtcctgcctcctcgtctacttggctcccaacttctccttcctctccctgcttgccaacctcttgctggtgcacggggagcgctacatggcagtcctgaggccactccagccccctgggagcattcggctggccctgctcctcacctgggctggtcccctgctctttgccagtctgcccgctctggggtggaaccactggacccctggtgccaactgcagctcccaggctatcttcccagccccctacctgtacctcgaagtctatgggctcctgctgcccgccgtgggtgctgctgccttcctctctgtccgcgtgctggccactgcccaccgccagctgcaggacatctgccggctggagcgggcagtgtgccgcgatgagccctccgccctggcccgggcccttacctggaggcaggcaagggcacaggctggagccatgctgctcttcgggctgtgctgggggccctacgtggccacactgctcctctcagtcctggcctatgagcagcgcccgccactggggcctgggacactgttgtccctcctctccctaggaagtgccagtgcagcggcagtgcccgtagccatggggctgggcgatcagcgctacacagccccctggagggcagccgcccaaaggtgcctgcaggggctgtggggaagagcctcccgggacagtcccggccccagcattgcctaccacccaagcagccaaagcagtgtcgacctggacttgaactaaaggaagggcctctgctgactcctaccagagcatccgtccagctcagccatccagcctgtctctaccgggccccacttctctggatcagagaccctgcctctgtttgaccccgcactgactgaataaagctc

SEQ ID NO: 11497 - DNA, 2003 bp, Homo sapiens
gagaacccagacgggcagagcctgggtaggagagcctggccccgctgtccccactgggtggagacaccatgcacttggtccacttgtgctcttcagccaggacaccagacatggtccaaaccgctgcagggctggctgcagcaactccctgacactcaggaaggcccaggctgggcaggcaatacctgctcccaacagccatctcccaggaaggaccctgttgctagtgtggagcaaagacgagtcaagtttatgggctggaagtcctacccggaggctgctcactgagctgtgatggctacaaggacagatggggggaagggtgcagggtgcccgagacctggcccgctggagcctgtcacctaatggctggctggaagaccactacacaccagccagccctggtccattctctcatttagaggcctccccggtggaggcagggatacacaaaatgctttggggctggatgggcccgcctttcagtctaaacaagagacctcaacacagctgcccagaaaaggcagataccagaaatggataaagctggctgggtggggactgtccgaagggcagccagcagtgagctccggctggttgctaccacacaggacatatgtgttgccagacctgaattttcaatagaaaccaaagatagttttttatataaatgtttaattggcaattaattgaaaaattctgtgtatcagcgaacatgatacagcccacagcctgcgggtctgcgcccctggattaacatgctgccctgccaggaggacacgacctgcagccccatcctaactctggccaccccatcctgcaggcatgccggctgccgctccaggactcccctgtccccaggaccaagatgacgcccaacagcactggcgaggtgcccagccccattcccaagggggctttggggctctccctggccctggcaagcctcatcatcaccgcgaacctgctcctagccctgggcatcgcctgggaccgccgcctgcgcagcccacctgctggctgcttcttcctgagcctactgctggctgggctgctcacgggtctggcattgcccacattgccagggctgtggaaccagagtcgccggggttactggtcctgcctcctcgtctacttggctcccaacttctccttcctctccctgcttgccaacctcttgctggtgcacggggagcgctacatggcagtcctgaggccactccagccccctgggagcattcggctggccctgctcctcacctgggctggtcccctgctctttgccagtctgcccgctctggggtggaaccactggacccctggtgccaactgcagctcccaggctatcttcccagccccctacctgtacctcgaagtctatgggctcctgctgcccgccgtgggtgctgctgccttcctctctgtccgcgtgctggccactgcccaccgccagctgcaggacatctgccggctggagcgggcagtgtgccgcgatgagccctccgccctggcccgggcccttacctggaggcaggcaagggcacaggctggagccatgctgctcttcgggctgtgctgggggccctacgtggccacactgctcctctcagtcctggcctatgagcagcgcccgccactggggcctgggacactgttgtccctcctctccctaggaagtgccagtgcagcggcagtgcccgtagccatggggctgggcgatcagcgctacacagccccctggagggcagccgcccaaaggtgcctgcaggggctgtggggaagagcctcccgggacagtcccggccccagcattgcctaccacccaagcagccaaagcagtgtcgacctggacttgaactaaaggaagggcctctgctgactcctaccagagcatccgtccagctcagccatccagcctgtctctaccgggccccacttctctggatcagagaccctgcctctgtttgaccccgcactgactgaataaagctcctctggccgtt

SEQ ID NO: 11498 - DNA, 2778 bp, Homo sapiens
ggaaaacgacacctagaagtaggagtgagattcgctgaagttcccttctgaggaagacccacccctccgcctggagagccggggctggcggtgcctgaggaccccttcggcctggacagcccacgcgggcttggggggcctcgctctgccctcatggggcggccatcggttcccgaagcggcgagtgaaaattcaaatggccagtagggggcgcactcggaagtggccgccccgcatgaggcagttcagcggccccgagagtccggggagggaggtttattctccgcctgcacgagactgtgaaatccgcaaccatgagcaggagaggcggccctggtggggaagaggccaccaacatctggacggcaggtacccagagagtgagcagctccacgcgggactgtgcacggtggccgacacccgcagggacgcccgccggacgagcacgcggagggccctcgcctccacggatgcaccatgccggtgtgaggagcatctgttcttcccactctctgcagttaacaaacccaacccaaaccaccacaggtgctcctcctggggagtttcctgtctgacaaatgccaggctcacttcaaggagaatcacgcttctttctaaagatggattcaccatttaaaacagagctctgggagcctttcggcaaatcttgaaagctgcacggtgcagagacatggatgtgacttcccaagcccggggcgtgggcctggagatgtacccaggcaccgcgcagcctgcggcccccaacaccacctcccccgagctcaacctgtcccacccgctcctgggcaccgccctggccaatgggacaggtgagctctcggagcaccagcagtacgtgatcggcctgttcctctcgtgcctctacaccatcttcctcttccccatcggctttgtgggcaacatcctgatcctggtggtgaacatcagcttccgcgagaagatgaccatccccgacctgtacttcatcaacctggcggtggcggacctcatcctggtggccgactccctcattgaggtgttcaacctgcacgagcggtactacgacatcgccgtcctgtgcaccttcatgtcgctcttcctgcaggtcaacatgtacagcagcgtcttcttcctcacctggatgagcttcgaccgctacatcgccctggccagggccatgcgctgcagcctgttccgcaccaagcaccacgcccggctgagctgtggcctcatctggatggcatccgtgtcagccacgctggtgcccttcaccgccgtgcacctgcagcacaccgacgaggcctgcttctgtttcgcggatgtccgggaggtgcagtggctcgaggtcacgctgggcttcatcgtgcccttcgccatcatcggcctgtgctactccctcattgtccgggtgctggtcagggcgcaccggcaccgtgggctgcggccccggcggcagaaggcgctccgcatgatcctcgcggtggtgctggtcttcttcgtctgctggctgccggagaacgtcttcatcagcgtgcacctcctgcagcggacgcagcctggggccgctccctgcaagcagtctttccgccatgcccaccccctcacgggccacattgtcaacctcgccgccttctccaacagctgcctaaaccccctcatctacagctttctcggggagaccttcagggacaagctgaggctgtacattgagcagaaaacaaatttgccggccctgaaccgcttctgtcacgctgccctgaaggccgtcattccagacagcaccgagcagtcggatgtgaggttcagcagtgccgtgtagacagccttggccgcataggcccagccagggtgtgactcgggagctgcacacacctgggtggacacaaggcacggccacgtcatgtctctaaactgcggtcagatgtggcttctggctcctcggggcctcgcgagggtcacgcttgcctggtcaccctggggctgcttaggaaacctcacgactggtcaccttgcactcctcacacagaattgctacaatcccaaagcgctcgccccgcagggtccaaaggccagcggtgaccagcctgtcacccagctcctccccgccaaccctgcctgccgctgcacctgcctgccgctgcaggaaacatttctgacaccgtcgaccaggaaagccacacggagaggccactgtgggtgaagcgcctcagttacacaggaaccctaaagcaaatctgccaccgtgggggaactgacgctggagatgcaaggtgctggtgggtctgagctggacgtcgcggtgtgtcctctgtgcccacggtctgagctagctagcgcaccgccgagttaaagaggagaaggaaaacatgctgctctggtgcacgcctgagcgtcctccatcttccaggatggcagcaatggcgctgtgcggcctcaccaggcccacgaggagcagcagcgctcggcccggagcagcaggaaggcccctctgtggagcgcccgccgtctgctccggggtggttcagtcactgcttgttgacatcaacatggcaattgcactcatgtggactgggaccgtgcgagctgccgtgtgggttagtcgggtgccaggacaatgaaatactccagcacctgtggctgacgaatttgtttctacagaaataacagctggggacaactgcggtgatgatgtaaaaaccttcccataaaatgtaagaaaagctgatgaggctggtgacgttcagcctttgtcaataaacctgtcatgtgcggatcctt

SEQ ID NO: 11499 - DNA, 571 bp, Homo sapiens
atgtctctaaactgcggtcagatgtggcttctggctcctcggggcctcgcgagggtcacgcttgcctggtcaccctggggctgcttaggaaacctcacgactggtcaccttgcactcctcacacagaattgctacaatcccaaagcgctcgccccgcagggtccaaaggccagcggtgaccagcctgtcacccagctcctccccgccaaccctgcctgccgctgcacctgcctgccgctgcaggaaacatttctgagcgtcctccatcttccaggatggcagcaatggcgctgtgcggcctcaccaggcccacgaggagcagcagcgctcggcccggagcagcaggaaggcccctctgtggagcgcccgccgtctgctccggggtggttcagtcactgcttgttgacatcaacatggcaattgcactcatgtggactgggaccgtgcgagctgccgtgtgggttagtcgggtgccaggacaatgaaatactccagcacctgtggctgacgaatttgtttctacagaaataacagctggggacaactgcggtgatgatgtaaaaaccttccc

SEQ ID NO: 11500 - DNA, 2639 bp, Homo sapiens
aaagccctgtgccaaggggcagactcactggctcagagggaggacgcacccgccagccagccgggaaccttccctcgcgggctcccagggcgggtctcttcctctctctagccctgctcaggcattcggcaggtccagcagaggtacacctcctgcagcgggttccaagtgcacctccagcctgatgggcctgaccaaggaggcttccaggagcacagaaggggctgcaacccaggtacccagagagtgagcagctccacgcgggactgtgcacggtggccgacacccgcagggacgcccgccggacgagcacgcggagggccctcgcctccacggatgcaccatgccggtgtgaggagcatctgttcttcccactctctgcagttaacaaacccaacccaaaccaccacaggtgctcctcctggggagtttcctgtctgacaaatgccaggctcacttcaaggagaatcacgcttctttctaaagatggattcaccatttaaaacagagctctgggagcctttcggcaaatcttgaaagctgcacggtgcagagacatggatgtgacttcccaagcccggggcgtgggcctggagatgtacccaggcaccgcgcagcctgcggcccccaacaccacctcccccgagctcaacctgtcccacccgctcctgggcaccgccctggccaatgggacaggtgagctctcggagcaccagcagtacgtgatcggcctgttcctctcgtgcctctacaccatcttcctcttccccatcggctttgtgggcaacatcctgatcctggtggtgaacatcagcttccgcgagaagatgaccatccccgacctgtacttcatcaacctggcggtggcggacctcatcctggtggccgactccctcattgaggtgttcaacctgcacgagcggtactacgacatcgccgtcctgtgcaccttcatgtcgctcttcctgcaggtcaacatgtacagcagcgtcttcttcctcacctggatgagcttcgaccgctacatcgccctggccagggccatgcgctgcagcctgttccgcaccaagcaccacgcccggctgagctgtggcctcatctggatggcatccgtgtcagccacgctggtgcccttcaccgccgtgcacctgcagcacaccgacgaggcctgcttctgtttcgcggatgtccgggaggtgcagtggctcgaggtcacgctgggcttcatcgtgcccttcgccatcatcggcctgtgctactccctcattgtccgggtgctggtcagggcgcaccggcaccgtgggctgcggccccggcggcagaaggcgctccgcatgatcctcgcggtggtgctggtcttcttcgtctgctggctgccggagaacgtcttcatcagcgtgcacctcctgcagcggacgcagcctggggccgctccctgcaagcagtctttccgccatgcccaccccctcacgggccacattgtcaacctcgccgccttctccaacagctgcctaaaccccctcatctacagctttctcggggagaccttcagggacaagctgaggctgtacattgagcagaaaacaaatttgccggccctgaaccgcttctgtcacgctgccctgaaggccgtcattccagacagcaccgagcagtcggatgtgaggttcagcagtgccgtgtagacagccttggccgcataggcccagccagggtgtgactcgggagctgcacacacctgggtggacacaaggcacggccacgtcatgtctctaaactgcggtcagatgtggcttctggctcctcggggcctcgcgagggtcacgcttgcctggtcaccctggggctgcttaggaaacctcacgactggtcaccttgcactcctcacacagaattgctacaatcccaaagcgctcgccccgcagggtccaaaggccagcggtgaccagcctgtcacccagctcctccccgccaaccctgcctgccgctgcacctgcctgccgctgcaggaaacatttctgacaccgtcgaccaggaaagccacacggagaggccactgtgggtgaagcgcctcagttacacaggaaccctaaagcaaatctgccaccgtgggggaactgacgctggagatgcaaggtgctggtgggtctgagctggacgtcgcggtgtgtcctctgtgcccacggtctgagctagctagcgcaccgccgagttaaagaggagaaggaaaacatgctgctctggtgcacgcctgagcgtcctccatcttccaggatggcagcaatggcgctgtgcggcctcaccaggcccacgaggagcagcagcgctcggcccggagcagcaggaaggcccctctgtggagcgcccgccgtctgctccggggtggttcagtcactgcttgttgacatcaacatggcaattgcactcatgtggactgggaccgtgcgagctgccgtgtgggttagtcgggtgccaggacaatgaaatactccagcacctgtggctgacgaatttgtttctacagaaataacagctggggacaactgcggtgatgatgtaaaaaccttcccataaaatgtaagaaaagctgatgaggctggtgacgttcagcctttgtcaataaacctgtcatgtgcgga

SEQ ID NO: 11501 - DNA, 2971 bp, Homo sapiens
gcattactcatactcagcggacaaaggatcactcagcattcaatctcaccacttcaaaacattacagagggaaaacgacacctagaagtaggagtgagattcgctgaagttcccttctgaggaagacccacccctccgcctggagagccggggctggcggtgcctgaggaccccttcggcctggacagcccacgcgggcttggggggcctcgctctgccctcatggggcggccatcggttcccgaagcggcgagtgaaaattcaaatggccagtagggggcgcactcggaagtggccgccccgcatgaggcagttcagcggccccgagagtccggggagggaggtttattctccgcctgcacgagactgtgaaatccgcaaccatgagcaggagaggcggccctggtggggaagaggccaccaacatctggacggcagccctgctcaggcattcggcaggtccagcagaggtacacctcctgcagcgggttccaagtgcacctccagcctgatgggcctgaccaaggaggcttccaggagcacagaaggggctgcaacccaggtacccagagagtgagcagctccacgcgggactgtgcacggtggccgacacccgcagggacgcccgccggacgagcacgcggagggccctcgcctccacggatgcaccatgccggtgtgaggagcatctgttcttcccactctctgcagttaacaaacccaacccaaaccaccacaggtgctcctcctggggagtttcctgtctgacaaatgccaggctcacttcaaggagaatcacgcttctttctaaagatggattcaccatttaaaacagagctctgggagcctttcggcaaatcttgaaagctgcacggtgcagagacatggatgtgacttcccaagcccggggcgtgggcctggagatgtacccaggcaccgcgcagcctgcggcccccaacaccacctcccccgagctcaacctgtcccacccgctcctgggcaccgccctggccaatgggacaggtgagctctcggagcaccagcagtacgtgatcggcctgttcctctcgtgcctctacaccatcttcctcttccccatcggctttgtgggcaacatcctgatcctggtggtgaacatcagcttccgcgagaagatgaccatccccgacctgtacttcatcaacctggcggtggcggacctcatcctggtggccgactccctcattgaggtgttcaacctgcacgagcggtactacgacatcgccgtcctgtgcaccttcatgtcgctcttcctgcaggtcaacatgtacagcagcgtcttcttcctcacctggatgagcttcgaccgctacatcgccctggccagggccatgcgctgcagcctgttccgcaccaagcaccacgcccggctgagctgtggcctcatctggatggcatccgtgtcagccacgctggtgcccttcaccgccgtgcacctgcagcacaccgacgaggcctgcttctgtttcgcggatgtccgggaggtgcagtggctcgaggtcacgctgggcttcatcgtgcccttcgccatcatcggcctgtgctactccctcattgtccgggtgctggtcagggcgcaccggcaccgtgggctgcggccccggcggcagaaggcgctccgcatgatcctcgcggtggtgctggtcttcttcgtctgctggctgccggagaacgtcttcatcagcgtgcacctcctgcagcggacgcagcctggggccgctccctgcaagcagtctttccgccatgcccaccccctcacgggccacattgtcaacctcgccgccttctccaacagctgcctaaaccccctcatctacagctttctcggggagaccttcagggacaagctgaggctgtacattgagcagaaaacaaatttgccggccctgaaccgcttctgtcacgctgccctgaaggccgtcattccagacagcaccgagcagtcggatgtgaggttcagcagtgccgtgtagacagccttggccgcataggcccagccagggtgtgactcgggagctgcacacacctgggtggacacaaggcacggccacgtcatgtctctaaactgcggtcagatgtggcttctggctcctcggggcctcgcgagggtcacgcttgcctggtcaccctggggctgcttaggaaacctcacgactggtcaccttgcactcctcacacagaattgctacaatcccaaagcgctcgccccgcagggtccaaaggccagcggtgaccagcctgtcacccagctcctccccgccaaccctgcctgccgctgcacctgcctgccgctgcaggaaacatttctgacaccgtcgaccaggaaagccacacggagaggccactgtgggtgaagcgcctcagttacacaggaaccctaaagcaaatctgccaccgtgggggaactgacgctggagatgcaaggtgctggtgggtctgagctggacgtcgcggtgtgtcctctgtgcccacggtctgagctagctagcgcaccgccgagttaaagaggagaaggaaaacatgctgctctggtgcacgcctgagcgtcctccatcttccaggatggcagcaatggcgctgtgcggcctcaccaggcccacgaggagcagcagcgctcggcccggagcagcaggaaggcccctctgtggagcgcccgccgtctgctccggggtggttcagtcactgcttgttgacatcaacatggcaattgcactcatgtggactgggaccgtgcgagctgccgtgtgggttagtcgggtgccaggacaatgaaatactccagcacctgtggctgacgaatttgtttctacagaaataacagctggggacaactgcggtgatgatgtaaaaaccttcccataaaatgtaagaaaagctgatgaggctggtgacgttcagcctttgtcaataaacctgtcatgtgcggatcctt

SEQ ID NO: 11502 - DNA, 1542 bp, Homo sapiens
attccatggtactcggagtcctgggaaccactcatcactgtcgggtgcaggtggacgtcccctcacggtacccagagagtgagcagctccacgcgggactgtgcacggtggccgacacccgcagggacgcccgccggacgagcacgcggagggccctcgcctccacggatgcaccatgccggtgtgaggagcatctgttcttcccactctctgcagttaacaaacccaacccaaaccaccacaggtgctcctcctggggagtttcctgtctgacaaatgccaggctcacttcaaggagaatcacgcttctttctaaagatggattcaccatttaaaacagagctctgggagcctttcggcaaatcttgaaagctgcacggtgcagagacatggatgtgacttcccaagcccggggcgtgggcctggagatgtacccaggcaccgcgcagcctgcggcccccaacaccacctcccccgagctcaacctgtcccacccgctcctgggcaccgccctggccaatgggacaggtgagctctcggagcaccagcagtacgtgatcggcctgttcctctcgtgcctctacaccatcttcctcttccccatcggctttgtgggcaacatcctgatcctggtggtgaacatcagcttccgcgagaagatgaccatccccgacctgtacttcatcaacctggcggtggcggacctcatcctggtggccgactccctcattgaggtgttcaacctgcacgagcggtactacgacatcgccgtcctgtgcaccttcatgtcgctcttcctgcaggtcaacatgtacagcagcgtcttcttcctcacctggatgagcttcgaccgctacatcgccctggccagggccatgcgctgcagcctgttccgcaccaagcaccacgcccggctgagctgtggcctcatctggatggcatccgtgtcagccacgctggtgcccttcaccgccgtgcacctgcagcacaccgacgaggcctgcttctgtttcgcggatgtccgggaggtgcagtggctcgaggtcacgctgggcttcatcgtgcccttcgccatcatcggcctgtgctactccctcattgtccgggtgctggtcagggcgcaccggcaccgtgggctgcggccccggcggcagaaggcgctccgcatgatcctcgcggtggtgctggtcttcttcgtctgctggctgccggagaacgtcttcatcagcgtgcacctcctgcagcggacgcagcctggggccgctccctgcaagcagtctttccgccatgcccaccccctcacgggccacattgtcaacctcgccgccttctccaacagctgcctaaaccccctcatctacagctttctcggggagaccttcagggacaagctgaggctgtacattgagcagaaaacaaatttgccggccctgaaccgcttctgtcacgctgccctgaaggccgtcattccagacagcaccgagcagtcggatgtgaggttcagcagtgccgtgtagacagccttggccgcataggcccagc

SEQ ID NO: 11503 - DNA, 1105 bp, Homo sapiens
gcattactcatactcagcggacaaaggatcactcagcattcaatctcaccacttcaaaacattacagagggaaaacgacacctagaagtaggagtgagattcgctgaagttcccttctgaggaagacccacccctccgcctggagagccggggctggcggtgcctgaggaccccttcggcctggacagcccacgcgggcttggggggcctcgctctgccctcatggggcggccatcggttcccgaagcggcgagtgaaaattcaaatggccagtagggggcgcactcggaagtggccgccccgcatgaggcagttcagcggccccgagagtccggggagggaggtttattctccgcctgcacgagactgtgaaatccgcaaccatgagcaggagaggcggccctggtggggaagaggccaccaacatctggacggcagccctgctcaggcattcggcaggtccagcagaggtacacctcctgcagcgggttccaagtgcacctccagcctgatgggcctgaccaaggaggcttccaggagcacagaaggggctgcaacccaggtacccagagagtgagcagctccacgcgggactgtgcacggtggccgacacccgcagggacgcccgccggacgagcacgcggagggccctcgcctccacggatgcaccatgccggtgtgaggagcatctgttcttcccactctctgcagttaacaaacccaacccaaaccaccacaggtgctcctcctggggagtttcctgtctgacaaatgccaggctcacttcaaggagaatcacgcttctttctaaagatggattcaccatttaaaacagagctctgggagcctttcggcaaatcttgaaagctgcacggtgcagagacatggatgtgacttcccaagcccggggcgtgggcctggagatgtacccaggcaccgcgcagcctgcggcccccaacaccacctcccccgagctcaacctgtcccacccgctcctgggcaccgccctggccaatgggacaggtgagctctcggagcaccagcagtacgtgatcggcctgttcctctcgtgcctctacaccatcttcctcttccccatcggctt

SEQ ID NO: 11504 - DNA, 1900 bp, Homo sapiens
cttcaaggagaatcacgcttctttctaaagatggattcaccatttaaaacagagctctgggagcctttcggcaaatcttgaaagctgcacggtgcagagacatggatgtgacttcccaagcccggggcgtgggcctggagatgtacccaggcaccgcgcagcctgcggcccccaacaccacctcccccgagctcaacctgtcccacccgctcctgggcaccgccctggccaatgggacaggtgagctctcggagcaccagcagtacgtgatcggcctgttcctctcgtgcctctacaccatcttcctcttccccatcggctttgtgggcaacatcctgatcctggtggtgaacatcagcttccgcgagaagatgaccatccccgacctgtacttcatcaacctggcggtggcggacctcatcctggtggccgactccctcattgaggtgttcaacctgcacgagcggtactacgacatcgccgtcctgtgcaccttcatgtcgctcttcctgcaggtcaacatgtacagcagcgtcttcttcctcacctggatgagcttcgaccgctacatcgccctggccagggccatgcgctgcagcctgttccgcaccaagcaccacgcccggctgagctgtggcctcatctggatggcatccgtgtcagccacgctggtgcccttcaccgccgtgcacctgcagcacaccgacgaggcctgcttctgtttcgcggatgtccgggaggtgcagtggctcgaggtcacgctgggcttcatcgtgcccttcgccatcatcggcctgtgctactccctcattgtccgggtgctggtcagggcgcaccggcaccgtgggctgcggccccggcggcagaaggcgctccgcatgatcctcgcggtggtgctggtcttcttcgtctgctggctgccggagaacgtcttcatcagcgtgcacctcctgcagcggacgcagcctggggccgctccctgcaagcagtctttccgccatgcccaccccctcacgcacggccacgtcatgtctctaaactgcggtcagatgtggcttctggctcctcggggcctcgcgagggtcacgcttgcctggtcaccctggggctgcttaggaaacctcacgactggtcaccttgcactcctcacacagaattgctacaatcccaaagcgctcgccccgcagggtccaaaggccagcggtgaccagcctgtcacccagctcctccccgccaaccctgcctgccgctgcacctgcctgccgctgcaggaaacatttctgacaccgtcgaccaggaaagccacacggagaggccactgtgggtgaagcgcctcagttacacaggaaccctaaagcaaatctgccaccgtgggggaactgacgctggagatgcaaggtgctggtgggtctgagctggacgtcgcggtgtgtcctctgtgcccacggtctgagctagctagcgcaccgccgagttaaagaggagaaggaaaacatgctgctctggtgcacgcctgagcgtcctccatcttccaggatggcagcaatggcgctgtgcggcctcaccaggcccacgaggagcagcagcgctcggcccggagcagcaggaaggcccctctgtggagcgcccgccgtctgctccggggtggttcagtcactgcttgttgacatcaacatggcaattgcactcatgtggactgggaccgtgcgagctgccgtgtgggttagtcgggtgccaggacaatgaaatactccagcacctgtggctgacgaatttgtttctacagaaataacagctggggacaactgcggtgatgatgtaaaaaccttcccataaaatgtaagaaaagctgatgaggctggtgacgttcagcctttgtcaataaacctgtcatgtgcgg

SEQ ID NO: 11505 - DNA, 2295 bp, Homo sapiens
aaaccacatttccttttccagggcaataacttaaaatattatgtatttccctttgttgcaaagagaggaaatacttcttcctagactcagggcagctgtgacccgtcctcccagagaaatcattaaaccacaaggattcagacagagcccagagccctgaaaactttggccacgcactttcccgcagcagccacaggcaccggcaacttcagagagccagataaaagtggaatgaggaatgcagccgttctgaacaccaccctccatttcattctggaaccgggaaggtacacccaggcatgacaatagcttctctcctcacagaaatttaactgatttcttcattctccatttagcaaggtcatggaagatttggaggaaacattatttgaagaatttgaaaactattcctatgacctagactattactctctggagtctgatttggaggagaaagtccagctgggagttgttcactgggtctccctggtgttatattgtttggcttttgttctgggaattccaggaaatgccatcgtcatttggttcacggggttcaagtggaagaagacagtcaccactctgtggttcctcaatctagccattgcggatttcatttttcttctctttctgcccctgtacatctcctatgtggccatgaatttccactggccctttggcatctggctgtgcaaagccaattccttcactgcccagttgaacatgtttgccagtgtttttttcctgacagtgatcagcctggaccactatatccacttgatccatcctgtcttatctcatcggcatcgaaccctcaagaactctctgattgtcattatattcatctggcttttggcttctctaattggcggtcctgccctgtacttccgggacactgtggagttcaataatcatactctttgctataacaattttcagaagcatgatcctgacctcactttgatcaggcaccatgttctgacttgggtgaaatttatcattggctatctcttccctttgctaacaatgagtatttgctacttgtgtctcatcttcaaggtgaagaagcgaagcatcctgatctccagtaggcatttctggacaattctggttgtggttgtggcctttgtggtttgctggactccttatcacctgtttagcatttgggagctcaccattcaccacaatagctattcccaccatgtgatgcaggctggaatccccctctccactggtttggcattcctcaatagttgcttgaaccccatcctttatgtcctaattagtaagaagttccaagctcgcttccggtcctcagttgctgagatactcaagtacacactgtgggaagtcagctgttctggcacagtgagtgaacagctcaggaactcagaaaccaagaatctgtgtctcctggaaacagctcaataagttattacttttccacaaatcagtatatggctttttatgtgggtcctctgactgatgctttcagattaaaattgtttccaagatagagagccgactccactttcatagttattgtttctggtcactatataggcatcacatttttgtgtggatatgaaacttaggaaggatcctcttgactccttgtgatgtggcaataaattttttttaaaaaactgaaaatacttaggaaggatccgcataatttttttctgcaacttaaatgaaatgcatcattcttgttaattataccatggtgaattaatcacttttgaagcaatatcagttattttttgaataataacttttctaaagccttaagtcttaatattaaatatatgattagccaggcacggtggctgacacctgtaatcccagcactttgggaggccaaggtggggggattacccgaggtcaggaattcgagaccagcctgaccaacatggagaaaccccgtctctactaaaaatacaaaattagccggtcatggtggtgcatgtctgcaaacccagctactcgggaggctgaagcaggagaatcacttgaacctgggaggcagaggttgtggtgagccaacatcacaccattgcactccagcctgggcaacaagagtaaaactctgtctcaaaaataaataaataaaatagataaataaatatatgattaactaattttaaaaatgttaaaatgtattcttaaattcattttaattttgtacaataacctgctagacacatttttaaaatgcaacatgtgtacttaatttctttatgtaatctatgtatatacatttatgaattaaagtaattgttggttatcttaaaa

SEQ ID NO: 11506 - DNA, 603 bp, Homo sapiens
aacagatttacttaaccactggcaaaccacatttccttttccagggcaataacttaaaatattatgtatttccctttgttgcaaagagaggaaatacttcttcctagactcagggcagctgtgacccgtcctcccagagaaatcattaaaccacaaggattcagacagagcccagagccctgaaaactttggccacgcactttcccgcagcagccacaggcaccggcaacttcagagagataaaagtggaatgaggaatgcagccgttctgaacaccaccctccatttcattctggaaccgggaaggtacacccaggcatgacaatagcttctctcctcacagaaatttaactgatttcttcattctccatttagcaaggtcatggaagatttggaggaaacattatttgaagaatttgaaaactattcctatgacctagactattactctctggagtctgatttggaggagaaagtccagctgggagttgttcactgggtctccctggtgttatattgtttggcttttgttctgggaattccaggaaatgccatcgtcatttggttcacggggttcaagtggaagaagacagtcaccactct

SEQ ID NO: 11507 - DNA, 1557 bp, Homo sapiens
attaaaccacaaggattcagacagagcccagagccctgaaaactttggccacgcactttcccgcagcagccacaggcaccggcaacttcagagaggtaattagaacttcggaaatcttagtggaaaagatggagaactaagtcctccgcagactttcccactaagtatcctcaagaatcactttctgcatcgggcaaaacagaattagaagcaagaatctagacaaggcttcgtcctcatttagaagcctttaagaattctctgctttaagtggatgaaaacgtccctgtatggctgggttgccatggttcctcgctgtgacccccagggctactgagcctgccatataaaagtggaatgaggaatgcagccgttctgaacaccaccctccatttcattctggaaccgggaaggtacacccaggcatgacaatagcttctctcctcacagaaatttaactgatttcttcattctccatttagcaaggtcatggaagatttggaggaaacattatttgaagaatttgaaaactattcctatgacctagactattactctctggagtctgatttggaggagaaagtccagctgggagttgttcactgggtctccctggtgttatattgtttggcttttgttctgggaattccaggaaatgccatcgtcatttggttcacggggttcaagtggaagaagacagtcaccactctgtggttcctcaatctagccattgcggatttcatttttcttctctttctgcccctgtacatctcctatgtggccatgaatttccactggccctttggcatctggctgtgcaaagccaattccttcactgcccagttgaacatgtttgccagtgtttttttcctgacagtgatcagcctggaccactatatccacttgatccatcctgtcttatctcatcggcatcgaaccctcaagaactctctgattgtcattatattcatctggcttttggcttctctaattggcggtcctgccctgtacttccgggacactgtggagttcaataatcatactctttgctataacaattttcagaagcatgatcctgacctcactttgatcaggcaccatgttctgacttgggtgaaatttatcattggctatctcttccctttgctaacaatgagtatttgctacttgtgtctcatcttcaaggtgaagaagcgaagcatcctgatctccagtaggcatttctggacaattctggttgtggttgtggcctttgtggtttgctggactccttatcacctgtttagcatttgggagctcaccattcaccacaatagctattcccaccatgtgatgcaggctggaatccccctctccactggtttggcattcctcaatagttgcttgaaccccatcctttatgtcctaattagtaagaagttccaagctcgcttccggtcctcagttgctgagatactcaagtacacactgtgggaagtcagctgttctggcacagtgagtgaacagctcaggaactcagaaaccaagaatctgtgtctcctggaaacagctcaataa

SEQ ID NO: 11508 - DNA, 592 bp, Homo sapiens
attcgaagaacattccatctctgctaatttaacttgccttttcataagcaaaagcctacccagacaaaggagggctgggtgacccccatccattaccgattttcagtctgcagcagaacagctagtagcagtggtttccattcaaaaaacaaacttcttacacaaacataggctggtcgaaagaattaatttgtacaccagataaaagtggaatgaggaatgcagccgttctgaacaccaccctccatttcattctggaaccgggaaggtacacccaggcatgacaatagcttctctcctcacagaaatttaactgatttcttcattctccatttagcaaggtcatggaagatttggaggaaacattatttgaagaatttgaaaactattcctatgacctagactattactctctggagtctgatttggaggagaaagtccagctgggagttgttcactgggtctccctggtgttatattgtttggcttttgttctgggaattccaggaaatgccatcgtcatttggttcacggggttcaagtggaagaagacagtcaccactctgtggttcctcaatctagccattgcgga

SEQ ID NO: 11509 - DNA, 830 bp, Homo sapiens
attctggaaccgggaaggtacacccaggcatgacaatagcttctctcctcacagaaatttaactgttccctatatcatcgatgaaggaacaggagctgattgtaccaaaacacttatatgatttcttcattctccatttagcaaggtcatggaagatttggaggaaacattatttgaagaatttgaaaactattcctatgacctagactattactctctggagtctgatttggaggagaaagtccagctgggagttgttcactgggtctccctggtgttatattgtttggcttttgttctgggaattccaggaaatgccatcgtcatttggttcacggggttcaagtggaagaagacagtcaccactctgtggttcctcaatctagccattgcggatttcatttttcttctctttctgcccctgtacatctcctatgtggccatgaatttccactggccctttggcatctggctgtgcaaagccaattccttcactgcccagttgaacatgtttgccagtgtttttttcctgacagtgatcagcctggaccactatatccacttgatccatcctgtcttatctcatcggcatcgaaccctcaagaactctctgattgtcattatattcatctggcttttggcttctctaattggcggtcctgccctgtacttccgggacactgtggagttcaataatcatactctttgctataacaattttcagaagcatgatcctgacctcactttgatcaggcaccatgttctgacttgggtgaaatttatcattggctatctcttccctttgctaacaatgagtatttgctacttgt

SEQ ID NO: 11510 - DNA, 572 bp, Homo sapiens
gtcatttcaaaagccagataaaagtggaatgaggaatgcagccgttctgaacaccaccctccatttcattctggaaccgggaaggtacacccaggcatgacaatagcttctctcctcacagaaatttaactgatttcttcattctccatttagcaaggtcatggaagatttggaggaaacattatttgaagaatttgaaaactattcctatgacctagactattactctctggagtctgatttggaggagaaagtccagctgggagttgttcactgggtctccctggtgttatattgtttggcttttgttctgggaattccaggaaatgccatcgtcatttggttcacggggttcaagtggaagaagacagtcaccactctgtggttcctcaatctagccattgcggatttcatttttcttctctttctgcccctgtacatctcctatgtggccatgaatttccactggccctttggcatctggctgtgcaaagccaattccttcactgcccagttgaacatgtttgccagtgtttttttcctgacagtgatcagcctggaccactatatcc

SEQ ID NO: 11511 - DNA, 756 bp, Homo sapiens
agctagtagcagtggtttccattcaaaaaacaaacttcttacacaaacataggctggtcgaaagaattaatttgtacaataaaagtggaatgaggaatgcagccgttctgaacaccaccctccatttcattctggaaccgggaaggtacacccaggcatgacaatagcttctctcctcacagaaatttaactgatttcttcattctccatttagcaaggtcatggaagatttggaggaaacattatttgaagaatttgaaaactattcctatgacctagactattactctctggagtctgatttggaggagaaagtccagctgggagttgttcactgggtctccctggtgttatattgtttggcttttgttctgggaattccaggaaatgccatcgtcatttggttcacggggttcaagtggaagaagacagtcaccactctgtggttcctcaatctagccattgcggatttcatttttcttctctttctgcccctgtacatctcctatgtggccatgaatttccactggccctttggcatctggctgtgcaaagccaattccttcactgcccagttgaacatgtttgccagtgtttttttcctgacagtgatcagcctggaccactatatccacttgatccatcctgtcttatctcatcggcatcgaaccctcaagaactctctgattgtcattatattcatctggcttttggcttctctaattggcggtcctgccctgtacttccgggacactg

SEQ ID NO: 11512 - DNA, 547 bp, Homo sapiens
aaaccacaaggattcagacagagcccagagccctgaaaactttggccacgcactttcccgcagcagccacaggcaccggcaacttcagagaggtaattagaacttcggaaatcttagtggaaaagatggagaactaagtcctccgcagactttcccactaagtatcctcaagaatcactttctgcatcgggcaaaacagaattagaagcaagaatctagacaaggcttcgtcctcatttagaagcctttaagaattctctgctttaagtggatgaaaacgtccctgtatggctgggttgccatggttcctcgctgtgacccccagggctactgagcctgccatccagataaaagtggaatgaggaatgcagccgttctgaacaccaccctccatttcattctggaaccgggaaggtacacccaggcatgacaatagcttctctcctcacagaaatttaactgatttcttcattctccatttagcaaggtcatggaagatttggaggaaacattatttgaagaatttgaaaactattcctatgaccta

SEQ ID NO: 11513 - DNA, 1527 bp, Homo sapiens
atgacgtccacctgcaccaacagcacgcgcgagagtaacagcagccacacgtgcatgcccctctccaaaatgcccatcagcctggcccacggcatcatccgctcaaccgtgctggttatcttcctcgccgcctctttcgtcggcaacatagtgctggcgctagtgttgcagcgcaagccgcagctgctgcaggtgaccaaccgttttatctttaacctcctcgtcaccgacctgctgcagatttcgctcgtggccccctgggtggtggccacctctgtgcctctcttctggcccctcaacagccacttctgcacggccctggttagcctcacccacctgttcgccttcgccagcgtcaacaccattgtcgtggtgtcagtggatcgctacttgtccatcatccaccctctctcctacccgtccaagatgacccagcgccgcggttacctgctcctctatggcacctggattgtggccatcctgcagagcactcctccactctacggctggggccaggctgcctttgatgagcgcaatgctctctgctccatgatctggggggccagccccagctacactattctcagcgtggtgtccttcatcgtcattccactgattgtcatgattgcctgctactccgtggtgttctgtgcagcccggaggcagcatgctctgctgtacaatgtcaagagacacagcttggaagtgcgagtcaaggactgtgtggagaatgaggatgaagagggagcagagaagaaggaggagttccaggatgagagtgagtttcgccgccagcatgaaggtgaggtcaaggccaaggagggcagaatggaagccaaggacggcagcctgaaggccaaggaaggaagcacggggaccagtgagagtagtgtagaggccaggggcagcgaggaggtcagagagagcagcacggtggccagcgacggcagcatggagggtaaggaaggcagcaccaaagttgaggagaacagcatgaaggcagacaagggtcgcacagaggtcaaccagtgcagcattgacttgggtgaagatgacatggagtttggtgaagacgacatcaatttcagtgaggatgacgtcgaggcagtgaacatcccggagagcctcccacccagtcgtcgtaacagcaacagcaaccctcctctgcccaggtgctaccagtgcaaagctgctaaagtgatcttcatcatcattttctcctatgtgctatccctggggccctactgctttttagcagtcctggccgtgtgggtggatgtcgaaacccaggtaccccagtgggtgatcaccataatcatctggcttttcttcctgcagtgctgcatccacccctatgtctatggctacatgcacaagaccattaagaaggaaatccaggacatgctgaagaagttcttctgcaaggaaaagcccccgaaagaagatagccacccagacctgcccggaacagagggtgggactgaaggcaagattgtcccttcctacgattctgctacttttccttga

SEQ ID NO: 11514 - DNA, 3162 bp, Homo sapiens
acaagccttgaaactgtgggtaactttacagttctcagatcggcttctcgcaacaggcagtcagttctcactgggccccttggactcccatttcaaaaatggagaagacagatcacagccactgaccagggaccgtgggaggtgccacgtgatggtgaggcatcatgctagggagctgagctctgaccttcctgctgggtgattctccacctctgggctgctagatctacttcctggatgccgtgaagatcctcatgtatgaaaatgaagtcccaggcaaccatgatttgctgcttagtgttctttctgtccacagaatgttcccactatagatccaagattcacctaaaagctggagataaacttcaaagccctgaagggaaacccaagactggaaggatccaagagaaatgcgaaggaccttgtatttcttcttccaactgcagccagccctgtgctaaggactttcatggagaaataggatttacatgtaatcaaaaaaagtggcaaaaatcagctgaaacatgtacaagcctttctgtggaaaaactctttaaggactcaactggtgcatctcgcctttctgtagcagcaccatctatacctctgcatattctagactttcgagctccagagaccattgagagtgtagctcaaggaatccgtaagaactgcccctttgattatgcctgcatcactgacatggtgaaatcatcagaaacaacatctggaaatattgcatttatagtggagttattaaaaaatatttctacagacttgtctgataatgttactcgagagaaaatgaagagctatagtgaagtggccaaccacatcctcgacacagcagccatttcaaactgggctttcattcccaacaaaaatgccagctcggatttgttgcagtcagtgaatttgtttgccagacaactccacatccacaataattctgagaacattgtgaatgaactcttcattcagacaaaagggtttcacatcaaccataatacctcagagaaaagcctcaatttctccatgagcatgaacaataccacagaagatatcttaggaatggtacagattcccaggcaagagctaaggaagctgtggccaaatgcatcccaagccattagcatagctttcccaaccttgggggctatcctgagagaagcccacttgcaaaatgtgagtcttcccagacaggtaaatggtctggtgctatcagtggttttaccagaaaggttgcaagaaatcatactcaccttcgaaaagatcaataaaacccgcaatgccagagcccagtgtgttggctggcactccaagaaaaggagatgggatgagaaagcgtgccaaatgatgttggatatcaggaacgaagtgaaatgccgctgtaactacaccagtgtggtgatgtctttttccattctcatgtcctccaaatcgatgaccgacaaagttctggactacatcacctgcattgggctcagcgtctcaatcctaagcttggttctttgcctgatcattgaagccacagtgtggtcccgggtggttgtgacggagatatcatacatgcgtcacgtgtgcatcgtgaatatagcagtgtcccttctgactgccaatgtgtggtttatcataggctctcactttaacattaaggcccaggactacaacatgtgtgttgcagtgacatttttcagccactttttctacctctctctgtttttctggatgctcttcaaagcattgctcatcatttatggaatattggtcattttccgtaggatgatgaagtcccgaatgatggtcattggctttgccattggctatgggtgcccattgatcattgctgtcactacagttgctatcacagagccagagaaaggctacatgagacctgaggcctgttggcttaactgggacaataccaaagcccttttagcatttgccatcccggcgttcgtcattgtggctgtaaatctgattgtggttttggttgttgctgtcaacactcagaggccctctattggcagttccaagtctcaggatgtggtcataattatgaggatcagcaaaaatgttgccatcctcactccactgctgggactgacctggggttttggaatagccactctcatagaaggcacttccttgacgttccatataatttttgccttgctcaatgctttccagggttttttcatcctgctgtttggaaccattatggatcacaagataagagatgctttgaggatgaggatgtcttcactgaaggggaaatcgagggcagctgagaatgcatcactaggcccaaccaatggatctaaattaatgaatcgtcaaggatgaaatgctgccccatttctcatggatgtcctgagaccaagaggggagatccaggagaaagaggccatggaaagcaggctggagtgaggaggaatggtcatgcttccttggaagactttctcttcttgtcaggagtgactcccaagctcttggtcggccgaagaaaaactgaggataacatttgctgactgggctttaaggagcatgatttatggaccccttaacctacccgtgccctgcaagaggctggcttcttggtcaatcttgactagattaagagtcaatctgcaagccattttatggtctccctggccagctgggggctgtagggccctgctgggcttggtcgtctttcactcctgaggcctgctctgtggctccatagctcagtcctccatcactctgcgtggatcctgggtactttggacagtgagggttcgatccaattttaggggtagggttgggggtgggagtgggagtgtgggttggcaggaggaagaatgagtctactttggagacaattaagtcatggtacgtttcctaaagatagggaacggaagaaaagcaagagaactgtttaatatgctgattattttagtctattttagaccttgagtaaactaatttagcttctaggatccaagtttccttatttgtgaaacaggaaaaaaaaattcttgtaggtattactgtttgtgtgtttgagtttactgcacatgtttgtgtttgtgtatatgtgtcttttaaaaatactatatataaagaagattctggttgttattttagacataaacgaatatatgtacctttcacaacttg

SEQ ID NO: 11515 - DNA, 3074 bp, Homo sapiens
acaagccttgaaactgtgggtaactttacagttctcagatcggcttctcgcaacaggcagtcagttctcactgggccccttggactcccatttcaaaaatggagaagacagatcacagccactgaccagggaccgtgggaggtgccacgtgatggtgaagatcctcatgtatgaaaatgaagtcccaggcaaccatgatttgctgcttagtgttctttctgtccacagaatgttcccactatagatccaagattcacctaaaagctggagataaacttcaaagccctgaagggaaacccaagactggaaggatccaagagaaatgcgaaggaccttgtatttcttcttccaactgcagccagccctgtgctaaggactttcatggagaaataggatttacatgtaatcaaaaaaagtggcaaaaatcagctgaaacatgtacaagcctttctgtggaaaaactctttaaggactcaactggtgcatctcgcctttctgtagcagcaccatctatacctctgcatattctagactttcgagctccagagaccattgagagtgtagctcaaggaatccgtaagaactgcccctttgattatgcctgcatcactgacatggtgaaatcatcagaaacaacatctggaaatattgcatttatagtggagttattaaaaaatatttctacagacttgtctgataatgttactcgagagaaaatgaagagctatagtgaagtggccaaccacatcctcgacacagcagccatttcaaactgggctttcattcccaacaaaaatgccagctcggatttgttgcagtcagtgaatttgtttgccagacaactccacatccacaataattctgagaacattgtgaatgaactcttcattcagacaaaagggtttcacatcaaccataatacctcagagaaaagcctcaatttctccatgagcatgaacaataccacagaagatatcttaggaatggtacagattcccaggcaagagctaaggaagctgtggccaaatgcatcccaagccattagcatagctttcccaaccttgggggctatcctgagagaagcccacttgcaaaatgtgagtcttcccagacaggtaaatggtctggtgctatcagtggttttaccagaaaggttgcaagaaatcatactcaccttcgaaaagatcaataaaacccgcaatgccagagcccagtgtgttggctggcactccaagaaaaggagatgggatgagaaagcgtgccaaatgatgttggatatcaggaacgaagtgaaatgccgctgtaactacaccagtgtggtgatgtctttttccattctcatgtcctccaaatcgatgaccgacaaagttctggactacatcacctgcattgggctcagcgtctcaatcctaagcttggttctttgcctgatcattgaagccacagtgtggtcccgggtggttgtgacggagatatcatacatgcgtcacgtgtgcatcgtgaatatagcagtgtcccttctgactgccaatgtgtggtttatcataggctctcactttaacattaaggcccaggactacaacatgtgtgttgcagtgacatttttcagccactttttctacctctctctgtttttctggatgctcttcaaagcattgctcatcatttatggaatattggtcattttccgtaggatgatgaagtcccgaatgatggtcattggctttgccattggctatgggtgcccattgatcattgctgtcactacagttgctatcacagagccagagaaaggctacatgagacctgaggcctgttggcttaactgggacaataccaaagcccttttagcatttgccatcccggcgttcgtcattgtggctgtaaatctgattgtggttttggttgttgctgtcaacactcagaggccctctattggcagttccaagtctcaggatgtggtcataattatgaggatcagcaaaaatgttgccatcctcactccactgctgggactgacctggggttttggaatagccactctcatagaaggcacttccttgacgttccatataatttttgccttgctcaatgctttccagggttttttcatcctgctgtttggaaccattatggatcacaagataagagatgctttgaggatgaggatgtcttcactgaaggggaaatcgagggcagctgagaatgcatcactaggcccaaccaatggatctaaattaatgaatcgtcaaggatgaaatgctgccccatttctcatggatgtcctgagaccaagaggggagatccaggagaaagaggccatggaaagcaggctggagtgaggaggaatggtcatgcttccttggaagactttctcttcttgtcaggagtgactcccaagctcttggtcggccgaagaaaaactgaggataacatttgctgactgggctttaaggagcatgatttatggaccccttaacctacccgtgccctgcaagaggctggcttcttggtcaatcttgactagattaagagtcaatctgcaagccattttatggtctccctggccagctgggggctgtagggccctgctgggcttggtcgtctttcactcctgaggcctgctctgtggctccatagctcagtcctccatcactctgcgtggatcctgggtactttggacagtgagggttcgatccaattttaggggtagggttgggggtgggagtgggagtgtgggttggcaggaggaagaatgagtctactttggagacaattaagtcatggtacgtttcctaaagatagggaacggaagaaaagcaagagaactgtttaatatgctgattattttagtctattttagaccttgagtaaactaatttagcttctaggatccaagtttccttatttgtgaaacaggaaaaaaaaattcttgtaggtattactgtttgtgtgtttgagtttactgcacatgtttgtgtttgtgtatatgtgtcttttaaaaatactatatataaagaagattctggttgttattttagacataaacgaatatatgtacctttcacaacttg

SEQ ID NO: 11516 - DNA, 3075 bp, Homo sapiens
atgtacactggtccctgtaaggtcctccacctctcatctgggcttttaccaaatagcggtaggtttggtattgttctcagcgatgaataccaggttgtaacatctttatggtgccagctgtatacaacccatgcacctcaacaggcctctggaatgcttcttctgaattatcttgtcatcccatcaaaggcccaagttaacaaaccaggctacatccctaacctaggagaatgttcccactatagatccaagattcacctaaaagctggagataaacttcaaagccctgaagggaaacccaagactggaaggatccaagagaaatgcgaaggaccttgtatttcttcttccaactgcagccagccctgtgctaaggactttcatggagaaataggatttacatgtaatcaaaaaaagtggcaaaaatcagctgaaacatgtacaagcctttctgtggaaaaactctttaaggactcaactggtgcatctcgcctttctgtagcagcaccatctatacctctgcatattctagactttcgagctccagagaccattgagagtgtagctcaaggaatccgtaagaactgcccctttgattatgcctgcatcactgacatggtgaaatcatcagaaacaacatctggaaatattgcatttatagtggagttattaaaaaatatttctacagacttgtctgataatgttactcgagagaaaatgaagagctatagtgaagtggccaaccacatcctcgacacagcagccatttcaaactgggctttcattcccaacaaaaatgccagctcggatttgttgcagtcagtgaatttgtttgccagacaactccacatccacaataattctgagaacattgtgaatgaactcttcattcagacaaaagggtttcacatcaaccataatacctcagagaaaagcctcaatttctccatgagcatgaacaataccacagaagatatcttaggaatggtacagattcccaggcaagagctaaggaagctgtggccaaatgcatcccaagccattagcatagctttcccaaccttgggggctatcctgagagaagcccacttgcaaaatgtgagtcttcccagacaggtaaatggtctggtgctatcagtggttttaccagaaaggttgcaagaaatcatactcaccttcgaaaagatcaataaaacccgcaatgccagagcccagtgtgttggctggcactccaagaaaaggagatgggatgagaaagcgtgccaaatgatgttggatatcaggaacgaagtgaaatgccgctgtaactacaccagtgtggtgatgtctttttccattctcatgtcctccaaatcgatgaccgacaaagttctggactacatcacctgcattgggctcagcgtctcaatcctaagcttggttctttgcctgatcattgaagccacagtgtggtcccgggtggttgtgacggagatatcatacatgcgtcacgtgtgcatcgtgaatatagcagtgtcccttctgactgccaatgtgtggtttatcataggctctcactttaacattaaggcccaggactacaacatgtgtgttgcagtgacatttttcagccactttttctacctctctctgtttttctggatgctcttcaaagcattgctcatcatttatggaatattggtcattttccgtaggatgatgaagtcccgaatgatggtcattggctttgccattggctatgggtgcccattgatcattgctgtcactacagttgctatcacagagccagagaaaggctacatgagacctgaggcctgttggcttaactgggacaataccaaagcccttttagcatttgccatcccggcgttcgtcattgtggctgtaaatctgattgtggttttggttgttgctgtcaacactcagaggccctctattggcagttccaagtctcaggatgtggtcataattatgaggatcagcaaaaatgttgccatcctcactccactgctgggactgacctggggttttggaatagccactctcatagaaggcacttccttgacgttccatataatttttgccttgctcaatgctttccagggttttttcatcctgctgtttggaaccattatggatcacaagataagagatgctttgaggatgaggatgtcttcactgaaggggaaatcgagggcagctgagaatgcatcactaggcccaaccaatggatctaaattaatgaatcgtcaaggatgaaatgctgccccatttctcatggatgtcctgagaccaagaggggagatccaggagaaagaggccatggaaagcaggctggagtgaggaggaatggtcatgcttccttggaagactttctcttcttgtcaggagtgactcccaagctcttggtcggccgaagaaaaactgaggataacatttgctgactgggctttaaggagcatgatttatggaccccttaacctacccgtgccctgcaagaggctggcttcttggtcaatcttgactagattaagagtcaatctgcaagccattttatggtctccctggccagctgggggctgtagggccctgctgggcttggtcgtctttcactcctgaggcctgctctgtggctccatagctcagtcctccatcactctgcgtggatcctgggtactttggacagtgagggttcgatccaattttaggggtagggttgggggtgggagtgggagtgtgggttggcaggaggaagaatgagtctactttggagacaattaagtcatggtacgtttcctaaagatagggaacggaagaaaagcaagagaactgtttaatatgctgattattttagtctattttagaccttgagtaaactaatttagcttctaggatccaagtttccttatttgtgaaacaggaaaaaaaaattcttgtaggtattactgtttgtgtgtttgagtttactgcacatgtttgtgtttgtgtatatgtgtcttttaaaaatactatatataaagaagattctggttgttattttagacataaacgaatatatgtacctttcacaacttg

SEQ ID NO: 11517 - DNA, 1981 bp, Homo sapiens
ggaaataggcgatttaaatattccatcgaggatggcggcccctggctcgagacctgccgctgccgcgtggttttctcggcagcagcccagatgtcaaacagttgttcgttttcagcatgcaagatgtgattttccaatgtgcattcccagcgctgttgcaaacagaccgccgcgagtccgtgtgtgcctgcctcgctcacgctggtgttttgaagtcctaccctgtgttttccccaatgccaaacggcatttttgttgtggggtttaaaccacagagactttggcttttgtttcatttcccaacagttcctcattcccgaagcttgtggcatttggtactggtatctgagcaggggctggctttctgtttgtctgtgtgttttttgcatgatcttggattgtcaccctgctgtatttaaacattaaaaagcctgtcttttcgttgaagaggacaggggttaaaatgaatgaagacctgaaggtcaatttaagcgggctgcctcgggattatttagatgccgctgctgcggagaacatctcggctgctgtctcctcccgggttcctgccgtagagccagagcctgagctcgtagtcaacccctgggacattgtcttgtgtacctcgggaaccctcatctcctgtgaaaatgccattgtggtccttatcatcttccacaaccccagcctgcgagcacccatgttcctgctaataggcagcctggctcttgcagacctgctggccggcattggactcatcaccaattttgtttttgcctacctgcttcagtcagaagccaccaagctggtcacgatcggcctcattgtcgcctctttctctgcctctgtctgcagcttgctggctatcactgttgaccgctacctctcactgtactacgctctgacgtaccattcggagaggacggtcacgtttacctatgtcatgctcgtcatgctctgggggacctccatctgcctggggctgctgcccgtcatgggctggaactgcctccgagacgagtccacctgcagcgtggtcagaccgctcaccaagaacaacgcggccatcctctcggtgtccttcctcttcatgtttgcgctcatgcttcagctctacatccagatctgtaagattgtgatgaggcacgcccatcagatagccctgcagcaccacttcctggccacgtcgcactatgtgaccacccggaaaggggtctccaccctggctatcatcctggggacgtttgctgcttgctggatgcctttcaccctctattccttgatagcggattacacctacccctccatctatacctacgccaccctcctgcccgccacctacaattccatcatcaaccctgtcatatatgctttcagaaaccaagagatccagaaagcgctctgtctcatttgctgcggctgcatcccgtccagtctcgcccagagagcgcgctcgcccagtgatgtgtagcacccttgcacccaggaggactctgcatttaccaagcacttccactgcctggccaaggtttgagatgcttcccttgaattccttgcattggattccctctcaagccacaggagcacttagcattcgtgaaacaatgacatcgttcagatgagttaagtgattgaagtgaaaataatgttaccagtgttttcaccattaaaaaaaattgttgagctctccactcaacattattttgttttgcttgggggcaagggtttccttttatactttgtttggagggctgactgggggtaggaaaggaagggatatgatacgcccatgatgttattagaagtaaatgagtttcagagtttttacctggactttaaaataaatttgagtgattgaggaaaattgagaaagacttactttttccagactattttttttttttacatgatggtagattttttaatgctgcatgtatgtaacagaatatgacccctttcaatccaatacaaatagtttacataa

SEQ ID NO: 11518 - DNA, 4846 bp, Homo sapiens
aaagctgggcgcgcgagccgaggctgctgctcacctgcagccgcgccgctcacctgccgcggagtgcgcgccccgcgccctcccggcccgctccggagcccggccgccccccccttgccacagcgggcaactgcgccgacatgcgacacgagtagcccacgcgcttcggaagcaccggaggagccccctcggcctgggcgagccaagaggacaggggttaaaatgaatgaagacctgaaggtcaatttaagcgggctgcctcgggattatttagatgccgctgctgcggagaacatctcggctgctgtctcctcccgggttcctgccgtagagccagagcctgagctcgtagtcaacccctgggacattgtcttgtgtacctcgggaaccctcatctcctgtgaaaatgccattgtggtccttatcatcttccacaaccccagcctgcgagcacccatgttcctgctaataggcagcctggctcttgcagacctgctggccggcattggactcatcaccaattttgtttttgcctacctgcttcagtcagaagccaccaagctggtcacgatcggcctcattgtcgcctctttctctgcctctgtctgcagcttgctggctatcactgttgaccgctacctctcactgtactacgctctgacgtaccattcggagaggacggtcacgtttacctatgtcatgctcgtcatgctctgggggacctccatctgcctggggctgctgcccgtcatgggctggaactgcctccgagacgagtccacctgcagcgtggtcagaccgctcaccaagaacaacgcggccatcctctcggtgtccttcctcttcatgtttgcgctcatgcttcagctctacatccagatctgtaagattgtgatgaggcacgcccatcagatagccctgcagcaccacttcctggccacgtcgcactatgtgaccacccggaaaggggtctccaccctggctatcatcctggggacgtttgctgcttgctggatgcctttcaccctctattccttgatagcggattacacctacccctccatctatacctacgccaccctcctgcccgccacctacaattccatcatcaaccctgtcatatatgctttcagaaaccaagagatccagaaagcgctctgtctcatttgctgcggctgcatcccgtccagtctcgcccagagagcgcgctcgcccagtgatgtgtagcacccttgcacccaggaggactctgcatttaccaagcacttccactgcctggccaaggtttgagatgcttcccttgaattccttgcattggattccctctcaagccacaggagcacttagcattcgtgaaacaatgacatcgttcagatgagttaagtgattgaagtgaaaataatgttaccagtgttttcaccattaaaaaaaattgttgagctctccactcaacattattttgttttgcttgggggcaagggtttccttttatactttgtttggagggctgactgggggtaggaaaggaagggatatgatacgcccatgatgttattagaagtaaatgagtttcagagtttttacctggactttaaaataaatttgagtgattgaggaaaattgagaaagacttactttttccagactattttttttttttacatgatggtagattttttaatgctgcatgtatgtaacagaatatgacccctttcaatccaatacaaatagtttacataattgtgtttggaagggacctgattttgctaacatgaactcagtaatgtcaccgacactgaaaccgtgaacccattcttatccattctttctttcctttcggcaattactgttcacgagaattccttcggtatttctataaatgttgcaactccttctgcatggtcgactgtgttagctagaccacttgtttcaaatgttgccatgtcaatctagattccaacgggtcatttttcaatatagttttccaatatgtactttctaaaatgaatcctgaagtaggttttgatcttcatatgaagtaggattgattagatccaccattgtagtttcttaagctattgtctgattgttttcagaaaacaaaaggaaaaaatattagcaattgagagtagattaaatttattttaatatattctgaaaaaaactaatgtgacattatcatgaaatgaaaaaaatcacctttcctctctctctgagaatatactaatggttattcttgattgagataattagaataaatattataggccaagtttttctggttcatactgtctgtggtgcataatgcatttgaaacaggcagtcccctattttaatgattaggtttgtttgtcagtgcacagcgtccatctatgactgtgacatataccagctatatcctgtaaggtcataaacagaatgaccattggctgttgatgaaaagttaagtttgaaatcttttaactccttttcaccaaaaaccaatttatacacaataaaaatcacattgcctgttttcagagaacaagaatgtagtcaggaaattgcaaagaagaattcactttaaacacattgtaaaatcgatgtgtctcaggtttcttttctgttcatgcagacaaatgtagacgcaggtaccttccctccatttgcaatggatttatagttatgtctatataatcagtggaaaaaattcttggcagcacattaattgagcccattcagatggcagcaaaagcagtatttcagggtcattggggaatcatttgtaataaattaacctcatcggtttgtcccagatgtgatgcccagggtgctctcaagaccattctgggagcctgcatgctgatgccttctctccagagcatcttctaatgtagcacacgtgtgaaaaaatcctctacttgaatctgtgtctcctccctgaggttacttatggaagcaggagagggactgaaatacttaagaagtgggaaagaattttcaatacataccactgtatgatcaatctaataaaactgatgcctttaaaacatttcttttgaacatttgatggagttagtaggttgaacatgatgagtctgttcgtttttaattaattaaaattgaatagcaccaccataggagacttgacaaaggtaagttggttttgagaggggctaggaaatatccgtaatgaggttttaaaggaataaatgatgattttataaaaatagtggctccatttgcatatctccaatagtcagaattataaagagaataatatgtacttgttgtgaccacatgtgtgccaggccccatgctgcgtgttttactataatcacaaaactactacttttataggtgagaaaactaagactaagagaggcgaggataaaaaatgtgcccgaggccacaaagcacaaggatagagtcagaatttgaagccagcttttccaaagtctaagtcttgctccttccctgtaccttgcaagctttcatccctcagtggataccagggctgaggaaactgatttgtaacacgttcctgtcacagagttttggctctacatttaagacataaaacttggcctggcgcagtggctcacgcctgtaatcccagcactttggggggccaaggcaggtggatcacctgaggtcaggagttcgaaaccagcctgaccaatatggcaaaaccctgtctctactaaaaataaaatttagccgggcgtggtggcgggtgcctgtaatcccagctactcaggaggctgaggcaggagaactgcttgaagacaggaggcagaggtagcagtgaacaaagatcgcaccactgcactccagcctgggtgacagagcaagactccatctcaaaaaaaaaaggacataaaatttcctgtttaaagttacactagttacgtggttgcttttggcccatgtttttaaaacatatagtttcagctaagagatttttcagttcaactaacaacatgcctttaccgtttaaattgtgaaaaatgttggatatttatgtggttttctacaaggtttcttttttcctgtggagctaattatttttaaatgtgcacacatctcaatgtacatatgtgtatgtatgtatttatgcatacgtatacccaataatattaactttgcaacaggaccaaagacctcatggaaaactgtcttatttccaacagtcctgaggtagcagataatcttttactccacataattaaaatttctagctaccaaggaattgatatttttccagtagaaacagttatccttgtaactaggacagttccattactttaccagaatcctgaattagtcaaaactagtcatcgaagttatgactatctagggttttgtttccttttattcctttaactctgtatttctttctatcagtgaagtttgtttttaaaggtacctggggcagggaagcagggtggagatagagcccctccttgcctggagcctacagtaaggagccaggttcaggaggagtggattccttggttgacttggccatgcagaaatagtcttagactcccccaggatttaaaataggattgaaacaagaagtttaaaagagcagaggaggaatagagatacttagtgccaataaaaatatcatggagacttcttcggctttttaaaaaaaatgcttaatccattattaaaataatgattgactttattttatagtaatatgtgataatatgaagttaggatgacttgccatttcagatttaaaatacatattaattaagtgactactatgttgtgattttgaataatgtttaagtttctatattgattgtatgcctggtataataaaggaaaagactgccttattgtccccttt

SEQ ID NO: 11519 - DNA, 3837 bp, Homo sapiens
atgcgaggccacgggaaccactcgcggctgaaatccagatgtgcttctctgggcaacgtccatcaccaccaggcacagatggcgcacggtgcacactgccgagggggccggacaccacagtcaccagacagccggggcccaaccgctgggggccacacccggggcagatggacgtaccggcccatcgaggccctcatcaacgtcagctttcccggagcaaagggtgggagaacggccgagggcgagccctcatgggcgtgggtcttcagaagtggctatttgcagagacaggctcttcctgggcttcccgtctccacccgagtggctgcctgctggtggcaacaccatccaggcagggactcagggttcttgggacctggatttattgacctgctcagagaggagcccagcggccgtgcagatgggaaggcagctgctcagaaaacagggcgtctttatttgttcccgactttcctaggcaacaaattaccagaggccgccgactcgtttggggaaattgcttctgggaacagtgttatttttacctccgtcttgcaatcctctcacccacctggcaccccaccgcccagcgcacgcaagccaagtcccggagctgccatgctcgtctgtgaggaaacgctggagctgggtgcccagggctgctgggggtccacgagcccccggggccaggccgtgagcttggtcggtgggcccacggccggaggctccaggctgggaggggctggctgcaccatgggcctgctcatggccctccaggccagacgccccagggacggcacctgggctgaccctcgaagatgctccagggctgtagagggctcgggcctcaccagggctgcccttgtgagtccagggccatcgggggtggaggaggacaccaggagggaaggctgcgtgcttgtgggctcctggaggtcgtccacccacagaagccgtgttctgattatcaacacgccctctggcaggaccccctggagccagggctccctcggcagcaccgggcgctacaaccagacccgggcaccaggcagccagcagcaggggctgtgctcggatgcagctctacacgaggattttgtgccggagcctactcctgccttctttcaataccctccacaagccttcagcaaaaccaaggttcgcgacttggggaggggaggcctttatgccttttccaaggaggagaaggtatctgaggcccagcgggtagaggcctacgagacccacggccttggcctgagtacaggccgacagaaccctgtgccgtccccctgtaagcctggatgcgtgtgccagggccttgcgctggacgcagaggcctggccgaggcaccctggacgcaggccctgtgcggccaaggaggcctgcctgggcccacctggctgcagcggggagctgagcctccctgaggaggaaggaatcgcacctggggcagcaacagcagctcctgcctgggtccctcatggccgcgtgagccgcttcctcactgtaaagctcttcacctatgtaactatgtatcaatgtaaacaggaacgtatcctccgcctctgcatctctggtgaatccgggcgatacgtgcggcgctcacgcttccgcaactttgcagcgctcatggtgagtacgggggtcccgggggtcctgcagctgggggctaggccgctgcgggggggcggccacccgtatggggactcccaggctggaaaagttgtggaatggcgagctggtgaccgggcttccgggctcagtgccggggaaagaaggttcctcagccagtcggagctgcagacctggccccggacacctcactgtgtaggaaagaaggttcctcagccagttggagctgcagacctagccccggacacctcactgtgcaggaaagaaggttcctcagccagtcggagctgcagacctggccccggacacctcacccgcagggaggaagattccttcaggcagctggcattccccaggtttgaagaggtcactttcccacctctcactgctgcagaaagagcaccctctgtccacggtggacactctctagccagccagggcctcgtcttggctggacggacaagaagtgtggcctcaggagggaagcaggagctctcgggcccgctggctgcctgcatcccgacacaggatctgaagacagtgctctccctgccccgctacccaggggagttcctgcaccccgtggtgtacgcgtgcacggccgtcatgctgctctgcctcctggcctccttcgtcacctacatcgtgcaccagagcgccatccgcatcagccgcaagggccggcacacgctcctgaatttctgcttccacgcggccctgaccttcactgtgttcgccggcggcatcaatcgcaccaagtaccccatcctgtgccaggcggtgggcatcgtgctgcactattctacactgtccaccatgctgtggataggagtgaccgccaggaacatctacaagcaggtgaccaagaaggcccctctgtgcctggacacagaccagccaccgtaccccaggcagcccctgctcaggttttacctcgtcagcggaggggtcccctttatcatctgtggggtcacggctgccacgaacatcaggaattacgggacagaggacgaggacacggcctgctggatggcctgggagcccagcctgggcgccttctacggcccagccgccatcatcaccctggtcacctgtgtgtacttcctgggcacctacgtgcagctgcggcgccacccagggcgcaggtacgagctgcgcacacagcccgaggagcagcggcggctggcgacacccgagggcggccgtgggatccggccaggcaccccacccgcacacgatgcccccggcgcctccgtgctgcagaacgagcactcattccaggcacagctgcgcgccgccgccttcacgctgttcctgttcacggccacgtgggccttcggggcgctggcggtgtcacagggccacttcctggacatggtcttcagctgcctgtacggcgccttctgcgtgaccctgggactcttcgtgctcatccaccactgcgccaagcgtgaggacgtgtggcagtgctggtgggcatgctgcccgccccgcaaggacgcccaccccgcacttgacgccaacggggccgcgctgggccgcgccgcctgcctgcactcgccgggactgggccagccacggggcttcgcgcacccaccgggcccctgcaagatgaccaacctgcaggccgcgcagggccacgccagttgcctgtcaccggccaccccgtgctgcgccaagatgcactgcgagccactgacggcggacgaggcgcacgtgcacctgcaggaggagggcgccttcgggcacgacccccacctgcacgggtgccttcagggcagaactaagccgccctactttagccggcacccagcagaggagcccgagtacgcctaccacatcccatccagcctggatggcagcccccgcagctcgcgcacagacagcccccccagctctctggatggcccggcggggacacacacgctggcctgctgcacccagggcgaccccttccccatggtcacccagcccgagggcagtgatgggagccctgccctctacagctgccccacgcagccgggcagggaggcagcgctcgggcccggccacttggagatgctgcggaggacacagtccctgccctttggtggccccagccagaacgggctgcccaagggtaaattgctagaaggcctgccgtttggcaccgacgggaccggcaacatccgaacgggaccctggaaaaacgaaactactgtg

SEQ ID NO: 11520 - DNA, 3441 bp, Homo sapiens
cccgtggggggctcatcctacccacagtaagagcatcctggcgtgaccccactgaggacttcacctcctctcccttggtggacacctatccaggtgggcatcgtgctgcactattctacactgtccaccatgctgtggataggagtgaccgccaggaacatctacaagcaggtgaccaagaaggcccctctgtgcctggacacagaccagccaccgtaccccaggcagcccctgctcagcaggttttacctcgtcagcggaggggtcccctttatcatctgtggggtcacggctgccacgaacatcaggaattacgggacagaggacgaggacacggcgtactgctggatggcctgggagcccagcctgggcgccttctacggcccagccgccatcatcaccctggtcacctgtgtgtacttcctgggcacctacgtgcagctgcggcgccacccagggcgcaggtacgagctgcgcacacagcccgaggagcagcggcggctggcgacacccgagggcggccgtgggatccggccaggcaccccacccgcacacgatgcccccggcgcctccgtgctgcagaacgagcactcattccaggcacagctgcgcgccgccgccttcacgctgttcctgttcacggccacgtgggccttcggggcgctggcggtgtcacagggccacttcctggacatggtcttcagctgcctgtacggcgccttctgcgtgaccctgggactcttcgtgctcatccaccactgcgccaagcgtgaggacgtgtggcagtgctggtgggcatgctgcccgccccgcaaggacgcccaccccgcacttgacgccaacggggccgcgctgggccgcgccgcctgcctgcactcgccgggactgggccagccacggggcttcgcgcacccaccgggcccctgcaagatgaccaacctgcaggccgcgcagggccacgccagttgcctgtcaccggccaccccgtgctgcgccaagatgcactgcgagccactgacggcggacgaggcgcacgtgcacctgcaggaggagggcgccttcgggcacgacccccacctgcacgggtgccttcagggcagaactaagccgccctactttagccggcacccagcagaggagcccgagtacgcctaccacatcccatccagcctggatggcagcccccgcagctcgcgcacagacagcccccccagctctctggatggcccggcggggacacacacgctggcctgctgcacccagggcgaccccttccccatggtcacccagcccgagggcagtgatgggagccctgccctctacagctgccccacgcagccgggcagggaggcagcgctcgggcccggccacttggagatgctgcggaggacacagtccctgccctttggtggccccagccagaacgggctgcccaagggtaaattgctagaaggcctgccgtttggcaccgacgggaccggcaacatccgaacgggaccctggaaaaacgaaactactgtgtagatgggggcagaggacacggtgttcctggaggagcttcagagcagagtggggggcccatctgccacatgaggtcactgggggtaccgaagtgaccccgcctttcagaagccgttcacacccctgccccttccttgtgatcacacccctgccccttccttgtgatcacacccctgccccttccttgtgatcacacccctgccccttccttgtgaaagacctcagcggggaaacgctccgggccacgcccactccccttatcccaattccgcgtgctggtcccgcacacggtcatccggtttctgtcctgtggtctccagtcctggggcaccctagaggcagagcaggggattccatcaaaggacccactgagaccccagcatggccctgcccgagatgccctgctgcccacggagtcctggcttcccctggtgtggccgggcagggccgagatcgcaggagggggctgccctgacctttcccagtgttcaatgtgtgtgtcttgcgttctactccgggggtggcggcggcaggtctgtccccagcattctcgctctgggcagaaccctcgggaccctccgctgtcgtgtgtctgagccacccctgcagcttcacagggcccctgcacacctctgcccactcagtgtgccctgtcagccctgtccttgtcgtagccccagccctgcagggctgagagcaccacagatgctgggggctgctctggactttggggatggctgtcagcctcagagggccaatggggggctttcacgggcccaaggcttgggaaaatgcccagacatcctttagtgaagactcgacttccaaaaccagccaccgctgggactggattccactccagtataggcacttagcaacacgaaggtttattccaaaaagaaaaggggctgacagacgggagattctcatggacaaaatccctttccctttttctcgtctccatgaacatctgggtaccaagccctgactcaaaggacagatgtggatgacagcaagacttctgtgaaagcaagtggcccgtccctaggtgggagggagtccagagggtcatgggtgtgaaactgtgcacagctttccctccctccctcttcctccttgtctgtgacacatgtgcacccacacacacacacacaaacacatgtgcatatcacacacatgcacacacacaaacacatgtgcatatcacacacgcgcacacacccaaacacgtgcatatcacacacatgcacacacacaaacacgtgcatatcacacacatgcacacaaacgtgcatatcacacacacgcacacacacccaaacacgtgcatatcacacacacgcacacacacaaacacgtgcatatcacacacaaacacacgtgcacacatacttaacacacacttgcacctgctgtgcacatgtgcacacacacgtagtagtgtgttttccagccacccacacactgggtttgcattggagattgtttcaccctgcaaacgtcaacgtcagcagactcgtcggtgcgctgtgctatccggttgggaggtctcaccaggagcagagcctccctaacgtgcacctccgagaagaggggtgtcggggagtgttcccagcacctgctcggtggaagggctctccggagactggcactcagtatctgagtatgaggagcctcacttcccggggtgtcggtaaacttgaccgtgactcagtaacccacagcgtgctcctcccagcaaaccccgtgtgtccttacaggtcgaccagacgggccgtcggaggaccaccaggtggctctgcctctgcctcaccttctcacctgcttccatagctgatgtgaacccgaatccccacgctgtgctgtgtacgcactgtaggtgcagaaccgtccacacaaaaatacagtcttggcattgtt

SEQ ID NO: 11521 - DNA, 4283 bp, Homo sapiens
gtcgccgcgggaggtgcgcgcagaggcggcggcgctgctggccgggctgggccgctcgtgcgcggggctgtgactcaccggccggcgccgcagccccgcaatctgttgataactcggtcccagctcggccgctgccctcgcgaatggagagcgggtccccggcggggggagcgcagcgcgtctgtctccgggagcgcggcccggccgccccggcagccgcttcggccacagcagatgggagcagctcccggactgcgcccgccccgccgcggtcaccctgaggccaggggcccgggagcgcgacctcctggccgccgtctgggactttgaccttccagaggccatggaggctggcggggagcagggcgccacctgatcgcctccccctggacgcctcctccagcggcgctcacgcttccgcaactttgcagcgctcatggatctgaagacagtgctctccctgccccgctacccaggggagttcctgcaccccgtggtgtacgcgtgcacggccgtcatgctgctctgcctcctggcctccttcgtcacctacatcgtgcaccagagcgccatccgcatcagccgcaagggccggcacacgctcctgaatttctgcttccacgcggccctgaccttcactgtgttcgccggcggcatcaatcgcaccaagtaccccatcctgtgccaggcggtgggcatcgtgctgcactattctacactgtccaccatgctgtggataggagtgaccgccaggaacatctacaagcaggtgaccaagaaggcccctctgtgcctggacacagaccagccaccgtaccccaggcagcccctgctcaggttttacctcgtcagcggaggggtcccctttatcatctgtggggtcacggctgccacgaacatcaggaattacgggacagaggacgaggacacggcgtactgctggatggcctgggagcccagcctgggcgccttctacggcccagccgccatcatcaccctggtcacctgtgtgtacttcctgggcacctacgtgcagctgcggcgccacccagggcgcaggtacgagctgcgcacacagcccgaggagcagcggcggctggcgacacccgagggcggccgtgggatccggccaggcaccccacccgcacacgatgcccccggcgcctccgtgctgcagaacgagcactcattccaggcacagctgcgcgccgccgccttcacgctgttcctgttcacggccacgtgggccttcggggcgctggcggtgtcacagggccacttcctggacatggtcttcagctgcctgtacggcgccttctgcgtgaccctgggactcttcgtgctcatccaccactgcgccaagcgtgaggacgtgtggcagtgctggtgggcatgctgcccgccccgcaaggacgcccaccccgcacttgacgccaacggggccgcgctgggccgcgccgcctgcctgcactcgccgggactgggccagccacggggcttcgcgcacccaccgggcccctgcaagatgaccaacctgcaggccgcgcagggccacgccagttgcctgtcaccggccaccccgtgctgcgccaagatgcactgcgagccactgacggcggacgaggcgcacgtgcacctgcaggaggagggcgccttcgggcacgacccccacctgcacgggtgccttcagggcagaactaagccgccctactttagccggcacccagcagaggagcccgagtacgcctaccacatcccatccagcctggatggcagcccccgcagctcgcgcacagacagcccccccagctctctggatggcccggcggggacacacacgctggcctgctgcacccagggcgaccccttccccatggtcacccagcccgagggcagtgatgggagccctgccctctacagctgccccacgcagccgggcagggaggcagcgctcgggcccggccacttggagatgctgcggaggacacagtccctgccctttggtggccccagccagaacgggctgcccaagggtaaattgctagaaggcctgccgtttggcaccgacgggaccggcaacatccgaacgggaccctggaaaaacgaaactactgtgtagatgggggcagaggacacggtgttcctggaggagcttcagagcagagtggggggcccatctgccacatgaggtcactgggggtaccgaagtgaccccgcctttcagaagccgttcacacccctgccccttccttgtgatcacacccctgccccttccttgtgatcacacccctgccccttccttgtgatcacacccctgccccttccttgtgaaagacctcagcggggaaacgctccgggccacgcccactccccttatcccaattccgcgtgctggtcccgcacacggtcatccggtttctgtcctgtggtctccagtcctggggcaccctagaggcagagcaggggattccatcaaaggacccactgagaccccagcatggccctgcccgagatgccctgctgcccacggagtcctggcttcccctggtgtggccgggcagggccgagatcgcaggagggggctgccctgacctttcccagtgttcaatgtgtgtgtcttgcgttctactccgggggtggcggcggcaggtctgtccccagcattctcgctctgggcagaaccctcgggaccctccgctgtcgtgtgtctgagccacccctgcagcttcacagggcccctgcacacctctgcccactcagtgtgccctgtcagccctgtccttgtcgtagccccagccctgcagggctgagagcaccacagatgctgggggctgctctggactttggggatggctgtcagcctcagagggccaatggggggctttcacgggcccaaggcttgggaaaatgcccagacatcctttagtgaagactcgacttccaaaaccagccaccgctgggactggattccactccagtataggcacttagcaacacgaaggtttattccaaaaagaaaaggggctgacagacgggagattctcatggacaaaatccctttccctttttctcgtctccatgaacatctgggtaccaagccctgactcaaaggacagatgtggatgacagcaagacttctgtgaaagcaagtggcccgtccctaggtgggagggagtccagagggtcatgggtgtgaaactgtgcacagctttccctccctccctcttcctccttgtctgtgacacatgtgcacccacacacacacacacaaacacatgtgcatatcacacacatgcacacacacaaacacatgtgcatatcacacacgcgcacacacccaaacacgtgcatatcacacacatgcacacacacaaacacgtgcatatcacacacatgcacacaaacgtgcatatcacacacacgcacacacacccaaacacgtgcatatcacacacacgcacacacacaaacacgtgcatatcacacacaaacacacgtgcacacatacttaacacacacttgcacctgctgtgcacatgtgcacacacacgtagtagtgtgttttccagccacccacacactgggtttgcattggagattgtttcaccctgcaaacgtcaacgtcagcagactcgtcggtgcgctgtgctatccggttgggaggtctcaccaggagcagagcctccctaacgtgcacctccgagaagaggggtgtcggggagtgttcccagcacctgctcggtggaagggctctccggagactggcactcagtatctgagtatgaggagcctcacttcccggggtgtcggtaaacttgaccgtgactcagtaacccacagcgtgctcctcccagcaaaccccgtgtgtccttacaggtcgaccagacgggccgtcggaggaccaccaggtggctctgcctctgcctcaccttctcacctgcttccatagctgatgtgaacccgaatccccacgctgtgctgtgtacgcactgtaggtgcagaaccgtccacacaaaaatacagtcttggcattgtttgttctttgtgaggctggttaatagcatccccgtgtgtttttctcaccctcgatggggtagaggggcacctgaatgtgtggcccccgtctgtgtcctggatcctggggcagggctgctctccctggcccctgcagcccctcatgaactttccaccctcagtgcccccggctgagcagagaggcgtcccaccattcaaccaaagaaagtcaacattgaacattaaacctctgtgtgtttctatactga

SEQ ID NO: 11522 - DNA, 6006 bp, Homo sapiens
atgcgaggccacgggaaccactcgcggctgaaatccagatgtgcttctctgggcaacgtccatcaccaccaggcacagatggcgcacggtgcacactgccgagggggccggacaccacagtcaccagacagccggggcccaaccgctgggggccacacccggggcagatggacgtaccggcccatcgaggccctcatcaacgtcagctttcccggagcaaagggtgggagaacggccgagggcgagccctcatgggcgtgggtcttcagaagtggctatttgcagagacaggctcttcctgggcttcccgtctccacccgagtggctgcctgctggtggcaacaccatccaggcagggactcagggttcttgggacctggatttattgacctgctcagagaggagcccagcggccgtgcagatgggaaggcagctgctcagaaaacagggcgtctttatttgttcccgactttcctaggcaacaaattaccagaggccgccgactcgtttggggaaattgcttctgggaacagtgttatttttacctccgtcttgcaatcctctcacccacctggcaccccaccgcccagcgcacgcaagccaagtcccggagctgccatgctcgtctgtgaggaaacgctggagctgggtgcccagggctgctgggggtccacgagcccccggggccaggccgtgagcttggtcggtgggcccacggccggaggctccaggctgggaggggctggctgcaccatgggcctgctcatggccctccaggccagacgccccagggacggcacctgggctgaccctcgaagatgctccagggctgtggagggctcgggcctcaccagggctgcccttgtgagtccagggccatcgggggtggaggaggacaccaggagggaaggctgcgtgcttgtgggctcctggaggtcgtccacccacagaagccgtgttctgattatcaacacgccctctggcaggaccccctggagccagggctccctcggcagcaccgggcgctacaaccagacccgggcaccaggcagccagcagcaggggctgtgctcggatgcagctctacacgaggattttgtgccggagcctactcctgccttctttcaataccctccacaagccttcagcaaaaccaaggttcgcgacttggggaggggaggcctttatgccttttccaaggaggagaaggtatctgaggcccagcgggtagaggcctacgagacccacggccttggcctgagtacaggccgacagaaccctgtgccgtccccctgtaagcctggatgcgtgtgccagggccttgcgctggacgcagaggcctggccgaggcaccctggacgcaggccctgtgcggccaaggaggcctgcctgggcccacctggctgcagcggggagctgagcctccctgaggaggaaggaatcgcacctggggcagcaacagcagctcctgcctgggtccctcatggccgcgtgagccgcttcctcactgtaaagctcttcacctatgtaactatgtatcaatgtaaacaggaacgtatcctccgcctctgcatctctggtgaatccgggcgatacgtgcggcgctcacgcttccgcaactttgcagcgctcatggtgagtacgggggtcccgggggtcctgcagctgggggctaggccgctgcgggggggcggccacccgtatggggactcccaggctggaaaagttgtggaatggcgagctggtgaccgggcttccgggctcagtgccggggaaagaaggttcctcagccagtcggagctgcagacctggccccggacacctcactgtgtaggaaagaaggttcctcagccagttggagctgcagacctagccccggacacctcactgtgcaggaaagaaggttcctcagccagtcggagctgcagacctggccccggacacctcacccgcagggaggaagattccttcaggcagctggcattccccaggtttgaagaggtcactttcccacctctcactgctgcagaaagagcaccctctgtccacggtggacactctctagccagccagggcctcgtcttggctggacggacaagaagtgtggcctcaggagggaagcaggagctctcgggcccgctggctgcctgcatcccgacacaggatctgaagacagtgctctccctgccccgctacccaggggagttcctgcaccccgtggtgtacgcgtgcacggccgtcatgctgctctgcctcctggcctccttcgtcacctacatcgtgcaccagagcgccatccgcatcagccgcaagggccggcacacgctcctgaatttctgcttccacgcggccgagcatcctggcgtgaccccactgaggacttcacctcctctcccttggtggacacctatccaggtgggcatcgtgctgcactattctacactgtccaccatgctgtggataggagtgaccgccaggaacatctacaagcaggtgaccaagaaggcccctctgtgcctggacacagaccagccaccgtaccccaggcagcccctgctcaggttttacctcgtcagcggaggggtcccctttatcatctgtggggtcacggctgccacgaacatcaggaattacgggacagaggacgaggacacggcgtactgctggatggcctgggagcccagcctgggcgccttctacggcccagccgccatcatcaccctggtcacctgtgtgtacttcctgggcacctacgtgcagctgcggcgccacccagggcgcaggtacgagctgcgcacacagcccgaggagcagcggcggctggcgacacccgagggcggccgtgggatccggccaggcaccccacccgcacacgatgcccccggcgcctccgtgctgcagaacgagcactcattccaggcacagctgcgcgccgccgccttcacgctgttcctgttcacggccacgtgggccttcggggcgctggcggtgtcacagggccacttcctggacatggtcttcagctgcctgtacggcgccttctgcgtgaccctgggactcttcgtgctcatccaccactgcgccaagcgtgaggacgtgtggcagtgctggtgggcatgctgcccgccccgcaaggacgcccaccccgcacttgacgccaacggggccgcgctgggccgcgccgcctgcctgcactcgccgggactgggccagccacggggcttcgcgcacccaccgggcccctgcaagatgaccaacctgcaggccgcgcagggccacgccagttgcctgtcaccggccaccccgtgctgcgccaagatgcactgcgagccactgacggcggacgaggcgcacgtgcacctgcaggaggagggcgccttcgggcacgacccccacctgcacgggtgccttcagggcagaactaagccgccctactttagccggcacccagcagaggagcccgagtacgcctaccacatcccatccagcctggatggcagcccccgcagctcgcgcacagacagcccccccagctctctggatggcccggcggggacacacacgctggcctgctgcacccagggcgaccccttccccatggtcacccagcccgagggcagtgatgggagccctgccctctacagctgccccacgcagccgggcagggaggcagcgctcgggcccggccacttggagatgctgcggaggacacagtccctgccctttggtggccccagccagaacgggctgcccaagggtaaattgctagaaggcctgccgtttggcaccgacgggaccggcaacatccgaacgggaccctggaaaaacgaaactactgtgtagatgggggcagaggacacggtgttcctggaggagcttcagagcagagtggggggcccatctgccacatgaggtcactgggggtaccgaagtgaccccgcctttcagaagccgttcacacccctgccccttccttgtgatcacacccctgccccttccttgtgatcacacccctgccccttccttgtgatcacacccctgccccttccttgtgaaagacctcagcggggaaacgctccgggccacgcccactccccttatcccaattccgcgtgctggtcccgcacacggtcatccggtttctgtcctgtggtctccagtcctggggcaccctagaggcagagcaggggattccatcaaaggacccactgagaccccagcatggccctgcccgagatgccctgctgcccacggagtcctggcttcccctggtgtggccgggcagggccgagatcgcaggagggggctgccctgacctttcccagtgttcaatgtgtgtgtcttgcgttctactccgggggtggcggcggcaggtctgtccccagcattctcgctctgggcagaaccctcgggaccctccgctgtcgtgtgtctgagccacccctgcagcttcacagggcccctgcacacctctgcccactcagtgtgccctgtcagccctgtccttgtcgtagccccagccctgcagggctgagagcaccacagatgctgggggctgctctggactttggggatggctgtcagcctcagagggccaatggggggctttcacgggcccaaggcttgggaaaatgcccagacatcctttagtgaagactcgacttccaaaaccagccaccgctgggactggattccactccagtataggcacttagcaacacgaaggtttattccaaaaagaaaaggggctgacagacgggagattctcatggacaaaatccctttccctttttctcgtctccatgaacatctgggtaccaagccctgactcaaaggacagatgtggatgacagcaagacttctgtgaaagcaagtggcccgtccctaggtgggagggagtccagagggtcatgggtgtgaaactgtgcacagctttccctccctccctcttcctccttgtctgtgacacatgtgcacccacacacacacacacaaacacatgtgcatatcacacacatgcacacacacaaacacatgtgcatatcacacacgcgcacacacccaaacacgtgcatatcacacacatgcacacacacaaacacgtgcatatcacacacatgcacacaaacgtgcatatcacacacacgcacacacacccaaacacgtgcatatcacacacacgcacacacacaaacacgtgcatatcacacacaaacacacgtgcacacatacttaacacacacttgcacctgctgtgcacatgtgcacacacacgtagtagtgtgttttccagccacccacacactgggtttgcattggagattgtttcaccctgcaaacgtcaacgtcagcagactcgtcggtgcgctgtgctatccggttgggaggtctcaccaggagcagagcctccctaacgtgcacctccgagaagaggggtgtcggggagtgttcccagcacctgctcggtggaagggctctccggagactggcactcagtatctgagtatgaggagcctcacttcccggggtgtcggtaaacttgaccgtgactcagtaacccacagcgtgctcctcccagcaaaccccgtgtgtccttacaggtcgaccagacgggccgtcggaggaccaccaggtggctctgcctctgcctcaccttctcacctgcttccatagctgatgtgaacccgaatccccacgctgtgctgtgtacgcactgtaggtgcagaaccgtccacacaaaaatacagtcttggcattgtttgttctttgtgaggctggttaatagcatccccgtgtgtttttctcaccctcgatggggtagaggggcacctgaatgtgtggcccccgtctgtgtcctggatcctggggcagggctgctctccctggcccctgcagcccctcatgaactttccaccctcagtgcccccggctgagcagagaggcgtcccaccattcaaccaaagaaagtcaacattgaacattaaacctctgtgtgtttctatactg

SEQ ID NO: 11523 - DNA, 6270 bp, Homo sapiens
gcggcggcagcaggagcccggcgcgatccgctaggtcccagcccagcgcccagcgagcaggcgacgcggaggggccgggcctccagtgtcccgagggccgggcgctgagactccggccgcgcagctgggagctgcccgcgctgcgctgacagccgcgccgacgtcctccccgccggggcgctcgcaggacatgcccccggggcgcggcggcggggaccccggggctcgcctccgcccagggcccccctccacgccctcgggagccccgggcccccgctgagcactcctcccgcacgcctgggtccctccggccggcgcgcagcccggccccagcgctgtgggtccccgcggggcgatgggttgatgggcgccgggggacgcaggatgcggggggcgcccgcgcgcctgctgctgccgctgctgccgtggctcctgctgctcctggcgcccgaggctcggggcgcgcccggctgcccgctatccatccgcagctgcaagtgctcgggggagcggcccaaggggctgagcggcggcgtccctggcccggctcggcggagggtggtgtgcagcggcggggacctcccggagcctcccgagcccggccttctgcctaacggcaccgttaccctgctcttgagcaataacaagatcacggggctccgcaatggctccttcctgggactgtcactgctggagaagctggacctgaggaacaacatcatcagcacagtgcagccgggcgccttcctgggcctgggggagctgaagcgtttagatctctccaacaaccggattggctgtctcacctccgagaccttccagggcctccccaggcttctccgactaaacatatctggaaacatcttctccagtctgcaacctggggtctttgatgagctgccagcccttaaggttgtggacttgggcaccgagttcctgacctgtgactgccacctgcgctggctgctgccctgggcccagaatcgctccctgcagctgtcggaacacacgctctgtgcttaccccagtgccctgcatgctcaggccctgggcagcctccaggaggcccagctctgctgcgagggggccctggagctgcacacacaccacctcatcccgtccctacgccaagtggtgttccagggggatcggctgcccttccagtgctctgccagctacctgggcaacgacacccgcatccgctggtaccacaaccgagcccctgtggagggtgatgagcaggcgggcatcctcctggccgagagcctcatccacgactgcaccttcatcaccagtgagctgacgctgtctcacatcggcgtgtgggcctcaggcgagtgggagtgcaccgtgtccatggcccaaggcaacgccagcaagaaggtggagatcgtggtgctggagacctctgcctcctactgccccgccgagcgtgttgccaacaaccgcggggacttcaggtggccccgaactctggctggcatcacagcctaccagtcctgcctgcagtatcccttcacctcagtgcccctgggcgggggtgccccgggcacccgagcctcccgccggtgtgaccgtgccggccgctgggagccaggggactactcccactgtctctacaccaacgacatcaccagggtgctgtacaccttcgtgctgatgcccatcaatgcctccaatgcgctgaccctggctcaccagctgcgcgtgtacacagccgaggccgctagcttttcagacatgatggatgtagtctatgtggctcagatgatccagaaatttttgggttatgtcgaccagatcaaagagctggtagaggtgatggtggacatggccagcaacctgatgctggtggacgagcacctgctgtggctggcccagcgcgaggacaaggcctgcagccgcatcgtgggtgccctggagcgcattgggggggccgccctcagcccccatgcccagcacatctcagtggagctgagcgcctttcccagggaggtggggggcgccggggcagggctgcaccccgtggtatacccctgcacggccttgctgctgctctgcctcttcgccaccatcatcacctacatcctcaaccacagctccatccgtgtgtcccggaaaggctggcacatgctgctgaacttgtgcttccacatagccatgacctctgctgtctttgcggggggcatcacactcaccaactaccagatggtctgccaggcggtgggcatcaccctgcactactcctccctatccacgctgctctggatgggcgtgaaggcgcgagtgctccataaggagctcacctggagggcaccccctccgcaagaaggggaccccgctctgcctactcccagtcctatgctccggttctatttgatcgctggagggattccactcattatctgtggcatcacagctgcagtcaacatccacaactaccgggaccacagcccctactgctggctggtgtggcgtccaagccttggcgccttctacatccctgtggctttgattctgctcatcacctggatctatttcctgtgcgccgggctacgcttacggggtcctctggcacagaaccccaaggcgggcaacagcagggcctccctggaggcaggggaggagctgaggggttccaccaggctcaggggcagcggccccctcctgagtgactcaggttcccttcttgctactgggagcgcgcgagtggggacgcccgggcccccggaggatggtgacagcctctattctccgggagtccagctaggggcgctggtgaccacgcacttcctgtacttggccatgtgggcctgcggggctctggcagtgtcccagcgctggctgccccgggtggtgtgcagctgcttgtacggggtggcagcctccgccctgggcctcttcgtcttcactcaccactgtgccaggcggagggacgtgagagcctcgtggcgcgcctgctgcccccctgcctctcccgcggccccccatgccccgccccgggccctgcccgccgccgcagaggacggttccccggtgttcggggagggccccccctccctcaagtcctccccaagcggcagcagcggccatccgctggctctgggcccctgcaagctcaccaacctgcagctggcccagagtcaggtgtgcgaggcgggggcggcggccggcggggaaggagagccggagccggcgggcacccggggaaacctcgcccaccgccaccccaacaacgtgcaccacgggcgtcgggcgcacaagagccgggccaagggacaccgcgcgggggaggcctgcggcaagaaccggctcaaggccctgcgcgggggcgcggcgggggcgctggagctgctgtccagcgagagcggcagtctgcacaacagccccaccgacagctacctgggcagcagccgcaacagcccgggcgccggcctgcagctggaaggcgagcccatgctcacgccgtccgagggcagcgacaccagcgccgcgccgctttctgaggcgggccgggcaggccagcgccgcagcgccagccgcgacagtctcaagggcggcggcgcgctggagaaggagagccatcgccgctcgtacccgctcaacgccgccagcctaaacggcgcccccaaggggggcaagtacgacgacgtcaccctgatgggcgcggaggtagccagcggcggctgcatgaagaccggactctggaagagcgaaactaccgtctaaggtggggcgggcgacgcggtagacgggctggccacgcggctcgttcccccgctcctcggggccctccaaggtgtctccgtagtcagcaggttggaggcagaggagccgatggctggaggaagcccacaggcggatgttccccacttgcctagagggcatccctctggggtagcgacagacaatcccagaaacacgcataatacatttccgtccagcccggggcagtctgactgtcggtgccctcccaggaacggggaaggcctccgtctgtgtgaaagggcacagcacatcccaggtgcaccctccccaagtactcccaccccgcctactgtccatgcggcctcactgggggccatcagcctcaccagcaaagcagagatgagagcgtgggaactgtgttctttcctccctgccctctactgatttcagcccagcccctgcctagatcctaggtcccttttcctcccgagtttggctggcacgagagctagcccagcacatgaagcaggtgatgttaagtcacaaggtgctgcttttcagatccactatgcaagaggggagggtggggccacgtgaaaggcagctctagacatcaaccagtcctgggggaggggagtgggaaccgggcacaactaggaacaatgccaccattcccacaggagtggtacttaaaccagacagcagggttcagaggtggcacaccgggacaaagctgaggccctgcacctcaacagctgactgccaggtgcctgtgggtgaactgaggggagtagagggagagggcaggtggaactggggcagaatctagtcatgccctaaagctagtcctgtaaacaatggtgccccagaaagctgcaggtggtgtttggagaagcagttacttttcagttacaagacccatctccctagtctcagccttacaacaccacgggactaaggaagagcacttccttgcctccgtaaggccagaggaagaaccatcccaatcatttgatctccagctccacagtagagagaaacctacaaaatgtcaaaccagcttcccgactcccaggagctcaagccaagcccagaggcagtggctggggtccctgcaggtcatgaggggcctatgcctttactccttttaaacaccagcacccgtcttttccccaacctaaaaccaaccaccagcatttcactacaggaccaaatggaaaccgagggaaccctgggtcttgggaagaacaacaggaaaccaaggtctgacctagggttccctcccagtcttcacatcactctggcctcatcaccaaggtgacagaggacacaggggagggggaaaacccacacacactccttggaatgggtcctgttatttatgcttgctgcacagacatattagaagaaaaaaaaaagctttgtattattcttccacatatgctggctgctgtttacacaccctgccaatgccttagcactggagagctttttgcaatatgctggggaaaggggagggagggaatgaaagtgccaaagaaaacatgtttttaagaactcgggttttatacaatagaatgttttctagcagatgcctcttgttttaatatattaaaattttgcaaagccctttgagctactgccttagtctacccactgtccttttgttatgaggtagaggatctcatgacaccatacacacaaacccatcattgcctgtgaatgcacgtagggccagaattccccagttcccgctcctctgagggttgatactgctgggaatgccaaccactccacaagcagagggaagccccctcaggcctgcaggaggagccgcagcagtgtgtccaattcaaaccagcagcaaagagcctgacattttcccatccatctatgaggaaagccatctcacagaacatggacataggcaacttgctctcccacaccaagggatgggaatctctcctacctatagtcatccctgcactcctgactttactccaggacccagggtccaactaatggcagagcccctcttggttccttcaaacaagaaaagcaatacctacggactggtgtacacttccatccttggttataacaggaatgttatcaagctgtcagaacaggatgaagtgctcccagtggatatccatcagggagggttagggacactcgtggcagcctgtctagcagcctgggctctctgaaagtccctaacttcctgaggggtacgcaaatactgttctatttcactatcagaaatgttctcatctccagtgacagtggagacagggggtacagggcagatccgcttcggggacttcaacatgcagggtggcaagagaagggcaggactggccggccgcttcccctggggtaaacctaaggaattatttcccacctccccttctccttgcccctgtccccaccccggtggctccttctctcgggtctccacttctgctgtcccatcccgaaaggcagagcggaccagtgactggcggtgctggagaaggtcaccgatgtgcttcaccacagaccgtttgtcaagtctcagaa

SEQ ID NO: 11524 - DNA, 5651 bp, Homo sapiens
gggcgatgggttgatgggcgccgggggacgcaggatgcggggggcgcccgcgcgcctgctgctgccgctgctgccgtggctcctgctgctcctggcgcccgaggctcggggcgcgcccggctgcccgctatccatccgcagctgcaagtgctcgggggagcggcccaaggggctgagcggcggcgtccctggcccggctcggcggagggtggtgtgcagcggcggggacctcccggagcctcccgagcccggccttctgcctaacggcaccgttaccctgctcttgagcaataacaagatcacggggctccgcaatggctccttcctgggactgtcactgctggagaagctggacctgaggaacaacatcatcagcacagtgcagccgggcgccttcctgggcctgggggagctgaagcgtttagatctctccaacaaccggattggctgtctcacctccgagaccttccagggcctccccaggcttctccgactaaacatatctggaaacatcttctccagtctgcaacctggggtctttgatgagctgccagcccttaaggttgtggacttgggcaccgagttcctgacctgtgactgccacctgcgctggctgctgccctgggcccagaatcgctccctgcagctgtcggaacacacgctctgtgcttaccccagtgccctgcatgctcaggccctgggcagcctccaggaggcccagctctgctgcgagggggccctggagctgcacacacaccacctcatcccgtccctacgccaagtggtgttccagggggatcggctgcccttccagtgctctgccagctacctgggcaacgacacccgcatccgctggtaccacaaccgagcccctgtggagggtgatgagcaggcgggcatcctcctggccgagagcctcatccacgactgcaccttcatcaccagtgagctgacgctgtctcacatcggcgtgtgggcctcaggcgagtgggagtgcaccgtgtccatggcccaaggcaacgccagcaagaaggtggagatcgtggtgctggagacctctgcctcctactgccccgccgagcgtgttgccaacaaccgcggggacttcaggtggccccgaactctggctggcatcacagcctaccagtcctgcctgcagtatcccttcacctcagtgcccctgggcgggggtgccccgggcacccgagcctcccgccggtgtgaccgtgccggccgctgggagccaggggactactcccactgtctctacaccaacgacatcaccagggtgctgtacaccttcgtgctgatgcccatcaatgcctccaatgcgctgaccctggctcaccagctgcgcgtgtacacagccgaggccgctagcttttcagacatgatggatgtagtctatgtggctcagatgatccagaaatttttgggttatgtcgaccagatcaaagagctggtagaggtgatggtggacatggccagcaacctgatgctggtggacgagcacctgctgtggctggcccagcgcgaggacaaggcctgcagccgcatcgtgggtgccctggagcgcattgggggggccgccctcagcccccatgcccagcacatctcagtgaatgcgaggaacgtggcattggaggcctacctcatcaagccgcacagctacgtgggcctgacctgcacagccttccagaggagggagggaggggtgccgggcacacggccaggaagccctggccagaaccccccacctgagcccgagcccccagctgaccagcagctccgcttccgctgcaccaccgggaggcccaatgtttctctgtcgtccttccacatcaagaacagcgtggccctggcctccatccagctgcccccgagtctattctcatcccttccggctgccctggctcccccggtgcccccagactgcaccctgcaactgctcgtcttccgaaatggccgcctcttccacagccacagcaacacctcccgccctggagctgctgggcctggcaagaggcgtggcgtggccacccccgtcatcttcgcaggaaccagtggctgtggcgtgggaaacctgacagagccagtggccgtttcgctgcggcactgggctgagggagccgaacctgtggccgcttggtggagccaggaggggcccggggaggctgggggctggacctcggagggctgccagctccgctccagccagcccaatgtcagcgccctgcactgccagcacttgggcaatgtggccgtgctcatggagctgagcgcctttcccagggaggtggggggcgccggggcagggctgcaccccgtggtatacccctgcacggccttgctgctgctctgcctcttcgccaccatcatcacctacatcctcaaccacagctccatccgtgtgtcccggaaaggctggcacatgctgctgaacttgtgcttccacatagccatgacctctgctgtctttgcggggggcatcacactcaccaactaccagatggtctgccaggcggtgggcatcaccctgcactactcctccctatccacgctgctctggatgggcgtgaaggcgcgagtgctccataaggagctcacctggagggcaccccctccgcaagaaggggaccccgctctgcctactcccagtcctatgctccggttctatttgatcgctggagggattccactcattatctgtggcatcacagctgcagtcaacatccacaactaccgggaccacagcccctactgctggctggtgtggcgtccaagccttggcgccttctacatccctgtggctttgattctgctcatcacctggatctatttcctgtgcgccgggctacgcttacggggtcctctggcacagaaccccaaggcgggcaacagcagggcctccctggaggcaggggaggagctgaggggttccaccaggctcaggggcagcggccccctcctgagtgactcaggttcccttcttgctactgggagcgcgcgagtggggacgcccgggcccccggaggatggtgacagcctctattctccgggagtccagctaggggcgctggtgaccacgcacttcctgtacttggccatgtgggcctgcggggctctggcagtgtcccagcgctggctgccccgggtggtgtgcagctgcttgtacggggtggcagcctccgccctgggcctcttcgtcttcactcaccactgtgccaggcggagggacgtgagagcctcgtggcgcgcctgctgcccccctgcctctcccgcggccccccatgccccgccccgggccctgcccgccgccgcagaggacggttccccggtgttcggggagggccccccctccctcaagtcctccccaagcggcagcagcggccatccgctggctctgggcccctgcaagctcaccaacctgcagctggcccagagtcaggtgtgcgaggcgggggcggcggccggcggggaaggagagccggagccggcgggcacccggggaaacctcgcccaccgccaccccaacaacgtgcaccacgggcgtcgggcgcacaagagccgggccaagggacaccgcgcgggggaggcctgcggcaagaaccggctcaaggccctgcgcgggggcgcggcgggggcgctggagctgctgtccagcgagagcggcagtctgcacaacagccccaccgacagctacctgggcagcagccgcaacagcccgggcgccggcctgcagctggaaggcgagcccatgctcacgccgtccgagggcagcgacaccagcgccgcgccgctttctgaggcgggccgggcaggccagcgccgcagcgccagccgcgacagtctcaagggcggcggcgcgctggagaaggagagccatcgccgctcgtacccgctcaacgccgccagcctaaacggcgcccccaaggggggcaagtacgacgacgtcaccctgatgggcgcggaggtagccagcggcggctgcatgaagaccggactctggaagagcgaaactaccgtctaaggtggggcgggcgacgcggtagacgggctggccacgcggctcgttcccccgctcctcggggccctccaaggtgtctccgtagtcagcaggttggaggcagaggagccgatggctggaggaagcccacaggcggatgttccccacttgcctagagggcatccctctggggtagcgacagacaatcccagaaacacgcataatacatttccgtccagcccggggcagtctgactgtcggtgccctcccaggaacggggaaggcctccgtctgtgtgaaagggcacagcacatcccaggtgcaccctccccaagtactcccaccccgcctactgtccatgcggcctcactgggggccatcagcctcaccagcaaagcagagatgagagcgtgggaactgtgttctttcctccctgccctctactgatttcagcccagcccctgcctagatcctaggtcccttttcctcccgagtttggctggcacgagagctagcccagcacatgaagcaggtgatgttaagtcacaaggtgctgcttttcagatccactatgcaagaggggagggtggggccacgtgaaaggcagctctagacatcaaccagtcctgggggaggggagtgggaaccgggcacaactaggaacaatgccaccattcccacaggagtggtacttaaaccagacagcagggttcagaggtggcacaccgggacaaagctgaggccctgcacctcaacagctgactgccaggtgcctgtgggtgaactgaggggagtagagggagagggcaggtggaactggggcagaatctagtcatgccctaaagctagtcctgtaaacaatggtgccccagaaagctgcaggtggtgtttggagaagcagttacttttcagttacaagacccatctccctagtctcagccttacaacaccacgggactaaggaagagcacttccttgcctccgtaaggccagaggaagaaccatcccaatcatttgatctccagctccacagtagagagaaacctacaaaatgtcaaaccagcttcccgactcccaggagctcaagccaagcccagaggcagtggctggggtccctgcaggtcatgaggggcctatgcctttactccttttaaacaccagcacccgtcttttccccaacctaaaaccaaccaccagcatttcactacaggaccaaatggaaaccgagggaaccctgggtcttgggaagaacaacaggaaaccaaggtctgacctagggttccctcccagtcttcacatcactctggcctcatcaccaaggtgacagaggacacaggggagggggaaaacccacacacactccttggaatgggtcctgttatttatgcttgctgcacagacatattagaagaaaaaaaaaagctttgtattattcttccacatatgctggctgctgtttacacaccctgccaatgccttagcactggagagctttttgcaatatgctggggaaaggggagggagggaatgaaagtgccaaagaaaacatgtttttaagaactcgggttttatacaatagaatgttttctagcagatgcctcttgttttaatatattaaaattttgcaaagccctttgagctactg

SEQ ID NO: 11525 - DNA, 6022 bp, Homo sapiens
atccatggcacggagcggcggcggcggcggcagcaggagcccggcgcgatccgctaggtcccagcccagcgcccagcgagcaggcgacgcggaggggccgggcctccagtgtcccgagggccgggcgctgagactccggccgcgcagctgggagctgcccgcgctgcgctgacagccgcgccgacgtcctccccgccggggcgctcgcaggacatgcccccggggcgcggcggcggggaccccggggctcgcctccgcccagggcccccctccacgccctcgggagccccgggcccccgctgagcactcctcccgcacgcctgggtccctccggccggcgcgcagcccggccccagcgctgtgggtccccgcggggcgatgggttgatgggcgccgggggacgcaggatgcggggggcgcccgcgcgcctgctgctgccgctgctgccgtggctcctgctgctcctggcgcccgaggctcggggcgcgcccggctgcccgctatccatccgcagctgcaagtgctcgggggagcggcccaaggggctgagcggcggcgtccctggcccggctcggcggagggtggtgtgcagcggcggggacctcccggagcctcccgagcccggccttctgcctaacggcaccgttaccctgctcttgagcaataacaagatcacggggctccgcaatggctccttcctgggactgtcactgctggagaagctggacctgaggaacaacatcatcagcacagtgcagccgggcgccttcctgggcctgggggagctgaagcgtttagatctctccaacaaccggattggctgtctcacctccgagaccttccagggcctccccaggcttctccgactaaacatatctggaaacatcttctccagtctgcaacctggggtctttgatgagctgccagcccttaaggttgtggacttgggcaccgagttcctgacctgtgactgccacctgcgctggctgctgccctgggcccagaatcgctccctgcagctgtcggaacacacgctctgtgcttaccccagtgccctgcatgctcaggccctgggcagcctccaggaggcccagctctgctgcgagggggccctggagctgcacacacaccacctcatcccgtccctacgccaagtggtgttccagggggatcggctgcccttccagtgctctgccagctacctgggcaacgacacccgcatccgctggtaccacaaccgagcccctgtggagggtgatgagcaggcgggcatcctcctggccgagagcctcatccacgactgcaccttcatcaccagtgagctgacgctgtctcacatcggcgtgtgggcctcaggcgagtgggagtgcaccgtgtccatggcccaaggcaacgccagcaagaaggtggagatcgtggtgctggagacctctgcctcctactgccccgccgagcgtgttgccaacaaccgcggggacttcaggtggccccgaactctggctggcatcacagcctaccagtcctgcctgcagtatcccttcacctcagtgcccctgggcgggggtgccccgggcacccgagcctcccgccggtgtgaccgtgccggccgctgggagccaggggactactcccactgtctctacaccaacgacatcaccagggtgctgtacaccttcgtgctgatgcccatcaatgcctccaatgcgctgaccctggctcaccagctgcgcgtgtacacagccgaggccgctagcttttcagacatgatggatgtagtctatgtggctcagatgatccagaaatttttgggttatgtcgaccagatcaaagagctggtagaggtgatggtggacatggccagcaacctgatgctggtggacgagcacctgctgtggctggcccagcgcgaggacaaggcctgcagccgcatcgtgggtgccctggagcgcattgggggggccgccctcagcccccatgcccagcacatctcagtgaatgcgaggaacgtggcattggaggcctacctcatcaagccgcacagctacgtgggcctgacctgcacagccttccagaggagggagggaggggtgccgggcacacggccaggaagccctggccagaaccccccacctgagcccgagcccccagctgaccagcagctccgcttccgctgcaccaccgggaggcccaatgtttctctgtcgtccttccacatcaagaacagcgtggccctggcctccatccagctgcccccgagtctattctcatcccttccggctgccctggctcccccggtgcccccagactgcaccctgcaactgctcgtcttccgaaatggccgcctcttccacagccacagcaacacctcccgccctggagctgctgggcctggcaagaggcgtggcgtggccacccccgtcatcttcgcaggaaccagtggctgtggcgtgggaaacctgacagagccagtggccgtttcgctgcggcactgggctgagggagccgaacctgtggccgcttggtggagccaggaggggcccggggaggctgggggctggacctcggagggctgccagctccgctccagccagcccaatgtcagcgccctgcactgccagcacttgggcaatgtggccgtgctcatggagctgagcgcctttcccagggaggtggggggcgccggggcagggctgcaccccgtggtatacccctgcacggccttgctgctgctctgcctcttcgccaccatcatcacctacatcctcaaccacagctccatccgtgtgtcccggaaaggctggcacatgctgctgaacttgtgcttccacatagccatgacctctgctgtctttgcggggggcatcacactcaccaactaccagatggtctgccaggcggtgggcatcaccctgcactactcctccctatccacgctgctctggatgggcgtgaaggcgcgagtgctccataaggagctcacctggagggcaccccctccgcaagaaggggaccccgctctgcctactcccagtcctatgctccggttctatttgatcgctggagggattccactcattatctgtggcatcacagctgcagtcaacatccacaactaccgggaccacagcccctactgctggctggtgtggcgtccaagccttggcgccttctacatccctgtggctttgattctgctcatcacctggatctatttcctgtgcgccgggctacgcttacggggtcctctggcacagaaccccaaggcgggcaacagcagggcctccctggaggcaggggaggagctgaggggttccaccaggctcaggggcagcggccccctcctgagtgactcaggttcccttcttgctactgggagcgcgcgagtggggacgcccgggcccccggaggatggtgacagcctctattctccgggagtccagaggggcgctggtgaccacgcacttcctgtacttggccatgtgggcctgcggggctctggcagtgtcccagcgctggctgccccgggtggtgtgcagctgcttgtacggggtggcagcctccgccctgggcctcttcgtcttcactcaccactgtgccaggcggagggacgtgagagcctcgtggcgcgcctgctgcccccctgcctctcccgcggccccccatgccccgccccgggccctgcccgccgccgcagaggacggttccccggtgttcggggagggccccccctccctcaagtcctccccaagcggcagcagcggccatccgctggctctgggcccctgcaagctcaccaacctgcagctggcccagagtcaggtgtgcgaggcgggggcggcggccggcggggaaggagagccggagccggcgggcacccggggaaacctcgcccaccgccaccccaacaacgtgcaccacgggcgtcgggcgcacaagagccgggccaagggacaccgcgcgggggaggcctgcggcaagaaccggctcaaggccctgcgcgggggcgcggcgggggcgctggagctgctgtccagcgagagcggcagtctgcacaacagccccaccgacagctacctgggcagcagccgcaacagcccgggcgccggcctgcagctggaaggcgagcccatgctcacgccgtccgagggcagcgacaccagcgccgcgccgctttctgaggcgggccgggcaggccagcgccgcagcgccagccgcgacagtctcaagggcggcggcgcgctggagaaggagagccatcgccgctcgtacccgctcaacgccgccagcctaaacggcgcccccaaggggggcaagtacgacgacgtcaccctgatgggcgcggaggtagccagcggcggctgcatgaagaccggactctggaagagcgaaactaccgtctaaggtggggcgggcgacgcggtagacgggctggccacgcggctcgttcccccgctcctcggggccctccaaggtgtctccgtagtcagcaggttggaggcagaggagccgatggctggaggaagcccacaggcggatgttccccacttgcctagagggcatccctctggggtagcgacagacaatcccagaaacacgcataatacatttccgtccagcccggggcagtctgactgtcggtgccctcccaggaacggggaaggcctccgtctgtgtgaaagggcacagcacatcccaggtgcaccctccccaagtactcccaccccgcctactgtccatgcggcctcactgggggccatcagcctcaccagcaaagcagagatgagagcgtgggaactgtgttctttcctccctgccctctactgatttcagcccagcccctgcctagatcctaggtcccttttcctcccgagtttggctggcacgagagctagcccagcacatgaagcaggtgatgttaagtcacaaggtgctgcttttcagatccactatgcaagaggggagggtggggccacgtgaaaggcagctctagacatcaaccagtcctgggggaggggagtgggaaccgggcacaactaggaacaatgccaccattcccacaggagtggtacttaaaccagacagcagggttcagaggtggcacaccgggacaaagctgaggccctgcacctcaacagctgactgccaggtgcctgtgggtgaactgaggggagtagagggagagggcaggtggaactggggcagaatctagtcatgccctaaagctagtcctgtaaacaatggtgccccagaaagctgcaggtggtgtttggagaagcagttacttttcagttacaagacccatctccctagtctcagccttacaacaccacgggactaaggaagagcacttccttgcctccgtaaggccagaggaagaaccatcccaatcatttgatctccagctccacagtagagagaaacctacaaaatgtcaaaccagcttcccgactcccaggagctcaagccaagcccagaggcagtggctggggtccctgcaggtcatgaggggcctatgcctttactccttttaaacaccagcacccgtcttttccccaacctaaaaccaaccaccagcatttcactacaggaccaaatggaaaccgagggaaccctgggtcttgggaagaacaacaggaaaccaaggtctgacctagggttccctcccagtcttcacatcactctggcctcatcaccaaggtgacagaggacacaggggagggggaaaacccacacacactccttggaatgggtcctgttatttatgcttgctgcacagacatattagaagaaaaaaaaaagctttgtattattcttccacatatgctggctgctgtttacacaccctgccaatgccttagcactggagagctttttgcaatatgctggggaaaggggagggagggaatgaaagtgccaaagaaaacatgtttttaagaactcgggttttatacaatagaatgttttctagcagatgcctcttgttttaatatattaaaattttgcaaagccctttgagctactg

SEQ ID NO: 11526 - DNA, 4557 bp, Homo sapiens
ggcggcggcagaggaggaggaggaggcggtgctcgcgccgggcggtagagcggcgctgggacccatgcggccgtgacccccggctccctagaggcccagcgcagccgcagcggacaaaggagcatgtccgcgccggggaaggcccgtcctccggccgccataaggctccggtcgccgctgggcccgcgccgcgctcctgcccgcccgggctccggggcggcccgctaggccagtgcgccgccgctcgccccgcaggccccggcccgcagcatggagccacccggacgccggcggggccgcgcgcagccgccgctgttgctgccgctctcgctgttagcgctgctcgcgctgctgggaggcggcggcggcggcggcgccgcggcgctgcccgccggctgcaagcacgatgggcggccccgaggggctggcagggcggcgggcgccgccgagggcaaggtggtgtgcagcagcctggaactcgcgcaggtcctgcccccagatactctgcccaaccgcacggtcaccctgattctgagtaacaataagatatccgagctgaagaatggctcattttctgggttaagtctccttgaaagattggacctccgaaacaatcttattagtagtatagatccaggtgccttctggggactgtcatctctaaaaagattggatctgacaaacaatcgaataggatgtctgaatgcagacatatttcgaggactcaccaatctggttcggctaaacctttcggggaatttgttttcttcattatctcaaggaacttttgattatcttgcgtcattacggtctttggaattccagactgagtatcttttgtgtgactgtaacatactgtggatgcatcgctgggtaaaggagaagaacatcacggtacgggataccaggtgtgtttatcctaagtcactgcaggcccaaccagtcacaggcgtgaagcaggagctgttgacatgcgaccctccgcttgaattgccgtctttctacatgactccatctcatcgccaagttgtgtttgaaggagacagccttcctttccagtgcatggcttcatatattgatcaggacatgcaagtgttgtggtatcaggatgggagaatagttgaaaccgatgaatcgcaaggtatttttgttgaaaagaacatgattcacaactgctccttgattgcaagtgccctaaccatttctaatattcaggctggatctactggaaattggggctgtcatgtccagaccaaacgtgggaataatacgaggactgtggatattgtggtattagagagttctgcacagtactgtcctccagagagggtggtaaacaacaaaggtgacttcagatggcccagaacattggcaggcattactgcatatctgcagtgtacgcggaacacccatggcagtgggatatatcccggaaacccacaggatgagagaaaagcttggcgcagatgtgatagaggtggcttttgggcagatgatgattattctcgctgtcagtatgcaaatgatgtcactagagttctttatatgtttaatcagatgcccctcaatcttaccaatgccgtggcaacagctcgacagttactggcttacactgtggaagcagccaacttttctgacaaaatggatgttatatttgtggcagaaatgattgaaaaatttggaagatttaccaaggaggaaaaatcaaaagagctaggtgacgtgatggttgacattgcaagtaacatcatgttggctgatgaacgtgtcctgtggctggcgcagagggaagctaaagcctgcagtaggattgtgcagtgtcttcagcgcattgctacctaccggctagccggtggagctcacgtttattcaacatattcacccaatattgctctggaagcttatgtcatcaagtctactggcttcacggggatgacctgtaccgtgttccagaaagtggcagcctctgatcgtacaggactttcggattatgggaggcgggatccagagggaaacctggataagcagctgagctttaagtgcaatgtttcaaatacattttcgagtctggcactaaagaatactattgtggaggcttctattcagcttcctccttcccttttctcaccaaagcaaaaaagagaactcagaccaactgatgactctctttacaagcttcaactcattgcattccgcaatggaaagctttttccagccactggaaattcaacaaatttggctgatgatggaaaacgacgtactgtggttacccctgtgattctcaccaaaatagatggtgtgaatgtagatacccaccacatccctgttaatgtgacactgcgtcgaattgcacatggagcagatgctgttgcagcccggtgggatttcgatttgctgaacggacaaggaggctggaagtcagatgggtgccatatactctattcagatgaaaatatcactacgattcagtgctactcccttagtaactatgcagttttaatggatttgacgggatctgaactatacacccaggcggccagcctcctgcatcctgtggtttatactaccgctatcattctcctcttatgtctcttagccgtcattgtcagttacatataccatcacagtttgattagaatcagcctcaagagctggcacatgcttgtgaacttgtgctttcatattttcctaacctgtgtggtctttgtgggaggaataacccagactaggaatgccagcatctgccaagcagttgggataattcttcactattccacccttgccacagtactatgggtaggagtgacagctcgaaatatctacaaacaagtcactaaaaaagctaaaagatgccaggatcctgatgaaccaccacctccaccaagaccaatgctcagattttacctgattggtggtggtatccccatcattgtttgcggcataactgcagcagcgaacattaagaattacggcagtcggccaaacgcaccctattgctggatggcatgggaaccctccttgggagccttctatgggccagccagcttcatcacttttgtaaactgcatgtactttctgagcatatttattcagttgaaaagacaccctgagcgcaaatatgagcttaaggagcccacggaggagcaacagagattggcagccaatgaaaatggcgaaataaatcatcaggattcaatgtctttgtctctgatttctacatcagccttggaaaatgagcacacttttcattctcagctcttgggggccagccttactttgctcttatatgttgcactgtggatgtttggggctttggctgtttctttgtattaccctttggacttggtttttagcttcgtttttggagccacaagtttaagcttcagtgcgttcttcgtggtccaccattgtgttaatagggaggatgttagacttgcgtggatcatgacttgctgcccaggacggagctcgtattcagtgcaagtcaacgtccagccccccaactctaatgggacgaatggagaggcacccaaatgccccaatagcagtgcggagtcttcatgcacaaacaaaagtgcttcaagcttcaaaaattcctcccagggctgcaaattaacaaacttgcaggcggctgcagctcagtgccatgccaattctttacctttgaactccacccctcagcttgataatagtctgacagaacattcaatggacaatgatattaaaatgcacgtggcgcctttagaagttcagtttcgaacaaatgtgcactcaagccgccaccataaaaacagaagtaaaggacaccgggcaagccgactcacagtcctgagagaatatgcctacgatgtcccaacgagcgtggaaggaagcgtgcagaacggcttacctaaaagccggctgggcaataacgaaggacactcgaggagccgaagagcttatttagcctacagagagagacagtacaacccaccccagcaagacagcagcgatgcttgtagcacacttcccaaaagtagcagaaattttgaaaagccagtttcaaccactagtaaaaaagatgcgttaaggaagccagctgtggttgaacttgaaaatcagcaaaaatcttatggcctcaacttggccattcagaatggaccaattaaaagcaatgggcaggagggacccttgctcggtaccgatagcactggcaatgttaggactggattatggaaacacgaaactactgtgtaacattgctgggcttcctaggcagaaattcatataaactgtgatactcacattccttgaagctatgagcatttaaaaactgtttacagccaccatagggattcaaaagaatttggaataaactttgaagttttggattttacttatttttatccccaaattgttgctattttttaggatctgaaacaaaatctttctaaaacattgttttagttgtcaaagcaccaacaggacattttgggatgtgaaatgtaatttcttggaatctgtaatttgtacttaatatttcaggcttgtatttaatataataaataggtgtttgtt

SEQ ID NO: 11527 - DNA, 2870 bp, Homo sapiens
gggacccatgcggccgtgacccccggctccctagaggcccagcgcagccgcagcggacaaaggagcatgtccgcgccggggaaggcccgtcctccggccgccataaggctccggtcgccgctgggcccgcgccgcgctcctgcccgcccgggctccggggcggcccgctaggccagtgcgccgccgctcgccccgcaggccccggcccgcagcatggagccacccggacgccggcggggccgcgcgcagccgccgctgttgctgccgctctcgctgttagcgctgctcgcgctgctgggaggcggcggcggcggcggcgccgcggcgctgcccgccggctgcaagcacgatgggcggccccgaggggctggcagggcggcgggcgccgccgagggcaaggtggtgtgcagcagcctggaactcgcgcaggtcctgcccccagatactctgcccaaccgcacggtcaccctgattctgagtaacaataagatatccgagctgaagaatggctcattttctgggttaagtctccttgaaagattggacctccgaaacaatcttattagtagtatagatccaggtgccttctggggactgtcatctctaaaaagattggatctgacaaacaatcgaataggatgtctgaatgcagacatatttcgaggactcaccaatctggttcggctaaacctttcggggaatttgttttcttcattatctcaaggaacttttgattatcttgcgtcattacggtctttggaattccagactgagtatcttttgtgtgactgtaacatactgtggatgcatcgctgggtaaaggagaagaacatcacggtacgggataccaggtgtgtttatcctaagtcactgcaggcccaaccagtcacaggcgtgaagcaggagctgttgacatgcgaccctccgcttgaattgccgtctttctacatgactccatctcatcgccaagttgtgtttgaaggagacagccttcctttccagtgcatggcttcatatattgatcaggacatgcaagtgttgtggtatcaggatgggagaatagttgaaaccgatgaatcgcaaggtatttttgttgaaaagaacatgattcacaactgctccttgattgcaagtgccctaaccatttctaatattcaggctggatctactggaaattggggctgtcatgtccagaccaaacgtgggaataatacgaggactgtggatattgtggtattagagagttctgcacagtactgtcctccagagagggtggtaaacaacaaaggtgacttcagatggcccagaacattggcaggcattactgcatatctgcagtgtacgcggaacacccatggcagtgggatatatcccggaaacccacaggatgagagaaaagcttggcgcagatgtgatagaggtggcttttgggcagatgatgattattctcgctgtcagtatgcaaatgatgtcactagagttctttatatgtttaatcagatgcccctcaatcttaccaatgccgtggcaacagctcgacagttactggcttacactgtggaagcagccaacttttctgacaaaatggatgttatatttgtggcagaaatgattgaaaaatttggaagatttaccaaggaggaaaaatcaaaagagctaggtgacgtgatggttgacattgcaagtaacatcatgttggctgatgaacgtgtcctgtggctggcgcagagggaagctaaagcctgcagtaggattgtgcagtgtcttcagcgcattgctacctaccggctagccggtggagctcacgtttattcaacatattcacccaatattgctctggaagcttatgtcatcaagtctactggcttcacggggatgacctgtaccgtgttccagaaagtggcagcctctgatcgtacaggactttcggattatgggaggcgggatccagagggaaacctggataagcagctgagctttaagtgcaatgtttcaaatacattttcgagtctggcactaaaggtatgttacattctgcaatcatttaagactatttacagttaaattagaatgctccaaatgttctgcttcgcaaaataaccttattaaaagattttttttttgcaggaagataggtattattgcttttgctactgttttaaagaaaactaaccaggaagaactgcattacgactttcaagggccctaggcatttttgcctttgattccctttcttcacataaaaatatcagaaattacattttataactgcagtggtataaatgcaaatatactattgttacatgtgaaaaaatcttatttgacttaaaagtttatttatttgtttttttgctcctgattttaagacaataagatgttttcatgggcccctaaaagtatcatgagcctttggcactgcgcctgccaagcctagtggagaagtcaaccctgagaccaggtgtttaatcaagcaagctgtatatcaaaatttttggcagaaaacacaaatatgtcatatatctttttttaaaaaaagtatttcattgaagcaagcaaaatgaaagcatttttactgatttttaaaattggtgctttagatatatttgactacactgtattgaagcaaatagaggaggcacaactccagcaccctaatggaaccacatttttttcacttagctttctgtgggcatgtgtaattgtattctctgcggtttttaatctcacagtactttatttctgtcttgtccctcaataatatcacaaacaatattccagtcattttaatggctgcataataactgatccaacaggtgttaggtgttctggtttagtgtgagcactcaataaatattgaatgaatgaacgaa

SEQ ID NO: 11528 - DNA, 1572 bp, Homo sapiens
atttctgtaatcatctgatactcttaggatgccactgaagaggaataactctaaataccctccgcttgaattgccgtctttctacatgactccatctcatcgccaagttgtgtttgaaggagacagccttcctttccagtgcatggcttcatatattgatcaggacatgcaagtgttgtggtatcaggatgggagaatagttgaaaccgatgaatcgcaaggtatttttgttgaaaagaacatgattcacaactgctccttgattgcaagtgccctaaccatttctaatattcaggctggatctactggaaattggggctgtcatgtccagaccaaacgtgggaataatacgaggactgtggatattgtggtattagagagttctgcacagtactgtcctccagagagggtggtaaacaacaaaggtgacttcagatggcccagaacattggcaggcattactgcatatctgcagtgtacgcggaacacccatggcagtgggatatatcccggaaacccacaggatgagagaaaagcttggcgcagatgtgatagaggtggcttttgggcagatgatgattattctcgctgtcagtatgcaaatgatgtcactagagttctttatatgtttaatcagatgcccctcaatcttaccaatgccgtggcaacagctcgacagttactggcttacactgtggaagcagccaacttttctgacaaaatggatgttatatttgtggcagaaatgattgaaaaatttggaagatttaccaaggaggaaaaatcaaaagagctaggtgacgtgatggttgacattgcaagtaacatcatgttggctgatgaacgtgtcctgtggctggcgcagagggaagctaaagcctgcagtaggattgtgcagtgtcttcagcgcattgctacctaccggctagccggtggagctcacgtttattcaacatattcacccaatattgctctggaagcttatgtcatcaagtctactggcttcacggggatgacctgtaccgtgttccagaaagtggcagcctctgatcgtacaggactttcggattatgggaggcgggatccagagggaaacctggataagcagctgagctttaagtgcaatgtttcaaatacattttcgagtctggcactaaaggggaaattccggtgaatatggaattagaagaagagaggttagaagccaagaaaaagattgtacaataaattcttcaactatggaatgtttttagatggttaattgttcacttctttggtatatatatattttttactgaatgctgaataatttgttatttaaaaatcctcaataaagaaatctgaaaaaattcagtgatcagtcagcattttcagttgttcctatgtgttattattttttttttctaaatgtgtttcctagtctcaaggaaatttctgctaagtgtactgaatctaaacctctattatgtttgtataatttcattcttttgttgtgtggaggtttgaattcatcataaatcaccttaaagttccataagcccaaattaattatactcatatttatgatatgct

SEQ ID NO: 11529 - DNA, 7026 bp, Homo sapiens
ccagctccagtcacgccggaagcgcgggcggagcgcacgggtccggggagagtcgcctgcgcccgcgagggggacccaagtacctagggtggtggccgagtcccgcctcccgccagcgggggcgaggacctgcgacgcgcacccctgcctggcccggtctcctcagcaccagccccacgcacaccctacttcctcagcttctcgccctcaccctgccaacttccctgcgaggagggacctgccgccagcctgcttcctcgtccgcaggccctgcgctgaacgctgccgcgcccagggttcaccttgcgccgtcgggaaagcccatgaactctccagaaacggcgtaaaggagggtcccgccgcggcgcagggctggggcgcctgggttccccctgggtggagcagcggcagcagagcgggaaagtggtggaggatgatcttgcggccaaaggggacctcggcgcagtaatgtcaacatgatgtttcgctcagatcgaatgtggagctgccattggaaatggaagcccagtcctctcctgttcttatttgctttatatatcatgtgtgttcctcactcagtgtggggatgtgccaactgccgagtggttttgtccaacccttctgggacctttacttctccatgctaccctaacgactacccaaacagccaggcttgcatgtggacgctccgagcccccaccggttatatcattcagataacatttaacgactttgacattgaagaagctcccaattgcatttatgactcattatcccttgataatggagagagccagactaaattttgtggagcaactgccaaaggcctatcatttaactcaagtgcgaatgagatgcatgtgtccttttcaagtgactttagcatccagaagaaaggtttcaatgccagctacatcagagttgccgtgtccttaaggaatcaaaaggtcattttaccccagacatcagatgcttaccaggtatctgttgcaaaaagcatctctattccagagctcagtgctttcacactctgctttgaagcaaccaaagttggccatgaagacagtgattggacagctttctcctactcaaatgcatccttcacacaattgctcagttttggaaaggccaagagtggctactttctatccatttctgattcaaaatgtttgttgaataatgcattacctgtcaaagaaaaagaagacatttttgcagaaagctttgaacagctctgccttgtttggaataattctttgggctctattggtgtaaatttcaaaagaaactatgaaacagttccatgtgattctaccattagtaaagttattcctgggaatgggaaattgttgttgggctccaatcaaaatgaaattgtctctctaaaaggggacatttataactttcgactttggaattttaccatgaatgccaaaatcctctccaacctcagctgtaatgtgaaagggaatgtagtcgactggcaaaatgacttctggaatatcccaaacctagctctgaaagctgaaagcaacctaagctgtggttcctacctgatcccgctcccagcagcagaactggccagctgtgcagacctggggaccctctgtcaagctactgtaaactctcctagtactacaccacccactgtcaccactaacatgcctgttactaacagaatcgataaacaaaggaatgatggaattatctatagaatatccgtagtgattcagaacatccttcgtcaccctgaggtaaaagtacagagcaaggtggcagaatggctcaattcaaccttccaaaattggaactacacggtttatgtcgttaatatcagttttcacctgagtgctggagaggacaagattaaagtcaagagaagccttgaggatgagccaaggttggtgctttgggcccttctagtttacaatgctaccaacaatactaatttggaaggaaaaatcattcagcagaagctcctaaaaaataatgagtccttggatgaaggcttgaggctacatacagtgaatgtgagacaactgggtcattgtcttgccatggaggaacccaaaggctactactggccatctatccaaccttctgaatacgttcttccttgtccagacaagcctggcttttctgcttctcggatatgtttttacaatgctaccaacccattggtaacctactggggacctgttgatatctccaactgtttaaaagaagcaaatgaagttgctaaccagattttaaatttaactgctgatgggcagaacttaacctcagccaatattaccaacattgtggaacaggtcaaaagaattgtgaataaagaagaaaacattgatataacacttggctcaactctaatgaatatattttctaatatcttaagcagttcagacagtgacttgcttgagtcatcttctgaagctttaaaaacaattgatgaattggccttcaagatagacctaaatagcacatcacatgtgaatattacaactcggaacttggctctcagcgtatcatccctgttaccagggacaaatgcaatttcaaattttagcattggtcttccaagcaataatgaatcgtatttccagatggattttgagagtggacaagtggatccactggcatctgtaattttgcctccaaacttacttgagaatttaagtccagaagattctgtattagttagaagagcacagtttactttcttcaacaaaactggacttttccaggatgtaggaccccaaagaaaaactttagtgagttatgtgatggcgtgcagtattggaaacattactatccagaatctgaaggatcctgttcaaataaaaatcaaacatacaagaactcaggaagtgcatcatcccatctgtgccttctgggatctgaacaaaaacaaaagttttggaggatggaacacgtcaggatgtgttgcacacagagattcagatgcaagtgagacagtctgcctgtgtaaccacttcacacactttggagttctgatggaccttccaagaagtgcctcacagttagatgcaagaaacactaaagtcctcactttcatcagctatattgggtgtggaatatctgctattttttcagcagcaactctcctgacatatgttgcttttgagaaattgcgaagggattatccctccaaaatcttgatgaacctgagcacagccctgctgttcctgaatctcctcttcctcctagatggctggatcacctccttcaatgtggatggactttgcattgctgttgcagtcctgttgcatttcttccttctggcaacctttacctggatggggctagaagcaattcacatgtacattgctctagttaaagtatttaacacttacattcgccgatacattctaaaattctgcatcattggctggggtttgcctgccttagtggtgtcagttgttctagcgagcagaaacaacaatgaagtctatggaaaagaaagttatgggaaagaaaaaggtgatgaattctgttggattcaagatccagtcatattttatgtgacctgtgctgggtattttggagtcatgttttttctgaacattgccatgttcattgtggtaatggtgcagatctgtgggaggaatggcaagagaagcaaccggaccctgagagaagaagtgttaaggaacctgcgcagtgtggttagcttgacctttctgttgggcatgacatggggttttgcattctttgcctggggacccttaaatatccccttcatgtacctcttctccatcttcaattcattacaaggcttatttatattcatcttccactgtgctatgaaggagaatgttcagaaacagtggcggcagcatctctgctgtggtagatttcggttagcagataactcagattggagtaagacagctaccaatatcatcaagaaaagttctgataatctaggaaaatctttgtcttcaagctccattggttccaactcaacctatcttacatccaaatctaaatccagctctaccacctatttcaaaaggaatagccacacagataatgtctcctatgagcattccttcaacaaaagtggatcactcagacagtgcttccatggacaagtccttgtcaaaactggcccatgctgatggagatcaaacatcaatcatccctgtccatcaggtcattgataaggtcaagggttattgcaatgctcattcagacaacttctataaaaatattatcatgtcagacaccttcagccacagcacaaagttttaatgtctttaagaaaaagaaatcaatctgcagaaatgtgaagatttgcaagcagtgtaaactgcaactagtgatgtaaatgtgctattacctaggtaactgcatatatataaggaatgtattttgttaagaaggcttttgtgaaattcagaatttttctttttaatatatttcttccatggaagagttgtcatcactaaaacttcagtactgagagtaacatgactcagtagccacagaagctatgatttgtaaaatatataattgaatcagagtaatcataatgcaggggagacattcaaattagagacaagggagaagcaatgctgaggaagaccctagatagagctcattttactccacctaatcgttatatctggatatacccattttctgcatcttctttctcaacaataaaaaatgtaactattttgaatgcccacaaatcccattccagtgttactttctgtgaatgcagtaccatattctcattttcaatgacatttcaaccacaggcagaaaagactgtttactccttgacccaaagattaaaaaggattttttattattttaaatattacaccttcagaaccataacatgcttaagaaaactttcccaaaatgttgacctagttaaatgaggctatataaatttctaatattttacttattctattcaaggcatagggccaaagcattaagtataatttaatcccatacattcgagttaagtttagtgttgatgttccatcattctggacctcccaggagttgtttaagaatgaatctcttacacctctacttttgcccctctactgtatattaagcccataggcttgtgggaggaaggagaatttccattaggcaagctgtatgcagtggaattttccttttaggagacacacaattaagactctctggttctgtccttgctttggagactttaagacatttcctaaagcacaaataaaagcctcgtatttccccattgagagttttgttccaaggaatatgaagtgagacatatgggtgagtcataataatcaaaataatttatgaagagctgggtctgcaatagctagtctaaaaactacttgtgtgtcagtcctctggttatagtatataagagcctgaggaggtctggcaagatagatggtgtattatttatggatcaggctgctgcatacaaaccttgcatactattatgcagcttacctaactctcagactattctgagtaatgcttgcttgctaatgaatgtataggagaccacattgtaattgttcttagatgatggagtccatgcagtttcttagaaatcggtctcagtgcatgctgtgctttttcacatttgctctgggttatctgggaagtatcaggttctgggaggcaacagcattaagtgataagaaaaggagacattctggcaaagccaatctgcttaaaggcaaagtccagaacctggaacctagaggcctttctctctgcacgaaaaacaggtagtttgcagtctgagatatgggagagcttttaggctacacagcaacccaagggacctctcaccttttgctgagcttcaatcaggaagctatttgcctggctccagcagatgatgagataatgaggtagtgggttttttattactgttccattttgcaacatcctgcaacaccatcctgggagacaagagcattacccagcttggctttcacgggggagggttgtattcagtaaaaaagaatagtaaatataaggtcactgagattctaagtaagatagtaaatctaaggtcactgagccaaatccttttcaataggcatatattaacaggctgcttattttggcggaggttacatatggatgaaaatgaatcttagtcactgaatattcatatacatttcccccaaaaccttagacattcatagtagattttaattagttagctttctaactagtcagatttctgcccaaagtgcttagtcaatagtaattaagatatagcttcaaaaatggctttgcttttgatttctactcatattcgtatggctccagaaaaatatttttttcatatttgacaatgtcagctccactttagaaattttcaataaccagatgagaaaaaaattaagaaattgctcaagggaaacatttgtaaatggatttgaaagattgagccaaattctgttgtcagttctaagcatgcagttctcacctccatttagtcccccatcagaacagaggtcaggaatttagctggggagcctaaatttagttcagcttacctttgagaatagcatcaattcagactctcttttcattatgttttcttttctttttccctctttttaaactacattgtgttagagtcatagtctaggatcctgagagattttccattcttgtcaccattcacttgcattgtaaagattttctttgtctgttgttggcatagattcttttgtacatatttatttatttgtgtttatatatgtcaattggtttcctttcttagcttgatattgcctagctttgttgttttaattaactttctattagagagactgtatatattttttctaaatactttgtgaaatcatttttggtagcaatatctttgaatatgatgaataaaagtgactgtgagtgcaaatagaattagcagtaagaagctactctagctaatttgccattttacttaaatggaaaatgtttttcaaataaatacttatgttgttcatgttccaagttattcaa

SEQ ID NO: 11530 - DNA, 6849 bp, Homo sapiens
ccaagtacctagggtggtggccgagtcccgcctcccgccagcgggggcgaggacctgcgacgcgcacccctgcctggcccggtctcctcagcaccagccccacgcacaccctacttcctcagcttctcgccctcaccctgccaacttccctgcgaggagggacctgccgccagcctgcttcctcgtccgcaggccctgcgctgaacgctgccgcgcccagggttcaccttgcgccgtcgggaaagcccatgaactctccagaaacggcgtaaaggagggtcccgccgcggcgcagggctggggcgcctgggttccccctgggtggagcagcggcagcagagcgggaaagtggtggaggatgatcttgcggccaaaggggacctcggcgcagtaatgtcaacatgatgtttcgctcagatcgaatgtggagctgccattggaaatggaagcccagtcctctcctgttcttatttgctttatatatcatgtgtgttcctcactcagtgtggggatgtgccaactgccgagtggttttgtccaacccttctgggacctttacttctccatgctaccctaacgactacccaaacagccaggcttgcatgtggacgctccgagcccccaccggttatatcattcagataacatttaacgactttgacattgaagaagctcccaattgcatttatgactcattatcccttgataatggagagagccagactaaattttgtggagcaactgccaaaggcctatcatttaactcaagtgcgaatgagatgcatgtgtccttttcaagtgactttagcatccagaagaaaggtttcaatgccagctacatcagagttgccgtgtccttaaggaatcaaaaggtcattttaccccagacatcagatgcttaccaggtatctgttgcaaaaagcatctctattccagagctcagtgctttcacactctgctttgaagcaaccaaagttggccatgaagacagtgattggacagctttctcctactcaaatgcatccttcacacaattgctcagttttggaaaggccaagagtggctactttctatccatttctgattcaaaatgtttgttgaataatgcattacctgtcaaagaaaaagaagacatttttgcagaaagctttgaacagctctgccttgtttggaataattctttgggctctattggtgtaaatttcaaaagaaactatgaaacagttccatgtgattctaccattagtaaagttattcctgggaatgggaaattgttgttgggctccaatcaaaatgaaattgtctctctaaaaggggacatttataactttcgactttggaattttaccatgaatgccaaaatcctctccaacctcagctgtaatgtgaaagggaatgtagtcgactggcaaaatgacttctggaatatcccaaacctagctctgaaagctgaaagcaacctaagctgtggttcctacctgatcccgctcccagcagcagaactggccagctgtgcagacctggggaccctctgtcaagatggaattatctatagaatatccgtagtgattcagaacatccttcgtcaccctgaggtaaaagtacagagcaaggtggcagaatggctcaattcaaccttccaaaattggaactacacggtttatgtcgttaatatcagttttcacctgagtgctggagaggacaagattaaagtcaagagaagccttgaggatgagccaaggttggtgctttgggcccttctagtttacaatgctaccaacaatactaatttggaaggaaaaatcattcagcagaagctcctaaaaaataatgagtccttggatgaaggcttgaggctacatacagtgaatgtgagacaactgggtcattgtcttgccatggaggaacccaaaggctactactggccatctatccaaccttctgaatacgttcttccttgtccagacaagcctggcttttctgcttctcggatatgtttttacaatgctaccaacccattggtaacctactggggacctgttgatatctccaactgtttaaaagaagcaaatgaagttgctaaccagattttaaatttaactgctgatgggcagaacttaacctcagccaatattaccaacattgtggaacaggtcaaaagaattgtgaataaagaagaaaacattgatataacacttggctcaactctaatgaatatattttctaatatcttaagcagttcagacagtgacttgcttgagtcatcttctgaagctttaaaaacaattgatgaattggccttcaagatagacctaaatagcacatcacatgtgaatattacaactcggaacttggctctcagcgtatcatccctgttaccagggacaaatgcaatttcaaattttagcattggtcttccaagcaataatgaatcgtatttccagatggattttgagagtggacaagtggatccactggcatctgtaattttgcctccaaacttacttgagaatttaagtccagaagattctgtattagttagaagagcacagtttactttcttcaacaaaactggacttttccaggatgtaggaccccaaagaaaaactttagtgagttatgtgatggcgtgcagtattggaaacattactatccagaatctgaaggatcctgttcaaataaaaatcaaacatacaagaactcaggaagtgcatcatcccatctgtgccttctgggatctgaacaaaaacaaaagttttggaggatggaacacgtcaggatgtgttgcacacagagattcagatgcaagtgagacagtctgcctgtgtaaccacttcacacactttggagttctgatggaccttccaagaagtgcctcacagttagatgcaagaaacactaaagtcctcactttcatcagctatattgggtgtggaatatctgctattttttcagcagcaactctcctgacatatgttgcttttgagaaattgcgaagggattatccctccaaaatcttgatgaacctgagcacagccctgctgttcctgaatctcctcttcctcctagatggctggatcacctccttcaatgtggatggactttgcattgctgttgcagtcctgttgcatttcttccttctggcaacctttacctggatggggctagaagcaattcacatgtacattgctctagttaaagtatttaacacttacattcgccgatacattctaaaattctgcatcattggctggggtttgcctgccttagtggtgtcagttgttctagcgagcagaaacaacaatgaagtctatggaaaagaaagttatgggaaagaaaaaggtgatgaattctgttggattcaagatccagtcatattttatgtgacctgtgctgggtattttggagtcatgttttttctgaacattgccatgttcattgtggtaatggtgcagatctgtgggaggaatggcaagagaagcaaccggaccctgagagaagaagtgttaaggaacctgcgcagtgtggttagcttgacctttctgttgggcatgacatggggttttgcattctttgcctggggacccttaaatatccccttcatgtacctcttctccatcttcaattcattacaaggcttatttatattcatcttccactgtgctatgaaggagaatgttcagaaacagtggcggcagcatctctgctgtggtagatttcggttagcagataactcagattggagtaagacagctaccaatatcatcaagaaaagttctgataatctaggaaaatctttgtcttcaagctccattggttccaactcaacctatcttacatccaaatctaaatccagctctaccacctatttcaaaaggaatagccacacagataatgtctcctatgagcattccttcaacaaaagtggatcactcagacagtgcttccatggacaagtccttgtcaaaactggcccatgctgatggagatcaaacatcaatcatccctgtccatcaggtcattgataaggtcaagggttattgcaatgctcattcagacaacttctataaaaatattatcatgtcagacaccttcagccacagcacaaagttttaatgtctttaagaaaaagaaatcaatctgcagaaatgtgaagatttgcaagcagtgtaaactgcaactagtgatgtaaatgtgctattacctaggtaactgcatatatataaggaatgtattttgttaagaaggcttttgtgaaattcagaatttttctttttaatatatttcttccatggaagagttgtcatcactaaaacttcagtactgagagtaacatgactcagtagccacagaagctatgatttgtaaaatatataattgaatcagagtaatcataatgcaggggagacattcaaattagagacaagggagaagcaatgctgaggaagaccctagatagagctcattttactccacctaatcgttatatctggatatacccattttctgcatcttctttctcaacaataaaaaatgtaactattttgaatgcccacaaatcccattccagtgttactttctgtgaatgcagtaccatattctcattttcaatgacatttcaaccacaggcagaaaagactgtttactccttgacccaaagattaaaaaggattttttattattttaaatattacaccttcagaaccataacatgcttaagaaaactttcccaaaatgttgacctagttaaatgaggctatataaatttctaatattttacttattctattcaaggcatagggccaaagcattaagtataatttaatcccatacattcgagttaagtttagtgttgatgttccatcattctggacctcccaggagttgtttaagaatgaatctcttacacctctacttttgcccctctactgtatattaagcccataggcttgtgggaggaaggagaatttccattaggcaagctgtatgcagtggaattttccttttaggagacacacaattaagactctctggttctgtccttgctttggagactttaagacatttcctaaagcacaaataaaagcctcgtatttccccattgagagttttgttccaaggaatatgaagtgagacatatgggtgagtcataataatcaaaataatttatgaagagctgggtctgcaatagctagtctaaaaactacttgtgtgtcagtcctctggttatagtatataagagcctgaggaggtctggcaagatagatggtgtattatttatggatcaggctgctgcatacaaaccttgcatactattatgcagcttacctaactctcagactattctgagtaatgcttgcttgctaatgaatgtataggagaccacattgtaattgttcttagatgatggagtccatgcagtttcttagaaatcggtctcagtgcatgctgtgctttttcacatttgctctgggttatctgggaagtatcaggttctgggaggcaacagcattaagtgataagaaaaggagacattctggcaaagccaatctgcttaaaggcaaagtccagaacctggaacctagaggcctttctctctgcacgaaaaacaggtagtttgcagtctgagatatgggagagcttttaggctacacagcaacccaagggacctctcaccttttgctgagcttcaatcaggaagctatttgcctggctccagcagatgatgagataatgaggtagtgggttttttattactgttccattttgcaacatcctgcaacaccatcctgggagacaagagcattacccagcttggctttcacgggggagggttgtattcagtaaaaaagaatagtaaatataaggtcactgagattctaagtaagatagtaaatctaaggtcactgagccaaatccttttcaataggcatatattaacaggctgcttattttggcggaggttacatatggatgaaaatgaatcttagtcactgaatattcatatacatttcccccaaaaccttagacattcatagtagattttaattagttagctttctaactagtcagatttctgcccaaagtgcttagtcaatagtaattaagatatagcttcaaaaatggctttgcttttgatttctactcatattcgtatggctccagaaaaatatttttttcatatttgacaatgtcagctccactttagaaattttcaataaccagatgagaaaaaaattaagaaattgctcaagggaaacatttgtaaatggatttgaaagattgagccaaattctgttgtcagttctaagcatgcagttctcacctccatttagtcccccatcagaacagaggtcaggaatttagctggggagcctaaatttagttcagcttacctttgagaatagcatcaattcagactctcttttcattatgttttcttttctttttccctctttttaaactacattgtgttagagtcatagtctaggatcctgagagattttccattcttgtcaccattcacttgcattgtaaagattttctttgtctgttgttggcatagattcttttgtacatatttatttatttgtgtttatatatgtcaattggtttcctttcttagcttgatattgcctagctttgttgttttaattaactttctattagagagactgtatatattttttctaaatactttgtgaaatcatttttggtagcaatatctttgaatatgatgaataaaagtgactgtgagtgcaaatagaattagcagtaagaagctactctagctaatttgccattttacttaaatggaaaatgtttttcaaataaatacttatgttgttc

SEQ ID NO: 11531 - DNA, 6879 bp, Homo sapiens
tccagtcacgccggaagcgcgggcggagcgcacgggtccggggagagtcgcctgcgcccgcgagggggacccaagtacctagggtggtggccgagtcccgcctcccgccagcgggggcgaggacctgcgacgcgcacccctgcctggcccggtctcctcagcaccagccccacgcacaccctacttcctcagcttctcgccctcaccctgccaacttccctgcgaggagggacctgccgccagcctgcttcctcgtccgcaggccctgcgctgaacgctgccgcgcccagggttcaccttgcgccgtcgggaaagcccatgaactctccagaaacggcgtaaaggagggtcccgccgcggcgcagggctggggcgcctgggttccccctgggtggagcagcggcagcagagcgggaaagtggtggaggatgatcttgcggccaaaggggacctcggcgcagtaatgtcaacatgatgtttcgctcagatcgaatgtggagctgccattggaaatggaagcccagtcctctcctgttcttatttgctttatatatcatgtgtgttcctcactcagtgtggggatgtgccaactgccgagtggttttgtccaacccttctgggacctttacttctccatgctaccctaacgactacccaaacagccaggcttgcatgtggacgctccgagcccccaccggttatatcattcagataacatttaacgactttgacattgaagaagctcccaattgcatttatgactcattatcccttgataatggagagagccagactaaattttgtggagcaactgccaaaggcctatcatttaactcaagtgcgaatgagatgcatgtgtccttttcaagtgactttagcatccagaagaaaggtttcaatgccagctacatcagagttgccgtgtccttaaggaatcaaaaggtcattttaccccagacatcagatgcttaccaggtatctgttgcaaaaagcatctctattccagagctcagtgctttcacactctgctttgaagcaaccaaagttggccatgaagacagtgattggacagctttctcctactcaaatgcatccttcacacaattgctcagttttggaaaggccaagagtggctactttctatccatttctgattcaaaatgtttgttgaataatgcattacctgtcaaagaaaaagaagacatttttgcagaaagctttgaacagctctgccttgtttggaataattctttgggctctattggtgtaaatttcaaaagaaactatgaaacagttccatgtgattctaccattagtaaagttattcctgggaatgggaaattgttgttgggctccaatcaaaatgaaattgtctctctaaaaggggacatttataactttcgactttggaattttaccatgaatgccaaaatcctctccaacctcagctgtaatgtgaaagggaatgtagtcgactggcaaaatgacttctggaatatcccaaacctagctctgaaagctgaaagcaacctaagctgtggttcctacctgatcccgctcccagcagcagaactggccagctgtgcagacctggggaccctctgtcaagatggaattatctatagaatatccgtagtgattcagaacatccttcgtcaccctgaggtaaaagtacagagcaaggtggcagaatggctcaattcaaccttccaaaattggaactacacggtttatgtcgttaatatcagttttcacctgagtgctggagaggacaagattaaagtcaagagaagccttgaggatgagccaaggttggtgctttgggcccttctagtttacaatgctaccaacaatactaatttggaaggaaaaatcattcagcagaagctcctaaaaaataatgagtccttggatgaaggcttgaggctacatacagtgaatgtgagacaactgggtcattgtcttgccatggaggaacccaaaggctactactggccatctatccaaccttctgaatacgttcttccttgtccagacaagcctggcttttctgcttctcggatatgtttttacaatgctaccaacccattggtaacctactggggacctgttgatatctccaactgtttaaaagaagcaaatgaagttgctaaccagattttaaatttaactgctgatgggcagaacttaacctcagccaatattaccaacattgtggaacaggtcaaaagaattgtgaataaagaagaaaacattgatataacacttggctcaactctaatgaatatattttctaatatcttaagcagttcagacagtgacttgcttgagtcatcttctgaagctttaaaaacaattgatgaattggccttcaagatagacctaaatagcacatcacatgtgaatattacaactcggaacttggctctcagcgtatcatccctgttaccagggacaaatgcaatttcaaattttagcattggtcttccaagcaataatgaatcgtatttccagatggattttgagagtggacaagtggatccactggcatctgtaattttgcctccaaacttacttgagaatttaagtccagaagattctgtattagttagaagagcacagtttactttcttcaacaaaactggacttttccaggatgtaggaccccaaagaaaaactttagtgagttatgtgatggcgtgcagtattggaaacattactatccagaatctgaaggatcctgttcaaataaaaatcaaacatacaagaactcaggaagtgcatcatcccatctgtgccttctgggatctgaacaaaaacaaaagttttggaggatggaacacgtcaggatgtgttgcacacagagattcagatgcaagtgagacagtctgcctgtgtaaccacttcacacactttggagttctgatggaccttccaagaagtgcctcacagttagatgcaagaaacactaaagtcctcactttcatcagctatattgggtgtggaatatctgctattttttcagcagcaactctcctgacatatgttgcttttgagaaattgcgaagggattatccctccaaaatcttgatgaacctgagcacagccctgctgttcctgaatctcctcttcctcctagatggctggatcacctccttcaatgtggatggactttgcattgctgttgcagtcctgttgcatttcttccttctggcaacctttacctggatggggctagaagcaattcacatgtacattgctctagttaaagtatttaacacttacattcgccgatacattctaaaattctgcatcattggctggggtttgcctgccttagtggtgtcagttgttctagcgagcagaaacaacaatgaagtctatggaaaagaaagttatgggaaagaaaaaggtgatgaattctgttggattcaagatccagtcatattttatgtgacctgtgctgggtattttggagtcatgttttttctgaacattgccatgttcattgtggtaatggtgcagatctgtgggaggaatggcaagagaagcaaccggaccctgagagaagaagtgttaaggaacctgcgcagtgtggttagcttgacctttctgttgggcatgacatggggttttgcattctttgcctggggacccttaaatatccccttcatgtacctcttctccatcttcaattcattacaaggcttatttatattcatcttccactgtgctatgaaggagaatgttcagaaacagtggcggcagcatctctgctgtggtagatttcggttagcagataactcagattggagtaagacagctaccaatatcatcaagaaaagttctgataatctaggaaaatctttgtcttcaagctccattggttccaactcaacctatcttacatccaaatctaaatccagctctaccacctatttcaaaaggaatagccacacagacagtgcttccatggacaagtccttgtcaaaactggcccatgctgatggagatcaaacatcaatcatccctgtccatcaggtcattgataaggtcaagggttattgcaatgctcattcagacaacttctataaaaatattatcatgtcagacaccttcagccacagcacaaagttttaatgtctttaagaaaaagaaatcaatctgcagaaatgtgaagatttgcaagcagtgtaaactgcaactagtgatgtaaatgtgctattacctaggtaactgcatatatataaggaatgtattttgttaagaaggcttttgtgaaattcagaatttttctttttaatatatttcttccatggaagagttgtcatcactaaaacttcagtactgagagtaacatgactcagtagccacagaagctatgatttgtaaaatatataattgaatcagagtaatcataatgcaggggagacattcaaattagagacaagggagaagcaatgctgaggaagaccctagatagagctcattttactccacctaatcgttatatctggatatacccattttctgcatcttctttctcaacaataaaaaatgtaactattttgaatgcccacaaatcccattccagtgttactttctgtgaatgcagtaccatattctcattttcaatgacatttcaaccacaggcagaaaagactgtttactccttgacccaaagattaaaaaggattttttattattttaaatattacaccttcagaaccataacatgcttaagaaaactttcccaaaatgttgacctagttaaatgaggctatataaatttctaatattttacttattctattcaaggcatagggccaaagcattaagtataatttaatcccatacattcgagttaagtttagtgttgatgttccatcattctggacctcccaggagttgtttaagaatgaatctcttacacctctacttttgcccctctactgtatattaagcccataggcttgtgggaggaaggagaatttccattaggcaagctgtatgcagtggaattttccttttaggagacacacaattaagactctctggttctgtccttgctttggagactttaagacatttcctaaagcacaaataaaagcctcgtatttccccattgagagttttgttccaaggaatatgaagtgagacatatgggtgagtcataataatcaaaataatttatgaagagctgggtctgcaatagctagtctaaaaactacttgtgtgtcagtcctctggttatagtatataagagcctgaggaggtctggcaagatagatggtgtattatttatggatcaggctgctgcatacaaaccttgcatactattatgcagcttacctaactctcagactattctgagtaatgcttgcttgctaatgaatgtataggagaccacattgtaattgttcttagatgatggagtccatgcagtttcttagaaatcggtctcagtgcatgctgtgctttttcacatttgctctgggttatctgggaagtatcaggttctgggaggcaacagcattaagtgataagaaaaggagacattctggcaaagccaatctgcttaaaggcaaagtccagaacctggaacctagaggcctttctctctgcacgaaaaacaggtagtttgcagtctgagatatgggagagcttttaggctacacagcaacccaagggacctctcaccttttgctgagcttcaatcaggaagctatttgcctggctccagcagatgatgagataatgaggtagtgggttttttattactgttccattttgcaacatcctgcaacaccatcctgggagacaagagcattacccagcttggctttcacgggggagggttgtattcagtaaaaaagaatagtaaatataaggtcactgagattctaagtaagatagtaaatctaaggtcactgagccaaatccttttcaataggcatatattaacaggctgcttattttggcggaggttacatatggatgaaaatgaatcttagtcactgaatattcatatacatttcccccaaaaccttagacattcatagtagattttaattagttagctttctaactagtcagatttctgcccaaagtgcttagtcaatagtaattaagatatagcttcaaaaatggctttgcttttgatttctactcatattcgtatggctccagaaaaatatttttttcatatttgacaatgtcagctccactttagaaattttcaataaccagatgagaaaaaaattaagaaattgctcaagggaaacatttgtaaatggatttgaaagattgagccaaattctgttgtcagttctaagcatgcagttctcacctccatttagtcccccatcagaacagaggtcaggaatttagctggggagcctaaatttagttcagcttacctttgagaatagcatcaattcagactctcttttcattatgttttcttttctttttccctctttttaaactacattgtgttagagtcatagtctaggatcctgagagattttccattcttgtcaccattcacttgcattgtaaagattttctttgtctgttgttggcatagattcttttgtacatatttatttatttgtgtttatatatgtcaattggtttcctttcttagcttgatattgcctagctttgttgttttaattaactttctattagagagactgtatatattttttctaaatactttgtgaaatcatttttggtagcaatatctttgaatatgatgaataaaagtgactgtgagtgcaaatagaattagcagtaagaagctactctagctaatttgccattttacttaaatggaaaatgtttttcaaataaatacttatgttgttcatgttc

SEQ ID NO: 11532 - DNA, 6887 bp, Homo sapiens
ccaagtacctagggtggtggccgagtcccgcctcccgccagcgggggcgaggacctgcgacgcgcacccctgcctggcccggtctcctcagcaccagccccacgcacaccctacttcctcagcttctcgccctcaccctgccaacttccctgcgaggagggacctgccgccagcctgcttcctcgtccgcaggccctgcgctgaacgctgccgcgcccagggttcaccttgcgccgtcgggaaagcccatgaactctccagaaacggcgtaaaggagggtcccgccgcggcgcagggctggggcgcctgggttccccctgggtggagcagcggcagcagagcgggaaagtggtggaggatgatcttgcggccaaaggggacctcggcgcagtaatgtcaacatgatgtttcgctcagatcgaatgtggagctgccattggaaatggaagcccagtcctctcctgttcttatttgctttatatatcatgtgtgttcctcactcagtgtggggatgtgccaactgccgagtggttttgtccaacccttctgggacctttacttctccatgctaccctaacgactacccaaacagccaggcttgcatgtggacgctccgagcccccaccggttatatcattcagataacatttaacgactttgacattgaagaagctcccaattgcatttatgactcattatcccttgataatggagagagccagactaaattttgtggagcaactgccaaaggcctatcatttaactcaagtgcgaatgagatgcatgtgtccttttcaagtgactttagcatccagaagaaaggtttcaatgccagctacatcagagttgccgtgtccttaaggaatcaaaaggtcattttaccccagacatcagatgcttaccaggtatctgttgcaaaaagcatctctattccagagctcagtgctttcacactctgctttgaagcaaccaaagttggccatgaagacagtgattggacagctttctcctactcaaatgcatccttcacacaattgctcagttttggaaaggccaagagtggctactttctatccatttctgattcaaaatgtttgttgaataatgcattacctgtcaaagaaaaagaagacatttttgcagaaagctttgaacagctctgccttgtttggaataattctttgggctctattggtgtaaatttcaaaagaaactatgaaacagttccatgtgattctaccattagtaaagttattcctgggaatgggaaattgttgttgggctccaatcaaaatgaaattgtctctctaaaaggggacatttataactttcgactttggaattttaccatgaatgccaaaatcctctccaacctcagctgtaatgtgaaagggaatgtagtcgactggcaaaatgacttctggaatatcccaaacctagctctgaaagctgaaagcaacctaagctgtggttcctacctgatcccgctcccagcagcagaactggccagctgtgcagacctggggaccctctgtcaagctactgtaaactctcctagtactacaccacccactgtcaccactaacatgcctgttactaacagaatcgataaacaaaggaatgatggaattatctatagaatatccgtagtgattcagaacatccttcgtcaccctgaggtaaaagtacagagcaaggtggcagaatggctcaattcaaccttccaaaattggaactacacggtttatgtcgttaatatcagttttcacctgagtgctggagaggacaagattaaagtcaagagaagccttgaggatgagccaaggttggtgctttgggcccttctagtttacaatgctaccaacaatactaatttggaaggaaaaatcattcagcagaagctcctaaaaaataatgagtccttggatgaaggcttgaggctacatacagtgaatgtgagacaactgggtcattgtcttgccatggaggaacccaaaggctactactggccatctatccaaccttctgaatacgttcttccttgtccagacaagcctggcttttctgcttctcggatatgtttttacaatgctaccaacccattggtaacctactggggacctgttgatatctccaactgtttaaaagaagcaaatgaagttgctaaccagattttaaatttaactgctgatgggcagaacttaacctcagccaatattaccaacattgtggaacaggtcaaaagaattgtgaataaagaagaaaacattgatataacacttggctcaactctaatgaatatattttctaatatcttaagcagttcagacagtgacttgcttgagtcatcttctgaagctttaaaaacaattgatgaattggccttcaagatagacctaaatagcacatcacatgtgaatattacaactcggaacttggctctcagcgtatcatccctgttaccagggacaaatgcaatttcaaattttagcattggtcttccaagcaataatgaatcgtatttccagatggattttgagagtggacaagtggatccactggcatctgtaattttgcctccaaacttacttgagaatttaagtccagaagattctgtattagttagaagagcacagtttactttcttcaacaaaactggacttttccaggatgtaggaccccaaagaaaaactttagtgagttatgtgatggcgtgcagtattggaaacattactatccagaatctgaaggatcctgttcaaataaaaatcaaacatacaagaactcaggaagtgcatcatcccatctgtgccttctgggatctgaacaaaaacaaaagttttggaggatggaacacgtcaggatgtgttgcacacagagattcagatgcaagtgagacagtctgcctgtgtaaccacttcacacactttggagttctgatggaccttccaagaagtgcctcacagttagatgcaagaaacactaaagtcctcactttcatcagctatattgggtgtggaatatctgctattttttcagcagcaactctcctgacatatgttgcttttgagaaattgcgaagggattatccctccaaaatcttgatgaacctgagcacagccctgctgttcctgaatctcctcttcctcctagatggctggatcacctccttcaatgtggatggactttgcattgctgttgcagtcctgttgcatttcttccttctggcaacctttacctggatggggctagaagcaattcacatgtacattgctctagttaaagtatttaacacttacattcgccgatacattctaaaattctgcatcattggctggggtttgcctgccttagtggtgtcagttgttctagcgagcagaaacaacaatgaagtctatggaaaagaaagttatgggaaagaaaaaggtgatgaattctgttggattcaagatccagtcatattttatgtgacctgtgctgggtattttggagtcatgttttttctgaacattgccatgttcattgtggtaatggtgcagatctgtgggaggaatggcaagagaagcaaccggaccctgagagaagaagtgttaaggaacctgcgcagtgtggttagcttgacctttctgttgggcatgacatggggttttgcattctttgcctggggacccttaaatatccccttcatgtacctcttctccatcttcaattcattacaaggcttatttatattcatcttccactgtgctatgaaggagaatgttcagaaacagtggcggcagcatctctgctgtggtagatttcggttagcagataactcagattggagtaagacagctaccaatatcatcaagaaaagttctgataatctaggaaaatctttgtcttcaagctccattggttccaactcaacctatcttacatccaaatctaaatccagctctaccacctatttcaaaaggaatagccacacagacagtgcttccatggacaagtccttgtcaaaactggcccatgctgatggagatcaaacatcaatcatccctgtccatcaggtcattgataaggtcaagggttattgcaatgctcattcagacaacttctataaaaatattatcatgtcagacaccttcagccacagcacaaagttttaatgtctttaagaaaaagaaatcaatctgcagaaatgtgaagatttgcaagcagtgtaaactgcaactagtgatgtaaatgtgctattacctaggtaactgcatatatataaggaatgtattttgttaagaaggcttttgtgaaattcagaatttttctttttaatatatttcttccatggaagagttgtcatcactaaaacttcagtactgagagtaacatgactcagtagccacagaagctatgatttgtaaaatatataattgaatcagagtaatcataatgcaggggagacattcaaattagagacaagggagaagcaatgctgaggaagaccctagatagagctcattttactccacctaatcgttatatctggatatacccattttctgcatcttctttctcaacaataaaaaatgtaactattttgaatgcccacaaatcccattccagtgttactttctgtgaatgcagtaccatattctcattttcaatgacatttcaaccacaggcagaaaagactgtttactccttgacccaaagattaaaaaggattttttattattttaaatattacaccttcagaaccataacatgcttaagaaaactttcccaaaatgttgacctagttaaatgaggctatataaatttctaatattttacttattctattcaaggcatagggccaaagcattaagtataatttaatcccatacattcgagttaagtttagtgttgatgttccatcattctggacctcccaggagttgtttaagaatgaatctcttacacctctacttttgcccctctactgtatattaagcccataggcttgtgggaggaaggagaatttccattaggcaagctgtatgcagtggaattttccttttaggagacacacaattaagactctctggttctgtccttgctttggagactttaagacatttcctaaagcacaaataaaagcctcgtatttccccattgagagttttgttccaaggaatatgaagtgagacatatgggtgagtcataataatcaaaataatttatgaagagctgggtctgcaatagctagtctaaaaactacttgtgtgtcagtcctctggttatagtatataagagcctgaggaggtctggcaagatagatggtgtattatttatggatcaggctgctgcatacaaaccttgcatactattatgcagcttacctaactctcagactattctgagtaatgcttgcttgctaatgaatgtataggagaccacattgtaattgttcttagatgatggagtccatgcagtttcttagaaatcggtctcagtgcatgctgtgctttttcacatttgctctgggttatctgggaagtatcaggttctgggaggcaacagcattaagtgataagaaaaggagacattctggcaaagccaatctgcttaaaggcaaagtccagaacctggaacctagaggcctttctctctgcacgaaaaacaggtagtttgcagtctgagatatgggagagcttttaggctacacagcaacccaagggacctctcaccttttgctgagcttcaatcaggaagctatttgcctggctccagcagatgatgagataatgaggtagtgggttttttattactgttccattttgcaacatcctgcaacaccatcctgggagacaagagcattacccagcttggctttcacgggggagggttgtattcagtaaaaaagaatagtaaatataaggtcactgagattctaagtaagatagtaaatctaaggtcactgagccaaatccttttcaataggcatatattaacaggctgcttattttggcggaggttacatatggatgaaaatgaatcttagtcactgaatattcatatacatttcccccaaaaccttagacattcatagtagattttaattagttagctttctaactagtcagatttctgcccaaagtgcttagtcaatagtaattaagatatagcttcaaaaatggctttgcttttgatttctactcatattcgtatggctccagaaaaatatttttttcatatttgacaatgtcagctccactttagaaattttcaataaccagatgagaaaaaaattaagaaattgctcaagggaaacatttgtaaatggatttgaaagattgagccaaattctgttgtcagttctaagcatgcagttctcacctccatttagtcccccatcagaacagaggtcaggaatttagctggggagcctaaatttagttcagcttacctttgagaatagcatcaattcagactctcttttcattatgttttcttttctttttccctctttttaaactacattgtgttagagtcatagtctaggatcctgagagattttccattcttgtcaccattcacttgcattgtaaagattttctttgtctgttgttggcatagattcttttgtacatatttatttatttgtgtttatatatgtcaattggtttcctttcttagcttgatattgcctagctttgttgttttaattaactttctattagagagactgtatatattttttctaaatactttgtgaaatcatttttggtagcaatatctttgaatatgatgaataaaagtgactgtgagtgcaaatagaattagcagtaagaagctactctagctaatttgccattttacttaaatggaaaatgtttttcaaataaatacttatgttgttc

SEQ ID NO: 11533 - DNA, 3140 bp, Homo sapiens
ataactctaatcacttttttcatgttctccttgagtgaaggatgaggaaattgaaagcagagtatgcaccttttattaggagattcaaactgcatcctactggattagcctcaaaagtcctaaaatacaaagacatccatctgacagatcactgaggggaggacttgtttttctgttttagaatagtttccgattaaactttttagctcaagaagaaaagaagctagttatttctcacccaggagtggatttgtggtttggcttcaccatggcttcctgccgtgcctggaaccttagggtgctggtggctgtcgtgtgtggactactgactggcatcattttgggactgggcatctggaggattgtgatcaggatccaaagaggaaaatctacttcctcatcaagcacccctacagagttctgcaggaatggtggaacctgggaaaatggcagatgtatttgtacagaagagtggaaaggactgagatgtacaattgctaatttttgtgaaaatagtacctatatgggttttacttttgccagaatcccagtgggcagatatggaccatccttgcaaacatgtggcaaggatactccaaatgcgggcaatccaatggcagtccggttgtgcagtctctctctatatggagagatagaattacaaaaagtgacaataggaaattgcaatgaaaatctggaaaccctggaaaagcaggtaaaggatgtcacagcaccacttaataacatttcttctgaagtccagattttaacatctgatgccaataaattaactgctgagaacatcactagtgctacgcgagtggttggacagatattcaacacttccagaaatgcttcacctgaggcaaagaaagttgccatagtaacagtgagtcaactcctagatgccagtgaagatgcttttcaaagagttgctgctactgctaatgatgatgcccttacaacgcttattgagcaaatggagacttattccttgtctttgggtaatcaatcagtggtggaacctaacatagcaatacagtcagcaaatttctcttcagaaaatgcggtggggccttcaaatgttcgcttctctgtgcagaaaggagctagcagttctctagtttctagttcaacatttatacatacaaatgtggatggccttaacccagatgcacagactgagcttcaggtcttgcttaatatgacgaaaaattacaccaagacatgcggctttgtagtttatcaaaatgacaagcttttccaatcaaaaacttttacagctaaatcggattttagtcaaaaaattatctcaagcaaaactgatgaaaatgagcaagatcagagtgcttctgttgacatggtctttagtccaaagtacaaccaaaaagaatttcaactctattcctatgcctgtgtctattggaatttgtcagcgaaggactgggacacatatggctgtcaaaaagacaagggcactgatggattcctgcgctgccgctgcaaccatactactaattttgctgtattaatgactttcaaaaaggattatcaatatcccaaatcacttgacatattatccaacgttggatgtgcactgtctgttactggtctggctctcacagttatatttcagattgtcaccaggaaagtcagaaaaacctcagtaacctgggttttggtcaatctgtgcatatcaatgttgattttcaacctcctctttgtgtttggaattgaaaactccaataagaacttgcagacaagtgatggtgacatcaataatattgactttgacaataatgacatacccaggacagacaccattaacatcccgaatcccatgtgcactgcgattgccgccttactgcactattttctgttagtgacatttacctggaacgcactcagcgctgcacagctctattaccttctaataaggaccatgaagcctcttcctcggcatttcattcttttcatctcattaattggatggggagtcccagctatagtagtggctataacagtgggagttatttattctcagaatggaaataatccacagtgggaattagactaccggcaagagaaaatctgctggctggcaattccagaacccaatggtgttataaaaagtccgctgttgtggtcattcatcgtacctgtaaccattatcctcatcagcaatgttgttatgtttattacaatctcgatcaaagtgctgtggaagaataaccagaacctgacaagcacaaaaaaagtttcatccatgaagaagattgttagcacattatctgttgcagttgtttttggaattacctggattctagcatacctgatgctagttaatgatgatagcatcaggatcgtcttcagctacatattctgccttttcaacactacacagggattgcaaatttttatcctgtacactgttagaacaaaagtcttccagagtgaagcttccaaagtgttgatgttgctatcgtctattgggagaaggaagtcattgccttcagtgacgcggccgaggctgcgtgtaaagatgtataatttcctcaggtcattgccaaccttacatgaacgctttaggctactggaaacctctccgagtactgaggaaatcacactctctgaaagtgacaatgcaaaggaaagcatctagacagtaaaacttacctgttgtggtctttttaatcacctcgtttgagttttatctgtttctctcctttatttcccagtcctctcagaaagtcttcctcaatgtattttgctcaggattaagaattagataaaacctgttgtttattattattcggcataatggacttggtagtttttctatttttcaatagatttgtacttgaataaggtgaagaatttcacacaacatacaagagtaccattgttccttatatcgttaaatctttgtgacacactttgacaaaaatgtagaacctataacaaattcttttacaagttactataaaggacacaaagagaaaactttaccttccagaacaaaatgactcctgatgaacagtgtgtggggatttgcttgtatgtattaaacttttgacctctgaatattttacagtcgtatgtgcttgtacttttatttccaatgaagaatttggcaccaa

SEQ ID NO: 11534 - DNA, 2035 bp, Homo sapiens
ttatttacctgcagttgcttacaaagtgtttggacataattgtgtaaagctagggttttttttctggtttttaaaacaggtaaaggatgtcacagcaccacttaataacatttcttctgaagtccagattttaacatctgatgccaataaattaactgctgagaacatcactagtgctacgcgagtggttggacagatattcaacacttccagaaatgcttcacctgaggcaaagaaagttgccatagtaacagtgagtcaactcctagatgccagtgaagatgcttttcaaagagttgctgctactgctaatgatgatgcccttacaacattacaccaagacatgcggctttgtagtttatcaaaatgacaagcttttccaatcaaaaacttttacagctaaatcggattttagtcaaaaaattatctcaagcaaaactgatgaaaatgagcaagatcagagtgcttctgttgacatggtctttagtccaaagtacaaccaaaaagaatttcaactctattcctatgcctgtgtctattggaatttgtcagcgaaggactgggacacatatggctgtcaaaaagacaagggcactgatggattcctgcgctgccgctgcaaccatactactaattttgctgtattaatgactttcaaaaaggattatcaatatcccaaatcacttgacatattatccaacgttggatgtgcactgtctgttactggtctggctctcacagttatatttcagattgtcaccaggaaagtcagaaaaacctcagtaacctgggttttggtcaatctgtgcatatcaatgttgattttcaacctcctctttgtgtttggaattgaaaactccaataagaacttgcagacaagtgatggtgacatcaataatattgactttgacaataatgacatacccaggacagacaccattaacatcccgaatcccatgtgcactgcgattgccgccttactgcactattttctgttagtgacatttacctggaacgcactcagcgctgcacagctctattaccttctaataaggaccatgaagcctcttcctcggcatttcattcttttcatctcattaattggatggggagtcccagctatagtagtggctataacagtgggagttatttattctcagaatggaaataatccacagtgggaattagactaccggcaagagaaaatctgctggctggcaattccagaacccaatggtgttataaaaagtccgctgttgtggtcattcatcgtacctgtaaccattatcctcatcagcaatgttgttatgtttattacaatctcgatcaaagtgctgtggaagaataaccagaacctgacaagcacaaaaaaagtttcatccatgaagaagattgttagcacattatctgttgcagttgtttttggaattacctggattctagcatacctgatgctagttaatgatgatagcatcaggatcgtcttcagctacatattctgccttttcaacactacacagggattgcaaatttttatcctgtacactgttagaacaaaagtcttccagagtgaagcttccaaagtgttgatgttgctatcgtctattgggagaaggaagtcattgccttcagtgacgcggccgaggctgcgtgtaaagatgtataatttcctcaggtcattgccaaccttacatgaacgctttaggctactggaaacctctccgagtactgaggaaatcacactctctgaaagtgacaatgcaaaggaaagcatctagacagtaaaacttacctgttgtggtctttttaatcacctcgtttgagttttatctgtttctctcctttatttcccagtcctctcagaaagtcttcctcaatgtattttgctcaggattaagaattagataaaacctgttgtttattattattcggcataatggacttggtagtttttctatttttcaatagatttgtacttgaataaggtgaagaatttcacacaacatacaagagtaccattgttccttatatcgtt

SEQ ID NO: 11535 - DNA, 3658 bp, Homo sapiens
agctaggactgcagggaggggtgcgaggctagccacgcaggcggggccctgggtcattttaaactctcagagtgaacgtcttgataggaccgacaagacgcatgacatgtacttagaaagcttatcttagagccacactgagattggaacccgcaaaatatgccagggaggaaggtgagcaagggacacgacactcacccggagaaacccagcaagcgcagcgaggctgtggggagaccggagccctgcacaccgccgggggaaggtgggccagcgccaccaccgtggagaacagcgcggaggcaccccacgagatgagacggaactgccgtgagatccagcaatgccaactgtgggtctgacccaggagaacggaaagcagggacgtgaacagccctcctcatgttcttgacaccgtcattctcagcagctcagctaaggcacagaggcagccgagcgtctgtcagcggagtcgtggctgagcagaacacgccacacgccacacgccacacgccacacgtgcaggattgctcaagatggaagggcacagtggaatatatatatatatttatatttttggcgagaccctggaggacacactgaatacaatggaataccatcccgcctttgaaaggaagggaaatcctggcacacgctgcaacaggagggagcttgaggacactgtggtgagtggagcacgtgagacacggaaggacacacgctgaagacacgcagagatgcccacccacgtggggaggtgacaggggagcccagcgcacagagacaaagtggaatggaggcctgggggctgggagcaaatgcggagcgagtgcttcctggggcagagtctccgtttgggaagatgagaaggttctgccgacggatgctggcgatggttgcagaagaatgtgaatgtgcccaatgctactgaaaaacggttacaatggaaacgccaccccagtgaccaccactgccccgtgggcctccctgggcctctccgccaagacctgcaacaacgtgtccttcgaagagagcaggatagtcctggtcgtggtgtacagcgcggtgtgcacgctgggggtgccggccaactgcctgactgcgtggctggcgctgctgcaggtactgcagggcaacgtgctggccgtctacctgctctgcctggcactctgcgagctgctgtacacaggcacgctgccactctgggtcatctatatccgcaaccagcaccgctggaccctaggcctgctggcctgcaaggtgaccgcctacatcttcttctgcaacatctacgtcagcatcctcttcctgtgctgcatctcctgcgaccgcttcgtggccgtggtgtacgcgctggagagtcggggccgccgccgccggaggaccgccatcctcatctccgcctgcatcttcatcctcgtcgggatcgttcactacccggtgttccagacggaagacaaggagacctgctttgacatgctgcagatggacagcaggattgccgggtactactacgccaggttcaccgttggctttgccatccctctctccatcatcgccttcaccaaccaccggattttcaggagcatcaagcagagcatgggcttaagcgctgcccagaaggccaaggtgaagcactcggccatcgcggtggttgtcatcttcctagtctgcttcgccccgtaccacctggttctcctcgtcaaagccgctgccttttcctactacagaggagacaggaacgccatgtgcggcttggaggaaaggctgtacacagcctctgtggtgtttctgtgcctgtccacggtgaacggcgtggctgaccccattatctacgtgctggccacggaccattcccgccaagaagtgtccagaatccataaggggtggaaagagtggtccatgaagacagacgtcaccaggctcacccacagcagggacaccgaggagctgcagtcgcccgtggcccttgcagaccactacaccttctccaggcccgtgcacccaccagggtcaccatgccctgcaaagaggctgattgaggagtcctgctgagcccactgtgtggcagggggatggcaggttgggggtcctggggccagcaatgtggttcctgtgcactgagcccaccagccacagtgcccatgtcccctctggaagacaaactaccaatttctcgttcctgaagccactccctccgtgaccactggccccaggctttcccacatggaaggtggctgcatgccaaggggaggagcgacacctccaggcttccgggagcccagagagcatgtggcaggcagtggggcctcttcatcagcagcctgcctggctggctcccttggctgtgggcaggtagcacgcctgctggcagaggtacctggtggctgccctgttcgcatcagtggcgatgactttatttgcggagcatttctgcaagcgttgcctggatgcggtggtgcattgtgggccctctgggctcctgcctcagaatgtcagtgagcaccatgctggaggtcacccagcactgtggcagcgcccaggagggcatagggcagcctaccacctccaagggggcaggcgccctcatctggggttgggtctgtgctgagctggagggcctctagggaaccgtggggcagggtggccagctgctggctcccagagcgcagcccaggcgtcctcaacggggagccccaaatgtccacgcccagaacaacagttggcaggacaggtgtgacacagccacagcagaggcaaggggtgccaggagtccccagcggcatcctcggggagatgctggtgaggggtccgtacagggtggggtccccacccctagccccttactgaggggggagtgcagcagttggcctgcttgtctggcggagaaagccagctccctgcaccctcggggctgagtcagatctgggtctgccgcaaaggccttgcctagaccaggtcacactgatgccctggtttccctatctgtaaaatggggccaatgacacctacctcactgggtcaccatcgagatcaatcctcctccctgccccgacacctcgggcacatcgcatgcactcagagcacagagccgggcagacgcagcacctgcatggggagcccagtgcccggcacagcacaggggcttccagggaggccgcgcagggccgtggggctgagccacgctctcgttttgtcaggcagctatgcagttgctcttccttgtttttgttttgtttttgtttttgtttttaatatttatttttttagagacagggccttgctctgttgcctgggctggagaacagtggcaccatcatagctcactgcagcctcaaactcctgggctcaagcgatcctccccgctcagcctcctgagtagctgggactacaggtgtgcaccaccacacccagccaaaacagccatcctccccttgagagtcatcagaaaaatacattaggaaaatgtgtttagaaataaaagcacaaggcagggcagtgctcacgcctgtcatcccagcactttgggaggccgagacgggaggatcagttgaggtcaggagtttgagaccagcctcggcaacatggcaaaatcttgtctcttttttttggtattaaaaaaatcataaaaataaaagaaataatgcaatttaacctt

SEQ ID NO: 11536 - DNA, 2887 bp, Homo sapiens
acttcctgaaacctcagctaggactgcagggaggggtgcgaggctagccacgcaggcggggccctgggtcattttaaactctcagagtgaacgtcttgataggaccgacaagacgcatgacatgtacttagaaagcttatcttagagccacactgagattggaacccgcaaaatatgccaggaaacgccaccccagtgaccaccactgccccgtgggcctccctgggcctctccgccaagacctgcaacaacgtgtccttcgaagagagcaggatagtcctggtcgtggtgtacagcgcggtgtgcacgctgggggtgccggccaactgcctgactgcgtggctggcgctgctgcaggtactgcagggcaacgtgctggccgtctacctgctctgcctggcactctgcgagctgctgtacacaggcacgctgccactctgggtcatctatatccgcaaccagcaccgctggaccctaggcctgctggcctgcaaggtgaccgcctacatcttcttctgcaacatctacgtcagcatcctcttcctgtgctgcatctcctgcgaccgcttcgtggccgtggtgtacgcgctggagagtcggggccgccgccgccggaggaccgccatcctcatctccgcctgcatcttcatcctcgtcgggatcgttcactacccggtgttccagacggaagacaaggagacctgctttgacatgctgcagatggacagcaggattgccgggtactactacgccaggttcaccgttggctttgccatccctctctccatcatcgccttcaccaaccaccggattttcaggagcatcaagcagagcatgggcttaagcgctgcccagaaggccaaggtgaagcactcggccatcgcggtggttgtcatcttcctagtctgcttcgccccgtaccacctggttctcctcgtcaaagccgctgccttttcctactacagaggagacaggaacgccatgtgcggcttggaggaaaggctgtacacagcctctgtggtgtttctgtgcctgtccacggtgaacggcgtggctgaccccattatctacgtgctggccacggaccattcccgccaagaagtgtccagaatccataaggggtggaaagagtggtccatgaagacagacgtcaccaggctcacccacagcagggacaccgaggagctgcagtcgcccgtggcccttgcagaccactacaccttctccaggcccgtgcacccaccagggtcaccatgccctgcaaagaggctgattgaggagtcctgctgagcccactgtgtggcagggggatggcaggttgggggtcctggggccagcaatgtggttcctgtgcactgagcccaccagccacagtgcccatgtcccctctggaagacaaactaccaatttctcgttcctgaagccactccctccgtgaccactggccccaggctttcccacatggaaggtggctgcatgccaaggggaggagcgacacctccaggcttccgggagcccagagagcatgtggcaggcagtggggcctcttcatcagcagcctgcctggctggctcccttggctgtgggcaggtagcacgcctgctggcagaggtacctggtggctgccctgttcgcatcagtggcgatgactttatttgcggagcatttctgcaagcgttgcctggatgcggtggtgcattgtgggccctctgggctcctgcctcagaatgtcagtgagcaccatgctggaggtcacccagcactgtggcagcgcccaggagggcatagggcagcctaccacctccaagggggcaggcgccctcatctggggttgggtctgtgctgagctggagggcctctagggaaccgtggggcagggtggccagctgctggctcccagagcgcagcccaggcgtcctcaacggggagccccaaatgtccacgcccagaacaacagttggcaggacaggtgtgacacagccacagcagaggcaaggggtgccaggagtccccagcggcatcctcggggagatgctggtgaggggtccgtacagggtggggtccccacccctagccccttactgaggggggagtgcagcagttggcctgcttgtctggcggagaaagccagctccctgcaccctcggggctgagtcagatctgggtctgccgcaaaggccttgcctagaccaggtcacactgatgccctggtttccctatctgtaaaatggggccaatgacacctacctcactgggtcaccatcgagatcaatcctcctccctgccccgacacctcgggcacatcgcatgcactcagagcacagagccgggcagacgcagcacctgcatggggagcccagtgcccggcacagcacaggggcttccagggaggccgcgcagggccgtggggctgagccacgctctcgttttgtcaggcagctatgcagttgctcttccttgtttttgttttgtttttgtttttgtttttaatatttatttttttagagacagggccttgctctgttgcctgggctggagaacagtggcaccatcatagctcactgcagcctcaaactcctgggctcaagcgatcctccccgctcagcctcctgagtagctgggactacaggtgtgcaccaccacacccagccaaaacagccatcctccccttgagagtcatcagaaaaatacattaggaaaatgtgtttagaaataaaagcacaaggcagggcagtgctcacgcctgtcatcccagcactttgggaggccgagacgggaggatcagttgaggtcaggagtttgagaccagcctcggcaacatggcaaaatcttgtctcttttttttggtattaaaaaaatcataaaaataaaagaaataatgcaattt

SEQ ID NO: 11537 - DNA, 2779 bp, Homo sapiens
agctaggactgcagggaggggtgcgaggctagccacgcaggcggggccctggctttataaaggtataattgacaaacaagaagagtacctaggccaggtgcggtggcttacgcctgtaatcccagcactttgggaggccgaggtcattttaaactctcagagtgaacgtcttgataggaccgacaagacgcatgacatgtacttagaaagcttatcttagagccacactgagattggaacccgcaaaatatgccagggaggaaggtgagcaagggacacgacactcacccggagaaacccagcaagcgcagcgaggctgtggggagaccggagccctgcacaccgccgggggaaggtgggccagcgccaccaccgtggagaacagcgcggaggcaccccacgagatgagacggaactgccgtgagatccagcaatgccaactgtgggtctgacccaggagaacggaaagcagggacgtgaacagccctcctcatgttcttgacaccgtcattctcagcagctcagctaaggcacagaggcagccgagcgtctgtcagcggagtcgtggctgagcagaacacgccacacgccacacgccacacgccacacgtgcaggattgctcaagatggaagggcacagtggaatatatatatatatttatatttttggcgagaccctggaggacacactgaatacaatggaataccatcccgcctttgaaaggaagggaaatcctggcacacgctgcaacaggagggagcttgaggacactgtggtgagtggagcacgtgagacacggaaggacacacgctgaagacacgcagagatgcccacccacgtggggaggtgacaggggagcccagcgcacagagacaaagtggaatggaggcctgggggctgggagcaaatgcggagcgagtgcttcctggggcagagtctccgtttgggaagatgagaaggttctgccgacggatgctggcgatggttgcagaagaatgtgaatgtgcccaatgctactgaaaaacggttacaatggaaacgccaccccagtgaccaccactgccccgtgggcctccctgggcctctccgccaagacctgcaacaacgtgtccttcgaagagagcaggatagtcctggtcgtggtgtacagcgcggtgtgcacgctgggggtgccggccaactgcctgactgcgtggctggcgctgctgcaggtactgcagggcaacgtgctggccgtctacctgctctgcctggcactctgcgagctgctgtacacaggcacgctgccactctgggtcatctatatccgcaaccagcaccgctggaccctaggcctgctggcctgcaaggtgaccgcctacatcttcttctgcaacatctacgtcagcatcctcttcctgtgctgcatctcctgcgaccgcttcgtggccgtggtgtacgcgctggagagtcggggccgccgccgccggaggaccgccatcctcatctccgcctgcatcttcatcctcgtcgggatcgttcactacccggtgttccagacggaagacaaggagacctgctttgacatgctgcagatggacagcaggattgccgggtactactacgccaggttcaccgttggctttgccatccctctctccatcatcgccttcaccaaccaccggattttcaggagcatcaagcagagcatgggcttaagcgctgcccagaaggccaaggtgaagcactcggccatcgcggtggttgtcatcttcctagtctgcttcgccccgtaccacctggttctcctcgtcaaagccgctgccttttcctactacagaggagacaggaacgccatgtgcggcttggaggaaaggctgtacacagcctctgtggtgtttctgtgcctgtccacggtgaacggcgtggctgaccccattatctacgtgctggccacggaccattcccgccaagaagtgtccagaatccataaggggtggaaagagtggtccatgaagacagacgtcaccaggctcacccacagcagggacaccgaggagctgcagtcgcccgtggcccttgcagaccactacaccttctccaggcccgtgcacccaccagggtcaccatgccctgcaaagaggctgattgaggagtcctgctgagcccactgtgtggcagggggatggcaggttgggggtcctggggccagcaatgtggttcctgtgcactgagcccaccagccacagtgcccatgtcccctctggaagacaaactaccaatttctcgttcctgaagccactccctccgtgaccactggccccaggctttcccacatggaaggtggctgcatgccaaggggaggagcgacacctccaggcttccgggagcccagagagcatgtggcaggcagtggggcctcttcatcagcagcctgcctggctggctcccttggctgtgggcaggtagcacgcctgctggcagaggtacctggtggctgccctgttcgcatcagtggcgatgactttatttgcggagcatttctgcaagcgttgcctggatgcggtggtgcattgtgggccctctgggctcctgcctcagaatgtcagtgagcaccatgctggaggtcacccagcactgtggcagcgcccaggagggcatagggcagcctaccacctccaagggggcaggcgccctcatctggggttgggtctgtgctgagctggagggcctctagggaaccgtggggcagggtggccagctgctggctcccagagcgcagcccaggcgtcctcaacg

SEQ ID NO: 11538 - DNA, 1092 bp, Homo sapiens
gacgttttgatgcctgttggcttggagccttgcttgtgtttctcatgtgggatgcaacggcagattctcaacatttaaaaaacacctacgaatcaacgggccacttagtaaattagtaaatactcactagccgtttgtcaatgggttaacttgtgactcaatctgatttccctaaaacaatttcaacctactctttttccaggtcattttaaactctcagagtgaacgtcttgataggaccgacaagacgcatgacatgtacttagaaagcttatcttagagccacactgagattggaacccgcaaaatatgccagggaggaaggtgagcaagggacacgacactcacccggagaaacccagcaagcgcagcgaggctgtggggagaccggagccctgcacaccgccgggggaaggtgggccagcgccaccaccgtggagaacagcgcggaggcaccccacgagatgagacggaactgccgtgagatccagcaatgccaactgtgggtctgacccaggagaacggaaagcagggacgtgaacagccctcctcatgttcttgacaccgtcattctcagcagctcagctaaggcacagaggcagccgagcgtctgtcagcggagtcgtggctgagcagaacacgccacacgccacacgccacacgccacacgtgcaggattgctcaagatggaagggcacagtggaatatatatatatatttatatttttggcgagaccctggaggacacactgaatacaatggaataccatcccgcctttgaaaggaagggaaatcctggcacacgctgcaacaggagggagcttgaggacactgtggtgagtggagcacgtgagacacggaaggacacacgctgaagacacgcagagatgcccacccacgtggggaggtgacaggggagcccagcgcacagagacaaagtggaatggaggcctgggggctgggagcaaatgcggagcgagtgcttcctggggcagagtctccgtttgggaagatgagaaggttctgccgacggatgctggcgatggttgcagaagaatgtgaatgtgcccaatgctactgaaaaacggttac

SEQ ID NO: 11539 - DNA, 5168 bp, Homo sapiens
actcactccccctccacccagagagcaggacggaggtgtgaacttgagccagaccagaaggagctcgagagcggccgcaggacaagcccgaggagcaggcgggcgctccaggggaaaaccacgcacaaaaccttcttcagagaaaagggaagctccaaacctgactgagacaaacggaggctcttgaaataaaaagaaaataccgcaggacaaacagcctcccgtccccgggcgcaggtcgcggtcacagtggtgacctgggattgctttcccaggactgcgagtcgggtttgggtttctcctccctgcattccacagctgctctggtcatcgcaacgtgtttattgatcactgaagaatctcaagttttgagacgaggaagaaacacccattaggtctccaagacagctgtgtttcacaaactttaaggagacagaaattttctcccctggaacctgtgaaaatgtcccttttccaaggaagtgaaggttaagaggtcccgttctcacagaccctcaggaatttcacttggctccgagctttgacctccgagagagccatggaaaagctgctgcggctgtgctgctggtactcctggctgctgctattttattacaactttcaggtgcgtggcgtctactccagatcgcaggaccatccaggatttcaggtgttggcgtctgcttcccattactggccactggagaatgtggatgggatccatgaacttcaggatacaactggagatattgtggaagggaaggtcaacaaaggcatttacctgaaagaggaaaagggagtcacgcttctctattacggcaggtacaacagctcctgcatcagcaagccagagcagtgtggccctgaaggggtcacgttttcttttttctggaagacacaaggagaacagtctagaccaatcccttctgcgtatgggggacaggtcatctccaatgggttcaaagtctgctccagcggtggcagaggctctgtggagctgtatacgcgggacaattccatgacatgggaggcctccttcagccccccaggcccctattggactcatgtcctatttacatggaaatccaaggagggcctgaaagtctacgtcaacgggaccctgagcacctctgatccgagtggaaaagtgtctcgtgactatggagagtccaacgtcaacctcgtgatagggtctgagcaggaccaggccaagtgttatgagaacggtgctttcgatgagttcatcatctgggagcgggctctgactccggatgagatcgccatgtacttcactgctgccattggaaagcatgctttattgtcttcaacgctgccaagcctcttcatgacatccacagcaagccccgtgatgcccacagatgcctaccatcccatcataaccaacctgacagaagagagaaaaaccttccaaagtcccggagtgatactgagttacctccaaaatgtatccctcagcttacccagtaagtccctctcggagcagacagccttgaatctcaccaagaccttcttaaaagccgtgggagagatccttctactgcctggttggattgctctgtcagaggacagcgccgtggtactgagtctcatcgacactattgacaccgtcatgggccatgtatcctccaacctgcacggcagcacgccccaggtcaccgtggagggctcctctgccatggcagagttttccgtggccaaaatcctgcccaagaccgtgaattcctcccattaccgcttcccggcccacgggcagagcttcatccagatcccccacgaggccttccacaggcacgcctggagcaccgtcgtgggtctgctgtaccacagcatgcactactacctgaacaacatctggcccgcccacaccaagatcgcggaggccatgcatcaccaggactgcctgctgttcgccaccagccacctgatttccctggaggtgtccccaccacccaccctgtctcagaacctgtcgggctctccactcattacggtccacctcaagcacagattgacacgtaagcagcacagtgaggccaccaacagcagcaaccgagtcttcgtgtactgcgccttcctggacttcagctccggagaaggggtctggtcgaaccacggctgtgcgctcacgagaggaaacctcacctactccgtctgccgctgcactcacctcaccaactttgccatcctcatgcaggtggtcccgctggagcttgcacgcggacaccaggtggcgctgtcgtctatcagctatgtgggctgctccctctccgtgctctgcctggtggccacgctggtcaccttcgccgtgctgtcctccgtgagcaccatccggaaccagcgctaccacatccacgccaacctgtccttcgccgtgctggtggcccaggtcctgctgctcattagtttccgcctcgagccgggcacgaccccctgccaagtgatggccgtgctcctacactacttcttcctgagtgccttcgcatggatgctggtggaggggctgcacctctacagcatggtgatcaaggtctttgggtcggaggacagcaagcaccgttactactatgggatgggatggggttttcctcttctgatctgcatcatttcactgtcatttgccatggacagttacggaacaagcaacaattgctggctgtcgttggcgagtggcgccatctgggcctttgtagcccctgccctgtttgtcatcgtggtcaacattggcatcctcatcgctgtgaccagagtcatctcacagatcagcgccgacaactacaagatccatggagaccccagtgccttcaagttgacagccaaggcagtggccgtgctgctgcccatcctgggtacctcgtgggtctttggcgtgcttgctgtcaacggttgtgctgtggttttccagtacatgtttgccacgctcaactccctgcagggactgttcatattcctctttcattgtctcctgaattcagaggtgagagccgccttcaagcacaaaaccaaggtctggtcgctcacgagcagctctgcccgcacctccaacgcgaagcccttccactcggacctcatgaatgggacccggccaggcatggcctccaccaagctcagcccttgggacaagagcagccactctgcccaccgcgtcgacctgtcagccgtgtgagccgggaggctgccaaccaggccaggctgcgctcagaacacacccccccaaacagaatgaaatgccccacctttgcccatggaccctctccttgctgctgtctggacatgggtgttgtggccccgagacagctgtcctcccctgtgactctggctgtcggagcacactgctcagcccagcagcctgatgcccaggccagcgtgggccctcctgccttgcatccacccgtgggctgagtgacttcctcgggggattcccaggacacagtggcctgactgtgatggtgcccttgagcctcccttcatcactcagcatcagacccagcgaggccaggacactcggggccggtcccgcagcaccaggaggggatgttcagcctctgtgccttggtggggcttggggactcagggccaaagaggtggttcaggtccccacgcaccctcagtcaggcgcaggcagctgggggtgtgtggggaagagcatgcggagtccccagtgtctgaatccactgagtggtgagttccccacagccggcgctagccgtggtgtgtgtctctgtaggtggtgccggcgtgggccaacctgtgctgtgtcatcagttgggggcccctgcccaagccgagctcgagccgtgggcgggagtcgttgactctccaggtgagggcgacccctctgccctgtccttgggggggtcccctctgctcacgtgaagagccgctctgggccttgaggctgcctgatggtgcctgtgcttgggggagcttctcggccatccgctgtgagttttgcctctttggaccccaattcggccttaagatgccctcctccctcgtgtgccagcctccttggttgttcttgggccacaggagctggccgtgtccccgcagtgcctggtgtccaggtggaaagtggagggcattttccagggcactgctttccccagaggcttcctcatggctcacaggcactctacgaagtttctaatgggcagaccacgcggcaggtagcacagtgcgctccgtctggtcaccatgagaccgacctgcgctgagtccccactgacctggagagggagggctggtgacagccgtgtcttctgtgttgagggaaatttatggactcagattcagccccagaggagatgggataattgttatggacccatgtgtgggcatgatcctgtggaacacaggtttgggatcatagatgtgaattaagacaccaccgagatacgggctgtgaggttcatactgtgctgatagcactcgtggtgtctgtgaaatgtgggtaagacattcaaacctggttttgatactggaaactcttcctttaaaactgtgaccatgatttcattcagcccctccacacccctatgtctgccttgtttcagagtgagttttctatggagcctgtggcccttttgcagcccacctggtggcttcttaatgtaactcttcccctggtcgcctggagtggaccactcatctgcaggcctctcctgcatggggagggtaggcagggagcagcatgtctgcaggggtgaacctttgctcttctgtcaggcgaggcccaggctgcaccagccacctgccacatggtgacagtgccacgggccctgcgtatggcccctgcaaccgtgctctggcgggcacacctggctgctgcaggccaaggccgctgttcagtgaagagtcccatgtttagtatggactaaagtcccatgtttagccactgccccaggctcccgtgaccccagaaaccaggtcacatggaccacagtgccagatcctcatcacgccggtgagcacctagaagtgagaacactgtattcctacaatgtacacttggatatttctccttatttagtttctagtgaaacaaatcaagtaaggaactatctttagtttagatggaattatttgtttttaattgttgccgtattcatctatatagctaatatttcaagataagtaatgaacaaaac

SEQ ID NO: 11540 - DNA, 2892 bp, Homo sapiens
gtcatggagtgtctgcacgggacgtcctggagagtcggacacgtaagcagcacagtgaggccaccaacagcagcaaccgagtcttcgtgtactgcgccttcctggacttcagctccggagaaggggtctggtcgaaccacggctgtgcgctcacgagaggaaacctcacctactccgtctgccgctgcactcacctcaccaactttgccatcctcatgcaggtggtcccgctggaggtcaacattggcatcctcatcgctgtgaccagagtcatctcacagatcagcgccgacaactacaagatccatggagaccccagtgccttcaagttgacagccaaggcagtggccgtgctgctgcccatcctgggtacctcgtgggtctttggcgtgcttgctgtcaacggttgtgctgtggttttccagtacatgtttgccacgctcaactccctgcagggactgttcatattcctctttcattgtctcctgaattcagaggtgagagccgccttcaagcacaaaaccaaggtctggtcgctcacgagcagctctgcccgcacctccaacgcgaagcccttccactcggacctcatgaatgggacccggccaggcatggcctccaccaagctcagcccttgggacaagagcagccactctgcccaccgcgtcgacctgtcagccgtgtgagccgggaggctgccaaccaggccaggctgcgctcagaacacacccccccaaacagaatgaaatgccccacctttgcccatggaccctctccttgctgctgtctggacatgggtgttgtggccccgagacagctgtcctcccctgtgactctggctgtcggagcacactgctcagcccagcagcctgatgcccaggccagcgtgggccctcctgccttgcatccacccgtgggctgagtgacttcctcgggggattcccaggacacagtggcctgactgtgatggtgcccttgagcctcccttcatcactcagcatcagacccagcgaggccaggacactcggggccggtcccgcagcaccaggaggggatgttcagcctctgtgccttggtggggcttggggactcagggccaaagaggtggttcaggtccccacgcaccctcagtcaggcgcaggcagctgggggtgtgtggggaagagcatgcggagtccccagtgtctgaatccactgagtggtgagttccccacagccggcgctagccgtggtgtgtgtctctgtaggtggtgccggcgtgggccaacctgtgctgtgtcatcagttgggggcccctgcccaagccgagctcgagccgtgggcgggagtcgttgactctccaggtgagggcgacccctctgccctgtccttgggggggtcccctctgctcacgtgaagagccgctctgggccttgaggctgcctgatggtgcctgtgcttgggggagcttctcggccatccgctgtgagttttgcctctttggaccccaattcggccttaagatgccctcctccctcgtgtgccagcctccttggttgttcttgggccacaggagctggccgtgtccccgcagtgcctggtgtccaggtggaaagtggagggcattttccagggcactgctttccccagaggcttcctcatggctcacaggcactctacgaagtttctaatgggcagaccacgcggcaggtagcacagtgcgctccgtctggtcaccatgagaccgacctgcgctgagtccccactgacctggagagggagggctggtgacagccgtgtcttctgtgttgagggaaatttatggactcagattcagccccagaggagatgggataattgttatggacccatgtgtgggcatgatcctgtggaacacaggtttgggatcatagatgtgaattaagacaccaccgagatacgggctgtgaggttcatactgtgctgatagcactcgtggtgtctgtgaaatgtgggtaagacattcaaacctggttttgatactggaaactcttcctttaaaactgtgaccatgatttcattcagcccctccacacccctatgtctgccttgtttcagagtgagttttctatggagcctgtggcccttttgcagcccacctggtggcttcttaatgtaactcttcccctggtcgcctggagtggaccactcatctgcaggcctctcctgcatggggagggtaggcagggagcagcatgtctgcaggggtgaacctttgctcttctgtcaggcgaggcccaggctgcaccagccacctgccacatggtgacagtgccacgggccctgcgtatggcccctgcaaccgtgctctggcgggcacacctggctgctgcaggccaaggccgctgttcagtgaagagtcccatgtttagtatggactaaagtcccatgtttagccactgccccaggctcccgtgaccccagaaaccaggtcacatggaccacagtgccagatcctcatcacgccggtgagcacctagaagtgagaacactgtattcctacaatgtacacttggatatttctccttatttagtttctagtgaaacaaatcaagtaaggaactatctttagtttagatggaattatttgtttttaattgttgccgtattcatctatatagctaatatttcaagataagtaatgaacaaaacctgtctaaaccttttgtttccaatgaatgaaagtcatgcactttatttataggctctatgttttggcttctgcagtacttttattatctatacataatttggccaaaaataagaaattggaaagaatgaaatgtttagtttatagtagaagaaagatgatgacactaagttgtgaaaatatgttgtgatttttatgaaataaactcatgtcctgaaaagaaa

SEQ ID NO: 11541 - DNA, 2776 bp, Homo sapiens
tggctccgagctttgacctccgagagagccatggaaaagctgctgcggctgtgctgctggtactcctggctgctgctattttattacaactttcaggtgcgtggcgtctactccagatcgcaggaccatccaggatttcaggtgttggcgtctgcttcccattactggccactggagaatgtggatgggatccatgaacttcaggatacaactggagcgtcccgaacccacaagctcactgtgcttccttcccgtaatgctacttttgtgtattccaatgattctgcctactcaaatctctctgcaactgtagatattgtggaagggaaggtcaacaaaggcatttacctgaaagaggaaaagggagtcacgcttctctattacggcaggtacaacagctcctgcatcagcaagccagagcagtgtggccctgaaggggtcacgttttcttttttctggaagacacaaggagaacagtctagaccaatcccttctgcgtatgggggacaggtcatctccaatgggttcaaagtctgctccagcggtggcagaggctctgtggagctgtatacgcgggacaattccatgacatgggaggcctccttcagccccccaggcccctattggactcatgtcctatttacatggaaatccaaggagggcctgaaagtctacgtcaacgggaccctgagcacctctgatccgagtggaaaagtgtctcgtgactatggagagtccaacgtcaacctcgtgatagggtctgagcaggaccaggccaagtgttatgagaacggtgctttcgatgagttcatcatctgggagcgggctctgactccggatgagatcgccatgtacttcactgctgccattggaaagcatgctttattgtcttcaacgctgccaagcctcttcatgacatccacagcaagccccgtgatgcccacagatgcctaccatcccatcataaccaacctgacagaagagagaaaaaccttccaaagtcccggagtgatactgagttacctccaaaatgtatccctcagcttacccagtaagtccctctcggagcagacagccttgaatctcaccaagaccttcttaaaagccgtgggagagatccttctactgcctggttggattgctctgtcagaggacagcgccgtggtactgagtctcatcgacactattgacaccgtcatgggccatgtatcctccaacctgcacggcagcacgccccaggtcaccgtggagggctcctctgccatggcagagttttccgtggccaaaatcctgcccaagaccgtgaattcctcccattaccgcttcccggcccacgggcagagcttcatccagatcccccacgaggccttccacaggcacgcctggagcaccgtcgtgggtctgctgtaccacagcatgcactactacctgaacaacatctggcccgcccacaccaagatcgcggaggccatgcatcaccaggactgcctgctgttcgccaccagccacctgatttccctggaggtgtccccaccacccaccctgtctcagaacctgtcgggctctccactcattacggtccacctcaagcacagattgacacgtaagcagcacagtgaggccaccaacagcagcaaccgagtcttcgtgtactgcgccttcctggacttcagctccggagaaggggtctggtcgaaccacggctgtgcgctcacgagaggaaacctcacctactccgtctgccgctgcactcacctcaccaactttgccatcctcatgcaggtggtcccgctggagcttgcacgcggacaccaggtggcgctgtcgtctatcagctatgtgggctgctccctctccgtgctctgcctggtggccacgctggtcaccttcgccgtgctgtcctccgtgagcaccatccggaaccagcgctaccacatccacgccaacctgtccttcgccgtgctggtggcccaggtcctgctgctcattagtttccgcctcgagccgggcacgaccccctgccaagtgatggccgtgctcctacactacttcttcctgagtgccttcgcatggatgctggtggaggggctgcacctctacagcatggtgatcaaggtctttgggtcggaggacagcaagcaccgttactactatgggatgggatggggttttcctcttctgatctgcatcatttcactgtcatttgccatggacagttacggaacaagcaacaattgctggctgtcgttggcgagtggcgccatctgggcctttgtagcccctgccctgtttgtcatcgtggtcaacattggcatcctcatcgctgtgaccagagtcatctcacagatcagcgccgacaactacaagatccatggagaccccagtgccttcaagttgacagccaaggcagtggccgtgctgctgcccatcctgggtacctcgtgggtctttggcgtgcttgctgtcaacggttgtgctgtggttttccagtacatgtttgccacgctcaactccctgcagggactgttcatattcctctttcattgtctcctgaattcagaggtgagagccgccttcaagcacaaaaccaaggtctggtcgctcacgagcagctctgcccgcacctccaacgcgaagcccttccactcggacctcatgaatgggacccggccaggcatggcctccaccaagctcagcccttgggacaagagcagccactctgcccaccgcgtcgacctgtcagccgtgtgagccgggaggctgccaaccaggccag

SEQ ID NO: 11542 - DNA, 1695 bp, Homo sapiens
caccgagcctggctctactgcaggcgctgggggttggggtgggggagaggcccagggcacatgatgccgcccccagcccgcccagcacatgacccaggcaggccggcggggtcctggcacacccgagccgcgtccgcgaacacagcccatggcctccccgcgcctagggaccttctgctgccccacgcgggacgcagccacgcagctcgtgctgagcttccagccgcgggccttccacgcgctctgcctgggcagcggcgggctccgcttggcgctgggccttctgcagctgctgcccggccgccggcccgcgggccccgggtcccccgcgacgtccccgccggcctcggtccgcatcctgcgcgctgccgctgcctgcgaccttctcggctgcctgggtatggtgatccggtccaccgtgtggttaggattcccaaattttgttgacagcgtctcggatatgaaccacacggaaatttggcctgctgctttctgcgtggggagtgcgatgtggatccagctgttgtacagtgcctgcttctggtggctgttttgctatgcagtggatgcttatctggtgatccggagatcggcaggactgagcaccatcctgctgtatcacatcatggcgtggggcctggccaccctgctctgtgtggagggagccgccatgctctactacccttccgtgtccaggtgtgagcggggcctggaccacgccatcccccactatgtcaccatgtacctgcccctgctgctggttctcgtggcgaaccccatcctgttccaaaagacagtgactgcagtggcctctttacttaaaggaagacaaggcatttacacggagaacgagaggaggatgggagccgtgatcaagatccgatttttcaaaatcatgctggttttaattatttgttggttgtcgaatatcatcaatgaaagccttttattctatcttgagatgcaaacagatatcaatggaggttctttgaaacctgtcagaactgcagccaagaccacatggtttattatgggaatcctgaatccagcccagggatttctcttgtctttggccttctacggctggacaggatgcagcctgggttttcagtctcccaggaaggagatccagtgggaatcactgaccacctcggctgctgagggggctcacccatccccactgatgccccatgaaaaccctgcttccgggaaggtgtctcaagtgggtgggcagacttctgacgaagccctgagcatgctgtctgaaggttctgatgccagcacaattgaaattcacactgcaagtgaatcctgcaacaaaaatgagggtgaccctgctctcccaacccatggagacctatgaaggggatgtgctgggggtccagaccccatattcctcagactcaacaattcttgttctttagaactgtgttctcaccttcccaacactgcactgccgaagtgtagcggcccccaaaccttgctctcatcaccagctagagcttcttcccgaagggcctttaggataggagaaagggttcatgcacacacgtgtgagaatggaagagccccctccagaccactctacagctgctctagccttagttgccactaggaagttttctgaggctggctgtaaagtaagtgtaaggtccacatccttggggaagtagttaaataaaatagttatgactg

SEQ ID NO: 11543 - DNA, 587 bp, Homo sapiens
taaagatggcaggtttggcgctctaggtggcagagaaaccaccaggaaggcttggtgaatggggagaaaggtatggtgatccggtccaccgtgtggttaggattcccaaattttgttgacagcgtctcggatatgaaccacacggaaatttggcctgctgctttctgcgtggggagtgcgatgtggatccagctgttgtacagtgcctgcttctggtggctgttttgctatgcagtggatgcttatctggtgatccggagatcggcaggactgagcaccatcctgctgtatcacatcatggcgtggggcctggccaccctgctctgtgtggagggagccgccatgctctactacccttccgtgtccaggtgtgagcggggcctggaccacgccatcccccactatgtcaccatgtacctgcccctgctgctggttctcgtggcgaaccccatcctgttccaaaagacagtgactgcagtggcctctttacttaaaggaagacaaggcatttacacggagaacgagaggaggatgggagccgtgatcaagatccgatttttcaaaatcatgctggttttaattatttg

SEQ ID NO: 11544 - DNA, 859 bp, Homo sapiens
taccgcggggccggtcacggggagcgcgtccagaggtccagcccgcggcccgaagggtatggtgatccggtccaccgtgtggttaggattcccaaattttgttgacagcgtctcggatatgaaccacacggaaatttggcctgctgctttctgcgtggggagtgcgatgtggatccagctgttgtacagtgcctgcttctggtggctgttttgctatgcagtggatgcttatctggtgatccggagatcggcaggactgagcaccatcctgctgtatcacatcatggcgtggggcctggccaccctgctctgtgtggagggagccgccatgctctactacccttccgtgtccaggtgtgagcggggcctggaccacgccatcccccactatgtcaccatgtacctgcccctgctgctggttctcgtggcgaaccccatcctgttccaaaagacagtgactgcagtggcctctttacttaaaggaagacaaggcatttacacggagaacgagaggaggatgggagccgtgatcaagatccgatttttcaaaatcatgctggttttaattatttgttggttgtcgaatatcatcaatgaaagccttttattctatcttgagatgcaaacagatatcaatggaggttctttgaaacctgtcagaactgcagccaagaccacatggtttattatgggaatcctgaatccagcccagggatttctcttgtctttggccttctacggctggacaggatgcagcctgggttttcagtctcccaggaaggagatccagtgggaatcactgaccacctcggctgctgagggggctcacccatccccactgatgccccatgaaaaccct

SEQ ID NO: 11545 - DNA, 1762 bp, Homo sapiens
accgagcctggctctactgcaggcgctgggggttggggtgggggagaggcccagggcacatgatgccgcccccagcccgcccagcacatgacccaggcaggccggcggggtcctggcacacccgagccgcgtccgcgaacacagcccatggcctccccgcgcctagggaccttctgctgccccacgcgggacgcagccacgcagctcgtgctgagcttccagccgcgggccttccacgcgctctgcctgggcagcggcgggctccgcttggcgctgggccttctgcagctgctgcccggccgccggcccgcgggccccgggtcccccgcgacgtccccgccggcctcggtccgcatcctgcgcgctgccgctgcctgcgaccttctcggctgcctgggtatggtgatccggtccaccgtgtggttaggattcccaaattttgttgacagcgtctcggatatgaaccacacggaaatttggcctgctgctttctgcgtggggagtgcgatgtggatccagctgttgtacagtgcctgcttctggtggctgttttgctatgcagtggatgcttatctggtgatccggagatcggcaggactgagcaccatcctgctgtatcacatcatggcgtggggcctggccaccctgctctgtgtggagggagccgccatgctctactacccttccgtgtccaggtgtgagcggggcctggaccacgccatcccccactatgtcaccatgtacctgcccctgctgctggttctcgtggcgaaccccatcctgttccaaaagacagtgactgcagtggcctctttacttaaaggaagacaaggcatttacacggagaacgagaggaggatgggagccgtgatcaagatccgatttttcaaaatcatgctggttttaattatttgttggttgtcgaatatcatcaatgaaagccttttattctatcttgagatgcaaacagatatcaatggaggttctttgaaacctgtcagaactgcagccaagaccacatggtttattatgggaatcctgaatccagcccagggatttctcttgtctttggccttctacggctggacaggatgcagcctgggttttcagtctcccaggaaggagatccagtgggaatcactgaccacctcggctgctgagggggctcacccatccccactgatgccccatgaaaaccctgcttccgggaaggtgtctcaagtgggtgggcagacttctgacgaagccctgagcatgctgtctgaaggttctgatgccagcacaattgaaattcacactgcaagtgaatcctgcaacaaaaatgagggtgaccctgctctcccaacccatggagacctatgaaggggatgtgctgggggtccagaccccatattcctcagactcaacaattcttgttctttagaactgtgttctcaccttcccaacactgcactgccgaagtgtagcggcccccaaaccttgctctcatcaccagctagagcttcttcccgaagggcctttaggataggagaaagggttcatgcacacacgtgtgagaatggaagagccccctccagaccactctacagctgctctagccttagttgccactaggaagttttctgaggctggctgtaaagtaagtgtaaggtccacatccttggggaagtagttaaataaaatagttatgactgagctctcagcctgacttggattctgtcttaacacttctagcaaaagaaaataaatacatgtacagtta

SEQ ID NO: 11546 - DNA, 1218 bp, Homo sapiens
gatctttaaagggaggggaaaaaagagagagagaggcaggcactgtataaaagaagcttccttgaggtttctaaaatttatacaaaaacatcatatgtaagtaaactcaccagatttggcatctgctctttggtgatggacccagaagaaacttcagtttatttggattattactatgctacgagcccaaactctgacatcagggagacccactcccatgttccttacacctctgtcttccttccagtcttttacacagctgtgttcctgactggagtgctggggaaccttgttctcatgggagcgttgcatttcaaacccggcagccgaagactgatcgacatctttatcatcaatctggctgcctctgacttcatttttcttgtcacattgcctctctgggtggataaagaagcatctctaggactgtggaggacgggctccttcctgtgcaaagggagctcctacatgatctccgtcaatatgcactgcagtgtcctcctgctcacttgcatgagtgttgaccgctacctggccattgtgtggccagtcgtatccaggaaattcagaaggacagactgtgcatatgtagtctgtgccagcatctggtttatctcctgcctgctggggttgcctactcttctgtccagggagctcacgctgattgatgataagccatactgtgcagagaaaaaggcaactccaattaaactcatatggtccctggtggccttaattttcaccttttttgtccctttgttgagcattgtgacctgctactgttgcattgcaaggaagctgtgtgcccattaccagcaatcaggaaagcacaacaaaaagctgaagaaatctataaagatcatctttattgtcgtggcagcctttcttgtctcctggctgcccttcaatactttcaagttcctggccattgtctctgggttgcggcaagaacactatttaccctcagctattcttcagcttggtatggaggtgagtggacccttggcatttgccaacagctgtgtcaaccctttcatttactatatcttcgacagctacatccgccgggccattgtccactgcttgtgcccttgcctgaaaaactatgactttgggagtagcactgagacatcagatagtcacctcactaaggctctctccaccttcattcatgcagaagattttgccaggaggaggaagaggtctgtgtcactctaa

SEQ ID NO: 11547 - DNA, 4082 bp, Homo sapiens
ccgccgccagcatgccccggcccgcgggccgctccgccgccagccacccccgcggccctcggcggcctgcgctcggcccgggggcgcgggaaccgcagccggagccggaggcgggagcagcgagccggagccccgggcgctcgaatgcaggatgctcgtggtccccagcatccttgagccaccaggagtgagggctgctgctccctgagacctggctccaaggaggatgccacagccgcctgccagctccggtctgcaccatgagtgatgagcggcggctgcctggcagtgcagtgggctggctggtatgtgggggcctctccctgctggccaatgcctggggcatcctcagcgttggcgccaagcagaagaagtggaagcccttggagttcctgctgtgtacactcgcggccacccacatgctaaatgtggccgtgcccatcgccacctactccgtggtgcagctgcggcggcagcgccccgacttcgagtggaatgagggtctctgcaaggtcttcgtgtccaccttctacaccctcaccctggccacctgtttctctgtcacctccctctcctaccaccgcatgtggatggtctgctggcctgtcaactaccggctgagcaatgccaagaagcaggcggtgcacacagtcatgggtatctggatggtgtccttcatcctgtcggccctgcctgccgttggctggcacgacaccagcgagcgcttctacacccatggctgccgcttcatcgtggctgagatcggcctgggctttggcgtctgcttcctgctgctggtgggcggcagcgtggccatgggcgtgatctgcacagccatcgccctcttccagacgctggccgtgcaggtggggcgccaggccgaccgccgcgccttcaccgtgcccaccatcgtggtggaggacgcgcagggcaagcggcgctcctccatcgatggctcggagcccgccaaaacctctctgcagaccacgggcctcgtgaccaccatagtcttcatctacgactgcctcatgggcttccctgtgctggtggtgagcttcagcagcctgcgggccgacgcctcagcgccctggatggcactctgcgtgctgtggtgctccgtggcccaggccctgctgctgcctgtgttcctctgggcctgcgaccgctaccgggctgacctcaaagctgtccgggagaagtgcatggccctcatggccaacgacgaggagtcagacgatgagaccagcctggaaggtggcatctccccggacctggtgttggagcgctccctggactatggctatggaggtgattttgtggccctagataggatggccaagtatgagatctccgccctggaggggggcctgccccagctctacccactgcggcccttgcaggaggacaagatgcaatacctgcaggtcccgcccacgcggcgcttctcccacgacgatgcggacgtgtgggccgccgtcccgctgcccgccttcctgccgcgctggggctccggcgaggacctggccgccctggcgcacctggtgctgcctgccgggcccgagcggcgccgcgccagcctcctggccttcgcggaggacgcaccaccgtcccgcgcgcgccgccgctcggccgagagcctgctgtcgctgcggccctcggccctggatagcggcccgcggggagcccgcgactcgccccccggcagcccgcgccgccgccccgggcccggcccccgctccgcctcggcctcgctgctgcccgacgccttcgccctgaccgccttcgagtgcgagccacaggccctgcgccgcccgcccgggcccttccccgctgcgcccgccgcccccgacggcgcagatcccggagaggccccgacgcccccaagcagcgcccagcggagcccagggccacgcccctctgcgcactcgcacgccggctctctgcgccccggcctgagcgcgtcgtggggcgagcccggggggctgcgcgcggcgggcggcggcggcagcaccagcagcttcctgagttccccctccgagtcctcgggctacgccacgctgcactcggactcgctgggctccgcgtcctaggaccgccggcgcctccccacggacgccaggcaggccaggccgctctccggggccgcagcaccaaagacgcccgcctccgccccgcgcgcagacatgcgccacccctcccaggggtgagggggcgttggcctcagcgtttgtcttccggctcctcccagctggccttgtcccaggggcgacggctgccccggacgactgcgctgggcaccgcatgtcccgggccgagtgaggtcgggcctggggagctgagtgacatcccaagcttgggcttgggtagtgagtgacatgtgcacacgtccagctgcgccatcaccagccctgcgcaacaggacgtcgggagcagggaacctgagacagggccactgcgggatcggacaaagccccgctttggagaggctgagctggagccattggcctccccaggggctttccacccacactgcaccataaccgccacacccttcggggggggggagggtacagagggtctctaagcacaggggtgttcagagcccgaacaagctttgatcaggtttccctgcttccgacctgtcctgcctcagtttccccatctgtgatgagcaggtgaccacgttaactctcagggctgtttgaagtctcttggttgtaggccctcgccactgagtggcccaggtgtgagaggtagtctagagccctctgcggcctttgtggaggtccgttttcagcatgtggcctggtgtggctccctaggcctgaggcctcccactctcagtgccccctgcccccttgggaacccacactccaccccagctaagcacaacactgtggaccaccaccaatggcacctgagccaccttgaccaccattagtgtccccaccctcattactctgccgtcgttgcctgtccccaccacatcatctccctccatggctcccaccatgacgctggcaggtgcaagcggagagcacgagggcagcagggcctggccttccgtgtccctgcgtcatccccagcctcactccccacccgtgcaggcctggccaggaagggatcctggcaggggcttccaggttctcagctcaaggcctggtcccgggcaggcgtccaacccctgggagcaatgtatttctttgccttccatcctgggcagaccccttacaggcctgggcattgccatgggccctgggtcttcccaggctaaggagaaccaggaacagctataaccttgagctagtgaaatagggtagatgagaaggctgtctcctccagacccctacccctacacagtggccccacaatatgaagacctggggtaattccaaggtgagcatagagcctgcctgtgcccagttccttctggccctcaggtggccaagcccatctcttcatccttcagatagggtcccactcccagaagaagctgctggggtgggggtgggaggctgcctaagcctgtctgtgcttcagaggcccctccagtccctggctgtggggtaactgggggtatgagctgtggccacaggtgagcaaggcagggaactgcaatccagccctggccgcgggaggggccatctctggccaatgctgctgtgccttcaaggactgacaagttacgtaggggcagaggtcgccagctagccagtgtctcctccatctggggggcgtctgtccacttgtcaccttaggttttcactcatttgtcaccttggggttttgctctgtgtgtttcatatccaacggcaatacttgcagggggacagagtcctctaaatactccaatcctgcggtttttacaaacataaagggggagaccccaagtggaggaccctgggcctggagctccctcccaaactttgtccagcatccagcctgttccctgggctcactggggagggagttgtcttcatagcacacccagagccagggatccctttgtagttttttgacaacggagcatttctcttctgtacaggacccaataaaaacttccttatgatttgcacctggca

SEQ ID NO: 11548 - DNA, 4193 bp, Homo sapiens
ggagcctagcgaaataaccctttgcttctacctgaatgggttgttcactctggattctgagcctgcagccagctccaaaatggggcctctgaagaaaagatttgagttgctcttgtgtcttagtcaaagatctacatccctaccagtgggtaaccaagactgtgaataagcacacaccaacaggggcatgtggtgacatggagcctgaaataaactgctctgaattgtgtgacagttttcctggccaggagctggatcggagaccccttcatgatctctgcaagacaacaattacatcttcccaccacagcagtaagaccatctcttcattatctcctgtcctcttgggtattgtttggacttttctcagctgtggacttctgctgatacttttctttcttgcctttacaattcactgcaggaagaacaggattgtgaagatgtccagtcccaatctgaacattgtgaccttactgggcagttgtctcacttacagtagcgcttacctctttgggattcaggatgttttagtggggagctcaatggaaactctcattcagacaagactgtccatgctgtgcattgggacctcccttgtgtttggccccattctgggaaagagctggcgactctacaaggtgtttacccaaagggtcccggacaagagagtgattatcaaagacctgcagttgctggggttggtggcagccctgttgatggctgatgtgatcctgctcatgacgtgggtgctgactgatcccatccagtgcctccagattctcagtgtcagtatgacggtgacagggaaagacgtgtcctgcacttcgaccagcacccacttctgtgcttcccggtattccgatgtttggattgctctcatttggggatgcaagggtctgctcctgctgtatggtgcctacctggctggcctgactggccatgtcagctcccctcctgtgaatcagtccttaaccatcatggtgggggtcaacctccttgtactggctgctgggctgctttttgtagtcaccagatacttgcattcctggcccaacctggtctttggactcacatctggagggatctttgtttgtacaactacaatcaactgcttcatcttcattccccagctgaagcaatggaaggcatttgaagaggaaaaccaaacaatcagacgcatggccaaatatttcagcactcccaacaaaagcttccatacccagtatggtgaggaggagaactgccacccgaggggagagaaaagctccatggagaggctcctcacagaaaaaaatgctgtgattgaaagcctgcaggaacaagtaaacaacgccaaagagaagattgtgaggctgatgtcagctgagtgcacctatgacctcccagagggggctgccccacctgcctcttccccgaacaaggacgtccaggcggtagcctcggtccacaccctggcagctgctcaggggccttcgggtcacctctctgactttcagaatgatcctggcatggctgcccgggattcccagtgcacttcagggccctcctcatatgcacaaagccttgaggggcctgggaaggactccagcttctccccagggaaggaggagaagatatctgactcaaaagacttttctgatcatttagactcaggttgtagccagaagccatggactgagcaaagcctgggtccagaaagaggagaccaagtccccatgaaccccagccagagtctcctaccagaaagaggcggctcagatccccagagacagaggcatctggagaactcagaggagcccccagagcggcggtcacgggttagttcagtaatcagggagaaacttcaggaggtcttacaagatctgggcctgggccctgaggcttccctctccaccgccccctcttgtcatcagcaaacctggaagaacagtgctgccttcagcccccaaaagatgcccctctccaaggagctcggctttagcccttacatggtgaggagaaggcgggcagctcagcgggcccgctcacactttcctggctctgcaccctcatctgtggggcatcgggcaaacaggactgttcctggggcacacagcaggctacatgtgcagaatggggacagccccagcctggccccacaaactactgattccagagtacgaagaccttcttccaggaagccttcactaccttcagatcctcaagacagaccaggtaccctggagggcagcaaacaaagccagacagagcccgagggggctagagggagcaaagcagcctttcttcgccagccttctggttctggccgggccccaagtcctgctgccccatgcctctccaaagcctcacctgacttgcctgaacagtggcagctgtggcccccagtgccctcaggctgtgcctccctgtcttctcaacacagctattttgatactgagtccagcagctcagatgagttcttctgccgctgccaccggccctactgtgaaatctgcttccagagctcttctgactctagtgacagtggcacatcagacactgaccctgagcctactggggggctggcttcctgggaaaagctgtgggcccgctccaagcctattgtgaacttcaaagatgacttgaaacccacgctggtgtgaaaagcaacagagctggtctagacacagaggtcagtccaagagaagctgtaccaaggcccacaggagaagagccaatttctggtctttggggaacagattagtgccctgcatttgaccagcccataccatgtttcagctaggctcactgtgttactttgagtacttcttgatctataaaaagagaggcattgcctgtcctgttactacctcgcagccttactataaaagactccagttgagtgactatgaaagacactgactccttggataaaaggtgctgaatgaacacataggattttctgtccaggtcagcctacattctgtaaaactcttaatatattcagatggatggctgaatggacagacagatggagagatgcatgggaaatttctgtagaacttgaggtgtggactgtgacccatcaaactggccttttggtggacagacctaccaggaagataagtctcctacatccttgggcctcccactcctggaaggcagtggttttatttctgctgaatgttgtgaacagcacctccctagattccagcttctggccagacccagctcagagccacccctacaccactatttcttgatggtgtctttccaccattatggcactttaccctcctctctgagacagatctccatgcgcccgcaggcttcccagatctctcccctgggatcggatgtacctgaggtcctgactgtccccactgtccccttgtcctgtggctcatcctcgattcacccactgatgcagttttgtactgcggggaggcacacaccagcaatttctgttggggtatgggagaacctgttggtcaagagtgcttttggttccattggggttacatgactaccaacagacacataaacctggaagccaaatggagaaataaaaaggaagacacgagggacacgaaaacaggaaagaaaacaggatttgaatatttcacttgagtccagcatagtacttggcaatatcatatttttgtgattccttttgataaccctgtgaagtagacactttcatttttacagacaaggattatgaggcttagagaaatgaggtagtttcccgcaacatcacactgctggacagagatgtacacacagctcctgggactcaagtaggtgggttttcccagggacacatggcttcatgtgttcttctgggaatggcaggtgacgcttggcagacgagacaacaaagcaaggctcatgtaagaaagctgggatgtgctcccctatagtccagaataatagacctgggtcctcacctcaggaaacgggcctccacttcctcactgccaaaggccacactggcacctcccaagggagctggggagctggtgaaggatgagtgcgaggaactcagccaccaccagagccacagggagagcacacctgggtccactgtgcttattgctgagctggctgtcatgtccaggctgtcccctgccccgagtcctgtgtatacatctgtgggtgtgcacatgtttgcatgaaggaattcaggccttattaaatattctcagaggggg

SEQ ID NO: 11549 - DNA, 4442 bp, Homo sapiens
ggggaccgtgggcgtcctgcacatagcagcgggcttggcgcttctcggcggtccgacgctgatgaggaaccagagtgagggtactcgaacagtgactgccatctggtggttaaccagaatcatcaccttgtgtagcctgatggttactaagatgtccactcttgactcacatggcatgcactcgcagcaggggaccagttgaaggatgtctgactttggagggtcaccagttgaaggatgtctgatgaaggagcctagcgaaataaccctttgcttctacctgaatgggttgttcactctggattctgagcctgcagccagctccaaaatggggcctctgaagaaaagatttgagttgctcttgtgtcttagtcaaagatctacatccctaccagtgggtaaccaagactgtgaataagcacacaccaacaggggcatgtggtgacatggagcctgaaataaactgctctgaattgtgtgacagttttcctggccaggagctggatcggagaccccttcatgatctctgcaagacaacaattacatcttcccaccacagcagtaagaccatctcttcattatctcctgtcctcttgggtattgtttggacttttctcagctgtggacttctgctgatacttttctttcttgcctttacaattcactgcaggaagaacaggattgtgaagatgtccagtcccaatctgaacattgtgaccttactgggcagttgtctcacttacagtagcgcttacctctttgggattcaggatgttttagtggggagctcaatggaaactctcattcagacaagactgtccatgctgtgcattgggacctcccttgtgtttggccccattctgggaaagagctggcgactctacaaggtgtttacccaaagggtcccggacaagagagtgattatcaaagacctgcagttgctggggttggtggcagccctgttgatggctgatgtgatcctgctcatgacgtgggtgctgactgatcccatccagtgcctccagattctcagtgtcagtatgacggtgacagggaaagacgtgtcctgcacttcgaccagcacccacttctgtgcttcccggtattccgatgtttggattgctctcatttggggatgcaagggtctgctcctgctgtatggtgcctacctggctggcctgactggccatgtcagctcccctcctgtgaatcagtccttaaccatcatggtgggggtcaacctccttgtactggctgctgggctgctttttgtagtcaccagatacttgcattcctggcccaacctggtctttggactcacatctggagggatctttgtttgtacaactacaatcaactgcttcatcttcattccccagctgaagcaatggaaggcatttgaagaggaaaaccaaacaatcagacgcatggccaaatatttcagcactcccaacaaaagcttccatacccagtatggtgaggaggagaactgccacccgaggggagagaaaagctccatggagaggctcctcacagaaaaaaatgctgtgattgaaagcctgcaggaacaagtaaacaacgccaaagagaagattgtgaggctgatgtcagctgagtgcacctatgacctcccagagggggctgccccacctgcctcttccccgaacaaggacgtccaggcggtagcctcggtccacaccctggcagctgctcaggggccttcgggtcacctctctgactttcagaatgatcctggcatggctgcccgggattcccagtgcacttcagggccctcctcatatgcacaaagccttgaggggcctgggaaggactccagcttctccccagggaaggaggagaagatatctgactcaaaagacttttctgatcatttagactcaggttgtagccagaagccatggactgagcaaagcctgggtccagaaagaggagaccaagtccccatgaaccccagccagagtctcctaccagaaagaggcggctcagatccccagagacagaggcatctggagaactcagaggagcccccagagcggcggtcacgggttagttcagtaatcagggagaaacttcaggaggtcttacaagatctgggcctgggccctgaggcttccctctccaccgccccctcttgtcatcagcaaacctggaagaacagtgctgccttcagcccccaaaagatgcccctctccaaggagctcggctttagcccttacatggtgaggagaaggcgggcagctcagcgggcccgctcacactttcctggctctgcaccctcatctgtggggcatcgggcaaacaggactgttcctggggcacacagcaggctacatgtgcagaatggggacagccccagcctggccccacaaactactgattccagagtacgaagaccttcttccaggaagccttcactaccttcagatcctcaagacagaccaggtaccctggagggcagcaaacaaagccagacagagcccgagggggctagagggagcaaagcagcctttcttcgccagccttctggttctggccgggccccaagtcctgctgccccatgcctctccaaagcctcacctgacttgcctgaacagtggcagctgtggcccccagtgccctcaggctgtgcctccctgtcttctcaacacagctattttgatactgagtccagcagctcagatgagttcttctgccgctgccaccggccctactgtgaaatctgcttccagagctcttctgactctagtgacagtggcacatcagacactgaccctgagcctactggggggctggcttcctgggaaaagctgtgggcccgctccaagcctattgtgaacttcaaagatgacttgaaacccacgctggtgtgaaaagcaacagagctggtctagacacagaggtcagtccaagagaagctgtaccaaggcccacaggagaagagccaatttctggtctttggggaacagattagtgccctgcatttgaccagcccataccatgtttcagctaggctcactgtgttactttgagtacttcttgatctataaaaagagaggcattgcctgtcctgttactacctcgcagccttactataaaagactccagttgagtgactatgaaagacactgactccttggataaaaggtgctgaatgaacacataggattttctgtccaggtcagcctacattctgtaaaactcttaatatattcagatggatggctgaatggacagacagatggagagatgcatgggaaatttctgtagaacttgaggtgtggactgtgacccatcaaactggccttttggtggacagacctaccaggaagataagtctcctacatccttgggcctcccactcctggaaggcagtggttttatttctgctgaatgttgtgaacagcacctccctagattccagcttctggccagacccagctcagagccacccctacaccactatttcttgatggtgtctttccaccattatggcactttaccctcctctctgagacagatctccatgcgcccgcaggcttcccagatctctcccctgggatcggatgtacctgaggtcctgactgtccccactgtccccttgtcctgtggctcatcctcgattcacccactgatgcagttttgtactgcggggaggcacacaccagcaatttctgttggggtatgggagaacctgttggtcaagagtgcttttggttccattggggttacatgactaccaacagacacataaacctggaagccaaatggagaaataaaaaggaagacacgagggacacgaaaacaggaaagaaaacaggatttgaatatttcacttgagtccagcatagtacttggcaatatcatatttttgtgattccttttgataaccctgtgaagtagacactttcatttttacagacaaggattatgaggcttagagaaatgaggtagtttcccgcaacatcacactgctggacagagatgtacacacagctcctgggactcaagtaggtgggttttcccagggacacatggcttcatgtgttcttctgggaatggcaggtgacgcttggcagacgagacaacaaagcaaggctcatgtaagaaagctgggatgtgctcccctatagtccagaataatagacctgggtcctcacctcaggaaacgggcctccacttcctcactgccaaaggccacactggcacctcccaagggagctggggagctggtgaaggatgagtgcgaggaactcagccaccaccagagccacagggagagcacacctgggtccactgtgcttattgctgagctggctgtcatgtccaggctgtcccctgccccgagtcctgtgtatacatctgtgggtgtgcacatgtttgcatgaaggaattcaggccttattaaatattctcagaggggg

SEQ ID NO: 11550 - DNA, 2525 bp, Homo sapiens
acaggggcatgtggtgacatggagcctgaaataaactgctctgaattgtgtgacagttttcctggccaggagctggatcggagaccccttcatgatctctgcaagacaacaattacatcttcccaccacagcagtaagaccatctcttcattatctcctgtcctcttgggtattgtttggacttttctcagctgtggacttctgctgatacttttctttcttgcctttacaattcactgcaggaagaacaggattgtgaagatgtccagtcccaatctgaacattgtgaccttactgggcagttgtctcacttacagtagcgcttacctctttgggattcaggatgttttagtggggagctcaatggaaactctcattcagacaagactgtccatgctgtgcattgggacctcccttgtgtttggccccattctgggaaagagctggcgactctacaaggtgtttacccaaagggtcccggacaagagagtgattatcaaagacctgcagttgctggggttggtggcagccctgttgatggctgatgtgatcctgctcatgacgtgggtgctgactgatcccatccagtgcctccagattctcagtgtgacagggaaagacgtgtcctgcacttcgaccagcacccacttctgtgcttcccggtattccgatgtttggattgctctcatttggggatgcaagggtctgctcctgctgtatggtgcctacctggctggcctgactggccatgtcagctcccctcctgtgaatcagtccttaaccatcatggtgggggtcaacctccttgtactggctgctgggctgctttttgtagtcaccagatacttgcattcctggcccaacctggtctttggactcacatctggagggatctttgtttgtacaactacaatcaactgcttcatcttcattccccagctgaagcaatggaaggcatttgaagaggaaaaccaaacaatcagacgcatggccaaatatttcagcactcccaacaaaagcttccatacccagtatggtgaggaggagaactgccacccgaggggagagaaaagctccatggagaggctcctcacagaaaaaaatgctgtgattgaaagcctgcaggaacaagtaaacaacgccaaagagaagattgtgaggctgatgtcagctgagtgcacctatgacctcccagagggggctgccccacctgcctcttccccgaacaaggacgtccaggcggtagcctcggtccacaccctggcagctgctcaggggccttcgggtcacctctctgactttcagaatgatcctggcatggctgcccgggattcccagtgcacttcagggccctcctcatatgcacaaagccttgaggggcctgggaaggactccagcttctccccagggaaggaggagaagatatctgactcaaaagacttttctgatcatttagactcaggttgtagccagaagccatggactgagcaaagcctgggtccagaaagaggagaccaagtccccatgaaccccagccagagtctcctaccagaaagaggcggctcagatccccagagacagaggcatctggagaactcagaggagcccccagagcggcggtcacgggttagttcagtaatcagggagaaacttcaggaggtcttacaagatctgggcctgggccctgaggcttccctctccaccgccccctcttgtcatcagcaaacctggaagaacagtgctgccttcagcccccaaaagatgcccctctccaaggagctcggctttagcccttacatggtgaggagaaggcgggcagctcagcgggcccgctcacactttcctggctctgcaccctcatctgtggggcatcgggcaaacaggactgttcctggggcacacagcaggctacatgtgcagaatggggacagccccagcctggccccacaaactactgattccagagtacgaagaccttcttccaggaagccttcactaccttcagatcctcaagacagaccaggtaccctggagggcagcaaacaaagccagacagagcccgagggggctagagggagcaaagcagcctttcttcgccagccttctggttctggccgggccccaagtcctgctgccccatgcctctccaaagcctcacctgacttgcctgaacagtggcagctgtggcccccagtgccctcaggctgtgcctccctgtcttctcaacacagctattttgatactgagtccagcagctcagatgagttcttctgccgctgccaccggccctactgtgaaatctgcttccagagctcttctgactctagtgacagtggcacatcagacactgaccctgagcctactggggggctggcttcctgggaaaagctgtgggcccgctccaagcctattgtgaacttcaaagatgacttgaaacccacgctggtgtgaaaagcaacagagctggtctagacacagaggtcagtccaagagaagctgtaccaaggcccacaggagaagagcca

SEQ ID NO: 11551 - DNA, 2422 bp, Homo sapiens
ttttcctgtcccctggtcctgccttatctttccagtcgtccagcatgctctgcccaccccacgccgaggtgcactgaccatgagcctcaactcctccctcagctgcaggaaggagctgagtaatctcactgaggaggagggtggcgaagggggcgtcatcatcacccagttcatcgccatcattgtcatcaccatttttgtctgcctgggaaacctggtcatcgtggtcaccttgtacaagaagtcctacctcctcaccctcagcaacaagttcgtcttcagcctgactctgtccaacttcctgctgtccgtgttggtgctgccttttgtggtgacgagctccatccgcagggaatggatctttggtgtagtgtggtgcaacttctctgccctcctctacctgctgatcagctctgccagcatgctaaccctcggggtcattgccatcgaccgctactatgctgtcctgtaccccatggtgtaccccatgaagatcacagggaaccgggctgtgatggcacttgtctacatctggcttcactcgctcatcggctgcctgccacccctgtttggttggtcatccgtggagtttgacgagttcaaatggatgtgtgtggctgcttggcaccgggagcctggctacacggccttctggcagatctggtgtgccctcttcccctttctggtcatgctggtgtgctatggcttcatcttccgcgtggccagggtcaaggcacgcaaggtgcactgtggcacagtcgtcatcgtggaggaggatgctcagaggaccgggaggaagaactccagcacctccacctcctcttcaggcagcaggaggaatgcctttcagggtgtggtctactcggccaaccagtgcaaagccctcatcaccatcctggtggtcctcggtgccttcatggtcacctggggcccctacatggttgtcatcgcctctgaggccctctgggggaaaagctccgtctccccgagcctggagacttgggccacatggctgtcctttgccagcgctgtctgccaccccctgatctatggactctggaacaagacagttcgcaaagaactactgggcatgtgctttggggaccggtattatcgggaaccatttgtgcaacgacagaggacttccaggctcttcagcatttccaacaggatcacagacctgggcctgtccccacacctcactgcgctcatggcaggtggacagcccctggggcacagcagcagcacgggggacactggcttcagctgctcccaggactcagggacagatatgatgctgcttgaggactacacgtctgatgacaaccctccctctcactgcacttgcccacccaagagaaggagctcggtgacatttgaggatgaagtggaacaaatcaaagaagctgccaagaactcgattcttcatgtgaaagctgaagtacacaagtccttggacagttacgcagcaagcttggccaaagccattgaggccgaagccaaaatcaacttatttggggaggaggctttgccaggggtcttggttacagcacggactgtcccggggggcggcttcgggggccgccgaggcagcagaactcttgtgagccagaggctgcagttgcagagcatcgaagaaggagatgttttagctgccgagcagagatgagggcctcagggtgccgtggggctgcagcctgagaggctggcccggggaggagttcccatcaccgcctgtgccgcggccttgggagcatgtcactgtgtacagctggccacacacagggaaggagcagcatctggtatgcagccaccaggacaaggactgaaaataatgtctacagtccacagcttcagcatttccagagaccacatgtgagcttcttttaggtcccagtgatgggaccagaagcatctaaagcaaaaaaaaaaccaaaaaaaaatctagagatgtggctgtggctttttgggaggtggggcatgggaggaccagagacgaagggcttggaaggagacccccacatgcatcatttcctcctcttcacagtgtgctgggagtccagccgtgcactgtgccagatgcctcaggaggagaaccctccccagtgtactgtgaaggatgacacagcacttcttcctaatgacacgcgaccgtcctggtgcctctacatggttgatgcgggcagtgtgggaccctcagttctaggactggtccgcagagaaagcacccaggagcagagcgcttcggagcggtcctcagtggcgccacctgctggtgctaatagggacagccacaggcctcttgcagactggcccaccctgcctacttccctactgacaagttctttggtatttcaaaagggagaaaccactataaaagacaagaggaagggcaggtactaggtgtttcatttccagaatt

SEQ ID NO: 11552 - DNA, 2152 bp, Homo sapiens
gtctgtgtgatggagagagacatggaaaaggcgacgtcccagcggctggaactggggcggaggaacgggaacagggaaggcctgagttaggcaccacaaaggttttcaggagaaaagtggggcgagccgagaggcctggtgcactgtgcgtcctctgagaggtgaaggagcactgtgtggtcagagggctgcgagctctctgtttgggttccgaggaagacagaatgggctgaactggaactgacctaaatgtcagcaagaggagtcgtccagcatgctctgcccaccccacgccgaggtgcactgaccatgagcctcaactcctccctcagctgcaggaaggagctgagtaatctcactgaggaggagggtggcgaagggggcgtcatcatcacccagttcatcgccatcattgtcatcaccatttttgtctgcctgggaaacctggtcatcgtggtcaccttgtacaagaagtcctacctcctcaccctcagcaacaagttcgtcttcagcctgactctgtccaacttcctgctgtccgtgttggtgctgccttttgtggtgacgagctccatccgcagggaatggatctttggtgtagtgtggtgcaacttctctgccctcctctacctgctgatcagctctgccagcatgctaaccctcggggtcattgccatcgaccgctactatgctgtcctgtaccccatggtgtaccccatgaagatcacagggaaccgggctgtgatggcacttgtctacatctggcttcactcgctcatcggctgcctgccacccctgtttggttggtcatccgtggagtttgacgagttcaaatggatgtgtgtggctgcttggcaccgggagcctggctacacggccttctggcagatctggtgtgccctcttcccctttctggtcatgctggtgtgctatggcttcatcttccgcgtggccagggtcaaggcacgcaaggtgcactgtggcacagtcgtcatcgtggaggaggatgctcagaggaccgggaggaagaactccagcacctccacctcctcttcaggcagcaggaggaatgcctttcagggtgtggtctactcggccaaccagtgcaaagccctcatcaccatcctggtggtcctcggtgccttcatggtcacctggggcccctacatggttgtcatcgcctctgaggccctctgggggaaaagctccgtctccccgagcctggagacttgggccacatggctgtcctttgccagcgctgtctgccaccccctgatctatggactctggaacaagacagttcgcaaagaactactgggcatgtgctttggggaccggtattatcgggaaccatttgtgcaacgacagaggacttccaggctcttcagcatttccaacaggatcacagacctgggcctgtccccacacctcactgcgctcatggcaggtggacagcccctggggcacagcagcagcacgggggacactggcttcagctgctcccaggactcagggacagatatgatgctgcttgaggactacacgtctgatgacaaccctccctctcactgcacttgcccacccaagagaaggagctcggtgacatttgaggatgaagtggaacaaatcaaagaagctgccaagaactcgattcttcatgtgaaagctgaagtacacaagtccttggacagttacgcagcaagcttggccaaagccattgaggccgaagccaaaatcaacttatttggggaggaggctttgccaggggtcttggttacagcacggactgtcccggggggcggcttcgggggccgccgaggcagcagaactcttgtgagccagaggctgcagttgcagagcatcgaagaaggagatgttttagctgccgagcagagatgagggcctcagggtgccgtggggctgcagcctgagaggctggcccggggaggagttcccatcaccgcctgtgccgcggccttgggagcatgtcactgtgtacagctggccacacacagggaaggagcagcatctggtatgcagccaccaggacaaggactgaaaataatgtctacagtccacagcttcagcatttccagagaccacatgtgagcttcttttaggtcccagtgatgggaccagaagcatctaaagc

SEQ ID NO: 11553 - DNA, 2400 bp, Homo sapiens
gttttgtgatgactgctccctggccttttggttccgagggagtgcagggcagcagtgtgaagacctgtttacgtccactccccactccccggggctggcttcgggacgaattcactgtggtattaacagagcccgggacagagcctggcagaaggcagatggatgctcgtgcccgtcggctggatgaatgaaaggtgagcagcaaaggcgataccaggatcgtccacggcgggactggaggaggagaatgggactgtgcggagcctgcgggaagaatctgaaagtgtctgtgtgatggagagagacatggaaaaggcgacgtcccagcggctggaactggggcggaggaacgggaacagggaaggcctgagttaggcaccacaaaggttttcaggagaaaagtggggcgagccgagaggagtctcaccctgttgcttaggcagatggcgcgatctcggctcctgggttcaagcaattctcctgcctcagcctcctgaatagccgggattacagtcgtccagcatgctctgcccaccccacgccgaggtgcactgaccatgagcctcaactcctccctcagctgcaggaaggagctgagtaatctcactgaggaggagggtggcgaagggggcgtcatcatcacccagttcatcgccatcattgtcatcaccatttttgtctgcctgggaaacctggtcatcgtggtcaccttgtacaagaagtcctacctcctcaccctcagcaacaagttcgtcttcagcctgactctgtccaacttcctgctgtccgtgttggtgctgccttttgtggtgacgagctccatccgcagggaatggatctttggtgtagtgtggtgcaacttctctgccctcctctacctgctgatcagctctgccagcatgctaaccctcggggtcattgccatcgaccgctactatgctgtcctgtaccccatggtgtaccccatgaagatcacagggaaccgggctgtgatggcacttgtctacatctggcttcactcgctcatcggctgcctgccacccctgtttggttggtcatccgtggagtttgacgagttcaaatggatgtgtgtggctgcttggcaccgggagcctggctacacggccttctggcagatctggtgtgccctcttcccctttctggtcatgctggtgtgctatggcttcatcttccgcgtggccagggtcaaggcacgcaaggtgcactgtggcacagtcgtcatcgtggaggaggatgctcagaggaccgggaggaagaactccagcacctccacctcctcttcaggcagcaggaggaatgcctttcagggtgtggtctactcggccaaccagtgcaaagccctcatcaccatcctggtggtcctcggtgccttcatggtcacctggggcccctacatggttgtcatcgcctctgaggccctctgggggaaaagctccgtctccccgagcctggagacttgggccacatggctgtcctttgccagcgctgtctgccaccccctgatctatggactctggaacaagacagttcgcaaagaactactgggcatgtgctttggggaccggtattatcgggaaccatttgtgcaacgacagaggacttccaggctcttcagcatttccaacaggatcacagacctgggcctgtccccacacctcactgcgctcatggcaggtggacagcccctggggcacagcagcagcacgggggacactggcttcagctgctcccaggactcagggacagatatgatgctgcttgaggactacacgtctgatgacaaccctccctctcactgcacttgcccacccaagagaaggagctcggtgacatttgaggatgaagtggaacaaatcaaagaagctgccaagaactcgattcttcatgtgaaagctgaagtacacaagtccttggacagttacgcagcaagcttggccaaagccattgaggccgaagccaaaatcaacttatttggggaggaggctttgccaggggtcttggttacagcacggactgtcccggggggcggcttcgggggccgccgaggcagcagaactcttgtgagccagaggctgcagttgcagagcatcgaagaaggagatgttttagctgccgagcagagatgagggcctcagggtgccgtggggctgcagcctgagaggctggcccggggaggagttcccatcaccgcctgtgccgcggccttgggagcatgtcactgtgtacagctggccacacacagggaaggagcagcatctggtatgcagccaccaggacaaggactgaaaataatgtctacagtccacagcttcagcatttccagagaccacatgtgagcttcttttaggtcccagtgatgggaccagaagcatctaaagc

SEQ ID NO: 11554 - DNA, 2676 bp, Homo sapiens
gtaggtgcgtgcccgggactctgccgatgcgggccgcgccccctggggccaagagactccacgtcccgctcagggcaaagggtgtggggagaagcggtcacgcccctcggctggaatccgtgaggaccaggtctttttcagtgtgctcaatatggtcaccaagcctggaaacatagagtctcaccctgttgcttaggcagatggcgcgatctcggctcctgggttcaagcaattctcctgcctcagcctcctgaatagccgggattacagtcgtccagcatgctctgcccaccccacgccgaggtgcactgaccatgagcctcaactcctccctcagctgcaggaaggagctgagtaatctcactgaggaggagggtggcgaagggggcgtcatcatcacccagttcatcgccatcattgtcatcaccatttttgtctgcctgggaaacctggtcatcgtggtcaccttgtacaagaagtcctacctcctcaccctcagcaacaagttcgtcttcagcctgactctgtccaacttcctgctgtccgtgttggtgctgccttttgtggtgacgagctccatccgcagggaatggatctttggtgtagtgtggtgcaacttctctgccctcctctacctgctgatcagctctgccagcatgctaaccctcggggtcattgccatcgaccgctactatgctgtcctgtaccccatggtgtaccccatgaagatcacagggaaccgggctgtgatggcacttgtctacatctggcttcactcgctcatcggctgcctgccacccctgtttggttggtcatccgtggagtttgacgagttcaaatggatgtgtgtggctgcttggcaccgggagcctggctacacggccttctggcagatctggtgtgccctcttcccctttctggtcatgctggtgtgctatggcttcatcttccgcgtggccagggtcaaggcacgcaaggtgcactgtggcacagtcgtcatcgtggaggaggatgctcagaggaccgggaggaagaactccagcacctccacctcctcttcaggcagcaggaggaatgcctttcagggtgtggtctactcggccaaccagtgcaaagccctcatcaccatcctggtggtcctcggtgccttcatggtcacctggggcccctacatggttgtcatcgcctctgaggccctctgggggaaaagctccgtctccccgagcctggagacttgggccacatggctgtcctttgccagcgctgtctgccaccccctgatctatggactctggaacaagacagttcgcaaagaactactgggcatgtgctttggggaccggtattatcgggaaccatttgtgcaacgacagaggacttccaggctcttcagcatttccaacaggatcacagacctgggcctgtccccacacctcactgcgctcatggcaggtggacagcccctggggcacagcagcagcacgggggacactggcttcagctgctcccaggactcagggacagatatgatgctgcttgaggactacacgtctgatgacaaccctccctctcactgcacttgcccacccaagagaaggagctcggtgacatttgaggatgaagtggaacaaatcaaagaagctgccaagaactcgattcttcatgtgaaagctgaagtacacaagtccttggacagttacgcagcaagcttggccaaagccattgaggccgaagccaaaatcaacttatttggggaggaggctttgccaggggtcttggttacagcacggactgtcccggggggcggcttcgggggccgccgaggcagcagaactcttgtgagccagaggctgcagttgcagagcatcgaagaaggagatgttttagctgccgagcagagatgagggcctcagggtgccgtggggctgcagcctgagaggctggcccggggaggagttcccatcaccgcctgtgccgcggccttgggagcatgtcactgtgtacagctggccacacacagggaaggagcagcatctggtatgcagccaccaggacaaggactgaaaataatgtctacagtccacagcttcagcatttccagagaccacatgtgagcttcttttaggtcccagtgatgggaccagaagcatctaaagcaaaaaaaaaaccaaaaaaaaatctagagatgtggctgtggctttttgggaggtggggcatgggaggaccagagacgaagggcttggaaggagacccccacatgcatcatttcctcctcttcacagtgtgctgggagtccagccgtgcactgtgccagatgcctcaggaggagaaccctccccagtgtactgtgaaggatgacacagcacttcttcctaatgacacgcgaccgtcctggtgcctctacatggttgatgcgggcagtgtgggaccctcagttctaggactggtccgcagagaaagcacccaggagcagagcgcttcggagcggtcctcagtggcgccacctgctggtgctaatagggacagccacaggcctcttgcagactggcccaccctgcctacttccctactgacaagttctttggtatttcaaaagggagaaaccactataaaagacaagaggaagggcaggtactaggtgtttcatttccagaattaaaaaaaaaatccatttaa

SEQ ID NO: 11555 - DNA, 2152 bp, Homo sapiens; identical to SEQ ID NO: 11552

SEQ ID NO: 11556 - DNA, 1878 bp, Homo sapiens
attgtgcgaggctgagggctcagggcgcgggccgggaagggtccccgcccccacggcgctccctttctccccgcgcccctctcggaggtcagggctgtcctccgcccgcactgcgccttgctttggagagctggagctctttgtgggaagatgttgggggcgcgcccctcccctgcggcctggggcttctgagaggcccaccccattctgctgggtgcagcccgccccgtttctccggcgccgcccgaagcccctaaacagtccgctggatgggagggcgtaggtgcgtgcccgggactctgccgatgcgggccgcgccccctggggccaagagactccacgtcccgctcagggcaaagggtgtggggagaagcggtcacgcccctcggctggaatccgtgaggaccagctactatgctgtcctgtaccccatggtgtaccccatgaagatcacagggaaccgggctgtgatggcacttgtctacatctggcttcactcgctcatcggctgcctgccacccctgtttggttggtcatccgtggagtttgacgagttcaaatggatgtgtgtggctgcttggcaccgggagcctggctacacggccttctggcagatctggtgtgccctcttcccctttctggtcatgctggtgtgctatggcttcatcttccgcgtggccagggtcaaggcacgcaaggtgcactgtggcacagtcgtcatcgtggaggaggatgctcagaggaccgggaggaagaactccagcacctccacctcctcttcaggcagcaggaggaatgcctttcagggtgtggtctactcggccaaccagtgcaaagccctcatcaccatcctggtggtcctcggtgccttcatggtcacctggggcccctacatggttgtcatcgcctctgaggccctctgggggaaaagctccgtctccccgagcctggagacttgggccacatggctgtcctttgccagcgctgtctgccaccccctgatctatggactctggaacaagacagttcgcaaagaactactgggcatgtgctttggggaccggtattatcgggaaccatttgtgcaacgacagaggacttccaggctcttcagcatttccaacaggatcacagacctgggcctgtccccacacctcactgcgctcatggcaggtggacagcccctggggcacagcagcagcacgggggacactggcttcagctgctcccaggactcagggacagatatgatgctgcttgaggactacacgtctgatgacaaccctccctctcactgcacttgcccacccaagagaaggagctcggtgacatttgaggatgaagtggaacaaatcaaagaagctgccaagaactcgattcttcatgtgaaagctgaagtacacaagtccttggacagttacgcagcaagcttggccaaagccattgaggccgaagccaaaatcaacttatttggggaggaggctttgccaggggtcttggttacagcacggactgtcccggggggcggcttcgggggccgccgaggcagcagaactcttgtgagccagaggctgcagttgcagagcatcgaagaaggagatgttttagctgccgagcagagatgagggcctcagggtgccgtggggctgcagcctgagaggctggcccggggaggagttcccatcaccgcctgtgccgcggccttgggagcatgtcactgtgtacagctggccacacacagggaaggagcagcatctggtatgcagccaccaggacaaggactgaaaataatgtctacagtccacagcttcagcatttccagagaccacatgtgagcttcttttaggtcccagtgatgggaccagaagcatctaaagc

SEQ ID NO: 11557 - DNA, 1653 bp, Homo sapiens
gactgctccctggccttttggttccgagggagtgcagggcagcagtgtgaagacctgtttacgtccactccccactccccggggctggcttcgggacgaattcactgtggtattaacagagcccgggacagagcctggcagaaggcagatggatgctcgtgcccgtcggctggatgaatgaaagctactatgctgtcctgtaccccatggtgtaccccatgaagatcacagggaaccgggctgtgatggcacttgtctacatctggcttcactcgctcatcggctgcctgccacccctgtttggttggtcatccgtggagtttgacgagttcaaatggatgtgtgtggctgcttggcaccgggagcctggctacacggccttctggcagatctggtgtgccctcttcccctttctggtcatgctggtgtgctatggcttcatcttccgcgtggccagggtcaaggcacgcaaggtgcactgtggcacagtcgtcatcgtggaggaggatgctcagaggaccgggaggaagaactccagcacctccacctcctcttcaggcagcaggaggaatgcctttcagggtgtggtctactcggccaaccagtgcaaagccctcatcaccatcctggtggtcctcggtgccttcatggtcacctggggcccctacatggttgtcatcgcctctgaggccctctgggggaaaagctccgtctccccgagcctggagacttgggccacatggctgtcctttgccagcgctgtctgccaccccctgatctatggactctggaacaagacagttcgcaaagaactactgggcatgtgctttggggaccggtattatcgggaaccatttgtgcaacgacagaggacttccaggctcttcagcatttccaacaggatcacagacctgggcctgtccccacacctcactgcgctcatggcaggtggacagcccctggggcacagcagcagcacgggggacactggcttcagctgctcccaggactcagggacagatatgatgctgcttgaggactacacgtctgatgacaaccctccctctcactgcacttgcccacccaagagaaggagctcggtgacatttgaggatgaagtggaacaaatcaaagaagctgccaagaactcgattcttcatgtgaaagctgaagtacacaagtccttggacagttacgcagcaagcttggccaaagccattgaggccgaagccaaaatcaacttatttggggaggaggctttgccaggggtcttggttacagcacggactgtcccggggggcggcttcgggggccgccgaggcagcagaactcttgtgagccagaggctgcagttgcagagcatcgaagaaggagatgttttagctgccgagcagagatgagggcctcagggtgccgtggggctgcagcctgagaggctggcccggggaggagttcccatcaccgcctgtgccgcggccttgggagcatgtcactgtgtacagctggccacacacagggaaggagcagcatctggtatgcagccaccaggacaaggactgaaaataatgtctacagtccacagcttcagcatttccagagaccacatgtgagcttcttttaggtcccagtgatgggaccagaagcatctaaagc

SEQ ID NO: 11558 - DNA, 2062 bp, Homo sapiens
ccgacacccacgggcggagatcacctgctgccccgcagacccctgtcccttcctcccggaccagcagctagaggatgtccaaacggagttggtgggctggatccagaaagcccccaagagagatgctgaaactctcaggctctgactccagccaaagcatgaatggccttgaagtggctcccccaggtctgatcaccaacttctccctggccacggcagagcaatgtggccaggagacgccactggagaacatgctgttcgcctccttctaccttctggattttatcctggctttagttggcaataccctggctctgtggcttttcatccgagaccacaagtccgggaccccggccaacgtgttcctgatgcatctggccgtggccgacttgtcgtgcgtgctggtcctgcccacccgcctggtctaccacttctctgggaaccactggccatttggggaaatcgcatgccgtctcaccggcttcctcttctacctcaacatgtacgccagcatctacttcctcacctgcatcagcgccgaccgtttcctggccattgtgcacccggtcaagtccctcaagctccgcaggcccctctacgcacacctggcctgtgccttcctgtgggtggtggtggctgtggccatggccccgctgctggtgagcccacagaccgtgcagaccaaccacacggtggtctgcctgcagctgtaccgggagaaggcctcccaccatgccctggtgtccctggcagtggccttcaccttcccgttcatcaccacggtcacctgctacctgctgatcatccgcagcctgcggcagggcctgcgtgtggagaagcgcctcaagaccaaggcagtgcgcatgatcgccatagtgctggccatcttcctggtctgcttcgtgccctaccacgtcaaccgctccgtctacgtgctgcactaccgcagccatggggcctcctgcgccacccagcgcatcctggccctggcaaaccgcatcacctcctgcctcaccagcctcaacggggcactcgaccccatcatgtatttcttcgtggctgagaagttccgccacgccctgtgcaacttgctctgtggcaaaaggctcaagggcccgccccccagcttcgaagggaaaaccaacgagagctcgctgagtgccaagtcagagctgtgagcggggggcgccgtccaggccgagcgcagactgtttaggactcagcagacccagcaagaggcatctgccctttccccagccacctccccagcaagcaacctgaaatctcagcagatgcccaccatttctctagatcgcctagtctcaacccataaaaaggaagaactgacaaaggggatccatcggccacccctctgcaggggcttgtgatggctacaatggctcctagacactcaacgacttcatctgtggcagggagagaggaggccggaagaacaacccctgaacaatggaggcctttctttcccgctaggctcccagcctccttcccgctacagaatcgctcatcggcgaggctcagcagaaagaccctgaaggcaggctgcaaatgacccagaagagggacctgggagtcctggtggggacggggagggagtctcaatactcctttgcagtgcaaggtactctgagtcccctctgtagtgcctctgccagacacacactgcctgagttgaagagacacaggccacacatttcaggctggttgccagcggacgtcagcactcacggcctgcagggactcagcacagctctggattctggatctctcctgctgtaaccccacgcacaagcctgcaacccccagagctctttgacaggctcccaggcctcccagtcctggacaagcatgtgcagtcacgggagctcagctcaggccagggctgggctgtgcacctgcctcccactgacccagacccacttcctccagagaggcctctctccgcctgagctatttcccttgctagtgtgcagatatttccctaacatgtccttttttgtatttgtttgtacggaccataaatataactgtagctttaagacta

SEQ ID NO: 11559 - DNA, 1727 bp, Homo sapiens
gacacaacaagggacccctcaggaatgaagcagcctttcagggccagaggggctgtggtctcccttcctctccttaaatagccagcgttccacccacagcggcaaggagccccctgccaccaccgacacccacgggcggagatcacctgctgccccgcagacccctgtcccttcctcccggaccagcagctagaggctctgactccagccaaagcatgaatggccttgaagtggctcccccaggtctgatcaccaacttctccctggccacggcagagcaatgtggccaggagacgccactggagaacatgctgttcgcctccttctacctcccacttcccaggcagcccaggatgtgtactgtcaccggccttaccgcaggatccacagcacggagcaaacagcatttggaagtcgtgttcgcagtacttccggccttcaaactgcaaaggggtcgcagagagaggacaagcaaaccacctatcatccccatgagcagcccaggcccttgttgggtcaggacctgacagcaggggatgaggcactgaggcaggggcatgccgggctgaggctggagcagtgggtcccaggcctggccagagaggacactggcccttttgggatggtggggtgcaaagggaggtgcccccgtggaagctggagaggtccgtgaggccacctgtcaaagggccactggtgtctactgaggatctggaccctgttggtccggagaacaggctgggggcgaggcggttttaagccaggagggatgagatccagtctgaagtgtagtgtcacttggtcctatttcgtataccttctctgtgggagtatccagctctctcagaggccatgaagacccgggtataggagacagaaggaagggaacgcaggaagggcctgggcacggggaagtgggaagagctcagggctgcggccagcaggagccagtgtgcacaccctccaggcggcagctgccagcgagggcccctgtgctggccacaagcggggccaaagcctgcctctgctttcctctaacaattgtattttctgttttttaattggtttttccctgttctctaaaatgagtgtcttattagactaaactggatatagccctacccagtgacctgtagagtcaggaagggcttaaactctttcagcaatgaaaatcttctgggcacctgctgtgtgtgagagagagaggctttgttctgggcatatggccacccctcctagagctttgcccacccctcccgctgcctctacacttagacagcattcctcaggaggctgaagacactgtgaggaacagcggctcttgctctgccaggcggaccacaggccccacatccatccaccagccagtcccatcagctctaccttgaaacagagccagcatctgacccctggccaccaccgccaccacaagcacaagtgatgttctggtaaatgctcaacagccagctctctggggcgcagaggcaggccctgctgtggggcgtttgccagtgtccatggtgtgaatattcccgtcatggccaactcctggctgccaacatgacatcgatgtggacttgaggggagatgtgcagtggccacaccagcacaatggacagaaataaccccatcagcatagacgatagtaaagtggaacaaaataattagcaagtggtatgctttgagtatttgttacctttgtttttaataaaattgtatcccattgt

SEQ ID NO: 11560 - DNA, 1177 bp, Homo sapiens
gagaaaatactcccagctggcctgatacccaggcacaggcttctcctaaacacaggtctccccacctgtcaggatgtccaaacggagttggtgggctggatccagaaagcccccaagagagatgctgaaactctcaggctctgactccagccaaagcatgaatggccttgaagtggctcccccaggtctgatcaccaacttctccctggccacggcagagcaatgtggccaggagacgccactggagaacatgctgttcgcctccttctaccttctggattttatcctggctttagttggcaataccctggctctgtggcttttcatccgagaccacaagtccgggaccccggccaacgtgttcctgatgcatctggccgtggccgacttgtcgtgcgtgctggtcctgcccacccgcctggtctaccacttctctgggaaccactggccatttggggaaatcgcatgccgtctcaccggcttcctcttctacctcaacatgtacgccagcatctacttcctcacctgcatcagcgccgaccgtttcctggccattgtgcacccggtcaagtccctcaagctccgcaggcccctctacgcacacctggcctgtgccttcctgtgggtggtggtggctgtggccatggccccgctgctggtgagcccacagaccgtgcagaccaaccacacggtggtctgcctgcagctgtaccgggagaaggcctcccaccatgccctggtgtccctggcagtggccttcaccttcccgttcatcaccacggtcacctgctacctgctgatcatccgcagcctgcggcagggcctgcgtgtggagaagcgcctcaagaccaaggcagtgcgcatgatcgccatagtgctggccatcttcctggtctgcttcgtgccctaccacgtcaaccgctccgtctacgtgctgcactaccgcagccatggggcctcctgcgccacccagcgcatcctggccctggcaaaccgcatcacctcctgcctcaccagcctcaacggggcactcgaccccatcatgtatttcttcgtggctgagaagttccgccacgccctgtgcaacttgctctgtggcaaaaggctcaagggcccgccccccagcttcgaagggaaaaccaacgagagctcgctgagtgccaagtcagagctgtga

SEQ ID NO: 11561 - DNA, 581 bp, Homo sapiens
gaccaagtcagagtactgtggaacctggattcctggggaatggggtccccatgaggaactccacattggactaagaacagaccctgttcctggaagcagcaggaaaccatctctggtgttagaacttcaggcatcttgaaacactctgaagccgggggcaatcttttcaggatgtccaaacggagttggtgggctggatccagaaagcccccaagagagatgctgaaactctcaggctctgactccagccaaagcatgaatggccttgaagtggctcccccaggtctgatcaccaacttctccctggccacggcagagcaatgtggccaggagacgccactggagaacatgctgttcgcctccttctaccttctggattttatcctggctttagttggcaataccctggctctgtggcttttcatccgagaccacaagtccgggaccccggccaacgtgttcctgatgcatctggccgtggccgacttgtcgtgcgtgctggtcctgcccacccgcctggtctaccacttctctgggaaccactggccatttggggaaatcgcatgccgtctcaccggctt

SEQ ID NO: 11562 - DNA, 2598 bp, Homo sapiens
aaacgtcctgttgtgtccctcagctccagcccaagccccccacccagcccccgcctgctctgagtctctgagacagtcacacactcagactatgtggccaagctgggggcggggggcatgggctagggacacactagaatattcacgctccggtggcagcagcagcagcagccagaggagcagcccgacacaacaagggacccctcaggaatgaagcagcctttcagggccagaggggctgtggtctcccttcctctccttaaatagccagcgttccacccacagcggcaaggagccccctgccaccaccgacacccacgggcggagatcacctgctgccccgcagacccctgtcccttcctcccggaccagcagctagagctctccgccctcaccgtggttttagcagtcctagggaaagtgccagccgagaccagccagaccaagtcagagtactgtggaacctggattcctggggaatggggtccccatgaggaactccacattggactaagaacagaccctgttcctggaagcagcaggaaaccatctctggtgttagaacttcaggcatcttgaaacactctgaagccgggggcaatcttttcaggatgtccaaacggagttggtgggctggatccagaaagcccccaagagagatgctgaaactctcaggctctgactccagccaaagcatgaatggccttgaagtggctcccccaggtctgatcaccaacttctccctggccacggcagagcaatgtggccaggagacgccactggagaacatgctgttcgcctccttctaccttctggattttatcctggctttagttggcaataccctggctctgtggcttttcatccgagaccacaagtccgggaccccggccaacgtgttcctgatgcatctggccgtggccgacttgtcgtgcgtgctggtcctgcccacccgcctggtctaccacttctctgggaaccactggccatttggggaaatcgcatgccgtctcaccggcttcctcttctacctcaacatgtacgccagcatctacttcctcacctgcatcagcgccgaccgtttcctggccattgtgcacccggtcaagtccctcaagctccgcaggcccctctacgcacacctggcctgtgccttcctgtgggtggtggtggctgtggccatggccccgctgctggtgagcccacagaccgtgcagaccaaccacacggtggtctgcctgcagctgtaccgggagaaggcctcccaccatgccctggtgtccctggcagtggccttcaccttcccgttcatcaccacggtcacctgctacctgctgatcatccgcagcctgcggcagggcctgcgtgtggagaagcgcctcaagaccaaggcagtgcgcatgatcgccatagtgctggccatcttcctggtctgcttcgtgccctaccacgtcaaccgctccgtctacgtgctgcactaccgcagccatggggcctcctgcgccacccagcgcatcctggccctggcaaaccgcatcacctcctgcctcaccagcctcaacggggcactcgaccccatcatgtatttcttcgtggctgagaagttccgccacgccctgtgcaacttgctctgtggcaaaaggctcaagggcccgccccccagcttcgaagggaaaaccaacgagagctcgctgagtgccaagtcagagctgtgagcggggggcgccgtccaggccgagcgcagactgtttaggactcagcagacccagcaagaggcatctgccctttccccagccacctccccagcaagcaacctgaaatctcagcagatgcccaccatttctctagatcgcctagtctcaacccataaaaaggaagaactgacaaaggggatccatcggccacccctctgcaggggcttgtgatggctacaatggctcctagacactcaacgacttcatctgtggcagggagagaggaggccggaagaacaacccctgaacaatggaggcctttctttcccgctaggctcccagcctccttcccgctacagaatcgctcatcggcgaggctcagcagaaagaccctgaaggcaggctgcaaatgacccagaagagggacctgggagtcctggtggggacggggagggagtctcaatactcctttgcagtgcaaggtactctgagtcccctctgtagtgcctctgccagacacacactgcctgagttgaagagacacaggccacacatttcaggctggttgccagcggacgtcagcactcacggcctgcagggactcagcacagctctggattctggatctctcctgctgtaaccccacgcacaagcctgcaacccccagagctctttgacaggctcccaggcctcccagtcctggacaagcatgtgcagtcacgggagctcagctcaggccagggctgggctgtgcacctgcctcccactgacccagacccacttcctccagagaggcctctctccgcctgagctatttcccttgctagtgtgcagatatttccctaacatgtccttttttgtatttgtttgtacggaccataaatataactgtagctttaagact

SEQ ID NO: 11563 - DNA, 1896 bp, Homo sapiens
ggcccggaaccgccacgggtgagtcgggtcgtggctgctgccgggtcctgcgcgctccggactgaggtggcgtccctgggccggacggcggtgtcccggcgtggcgggaagccggcactggagcgggagcgcactgggcgcgggaccgggaggcgcagggaccggacggctcccgagtcgcccacctgacgctagaagaagtcttcacttcccaggagagccaaagcgtgtctggccctaggtgggaaaagaactggctgtgacctttgccctgacctggaagggcccagccttgggctgaatggcagcacccacgcccgcccgtccggtgctgacccacctgctggtggctctcttcggcatgggctcctgggctgcggtcaatgggatctgggtggagctacctgtggtggtcaaagagcttccagagggttggagcctcccctcttacgtctctgtgcttgtggctctggggaacctgggtctgctggtggtgaccctctggaggaggctggccccaggaaaggacgagcaggtccccatccgggtggtgcaggtgctgggcatggtgggcacagccctgctggcctctctgtggcaccatgtggccccagtggcaggacagttgcattctgtggccttcttagcactggcctttgtgctggcactggcatgctgtgcctcgaatgtcactttcctgcccttcttgagccacctgccacctcgcttcttacggtcattcttcctgggtcaaggcctgagtgccctgctgccctgcgtgctggccctagtgcagggtgtgggccgcctcgagtgcccgccagcccccatcaacggcacccctggccccccgctcgacttccttgagcgttttcccgccagcaccttcttctgggcactgactgcccttctggtcgcttcagctgctgccttccagggtcttctgctgctgttgccgccaccaccatctgtacccacaggggagttaggatcaggcctccaggtgggagccccaggagcagaggaagaggtggaagagtcctcaccactgcaagagccaccaagccaggcagcaggcaccacccctggtccagaccctaaggcctatcagcttctatcagcccgcagtgcctgcctgctgggcctgttggccgccaccaacgcgctgaccaatggcgtgctgcctgccgtgcagagcttttcctgcttaccctacgggcgtctggcctaccacctggctgtggtgctgggcagtgctgccaatcccctggcctgcttcctggccatgggtgtgctgtgcaggtccttggcagggctgggcggcctctctctgctgggcgtgttctgtgggggctacctgatggcgctggcagtcctgagcccctgcccgcccctggtgggcacctcggcgggggtggtcctcgtggtgctgtcgtgggtgctgtgtcttggcgtgttctcctacgtgaaggtggcagccagctccctgctgcatggcgggggccggccggcattgctggcagccggcgtggccatccaggtgggctctctgctcggcgctgttgctatgttccccccgaccagcatctatcacgtgttccacagcagaaaggactgtgcagacccctgtgactcctgagcctgggcaggtggggaccccgctccccaacacctgtctttccctcaatgctgccaccatgcctgagtgcctgcagcccaggaggcccgcacaccggtacactcgtggacacctacacactccataggagatcctggctttccagggtgggcaagggcaaggagcaggcttggagccagggaccagtgggggctgtagggtaagcccctgagcctgggacctacatgtggtttgcgtaataaaacatttgtatttaa

SEQ ID NO: 11564 - DNA, 1777 bp, Homo sapiens
atgccgggggcgggcccggaaccgccacgggtgagtcgggtcgtggctgctgccgggtcctgcgcgctccggactgagaagaagtcttcacttcccaggagagccaaagcgtgtctggccctaggtgggaaaagaactggctgtgacctttgccctgacctggaagggcccagccttgggctgaatggcagcacccacgcccgcccgtccggtgctgacccacctgctggtggctctcttcggcatgggctcctgggctgcggtcaatgggatctgggtggagctacctgtggtggtcaaagagcttccagagggttggagcctcccctcttacgtctctgtgcttgtggctctggggaacctgggtctgctggtggtgaccctctggaggaggctggccccaggaaaggacgagcaggtccccatccgggtggtgcaggtgctgggcatggtgggcacagccctgctggcctctctgtggcaccatgtggccccagtggcaggacagttgcattctgtggccttcttagcactggcctttgtgctggcactggcatgctgtgcctcgaatgtcactttcctgcccttcttgagccacctgccacctcgcttcttacggtcattcttcctgggtcaaggcctgagtgccctgctgccctgcgtgctggccctagtgcagggtgtgggccgcctcgagtgcccgccagcccccatcaacggcacccctggccccccgctcgacttccttgagcgttttcccgccagcaccttcttctgggcactgactgcccttctggtcgcttcagctgctgccttccagggtcttctgctgctgttgccgccaccaccatctgtacccacaggggagttaggatcaggcctccaggtgggagccccaggagcagaggaagaggtggaagagtcctcaccactgcaagagccaccaagccaggcagcaggcaccacccctggtccagaccctaaggcctatcagcttctatcagcccgcagtgcctgcctgctgggcctgttggccgccaccaacgcgctgaccaatggcgtgctgcctgccgtgcagagcttttcctgcttaccctacgggcgtctggcctaccacctggctgtggtgctgggcagtgctgccaatcccctggcctgcttcctggccatgggtgtgctgtgcaggtccttggcagggctgggcggcctctctctgctgggcgtgttctgtgggggctacctgatggcgctggcagtcctgagcccctgcccgcccctggtgggcacctcggcgggggtggtcctcgtggtgctgtcgtgggtgctgtgtcttggcgtgttctcctacgtgaaggtggcagccagctccctgctgcatggcgggggccggccggcattgctggcagccggcgtggccatccaggtgggctctctgctcggcgctgttgctatgttccccccgaccagcatctatcacgtgttccacagcagaaaggactgtgcagacccctgtgactcctgagcctgggcaggtggggaccccgctccccaacacctgtctttccctcaatgctgccaccatgcctgagtgcctgcagcccaggaggcccgcacaccggtacactcgtggacacctacacactccataggagatcctggctttccagggtgggcaagggcaaggagcaggcttggagccagggaccagtgggggctgtagggtaagcccctgagcctgggacctacatgtggtttgcgtaataaaacatttgtattt

SEQ ID NO: 11565 - DNA, 1790 bp, Homo sapiens
cttccggtcgtgggccatgccgggggcgggcccggaaccgccacgggtgagtcgggtcgtggctgctgccgggtcctgcgcgctccggactgaggtggcgtccctgggccggacggcggtgtcccggcgtggcgggaagccggcactggagcgggagcgcactgggcgcgggaccgggaggcgcagggaccggacggctcccgagtcgcccacctgacggtaccgagagggcggcgcccctccgagcagagccgtcccggccactcccctgggatctgacttggctcttgcggtcgcgggcaccgtgaagccctggggtgtgcgtggctcctcctgctagaagaagtcttcacttcccaggagagccaaagcgtgtctggccctaggtgggaaaagaactggctgtgacctttgccctgacctggaagggcccagccttgggctgaatggcagcacccacgcccgcccgtccggtgctgacccacctgctggtggctctcttcggcatgggctcctgggctgcggtcaatgggatctgggtggagctacctgtggtggtcaaagagcttccagagggttggagcctcccctcttacgtctctgtgcttgtggctctggggaacctgggtctgctggtggtgaccctctggaggaggctggccccaggaaaggacgagcaggtccccatccgggtggtgcaggtgctgggcatggtgggcacagccctgctggcctctctgtggcaccatgtggccccagtggcaggacagttgcattctgtggccttcttagcactggcctttgtgctggcactggcatgctgtgcctcgaatgtcactttcctgcccttcttgagccacctgccacctcgcttcttacggtcattcttcctgggtcaaggcctgagtgccctgctgccctgcgtgctggccctagtgcagggtgtgggccgcctcgagtgcccgccagcccccatcaacggcacccctggccccccgctcgacttccttgagcgttttcccgccagcaccttcttctgggcactgactgcccttctggtcgcttcagctgctgccttccagggtcttctgctgctgttgccgccaccaccatctgtacccacaggggagttaggatcaggcctccaggtgggagccccaggagcagaggaagaggtggaagagtcctcaccactgcaagagccaccaagccaggcagcaggcaccacccctggtccagaccctaaggcctatcagcttctatcagcccgcagtgcctgcctgctgggcctgttggccgccaccaacgcgctgaccaatggcgtgctgcctgccgtgcagagcttttcctgcttaccctacgggcgtctggcctaccacctggctgtggtgctgggcagtgctgccaatcccctggcctgcttcctggccatgggtgtgctgtgcaggtccttggcagggctgggcggcctctctctgctgggcgtgttctgtgggggctacctgatggcgctggcagtcctgagcccctgcccgcccctggtgggcacctcggcgggggtggtcctcgtggtgctgtcgtgggtgctgtgtcttggcgtgttctcctacgtgaaggtggcagccagctccctgctgcatggcgggggccggccggcattgctggcagccggcgtggccatccaggtgggctctctgctcggcgctgttgctatgttccccccgaccagcatctatcacgtgttccacagcagaaaggactgtgcagacccctgtgactcctgagcctgg

SEQ ID NO: 11566 - DNA, 1757 bp, Homo sapiens
gggcgggacttccggtcgtgggccatgccgggggcgggcccggaaccgccacggctagaagaagtcttcacttcccaggagagccaaagcgtgtctggccctaggtgggaaaagaactggctgtgacctttgccctgacctggaagggcccagccttgggctgaatggcagcacccacgcccgcccgtccggtgctgacccacctgctggtggctctcttcggcatgggctcctgggctgcggtcaatgggatctgggtggagctacctgtggtggtcaaagagcttccagagggttggagcctcccctcttacgtctctgtgcttgtggctctggggaacctgggtctgctggtggtgaccctctggaggaggctggccccaggaaaggacgagcaggtccccatccgggtggtgcaggtgctgggcatggtgggcacagccctgctggcctctctgtggcaccatgtggccccagtggcaggacagttgcattctgtggccttcttagcactggcctttgtgctggcactggcatgctgtgcctcgaatgtcactttcctgcccttcttgagccacctgccacctcgcttcttacggtcattcttcctgggtcaaggcctgagtgccctgctgccctgcgtgctggccctagtgcagggtgtgggccgcctcgagtgcccgccagcccccatcaacggcacccctggccccccgctcgacttccttgagcgttttcccgccagcaccttcttctgggcactgactgcccttctggtcgcttcagctgctgccttccagggtcttctgctgctgttgccgccaccaccatctgtacccacaggggagttaggatcaggcctccaggtgggagccccaggagcagaggaagaggtggaagagtcctcaccactgcaagagccaccaagccaggcagcaggcaccacccctggtccagaccctaaggcctatcagcttctatcagcccgcagtgcctgcctgctgggcctgttggccgccaccaacgcgctgaccaatggcgtgctgcctgccgtgcagagcttttcctgcttaccctacgggcgtctggcctaccacctggctgtggtgctgggcagtgctgccaatcccctggcctgcttcctggccatgggtgtgctgtgcaggtccttggcagggctgggcggcctctctctgctgggcgtgttctgtgggggctacctgatggcgctggcagtcctgagcccctgcccgcccctggtgggcacctcggcgggggtggtcctcgtggtgctgtcgtgggtgctgtgtcttggcgtgttctcctacgtgaaggtggcagccagctccctgctgcatggcgggggccggccggcattgctggcagccggcgtggccatccaggtgggctctctgctcggcgctgttgctatgttccccccgaccagcatctatcacgtgttccacagcagaaaggactgtgcagacccctgtgactcctgagcctgggcaggtggggaccccgctccccaacacctgtctttccctcaatgctgccaccatgcctgagtgcctgcagcccaggaggcccgcacaccggtacactcgtggacacctacacactccataggagatcctggctttccagggtgggcaagggcaaggagcaggcttggagccagggaccagtgggggctgtagggtaagcccctgagcctgggacctacatgtggtttgcgtaataaaacatttgtattt

SEQ ID NO: 11567 - DNA, 2147 bp, Homo sapiens
ggcccggaaccgccacgggtgagtcgggtcgtggctgctgccgggtcctgcgcgctccggactgaggtggcgtccctgggccggacggcggtgtcccggcgtggcgggaagccggcactggagcgggagcgcactgggcgcgggaccgggaggcgcagggaccggacggctcccgagtcgcccacctgacggtaccgagagggcggcgcccctccgagcagagccgtcccggccactcccctgggatctgacttggctcttgcggtcgcgggcaccgtgaagccctggggtgtgcgtggctcctcctggtaggcgccctttcccggcgtccggcttggggtggtggtggcgttgactccagccccgcctctccctggagaggagggctccactcgctccttcggcctcctcccctggggccgcagcgactcgggccggcttcctgcttccctgcctgccggcggtcccgctggctagaagaagtcttcacttcccaggagagccaaagcgtgtctggccctaggtgggaaaagaactggctgtgacctttgccctgacctggaagggcccagccttgggctgaatggcagcacccacgcccgcccgtccggtgctgacccacctgctggtggctctcttcggcatgggctcctgggctgcggtcaatgggatctgggtggagctacctgtggtggtcaaagagcttccagagggttggagcctcccctcttacgtctctgtgcttgtggctctggggaacctgggtctgctggtggtgaccctctggaggaggctggccccaggaaaggacgagcaggtccccatccgggtggtgcaggtgctgggcatggtgggcacagccctgctggcctctctgtggcaccatgtggccccagtggcaggacagttgcattctgtggccttcttagcactggcctttgtgctggcactggcatgctgtgcctcgaatgtcactttcctgcccttcttgagccacctgccacctcgcttcttacggtcattcttcctgggtcaaggcctgagtgccctgctgccctgcgtgctggccctagtgcagggtgtgggccgcctcgagtgcccgccagcccccatcaacggcacccctggccccccgctcgacttccttgagcgttttcccgccagcaccttcttctgggcactgactgcccttctggtcgcttcagctgctgccttccagggtcttctgctgctgttgccgccaccaccatctgtacccacaggggagttaggatcaggcctccaggtgggagccccaggagcagaggaagaggtggaagagtcctcaccactgcaagagccaccaagccaggcagcaggcaccacccctggtccagaccctaaggcctatcagcttctatcagcccgcagtgcctgcctgctgggcctgttggccgccaccaacgcgctgaccaatggcgtgctgcctgccgtgcagagcttttcctgcttaccctacgggcgtctggcctaccacctggctgtggtgctgggcagtgctgccaatcccctggcctgcttcctggccatgggtgtgctgtgcaggtccttggcagggctgggcggcctctctctgctgggcgtgttctgtgggggctacctgatggcgctggcagtcctgagcccctgcccgcccctggtgggcacctcggcgggggtggtcctcgtggtgctgtcgtgggtgctgtgtcttggcgtgttctcctacgtgaaggtggcagccagctccctgctgcatggcgggggccggccggcattgctggcagccggcgtggccatccaggtgggctctctgctcggcgctgttgctatgttccccccgaccagcatctatcacgtgttccacagcagaaaggactgtgcagacccctgtgactcctgagcctgggcaggtggggaccccgctccccaacacctgtctttccctcaatgctgccaccatgcctgagtgcctgcagcccaggaggcccgcacaccggtacactcgtggacacctacacactccataggagatcctggctttccagggtgggcaagggcaaggagcaggcttggagccagggaccagtgggggctgtagggtaagcccctgagcctgggacctacat

SEQ ID NO: 11568 - DNA, 1676 bp, Homo sapiens
ccttcggcctcctcccctggggccgcagcgactcgggccggcttcctgcttccctgcctgccggcggtcccgctggctagaagaagtcttcacttcccaggagagccaaagcgtgtctggccctaggtgggaaaagaactggctgtgacctttgccctgacctggaagggcccagccttgggctgaatggcagcacccacgcccgcccgtccggttggagcctcccctcttacgtctctgtgcttgtggctctggggaacctgggtctgctggtggtgaccctctggaggaggctggccccaggaaaggacgagcaggtccccatccgggtggtgcaggtgctgggcatggtgggcacagccctgctggcctctctgtggcaccatgtggccccagtggcaggacagttgcattctgtggccttcttagcactggcctttgtgctggcactggcatgctgtgcctcgaatgtcactttcctgcccttcttgagccacctgccacctcgcttcttacggtcattcttcctgggtcaaggcctgagtgccctgctgccctgcgtgctggccctagtgcagggtgtgggccgcctcgagtgcccgccagcccccatcaacggcacccctggccccccgctcgacttccttgagcgttttcccgccagcaccttcttctgggcactgactgcccttctggtcgcttcagctgctgccttccagggtcttctgctgctgttgccgccaccaccatctgtacccacaggggagttaggatcaggcctccaggtgggagccccaggagcagaggaagaggtggaagagtcctcaccactgcaagagccaccaagccaggcagcaggcaccacccctggtccagaccctaaggcctatcagcttctatcagcccgcagtgcctgcctgctgggcctgttggccgccaccaacgcgctgaccaatggcgtgctgcctgccgtgcagagcttttcctgcttaccctacgggcgtctggcctaccacctggctgtggtgctgggcagtgctgccaatcccctggcctgcttcctggccatgggtgtgctgtgcaggtccttggcagggctgggcggcctctctctgctgggcgtgttctgtgggggctacctgatggcgctggcagtcctgagcccctgcccgcccctggtgggcacctcggcgggggtggtcctcgtggtgctgtcgtgggtgctgtgtcttggcgtgttctcctacgtgaaggtggcagccagctccctgctgcatggcgggggccggccggcattgctggcagccggcgtggccatccaggtgggctctctgctcggcgctgttgctatgttccccccgaccagcatctatcacgtgttccacagcagaaaggactgtgcagacccctgtgactcctgagcctgggcaggtggggaccccgctccccaacacctgtctttccctcaatgctgccaccatgcctgagtgcctgcagcccaggaggcccgcacaccggtacactcgtggacacctacacactccataggagatcctggctttccagggtgggcaagggcaaggagcaggcttggagccagggaccagtgggggctgtagggtaagcccctgagcctgggacctacatgtggtttgcgtaataaaacatttgtattt

SEQ ID NO: 11569 - DNA, 2377 bp, Homo sapiens
gcaaaagcgctagggttgcaagtggcaccagagacgtgcccttgtcccggggtccatttgagggtgagcgtgttggtgccgagctgtttttttgttttgttttgttttgttttgtttttgagaccgaatctcgttctgtcgcccaggctggaatgcagtggtgtgatcttggctcactgcaacctccaccttccgggttcaagtgaatctcctgcctcagcctcctgagtagctgggattactggcacccaccaccacgaccagctaatttttgtatttttagtagagacgggttttcaccatgttggccaggatggtctcaatctcctgacctcaggcgatctgccttcctcagcttcccaaagtgctgggattacaggtgtgagccaccgcacccggccagtgctgagctgttttgacaacttggaccccgggtcctctgtgggtaggaaaatcagctccctctttgctcctctggggcagctgcacctcgggccagctttctgcctgtctgcctgccggcactgctgggtcgctgtacccaaacgcacagccggtgccccgtgctagaaggtcttcagtttccagaagaaccaaagcatctttggacctacctagggaaggacctgcctgtgacctttgccctgtcctggagggtccagctttgggctgaatggcagcacccacgctgggccgtctggtgctgacccacctgctggtggccctttttggcatgggctcctgggctgctgtgaacgggatctgggtggagctgcctgtggtggtaaaagaccttccagagggttggagcctcccctcatacctctctgtggttgtggcgctgggaaacctgggtctgctggtggtgaccctgtggaggcagctggccccgggcaagggcgagcaggtccccatccaggtggtacaggtgctgagtgtagtgggcacagccctgctggcccctctgtggcaccacgtggccccagtggcagggcagctccactctgtggccttcctaactctggccttggtgttggcaatggcctgttgtacctctaatgtcactttcctgcccttcctgagccacctgccacctcctttcttacggtctttcttcctgggtcagggtctcagtgccctactcccctgtgtgctggccctagtgcaaggtgtgggccgcctcgagtgcccaccagcgcccaccaatggcacctctgggcctcccctcgacttccctgagcgttttcctgccagcaccttcttctgggcactgactgcccttctggtcacttcagctgccgccttccggggtctcctgttgctgttgccatcactaccctctgtaaccacagggggctcagggcctgaacttcaactgggatccccaggagcagaggaggaagagaaggaggaagaagaggctttgccattgcaggagccaccgagccaggcagcaggcaccatccctggcccagaccctgaggcccatcagctgttctcagcccatggtgccttcctgctgggcctgatggccttcaccagtgccgtgaccaatggcgtgctgccttctgtgcagagcttttcctgtttgccctatgggcgcctggcctaccacctggctgtggtgctgggcagtgccgccaacccccttgcctgcttcctggccatgggcgtgctgtgcaggtccctggcagggctggttggtctttctctgctgggcatgctctttggggcctacctgatggcactggcaatcctgagcccctgcccacccctggtgggcaccactgcaggggtggtccttgtggtgctgtcgtgggtgctgtgtctgtgtgtgttctcatatgtgaaggtggctgcaagctccctgctgcatggtgggggtcggccggcattgctggcagctggtgtggccatccaagtgggctccctgcttggtgccggtgccatgttccctcccaccagcatctaccacgtgtttcaaagcagaaaggactgtgtagacccctgtggcccctgagcctgggcaggtggggacccaactccaccccacctgtcttcatcgtgaggctgccacagtgcctgactacttgtggcccaggcaggcttcccccaacacaggaacgctcatggacacctgcacactccacagaagacgttggcatgtgaggccagggtgggcaccaaagaccaggcccagagccaggggacaggttggggctgtgggcttggacccagggcctgagacctttgtgggatttgtgcaataaagtgtttttatttaaaaccaaaaacaaaaacaaaagcctaatgaaaaccttataagaaatatataatgaaatcaggaaactggattaaataatttttcatacatata

SEQ ID NO: 11570 - DNA, 2412 bp, Homo sapiens
agtgtcgcaaaagcgctagggttgcaagtggcaccagagacgtgcccttgtcccggggtccatttgagggtgagcgtgttggtgccgagctgtttttttgttttgttttgttttgttttgtttttgagaccgaatctcgttctgtcgcccaggctggaatgcagtggtgtgatcttggctcactgcaacctccaccttccgggttcaagtgaatctcctgcctcagcctcctgagtagctgggattactggcacccaccaccacgaccagctaatttttgtatttttagtagagacgggttttcaccatgttggccaggatggtctcaatctcctgacctcaggcgatctgccttcctcagcttcccaaagtgctgggattacaggtgtgagccaccgcacccggccagtgctgagctgttttgacaacttggaccccgggtcctctgtgggtaggaaaatcagctccctctttgctcctctggggcagctgcacctcgggccagctttctgcctgtctgcctgccggcactgctgggtcgctgtacccaaacgcacagccggtgccccgtgcctattacctgccagcctgtctgtttccctccagctagaaggtcttcagtttccagaagaaccaaagcatctttggacctacctagggaaggacctgcctgtgacctttgccctgtcctggagggtccagctttgggctgaatggcagcacccacgctgggccgtctggtgctgacccacctgctggtggccctttttggcatgggctcctgggctgctgtgaacgggatctgggtggagctgcctgtggtggtaaaagaccttccagagggttggagcctcccctcatacctctctgtggttgtggcgctgggaaacctgggtctgctggtggtgaccctgtggaggcagctggccccgggcaagggcgagcaggtccccatccaggtggtacaggtgctgagtgtagtgggcacagccctgctggcccctctgtggcaccacgtggccccagtggcagggcagctccactctgtggccttcctaactctggccttggtgttggcaatggcctgttgtacctctaatgtcactttcctgcccttcctgagccacctgccacctcctttcttacggtctttcttcctgggtcagggtctcagtgccctactcccctgtgtgctggccctagtgcaaggtgtgggccgcctcgagtgcccaccagcgcccaccaatggcacctctgggcctcccctcgacttccctgagcgttttcctgccagcaccttcttctgggcactgactgcccttctggtcacttcagctgccgccttccggggtctcctgttgctgttgccatcactaccctctgtaaccacagggggctcagggcctgaacttcaactgggatccccaggagcagaggaggaagagaaggaggaagaagaggctttgccattgcaggagccaccgagccaggcagcaggcaccatccctggcccagaccctgaggcccatcagctgttctcagcccatggtgccttcctgctgggcctgatggccttcaccagtgccgtgaccaatggcgtgctgccttctgtgcagagcttttcctgtttgccctatgggcgcctggcctaccacctggctgtggtgctgggcagtgccgccaacccccttgcctgcttcctggccatgggcgtgctgtgcaggtccctggcagggctggttggtctttctctgctgggcatgctctttggggcctacctgatggcactggcaatcctgagcccctgcccacccctggtgggcaccactgcaggggtggtccttgtggtgctgtcgtgggtgctgtgtctgtgtgtgttctcatatgtgaaggtggctgcaagctccctgctgcatggtgggggtcggccggcattgctggcagctggtgtggccatccaagtgggctccctgcttggtgccggtgccatgttccctcccaccagcatctaccacgtgtttcaaagcagaaaggactgtgtagacccctgtggcccctgagcctgggcaggtggggacccaactccaccccacctgtcttcatcgtgaggctgccacagtgcctgactacttgtggcccaggcaggcttcccccaacacaggaacgctcatggacacctgcacactccacagaagacgttggcatgtgaggccagggtgggcaccaaagaccaggcccagagccaggggacaggttggggctgtgggcttggacccagggcctgagacctttgtgggatttgtgcaataaagtgtttttatttaaaaccaaaaacaaaaacaaaagcctaatgaaaaccttataagaaatatataatgaaatcaggaaactggattaaataatttttcatac

SEQ ID NO: 11571 - DNA, 2989 bp, Homo sapiens
tcggcctcccaaagtgctgggattacaggcctgagccacggtgcctggcctatctttcattttcaaagcttgtttttgagtggtggcatggggcacacccctgtactgctaatgcaaaggaatattagaatcaccatttgtgaaagaaacttggcagtctgttacaagagcctcagctatgtcatacagtttcacccaataattctatttcaagagacttatccaggaaaaaaaaaaaaaaaaagaccaaaataagaaaagctttgtaatgagcccttgttgcttttacctacccagtgcctctgttcctcttctggtaactgaattcctccttcatctaccaatttatagcagcagggtttgagattctttcactgaattccaaccaatcaaattatctgaaaagtattatttttcttttttcagacagggtctcgctctttcacccaggctggagcacggtggtgtgaccccagttcactgaagcctcaacctcctgggctcaagggatcctcccacctcagcctcctgagtagctgggactataggtgcacatcagcatgcccaactaaattttattttttgtagagatggggtttcgccatgttgcttgggctggtctcgaactcctgggctcctgcgatccgcccatctcagcctcccagagtgctgggactacaggcatgggccattgcacctggcctttaaaatattcttttcttttcaagtgagaaatggtatcctactgatgtcttaatttgcctttctttgatatatacagtcagggagagcatcttttccacatgtctattggccatgtgtatttcccatgaaatatttcataccacccccctcaccattttacaatatgatctttatcaatgtcacagtgataggatatgtctctaacctgtatcttttattttctttctttccttttttttttttttgatacggagttttcctcttgtcgtccagtctggaatgcaatgacatgatctcggctcaccacaatctccgcctcccgggttcaagcaattctcctgcctcagcctcccgagtagctgggattacaggcatgtgccaccatgcccggctaattttgtatttttagtagagacagggtttcgccatgttggtcaggctggtctcgaactcctgacctcaggtgatccacgcccccttagcgtcccaaagtgctgggattacaggcacgaactactatgcctgggattaacctgtatcttttgacttattaacttgtctgtgcttactggagtggcactctgagctgagcctggacagctagaaggtcttcagtttccagaagaaccaaagcatctttggacctacctagggaaggacctgcctgtgacctttgccctgtcctggagggtccagctttgggctgaatggcagcacccacgctgggccgtctggtgctgacccacctgctggtggccctttttggcatgggctcctgggctgctgtgaacgggatctgggtggagctgcctgtggtggtaaaagaccttccagagggttggagcctcccctcatacctctctgtggttgtggcgctgggaaacctgggtctgctggtggtgaccctgtggaggcagctggccccgggcaagggcgagcaggtccccatccaggtggtacaggtgctgagtgtagtgggcacagccctgctggcccctctgtggcaccacgtggccccagtggcagggcagctccactctgtggccttcctaactctggccttggtgttggcaatggcctgttgtacctctaatgtcactttcctgcccttcctgagccacctgccacctcctttcttacggtctttcttcctgggtcagggtctcagtgccctactcccctgtgtgctggccctagtgcaaggtgtgggccgcctcgagtgcccaccagcgcccaccaatggcacctctgggcctcccctcgacttccctgagcgttttcctgccagcaccttcttctgggcactgactgcccttctggtcacttcagctgccgccttccggggtctcctgttgctgttgccatcactaccctctgtaaccacagggggctcagggcctgaacttcaactgggatccccaggagcagaggaggaagagaaggaggaagaagaggctttgccattgcaggagccaccgagccaggcagcaggcaccatccctggcccagaccctgaggcccatcagctgttctcagcccatggtgccttcctgctgggcctgatggccttcaccagtgccgtgaccaatggcgtgctgccttctgtgcagagcttttcctgtttgccctatgggcgcctggcctaccacctggctgtggtgctgggcagtgccgccaacccccttgcctgcttcctggccatgggcgtgctgtgcaggtgctgtcgtgggtgctgtgtctgtgtgtgttctcatatgtgaaggtggctgcaagctccctgctgcatggtgggggtcggccggcattgctggcagctggtgtggccatccaagtgggctccctgcttggtgccggtgccatgttccctcccaccagcatctaccacgtgtttcaaagcagaaaggactgtgtagacccctgtggcccctgagcctgggcaggtggggacccaactccaccccacctgtcttcatcgtgaggctgccacagtgcctgactacttgtggcccaggcaggcttcccccaacacaggaacgctcatggacacctgcacactccacagaagacgttggcatgtgaggccagggtgggcaccaaagaccaggcccagagccaggggacaggttggggctgtgggcttggacccagggcctgagacctttgtgggatttgtgcaataaagtgtttttatttaaaaccaaaaacaaaaacaaaagcctaatgaaaaccttataagaaatatataatgaaatcaggaaactggattaaataatttttcatacat

SEQ ID NO: 11572 - DNA, 1755 bp, Homo sapiens
cattctgatgcccgagtccaagtggcttttccagcgacacatctttggtctttgttctcagtgttgggggttgcgttgtgaggtgttgtctcttcatgagaaggcagtgtgacgtagtgatcacatcccaggctctggagttcaactgcttctgtctgaatgccagctccactgcttcttatttctagaactttgggaaacttcatggtgttatggtcaacttgccgcacaaccgtgttcaaatctgtcaccaacaggttcattaaaaacctggcctgctcggggatttgtgccagcctggtctgtgtgcccttcgacatcatcctcagcaccagtcctcactgttgctggtggatctacaccatgctcttctgcaaggtcgtcaaatttttgcacaaagtattctgctctgtgaccatcctcagcttccctgctattgctttggacaggtactactcagtcctctatccactggagaggaaaatatctgatgccaagtcccgtgaactggtgatgtacatctgggcccatgcagtggtggccagtgtccctgtgtttgcagtaaccaatgtggctgacatctatgccacgtccacctgcacggaagtctggagcaactccttgggccacctggtgtacgttctggtgtataacatcaccacggtcattgtgcctgtggtggtggtgttcctcttcttgatactgatccgacgggccctgagtgccagccagaagaagaaggtcatcatagcagcgctccggaccccacagaacaccatctctattccctatgcctcccagcgggaggccgagctgcacgccaccctgctctccatggtgatggtcttcatcttgtgtagcgtgccctatgccaccctggtcgtctaccagactgtgctcaatgtccctgacacttccgtcttcttgctgctcactgctgtttggctgcccaaagtctccctgctggcaaaccctgttctctttcttactgtgaacaaatctgtccgcaagtgcttgatagggaccctggtgcaactacaccaccggtacagtcgccgtaatgtggtcagtacagggagtggcatggctgaggccagcctggaacccagcatacgctcgggtagccagctcctggagatgttccacattgggcagcagcagatctttaagcccacagaggatgaggaagagagtgaggccaagtacattggctcagctgacttccaggccaaggagatatttagcacctgcctggagggagagcaggggccacagtttgcgccctctgccccacccctgagcacagtggactctgtatcccaggtggcaccggcagcccctgtggaacctgaaacattccctgataagtattccctgcagtttggctttgggccttttgagttgcctcctcagtggctctcagagacccgaaacagcaagaagcggctgcttccccccttgggcaacaccccagaagagctgatccagacaaaggtgcccaaggtaggcagggtggagcggaagatgagcagaaacaataaagtgagcatttttccaaaggtggattcctagcaaggattgtaaattcttggaagcaacggggagcttccatattcccaccagagtgtgggaatgctgtggccatgtgattgtatgatctccttgcaactcagtgtgagttgattcctccaatatgggccagatgcttttgaatgatagggaaatctacataaaatccagtgtcctctttattga

SEQ ID NO: 11573 - DNA, 2816 bp, Homo sapiens
tgggggcgtcctccttcgtccccgcccggctgtcaagctgtgttctagcggccgagggaccgaggggggctaagaaagggggcgcccagccatgcagaggcaaaaaggcgctgcggaacggggtccccgtcgccagtgctgaggcaggaggtcggagccacaagtgaggggctgggaagcaggacccagcacgggcgtcttggcaggcggccgggcgcagggccaggctgctggggacgctcagggctttccacccaagccatgggcgctgtcgggcactcgggggtcccctcgtggctccggccactcggcgtgggcattacgttggcttcacatcgccatccagcctcgaagccaacaggactgaaaaatagcttcggccaaacgttctcctcccgctaaggagaggggtcgagtgcgtcagcccgaggggactggagagggatgccctagccctcgaggggcggaggacccgcggttgaaggaggcagcgggagcggagagcgccctccttgaccatcgaatgcctccttctgtgtttccattcctgtcgagtgggctgggccacgctgaccaccctggaggagggacggacgacgctcggcgggctctgaccgtgccgccttcttgtggctgctgactgggatccaggagggagtgggcatggggcgcagccgcgcctccctccctccccgcctcccgggcgccggggttggcgatgtggagacgtgaggggacccgtcggctgctccggcttctccaggactccgccaggcgcccgcgcgtccctcctcacccggaggaggagaggctccgcgcggggctccgaggcgggcggcgcgcggagccggagtcccagcctcgccatgggacataacgggagctggatctctccaaatgccagcgagccgcacaacgcgtccggcgccgaggctgcgggtgtgaaccgcagcgcgctcggggagttcggcgaggcgcagctgtaccgccagttcaccaccaccgtgcaggtcgtcatcttcataggctcgctgctcggaaacttcatggtgttatggtcaacttgccgcacaaccgtgttcaaatctgtcaccaacaggttcattaaaaacctggcctgctcggggatttgtgccagcctggtctgtgtgcccttcgacatcatcctcagcaccagtcctcactgttgctggtggatctacaccatgctcttctgcaaggtcgtcaaatttttgcacaaagtattctgctctgtgaccatcctcagcttccctgctattgctttggacaggtactactcagtcctctatccactggagaggaaaatatctgatgccaagtcccgtgaactggtgatgtacatctgggcccatgcagtggtggccagtgtccctgtgtttgcagtaaccaatgtggctgacatctatgccacgtccacctgcacggaagtctggagcaactccttgggccacctggtgtacgttctggtgtataacatcaccacggtcattgtgcctgtggtggtggtgttcctcttcttgatactgatccgacgggccctgagtgccagccagaagaagaaggtcatcatagcagcgctccggaccccacagaacaccatctctattccctatgcctcccagcgggaggccgagctgcacgccaccctgctctccatggtgatggtcttcatcttgtgtagcgtgccctatgccaccctggtcgtctaccagactgtgctcaatgtccctgacacttccgtcttcttgctgctcactgctgtttggctgcccaaagtctccctgctggcaaaccctgttctctttcttactgtgaacaaatctgtccgcaagtgcttgatagggaccctggtgcaactacaccaccggtacagtcgccgtaatgtggtcagtacagggagtggcatggctgaggccagcctggaacccagcatacgctcgggtagccagctcctggagatgttccacattgggcagcagcagatctttaagcccacagaggatgaggaagagagtgaggccaagtacattggctcagctgacttccaggccaaggagatatttagcacctgcctggagggagagcaggggccacagtttgcgccctctgccccacccctgagcacagtggactctgtatcccaggtggcaccggcagcccctgtggaacctgaaacattccctgataagtattccctgcagtttggctttgggccttttgagttgcctcctcagtggctctcagagacccgaaacagcaagaagcggctgcttccccccttgggcaacaccccagaagagctgatccagacaaaggtgcccaaggtaggcagggtggagcggaagatgagcagaaacaataaagtgagcatttttccaaaggtggattcctagcaaggattgtaaattcttggaagcaacggggagcttccatattcccaccagagtgtgggaatgctgtggccatgtgattgtatgatctccttgcaactcagtgtgagttgattcctccaatatgggccagatgcttttgaatgatagggaaatctacataaaatccagtgtcctctttattgagggagtatatgtatccatctcagtgatccatgtccttagtgaagtccacattattctctgtggggacaagagctgggcagttttgaatgggtcttgaggtgggtaccccatgtgcactttctgaggatgcctcacttccctgggctctgcagagaacacacagagagaagactttcagagctcacaggagcagggagcaggagcactctaagggaattc

SEQ ID NO: 11574 - DNA, 2816 bp, Homo sapiens; identical to SEQ ID NO: 11573

SEQ ID NO: 11575 - DNA, 1698 bp, Homo sapiens
agtaaaatgtcacactgcaaactctgggcctggggtcccatgggacttcagtggttccaggactgatttcactgccatcacttatatatgatgatgcagacttcaagcatcaaagtacacaaactgaagaaactttatcctttgtatataattatcttaaatatatgccatcatttcaaggggagcttatgctaagtgtgacttcataaacaaatcatttgtgaaagagaaaaaccacatccagggtaaagtcataaggtgaaaaagcctatttcagagagcacttcctgaaagagacaaagcagcaattaaagtcagcccagcaccaactccgacgccaagcgttacactggaaactactttttaaagcaacaaaagagtctaaaacaaaatacaacatttcttaaatacactgtttccagaaagagctattttaacagaagcaactcaaagatatcccttcgacagaagtggaagtgctgaaaaatgctcatctctcacacagacttttgatggacaggagtttctaagtatcatgcctaccaacaagctgtaaaatgatcaccctgaacaatcaagatcaacctgtcccttttaacagctcacatccagatgaatacaaaattgcagcccttgtcttctatagctgtatcttcataattggattatttgttaacatcactgcattatgggttttcagttgtaccaccaagaagagaaccacggtaaccatctatatgatgaatgtggcattagtggacttgatatttataatgactttaccctttcgaatgttttattatgcaaaagatgaatggccatttggagagtacttctgccagattcttggagctctcacagtgttttacccaagcattgctttatggcttcttgcctttattagtgctgacagatacatggccattgtacagccgaagtacgccaaagaacttaaaaacacgtgcaaagccgtgctggcgtgtgtgggagtctggataatgaccctgaccacgaccacccctctgctactgctctataaagacccagataaagactccactcccgccacctgcctcaagatttctgacatcatctatctaaaagctgtgaacgtgctgaacctcactcgactgacattttttttcttgattcctttgttcatcatgattgggtgctacttggtcattattcataatctccttcacggcaggacgtctaagctgaaacccaaagtcaaggagaagtccataaggatcatcatcacgctgctggtgcaggtgctcgtctgctttatgcccttccacatctgtttcgctttcctgatgctgggaacgggggagaacagttacaatccctggggagcctttaccaccttcctcatgaacctcagcacgtgtctggatgtgattctctactacatcgtttcaaaacaatttcaggctcgagtcattagtgtcatgctataccgtaattaccttcgaagcatgcgcagaaaaagtttccgatctggtagtctacggtcactaagcaatataaacagtgaaatgttatgaataataaggttctttcatttcaatcccatcaaaattcacttcactaactactctggcgtcaatggatattctgtataatactatcaagtcccttttctcttgaaaaaataaattcattatcttcattttaaaaacttatataaaa

SEQ ID NO: 11576 - DNA, 1468 bp, Homo sapiens
aagtcataaggtgaaaaagcctatttcagagagcacttcctgaaagagacaaagcagcaattaaagtcagcccagcaccaactccgacgccaagcgttacactggaaactactttttaaagcaacaaaagagtctaaaacaaaatacaacatttcttaaatacactgtttccagaaagagctattttaacagaagcaactcaaagatatcccttcgacagaagtggaagtgctgaaaaatgctcatctctcacacagacttttgatggacaggagtttctaagtatcatgcctaccaacaagctgtaaaatgatcaccctgaacaatcaagatcaacctgtcccttttaacagctcacatccagatgaatacaaaattgcagcccttgtcttctatagctgtatcttcataattggattatttgttaacatcactgcattatgggttttcagttgtaccaccaagaagagaaccacggtaaccatctatatgatgaatgtggcattagtggacttgatatttataatgactttaccctttcgaatgttttattatgcaaaagatgaatggccatttggagagtacttctgccagattcttggagctctcacagtgttttacccaagcattgctttatggcttcttgcctttattagtgctgacagatacatggccattgtacagccgaagtacgccaaagaacttaaaaacacgtgcaaagccgtgctggcgtgtgtgggagtctggataatgaccctgaccacgaccacccctctgctactgctctataaagacccagataaagactccactcccgccacctgcctcaagatttctgacatcatctatctaaaagctgtgaacgtgctgaacctcactcgactgacattttttttcttgattcctttgttcatcatgattgggtgctacttggtcattattcataatctccttcacggcaggacgtctaagctgaaacccaaagtcaaggagaagtccataaggatcatcatcacgctgctggtgcaggtgctcgtctgctttatgcccttccacatctgtttcgctttcctgatgctgggaacgggggagaacagttacaatccctggggagcctttaccaccttcctcatgaacctcagcacgtgtctggatgtgattctctactacatcgtttcaaaacaatttcaggctcgagtcattagtgtcatgctataccgtaattaccttcgaagcatgcgcagaaaaagtttccgatctggtagtctacggtcactaagcaatataaacagtgaaatgttatgaataataaggttctttcatttcaatcccatcaaaattcacttcactaactactctggcgtcaatggatattctgtataatactatcaagtcccttttctcttgaaaaaataaattcattatcttcattttaaaaacttatataaaacatttttgtgaattattc

SEQ ID NO: 11577 - DNA, 1660 bp, Homo sapiens
aagtcataaggtgaaaaagcctatttcagagagcacttcctgaaagagacaaagcagcaattaaagtcagcccagcaccaactccgacgccaagcgttacactggaaactactttttaaagcaacaaaagagtctaaaacaaaatacaacatttcttaaatacactgtttccagaaagagctattttaacagaagcaactcaaagatatcccttcgacagaagtggaagtgctgaaaaatgctcatctctcacacagacttttgatggacaggaggtgctgctttctgtgaaccactgaagtagagcagctgaaatcacaaaacctggaagacttggctttacgtactcccaattgtgcactagaaaacagctcatctattgctctaacagtctagttcttgatctgctgaccatgacacaaaacattgctgtttctcaacctatgataatttaaagagaacataagtttctaagtatcatgcctaccaacaagctgtaaaatgatcaccctgaacaatcaagatcaacctgtcccttttaacagctcacatccagatgaatacaaaattgcagcccttgtcttctatagctgtatcttcataattggattatttgttaacatcactgcattatgggttttcagttgtaccaccaagaagagaaccacggtaaccatctatatgatgaatgtggcattagtggacttgatatttataatgactttaccctttcgaatgttttattatgcaaaagatgaatggccatttggagagtacttctgccagattcttggagctctcacagtgttttacccaagcattgctttatggcttcttgcctttattagtgctgacagatacatggccattgtacagccgaagtacgccaaagaacttaaaaacacgtgcaaagccgtgctggcgtgtgtgggagtctggataatgaccctgaccacgaccacccctctgctactgctctataaagacccagataaagactccactcccgccacctgcctcaagatttctgacatcatctatctaaaagctgtgaacgtgctgaacctcactcgactgacattttttttcttgattcctttgttcatcatgattgggtgctacttggtcattattcataatctccttcacggcaggacgtctaagctgaaacccaaagtcaaggagaagtccataaggatcatcatcacgctgctggtgcaggtgctcgtctgctttatgcccttccacatctgtttcgctttcctgatgctgggaacgggggagaacagttacaatccctggggagcctttaccaccttcctcatgaacctcagcacgtgtctggatgtgattctctactacatcgtttcaaaacaatttcaggctcgagtcattagtgtcatgctataccgtaattaccttcgaagcatgcgcagaaaaagtttccgatctggtagtctacggtcactaagcaatataaacagtgaaatgttatgaataataaggttctttcatttcaatcccatcaaaattcacttcactaactactctggcgtcaatggatattctgtataatactatcaagtcccttttctcttgaaaaaataaattcattatcttcattttaaaaacttatataaaacatttttgtgaattattc

SEQ ID NO: 11578 - DNA, 741 bp, Homo sapiens
cagcaattaaagtcagcccagcaccaactccgacgccaagcgttacactggaaactactttttaaagcaacaaaagagtctaaaacaaaatacaacatttcttaaatacactgtttccagaaagagctattttaacagaagcaactcaaagatatcccttcgacagaagtggaagtgctgaaaaatgctcatctctcacacagacttttgatggacaggaggtgctgctttctgtgaaccactgaagtagagcagctgaaatcacaaaacctggaagacttggctttacgtactcccaattgtgcactagaaaacagctcatctattgctctaacagtctagttcttgatctgctgaccatgacacaaaacattgctgtttctcaacctatgataatttaaagagaacataagtttctaagtatcatgcctaccaacaagctgtaaaatgatcaccctgaacaatcaagatcaacctgtcccttttaacagctcacatccagatgaatacaaaattgcagcccttgtcttctatagctgtatcttcataattggattatttgttaacatcactgcattatgggttttcagttgtaccaccaagaagagaaccacggtaaccatctatatgatgaatgtggcattagtggacttgatatttataatgactttaccctttcgaatgttttattatgcaaaagatgaatggccatttggagagtacttctgccagattcttgga

SEQ ID NO: 11579 - DNA, 1700 bp, Homo sapiens
aaacttacttcagtttggacaactactcacagctactacacagagacccgaacgagtcactgatatacacctggaccaccaccaatggatatacaaatggcaaacaattttactccgccctctgcaactcctcagggaaatgactgtgacctctatgcacatcacagcacggccaggatagtaatgcctctgcattacagcctcgtcttcatcattgggctcgtgggaaacttactagccttggtcgtcattgttcaaaacaggaaaaaaatcaactctaccaccctctattcaacaaatttggtgatttctgatatactttttaccaccgctttgcctacacgaatagcctactatgcaatgggctttgactggagaatcggagatgccttgtgtaggataactgcgctagtgttttacatcaacacatatgcaggtgtgaactttatgacctgcctgagtattgaccgcttcattgctgtggtgcaccctctacgctacaacaagataaaaaggattgaacatgcaaaaggcgtgtgcatatttgtctggattctagtatttgctcagacactcccactcctcatcaaccctatgtcaaagcaggaggctgaaaggattacatgcatggagtatccaaactttgaagaaactaaatctcttccctggattctgcttggggcatgtttcataggatatgtacttccacttataatcattctcatctgctattctcagatctgctgcaaactcttcagaactgccaaacaaaacccactcactgagaaatctggtgtaaacaaaaaggctctcaacacaattattcttattattgttgtgtttgttctctgtttcacaccttaccatgttgcaattattcaacatatgattaagaagcttcgtttctctaatttcctggaatgtagccaaagacattcgttccagatttctctgcactttacagtatgcctgatgaacttcaattgctgcatggacccttttatctacttctttgcatgtaaagggtataagagaaaggttatgaggatgctgaaacggcaagtcagtgtatcgatttctagtgctgtgaagtcagcccctgaagaaaattcacgtgaaatgacagaaacgcagatgatgatacattccaagtcttcaaatggaaagtgaaatggattgtattttggtttatagtgacgtaaactgtatgacaaactttgcaggacttcccttataaagcaaaataattgttcagcttccaattagtattcttttatatttctttcattgggcactttcccatctccaactcggaagtaagcccaagagaacaacataaagcaaacaacataaagcacaataaaaatgcaaataaatatttcatttttatttgtaaacgaatacaccaaaaggaggcgctcttaataactcccaatgtaaaaagttttgttttaataaaaaatttaattattatttcttgccaacaaatggctagaaaggactgaatagattatatattgccagatgttaatactgtaacatactttttaaataacatatttcttaaatccaaatttctctcaatgttagatttaattccctcaataacaccaatgttttgttttgtttcgttctgggtcataaaactttgttaaggaactcttttggaataaagagcaggatgctgcaaagttatgagt

SEQ ID NO: 11580 - DNA, 1743 bp, Homo sapiens
ctttccgcctagtgagaggcggtccgatttggcccttggggagtgtccgtcgcgttgatctgatggattcacgtacacaacaccacattctatgagattttgcaggcaaaagtccacaagctcgatatatgggacacctgcaccggcattggatttggccccgcaacatcttaaaggaagcaggctgtgagccaaggggaaggcagaggacagaaatgaatgtgtttccaggctttcctggtggtttatggcattctccaaactcctatgcaagggctattcctgaccaagaagatctaaagagaacgtctctgaaatcaagtccggatgaagaattaagagaaaaaaagtgaatatggtttttgctcacagaatggataacagcaagccacatttgattattcctacacttctggtgcccctccaaaaccgcagctgcactgaaacagccacacctctgccaagccaatacctgatggaattaagtgaggagcacagttggatgagcaaccaaacagaccttcactatgtgctgaaacccggggaagtggccacagccagcatcttctttgggattctgtggttgttttctatcttcggcaattccctggtttgtttggtcatccataggagtaggaggactcagtctaccaccaactactttgtggtctccatggcatgtgctgaccttctcatcagcgttgccagcacgcctttcgtcctgctccagttcaccactggaaggtggacgctgggtagtgcaacgtgcaaggttgtgcgatattttcaatatctcactccaggtgtccagatctacgttctcctctccatctgcatagaccggttctacaccatcgtctatcctctgagcttcaaggtgtccagagaaaaagccaagaaaatgattgcggcatcgtgggtctttgatgcaggctttgtgacccctgtgctctttttctatggctccaactgggacagtcattgtaactatttcctcccctcctcttgggaaggcactgcctacactgtcatccacttcttggtgggctttgtgattccatctgtcctcataattttattttaccaaaaggtcataaaatatatttggagaataggcacagatggccgaacggtgaggaggacaatgaacattgtccctcggacaaaagtgaaaactatcaagatgttcctcattttaaatctgttgtttttgctctcctggctgccttttcatgtagctcagctatggcacccccatgaacaagactataagaaaagttcccttgttttcacagctatcacatggatatcctttagttcttcagcctctaaacctactctgtattcaatttataatgccaattttcggagagggatgaaagagactttttgcatgtcctctatgaaatgttaccgaagcaatgcctatactatcacaacaagttcaaggatggccaaaaaaaactacgttggcatttcagaaatcccttccatggccaaaactattaccaaagactcgatctatgactcatttgacagagaagccaaggaaaaaaagcttgcttggcccattaactcaaatccaccaaatacttttgtctaagttctcattctttcaattgttatgcaccagagattaaaaagctttaactataaaaacagaagctatttacatatttgttttcactcaactttccaagggaaatgttttattttgtaaaatgcattcatttgtttactgta

SEQ ID NO: 11581 - DNA, 1751 bp, Homo sapiens
tgtctccctaacaggaagcaggctgtgagccaaggggaaggcagaggacagaaatgaatgtgtttccaggctttcctggtggtttatggcattctccaaactcctatgcaagggctattcctgaccaagaagatctaaagagaacgtctctgaaatcaagtccggatgaagaattaagagaaaaaaagtgaatatggtttttgctcacagaatggataacagcaagccacatttgattattcctacacttctggtgcccctccaaaaccgcagctgcactgaaacagccacacctctgccaagccaatacctgatggaattaagtgaggagcacagttggatgagcaaccaaacagaccttcactatgtgctgaaacccggggaagtggccacagccagcatcttctttgggattctgtggttgttttctatcttcggcaattccctggtttgtttggtcatccataggagtaggaggactcagtctaccaccaactactttgtggtctccatggcatgtgctgaccttctcatcagcgttgccagcacgcctttcgtcctgctccagttcaccactggaaggtggacgctgggtagtgcaacgtgcaaggttgtgcgatattttcaatatctcactccaggtgtccagatctacgttctcctctccatctgcatagaccggttctacaccatcgtctatcctctgagcttcaaggtgtccagagaaaaagccaagaaaatgattgcggcatcgtgggtctttgatgcaggctttgtgacccctgtgctctttttctatggctccaactgggacagtcattgtaactatttcctcccctcctcttgggaaggcactgcctacactgtcatccacttcttggtgggctttgtgattccatctgtcctcataattttattttaccaaaaggtcataaaatatatttggagaataggcacagatggccgaacggtgaggaggacaatgaacattgtccctcggacaaaagtgaaaactatcaagatgttcctcattttaaatctgttgtttttgctctcctggctgccttttcatgtagctcagctatggcacccccatgaacaagactataagaaaagttcccttgttttcacagctatcacatggatatcctttagttcttcagcctctaaacctactctgtattcaatttataatgccaattttcggagagggatgaaagagactttttgcatgtcctctatgaaatgttaccgaagcaatgcctatactatcacaacaagttcaaggatggccaaaaaaaactacgttggcatttcagaaatcccttccatggccaaaactattaccaaagactcgatctatgactcatttgacagagaagccaaggaaaaaaagcttgcttggcccattaactcaaatccaccaaatacttttgtctaagttctcattctttcaattgttatgcaccagagattaaaaagctttaactataaaaacagaagctatttacatatttgttttcactcaactttccaagggaaatgttttattttgtaaaatgcattcatttgtttactgtagtttttgtgggttttattttacttgctttttatgttttaggaaaagcgttcactttgaactttagccaacagtccttttactattaatatattagttacatgcataaaaaagaaaatgctttcttactatttactgttggttcaaaaacataaacctaagccatacacac

SEQ ID NO: 11582 - DNA, 553 bp, Homo sapiens
agcgcgcaaaagtttcaaaactttccgcctagtgagaggcggtccgatttggcccttggggagtgtccgtcgcgttgatctgatggattcacgtacacaacaccacattctatgagattttgcaggcaaaagtccacaagctcgatatatgggacacctgcaccggcattggatttggccccgcaacatcttaaaggaagcaggctgtgagccaaggggaaggcagaggacagaaatgaatgtgtttccaggctttcctggtggtttatggcattctccaaactcctatgcaagggctattcctgaccaagaagatctaaagagaacgtctctgaaatcaagtccggatgaagaattaagagaaaaaaagtgaatatggtttttgctcacagaatggataacagcaagccacatttgattattcctacacttctggtgcccctccaaaaccgcagctgcactgaaacagccacacctctgccaagccaatacctgatggaattaagtgaggagcacagttggatgagcaaccaaacagaccttcactatgtgc

SEQ ID NO: 11583 - DNA, 1515 bp, Homo sapiens
aggtccgggctgcatgcagagctgagagctgaggactcccatctccagcctgcccgggtgaagcgcggcctggggtgtgctggctgccgtcatgccctctgtgtctccagcggggccctcggccggggcagtccccaatgccaccgcagtgacaacagtgcggaccaatgccagcgggctggaggtgcccctgttccacctgtttgcccggctggacgaggagctgcatggcaccttcccaggcctgtggctggcgctgatggcggtgcacggagccatcttcctggcagggctggtgctcaacgggctggcgctgtacgtcttctgctgccgcacccgggccaagacaccctcagtcatctacaccatcaacctggtggtgaccgatctactggtagggctgtccctgcccacgcgcttcgctgtgtactacggcgccaggggctgcctgcgctgtgccttcccgcacgtcctcggttacttcctcaacatgcactgctccatcctcttcctcacctgcatctgcgtggaccgctacctggccatcgtgcggcccgaaggctcccgccgctgccgccagcctgcctgtgccagggccgtgtgcgccttcgtgtggctggccgccggtgccgtcaccctgtcggtgctgggcgtgacaggcagccggccctgctgccgtgtctttgcgctgactgtcctggagttcctgctgcccctgctggtcatcagcgtgtttaccggccgcatcatgtgtgcactgtcgcggccgggtctgctccaccagggtcgccagcgccgcgtgcgggccatgcagctcctgctcacggtgctcatcatctttctcgtctgcttcacgcccttccacgcccgccaagtggccgtggcgctgtggcccgacatgccacaccacacgagcctcgtggtctaccacgtggccgtgaccctcagcagcctcaacagctgcatggaccccatcgtctactgcttcgtcaccagtggcttccaggccaccgtccgaggcctcttcggccagcacggagagcgtgagcccagcagcggtgacgtggtcagcatgcacaggagctccaagggctcaggccgtcatcacatcctcagtgccggccctcacgccctcacccaggccctggctaatgggcccgaggcttagtcagcagggctctgccaggggccgaaggtcaggactcatctgggcatgccagcgtggacacccaccatgccaggggtggcaatcggttccatctcgattgattggtgatggctacccagagcaccgcattgagcgtctaaggccactgtgctgtggttgattagcaatgtctgccactggctccgatgggatgtggtggcctgaatgccggtgatttgctgttcctggggtatagcacgtccactgaaaactcacaggggtagccgggagctgctcctcactttggccagtttgtctccagaaggagttcctcagaaaaaagggcacagtggattccattgattaga

SEQ ID NO: 11584 - DNA, 1170 bp, Homo sapiens
aagcggcagcatgaagtgacagatcactcctgagctcaagatgaactccaccttggatggtaatcagagcagccaccctttttgcctcttggcatttggctatttggaaactgtcaatttttgccttttggaagtattgattattgtctttctaactgtattgattatttctggcaacatcattgtgatttttgtatttcactgtgcacctttgttgaaccatcacactacaagttattttatccagactatggcatatgctgacctttttgttggggtgagctgcgtggtcccttctttatcactcctccatcacccccttccagtagaggagtccttgacttgccagatatttggttttgtagtatcagttctgaagagcgtctccatggcttctctggcctgtatcagcattgatagatacattgccattactaaacctttaacctataatactctggttacaccctggagactacgcctgtgtattttcctgatttggctatactcgaccctggtcttcctgccttcctttttccactggggcaaacctggatatcatggagatgtgtttcagtggtgtgcggagtcctggcacaccgactcctacttcaccctgttcatcgtgatgatgttatatgccccagcagcccttattgtctgcttcacctatttcaacatcttccgcatctgccaacagcacacaaaggatatcagcgaaaggcaagcccgcttcagcagccagagtggggagactggggaagtgcaggcctgtcctgataagcgctatgccatggtcctgtttcgaatcactagtgtattttacatcctctggttgccatatatcatctacttcttgttggaaagctccactggccacagcaaccgcttcgcatccttcttgaccacctggcttgctattagtaacagtttctgcaactgtgtaatttatagtctctccaacagtgtattccaaagaggactaaagcgcctctcaggggctatgtgtacttcttgtgcaagtcagactacagccaacgacccttacacagttagaagcaaaggccctcttaatggatgtcatatctgaagtggctcagttacggggttcccgtgtgtgtgtgtgtgtgtgtgtgtgtgtgtgtgtgtgtgtgtgtattttatctctaa

SEQ ID NO: 11585 - DNA, 753 bp, Homo sapiens
atgaactccaccttggatggtaatcagagcagccaccctttttgcctcttggcatttggctatttggaaactgtcaatttttgccttttggaagtattgattattgtctttctaactgtattgattatttctggcaacatcattgtgatttttgtatttcactgtgcacctttgttgaaccatcacactacaagttattttatccagactatggcatatgctgacctttttgttggggtgagctgcgtggtcccttctttatcactcctccatcacccccttccagtagaggagtccttgacttgccagatatttggttttgtagtatcagttctgaagagcgtctccatggcttctctggcctgtatcagcattgatagatacattgccattactaaacctttaacctataatactctggttacaccctggagactacgcctgtgtattttcctgatttggctatactcgaccctggtcttcctgccttcctttttccactggggcaaacctggatatcatggagatgtgtttcagtggtgtgcggagtcctggcacaccgactcctacttcaccctgttcatcgtgatgatgttatatgccccagcagcccttattgtctgcttcacctatttcaacatcttccgcatctgccaacagcacacaaaggatatcagcgaaaggcaagcccgcttcagcagccagagtggggagactggggaagtgcaggcctgtcctgtttcgaatcactag

SEQ ID NO: 11586 - DNA, 2936 bp, Homo sapiens
attctgcaaaagctgcccgaacaggctttcctctgaaaagcagtgccgttcctttttagaaagactgaatctaaatgttgtctctggagacaagaagccttcagtatgttaaattactttcattatgtattttcagatgcttattgattccacagtaggaagagtgagagactgcagcagcctctaagcagcactacatgttccatacattagcagtactgctgaaacaatggcacactacagacacatattttcattaaggtcattttcgaagagatgtttatgaccctcttcccccagtcctctactaacaagtgaacaaaatgaatcaatccaaactggaaatgcttcaactacatcaagaatttatcaaatctttagcagagggccaatagcagctaattcagtatttacaactgacaatatgaagaatgcaattgactgagcatctccctagctgtctgaactacgaactgcaagatgttcttgtaacacgactttaagacattaaggagttaaaaccagggaataggtctacattactgatggaatataaaaaatcaactgtatcctaagaagatgctacataaaataaccacaaaaagaaaaacaatataactgtaaaagcctgaaaagaatttttaaaaggggaagtttatactttcatataccagaattgtggaagttactgattctggaagacataatgaaacatgaatttccaaaaagaaaagaaaatactttatcagcacacaaaaggaagatttaggaagtgttttctgcactaaatattcagatattcatatcaattggtatgactaatggatttttctatctgacttttatgaccaattatgtatcctcttctaatgaaaacaaacaaaattaaacagcagatggtttttatcaaaaggacatggcctggatttataatataaagcaagttatgtgatcaagaaatcatttcaaaatagtgagcactgctattaaaaacagatttacaatggtaacaaaaggatgtctaaatatattttagaagctacaaacgttatgtttccttttttgttttcacatattctggaaaataaagaaatattatcatgtactccatcaaagggaaacataattcctatcatctgaggaaattcctcttggccgtgactttttaaagcaaaacaaatacaaatattatgtactgttctttagaaatccatcagccaactaaatctcataatgcatgcagttgaagtattggagagaaaacgaaagaattcctacaagacatgaaataaaacacagctacttcactgttgtcagggaaaaaaaccaactgctccaaaagaatgtgtttttctcccattctggaaatcaacatgcagtctgaatctaacattacagtgcgagatgacattgatgacatcaacaccaatatgtaccaaccactatcatatccgttaagctttcaagtgtctctcaccggatttcttatgttagaaattgtgttgggacttggcagcaacctcactgtattggtactttactgcatgaaatccaacttaatcaactctgtcagtaacattattacaatgaatcttcatgtacttgatgtaataatttgtgtgggatgtattcctctaactatagttatccttctgctttcactggagagtaacactgctctcatttgctgtttccatgaggcttgtgtatcttttgcaagtgtctcaacagcaatcaacgtttttgctatcactttggacagatatgacatctctgtaaaacctgcaaaccgaattctgacaatgggcagagctgtaatgttaatgatatccatttggattttttcttttttctctttcctgattccttttattgaggtaaattttttcagtcttcaaagtggaaatacctgggaaaacaagacacttttatgtgtcagtacaaatgaatactacactgaactgggaatgtattatcacctgttagtacagatcccaatattctttttcactgttgtagtaatgttaatcacatacaccaaaatacttcaggctcttaatattcgaataggcacaagattttcaacagggcagaagaagaaagcaagaaagaaaaagacaatttctctaaccacacaacatgaggctacagacatgtcacaaagcagtggtgggagaaatgtagtctttggtgtaagaacttcagtttctgtaataattgccctccggcgagctgtgaaacgacaccgtgaacgacgagaaagacaaaagagagtcttcaggatgtctttattgattatttctacatttcttctctgctggacaccaatttctgttttaaataccaccattttatgtttaggcccaagtgaccttttagtaaaattaagattgtgttttttagtcatggcttatggaacaactatatttcaccctctattatatgcattcactagacaaaaatttcaaaaggtcttgaaaagtaaaatgaaaaagcgagttgtttctatagtagaagctgatcccctgcctaataatgctgtaatacacaactcttggatagatcctaaaagaaacaaaaaaattacctttgaagatagtgaaataagagaaaaatgtttagtgcctcaggttgtcacagactagagaaaagtctcagtttcaccaaatccacattcaaatgagttttaaatttaaattgtaaaaactgatattactgccaaatataagaaaaatattttaagtattggttatgttgtaaattttcaatgtgaatgtcaattagataggtcatatatattcaatttcttcattacttaatgtatttgttgcatggcagtttgttaaagtactatcatgtgtatattttgtcaatattatgtccaacagaaaatattcatgtaagtcatattttttaaggaataaatacatagcctt

SEQ ID NO: 11587 - DNA, 1224 bp, Homo sapiens
cgtgaagagcaaaccccctcctgctcagagctgctgccgcctgcgcccagggctgcactccgcgcaggcctcatagccaggccatggcccccacagagccctggagccccagcccggggtcagcgccctgggactactcggggttggacggcctggaggagctggagctgtgtccggccggggacctgccctacggctacgtctacatccccgcgctctacctggcggccttcgccgtgggcctgctgggcaacgcctttgtggtgtggctgctggccgggcggcggggcccgcggcggctggtggataccttcgtgctgcacctggcggcagctgacctgggcttcgtgctcacgctgccgctgtgggccgcggcggcggcgctaggcggccgctggccgttcggcgatggcctctgcaagctcagcagcttcgcgctggcgggcacgcgctgcgcgggcgcgctgctgctggcgggcatgagcgtggaccgctacctggccgtggtgaagctgctcgaggcgaggccactgcgcaccccgcgctgcgcgctggcctcgtgctgcggcgtctgggccgtggcgctgctggccggcctgccctccctggtctaccgggggttgcagcccctgcctgggggccaggacagccagtgcggcgaggagccctcccacgccttccagggcctcagcttgctgctgctgctgctgaccttcgtgctgcccctggtcgtcaccctcttctgctactgccgcatctcgcgccgcctgcgacggccgccgcacgtgggtcgggcccggaggaactcgctgcgcatcatcttcgccatcgagagcacgtttgtgggctcctggctgcccttcagcgccctgcgggccgtcttccacctggcgcgtctgggggcgctgccgctgccgtgccccctgctgctggcgctgcgctggggcctcaccattgccacctgcctggccttcgtcaacagctgcgccaacccgctcatctacctcctgctggaccgctcattccgagcccgggcgctggacggggcctgcgggcgcaccggccgcctggcgcgaaggatcagctcagcctcctcgctctccagggacgacagttccgtgttccgttgccgggcccaggccgcgaacactgcctcggcctcctggtagctgccccgggccgctggaggtgggcggcagcggagcatcgagaggaggccagagg

SEQ ID NO: 11588 - DNA, 7514 bp, Homo sapiens
cgccatggcggcgccgggttgcggaccctgagcgccggcgcggggcgcgcaccatgaactcgtgggacgcgggcctggcggggctactggtgggcacgatgggcgtctcgctgctgtccaacgcgctggtgctgctctgcctgctgcacagcgcggacatccgccgccaggcgccggcgctcttcaccctgaacctcacgtgcgggaacctgctgtgcaccgtggtcaacatgccgctcacgctggccggcgtcgtggcgcagcggcagccggcgggcgaccgcctgtgccgcctggctgccttcctcgacaccttcctggctgccaactccatgctcagcatggccgcgctcagcatcgaccgctgggtggccgtggtcttcccgctgagctaccgggccaagatgcgcctccgcgacgcggcgctcatggtggcctacacgtggctgcacgcgctcaccttcccagccgccgcgctcgccctgtcctggctcggcttccaccagctgtacgcctcgtgcacgctgtgcagccggcggccagacgagcgcctgcgcttcgccgtcttcactggcgccttccacgctctcagcttcctgctctccttcgtcgtgctctgctgcacgtacctcaaggtgctcaaggtggcccgcttccattgcaagcgcatcgacgtgatcaccatgcagacgctggtgctgctggtggacctgcaccccagtgtgcgggaacgctgtctggaggagcagaagcggaggcgacagcgagccaccaagaagatcagcaccttcatagggaccttccttgtgtgcttcgcgccctatgtgatcaccaggctagtggagctcttctccacggtgcccatcggctcccactggggggtgctgtccaagtgcttggcgtacagcaaggccgcatccgacccctttgtgtactccttactgcgacaccagtaccgcaaaagctgcaaggagattctgaacaggctcctgcacagacgctccatccactcctctggcctcacaggcgactctcacagccagaacattctgccggtgtctgagtgaaggaccgcgctcctgctgaagagtttagaatgaggcagcggtgagaagaagggtgggagggcgtgggggcccctgggtggacaccaccagccaccagtccctggcatgcccagtgatcctggttccctggcttgtaggggctccagagcctgcttcctggttcctcaagggcagatattggacactccttatttgtcaccaaaggatgactgtaggccgtgtgctggcctttctttctaagaagctgctttgagctcctggactcacctgaggctccctgggggatgacactcagttctgtcactgtcaaggatgcagagagctggtggtaggtgggaagcatggtgtccacctgcctgctgaccactggacgctgctccatgctgaagaaaagtgacagtctccaggggacatttcagccatgctgaaagggaggctggcagtggtcatttggcccggatctaacatggcacctcgtctccacagggtagtggtggctgcttcaacccaaatattattcagctggtactaacgacattgtgcccagctgggactcttgggctctgtgcctgagggaaaatgtttcacaactagtggctgcccaattgctgctgaccagttgtcttagaaatggtcaattggattcaactttagtcctctccttccccctaaaagcgaatgtttgtgtgtgcagacaatcttagcatgaaaatggtttaaataggctggtcctacatgtattaggttctttcaagtttgactgggaggtcacctttttctgatttacaagtcctaattgttggagctcagtaaaggtaggaggaaggtggctggttggtcctcccttccccctgtttgtgacctgaatttacaggaagtgtttcaacttgtcttatgcatcttatctggcatgtcctgggagatggatgggcaagaactggcctgagcagggatttttgccttgattttaagtcactgggttccattgtcctggcacctccatttccttagtttctgtaagcctgttaacagaaagtagaggctattcaaggttatcaagaaagtgccctgtgctaatgatgagacagtgaattttttttttttttcgagatgggagtttcactcttattgcccaggctagagtgcaatggtgcgatctaggctcaccacaacctctgccttccaggttcaagtgattagagacagtgaaatttttatggaatactgcacctataaaacacatgccaatctgttagcagtcctgacttgatttaataaaaaccaaggagagccacccctgctttctggccatctcttctttgtctaccatttcaaattgacttgtgaatactcagagcagttatttttcaatcctccactctaagtgattcctccagggtgggaagcacggggagcaatggaatcagatggctcattctctccttccagctctttacatcctaactttggaggtatagaaggaaggatgtggtccaacgggaaggaagtgaagagtctattggtttttacttctaggcagtcccaatttttaaaggcagagaagtatctgcatctttatttgaaaagacgtcttattaactcttagctcctcagttagaaaacaattcacctggcttagtcttgtctagtttcaaagttaccatggagactagaatggagacaggtgtagcttccaaggaggccttggcatcttgcagttgctgtcagagatgggctcatatctgcttggggaagccaatggggcacaatccttcccaatttcatgatctggggcatcatgtcggtagctgaagtcagccacggtgggagtgtttataccatgaaaatcagcaagtgctgtaaatcaggccttttgccccacagagagctgattgtgaaacatctactagcacaccactgccagacatgactgtgtgtgtccctgaaacaaaattgctctggctcagagctcctttggccactcatattacaatagcaacagacatttgcttcctggtggcaagtaactgtgcaccctccaacatcccaaccccagaggaaccagtgggattgaaaaccagcagaagccaagacaggatgcacagctgaattggaggagagtagctcccttctcacacaaacgctttcaaagttgggcaaaagtggcccagtgcgtgaggtcagtcaacagccaaattccagcagcaaaatacattttcatcaatatcactttgggagaataactgtggcacatgctctttctgctttctctgtactgtataggcaacatgttgtactcccagtagcaactagatctcttttacctcttctttagccaagaagcaagatctgtcacccacaacaccacatatcttgaaaagatgcttttcataattttcactatacctctaaaaccaattgtaccgacatcacgtagacaaaaactccagataaatccattgattgggtattttcattattatttggacacatgaattaaatcccaagggaaagtgagaagaaaattaatgtattagcaaccagtgttagccaactctgctgtaattacctttagataaatgtttattttcatctctatacagtctatcaaatttgccccctggctttattactcccaattgaattatctacctcattttgttaatttaatttatcaaaggtaacattgttttctcaggtataacacatagaaacaccaagattttcagcatctgaatcaaactaaaattacttgcttgacttcactccagggtgagacttgacctttaaggcccaaactctggtgaactgttggactgggtagaaatctttcaagaagcttgaaaataaggccataaaggaggggctttcaaattcctaaatccacatatagggctgagttcctagtcctacacaatcagaatttgcctttttaagtcacgctgcaactattccggctttttatatggcacctttctgagggaggggattttacagccgagggacctccaaagggaacgtccatttgcatgtgtgccctggtatttagggtttgtctcatggtcagctcgcctctcaaagatggctcaccaatcacctgcctgtttttacttagaaagcaggcttgggcaggaggggaaatggatttgaaccatctcagaccaactctatctcttctagcactcagctcagcctcctgtccccatgagcaataaaactctctccttatgtctgtgaaattcgttttctttttcatggtgcctttctttctaagaaaagatagaaagaatggggccaggttcatgtcccagttgtcacccttttacatgcttgggtgcaggtagatgaggccttcccatggctacagtgtgacccttggaggaaccaaaggctgtgcattgttagaatttagcccagatgcaggataaactagcttgcctgagtttaatgaggatattatatcaggtgccaggaatcccttgggtcagctcctatcctctggacggggagcatcatgggaaaaagaggtccgagtcatatttagggcttcatgtgtctggaagggagccattagctcttaaattattcacagaagtcaccacggaaggttgtttaagatgcagattccagcatcccctcctcagagatcaatttcagcagggccaggcaggacctgggtttccgcacttttaatcatcgatgcccaggtaactgataggagttttcttcaaaccatcccctaaggagaaatgatcttagacacttggataaactctatagaaaattgagtgtttctattaataactatctaggtttcaattgtcttgtatctttccctaattctccaaacagttcaatctccagctttattcaatggctgggccattttgttcttggagggacaaaattgacctctccatgaaattgcaaaaacccatcttcattcctttttatggggctccaggtcataaggatgagatatatttggggtactggcagaggatggcagagctggctggctctgagccaggaagccttgttagaggaaggaactctggcattcagaggtgtccccttgggggcacttgcttgggtcttggatcaaactctactggggcagcctggctgtgggaggtgatgacatctgccacctctgccactacccagagcttgtcctgccctcttcccagccagcctcacacacaggagctgagccaggctgaggcaaggtcagcgagagacagttctccatgccagtatctgggtgtgggtctcttgttggctcccagctcatcccgtgtggctgacccttccaggtcacttggagcagccagtaatgacagtgtcctaacagctggtgggtatggaggaaagactagacatcaggctatggactcacatggagggccctggtgttggctctgggacctgggctgggccggacctggggagagggtgggtggagcttggcctctgcagtttgcgcttgcaggttcaggggagaaagttgtttgagatcagggtttaggggtagtgtttcccattaatcttcatcataatcttttgatgtaggtgctgttattatctctacgttacacatctgggaggatttgaaagtcctggagacagggaggttttggggagaatgcaaaacagggcagggctctcaaggagggtggaccagtgaccatggggaaactgagtgtttctattaataagtatctaagtttcaattgtcttgtatctttccctaattctccaaacggttcaatctccagttttattcagggactgggccattttgttctcagagggacaaaactgatctctccatgaaatcccctgcacctcactctgggcagctctaggctcagcagatgtttttctgccattaggaaacagccccttactctcagctcctgtgctaacacccatacccaccagctgggcgttgggacctctcccgtcatatggctgccacttgcttgggaaggaattctccagactccttttactttgtatgtgtttctaggggaattctgagggaagaagctttgcagcaacctctgtgcccagaacatacggctcacaagtcctttgtgccgacagggaatctatctaattgttttagtgtgtgaggctcattgtcagcctagatttccctgaaactctgggccagcagcccccaggagcatcagtaggacccagcatttcccctggcaccaaagtggacctctttgcaccttgcagccgggagaactgacttagagggccctggtgttggctctggaacctgggctgagatggattcggggagaggctgggtggagcttggcctctacggtctgttcttgcagattcaggagagaaagtggtatgagagcagtgtggtttgtaagttccccaacttccccgctggctcacactgtctccccagaccaatggcctattagcccccaaaaagttagtccaaccccaggccagctgcctttgctctgctgtggcctaagttctggcctggtcaaaggaaggtggcaggaactccaggcttgctcctgcctcctcacacctcattccacaaatgcggagtgaaagagcaggagccagacacatttgggggttgactgtctagaaaggaggaatcagaggtcccaaggaacacaatcgtgcaacttcctagggaatctgcatcaggagaaagaagcggctaggacacacagtggcttcgctcagcctggccacgacatcactgtgcagaagaagagatctgtcaggggtccagaggagcggagtcctggagcctctgggagggtggcatgtggcagctgcaggctgtggtccagaactatgagcagacttgcctgtcactctccaaacatttactgaacacctactgtgtgccaggccctgtgctttgtcaggctctgggggagacaggtcattactctgcagtgtgggaagcggggctgccctggaagtgtgtactcagtgctgtgggggtacagagggagggctggagaacttagctggtgggaaaggagggttctggaaggcttctcagaggtagtggcattgggccagaacttacagtagggaagagcatgtggcaaggcacagaggagatgggagcctgcctggtgaggggtccagtggtgacagagctcagtgtgggtccagagatggtgtcaggtgagggctgagaggggagggcaagtgccccttgagatgggctgaacgtgatgatgatctgtggccagtgggagatgatagaagtcttgaggttgggaatataagaattaggtctcttttagaaagagaggacatggagaaaatccatatatttttagctaccaaaaaagagaaggaagaaagaaaagaaataagaagagaagcaagacagaaaagaaggaagagagaaggaagaatggcaaaggaaggaagaaggag

SEQ ID NO: 11589 - DNA, 2447 bp, Homo sapiens
atggcgaacgcgagcgagccgggtggcagcggcggcggcgaggcggccgccctgggcctcaagctggccacgctcagcctgctgctgtgcgtgagcctagcgggcaacgtgctgttcgcgctgctgatcgtgcgggagcgcagcctgcaccgcgccccgtactacctgctgctcgacctgtgcctggccgacgggctgcgcgcgctcgcctgcctcccggccgtcatgctggcggcgcggcgtgcggcggccgcggcgggggcgccgccgggcgcgctgggctgcaagctgctcgccttcctggccgcgctcttctgcttccacgccgccttcctgctgctgggcgtgggcgtcacccgctacctggccatcgcgcaccaccgcttctatgcagagcgcctggccggctggccgtgcgccgccatgctggtgtgcgccgcctgggcgctggcgctggccgcggccttcccgccagtgctggacggcggtggcgacgacgaggacgcgccgtgcgccctggagcagcggcccgacggcgcccccggcgcgctgggcttcctgctgctgctggccgtggtggtgggcgccacgcacctcgtctacctccgcctgctcttcttcatccacgaccgccgcaagatgcggcccgcgcgcctggtgcccgccgtcagccacgactggaccttccacggcccgggcgccaccggccaggcggccgccaactggacggcgggcttcggccgcgggcccacgccgcccgcgcttgtgggcatccggcccgcagggccgggccgcggcgcgcgccgcctcctcgtgctggaagaattcaagacggagaagaggctgtgcaagatgttctacgccgtcacgctgctcttcctgctcctctgggggccctacgtcgtggccagctacctgcgggtcctggtgcggcccggcgccgtcccccaggcctacctgacggcctccgtgtggctgaccttcgcgcaggccggcatcaaccccgtcgtgtgcttcctcttcaacagggagctgagggactgcttcagggcccagttcccctgctgccagagcccccggaccacccaggcgacccatccctgcgacctgaaaggcattggtttatgagggaggccccgccacatagacccccaacccagcctttccctttggctcggacggtgacgttgtatcttttccttctggcccctgtttaattttctaagctgccttcaaaatgactcgaagtggacagacacttggattgtactgactcctttgggggtggggtgggtgaggagtaggatgctcagcccactccagctccgcacattcgtcctcctaactcgactttcttcctgacaataggccctgcagtctttttgtagcggtactgacgtcttttattccatgtgtggttcctttttttctttttctataaaggctgtactaattttcttcatgcaacgtttcctaaagaccatggccagttttctacagaagctatttttgacaacctcaagtggcattacattttgcagtgaagtagaggaacctagggggacttcttcacaagttagatttcttgaggatcttctgttggaagcaggagaaagtggggggtggggggaagttgtccgaaatgccctctgaattgccggctgcagggtccttgtgctgcgctggttctttgaaagtctcagtgttgatattgaacttaaagagcagagatggagatcagtagcaaggcagtcatttttttaaagcagtaagtaacaagtaagatttggttcccggtttactttctgctgctaaaaaccacgtcagtgacaactgctctctgtattatagcaatcttgaatggaaacatttctgtcaagttgtaagttttaaaagagtaaagtgttttggttagtaatgatgtggagaaaaatacagtattgcatgtgttcgtgtgtatagattgtggttcgaggattgggagggctctgagaagcagagtactacatcaaaattgttttaagtattttttgccaataaaaaattaattttatggaaatggcttgtgctttgagaagcccagttttattctgtcttatgaaactaatttccactttgaaaattgttcttctgttgtttatggtataaatgaatggaatataatgatatcctccttctaggaaacaaagcatttccttaaaatgtttgctaggttaagctgtgctgttctactgatggttgttttaaattaataatgagaactataatttaaataatatttctttgttagacattataatgttaaactgaaagactaaattctgcaagtactatataatatttttggcttataatgctacatttttattaatgtaccttccgttttgaggatttatatctgtatttctctttgcattatacaaatataccagtattttcattctgga

SEQ ID NO: 11590 - DNA, 2115 bp, Homo sapiens
cggccgcgggggcttctcggggtccacgcacgccctgcgccgccaggacccgagcggagcctccccgcggcccggccgcgcctggtcctgagcggtaccatgatgtggggtgcaggcagccctctggcctggctctcagctggctcaggcaacgtgaatgtaagcagcgtgggcccagcagaggggcccacaggtccagccgcaccactgccctcgcctaaggcctgggatgtggtgctctgcatctcaggcaccctggtgtcctgcgagaatgcgctagtggtggccatcatcgtgggcactcctgccttccgtgcccccatgttcctgctggtgggcagcctggccgtggcagacctgctggcaggcctgggcctggtcctgcactttgctgctgtcttctgcatcggctcagcggagatgagcctggtgctggttggcgtgctggcaatggcctttaccgccagcatcggcagtctactggccatcactgtcgaccgctacctttctctgtacaatgccctcacctactattcagagacaacagtgacacggacctatgtgatgctggccttagtgtggggaggtgccctgggcctggggctgctgcctgtgctggcctggaactgcctggatggcctgaccacatgtggcgtggtttatccactctccaagaaccatctggtagttctggccattgccttcttcatggtgtttggcatcatgctgcagctctacgcccaaatctgccgcatcgtctgccgccatgcccagcagattgcccttcagcggcacctgctgcctgcctcccactatgtggccacccgcaagggcattgccacactggccgtggtgcttggagcctttgccgcctgctggttgcccttcactgtctactgcctgctgggtgatgcccactctccacctctctacacctatcttaccttgctccctgccacctacaactccatgatcaaccctatcatctacgccttccgcaaccaggatgtgcagaaagtgctgtgggctgtctgctgctgctgttcctcttccaagatccccttccgatcccgctcccccagtgatgtctagctgagtcttcatgacccttcaaccctgattactacagaattccagaatgttaggctctccagggcttctttccaaacccccagctccacaccccccagacccagctggttctggagttctaggacattgggtgtttcaaggttctgttcagatccctatgggggcccagctggctccacggttccagaatgttcaggtggtcagtgttctactcagaaatgtctcacagcccagctgggttgcaattccagaatgctgggagttttacagtgccattccaagtcccagatgtccctcttcccccaaacttgaccttgaccatgtcactttacgtttgaatttctgagctaaagagtcagagagattagtcacatagttgcctaaataggagagagaaagattatatatgcacatatacaaagacagtgtctatttatgattgatttatttatttataaatttacttatgggtggtaaggggcaaaaaagaggcccacaccttgatatccaggccataccagggtatcccttgtcccttcacccccatttctgacctcagttcctggaggggggaaagggtgaaagagaaaccacgtattttgttattattttggattattttttatcgaagagatcatagaaaccagagccttctccccaggcctgccctcctcgggtttggaaggggaacacaccagcctctggttttttatttttttaagaagccatcacctgagcaaccaaaaattcctctgcgctggggtccgactgccctctggtggccatttggggaaaactgcagcccggccaggcagctgggaccagaatgcaaccccagctccactccagcctggcgtccagggccacagccatggcctgggggccaagcctcaccctgcggtgccctaaaggagggggggcacgagccaacaccccacccctctgccaaccggggtatggcccccagtgcattccctgttcccgtctccaacccaactcaataaaaaatgattttgtcataaa

SEQ ID NO: 11591 - DNA, 2059 bp, Homo sapiens
ggatcccagcaagcgtcctttatgtatgaaaaggaagaagaaaatttccccatgaaacatattcaaagtagagaacaatctttttgattccattgttattttaattgtatacagacataggagtctttgcataattagacttttccttctttcaggactgtggatgcaaagccctggacccccagacgttataggacattactcctcagctttgcagcccggtgatgtgaagcgaaacaccatttccccttttttatggcggaagaaaacagaacacaactgcaaaggggcttttccctcccctgctcatcctctttccccaaatgaattttggtttgctgtggactctattctgctgaggaactgttcttgttgggcaaatgtagatcttgtctactctgtggcaggaaaaggccttttctttcattttgtaagaaagagcacagagttcctcctgtacctgctccagctgtgcctgcagcccctcacggccgggtgatgccattcccaaactgctcagcccccagcactgtggtggccacagctgtgggtgtcttgctggggctggagtgtgggctgggtctgctgggcaacgcggtggcgctgtggaccttcctgttccgggtcagggtgtggaagccgtacgctgtctacctgctcaacctggccctggctgacctgctgttggctgcgtgcctgcctttcctggccgccttctacctgagcctccaggcttggcatctgggccgtgtgggctgctgggccctgcacttcctgctggacctcagccgcagcgtggggatggccttcctggccgccgtggctttggaccggtacctccgtgtggtccaccctcggcttaaggtcaacctgctgtctcctcaggcggccctgggggtctcgggcctcgtctggctcctgatggtcgccctcacctgcccgggcttgctcatctctgaggccgcccagaactccaccaggtgccacagtttctactccagggcagacggctccttcagcatcatctggcaggaagcactctcctgccttcagtttgtcctcccctttggcctcatcgtgttctgcaatgcaggcatcatcagggctctccagaaaagactccgggagcctgagaaacagcccaagcttcagcgggcccaggcactggtcaccttggtggtggtgctgtttgctctgtgctttctgccctgcttcctggccagagtcctgatgcacatcttccagaatctggggagctgcagggccctttgtgcagtggctcatacctcggatgtcacgggcagcctcacctacctgcacagtgtgctcaaccccgtggtatactgcttctccagccccaccttcaggagctcctatcggagggtcttccacaccctccgaggcaaagggcaggcagcagagcccccagatttcaaccccagagactcctattcctgacaacagccagcgtcctcaacgcccgtgtttatggaactacctgcgacctaaataataattactcctactttgggattctggaagaagaagaagtcttaagactgcaatacaaggatcagagcataaacatgggcacagttgctgcaggtgtggtcttatactttgttgaccagggtggtcctctgtgattttaccttgtagagtggcaaatcaaaatgaacaagctagaacctcctcctacccaactatgatgcagattcagttgctgaactgaaaagtcgggcagctactccatctccacacttgaagaaatgtaatttgctaaatcagtgaaggaagagaagaaagccgggtgatggcatctttccaactcttacttggtctcagcaagtcattttcatttattatgcttcagttttaaatacaaaaaaaaaactatgttttcttcccacctgctgtgcagactggggatgaccgacatcagaaagtgccctggttctaaaaagagactctgctgtatataaggtactgtcgtacatgctagcctttatttggaacataacatttttgttttcataaaattttgcttcatttttctaga

SEQ ID NO: 11592 - DNA, 1071 bp, Homo sapiens
atgaatggggtctcggaggggaccagaggctgcagtgacaggcaacctggggtcctgacacgtgatcgctcttgttccaggaagatgaactcttccggatgcctgtctgaggaggtggggtccctccgcccactgactgtggttatcctgtctgcgtccattgtcgtcggagtgctgggcaatgggctggtgctgtggatgactgtcttccgtatggcacgcacggtctccaccgtctgcttcttccacctggcccttgccgatttcatgctctcactgtctctgcccattgccatgtactatattgtctccaggcagtggctcctcggagagtgggcctgcaaactctacatcacctttgtgttcctcagctactttgccagtaactgcctccttgtcttcatctctgtggaccgttgcatctctgtcctctaccccgtctgggccctgaaccaccgcactgtgcagcgggcgagctggctggcctttggggtgtggctcctggccgccgccttgtgctctgcgcacctgaaattccggacaaccagaaaatggaatggctgtacgcactgctacttggcgttcaactctgacaatgagactgcccagatttggattgaaggggtcgtggagggacacattatagggaccattggccacttcctgctgggcttcctggggcccttagcaatcataggcacctgcgcccacctcatccgggccaagctcttgcgggagggctgggtccatgccaaccggcccaagaggctgctgctggtgctggtgagcgctttctttatcttctggtccccgtttaacgtggtgctgttggtccatctgtggcgacgggtgatgctcaaggaaatctaccacccccggatgctgctcatcctccaggctagctttgccttgggctgtgtcaacagcagcctcaaccccttcctctacgtcttcgttggcagagatttccaagaaaagtttttccagtctttgacttctgccctggcgagggcgtttggagaggaggagtttctgtcatcctgtccccgtggcaacgccccccgggaatga

SEQ ID NO: 11593 - DNA, 1815 bp, Homo sapiens
agctgacacaaccaagacgagtctcagtgtctagggaagcttggggttctgctccttttacttcaggcgaacctgaactttaatgcaattttgaagcatgccctgaatagattcagtcattatcaagtcaaactaaaaacggtgaaaggttgcgactattaccaaatagaagacaatgagaagtcataccataacaatgacgacaacttcagtcagcagctggccttactcctcccacagaatgcgctttataaccaatcatagcgaccaaccgccacaaaacttctcagcaacaccaaatgttactacctgtcccatggatgaaaaattgctatctactgtgttaaccacatcctactctgttattttcatcgtgggactggttgggaacataatcgccctctatgtatttctgggtattcaccgtaaaagaaattccattcaaatttatctacttaacgtagccattgcagacctcctactcatcttctgcctccctttccgaataatgtatcatattaaccaaaacaagtggacactaggtgtgattctgtgcaaggttgtgggaacactgttttatatgaacatgtacattagcattattttgcttggattcatcagtttggatcgctatataaaaattaatcggtctatacagcaacggaaggcaataacaaccaaacaaagtatttatgtctgttgtatagtatggatgcttgctcttggtggattcctaactatgattattttaacacttaagaaaggagggcataattccacaatgtgtttccattacagagataagcataacgcaaaaggagaagccatttttaacttcattcttgtggtaatgttctggctaattttcttactaataatcctttcatatattaagattgggaagaatctattgaggatttctaaaaggaggtcaaaatttcctaattctggtaaatatgccactacagctcgtaactcctttattgtacttatcatttttactatatgttttgttccctatcatgcctttcgattcatctacatttcttcacagctaaatgtatcatcttgctactggaaagaaattgttcacaaaaccaatgagatcatgctggttctctcatctttcaatagttgcttagatccagtcatgtatttcctgatgtccagtaacattcgcaaaataatgtgccaacttctttttagacgatttcaaggtgaaccaagtaggagtgaaagcacttcagaatttaaaccaggatactccctgcatgatacatctgtggcagtgaaaatacagtctagttctaaaagtacttgaggtaaacatactaaaatgaattatataatgcagcctcttaattctttgaagaactaaaaaattaggaaacaaagttctagcatttacaaaactcagatctcaaagctctgcttgtatttgtgatatttcatttgcttaactgtaaaccatttcaaggtactaacttttaaatctgtatgtaaaatcttttcaaaatacatttttaagctaatactcttaacatagattatgaagttaagtgaaatttatggctctaacagcaaaataattaaagtgccatagtttctcaagtgactaaagtagttattaaaatcaagcacttgatactaatttgaagtgtgtttaaaagtaaatgatttgggaactgacaatgtgtcagaaaatatatgttcatttatcattttaaaatcttgtataatttgccactgtattcatttatgcctaaatctctataacagatgaaaagataattaataaaatcctaattaaaaaat

SEQ ID NO: 11594 - DNA, 1924 bp, Homo sapiens
aaccaattgcaccacgaccggatggaagagcccagctgacacaaccaagacgagtctcagtgtctagggaagcttggggttctgctccttttacttcaggcgaacctgaactcagttaatgcaattttgaagcatgccctgaatagattcagtcattatcaagtcaaactaaaaacggtgaaaggttgcgactattaccaaataggaaaaatctgaagacataagaactacacatgaggaatatgtcatttagcactttcactttttgatctccacagaagacaatgagaagtcataccataacaatgacgacaacttcagtcagcagctggccttactcctcccacagaatgcgctttataaccaatcatagcgaccaaccgccacaaaacttctcagcaacaccaaatgttactacctgtcccatggatgaaaaattgctatctactgtgttaaccacatcctactctgttattttcatcgtgggactggttgggaacataatcgccctctatgtatttctgggtattcaccgtaaaagaaattccattcaaatttatctacttaacgtagccattgcagacctcctactcatcttctgcctccctttccgaataatgtatcatattaaccaaaacaagtggacactaggtgtgattctgtgcaaggttgtgggaacactgttttatatgaacatgtacattagcattattttgcttggattcatcagtttggatcgctatataaaaattaatcggtctatacagcaacggaaggcaataacaaccaaacaaagtatttatgtctgttgtatagtatggatgcttgctcttggtggattcctaactatgattattttaacacttaagaaaggagggcataattccacaatgtgtttccattacagagataagcataacgcaaaaggagaagccatttttaacttcattcttgtggtaatgttctggctaattttcttactaataatcctttcatatattaagattgggaagaatctattgaggatttctaaaaggaggtcaaaatttcctaattctggtaaatatgccactacagctcgtaactcctttattgtacttatcatttttactatatgttttgttccctatcatgcctttcgattcatctacatttcttcacagctaaatgtatcatcttgctactggaaagaaattgttcacaaaaccaatgagatcatgctggttctctcatctttcaatagttgcttagatccagtcatgtatttcctgatgtccagtaacattcgcaaaataatgtgccaacttctttttagacgatttcaaggtgaaccaagtaggagtgaaagcacttcagaatttaaaccaggatactccctgcatgatacatctgtggcagtgaaaatacagtctagttctaaaagtacttgaggtaaacatactaaaatgaattatataatgcagcctcttaattctttgaagaactaaaaaattaggaaacaaagttctagcatttacaaaactcagatctcaaagctctgcttgtatttgtgatatttcatttgcttaactgtaaaccatttcaaggtactaacttttaaatctgtatgtaaaatcttttcaaaatacatttttaagctaatactcttaacatagattatgaagttaagtgaaatttatggctctaacagcaaaataattaaagtgccatagtttctcaagtgactaaagtagttattaaaatcaagcacttgatactaatttgaagtgtgtttaaaagtaaatgatttgggaactgacaatgtgtcagaaaatatatgttcatttatcattttaaaatcttgtataatttgccactgtattcatttatgcctaaatctctataacagatgaaaagataattaataaaatcctaattaaaaaat

SEQ ID NO: 11595 - DNA, 1282 bp, Homo sapiens
ggttctgctccttttacttcaggcgaacctgaactcagttaatgcaattttgaagcatgccctgaatagattcagtcattatcaagtcaaactaaaaacggtgaaaggttgcgactattaccaaataggaaaaatctgaagacataagaactacacatgaggaatatgtcatttagcactttcactttttgatctccacagaagacaatgagaagtcataccataacaatgacgacaacttcagtcagcagcaacaccaaatgttactacctgtcccatggatgaaaaattgctatctactgtgttaaccacatcctactctgttattttcatcgtgggactggttgggaacataatcgccctctatgtatttctgggtattcaccgtaaaagaaattccattcaaatttatctacttaacgtagccattgcagacctcctactcatcttctgcctccctttccgaataatgtatcatattaaccaaaacaagtggacactaggtgtgattctgtgcaaggttgtgggaacactgttttatatgaacatgtacattagcattattttgcttggattcatcagtttggatcgctatataaaaattaatcggtctatacagcaacggaaggcaataacaaccaaacaaagtatttatgtctgttgtatagtatggatgcttgctcttggtggattcctaactatgattattttaacacttaagaaaggagggcataattccacaatgtgtttccattacagagataagcataacgcaaaaggagaagccatttttaacttcattcttgtggtaatgttctggctaattttcttactaataatcctttcatatattaagattgggaagaatctattgaggatttctaaaaggaggtcaaaatttcctaattctggtaaatatgccactacagctcgtaactcctttattgtacttatcatttttactatatgttttgttccctatcatgcctttcgattcatctacatttcttcacagctaaatgtatcatcttgctactggaaagaaattgttcacaaaaccaatgagatcatgctggttctctcatctttcaatagttgcttagatccagtcatgtatttcctgatgtccagtaacattcgcaaaataatgtgccaacttctttttagacgatttcaaggtgaaccaagtaggagtgaaagcacttcagaatttaaaccaggatactccctgcatgatacatctgtggcagtgaaaatacagtctagttctaaaagtacttga

SEQ ID NO: 11596 - DNA, 2249 bp, Homo sapiens
ctttagtcacttccagctccaggcacagcagttggtgactccttggtgggagccgtgtcccacccggtcctgatactgccgtcttctctttcacagtcctccaggcttgggccagccttgggggcagcagagcttctgggctgacatgggctcattgctccttctccaagccctctgaggacatcaaaagcgtggacgcatcactttccaccatcttgctgcccactgtccctccatcctgaggcctcctaagcacatgtgtggggtggcaggcacactgctgatagctgtggatgcggccgtgacatccttcacccctgcccccatggcatgcatgatccattagggaggaccgtctgcacaaaggtctcttgccctgtgcagcttcctgcagactggacttgcaaagtccagcctgtatggctggagttcccatgcctgccaatctcctgtcgactgcgagtcagctccgatacttcaccagattcagccacctgggggagctggaagtgaatctcctcgtagctgagccttctgatgagactgcagccccggctgacacctggattgcagactcatgaaagacctgaaactctaccaacagccacctgggggagctggaagtgaatctcctcgtagctgagccttctgatgagactgcagccccggctgacacctggattgcagactcatgaaagaccctgagcagaggacccagtttggcagagcccgaattcctgacccacaggaactgggagataaaactctgtggttttaatcttctcattttagagtgctcagtgtcctgtggtgtgaacacgcttcattcaacctgggcccttgggagagatgctgagtggttcccgggctgtccccactccacaccgtggcagtgaagagctgctgaagtacatgcttcatagtccttgcgtctctctgaccatgaatggcacctacaacacctgtggctccagcgacctcacctggcccccagcgatcaagctgggcttctacgcctacttgggcgtcctgctggtgctaggcctgctgctcaacagcctggcgctctgggtgttctgctgccgcatgcagcagtggacggagacccgcatctacatgaccaacctggcggtggccgacctctgcctgctgtgcaccttgcccttcgtgctgcactccctgcgagacacctcagacacgccgctgtgccagctctcccagggcatctacctgaccaacaggtacatgagcatcagcctggtcacggccatcgccgtggaccgctatgtggccgtgcggcacccgctgcgtgcccgcgggctgcggtcccccaggcaggctgcggccgtgtgcgcggtcctctgggtgctggtcatcggctccctggtggctcgctggctcctggggattcaggagggcggcttctgcttcaggagcacccggcacaatttcaactccatggcgttcccgctgctgggattctacctgcccctggccgtggtggtcttctgctccctgaaggtggtgactgccctggcccagaggccacccaccgacgtggggcaggcagaggccacccgcaaggctgcccgcatggtctgggccaacctcctggtgttcgtggtctgcttcctgcccctgcacgtggggctgacagtgcgcctcgcagtgggctggaacgcctgtgccctcctggagacgatccgtcgcgccctgtacataaccagcaagctctcagatgccaactgctgcctggacgccatctgctactactacatggccaaggagttccaggaggcgtctgcactggccgtggctcccagtgctaaggcccacaaaagccaggactctctgtgcgtgaccctcgcctaagaggcgtgctgtgggcgctgtgggccaggtctcgggggctccgggaggtgctgcctgccaggggaagctggaaccagtagcaaggagcccgagatcagccctgaactcactgtgtattctcttggagccttgggtgggcagggacggcccaggtacctgctctcttgggaagagagagggacagggacaagggcaagaggactgaggccagagcaaggccaatgtcagagacccccgggatggggcctcacacttgccacccccagaaccagctcacctggccagagtgggttcctgctggccagggtgcagccttgatgacacctgccgctgcccctcggggctggaataaaactccccacccagagtcagtccta

SEQ ID NO: 11597 - DNA, 2032 bp, Homo sapiens
agctccaggcacagcagttggtgactccttggtgggagccgtgtcccacccggtcctgatactgccgtcttctctttcacagtcctccaggcttgggccagccttgggggcagcagagcttctgggctgacatgggctcattgctccttctccaagccctctgaggacatcaaaagcgtggacgcatcactttccaccatcttgctgcccactgtccctccatcctgaggcctcctaagcacatgtgtggggtggcaggcacactgctgatagctgtggatgcggccgtgacatccttcacccctgcccccatggcatgcatgatccattagggaggaccgtctgcacaaaggtctcttgccctgtgcagcttcctgcagactggacttgcaaagtccagcctgtatggctggagttcccatgcctgccaatctcctgtcgactgcgagtcagctccgatacttcaccagattcagccacctgggggagctggaagtgaatctcctcgtagctgagccttctgatgagactgcagccccggctgacacctggattgcagactcatgaaagaccctgagcagaggacccagtttggcagagcccgaattcctgacccacaggaactgggagataaaactctgtggttttaatcttctcattttagagtgctcagtgtcctgtggtgtgaacacgcttcattcaacctgggcccttgggagagatgctgagtggttcccgggctgtccccactccacaccgtggcagtgaagagctgctgaagtacatgcttcatagtccttgcgtctctctgaccatgaatggcacctacaacacctgtggctccagcgacctcacctggcccccagcgatcaagctgggcttctacgcctacttgggcgtcctgctggtgctaggcctgctgctcaacagcctggcgctctgggtgttctgctgccgcatgcagcagtggacggagacccgcatctacatgaccaacctggcggtggccgacctctgcctgctgtgcaccttgcccttcgtgctgcactccctgcgagacacctcagacacgccgctgtgccagctctcccagggcatctacctgaccaacaggtacatgagcatcagcctggtcacggccatcgccgtggaccgctatgtggccgtgcggcacccgctgcgtgcccgcgggctgcggtcccccaggcaggctgcggccgtgtgcgcggtcctctgggtgctggtcatcggctccctggtggctcgctggctcctggggattcaggagggcggcttctgcttcaggagcacccggcacaatttcaactccatggcgttcccgctgctgggattctacctgcccctggccgtggtggtcttctgctccctgaaggtggtgactgccctggcccagaggccacccaccgacgtggggcaggcagaggccacccgcaaggctgcccgcatggtctgggccaacctcctggtgttcgtggtctgcttcctgcccctgcacgtggggctgacagtgcgcctcgcagtgggctggaacgcctgtgccctcctggagacgatccgtcgcgccctgtacataaccagcaagctctcagatgccaactgctgcctggacgccatctgctactactacatggccaaggagttccaggaggcgtctgcactggccgtggctcccagtgctaaggcccacaaaagccaggactctctgtgcgtgaccctcgcctaagaggcgtgctgtgggcgctgtgggccaggtctcgggggctccgggaggtgctgcctgccaggggaagctggaaccagtagcaaggagcccgagatcagccctgaactcactgtgtattctcttggagccttgggtgggcagggacggcccaggtacctgctctcttgggaagagagagggacagggacaagggcaagaggactgaggccagagcaaggccaatgtcagagacccccgggatggggcctcacacttgccacccccagaaccagctcacctggccagagt

SEQ ID NO: 11598 - DNA, 1258 bp, Homo sapiens
agaacaaatgtgtgccctcagcaaggatgctggctcttcagaggtgtcagcacaggcagccggcaccccacttccctcccagaaatcccccacgccctctagctggggctggtgcaggagcagtggggaactcctgttacccctgacctgctgccgtcagtcagccgcccgcccccccaccttaaggaggggcagagtcagggaccagccctgaggggtggctcaccccagcttcacttcccccagcccttctcagacagccactgtgcaggctttggcagcgggggtcacacactccacccgggaggccaaagctgcctgcaggaccatgaatggcacctacaacacctgtggctccagcgacctcacctggcccccagcgatcaagctgggcttctacgcctacttgggcgtcctgctggtgctaggcctgctgctcaacagcctggcgctctgggtgttctgctgccgcatgcagcagtggacggagacccgcatctacatgaccaacctggcggtggccgacctctgcctgctgtgcaccttgcccttcgtgctgcactccctgcgagacacctcagacacgccgctgtgccagctctcccagggcatctacctgaccaacaggtacatgagcatcagcctggtcacggccatcgccgtggaccgctatgtggccgtgcggcacccgctgcgtgcccgcgggctgcggtcccccaggcaggctgcggccgtgtgcgcggtcctctgggtgctggtcatcggctccctggtggctcgctggctcctggggattcaggagggcggcttctgcttcaggagcacccggcacaatttcaactccatggcgttcccgctgctgggattctacctgcccctggccgtggtggtcttctgctccctgaaggtggtgactgccctggcccagaggccacccaccgacgtggggcaggcagaggccacccgcaaggctgcccgcatggtctgggccaacctcctggtgttcgtggtctgcttcctgcccctgcacgtggggctgacagtgcgcctcgcagtgggctggaacgcctgtgccctcctggagacgatccgtcgcgccctgtacataaccagcaagctctcagatgccaactgctgcctggacgccatctgctactactacatggccaaggagttccaggaggcgtctgcactggccgtggctcccagtgctaaggcccacaaaagccaggactctctgtgcgtgaccctcgcctaa

SEQ ID NO: 11599 - DNA, 1875 bp, Homo sapiens
caggccagagtcccagctgtcctggactctgctgtggggaagggctgatgcaggtgtggagtcaaatgtgggtgcctcctgcagccgggtgccaggaggggtggaggggccaccctgggctttgtccgggagcctggtcttcccgtccttgggctgacaggtgctgctgcctctgagccctccctgctaagagctgtgtgctgggtaaggctggtggccctttgggctccctgtccaggatttgcgctctggagggtagggcttgctgggctggggactggaggggaacgtggagctccttctgcctcctttcctgccccatgacagcaggcagatcccaggagagaagagctcaggagatgggaagaggatctgtccaggggttagacctcaagggtgacttggagttctttacggcacccatgctttctttgaggagttttgtgtttgtgggtgtggggtcggggctcacctcctcccacatccctgcccagaggtgggcagagtgggggcagtgccttgctccccctgctcactctctgctgacctccggctccctgtgctgccccaggaccatgaatggcacctacaacacctgtggctccagcgacctcacctggcccccagcgatcaagctgggcttctacgcctacttgggcgtcctgctggtgctaggcctgctgctcaacagcctggcgctctgggtgttctgctgccgcatgcagcagtggacggagacccgcatctacatgaccaacctggcggtggccgacctctgcctgctgtgcaccttgcccttcgtgctgcactccctgcgagacacctcagacacgccgctgtgccagctctcccagggcatctacctgaccaacaggtacatgagcatcagcctggtcacggccatcgccgtggaccgctatgtggccgtgcggcacccgctgcgtgcccgcgggctgcggtcccccaggcaggctgcggccgtgtgcgcggtcctctgggtgctggtcatcggctccctggtggctcgctggctcctggggattcaggagggcggcttctgcttcaggagcacccggcacaatttcaactccatggcgttcccgctgctgggattctacctgcccctggccgtggtggtcttctgctccctgaaggtggtgactgccctggcccagaggccacccaccgacgtggggcaggcagaggccacccgcaaggctgcccgcatggtctgggccaacctcctggtgttcgtggtctgcttcctgcccctgcacgtggggctgacagtgcgcctcgcagtgggctggaacgcctgtgccctcctggagacgatccgtcgcgccctgtacataaccagcaagctctcagatgccaactgctgcctggacgccatctgctactactacatggccaaggagttccaggaggcgtctgcactggccgtggctcccagtgctaaggcccacaaaagccaggactctctgtgcgtgaccctcgcctaagaggcgtgctgtgggcgctgtgggccaggtctcgggggctccgggaggtgctgcctgccaggggaagctggaaccagtagcaaggagcccgagatcagccctgaactcactgtgtattctcttggagccttgggtgggcagggacggcccaggtacctgctctcttgggaagagagagggacagggacaagggcaagaggactgaggccagagcaaggccaatgtcagagacccccgggatggggcctcacacttgccacccccagaaccagctcacctggccagagtgggttcctgctggccagggtgcagccttgatgacacctgccgctgcccctcggggctggaataaaactccccacccagagtc

SEQ ID NO: 11600 - DNA, 2032 bp, Homo sapiens; identical to SEQ ID NO: 11597

SEQ ID NO: 11601 - DNA, 3021 bp, Homo sapiens
ggggttggaatcccgcttctcctcggcagcagtaggctcgcaagtcgctggggttaggtggggcaagagtttcgccggcgcatcagcgctgcttcggactgtttgcaacgtgtttccagcgagctgggagcggggttgtgactgcgagtcgtctgggggagggggacttgtttttcttttcctctagagacctcggcttgcaactggatcaaacgctgtcgaaaggatgtaaataggcagagcaactgttaccaagaaggccaccacccccacccaaaggcagtgaggagtgtggggcttcgtctgggctcccccgagtctcaacagtaatcaacagtcaggtgttgattgcaacttttcaaggtcagccaccgggagtagcctattccctctaggaaccttggagggcataccttgctgggactcaacttggctgagaaatgcacaagatgccaaaggaggaaggattatagggggcgtgtgtgtgacccccaagaccgatcttccgctatcaccctaatctccggttccccgctacccgggcgggggtgagtatgtgacatgtgcctaactctcagcagcaacttcggcagcaggtgtcgatcctaactaagcaggagctgcggctgccgggtgtgccctcaccaagccatgcgagccccgggcgcgcttctcgcccgcatgtcgcggctactgcttctgctactgctcaaggtgtctgcctcttctgccctcggggtcgcccctgcgtccagaaacgaaacttgtctgggggagagctgtgcacctacagtgatccagcgccgcggcagggacgcctggggaccgggaaattctgcaagagacgttctgcgagcccgagcacccagggaggagcagggggcagcgtttcttgcgggaccctcctgggacctgccggcggccccgggccgtgacccggctgcaggcagaggggcggaggcgtcggcagccggacccccgggacctccaaccaggccacctggcccctggaggtggaaaggtgctcggggtcaggagccttctgaaactttggggagagggaaccccacggccctccagctcttccttcagatctcagaggaggaagagaagggtcccagaggcgctggcatttccgggcgtagccaggagcagagtgtgaagacagtccccggagccagcgatcttttttactggccaaggagagccgggaaactccagggttcccaccacaagcccctgtccaagacggccaatggactggcggggcacgaagggtggacaattgcactcccgggccgggcgctggcccagaatggatccttgggtgaaggaatccatgagcctgggggtccccgccggggaaacagcacgaaccggcgtgtgagactgaagaaccccttctacccgctgacccaggagtcctatggagcctacgcggtcatgtgtctgtccgtggtgatcttcgggaccggcatcattggcaacctggcggtgatgtgcatcgtgtgccacaactactacatgcggagcatctccaactccctcttggccaacctggccttctgggactttctcatcatcttcttctgccttccgctggtcatcttccacgagctgaccaagaagtggctgctggaggacttctcctgcaagatcgtgccctatatagaggtcgcttctctgggagtcaccactttcaccttatgtgctctgtgcatagaccgcttccgtgctgccaccaacgtacagatgtactacgaaatgatcgaaaactgttcctcaacaactgccaaacttgctgttatatgggtgggagctctattgttagcacttccagaagttgttctccgccagctgagcaaggaggatttggggtttagtggccgagctccggcagaaaggtgcattattaagatctctcctgatttaccagacaccatctatgttctagccctcacctacgacagtgcgagactgtggtggtattttggctgttacttttgtttgcccacgcttttcaccatcacctgctctctagtgactgcgaggaaaatccgcaaagcagagaaagcctgtacccgagggaataaacggcagattcaactagagagtcagatgaactgtacagtagtggcactgaccattttatatggattttgcattattcctgaaaatatctgcaacattgttactgcctacatggctacaggggtttcacagcagacaatggacctccttaatatcatcagccagttccttttgttctttaagtcctgtgtcaccccagtcctccttttctgtctctgcaaacccttcagtcgggccttcatggagtgctgctgctgttgctgtgaggaatgcattcagaagtcttcaacggtgaccagtgatgacaatgacaacgagtacaccacggaactcgaactctcgcctttcagtaccatacgccgtgaaatgtccacttttgcttctgtcggaactcattgctgaaggacagtacttggttgggtcagatttatttgtttgattttcatatcccgtgaaagtttttaattcatatttttccttatagggaaaaatgcaaaaaagaaacaataaagaaagaaatattaactactgtagaactgattttacaaattaatatttgtgctttgaaaaaaagtttctatttagttatttaagaagaatgagaaggccaatagttttagattattttatctggtatggtgctaatattttatttgaaaaaagttactgcaacttaacttaaaattgctaacgttttttcttcttttaaaaatacaattattgtatattgattatagcaatgtgattttgtaggttattttatatttgagttgtgattgaaagtatgttgtatatggtattgtgagatgatttgtacttggaagcattcacaaagtagcaccaaataaattacactttattctttaatgtcattgtcaatctacttttaaccaatattcaataaatcttctaattgccttaaagatacaa

SEQ ID NO: 11602 - DNA, 2784 bp, Homo sapiens
atgattaatcgctgaccaccccgcctcccgcagctcgggagagggtgctctgggaatgtggaccggggctctcaagtgccggcagctggaaaggaagaggagtgctgcgaggcggagtgcgccctcggcgaagaggggcagaggcggagcgccaggtgctgcggtctcactcccagccagccaggagtttagaacgttcttcctccgccctctccccgcctcgccccagccacatacactcccaaacctcaacacccaggcgcctcctgggcctctcctaggttgggctgctccagcaagtttccatgaaagcacctgaaatactaagttaccttcgcgaggagaactcgagtgagataaaatcgtgcgcccacgcaggtgagtttgcagccaagaattttggacgctgctgggaggagaaagggaagttgagaaagtctttggacctggtagcctggtgctctttctcatggcttcacccagcctcccgggcagtgactgctcccaaatcattgatcacagtcatgtccccgagtttgaggtggccacctggatcaaaatcacccttattctggtgtacctgatcatcttcgtgatgggccttctggggaacagcgccaccattcgggtcacccaggtgctgcagaagaaaggatacttgcagaaggaggtgacagaccacatggtgagtttggcttgctcggacatcttggtgttcctcatcggcatgcccatggagttctacagcatcatctggaatcccctgaccacgtccagctacaccctgtcctgcaagctgcacactttcctcttcgaggcctgcagctacgctacgctgctgcacgtgctgacactcagctttgagcgctacatcgccatctgtcaccccttcaggtacaaggctgtgtcgggaccttgccaggtgaagctgctgattggcttcgtctgggtcacctccgccctggtggcactgcccttgctgtttgccatgggtactgagtaccccctggtgaacgtgcccagccaccggggtctcacttgcaaccgctccagcacccgccaccacgagcagcccgagacctccaatatgtccatctgtaccaacctctccagccgctggaccgtgttccagtccagcatcttcggcgccttcgtggtctacctcgtggtcctgctctccgtagccttcatgtgctggaacatgatgcaggtgctcatgaaaagccagaagggctcgctggccgggggcacgcggcctccgcagctgaggaagtccgagagcgaagagagcaggaccgccaggaggcagaccatcatcttcctgaggctgattgttgtgacattggccgtatgctggatgcccaaccagattcggaggatcatggctgcggccaaacccaagcacgactggacgaggtcctacttccgggcgtacatgatcctcctccccttctcggagacgtttttctacctcagctcggtcatcaacccgctcctgtacacggtgtcctcgcagcagtttcggcgggtgttcgtgcaggtgctgtgctgccgcctgtcgctgcagcacgccaaccacgagaagcgcctgcgcgtacatgcgcactccaccaccgacagcgcccgctttgtgcagcgcccgttgctcttcgcgtcccggcgccagtcctctgcaaggagaactgagaagattttcttaagcacttttcagagcgaggccgagccccagtctaagtcccagtcattgagtctcgagtcactagagcccaactcaggcgcgaaaccagccaattctgctgcagagaatggttttcaggagcatgaagtttgaatgtcaagcgagggagccttgagtgggaactggccctccagccctaagaaaacgtcactctcactctgcagtctcaaactatgcccccatcagggatggaatggacactggaggctttacaaaaggcagatgcccacctcagtgacttctaaggactgactctgccagcctggccttgactccggttacacagacatgggggtgaactttcactccacctccttccttcaagtacatactgaaaattcagtcaggctgaatttattcagaatgctttaccgagctctttcattatttgcacaggaacaaaagagaacacggactcccgctccctacccagaataaaaggacacccagaagaaactcactcagggaggtggggggttgggggcgagggctggaagaacaatgcaggagggggtggcatctccttcagcttcagcagtgtgccgagaagagggctaatttgaggaacaggatggtggtgcggagccctggcctgagggccgaggcagaacttccccttttcttgggccttggcccgttacaaagaggggtgttgcagcagctgatgcaaactgagttcagtttccctggggagcagaaggactggtacccggcagaggcgatgagacaggccgctgatgatgcacaggacttgcggtacatgatccctgtaacacagacccaaaggagctgagttaacgtgcaccggcaaaagaatagctgtccctctcagcccaaatccaaacggacagctcttccttactcctcccacagcccagagactaggtgaggtcagggaagtgcttcggattgtctcattgatattcaagatagatggtgaaagagacaggcactatttcattagttttaacaaaactgttccaaaagcgatttgagatgccaatacctgtgaatacctgttaataaagagctgttaaatagactta

SEQ ID NO: 11603 - DNA, 3045 bp, Homo sapiens
gctgttctgccccgcgggggcatccgctgggtccccgcgccgttgtcaagaccggggacctggacgcagcggagagaggtgccgccgcccgccccgtccagtcgccgcgcgcaggcactgcagtcagcggtgaactgacttcatcccaatccctcagcccccaccaggaccagtctggagtccctcccctgcccccattgaaatttcccttccgtccccaaacttacctctgatctagaccttactcacctccttcctgtttcctaagactccttcctgccgtccacagaccgagccttttatctttgtccaccctgtgccagacacctccttttccagaaccttctccttactggtgaccttacttatctctgttgctttctggggtcctaggaaatgccagcactcccacccacattgcctgaactttccaacactccctaactgcgctgtgtcctatctcaacactttctcatgtatttcttgtgtcttctagaacattcccccgccattattacttcaatatggctacacatacttcctaattgccctgcaaaccatctccttctcaccattgcccagcgatgctttcgtctcctccataaacactcccggagaccaatttttgtgtcacccccatactccctcgttgacacactgactccatacataacctccttgaaaaacctctttattaatctcaccatcctccagacttccctcctgtcataattccatccctcctccaacttttccctctcaagctctgcccttcccagcccagcccagcctacccaacctcatctcttccctgtagaccacatcccaccatgttcccctgagcctccaaggaaggggctcagggggccccatggcctcccgctccctgtggccccacagcccccgtgggccaggggaagcgccccagaagccgaagtgcccaccatgggcaaccacacgtgggagggctgccacgtggactcgcgcgtggaccacctctttccgccatccctctacatctttgtcatcggcgtggggctgcccaccaactgcctggctctgtgggcggcctaccgccaggtgcaacagcgcaacgagctgggcgtctacctgatgaacctcagcatcgccgacctgctgtacatctgcacgctgccgctgtgggtggactacttcctgcaccacgacaactggatccacggccccgggtcctgcaagctctttgggttcatcttctacaccaatatctacatcagcatcgccttcctgtgctgcatctcggtggaccgctacctggctgtggcccacccactccgcttcgcccgcctgcgccgcgtcaagaccgccgtggccgtgagctccgtggtctgggccacggagctgggcgccaactcggcgcccctgttccatgacgagctcttccgagaccgctacaaccacaccttctgctttgagaagttccccatggaaggctgggtggcctggatgaacctctatcgggtgttcgtgggcttcctcttcccgtgggcgctcatgctgctgtcgtaccggggcatcctgcgggccgtgcggggcagcgtgtccaccgagcgccaggagaaggccaagatcaagcggctggccctcagcctcatcgccatcgtgctggtctgctttgcgccctatcacgtgctcttgctgtcccgcagcgccatctacctgggccgcccctgggactgcggcttcgaggagcgcgtcttttctgcataccacagctcactggctttcaccagcctcaactgtgtggcggaccccatcctctactgcctggtcaacgagggcgcccgcagcgatgtggccaaggccctgcacaacctgctccgctttctggccagcgacaagccccaggagatggccaatgcctcgctcaccctggagaccccactcacctccaagaggaacagcacagccaaagccatgactggcagctgggcggccactccgccctcccagggggaccaggtgcagctgaagatgctgccgccagcacaatgaaccccgagtggcacagaatccccagttttcccctctcatcccacagtcccttctctcctggtctggtgtatgcaaattgtatggaaaaagggctgtgttaatattcataagaatacaagaacttaggaagagtgaggttggtgtgtcactggtcaacctttgtgctcccagatcccatcacagtttggcgattgtggagggcctcctgaaggaggagatgagtaaatatatttttttggagacagggtctcactgtgttgcccaggctggagtgcagtagtgcagtcgtggctcactgcagcctccacctcctgggctctccagcgatcttcccacatcagcctcccgagtagctgggaccacaaatgtgagccaccatgcctggctaatttttgtactttttgtagaaatggagtctcactatgtttcccaggctgatcttgaactcctgggctcaagagatcctcctgccttggcctcccaaagtgctcagattagagatgtgagccgccatgtctggccagataaattaagtcaaacatttggtttccagaaaataaagacaaatagagaaggttagatttttttttttccaacaagtggataaaagtctgtgactcgggggaaagtggaaggagaaatgcagccgatatagagtcattatgtttgcaaagcccctggtcatacaggccagggaacataagaccgcaattctaagtttctagataaacagcgatctccaagtcaagactgaggatgaagagggagaatgtcagaactcaagtgaagggcaatcagggcagactgcctggaggagtgatgccagaaggtttgggaagaaggtgtgggacaagaagaaagggtatttattcattcattcaacagaggtttatgtagggcactgtgctgggtggggctggggacacaacaatgactgaggcagcctggccttgccttcacagggctcaccatacacaagtaaataaaaaatatgtaatgtttggaattgct

SEQ ID NO: 11604 - DNA, 1795 bp, Homo sapiens
cccctttttgcatactgaccagccctggcaacggagctcaaggcatctttgtgccactgctcaacagtgagtgatgtcatgggcacggccaggtctttatcagttctgccggataaatagccaactgcactaggtctggagagacagcaaggtgctgtgcggcagagcatttggggtctcaaagaagcagtggccaccaccatggatacaggccccgaccagtcctacttctccggcaatcactggttcgtcttctcggtgtaccttctcactttcctggtggggctccccctcaacctgctggccctggtggtcttcgtgggcaagctgcggtgccgcccggtggccgtggacgtgctcctgctcaacctgaccgcctcggacctgctcctgctgctgttcctgcctttccgcatggtggaggcagccaatggcatgcactggcccctgcccttcatcctctgcccactctctggattcatcttcttcaccaccatctatctcaccgccctcttcctggcagctgtgagcattgaacgcttcctgagtgtggcccacccactgtggtacaagacccggccgaggctggggcaggcaggtctggtgagtgtggcctgctggctgttggcctctgctcactgcagcgtggtctacgtcatagaattctcaggggacatctcccacagccagggcaccaatgggacctgctacctggagttctggaaggaccagctagccatcctcctgcccgtgcggctggagatggctgtggtcctctttgtggtcccgctgatcatcaccagctactgctacagccgcctggtgtggatcctcggcagagggggcagccaccgccggcagaggagggtggcggggctggtggcggccacgctgctcaacttccttgtctgctttgggccctacaacgtgtcccatgtcgtgggctatatctgcggtgaaagcccggtgtggaggatctacgtgacgcttctcagcaccctgaactcctgtgtcgacccctttgtctactacttctcctcctccgggttccaagccgactttcatgagctgctgaggaggttgtgtgggctctggggccagtggcagcaggagagcagcatggagctgaaggagcagaagggaggggaggagcagagagcggaccgaccagctgaaagaaagaccagtgaacactcacagggctgtggaactggtggccaggtggcctgtgctgaaaactaggtcctccgggggaggagggtgtagctggcgtgtcatcctcagggcgcttcctcgctcacgccaggagggacttggagtggcgagctggggcccgatggggcttgggggcagagtagacatctagcctccctaagggtatgcgcgctaaagcccagctctcgatctcacctccatccccatccacccacacactatggattgggctctgggaaggggtcagggtgagaggctgctctggagaacaatgaggtcctcatagcagcaggcagctcctgtgttttcttgagggtggcagaggagctaagagcagtgcccaggtctgagggggctgcccagtgagtggcaggggcaggagaggggagaaccccatcctcagagctgctcccagccagcgagtcaggagcgggggagacagggctccagggatgaggccgcattctgctcccacagtgccttttccagaaagttcccattgctcaataaatgtggatcatcagagacatttatgaacaatgacagaagaaaaattacccaaataaatgtggaagcaagc

SEQ ID NO: 11605 - DNA, 1725 bp, Homo sapiens
cagaggtccacagacatccaggaagatgcagccagcagacaaagaatggcagccacccaagtgctgaggggagccctcccggccatttctgtcccagctccaagggtctctccacgatggcctgcaacagcacgtcccttgaggcttacacatacctgctgctgaacaccagcaacgcctcagactcggggtccacccagttgcccgcacccctcaggatctccttggccatagtgatgctgctgatgaccgtggtggggttcctgggcaacactgtggtctgcatcatcgtgtaccagaggccggctatgcgctcggccatcaacctgctgctggccaccctggccttctccgacatcatgctgtccctctgctgcatgcccttcaccgccgtcaccctcatcaccgtgcgctggcactttggggaccacttctgccgcctctcagccacgctctactggttttttgtcctggagggcgtggccatcctgctcatcatcagcgtggaccgcttcctcatcatcgtccagcgccaggacaagctgaacccgcgcagggccaaggtgatcatcgcggtctcctgggtgctgtccttctgcatcgcggggccctcgctcacgggctggacgctggtggaggtgccggcgcgggccccacagtgcgtgctgggctacacggagctccccgctgaccgcgcctacgtggtcaccttggtggtggccgtgttcttcgcgccctttggcgtcatgctgtgcgcctacatgtgcatcctcaacacggtccgcaagaacgccgtgcgcgtgcacaaccagtcggacagcctggacctgcggcagctcaccagggcgggcctgcggcgcctgcagcggcagcaacaggtcagcgtggacttgagcttcaagaccaaggccttcaccaccatcctgatcctcttcgtgggcttctccctctgctggctgccccactccgtctacagcctcctgtctgtgtttagccagcgcttttactgcggttcctccttctacgccaccagcacctgcgtcctgtggctcagttacctcaagtccgtcttcaaccccatcgtctactgctggagaatcaaaaaattccgcgaggcctgcatagagttgctgccccagaccttccaaatcctccccaaagtgcctgagcggatccgaaggagaatccagccaagcacagtctacgtgtgcaatgaaaaccagtctgcggtttagggggtcagggggccacagagaaggggcagctgagccccagtcccagggtggatctgtcctgctctgttccctggcatgttggtcatagtctgcactttgtggtggcaatttaagcacaaaggtactcatttgtaatcagatgagctgcagctcccaaatttcaaattttggcacgatgaattatttttgtttctctttgcagagagccaaatatggggctgatgggaactgcaacgtcattaagtcaaaaatggagtgggctggggagtgcagaagttgggcagaaagggaggaggagggcaacagggaatgaagctggttgagtgtggggcaggaggactggtcagtcacaagagcttcaacctgccctgcgagccctctctgcacctgctcaagagaaaccctgagaaaccccagtaggtgtgagctcctgggtgttcattcattttgtttgacaccagggttcttcagctattgatgtttgtggtgt

SEQ ID NO: 11606 - DNA, 1951 bp, Homo sapiens
tgtttgctgtctggacctggctgctgatcctgagcctgctgggagatcttaacgatccccaggagcaacatggggcccaccctagcggttcccaccccctatggctgtattggctgtaagctaccccagccagaatacccaccggctctaatcatctttatgttctgcgcgatggttatcaccatcgttgtagacctaatcggcaactccatggtcattttggctgtgacgaagaacaagaagctccggaattctggcaacatcttcgtggtcagtctctctgtggccgatatgctggtggccatctacccataccctttgatgctgcatgccatgtccattgggggctgggatctgagccagttacagtgccagatggtcgggttcatcacagggctgagtgtggtcggctccatcttcaacatcgtggcaatcgctatcaaccgttactgctacatctgccacagcctccagtacgaacggatcttcagtgtgcgcaatacctgcatctacctggtcatcacctggatcatgaccgtcctggctgtcctgcccaacatgtacattggcaccatcgagtacgatcctcgcacctacacctgcatcttcaactatctgaacaaccctgtcttcactgttaccatcgtctgcatccacttcgtcctccctctcctcatcgtgggtttctgctacgtgaggatctggaccaaagtgctggcggcccgtgaccctgcagggcagaatcctgacaaccaacttgctgaggttcgcaattttctaaccatgtttgtgatcttcctcctctttgcagtgtgctggtgccctatcaacgtgctcactgtcttggtggctgtcagtccgaaggagatggcaggcaagatccccaactggctttatcttgcagcctacttcatagcctacttcaacagctgcctcaacgctgtgatctacgggctcctcaatgagaatttccgaagagaatactggaccatcttccatgctatgcggcaccctatcatattcttctctggcctcatcagtgatattcgtgagatgcaggaggcccgtaccctggcccgcgcccgtgcccatgctcgcgaccaagctcgtgaacaagaccgtgcccatgcctgtcctgctgtggaggaaaccccgatgaatgtccggaatgttccattacctggtgatgctgcagctggccaccccgaccgtgcctctggccaccctaagccccattccagatcctcctctgcctatcgcaaatctgcctctacccaccacaagtctgtctttagccactccaaggctgcctctggtcacctcaagcctgtctctggccactccaagcctgcctctggtcaccccaagtctgccactgtctaccctaagcctgcctctgtccatttcaaggctgactctgtccatttcaagggtgactctgtccatttcaagcctgactctgttcatttcaagcctgcttccagcaaccccaagcccatcactggccaccatgtctctgctggcagccactccaagtctgccttcagtgctgccaccagccaccctaaacccaccactggccacatcaagccagctaccagccatgctgagcccaccactgctgactatcccaagcctgccactaccagccaccctaagcccactgctgctgacaaccctgagctctctgcctcccattgccccgagatccctgccattgcccaccctgtgtctgacgacagtgacctccctgagtcggcctctagccctgccgctgggcccaccaagcctgctgccagccagctggagtctgacaccatcgctgaccttcctgaccctactgtagtcactaccagtaccaatgattaccatgatgtcgtggttattgatgttgaagatgatcctgatgaaatggctgtgtgaaaaatgctctcgtaggtggccaggcagt

SEQ ID NO: 11607 - DNA, 864 bp, Homo sapiens
gctgtcatttgctctctgactctcagagagggaggcacgctttcctggagctcctggtgacagaacaggtgtttgctgtctggacctggctgctgatcctgagcctgctgggagatcttaacgatccccaggagcaacatggggcccaccctagcggttcccaccccctatggctgtattggctgtaagctaccccagccagaatacccaccggctctaatcatctttatgttctgcgcgatggttatcaccatcgttgtagacctaatcggcaactccatggtcattttggctgtgacgaagaacaagaagctccggaattctggcaacatcttcgtggtcagtctctctgtggccgatatgctggtggccatctacccataccctttgatgctgcatgccatgtccattgggggctgggatctgagccagttacagtgccagatggtcgggttcatcacagggctgagtgtggtcggctccatcttcaacatcgtggcaatcgctatcaaccgttactgctacatctgccacagcctccagtacgaacggatcttcagtgtgcgcaatacctgcatctacctggtcatcacctggatcatgaccgtcctggctgtcctgcccaacatgtacattggcaccatcgagtacgatcctcgcacctacacctgcatcttcaactatctgaacaaccctgtcttcactgttaccatcgtctgcatccacttcgtcctccctctcctcatcgtgggtttctgctacgtgaggatctggaccaaagtgctggcggcccgtgaccctgcagggcagaatcctgacaaccaacttgctgagcctacttcaacagctgcctcaacgctgtga

SEQ ID NO: 11608 - DNA, 1472 bp, Homo sapiens
tgtagccaagtctgcaggtgtctttaaatttccaagccatgaatgaatccaggtggactgaatggaggatcctgaacatgagcagtggcattgtgaatgtgtccgagcgtcactcctgcccacttggatttggccactacagtgtggtggatgtctgcatcttcgagacagtggttattgtgttgctgacatttctgatcattgctgggaatctaacagttatctttgtctttcattgtgctccactgttacatcattatactaccagctatttcattcagacgatggcatatgctgatcttttcgttggagttagctgcttggttcctactctgtcacttctccactactccacaggtgtccacgagtcattgacttgccaggtttttggatatatcatctcagttctaaaaagtgtttctatggcatgtcttgcttgcatcagtgtggatcgttatcttgcaataaccaagcctctttcctacaatcaactggtcaccccttgtcgcttgagaatttgcattattttgatctggatctactcctgcctaattttcttgccttccttttttggctgggggaaacctggttaccatggtgacatttttgaatggtgtgccacgtcttggctcaccagtgcctattttactggctttattgtttgtttactttatgctcctgctgcctttgttgtctgcttcacttacttccacattttcaaaatttgccgtcagcacaccaaagagataaatgaccgaagagcccgattccctagtcatgaggtagattcttccagagagactggacacagccctgaccgtcgctacgccatggttttgtttaggataaccagtgtattttatatgctgtggctcccctatataatttactttcttctagaaagctcccgggtcttggacaatccaactctgtccttcttaacaacctggcttgcaataagtaatagtttttgtaactgtgtaatatacagcctctccaacagcgttttccggctaggcctccgaagactgtctgagacaatgtgcacatcctgtatgtgtgtgaaggatcaggaagcacaagaacccaaacctaggaaacgggctaattcttgctccatttgaagagagctacatagtaaatcaaatgtaatctgacagtggttttggatcatattctagattcatctggaaatttgccatcagagaaatatttacttgaatagttgactgtaaaatgaagtatgagactaaaggtttctctctttttttttctttttcatggaagaaactaaagggaaggatgtatagagggttagctcatgaaataattatagcatgtgagtattagtgtgcagtaataggaaaaattaagcactgagatgaaaaagaatatctcaaatcttctgcaggacatgagcaagccccttggctcagcatttctgtctttctgtctgactgtaccctgcctct

SEQ ID NO: 11609 - DNA, 1523 bp, Homo sapiens
agaatgctctgggctttcaaaatggttacttttcggctgggcatggttttaaatggttacttttcctctcctgttgcctgaagcctggggatttttctcctgtcttcacagtgagaaactggtgaccttcctggaggtaaccccaggaaaatgtggggcttccctactacagggaccccaggactttatgacacttaagctagcccaaacactcagcctccagcaattcgtcaggtaccatgtaagtgctcctacaagttgccggctcctgggtggcttctgcttctggaagttgtgattcaatgggcatgaattgctgtgtgatgctggggaggtgtttgtgattcttgacaaagtcatttgaatccatcacttcaagagagtgaaaggagccccgtctgatctgttggtgttgtaggaagaaacatgagtcagcaaaacaccagtggggactgcctgtttgacggtgtcaacgagctgatgaaaaccctacagtttgcagtccacatccccaccttcgtcctgggcctgctcctcaacctgctggccatccatggcttcagcaccttccttaagaacaggtggcccgattatgctgccacctccatctacatgatcaacctggcagtctttgacctgctgctggtgctctccctcccattcaagatggtcctgtcccaggtacagtcccccttcccgtccctgtgcaccctggtggagtgcctttacttcgtcagcatgtacggaagcgtcttcaccatctgcttcatcagcatggaccggttcttggccatccgttacccgctactggtgagccacctccggtcccccaggaagatctttgggatctgctgcaccatctgggtcctggtgtggaccggaagcatccctatctacagtttccatgggaaagtggaaaaatacatgtgcttccacaacatgtctgatgatacctggagcgccaaggtcttcttcccgctggaggtgtttggcttcctccttcccatgggcatcatgggcttctgctgctccaggagcatccacatcctgctgggccgccgagaccacacccaggactgggtgcagcagaaagcctgcatctacagcatcgcagccagcctggctgtcttcgtggtctccttcctcccagtccacctggggttcttcctgcagttcctggtgagaaacagctttatcgtagagtgcagagccaagcagagcatcagcttcttcttgcaattgtccatgtgtttctccaacgtcaactgctgcctggatgttttctgctactactttgtcatcaaagaattccgcatgaacatcagggcccaccggccttccagggtccagctggtcctgcaggacaccacgatctcccggggctaacggaaggacatcctgttcaggggaagaaagccctggccctgaattctggtaacggatatcgcgttccagggttttgatgtggtgggatgatccgcaccatcttcactgatgtgcttccctttgatgcccattgagtg

SEQ ID NO: 11610 - DNA, 3828 bp, Homo sapiens
caggcctggaggagaaatgacatctctcagccctctcagctgcaccggaccaccaacagttgtgattcaatgggcatgaattgctgtgtgatgctggggaggtgtttgtgattcttgacaaagtcatttgaatccatcacttcaagagagtgaaaggagccccgtctgatctgttggtgttgtaggaagaaacatgagtcagcaaaacaccagtggggactgcctgtttgacggtgtcaacgagctgatgaaaaccctacagtttgcagtccacatccccaccttcgtcctgggcctgctcctcaacctgctggccatccatggcttcagcaccttccttaagaacaggtggcccgattatgctgccacctccatctacatgatcaacctggcagtctttgacctgctgctggtgctctccctcccattcaagatggtcctgtcccaggtacagtcccccttcccgtccctgtgcaccctggtggagtgcctttacttcgtcagcatgtacggaagcgtcttcaccatctgcttcatcagcatggaccggttcttggccatccgttacccgctactggtgagccacctccggtcccccaggaagatctttgggatctgctgcaccatctgggtcctggtgtggaccggaagcatccctatctacagtttccatgggaaagtggaaaaatacatgtgcttccacaacatgtctgatgatacctggagcgccaaggtcttcttcccgctggaggtgtttggcttcctccttcccatgggcatcatgggcttctgctgctccaggagcatccacatcctgctgggccgccgagaccacacccaggactgggtgcagcagaaagcctgcatctacagcatcgcagccagcctggctgtcttcgtggtctccttcctcccagtccacctggggttcttcctgcagttcctggtgagaaacagctttatcgtagagtgcagagccaagcagagcatcagcttcttcttgcaattgtccatgtgtttctccaacgtcaactgctgcctggatgttttctgctactactttgtcatcaaagaattccgcatgaacatcagggcccaccggccttccagggtccagctggtcctgcaggacaccacgatctcccggggctaacggaaggacatcctgttcaggggaagaaagccctggccctgaattctggtaacggatatcgcgttccagggttttgatgtggtgggatgatccgcaccatcttcactgatgtgcttccctttgatgcccattgagtgccagctttgctcattataccccaaagaccttttttccactgcccagacagcttataccacccagtgttcagggatctctgaagaacccacagaccaggtgaattactgatttctaagtccaaaaactatagagcagaagaattgagaaagagaatgagaccatgtcaacaaggctgtttccaactctccccattttcctgttcgactgggaggttctggaaagaaagagagagagagaaaagaggtaaaggagggagccaagagagtcagttattggggagagtgtcttgggcagaggtggggtggtagggatgagtgaagtccctttttagtttgggtgtcccagaacagagcagacttgcattttccagtcccttctggaactgtgttgccaaaagcctcactgagatgacagcaagaaggggtggtgttggggctgggcaagtagcatggatcaccccaagtttccagtgagcctcagaaaggtgaaggaagccagccacacctttccgtgcccgtgagaagactgcaaaatgactgagtggggtgttgatgacatccaagagccatgaggggggagaggaaaggacacttctggggaaggaagaagacaggcccagggctggaagcacacagcccctcccctatcaccatcagggtgtccacagcacggagtgttggtgctggcccagggtgaagagagacagtgagagacggcctgggagcggggagaccccgacctgctttctatcttaaacagactgggaagttgctcattacagctagcttccttgaaaacaatggcaaagaatcaggcctgccttggttccaccataggagggtggaggaggtgctgtcttactcacctgcatcctggctgggcagctggcacccgtggcactgcccatggagccgtccctccctggcagctgggagggagatgaggcagctaggcacaagggtgtggccttgagaaagaaggcaagggggggtccctgctggtcccaggaaactgtaaacaattgagtcacgcctggatggcttctcaacggatctggaggaggagtgcaagtgacagcggaagcctcccaatgactcagctgctccggagagtgaaatgatgagaaggatccattgtggggtggttttgcatgacagagcgagtgggatgaggagtaactgatgagacttcatgtgagcaaggtcttcaggaggaaaagcaactgaggtctacttgtaggatctgggctcagtgggggctgaagggcttgggaggggtggtgacctgaggggaagaagagaagcatttggataaacctggacctgtggggaggaggaggaggaagaggaagaggaaaaggaggggaagctgagccgtggccctaggcttgaagcctgcagggagtgcagggtgggtggggaacctggctgagctgcttcctgcctgagagctttcccagctggcctaagagccatggacggacaggagtcgccttctcaggagcagctcccgctgttgctgtgttcaagtggcaccctgtacacctcctcctaggtggatggagggaagggtgaggaagagagcgtcaatgaaggggtggaagtggatgtggaggagtgaccagaccagaccagaccagaccagagggatcggaggctcaggccccctgagctgggcctctaagaaccacagccacagagtcaggctctgcagacccagaggtaaggctgcctggctgccccaaaccccagacactcctctccttgcctgcaggctgccctctcccatggccaccctagacagagacccacccgtgatactctgagggagccagactttcacatgcaacggggcatttggggctggttcgggtcagtgtctacgggtggtggatttagtgaccaccctcctcccacttctttctctgcacgaggagttgggagcctgcctggtggagttgagtgatgcccgtcatgtgcacttgggtctaccaatgtgcttaaggccagatgggcttcctaagagacaagggtgggtggacctaaccaactatcatccccagcgatgttcaaacataaaatcttatctatgtgcagcatgactctctccaggtgacagaaagggctctagacagctgagaggacctgatcatgtagggagggacggggaggggagccaggacccaggagctgcatggctgtaagaggaaggtccttggagggtatcagcagtctcagtgtgatgtgacaactatggacctgtgggtgtgccctggggacccctgacccatcccaaaacactgtggaaagaagggcctcttctccgtggggacccgtgtctgtgggagcgggcacaggtccatgctgcaggccactacggctgctcggcaggagggccgagagtttggacccacatagctgcaacccaagctggcccataatcagcagtggggcccagcagcacaggaggggcggacggttagctttggaaaaaatgacttgattaatctgattcgccaaataaatagattcatgtga

SEQ ID NO: 11611 - DNA, 919 bp, Homo sapiens
caggcctggaggagaaatgacatctctcagccctctcagctgcaccggaccaccaacagttgtgattcaatgggcatgaattgctgtgtgatgctggggaggtgtttgtgattcttgacaaagtcatttgaatccatcacttcaagagagtgaaaggagccccgtctgatctgttggtgttgtaggaagaaacatgagtcagcaaaacaccagtggggactgcctgtttgacggtgtcaacgagctgatgaaaaccctacagtttgcagtccacatccccaccttcgtcctgggcctgctcctcaacctgctggccatccatggcttcagcaccttccttaagaacaggtggcccgattatgctgccacctccatctacatgatcaacctggcagtctttgacctgctgctggtgctctccctcccattcaagatggtcctgtcccaggtacagtcccccttcccgtccctgtgcaccctggtggagtgcctttacttcgtcagcatgtacggaagcgtcttcaccatctgcttcatcagcatggaccggttcttggccatccgttacccgctactggtgagccacctccggtcccccaggaagatctttgggatctgctgcaccatctgggtcctggtgtggaccggaagcatccctatctacagtttccatgggaaagtggaaaaatacatgtgcttccacaacatgtctgatgatacctggagcgccaaggtcttcttcccgctggaggtgtttggcttcctccttcccatgggcatcatgggcttctgctgctccaggagcatccacatcctgctgggccgccgagaccacacccaggactgggtgcagcagaaagcctgcatctacagcatcgcagccagcctggctgtcttcgtggtctccttcctcccagtc

SEQ ID NO: 11612 - DNA, 2527 bp, Homo sapiens
caggcctggaggagaaatgacatctctcagccctctcagctgcaccggaccaccaacagttgtgattcaatgggcatgaattgctgtgtgatgctggggaggtgtttgtgattcttgacaaagtcatttgaatccatcacttcaagagagtgaaaggagccccgtctgatctgttggtgttgtaggaagaaacatgagtcagcaaaacaccagtggggactgcctgtttgacggtgtcaacgagctgatgaaaaccctacagtttgcagtccacatccccaccttcgtcctgggcctgctcctcaacctgctggccatccatggcttcagcaccttccttaagaacaggtggcccgattatgctgccacctccatctacatgatcaacctggcagtctttgacctgctgctggtgctctccctcccattcaagatggtcctgtcccaggtacagtcccccttcccgtccctgtgcaccctggtggagtgcctttacttcgtcagcatgtacggaagcgtcttcaccatctgcttcatcagcatggaccggttcttggccatccgttacccgctactggtgagccacctccggtcccccaggaagatctttgggatctgctgcaccatctgggtcctggtgtggaccggaagcatccctatctacagtttccatgggaaagtggaaaaatacatgtgcttccacaacatgtctgatgatacctggagcgccaaggtcttcttcccgctggaggtgtttggcttcctccttcccatgggcatcatgggcttctgctgctccaggagcatccacatcctgctgggccgccgagaccacacccaggactgggtgcagcagaaagcctgcatctacagcatcgcagccagcctggctgtcttcgtggtctccttcctcccagtccacctggggttcttcctgcagttcctggtgagaaacagctttatcgtagagtgcagagccaagcagagcatcagcttcttcttgcaattgtccatgtgtttctccaacgtcaactgctgcctggatgttttctgctactactttgtcatcaaagaattccgcatgaacatcagggcccaccggccttccagggtccagctggtcctgcaggacaccacgatctcccggggctaacggaaggacatcctgttcaggggaagaaagccctggccctgaattctggtaacggatatcgcgttccagggttttgatgtggtgggatgatccgcaccatcttcactgatgtgcttccctttgatgcccattgagtgccagctttgctcattataccccaaagaccttttttccactgcccagacagcttataccacccagtgttcagggatctctgaagaacccacagaccaggtgaattactgatttctaagtccaaaaactatagagcagaagaattgagaaagagaatgagaccatgtcaacaaggctgtttccaactctccccattttcctgttcgactgggaggttctggaaagaaagagagagagagaaaagaggtggatggagggaagggtgaggaagagagcgtcaatgaaggggtggaagtggatgtggaggagtgaccagaccagaccagaccagaccagagggatcggaggctcaggccccctgagctgggcctctaagaaccacagccacagagtcaggctctgcagacccagaggtaaggctgcctggctgccccaaaccccagacactcctctccttgcctgcaggctgccctctcccatggccaccctagacagagacccacccgtgatactctgagggagccagactttcacatgcaacggggcatttggggctggttcgggtcagtgtctacgggtggtggatttagtgaccaccctcctcccacttctttctctgcacgaggagttgggagcctgcctggtggagttgagtgatgcccgtcatgtgcacttgggtctaccaatgtgcttaaggccagatgggcttcctaagagacaagggtgggtggacctaaccaactatcatccccagcgatgttcaaacataaaatcttatctatgtgcagcatgactctctccaggtgacagaaagggctctagacagctgagaggacctgatcatgtagggagggacggggaggggagccaggacccaggagctgcatggctgtaagaggaaggtccttggagggtatcagcagtctcagtgtgatgtgacaactatggacctgtgggtgtgccctggggacccctgacccatcccaaaacactgtggaaagaagggcctcttctccgtggggacccgtgtctgtgggagcgggcacaggtccatgctgcaggccactacggctgctcggcaggagggccgagagtttggacccacatagctgcaacccaagctggcccataatcagcagtggggcccagcagcacaggaggggcggacggttagctttggaaaaaatgacttgattaatctgattcgccaaataaatagattcatgtgatgccttgtga

SEQ ID NO: 11613 - DNA, 3174 bp, Homo sapiens
aagcagggtctcactctgtcacccaggctggagtgcagtggcgcagttatagctcactgcagcctcgacctcctgggctcaagtgatccttccacctcagcctccctagtagctgggaccacaggtggtgacttccaagagtgactccgtcggaggaaaatgactccccagtcgctgctgcagacgacactgttcctgctgagtctgctcttcctggtccaaggtgcccacggcaggggccacagggaagactttcgcttctgcagccagcagttgcagagcctggagtcgaaactgacctctgtgagattcatgggggacatggtgtccttcgaggaggaccggatcaacgccacggtgtggaagctccagcccacagccggcctccaggacctgcacatccactcccggcaggaggaggagcagagcgagatcatggagtactcggtgctgctgcctcgaacactcttccagaggacgaaaggccggagcggggaggctgagaagagactcctcctggtggacttcagcagccaagccctgttccaggacaagaattccagccaagtcctgggtgagaaggtcttggggattgtggtacagaacaccaaagtagccaacctcacggagcccgtggtgctcactttccagcaccagctacagccgaagaatgtgactctgcaatgtgtgttctgggttgaagaccccacattgagcagcccggggcattggagcagtgctgggtgtgagaccgtcaggagagaaacccaaacatcctgcttctgcaaccacttgacctactttgcagtgctgatggtctcctcggtggaggtggacgccgtgcacaagcactacctgagcctcctctcctacgtgggctgtgtcgtctctgccctggcctgccttgtcaccattgccgcctacctctgctccagggtgcccctgccgtgcaggaggaaacctcgggactacaccatcaaggtgcacatgaacctgctgctggccgtcttcctgctggacacgagcttcctgctcagcgagccggtggccctgacaggctctgaggctggctgccgagccagtgccatcttcctgcacttctccctgctcacctgcctttcctggatgggcctcgaggggtacaacctctaccgactcgtggtggaggtctttggcacctatgtccctggctacctactcaagctgagcgccatgggctggggcttccccatctttctggtgacgctggtggccctggtggatgtggacaactatggccccatcatcttggctgtgcataggactccagagggcgtcatctacccttccatgtgctggatccgggactccctggtcagctacatcaccaacctgggcctcttcagcctggtgtttctgttcaacatggccatgctagccaccatggtggtgcagatcctgcggctgcgcccccacacccaaaagtggtcacatgtgctgacactgctgggcctcagcctggtccttggcctgccctgggccttgatcttcttctcctttgcttctggcaccttccagcttgtcgtcctctaccttttcagcatcatcacctccttccaaggcttcctcatcttcatctggtactggtccatgcggctgcaggcccggggtggcccctcccctctgaagagcaactcagacagcgccaggctccccatcagctcgggcagcacctcgtccagccgcatctaggcctccagcccacctgcccatgtgatgaagcagagattcggcctcgtcgcacactgcctgtggcccccgagcccggcccagccccaggccagtcagccgcagactttggaaagcccaacgaccatggagagatgggccgttgccatggtggacggactcccgggctgggcttttgaattggccttggggactactcggctctcactcagctcccacgggactcagaagtgcgccgccatgctgcctagggtactgtccccacatctgtcccaacccagctggaggcctggtctctccttacaacccctgggcccagccctcattgctgggggccaggccttggatcttgagggtctggcacatccttaatcctgtgcccctgcctgggacagaaatgtggctccagttgctctgtctctcgtggtcaccctgagggcactctgcatcctctgtcattttaacctcaggtggcacccagggcgaatggggcccagggcagaccttcagggccagagccctggcggaggagaggccctttgccaggagcacagcagcagctcgcctacctctgagcccaggccccctccctccctcagccccccagtcctccctccatcttccctggggttctcctcctctcccagggcctccttgctccttcgttcacagctgggggtccccgattccaatgctgttttttggggagtggtttccaggagctgcctggtgtctgctgtaaatgtttgtctactgcacaagcctcggcctgcccctgagccaggctcggtaccgatgcgtgggctgggctaggtccctctgtccatctgggcctttgtatgagctgcattgcccttgctcaccctgaccaagcacacgcctcagaggggccctcagcctctcctgaagccctcttgtggcaagaactgtggaccatgccagtcccgtctggtttccatcccaccactccaaggactgagactgacctcctctggtgacactggcctagggcctgacactctcctaagaggttctctccaagcccccaaatagctccaggcgccctcggccgcccatcatggttaattctgtccaacaaacacacacgggtagattgctggcctgttgtaggtggtagggacacagatgaccgacctggtcactcctcctgccaacattcagtctggtatgtgaggcgtgcgtgaagcaagaactcctggagctacagggacagggagccatcattcctgcctgggaatcctggaagacttcctgcaggagtcagcgttcaatcttgaccttgaagatgggaaggatgttctttttacgtaccaattcttttgtcttttgatattaaaaagaagtacatgttcattgtagagaatttggaaactgtagaagagaatcaagaagaaaaataaaaatcagctgttgtaatcacctagc

SEQ ID NO: 11614 - DNA, 3689 bp, Homo sapiens
gcagggtctcactctgtcacccaggctggagtgcagtggcgcagttatagctcactgcagcctcgacctcctgggctcaagtgatccttccacctcagcctccctagtagctgggaccacaggtggtgacttccaagagtgactccgtcggaggaaaatgactccccagtcgctgctgcagacgacactgttcctgctgagtctgctcttcctggtccaaggtgcccacggcaggggccacagggaagactttcgcttctgcagccagcggaaccagacacacaggagcagcctccactacaaacccacaccagacctgcgcatctccatcgagaactccgaagaggccctcacagtccatgcccctttccctgcagcccaccctgcttcccgatccttccctgaccccaggggcctctaccacttctgcctctactggaaccgacatgctgggagattacatcttctctatggcaagcgtgacttcttgctgagtgacaaagcctctagcctcctctgcttccagcaccaggaggagagcctggctcagggccccccgctgttagccacttctgtcacctcctggtggagccctcagaacatcagcctgcccagtgccgccagcttcaccttctccttccacagtcctccccacacggccgctcacaatgcctcggtggacatgtgcgagctcaaaagggacctccagctgctcagccagttcctgaagcatccccagaaggcctcaaggaggccctcggctgcccccgccagccagcagttgcagagcctggagtcgaaactgacctctgtgagattcatgggggacatggtgtccttcgaggaggaccggatcaacgccacggtgtggaagctccagcccacagccggcctccaggacctgcacatccactcccggcaggaggaggagcagagcgagatcatggagtactcggtgctgctgcctcgaacactcttccagaggacgaaaggccggagcggggaggctgagaagagactcctcctggtggacttcagcagccaagccctgttccaggacaagaattccagccaagtcctgggtgagaaggtcttggggattgtggtacagaacaccaaagtagccaacctcacggagcccgtggtgctcactttccagcaccagctacagccgaagaatgtgactctgcaatgtgtgttctgggttgaagaccccacattgagcagcccggggcattggagcagtgctgggtgtgagaccgtcaggagagaaacccaaacatcctgcttctgcaaccacttgacctactttgcagtgctgatggtctcctcggtggaggtggacgccgtgcacaagcactacctgagcctcctctcctacgtgggctgtgtcgtctctgccctggcctgccttgtcaccattgccgcctacctctgctccagggtgcccctgccgtgcaggaggaaacctcgggactacaccatcaaggtgcacatgaacctgctgctggccgtcttcctgctggacacgagcttcctgctcagcgagccggtggccctgacaggctctgaggctggctgccgagccagtgccatcttcctgcacttctccctgctcacctgcctttcctggatgggcctcgaggggtacaacctctaccgactcgtggtggaggtctttggcacctatgtccctggctacctactcaagctgagcgccatgggctggggcttccccatctttctggtgacgctggtggccctggtggatgtggacaactatggccccatcatcttggctgtgcataggactccagagggcgtcatctacccttccatgtgctggatccgggactccctggtcagctacatcaccaacctgggcctcttcagcctggtgtttctgttcaacatggccatgctagccaccatggtggtgcagatcctgcggctgcgcccccacacccaaaagtggtcacatgtgctgacactgctgggcctcagcctggtccttggcctgccctgggccttgatcttcttctcctttgcttctggcaccttccagcttgtcgtcctctaccttttcagcatcatcacctccttccaaggcttcctcatcttcatctggtactggtccatgcggctgcaggcccggggtggcccctcccctctgaagagcaactcagacagcgccaggctccccatcagctcgggcagcacctcgtccagccgcatctaggcctccagcccacctgcccatgtgatgaagcagagattcggcctcgtcgcacactgcctgtggcccccgagcccggcccagccccaggccagtcagccgcagactttggaaagcccaacgaccatggagagatgggccgttgccatggtggacggactcccgggctgggcttttgaattggccttggggactactcggctctcactcagctcccacgggactcagaagtgcgccgccatgctgcctagggtactgtccccacatctgtcccaacccagctggaggcctggtctctccttacaacccctgggcccagccctcattgctgggggccaggccttggatcttgagggtctggcacatccttaatcctgtgcccctgcctgggacagaaatgtggctccagttgctctgtctctcgtggtcaccctgagggcactctgcatcctctgtcattttaacctcaggtggcacccagggcgaatggggcccagggcagaccttcagggccagagccctggcggaggagaggccctttgccaggagcacagcagcagctcgcctacctctgagcccaggccccctccctccctcagccccccagtcctccctccatcttccctggggttctcctcctctcccagggcctccttgctccttcgttcacagctgggggtccccgattccaatgctgttttttggggagtggtttccaggagctgcctggtgtctgctgtaaatgtttgtctactgcacaagcctcggcctgcccctgagccaggctcggtaccgatgcgtgggctgggctaggtccctctgtccatctgggcctttgtatgagctgcattgcccttgctcaccctgaccaagcacacgcctcagaggggccctcagcctctcctgaagccctcttgtggcaagaactgtggaccatgccagtcccgtctggtttccatcccaccactccaaggactgagactgacctcctctggtgacactggcctagggcctgacactctcctaagaggttctctccaagcccccaaatagctccaggcgccctcggccgcccatcatggttaattctgtccaacaaacacacacgggtagattgctggcctgttgtaggtggtagggacacagatgaccgacctggtcactcctcctgccaacattcagtctggtatgtgaggcgtgcgtgaagcaagaactcctggagctacagggacagggagccatcattcctgcctgggaatcctggaagacttcctgcaggagtcagcgttcaatcttgaccttgaagatgggaaggatgttctttttacgtaccaattcttttgtcttttgatattaaaaagaagtacatgttcattgtagagaatttggaaactgtagaagagaatcaagaagaaaaataaaaatcagctgttgtaatcacctagcaaactgg

SEQ ID NO: 11615 - DNA, 3972 bp, Homo sapiens
gagaaatccatgactcacatatatcgtccgtcatccccagtcaagctcagggaggagggaggagcccagctggggcaggagaggggtgtctccccaccaaacaaacccggtccctccctctccgcactagctgtctgccctgccctgccgtaggagatgggctgggagcctcccacgctctccagctcactcggcaggcagcggggaccagggctggcaggttaagcctctgggggtggatcctgaaaggtggtccagccgcctggccctgcgtgggaccctccacctggcagcaggtacccaaacaagggctggacagcaggtgggaaggggaatagtgtgagtgtggccagcccaaccaccacacagtccacactcccagctaacactcctggtctcttccaggtggtgacttccaagagtgactccgtcggaggaaaatgactccccagtcgctgctgcagacgacactgttcctgctgagtctgctcttcctggtccaaggtgcccacggcaggggccacagggaagactttcgcttctgcagccagcggaaccagacacacaggagcagcctccactacaaacccacaccagacctgcgcatctccatcgagaactccgaagaggccctcacagtccatgcccctttccctgcagcccaccctgcttcccgatccttccctgaccccaggggcctctaccacttctgcctctactggaaccgacatgctgggagattacatcttctctatggcaagcgtgacttcttgctgagtgacaaagcctctagcctcctctgcttccagcaccaggaggagagcctggctcagggccccccgctgttagccacttctgtcacctcctggtggagccctcagaacatcagcctgcccagtgccgccagcttcaccttctccttccacagtcctccccacacggccgctcacaatgcctcggtggacatgtgcgagctcaaaagggacctccagctgctcagccagttcctgaagcatccccagaaggcctcaaggaggccctcggctgcccccgccagccagcagttgcagagcctggagtcgaaactgacctctgtgagattcatgggggacatggtgtccttcgaggaggaccggatcaacgccacggtgtggaagctccagcccacagccggcctccaggacctgcacatccactcccggcaggaggaggagcagagcgagatcatggagtactcggtgctgctgcctcgaacactcttccagaggacgaaaggccggagcggggaggctgagaagagactcctcctggtggacttcagcagccaagccctgttccaggacaagaattccagccaagtcctgggtgagaaggtcttggggattgtggtacagaacaccaaagtagccaacctcacggagcccgtggtgctcactttccagcaccagctacagccgaagaatgtgactctgcaatgtgtgttctgggttgaagaccccacattgagcagcccggggcattggagcagtgctgggtgtgagaccgtcaggagagaaacccaaacatcctgcttctgcaaccacttgacctactttgcagtgctgatggtctcctcggtggaggtggacgccgtgcacaagcactacctgagcctcctctcctacgtgggctgtgtcgtctctgccctggcctgccttgtcaccattgccgcctacctctgctccagggtgcccctgccgtgcaggaggaaacctcgggactacaccatcaaggtgcacatgaacctgctgctggccgtcttcctgctggacacgagcttcctgctcagcgagccggtggccctgacaggctctgaggctggctgccgagccagtgccatcttcctgcacttctccctgctcacctgcctttcctggatgggcctcgaggggtacaacctctaccgactcgtggtggaggtctttggcacctatgtccctggctacctactcaagctgagcgccatgggctggggcttccccatctttctggtgacgctggtggccctggtggatgtggacaactatggccccatcatcttggctgtgcataggactccagagggcgtcatctacccttccatgtgctggatccgggactccctggtcagctacatcaccaacctgggcctcttcagcctggtgtttctgttcaacatggccatgctagccaccatggtggtgcagatcctgcggctgcgcccccacacccaaaagtggtcacatgtgctgacactgctgggcctcagcctggtccttggcctgccctgggccttgatcttcttctcctttgcttctggcaccttccagcttgtcgtcctctaccttttcagcatcatcacctccttccaaggcttcctcatcttcatctggtactggtccatgcggctgcaggcccggggtggcccctcccctctgaagagcaactcagacagcgccaggctccccatcagctcgggcagcacctcgtccagccgcatctaggcctccagcccacctgcccatgtgatgaagcagagattcggcctcgtcgcacactgcctgtggcccccgagcccggcccagccccaggccagtcagccgcagactttggaaagcccaacgaccatggagagatgggccgttgccatggtggacggactcccgggctgggcttttgaattggccttggggactactcggctctcactcagctcccacgggactcagaagtgcgccgccatgctgcctagggtactgtccccacatctgtcccaacccagctggaggcctggtctctccttacaacccctgggcccagccctcattgctgggggccaggccttggatcttgagggtctggcacatccttaatcctgtgcccctgcctgggacagaaatgtggctccagttgctctgtctctcgtggtcaccctgagggcactctgcatcctctgtcattttaacctcaggtggcacccagggcgaatggggcccagggcagaccttcagggccagagccctggcggaggagaggccctttgccaggagcacagcagcagctcgcctacctctgagcccaggccccctccctccctcagccccccagtcctccctccatcttccctggggttctcctcctctcccagggcctccttgctccttcgttcacagctgggggtccccgattccaatgctgttttttggggagtggtttccaggagctgcctggtgtctgctgtaaatgtttgtctactgcacaagcctcggcctgcccctgagccaggctcggtaccgatgcgtgggctgggctaggtccctctgtccatctgggcctttgtatgagctgcattgcccttgctcaccctgaccaagcacacgcctcagaggggccctcagcctctcctgaagccctcttgtggcaagaactgtggaccatgccagtcccgtctggtttccatcccaccactccaaggactgagactgacctcctctggtgacactggcctagggcctgacactctcctaagaggttctctccaagcccccaaatagctccaggcgccctcggccgcccatcatggttaattctgtccaacaaacacacacgggtagattgctggcctgttgtaggtggtagggacacagatgaccgacctggtcactcctcctgccaacattcagtctggtatgtgaggcgtgcgtgaagcaagaactcctggagctacagggacagggagccatcattcctgcctgggaatcctggaagacttcctgcaggagtcagcgttcaatcttgaccttgaagatgggaaggatgttctttttacgtaccaattcttttgtcttttgatattaaaaagaagtacatgttcattgtagagaatttggaaactgtagaagagaatcaagaagaaaaataaaaatcagctgttgtaatcacctagcaaactgg

SEQ ID NO: 11616 - DNA, 3989 bp, Homo sapiens
gagaaatccatgactcacatatatcgtccgtcatccccagtcaagctcagggaggagggaggagcccagctggggcaggagaggggtgtctccccaccaaacaaacccggtccctccctctccgcactagctgtctgccctgccctgccgtaggagatgggctgggagcctcccacgctctccagctcactcggcaggcagcggggaccagggctggcaggttaagcctctgggggtggatcctgaaaggtggtccagccgcctggccctgcgtgggaccctccacctggcagcaggtacccaaacaagggctggacagcagggtctcgctctgtcacacaggctggagtgcagtggtgtgatcttggctcatcgtaacctccacctcccgggttcaagtgattctcatgcctcagcctcccgagtagctgggattacaggtggtgacttccaagagtgactccgtcggaggaaaatgactccccagtcgctgctgcagacgacactgttcctgctgagtctgctcttcctggtccaaggtgcccacggcaggggccacagggaagactttcgcttctgcagccagcggaaccagacacacaggagcagcctccactacaaacccacaccagacctgcgcatctccatcgagaactccgaagaggccctcacagtccatgcccctttccctgcagcccaccctgcttcccgatccttccctgaccccaggggcctctaccacttctgcctctactggaaccgacatgctgggagattacatcttctctatggcaagcgtgacttcttgctgagtgacaaagcctctagcctcctctgcttccagcaccaggaggagagcctggctcagggccccccgctgttagccacttctgtcacctcctggtggagccctcagaacatcagcctgcccagtgccgccagcttcaccttctccttccacagtcctccccacacggccgctcacaatgcctcggtggacatgtgcgagctcaaaagggacctccagctgctcagccagttcctgaagcatccccagaaggcctcaaggaggccctcggctgcccccgccagccagcagttgcagagcctggagtcgaaactgacctctgtgagattcatgggggacatggtgtccttcgaggaggaccggatcaacgccacggtgtggaagctccagcccacagccggcctccaggacctgcacatccactcccggcaggaggaggagcagagcgagatcatggagtactcggtgctgctgcctcgaacactcttccagaggacgaaaggccggagcggggaggctgagaagagactcctcctggtggacttcagcagccaagccctgttccaggacaagaattccagccaagtcctgggtgagaaggtcttggggattgtggtacagaacaccaaagtagccaacctcacggagcccgtggtgctcactttccagcaccagctacagccgaagaatgtgactctgcaatgtgtgttctgggttgaagaccccacattgagcagcccggggcattggagcagtgctgggtgtgagaccgtcaggagagaaacccaaacatcctgcttctgcaaccacttgacctactttgcagtgctgatggtctcctcggtggaggtggacgccgtgcacaagcactacctgagcctcctctcctacgtgggctgtgtcgtctctgccctggcctgccttgtcaccattgccgcctacctctgctccaggaggaaacctcgggactacaccatcaaggtgcacatgaacctgctgctggccgtcttcctgctggacacgagcttcctgctcagcgagccggtggccctgacaggctctgaggctggctgccgagccagtgccatcttcctgcacttctccctgctcacctgcctttcctggatgggcctcgaggggtacaacctctaccgactcgtggtggaggtctttggcacctatgtccctggctacctactcaagctgagcgccatgggctggggcttccccatctttctggtgacgctggtggccctggtggatgtggacaactatggccccatcatcttggctgtgcataggactccagagggcgtcatctacccttccatgtgctggatccgggactccctggtcagctacatcaccaacctgggcctcttcagcctggtgtttctgttcaacatggccatgctagccaccatggtggtgcagatcctgcggctgcgcccccacacccaaaagtggtcacatgtgctgacactgctgggcctcagcctggtccttggcctgccctgggccttgatcttcttctcctttgcttctggcaccttccagcttgtcgtcctctaccttttcagcatcatcacctccttccaaggcttcctcatcttcatctggtactggtccatgcggctgcaggcccggggtggcccctcccctctgaagagcaactcagacagcgccaggctccccatcagctcgggcagcacctcgtccagccgcatctaggcctccagcccacctgcccatgtgatgaagcagagattcggcctcgtcgcacactgcctgtggcccccgagcccggcccagccccaggccagtcagccgcagactttggaaagcccaacgaccatggagagatgggccgttgccatggtggacggactcccgggctgggcttttgaattggccttggggactactcggctctcactcagctcccacgggactcagaagtgcgccgccatgctgcctagggtactgtccccacatctgtcccaacccagctggaggcctggtctctccttacaacccctgggcccagccctcattgctgggggccaggccttggatcttgagggtctggcacatccttaatcctgtgcccctgcctgggacagaaatgtggctccagttgctctgtctctcgtggtcaccctgagggcactctgcatcctctgtcattttaacctcaggtggcacccagggcgaatggggcccagggcagaccttcagggccagagccctggcggaggagaggccctttgccaggagcacagcagcagctcgcctacctctgagcccaggccccctccctccctcagccccccagtcctccctccatcttccctggggttctcctcctctcccagggcctccttgctccttcgttcacagctgggggtccccgattccaatgctgttttttggggagtggtttccaggagctgcctggtgtctgctgtaaatgtttgtctactgcacaagcctcggcctgcccctgagccaggctcggtaccgatgcgtgggctgggctaggtccctctgtccatctgggcctttgtatgagctgcattgcccttgctcaccctgaccaagcacacgcctcagaggggccctcagcctctcctgaagccctcttgtggcaagaactgtggaccatgccagtcccgtctggtttccatcccaccactccaaggactgagactgacctcctctggtgacactggcctagggcctgacactctcctaagaggttctctccaagcccccaaatagctccaggcgccctcggccgcccatcatggttaattctgtccaacaaacacacacgggtagattgctggcctgttgtaggtggtagggacacagatgaccgacctggtcactcctcctgccaacattcagtctggtatgtgaggcgtgcgtgaagcaagaactcctggagctacagggacagggagccatcattcctgcctgggaatcctggaagacttcctgcaggagtcagcgttcaatcttgaccttgaagatgggaaggatgttctttttacgtaccaattcttttgtcttttgatattaaaaagaagtacatgttcattgtagagaatttggaaactgtagaagagaatcaagaagaaaaataaaaatcagctgttgtaatcacctagcaaactgg

SEQ ID NO: 11617 - DNA, 3863 bp, Homo sapiens
gagaaatccatgactcacatatatcgtccgtcatccccagtcaagctcagggaggagggaggagcccagctggggcaggagaggggtgtctccccaccaaacaaacccggtccctccctctccgcactagctgtctgccctgccctgccgtaggagatgggctgggagcctcccacgctctccagctcactcggcaggcagcggggaccagggctggcaggttaagcctctgggggtggatcctgaaaggtggtccagccgcctggccctgcgtgggaccctccacctggcagcaggtggtgacttccaagagtgactccgtcggaggaaaatgactccccagtcgctgctgcagacgacactgttcctgctgagtctgctcttcctggtccaaggtgcccacggcaggggccacagggaagactttcgcttctgcagccagcggaaccagacacacaggagcagcctccactacaaacccacaccagacctgcgcatctccatcgagaactccgaagaggccctcacagtccatgcccctttccctgcagcccaccctgcttcccgatccttccctgaccccaggggcctctaccacttctgcctctactggaaccgacatgctgggagattacatcttctctatggcaagcgtgacttcttgctgagtgacaaagcctctagcctcctctgcttccagcaccaggaggagagcctggctcagggccccccgctgttagccacttctgtcacctcctggtggagccctcagaacatcagcctgcccagtgccgccagcttcaccttctccttccacagtcctccccacacggccgctcacaatgcctcggtggacatgtgcgagctcaaaagggacctccagctgctcagccagttcctgaagcatccccagaaggcctcaaggaggccctcggctgcccccgccagccagcagttgcagagcctggagtcgaaactgacctctgtgagattcatgggggacatggtgtccttcgaggaggaccggatcaacgccacggtgtggaagctccagcccacagccggcctccaggacctgcacatccactcccggcaggaggaggagcagagcgagatcatggagtactcggtgctgctgcctcgaacactcttccagaggacgaaaggccggagcggggaggctgagaagagactcctcctggtggacttcagcagccaagccctgttccaggacaagaattccagccaagtcctgggtgagaaggtcttggggattgtggtacagaacaccaaagtagccaacctcacggagcccgtggtgctcactttccagcaccagctacagccgaagaatgtgactctgcaatgtgtgttctgggttgaagaccccacattgagcagcccggggcattggagcagtgctgggtgtgagaccgtcaggagagaaacccaaacatcctgcttctgcaaccacttgacctactttgcagtgctgatggtctcctcggtggaggtggacgccgtgcacaagcactacctgagcctcctctcctacgtgggctgtgtcgtctctgccctggcctgccttgtcaccattgccgcctacctctgctccagggtgcccctgccgtgcaggaggaaacctcgggactacaccatcaaggtgcacatgaacctgctgctggccgtcttcctgctggacacgagcttcctgctcagcgagccggtggccctgacaggctctgaggctggctgccgagccagtgccatcttcctgcacttctccctgctcacctgcctttcctggatgggcctcgaggggtacaacctctaccgactcgtggtggaggtctttggcacctatgtccctggctacctactcaagctgagcgccatgggctggggcttccccatctttctggtgacgctggtggccctggtggatgtggacaactatggccccatcatcttggctgtgcataggactccagagggcgtcatctacccttccatgtgctggatccgggactccctggtcagctacatcaccaacctgggcctcttcagcctggtgtttctgttcaacatggccatgctagccaccatggtggtgcagatcctgcggctgcgcccccacacccaaaagtggtcacatgtgctgacactgctgggcctcagcctggtccttggcctgccctgggccttgatcttcttctcctttgcttctggcaccttccagcttgtcgtcctctaccttttcagcatcatcacctccttccaaggcttcctcatcttcatctggtactggtccatgcggctgcaggcccggggtggcccctcccctctgaagagcaactcagacagcgccaggctccccatcagctcgggcagcacctcgtccagccgcatctaggcctccagcccacctgcccatgtgatgaagcagagattcggcctcgtcgcacactgcctgtggcccccgagcccggcccagccccaggccagtcagccgcagactttggaaagcccaacgaccatggagagatgggccgttgccatggtggacggactcccgggctgggcttttgaattggccttggggactactcggctctcactcagctcccacgggactcagaagtgcgccgccatgctgcctagggtactgtccccacatctgtcccaacccagctggaggcctggtctctccttacaacccctgggcccagccctcattgctgggggccaggccttggatcttgagggtctggcacatccttaatcctgtgcccctgcctgggacagaaatgtggctccagttgctctgtctctcgtggtcaccctgagggcactctgcatcctctgtcattttaacctcaggtggcacccagggcgaatggggcccagggcagaccttcagggccagagccctggcggaggagaggccctttgccaggagcacagcagcagctcgcctacctctgagcccaggccccctccctccctcagccccccagtcctccctccatcttccctggggttctcctcctctcccagggcctccttgctccttcgttcacagctgggggtccccgattccaatgctgttttttggggagtggtttccaggagctgcctggtgtctgctgtaaatgtttgtctactgcacaagcctcggcctgcccctgagccaggctcggtaccgatgcgtgggctgggctaggtccctctgtccatctgggcctttgtatgagctgcattgcccttgctcaccctgaccaagcacacgcctcagaggggccctcagcctctcctgaagccctcttgtggcaagaactgtggaccatgccagtcccgtctggtttccatcccaccactccaaggactgagactgacctcctctggtgacactggcctagggcctgacactctcctaagaggttctctccaagcccccaaatagctccaggcgccctcggccgcccatcatggttaattctgtccaacaaacacacacgggtagattgctggcctgttgtaggtggtagggacacagatgaccgacctggtcactcctcctgccaacattcagtctggtatgtgaggcgtgcgtgaagcaagaactcctggagctacagggacagggagccatcattcctgcctgggaatcctggaagacttcctgcaggagtcagcgttcaatcttgaccttgaagatgggaaggatgttctttttacgtaccaattcttttgtcttttgatattaaaaagaagtacatgttcattgtagagaatttggaaactgtagaagagaatcaagaagaaaaataaaaatcagctgttgtaatcacctagcaaactgg

SEQ ID NO: 11618 - DNA, 3967 bp, Homo sapiens
gagaaatccatgactcacatatatcgtccgtcatccccagtcaagctcagggaggagggaggagcccagctggggcaggagaggggtgtctccccaccaaacaaacccggtccctccctctccgcactagctgtctgccctgccctgccgtaggagatgggctgggagcctcccacgctctccagctcactcggcaggcagcggggaccagggctggcaggttaagcctctgggggtggatcctgaaaggtggtccagccgcctggccctgcgtgggaccctccacctggcagcagacagggtctcgctctgtcacacaggctggagtgcagtggtgtgatcttggctcatcgtaacctccacctcccgggttcaagtgattctcatgcctcagcctcccgagtagctgggattacaggtggtgacttccaagagtgactccgtcggaggaaaatgactccccagtcgctgctgcagacgacactgttcctgctgagtctgctcttcctggtccaaggtgcccacggcaggggccacagggaagactttcgcttctgcagccagcggaaccagacacacaggagcagcctccactacaaacccacaccagacctgcgcatctccatcgagaactccgaagaggccctcacagtccatgcccctttccctgcagcccaccctgcttcccgatccttccctgaccccaggggcctctaccacttctgcctctactggaaccgacatgctgggagattacatcttctctatggcaagcgtgacttcttgctgagtgacaaagcctctagcctcctctgcttccagcaccaggaggagagcctggctcagggccccccgctgttagccacttctgtcacctcctggtggagccctcagaacatcagcctgcccagtgccgccagcttcaccttctccttccacagtcctccccacacggccgctcacaatgcctcggtggacatgtgcgagctcaaaagggacctccagctgctcagccagttcctgaagcatccccagaaggcctcaaggaggccctcggctgcccccgccagccagcagttgcagagcctggagtcgaaactgacctctgtgagattcatgggggacatggtgtccttcgaggaggaccggatcaacgccacggtgtggaagctccagcccacagccggcctccaggacctgcacatccactcccggcaggaggaggagcagagcgagatcatggagtactcggtgctgctgcctcgaacactcttccagaggacgaaaggccggagcggggaggctgagaagagactcctcctggtggacttcagcagccaagccctgttccaggacaagaattccagccaagtcctgggtgagaaggtcttggggattgtggtacagaacaccaaagtagccaacctcacggagcccgtggtgctcactttccagcaccagctacagccgaagaatgtgactctgcaatgtgtgttctgggttgaagaccccacattgagcagcccggggcattggagcagtgctgggtgtgagaccgtcaggagagaaacccaaacatcctgcttctgcaaccacttgacctactttgcagtgctgatggtctcctcggtggaggtggacgccgtgcacaagcactacctgagcctcctctcctacgtgggctgtgtcgtctctgccctggcctgccttgtcaccattgccgcctacctctgctccaggaggaaacctcgggactacaccatcaaggtgcacatgaacctgctgctggccgtcttcctgctggacacgagcttcctgctcagcgagccggtggccctgacaggctctgaggctggctgccgagccagtgccatcttcctgcacttctccctgctcacctgcctttcctggatgggcctcgaggggtacaacctctaccgactcgtggtggaggtctttggcacctatgtccctggctacctactcaagctgagcgccatgggctggggcttccccatctttctggtgacgctggtggccctggtggatgtggacaactatggccccatcatcttggctgtgcataggactccagagggcgtcatctacccttccatgtgctggatccgggactccctggtcagctacatcaccaacctgggcctcttcagcctggtgtttctgttcaacatggccatgctagccaccatggtggtgcagatcctgcggctgcgcccccacacccaaaagtggtcacatgtgctgacactgctgggcctcagcctggtccttggcctgccctgggccttgatcttcttctcctttgcttctggcaccttccagcttgtcgtcctctaccttttcagcatcatcacctccttccaaggcttcctcatcttcatctggtactggtccatgcggctgcaggcccggggtggcccctcccctctgaagagcaactcagacagcgccaggctccccatcagctcgggcagcacctcgtccagccgcatctaggcctccagcccacctgcccatgtgatgaagcagagattcggcctcgtcgcacactgcctgtggcccccgagcccggcccagccccaggccagtcagccgcagactttggaaagcccaacgaccatggagagatgggccgttgccatggtggacggactcccgggctgggcttttgaattggccttggggactactcggctctcactcagctcccacgggactcagaagtgcgccgccatgctgcctagggtactgtccccacatctgtcccaacccagctggaggcctggtctctccttacaacccctgggcccagccctcattgctgggggccaggccttggatcttgagggtctggcacatccttaatcctgtgcccctgcctgggacagaaatgtggctccagttgctctgtctctcgtggtcaccctgagggcactctgcatcctctgtcattttaacctcaggtggcacccagggcgaatggggcccagggcagaccttcagggccagagccctggcggaggagaggccctttgccaggagcacagcagcagctcgcctacctctgagcccaggccccctccctccctcagccccccagtcctccctccatcttccctggggttctcctcctctcccagggcctccttgctccttcgttcacagctgggggtccccgattccaatgctgttttttggggagtggtttccaggagctgcctggtgtctgctgtaaatgtttgtctactgcacaagcctcggcctgcccctgagccaggctcggtaccgatgcgtgggctgggctaggtccctctgtccatctgggcctttgtatgagctgcattgcccttgctcaccctgaccaagcacacgcctcagaggggccctcagcctctcctgaagccctcttgtggcaagaactgtggaccatgccagtcccgtctggtttccatcccaccactccaaggactgagactgacctcctctggtgacactggcctagggcctgacactctcctaagaggttctctccaagcccccaaatagctccaggcgccctcggccgcccatcatggttaattctgtccaacaaacacacacgggtagattgctggcctgttgtaggtggtagggacacagatgaccgacctggtcactcctcctgccaacattcagtctggtatgtgaggcgtgcgtgaagcaagaactcctggagctacagggacagggagccatcattcctgcctgggaatcctggaagacttcctgcaggagtcagcgttcaatcttgaccttgaagatgggaaggatgttctttttacgtaccaattcttttgtcttttgatattaaaaagaagtacatgttcattgtagagaatttggaaactgtagaagagaatcaagaagaaaaataaaaatcagctgttgtaatcacctagcaaactgg

SEQ ID NO: 11619 - DNA, 4043 bp, Homo sapiens
acttgggaacaggacaagttacggagccacgttgctttgctgggtctgagccggggtgtgacgtagtccctgcagctgccaacggttgccagggcaacggttgccaggggctgctgtcacctgcgccccttctcccgcgctggcggctggggcttctcagcctctattccctggctgtcccctttgtttgaagctccagtgagggagcagtggctggggtggcccagcttcaaagtctctgtcctcttgaaaaaaggtggtcgggggacattgacccaccagccccgcaggctactgcctgcaaacaagaacccctcatctgccacgcacgttcttaatgtatctatagtctgcctgatgccacaaaggagtccagggtctcgctctgtcacacaggctggagtgcagtggtgtgatcttggctcatcgtaacctccacctcccgggttcaagtgattctcatgcctcagcctcccgagtagctgggattacaggtggtgacttccaagagtgactccgtcggaggaaaatgactccccagtcgctgctgcagacgacactgttcctgctgagtctgctcttcctggtccaaggtgcccacggcaggggccacagggaagactttcgcttctgcagccagcggaaccagacacacaggagcagcctccactacaaacccacaccagacctgcgcatctccatcgagaactccgaagaggccctcacagtccatgcccctttccctgcagcccaccctgcttcccgatccttccctgaccccaggggcctctaccacttctgcctctactggaaccgacatgctgggagattacatcttctctatggcaagcgtgacttcttgctgagtgacaaagcctctagcctcctctgcttccagcaccaggaggagagcctggctcagggccccccgctgttagccacttctgtcacctcctggtggagccctcagaacatcagcctgcccagtgccgccagcttcaccttctccttccacagtcctccccacacggccgctcacaatgcctcggtggacatgtgcgagctcaaaagggacctccagctgctcagccagttcctgaagcatccccagaaggcctcaaggaggccctcggctgcccccgccagccagcagttgcagagcctggagtcgaaactgacctctgtgagattcatgggggacatggtgtccttcgaggaggaccggatcaacgccacggtgtggaagctccagcccacagccggcctccaggacctgcacatccactcccggcaggaggaggagcagagcgagatcatggagtactcggtgctgctgcctcgaacactcttccagaggacgaaaggccggagcggggaggctgagaagagactcctcctggtggacttcagcagccaagccctgttccaggacaagaattccagccaagtcctgggtgagaaggtcttggggattgtggtacagaacaccaaagtagccaacctcacggagcccgtggtgctcactttccagcaccagctacagccgaagaatgtgactctgcaatgtgtgttctgggttgaagaccccacattgagcagcccggggcattggagcagtgctgggtgtgagaccgtcaggagagaaacccaaacatcctgcttctgcaaccacttgacctactttgcagtgctgatggtctcctcggtggaggtggacgccgtgcacaagcactacctgagcctcctctcctacgtgggctgtgtcgtctctgccctggcctgccttgtcaccattgccgcctacctctgctccaggaggaaacctcgggactacaccatcaaggtgcacatgaacctgctgctggccgtcttcctgctggacacgagcttcctgctcagcgagccggtggccctgacaggctctgaggctggctgccgagccagtgccatcttcctgcacttctccctgctcacctgcctttcctggatgggcctcgaggggtacaacctctaccgactcgtggtggaggtctttggcacctatgtccctggctacctactcaagctgagcgccatgggctggggcttccccatctttctggtgacgctggtggccctggtggatgtggacaactatggccccatcatcttggctgtgcataggactccagagggcgtcatctacccttccatgtgctggatccgggactccctggtcagctacatcaccaacctgggcctcttcagcctggtgtttctgttcaacatggccatgctagccaccatggtggtgcagatcctgcggctgcgcccccacacccaaaagtggtcacatgtgctgacactgctgggcctcagcctggtccttggcctgccctgggccttgatcttcttctcctttgcttctggcaccttccagcttgtcgtcctctaccttttcagcatcatcacctccttccaaggcttcctcatcttcatctggtactggtccatgcggctgcaggcccggggtggcccctcccctctgaagagcaactcagacagcgccaggctccccatcagctcgggcagcacctcgtccagccgcatctaggcctccagcccacctgcccatgtgatgaagcagagattcggcctcgtcgcacactgcctgtggcccccgagcccggcccagccccaggccagtcagccgcagactttggaaagcccaacgaccatggagagatgggccgttgccatggtggacggactcccgggctgggcttttgaattggccttggggactactcggctctcactcagctcccacgggactcagaagtgcgccgccatgctgcctagggtactgtccccacatctgtcccaacccagctggaggcctggtctctccttacaacccctgggcccagccctcattgctgggggccaggccttggatcttgagggtctggcacatccttaatcctgtgcccctgcctgggacagaaatgtggctccagttgctctgtctctcgtggtcaccctgagggcactctgcatcctctgtcattttaacctcaggtggcacccagggcgaatggggcccagggcagaccttcagggccagagccctggcggaggagaggccctttgccaggagcacagcagcagctcgcctacctctgagcccaggccccctccctccctcagccccccagtcctccctccatcttccctggggttctcctcctctcccagggcctccttgctccttcgttcacagctgggggtccccgattccaatgctgttttttggggagtggtttccaggagctgcctggtgtctgctgtaaatgtttgtctactgcacaagcctcggcctgcccctgagccaggctcggtaccgatgcgtgggctgggctaggtccctctgtccatctgggcctttgtatgagctgcattgcccttgctcaccctgaccaagcacacgcctcagaggggccctcagcctctcctgaagccctcttgtggcaagaactgtggaccatgccagtcccgtctggtttccatcccaccactccaaggactgagactgacctcctctggtgacactggcctagggcctgacactctcctaagaggttctctccaagcccccaaatagctccaggcgccctcggccgcccatcatggttaattctgtccaacaaacacacacgggtagattgctggcctgttgtaggtggtagggacacagatgaccgacctggtcactcctcctgccaacattcagtctggtatgtgaggcgtgcgtgaagcaagaactcctggagctacagggacagggagccatcattcctgcctgggaatcctggaagacttcctgcaggagtcagcgttcaatcttgaccttgaagatgggaaggatgttctttttacgtaccaattcttttgtcttttgatattaaaaagaagtacatgttcattgtagagaatttggaaactgtagaagagaatcaagaagaaaaataaaaatcagctgttgtaatcacctagcaaactgg

SEQ ID NO: 11620 - DNA, 2688 bp, Homo sapiens
tctcccgcgctggcggctggggcttctcagcctctattccctggctgtcccctttgtttgaagctccagtgagggagcagtggctggggtggcccagcttcaaagtctctgtcctcttgaaaaaaggtggtcgggggacattgacccaccagccccgcaggctactgcctgcaaacaagaacccctcatctgccacgcacgttcttaatgtatctatagtctgcctgatgccacaaaggagtccaggtggtgacttccaagagtgactccgtcggaggaaaatgactccccagtcgctgctgcagacgacactgttcctgctgagtctgctcttcctggtccaagccagcggaaccagacacacaggagcagcctccactacaaacccacaccagacctgcgcatctccatcgagaactccgaagaggccctcacagtccatgcccctttccctgcagcccaccctgcttcccgatccttccctgaccccaggggcctctaccacttctgcctctactggaaccgacatgctgggagattacatcttctctatggcaagcgtgacttcttgctgagtgacaaagcctctagcctcctctgcttccagcaccaggaggagagcctggctcagggccccccgctgttagccacttctgtcacctcctggtggagccctcagaacatcagcctgcccagtgccgccagcttcaccttctccttccacagtcctccccacacggccgctcacaatgcctcggtggacatgtgcgagctcaaaagggacctccagctgctcagccagttcctgaagcatccccagaaggcctcaaggaggccctcggctgcccccgccagccagcagttgcagagcctggagtcgaaactgacctctgtgagattcatgggggacatggtgtccttcgaggaggaccggatcaacgccacggtgtggaagctccagcccacagccggcctccaggacctgcacatccactcccggcaggaggaggagcagagcgagatcatggagtactcggtgctgctgcctcgaacactcttccagaggacgaaaggccggagcggggaggctgagaagagactcctcctggtggacttcagcagccaagccctgttccaggacaagaattccagccaagtcctgggtgagaaggtcttggggattgtggtacagaacaccaaagtagccaacctcacggagcccgtggtgctcactttccagcaccagctacagccgaagaatgtgactctgcaatgtgtgttctgggttgaagaccccacattgagcagcccggggcattggagcagtgctgggtgtgagaccgtcaggagagaaacccaaacatcctgcttctgcaaccacttgacctactttgcagtgctgatggtctcctcggtggaggtggacgccgtgcacaagcactacctgagcctcctctcctacgtgggctgtgtcgtctctgccctggcctgccttgtcaccattgccgcctacctctgctccaggaggaaacctcgggactacaccatcaaggtgcacatgaacctgctgctggccgtcttcctgctggacacgagcttcctgctcagcgagccggtggccctgacaggctctgaggctggctgccgagccagtgccatcttcctgcacttctccctgctcacctgcctttcctggatgggcctcgaggggtacaacctctaccgactcgtggtggaggtctttggcacctatgtccctggctacctactcaagctgagcgccatgggctggggcttccccatctttctggtgacgctggtggccctggtggatgtggacaactatggccccatcatcttggctgtgcataggactccagagggcgtcatctacccttccatgtgctggatccgggactccctggtcagctacatcaccaacctgggcctcttcagcctggtgtttctgttcaacatggccatgctagccaccatggtggtgcagatcctgcggctgcgcccccacacccaaaagtggtcacatgtgctgacactgctgggcctcagcctggtccttggcctgccctgggccttgatcttcttctcctttgcttctggcaccttccagcttgtcgtcctctaccttttcagcatcatcacctccttccaaggcttcctcatcttcatctggtactggtccatgcggctgcaggcccggggtggcccctcccctctgaagagcaactcagacagcgccaggctccccatcagctcgggcagcacctcgtccagccgcatctaggcctccagcccacctgcccatgtgatgaagcagagattcggcctcgtcgcacactgcctgtggcccccgagcccggcccagccccaggccagtcagccgcagactttggaaagcccaacgaccatggagagatgggccgttgccatggtggacggactcccgggctgggcttttgaattggccttggggactactcggctctcactcagctcccacgggactcagaagtgcgccgccatgctgcctagggtactgtccccacatctgtcccaacccagctggaggcctggtctctccttacaacccctgggcccagccctcattgctgggggccaggccttggatcttgagggtctggcacatccttaatcctgtgcccctgcctg

SEQ ID NO: 11621 - DNA, 4042 bp, Homo sapiens
actttggggagactggccctgggaggcgacagatggaggctgaggaagcagagtgatccccggccccttcctgtccctgaacactgtctgcctggatgaggggtgaggctgaggtgcccccttgcccggcgctgagtcatgggcatcccccaggatcactgcctcagcgctctcagccctgccccctcctggtctccctctgagaaatccatgactcacatatatcgtccgtcatccccagtcaagctcagggaggagggaggagcccagctggggcaggagaggggtgtctccccaccaaacaaacccggtccctccctctccgcactagctgtctgccctgccctgccgtaggagatgggctgggagcctcccacgctctccagctcactcggcaggcagcggggaccagggctggcaggttaagcctctgggggtggatcctgaaaggtggtccagccgcctggccctgcgtgggaccctccacctggcagcaggtggtgacttccaagagtgactccgtcggaggaaaatgactccccagtcgctgctgcagacgacactgttcctgctgagtctgctcttcctggtccaaggtgcccacggcaggggccacagggaagactttcgcttctgcagccagcggaaccagacacacaggagcagcctccactacaaacccacaccagacctgcgcatctccatcgagaactccgaagaggccctcacagtccatgcccctttccctgcagcccaccctgcttcccgatccttccctgaccccaggggcctctaccacttctgcctctactggaaccgacatgctgggagattacatcttctctatggcaagcgtgacttcttgctgagtgacaaagcctctagcctcctctgcttccagcaccaggaggagagcctggctcagggccccccgctgttagccacttctgtcacctcctggtggagccctcagaacatcagcctgcccagtgccgccagcttcaccttctccttccacagtcctccccacacggccgctcacaatgcctcggtggacatgtgcgagctcaaaagggacctccagctgctcagccagttcctgaagcatccccagaaggcctcaaggaggccctcggctgcccccgccagccagcagttgcagagcctggagtcgaaactgacctctgtgagattcatgggggacatggtgtccttcgaggaggaccggatcaacgccacggtgtggaagctccagcccacagccggcctccaggacctgcacatccactcccggcaggaggaggagcagagcgagatcatggagtactcggtgctgctgcctcgaacactcttccagaggacgaaaggccggagcggggaggctgagaagagactcctcctggtggacttcagcagccaagccctgttccaggacaagaattccagccaagtcctgggtgagaaggtcttggggattgtggtacagaacaccaaagtagccaacctcacggagcccgtggtgctcactttccagcaccagctacagccgaagaatgtgactctgcaatgtgtgttctgggttgaagaccccacattgagcagcccggggcattggagcagtgctgggtgtgagaccgtcaggagagaaacccaaacatcctgcttctgcaaccacttgacctactttgcagtgctgatggtctcctcggtggaggtggacgccgtgcacaagcactacctgagcctcctctcctacgtgggctgtgtcgtctctgccctggcctgccttgtcaccattgccgcctacctctgctccaggaggaaacctcgggactacaccatcaaggtgcacatgaacctgctgctggccgtcttcctgctggacacgagcttcctgctcagcgagccggtggccctgacaggctctgaggctggctgccgagccagtgccatcttcctgcacttctccctgctcacctgcctttcctggatgggcctcgaggggtacaacctctaccgactcgtggtggaggtctttggcacctatgtccctggctacctactcaagctgagcgccatgggctggggcttccccatctttctggtgacgctggtggccctggtggatgtggacaactatggccccatcatcttggctgtgcataggactccagagggcgtcatctacccttccatgtgctggatccgggactccctggtcagctacatcaccaacctgggcctcttcagcctggtgtttctgttcaacatggccatgctagccaccatggtggtgcagatcctgcggctgcgcccccacacccaaaagtggtcacatgtgctgacactgctgggcctcagcctggtccttggcctgccctgggccttgatcttcttctcctttgcttctggcaccttccagcttgtcgtcctctaccttttcagcatcatcacctccttccaaggcttcctcatcttcatctggtactggtccatgcggctgcaggcccggggtggcccctcccctctgaagagcaactcagacagcgccaggctccccatcagctcgggcagcacctcgtccagccgcatctaggcctccagcccacctgcccatgtgatgaagcagagattcggcctcgtcgcacactgcctgtggcccccgagcccggcccagccccaggccagtcagccgcagactttggaaagcccaacgaccatggagagatgggccgttgccatggtggacggactcccgggctgggcttttgaattggccttggggactactcggctctcactcagctcccacgggactcagaagtgcgccgccatgctgcctagggtactgtccccacatctgtcccaacccagctggaggcctggtctctccttacaacccctgggcccagccctcattgctgggggccaggccttggatcttgagggtctggcacatccttaatcctgtgcccctgcctgggacagaaatgtggctccagttgctctgtctctcgtggtcaccctgagggcactctgcatcctctgtcattttaacctcaggtggcacccagggcgaatggggcccagggcagaccttcagggccagagccctggcggaggagaggccctttgccaggagcacagcagcagctcgcctacctctgagcccaggccccctccctccctcagccccccagtcctccctccatcttccctggggttctcctcctctcccagggcctccttgctccttcgttcacagctgggggtccccgattccaatgctgttttttggggagtggtttccaggagctgcctggtgtctgctgtaaatgtttgtctactgcacaagcctcggcctgcccctgagccaggctcggtaccgatgcgtgggctgggctaggtccctctgtccatctgggcctttgtatgagctgcattgcccttgctcaccctgaccaagcacacgcctcagaggggccctcagcctctcctgaagccctcttgtggcaagaactgtggaccatgccagtcccgtctggtttccatcccaccactccaaggactgagactgacctcctctggtgacactggcctagggcctgacactctcctaagaggttctctccaagcccccaaatagctccaggcgccctcggccgcccatcatggttaattctgtccaacaaacacacacgggtagattgctggcctgttgtaggtggtagggacacagatgaccgacctggtcactcctcctgccaacattcagtctggtatgtgaggcgtgcgtgaagcaagaactcctggagctacagggacagggagccatcattcctgcctgggaatcctggaagacttcctgcaggagtcagcgttcaatcttgaccttgaagatgggaaggatgttctttttacgtaccaattcttttgtcttttgatattaaaaagaagtacatgttcattgtagagaatttggaaactgtagaagagaatcaagaagaaaaataaaaatcagctgttgtaatcacctagcaaa

SEQ ID NO: 11622 - DNA, 3852 bp, Homo sapiens
aacaagagagggtggcggctgcagtggctgtggggcagccggaaatggggcgagacagacaggcggagcctcacctggggctgcccgccagcccagacaagctcagactgggtgcctgtggccctgggaggaggtggaaggggaggagcaggccacacaggcacaggccggtgagggacctgcccagacctggagggtctcgctctgtcacacaggctggagtgcagtggtgtgatcttggctcatcgtaacctccacctcccgggttcaagtgattctcatgcctcagcctcccgagtagctgggattacaggtggtgacttccaagagtgactccgtcggaggaaaatgactccccagtcgctgctgcagacgacactgttcctgctgagtctgctcttcctggtccaaggtgcccacggcaggggccacagggaagactttcgcttctgcagccagcggaaccagacacacaggagcagcctccactacaaacccacaccagacctgcgcatctccatcgagaactccgaagaggccctcacagtccatgcccctttccctgcagcccaccctgcttcccgatccttccctgaccccaggggcctctaccacttctgcctctactggaaccgacatgctgggagattacatcttctctatggcaagcgtgacttcttgctgagtgacaaagcctctagcctcctctgcttccagcaccaggaggagagcctggctcagggccccccgctgttagccacttctgtcacctcctggtggagccctcagaacatcagcctgcccagtgccgccagcttcaccttctccttccacagtcctccccacacggccgctcacaatgcctcggtggacatgtgcgagctcaaaagggacctccagctgctcagccagttcctgaagcatccccagaaggcctcaaggaggccctcggctgcccccgccagccagcagttgcagagcctggagtcgaaactgacctctgtgagattcatgggggacatggtgtccttcgaggaggaccggatcaacgccacggtgtggaagctccagcccacagccggcctccaggacctgcacatccactcccggcaggaggaggagcagagcgagatcatggagtactcggtgctgctgcctcgaacactcttccagaggacgaaaggccggagcggggaggctgagaagagactcctcctggtggacttcagcagccaagccctgttccaggacaagaattccagccaagtcctgggtgagaaggtcttggggattgtggtacagaacaccaaagtagccaacctcacggagcccgtggtgctcactttccagcaccagctacagccgaagaatgtgactctgcaatgtgtgttctgggttgaagaccccacattgagcagcccggggcattggagcagtgctgggtgtgagaccgtcaggagagaaacccaaacatcctgcttctgcaaccacttgacctactttgcagtgctgatggtctcctcggtggaggtggacgccgtgcacaagcactacctgagcctcctctcctacgtgggctgtgtcgtctctgccctggcctgccttgtcaccattgccgcctacctctgctccaggaggaaacctcgggactacaccatcaaggtgcacatgaacctgctgctggccgtcttcctgctggacacgagcttcctgctcagcgagccggtggccctgacaggctctgaggctggctgccgagccagtgccatcttcctgcacttctccctgctcacctgcctttcctggatgggcctcgaggggtacaacctctaccgactcgtggtggaggtctttggcacctatgtccctggctacctactcaagctgagcgccatgggctggggcttccccatctttctggtgacgctggtggccctggtggatgtggacaactatggccccatcatcttggctgtgcataggactccagagggcgtcatctacccttccatgtgctggatccgggactccctggtcagctacatcaccaacctgggcctcttcagcctggtgtttctgttcaacatggccatgctagccaccatggtggtgcagatcctgcggctgcgcccccacacccaaaagtggtcacatgtgctgacactgctgggcctcagcctggtccttggcctgccctgggccttgatcttcttctcctttgcttctggcaccttccagcttgtcgtcctctaccttttcagcatcatcacctccttccaaggcttcctcatcttcatctggtactggtccatgcggctgcaggcccggggtggcccctcccctctgaagagcaactcagacagcgccaggctccccatcagctcgggcagcacctcgtccagccgcatctaggcctccagcccacctgcccatgtgatgaagcagagattcggcctcgtcgcacactgcctgtggcccccgagcccggcccagccccaggccagtcagccgcagactttggaaagcccaacgaccatggagagatgggccgttgccatggtggacggactcccgggctgggcttttgaattggccttggggactactcggctctcactcagctcccacgggactcagaagtgcgccgccatgctgcctagggtactgtccccacatctgtcccaacccagctggaggcctggtctctccttacaacccctgggcccagccctcattgctgggggccaggccttggatcttgagggtctggcacatccttaatcctgtgcccctgcctgggacagaaatgtggctccagttgctctgtctctcgtggtcaccctgagggcactctgcatcctctgtcattttaacctcaggtggcacccagggcgaatggggcccagggcagaccttcagggccagagccctggcggaggagaggccctttgccaggagcacagcagcagctcgcctacctctgagcccaggccccctccctccctcagccccccagtcctccctccatcttccctggggttctcctcctctcccagggcctccttgctccttcgttcacagctgggggtccccgattccaatgctgttttttggggagtggtttccaggagctgcctggtgtctgctgtaaatgtttgtctactgcacaagcctcggcctgcccctgagccaggctcggtaccgatgcgtgggctgggctaggtccctctgtccatctgggcctttgtatgagctgcattgcccttgctcaccctgaccaagcacacgcctcagaggggccctcagcctctcctgaagccctcttgtggcaagaactgtggaccatgccagtcccgtctggtttccatcccaccactccaaggactgagactgacctcctctggtgacactggcctagggcctgacactctcctaagaggttctctccaagcccccaaatagctccaggcgccctcggccgcccatcatggttaattctgtccaacaaacacacacgggtagattgctggcctgttgtaggtggtagggacacagatgaccgacctggtcactcctcctgccaacattcagtctggtatgtgaggcgtgcgtgaagcaagaactcctggagctacagggacagggagccatcattcctgcctgggaatcctggaagacttcctgcaggagtcagcgttcaatcttgaccttgaagatgggaaggatgttctttttacgtaccaattcttttgtcttttgatattaaaaagaagtacatgttcattgtagagaatttggaaactgtagaagagaatcaagaagaaaaataaaaatcagctgttgtaatcacct

SEQ ID NO: 11623 - DNA, 1624 bp, Homo sapiens
ggtgcaaatccggccgcgatgaacgcgagcgccgcctcgctcaacgactcccaggtggtggtagtggcggccgaaggagcggcggcggcggccacagcagcaggggggccggacacgggcgaatggggaccccctgctgcggcggctctaggagccggcggcggagctaatgggtctctggagctgtcctcgcagctgtcggctgggccaccgggactcctgctgccagcggtgaatccgtgggacgtgctcctgtgcgtgtcggggacagtgatcgctggagaaaacgcgctggtggtggcgctcatcgcgtccactccggcgctgcgcacgcccatgttcgtgctggtaggcagcctggccaccgctgacctgttggcgggctgtggcctcatcttgcactttgtgttccagtacttggtgccctcggagactgtgagtctgctcacggtgggcttcctcgtggcctccttcgccgcctctgtcagcagcctgctggccattacggtggaccgctacctgtccctgtataacgcgctcacctattactcgcgccggaccctgttgggcgtgcacctcctgcttgccgccacttggaccgtgtccctaggcctggggctgctgcccgtgctgggctggaactgcctggcagagcgcgccgcctgcagcgtggtgcgcccgctggcgcgcagccacgtggctctgctctccgccgccttcttcatggtcttcggcatcatgctgcacctgtacgtgcgcatctgccaggtggtctggcgccacgcgcaccagatcgcgctgcagcagcactgcctggcgccaccccatctcgctgccaccagaaagggtgtgggtacactggctgtggtgctgggcactttcggcgccagctggctgcccttcgccatctattgcgtggtgggcagccatgaggacccggcggtctacacttacgccaccctgctgcccgccacctacaactccatgatcaatcccatcatctatgccttccgcaaccaggagatccagcgcgccctgtggctcctgctctgtggctgtttccagtccaaagtgccctttcgttccaggtctcccagcgaggtctgaagggctcgccccgtgtcctctcaccaacaccacaccccaacaagccagcctttggtaagctcggtgcctgctgacgaactctgagatcccaatggtgtgagtctgactttggaaagaaaaagggactaaagagaaatgtaacaaacttacaaggacaaagaggcttgttggcactttacatatacagtgtatacatgtgtacatatatatacaaatatttgtatcttctggaggtgttcaggatgtggagcttcctattctgtgaaaaaccaagaaaaagatatggttgtatactcaaattgtacatcacgtttgtcaaacgaagacattccaatactgcttaattatagcactttatttttagctgctgaactgccaaaacagtgttgccattttcaagggcagggaaaagggagtaaaaggtgtatttttgtcgtatgtgatagaatattttgctgcacatgcatcaacaaattacaacatgttttgtacacgaataaacccattacaagaatgt

SEQ ID NO: 11624 - DNA, 1711 bp, Homo sapiens
actcgcggagccggcacagcgacaggcgccccgcgcttgcctcctccccggcccggccgcctcctgcaggcagctgctctgtttgcgcggggagctcagcccggcgccccgcctcggcgcccatgaccagcgacttccagaagtcctgacgccccagcaccgcggacagcgtctctgctgcccagccccatggggatgtcctggtcgcgccgccacaacccaggcgggactctcccaggatgacactcctagcttggtgcactcggggtgcaaatccggccgcgatgaacgcgagcgccgcctcgctcaacgactcccaggtggtggtagtggcggccgaaggagcggcggcggcggccacagcagcaggggggccggacacgggcgaatggggaccccctgctgcggcggctctaggagccggcggcggagctaatgggtctctggagctgtcctcgcagctgtcggctgggccaccgggactcctgctgccagcggtgaatccgtgggacgtgctcctgtgcgtgtcggggacagtgatcgctggagaaaacgcgctggtggtggcgctcatcgcgtccactccggcgctgcgcacgcccatgttcgtgctggtaggcagcctggccaccgctgacctgttggcgggctgtggcctcatcttgcactttgtgttccagtacttggtgccctcggagactgtgagtctgctcacggtgggcttcctcgtggcctccttcgccgcctctgtcagcagcctgctggccattacggtggaccgctacctgtccctgtataacgcgctcacctattactcgcgccggaccctgttgggcgtgcacctcctgcttgccgccacttggaccgtgtccctaggcctggggctgctgcccgtgctgggctggaactgcctggcagagcgcgccgcctgcagcgtggtgcgcccgctggcgcgcagccacgtggctctgctctccgccgccttcttcatggtcttcggcatcatgctgcacctgtacgtgcgcatctgccaggtggtctggcgccacgcgcaccagatcgcgctgcagcagcactgcctggcgccaccccatctcgctgccaccagaaagggtgtgggtacactggctgtggtgctgggcactttcggcgccagctggctgcccttcgccatctattgcgtggtgggcagccatgaggacccggcggtctacacttacgccaccctgctgcccgccacctacaactccatgatcaatcccatcatctatgccttccgcaaccaggagatccagcgcgccctgtggctcctgctctgtggctgtttccagtccaaagtgccctttcgttccaggtctcccagcgaggtctgaagggctcgccccgtgtcctctcaccaacaccacaccccaacaagccagcctttggtaagctcggtgcctgctgacgaactctgagatcccaatggtgtgagtctgactttggaaagaaaaagggactaaagagaaatgtaacaaacttacaaggacaaagaggcttgttggcactttacatatacagtgtatacatgtgtacatatatatacaaatatttgtatcttctggaggtgttcaggatgtggagcttcctattctgtgaaaaaccaagaaaaagatatggttgtatactcaaattgtacatcacgtttgtcaaacgaagacattccaatact

SEQ ID NO: 11625 - DNA, 1259 bp, Homo sapiens
ctctcactcgcggagccggcacagcgacaggcgccccgcgcttgcctcctccccggcccggccgcctcctgcaggcagctgctctgtttgcgcggggagctcagcccggcgccccgcctcggcgcccatgaccagcgacttccagaagtcctgacgccccagggtgcaaatccggccgcgatgaacgcgagcgccgcctcgctcaacgactcccaggtggtggtagtggcggccgaaggagcggcggcggcggccacagcagcaggggggccggacacgggcgaatggggaccccctgctgcggcggctctaggagccggcggcggagctaatgggtctctggagctgtcctcgcagctgtcggctgggccaccgggactcctgctgccagcggtgaatccgtgggacgtgctcctgtgcgtgtcggggacagtgatcgctggagaaaacgcgctggtggtggcgctcatcgcgtccactccggcgctgcgcacgcccatgttcgtgctggtaggcagcctggccaccgctgacctgttggcgggctgtggcctcatcttgcactttgtgttccagtacttggtgccctcggagactgtgagtctgctcacggtgggcttcctcgtggcctccttcgccgcctctgtcagcagcctgctggccattacggtggaccgctacctgtccctgtataacgcgctcacctattactcgcgccggaccctgttgggcgtgcacctcctgcttgccgccacttggaccgtgtccctaggcctggggctgctgcccgtgctgggctggaactgcctggcagagcgcgccgcctgcagcgtggtgcgcccgctggcgcgcagccacgtggctctgctctccgccgccttcttcatggtcttcggcatcatgctgcacctgtacgtgcgcatctgccaggtggtctggcgccacgcgcaccagatcgcgctgcagcagcactgcctggcgccaccccatctcgctgccaccagaaagggtgtgggtacactggctgtggtgctgggcactttcggcgccagctggctgcccttcgccacctacaactccatgatcaatcccatcatctatgccttccgcaaccaggagatccagcgcgccctgtggctcctgctctgtggctgtttccagtccaaagtgccctttcgttccaggtctcccagcgaggtctgaagggctcgccccgtgtcctctcaccaacaccacaccccaacaagccagcctttggt

SEQ ID NO: 11626 - DNA, 2819 bp, Homo sapiens
gcagtgcttcaggcttcagcagccttggagaagcatcagctgagaggagctatcacatgggagccgggactgctcagcaaagatggatttatgaggaaactgaaattcagaagattcacagagttagtaatgcccagaactgggactagaaactaaattttgtgctccttctactccccagcagctcttgccattctgaggagacaagaaatcaggaaatttacataaggaaccctaaaactgaggcactatcccagagatcagcaggaccctgggaaggagaaacaggatttagaatccccggctaacagttctggaaagggtagaagggtatggagaacaagaatggcagaaaggagatggaaaaggaagaggtgaaggccattccgaaagcggagtgttgagtgggtcaggctcctgcacctctcacgtctcctgcttcttagcagtcaccaaggcagaccctgcagctacctccggccagaaaggggatgagcttctgatccttcagctgcctggcctggcgctctgtacgcagacaaacctgcccaagaggctccagtgggaggtgccccctacgaaaccaggaagcctgggcctgggctcgccatcccagggtcgctggactaggatgggggatgggcctcaggaggtaccctgggtgccctctttcggccccatggagtcctcacccatcccccagtcatcagggaactcttccactttggggagggtccctcaaaccccaggtccctctactgccagtggggtcccggaggtggggctacgggatgttgcttcggaatctgtggccctcttcttcatgctcctgctggacttgactgctgtggctggcaatgccgctgtgatggccgtgatcgccaagacgcctgccctccgaaaatttgtcttcgtcttccacctctgcctggtggacctgctggctgccctgaccctcatgcccctggccatgctctccagctctgccctctttgaccacgccctctttggggaggtggcctgccgcctctacttgtttctgagcgtgtgctttgtcagcctggccatcctctcggtgtcagccatcaatgtggagcgctactattacgtagtccaccccatgcgctacgaggtgcgcatgacgctggggctggtggcctctgtgctggtgggtgtgtgggtgaaggccttggccatggcttctgtgccagtgttgggaagggtctcctgggaggaaggagctcccagtgtccccccaggctgttcactccagtggagccacagtgcctactgccagctttttgtggtggtctttgctgtcctttactttctgttgcccctgctcctcatacttgtggtctactgcagcatgttccgagtggcccgcgtggctgccatgcagcacgggccgctgcccacgtggatggagacaccccggcaacgctccgaatctctcagcagccgctccacgatggtcaccagctcgggggccccccagaccaccccacaccggacgtttgggggagggaaagcagcagtggttctcctggctgtggggggacagttcctgctctgttggttgccctacttctctttccacctctatgttgccctgagtgctcagcccatttcaactgggcaggtggagagtgtggtcacctggattggctacttttgcttcacttccaaccctttcttctatggatgtctcaaccggcagatccggggggagctcagcaagcagtttgtctgcttcttcaagccagctccagaggaggagctgaggctgcctagccgggagggctccattgaggagaacttcctgcagttccttcaggggactggctgtccttctgagtcctgggtttcccgacccctacccagccccaagcaggagccacctgctgttgactttcgaatcccaggccagatagctgaggagacctctgagttcctggagcagcaactcaccagcgacatcatcatgtcagacagctacctccgtcctgccgcctcaccccggctggagtcatgatgggccgctggacactcggagggatatggggctggggccagttatgattgcaaggaccaccttgtgggatcaccttttcccagctggctagggctgaggctggggtctctgcacacagcttttgcttagtgtttcctgggtcaggaacagagccaacaggatgaacgtgtgcaaaagccttggacttggctgtgatctttgactgctaggggagggaacctgggtatggtgagacggtgacgagagaaaagggtcacaaaggactggcctccctgatctctctcctcatggcagcgacccacctccagtcccctggacaatcgggtacaagagacttaaggttgggcatgggaagggtggggtttccatgatccattaaatgccttcctactcccattcatcgctctcaaaattagcttcagtgacaaagacttaaatctctctcctatctgcagcactgggttggagagagggcacgggagttggtcttggctgttcattgattgagactgtaggaactgtgttggttggtattggtggtggtattttcaacaaacagggaataactgcaaactggacaggacacccatctgggaccacctgtccatcctacttccctcaattgaatcaggtaacactaacggatcaaggcagggccagagggtggtgtggtctctatttgaacaaattcctggctcactgagcatcaaaaggggaaatgggctggtgggagtgggatagtctcccatttaagcagctaataaataatttttatgataaaagg

SEQ ID NO: 11627 - DNA, 2834 bp, Homo sapiens
gcagtgcttcaggcttcagcagccttggagaagcatcagctgagaggagctatcacatgggagccgggactgctcagcaaagatggatttatgaggaaactgaaattcagaagattcacagagttagtaatgcccagaactgggactagaaactaaattttgtgctccttctactccccagcagctcttgccattctgaggagacaagaaatcaggaaatttacataaggaaccctaaaactgaggcactatcccagagatcagcaggaccctgggaaggagaaacaggatttagaatccccggctaacagttctggaaagggtagaagggtatggagaacaagaatggcagaaaggagatggaaaaggaagaggtgaaggccattccgaaagcggagtgttgagtgggtcaggctcctgcacctctcacgtctcctgcttcttagcagtcaccaaggcagaccctgcagctacctccggccagaaaggggatgagcttctgatccttcagctgcctggcctggcgctctgtacgcagacaaacctgcccaagaggctccagtgggaggtgccccctacgaaaccaggaagcctgggcctgggctcgccatcccagggtcgctggactaggatgggggatgggcctgtgacaggaggtaccctgggtgccctctttcggccccatggagtcctcacccatcccccagtcatcagggaactcttccactttggggagggtccctcaaaccccaggtccctctactgccagtggggtcccggaggtggggctacgggatgttgcttcggaatctgtggccctcttcttcatgctcctgctggacttgactgctgtggctggcaatgccgctgtgatggccgtgatcgccaagacgcctgccctccgaaaatttgtcttcgtcttccacctctgcctggtggacctgctggctgccctgaccctcatgcccctggccatgctctccagctctgccctctttgaccacgccctctttggggaggtggcctgccgcctctacttgtttctgagcgtgtgctttgtcagcctggccatcctctcggtgtcagccatcaatgtggagcgctactattacgtagtccaccccatgcgctacgaggtgcgcatgacgctggggctggtggcctctgtgctggtgggtgtgtgggtgaaggccttggccatggcttctgtgccagtgttgggaagggtctcctgggaggaaggagctcccagtgtccccccaggctgttcactccagtggagccacagtgcctactgccagctttttgtggtggtctttgctgtcctttactttctgttgcccctgctcctcatacttgtggtctactgcagcatgttccgagtggcccgcgtggctgccatgcagcacgggccgctgcccacgtggatggagacaccccggcaacgctccgaatctctcagcagccgctccacgatggtcaccagctcgggggccccccagaccaccccacaccggacgtttgggggagggaaagcagcagtggttctcctggctgtggggggacagttcctgctctgttggttgccctacttctctttccacctctatgttgccctgagtgctcagcccatttcaactgggcaggtggagagtgtggtcacctggattggctacttttgcttcacttccaaccctttcttctatggatgtctcaaccggcagatccggggggagctcagcaagcagtttgtctgcttcttcaagccagctccagaggaggagctgaggctgcctagccgggagggctccattgaggagaacttcctgcagttccttcaggggactggctgtccttctgagtcctgggtttcccgacccctacccagccccaagcaggagccacctgctgttgactttcgaatcccaggccagatagctgaggagacctctgagttcctggagcagcaactcaccagcgacatcatcatgtcagacagctacctccgtcctgccgcctcaccccggctggagtcatgatgggccgctggacactcggagggatatggggctggggccagttatgattgcaaggaccaccttgtgggatcaccttttcccagctggctagggctgaggctggggtctctgcacacagcttttgcttagtgtttcctgggtcaggaacagagccaacaggatgaacgtgtgcaaaagccttggacttggctgtgatctttgactgctaggggagggaacctgggtatggtgagacggtgacgagagaaaagggtcacaaaggactggcctccctgatctctctcctcatggcagcgacccacctccagtcccctggacaatcgggtacaagagacttaaggttgggcatgggaagggtggggtttccatgatccattaaatgccttcctactcccattcatcgctctcaaaattagcttcagtgacaaagacttaaatctctctcctatctgcagcactgggttggagagagggcacgggagttggtcttggctgttcattgattgagactgtaggaactgtgttggttggtattggtggtggtattttcaacaaacagggaataactgcaaactggacaggacacccatctgggaccacctgtccatcctacttccctcaattgaatcaggtaacactaacggatcaaggcagggccagagggtggtgtggtctctatttgaacaaattcctggctcactgagcatcaaaaggggaaatgggctggtgggagtgggatagtctcccatttaagcagctaataaataatttttatgataaaaggttatactgata

SEQ ID NO: 11628 - DNA, 2557 bp, Homo sapiens
ctatcacatgggagccgggactgctcagcaaagatggatttatgaggaaactgaaattcagaagattcacagagttagtaatgcccagaactgggactagaaactaaattttgtgctccttctactccccagcagctcttgccattctgaggagacaagaaatcaggaaatttacataaggaaccctaaaactgaggcactatcccagagatcagcaggaccctgggaaggagaaacaggatttagaatccccggctaacagttctggaaagggtagaagggtatggagaacaagaatggcagaaaggagatggaaaaggaagaggtgaaggccattccgaaagcggagtgttgagtgggtcaggctcctgcacctctcacgtctcctgcttcttagcagtcaccaaggcagaccctgcagctacctccggccagaaaggggatgagcttctgatccttcagctgcctggcctggcgctctgtacgcagacaaacctgcccaagaggctccagtgggaggtgccccctacgaaaccaggaagcctgggcctgggctcgccatcccagggtcgctggactaggatgggggatgggcctgtgacaggaggtaccctgggtgccctctttcggccccatggagtcctcacccatcccccagtcatcagggaactcttccactttggggagggtccctcaaaccccaggtccctctactgccagtggggtcccggaggtggggctacgggatgttgcttcggaatctgtggccctcttcttcatgctcctgctggacttgactgctgtggctggcaatgccgctgtgatggccgtgatcgccaagacgcctgccctccgaaaatttgtcttcgtcttccacctctgcctggtggacctgctggctgccctgaccctcatgcccctggccatgctctccagctctgccctctttgaccacgccctctttggggaggtggcctgccgcctctacttgtttctgagcgtgtgctttgtcagcctggccatcctctcggtgtcagccatcaatgtggagcgctactattacgtagtccaccccatgcgctacgaggtgcgcatgacgctggggctggtggcctctgtgctggtgggtgtgtgggtgaaggccttggccatggcttctgtgccagtgttgggaagggtctcctgggaggaaggagctcccagtgtccccccaggctgttcactccagtggagccacagtgcctactgccagctttttgtggtggtctttgctgtcctttactttctgttgcccctgctcctcatacttgtggtctactgcagcatgttccgagtggcccgcgtggctgccatgcagcacgggccgctgcccacgtggatggagacaccccggcaacgctccgaatctctcagcagccgctccacgatggtcaccagctcgggggccccccagaccaccccacaccggacgtttgggggagggaaagcagcagtggttctcctggctgtggggggacagttcctgctctgttggttgccctacttctctttccacctctatgttgccctgagtgctcagcccatttcaactgggcaggtggagagtgtggtcacctggattggctacttttgcttcacttccaaccctttcttctatggatgtctcaaccggcagatccggggggagctcagcaagcagtttgtctgcttcttcaagccagctccagaggaggagctgaggctgcctagccgggagggctccattgaggagaacttcctgcagttccttcaggggactggctgtccttctgagtcctgggtttcccgacccctacccagccccaagcaggagccacctgctgttgactttcgaatcccaggccagatagctgaggagacctctgagttcctggagcagcaactcaccagcgacatcatcatgtcagacagctacctccgtcctgccgcctcaccccggctggagtcatgatgggccgctggacactcggagggatatggggctggggccagttatgattgcaaggaccaccttgtgggatcaccttttcccagctggctagggctgaggctggggtctctgcacacagcttttgcttagtgtttcctgggtcaggaacagagccaacaggatgaacgtgtgcaaaagccttggacttggctgtgatctttgactgctaggggagggaacctgggtatggtgagacggtgacgagagaaaagggtcacaaaggactggcctccctgatctctctcctcatggcagcgacccacctccagtcccctggacaatcgggtacaagagacttaaggagtggatcatgaaggaaataaaaatttctcttttattatgctgagaactttcccaacaatttctgctatgaccaccttccaggagttttctagtcaccagatgccttggtaaagttcaatacgtaatctttggctctgaaagctgttcctggacaaaatctgagctaactcactgaagaatcaacagattgaggcaaccatccggtagccgaaaggtaaatgaggc

SEQ ID NO: 11629 - DNA, 4921 bp, Homo sapiens
gcagtgcttcaggcttcagcagccttggagaagcatcagctgagaggagctatcacatgggagccgggactgctcagcaaagatggatttatgaggaaactgaaattcagaagattcacagagttagtaatgcccagaactgggactagaaactaaattttgtgctccttctactccccagcagctcttgccattctgaggagacaagaaatcaggaaatttacataaggaaccctaaaactgaggcactatcccagagatcagcaggaccctgggaaggagaaacaggatttagaatccccggctaacagttctggaaagggtagaagggtatggagaacaagaatggcagaaaggagatggaaaaggaagaggtgaaggccattccgaaagcggagtgttgagtgggtcaggctcctgcacctctcacgtctcctgcttcttagcagtcaccaaggcagaccctgcagctacctccggccagaaaggggatgagcttctgatccttcagctgcctggcctggcgctctgtacgcagacaaacctgcccaagaggctccagtgggaggtgccccctacgaaaccaggaagcctgggcctgggctcgccatcccagggtcgctggactaggatgggggatgggcctgtgacaggaggtaccctgggtgccctctttcggccccatggagtcctcacccatcccccagtcatcagggaactcttccactttggggagggtccctcaaaccccaggtccctctactgccagtggggtcccggaggtggggctacgggatgttgcttcggaatctgtggccctcttcttcatgctcctgctggacttgactgctgtggctggcaatgccgctgtgatggccgtgatcgccaagacgcctgccctccgaaaatttgtcttcgtcttccacctctgcctggtggacctgctggctgccctgaccctcatgcccctggccatgctctccagctctgccctctttgaccacgccctctttggggaggtggcctgccgcctctacttgtttctgagcgtgtgctttgtcagcctggccatcctctcggtgtcagccatcaatgtggagcgctactattacgtagtccaccccatgcgctacgaggtgcgcatgacgctggggctggtggcctctgtgctggtgggtgtgtgggtgaaggccttggccatggcttctgtgccagtgttgggaagggtctcctgggaggaaggagctcccagtgtccccccaggctgttcactccagtggagccacagtgcctactgccagctttttgtggtggtctttgctgtcctttactttctgttgcccctgctcctcatacttgtggtctactgcagcatgttccgagtggcccgcgtggctgccatgcagcacgggccgctgcccacgtggatggagacaccccggcaacgctccgaatctctcagcagccgctccacgatggtcaccagctcgggggccccccagaccaccccacaccggacgtttgggggagggaaagcagcagtggttctcctggctgtggggggacagttcctgctctgttggttgccctacttctctttccacctctatgttgccctgagtgctcagcccatttcaactgggcaggtggagagtgtggtcacctggattggctacttttgcttcacttccaaccctttcttctatggatgtctcaaccggcagatccggggggagctcagcaagcagtttgtctgcttcttcaagccagctccagaggaggagctgaggctgcctagccgggagggctccattgaggagaacttcctgcagttccttcaggggactggctgtccttctgagtcctgggtttcccgacccctacccagccccaagcaggagccacctgctgttgactttcgaatcccaggccagatagctgaggagacctctgagttcctggagcagcaactcaccagcgacatcatcatgtcagacagctacctccgtcctgccgcctcaccccggctggagtcatgatgggccgctggacactcggagggatatggggctggggccagttatgattgcaaggaccaccttgtgggatcaccttttcccagctggctagggctgaggctggggtctctgcacacagcttttgcttagtgtttcctgggtcaggaacagagccaacaggatgaacgtgtgcaaaagccttggacttggctgtgatctttgactgctaggggagggaacctgggtatggtgagacggtgacgagagaaaagggtcacaaaggtgaggtgaaacctctcaattggtgaaatttccatgcttccagaagcagggaattctctaagggtaggagttggaggatacagggcagcaggccaggtttggagttattctaggggccatttaggatattttatttttcagtgtaattgtccagggcagtaattgcacccaagcaaggtaagaaaatgacccatgttttctcatttccttgctaggtttaaaaagaactaaattatagccaagtgtttccacttgagttaatagatcatttttctggttttatacctgagatttccttaaaatgagaggaccagtagggtgtattcctttactgagtttggccagaaacaaggcaaaatagaaattagggtacatggagtagaagataggaaagctgactgcagctctctctctcccacccttcaggaaaagcccttctgttctatttttctgtctctctcctgcacacaggagatcaagggtagagcctgatcttagcagagacaagaataaggcaggatggctttcctctcttttaggaggaagaattagaatgactgggggtcagacgggcgagggtggaggttagcatttgaattggtaaagtagctggaaacagagaggccaggtaatcagcctgatcaataatactgcgaatcttttctttccaggactggcctccctgatctctctcctcatggcagcgacccacctccagtcccctggacaatcgggtacaagagacttaaggttgggcatgggaagggtggggtttccatgatccattaaatgccttcctactcccattcatcgctctcaaaattagcttcagtgacaaagacttaaatctctctcctatctgcagcactgggttggagagagggcacgggagttggtcttggctgttcattgattgagactgtaggaactgtgttggttggtattggtggtggtattttcaacaaacagggaataactgcaaactggacaggacacccatctgggaccacctgtccatcctacttccctcaattgaatcaggtaacactaacggatcaaggcagggccagagggtggtgtggtctctatttgaacaaattcctggctcactgagcatcaaaaggggaaatgggctggtgggagtgggatagtctcccatttaagcagctaataaataatttttatgataaaaggttatactgataacaacattgactcctttagttcaattcagtgcataatagttgaacacccactagtccctgggacccacacagggcgtgtggtcattgcttttaaggagttcatagtctaagttgatgagataccttatattttcacaaagcactttgatttgataaagcactacagaatgtgcttgagaaatatattggagaatatgtccatggctctaacttctgagagttcagcccgtggcagcaagatgcataccttgaagcttcctgcagattgtggaaagcataggggttgtaaatgaaactctctaatgaagaaaaaaaattaaatgaaactgggcaaacagctttccccctttgttctaggaaaatttctaggttgtcttcctaccactagattattataccagtctagtgcctattacattgtggaagttccctaaaaacatagtatatatagggaggagagtcctttgtgattgaaaaacatgttcacctctcctccctattaaaataaatgcatacagaggaatcaatcattcctagacagggaaaaaactcttctttcaaacaccactgatcagctattagatccaaggaattgccagcaggtggcagtgtgagcccaatggaaggaggaaaggcgagtgtacgtggtgggaggaggaaggggagggcattaaacattgcctggcagccattttgttaatttattttgccttttcctttgactttgccctccagcccttccttcacatacatcaaagaagaaagttttaagagcaagggtatctttaattcaggctgaaatttcctgacactgtgatctcactggtgtttattacagagtttgacatacatgggttcatttgccatttatttttccctgtaggagtggatcatgaaggaaataaaaatttctcttttattatgctgagaactttcccaacaatttctgctatgaccaccttccaggagttttctagtcaccagatgccttggtaaagttcaatacgtaatctttggctctgaaagctgttcctggacaaaatctgagctaactcactgaagaatcaacagattgaggcaaccatccggtcagttactttttcctgcatcctgctggtgttggggtaactcccaatcctagatgaaaaccttagactttctgttgtcaggtgtccccaggcaatatcctacgggggcatgatagaaaagggtaactctggggtcagatagatgtacttactcactgtgtgaagttgggaaagctgcttaatttctctgagcctacttcctcacctgtaaaaatggggatcattattacctacctcacagggttgttgtgaggattaagagatgggatgtgggagcacctagccgtatctggcaaataggtactcaataaatactggttttacttcc

SEQ ID NO: 11630 - DNA, 2180 bp, Homo sapiens
cagggggctggcgccaggccctgcccctcccttgccagccgtgtgtggcaacatcagagtgacagccagtaccatctccgacaggggctgagttgctggagctgggctggggcaggggagaaagacagcagactcatccttgcacccctccatgggcctggccaagcccccaagaggatggcagcctgggcgtcggagccacctcctgggcagccaatgaggtgaggggccggaggagcaagggacaagaggagcagaggacaggtgatggaaatcctgcagctttaggctccattctgccatctacatcccagcgcagggtgaagcctgagagcccaaatggccaactccacagggctgaacgcctcagaagtcgcaggctcgttggggttgatcctggcagctgtcgtggaggtgggggcactgctgggcaacggcgcgctgctggtcgtggtgctgcgcacgccgggactgcgcgacgcgctctacctggcgcacctgtgcgtcgtggacctgctggcggccgcctccatcatgccgctgggcctgctggccgcaccgccgcccgggctgggccgcgtgcgcctgggccccgcgccatgccgcgccgctcgcttcctctccgccgctctgctgccggcctgcacgctcggggtggccgcacttggcctggcacgctaccgcctcatcgtgcacccgctgcggccaggctcgcggccgccgcctgtgctcgtgctcaccgccgtgtgggccgcggcgggactgctgggcgcgctctccctgctcggcacgccgcccgcaccgccccctgctcctgctcgctgctcggtcctggctgggggcctcgggcccttccggccgctctgggccctgctggccttcgcgctgcccgccctcctgctgctcggcgcctacggcggcatcttcgtggtggcgcgtcgcgctgccctgaggcccccacggccggcgcgcgggtcccgactccactcggactctctggatagccgcctttccatcttgccgccgctccggcctcgcctgcccgggggcaaggcggccctggccccagcgctggccgtgggccaatttgcagcctgctggctgccttatggctgcgcgtgcctggcgcccgcagcgcgggccgcggaagccgaagcggctgtcacctgggtcgcctactcggccttcgcggctcaccccttcctgtacgggctgctgcagcgccccgtgcgcttggcactgggccgcctctctcgccgtgcactgcctggacctgtgcgggcctgcactccgcaagcctggcacccgcgggcactcttgcaatgcctccagagacccccagagggccctgccgtaggcccttctgaggctccagaacagacccccgagttggcaggagggcggagccccgcataccaggggccacctgagagttctctctcctgagcaggagaaaggagggtggtttccgtgggggctcatccaacccctgcacaggtcacagcaggtgccctgctggatatctgggtctggaacaggaggagaaagggtgtctgctgcctggtgaggcccacggacttctgagagccaggaatcctgcggtctgggcccaacactgcatagcactgtgcataggccgacccttccttaggcctcagctttcccatctgcaccctgcagcatctctaagggcccctccagcataggtggtttgtgaaactcacaggtggtccccaggccaagatgggcaggtgtcacaaagaagagggccctaagggctcacaaccaaagtgatccgccaagcagggcagtatctgggttacagccacagcaggaagaaccactggagagacactcagaaggacttccctgacatctgcaccaaggagagtctggacaaagctactgaaactcctccacctgcttctaaaatgcccagaagacaactggaccagtttggtattagaagtaggaggctggacgacttcacccccaaagggtcctgaagccccagaactggcatgtggaaggggctgaggcctaattgaggttggtggattcacacatgggggtcctccaggacctcagctgcacccattttctggaggttttgctgcccacaacaccagtatttcacaacttcctggtcgctgagaatatttattcaaaaacagggattg

SEQ ID NO: 11631 - DNA, 2080 bp, Homo sapiens
actttcagctccagctcccgccaccgccgcctgtatcgccgccgccgccaccacctcctcttcgttgtcctccttcctcctccgcctggcagcgttgttctctgcagcggaggagagaagtgctatgtcaggaaagttccgggagggactacatggagccatgctccctgggctcttccgcgggcgcccgcgcgctgcccttcgcttgaggcaaaaggactcttgtggaagatggaactcattgtccattttccagaatgtatttccaagcccatcaatgggacctgatactgctgttctgtgttgaaatgcttgaagaactcctgcatctctgcttgcatcttccatcctactgaaaccatggtcttctcggcagtgttgactgcgttccataccgggacatccaacacaacatttgtcgtgtatgaaaacacctacatgaatattacactccctccaccattccagcatcctgacctcagtccattgcttagatatagttttgaaaccatggctcccactggtttgagttccttgaccgtgaatagtacagctgtgcccacaacaccagcagcatttaagagcctaaacttgcctcttcagatcaccctttctgctataatgatattcattctgtttgtgtcttttcttgggaacttggttgtttgcctcatggtttaccaaaaagctgccatgaggtctgcaattaacatcctccttgccagcctagcttttgcagacatgttgcttgcagtgctgaacatgccctttgccctggtaactattcttactacccgatggatttttgggaaattcttctgtagggtatctgctatgtttttctggttatttgtgatagaaggagtagccatcctgctcatcattagcatagataggttccttattatagtccagaggcaggataagctaaacccatatagagctaaggttctgattgcagtttcttgggcaacttccttttgtgtagcttttcctttagccgtaggaaaccccgacctgcagataccttcccgagctccccagtgtgtgtttgggtacacaaccaatccaggctaccaggcttatgtgattttgatttctctcatttctttcttcatacccttcctggtaatactgtactcatttatgggcatactcaacacccttcggcacaatgccttgaggatccatagctaccctgaaggtatatgcctcagccaggccagcaaactgggtctcatgagtctgcagagacctttccagatgagcattgacatgggctttaaaacacgtgccttcaccactattttgattctctttgctgtcttcattgtctgctgggccccattcaccacttacagccttgtggcaacattcagtaagcacttttactatcagcacaacttttttgagattagcacctggctactgtggctctgctacctcaagtctgcattgaatccgctgatctactactggaggattaagaaattccatgatgcttgcctggacatgatgcctaagtccttcaagtttttgccgcagctccctggtcacacaaagcgacggatacgtcctagtgctgtctatgtgtgtggggaacatcggacggtggtgtgaatattggaactggctgacattttgggtgatgcttgttctttattgacattgaattctctttctcatagcctctccactttatttttttttatagggtttgtgtatgtatgtgtgtgagcagtgtaaagaaagaatggtaattatagttctgttaccaagaataaataataggaaagtgattacaaatattacctccagggttcaatagaaatcctcaatttagggtgaggagacttttttttggttttggggtttttccttgattgattttgttttcatagtgggaatcaggattgtgctttattgagcctgcagttacattgaattgtaggtgtttcgtgtgctgctaaggtatgcttatttgagtttatcaagactttttttttctggaagacactgctgcttttaccatcacattggagccaaacatctcaatcaatatatatttagttttatttta

SEQ ID NO: 11632 - DNA, 1801 bp, Homo sapiens
ttcaggcaaaaggactcttgtggaagatggaactcattgtccattttccagaatgtatttccaagcccatcaatgggacctgatactgctgttctgtgttgaaatgcttgaagaactcctgcatctctgcttgcatcttccatcctactgaaaccatggtcttctcggcagtgttgactgcgttccataccgggacatccaacacaacatttgtcgtgtatgaaaacacctacatgaatattacactccctccaccattccagcatcctgacctcagtccattgcttagatatagttttgaaaccatggctcccactggtttgagttccttgaccgtgaatagtacagctgtgcccacaacaccagcagcatttaagagcctaaacttgcctcttcagatcaccctttctgctataatgatattcattctgtttgtgtcttttcttgggaacttggttgtttgcctcatggtttaccaaaaagctgccatgaggtctgcaattaacatcctccttgccagcctagcttttgcagacatgttgcttgcagtgctgaacatgccctttgccctggtaactattcttactacccgatggatttttgggaaattcttctgtagggtatctgctatgtttttctggttatttgtgatagaaggagtagccatcctgctcatcattagcatagataggttccttattatagtccagaggcaggataagctaaacccatatagagctaaggttctgattgcagtttcttgggcaacttccttttgtgtagcttttcctttagccgtaggaaaccccgacctgcagataccttcccgagctccccagtgtgtgtttgggtacacaaccaatccaggctaccaggcttatgtgattttgatttctctcatttctttcttcatacccttcctggtaatactgtactcatttatgggcatactcaacacccttcggcacaatgccttgaggatccatagctaccctgaaggtatatgcctcagccaggccagcaaactgggtctcatgagtctgcagagacctttccagatgagcattgacatgggctttaaaacacgtgccttcaccactattttgattctctttgctgtcttcattgtctgctgggccccattcaccacttacagccttgtggcaacattcagtaagcacttttactatcagcacaacttttttgagattagcacctggctactgtggctctgctacctcaagtctgcattgaatccgctgatctactactggaggattaagaaattccatgatgcttgcctggacatgatgcctaagtccttcaagtttttgccgcagctccctggtcacacaaagcgacggatacgtcctagtgctgtctatgtgtgtggggaacatcggacggtggtgtgaatattggaactggctgacattttgggtgatgcttgttctttattgacattgaattctctttctcatagcctctccactttatttttttttatagggtttgtgtatgtatgtgtgtgagcagtgtaaagaaagaatggtaattatagttctgttaccaagaataaataataggaaagtgattacaaatattacctccagggttcaatagaaatcctcaatttagggtgaggagacttttttttggttttggggtttttccttgattgattttgttttcatagtgggaatcaggattgtgctttattgagcctgcagttacattgaattgtaggtgtttcgtgtgctgctaaggtatgcttatttgagtttatcaagacttttttttt

SEQ ID NO: 11633 - DNA, 2198 bp, Homo sapiens
actttcagctccagctcccgccaccgccgcctgtatcgccgccgccgccaccacctcctcttcgttgtcctccttcctcctccgcctggcagcgttgttctctgcagcggaggagagaagtgctatgtcaggaaagttccgggagggactacatggagccatgctccctgggctcttccgcgggcgcccgcgcgctgcccttcgcttgagagtctcaccgtgttgcccaggctggaatgcagtggcgcgatctcggctcacagcaacctccgcctcccgggttcaagcgattctcatgcttcagcctcctgagtacctgggattactggcaaaaggactcttgtggaagatggaactcattgtccattttccagaatgtatttccaagcccatcaatgggacctgatactgctgttctgtgttgaaatgcttgaagaactcctgcatctctgcttgcatcttccatcctactgaaaccatggtcttctcggcagtgttgactgcgttccataccgggacatccaacacaacatttgtcgtgtatgaaaacacctacatgaatattacactccctccaccattccagcatcctgacctcagtccattgcttagatatagttttgaaaccatggctcccactggtttgagttccttgaccgtgaatagtacagctgtgcccacaacaccagcagcatttaagagcctaaacttgcctcttcagatcaccctttctgctataatgatattcattctgtttgtgtcttttcttgggaacttggttgtttgcctcatggtttaccaaaaagctgccatgaggtctgcaattaacatcctccttgccagcctagcttttgcagacatgttgcttgcagtgctgaacatgccctttgccctggtaactattcttactacccgatggatttttgggaaattcttctgtagggtatctgctatgtttttctggttatttgtgatagaaggagtagccatcctgctcatcattagcatagataggttccttattatagtccagaggcaggataagctaaacccatatagagctaaggttctgattgcagtttcttgggcaacttccttttgtgtagcttttcctttagccgtaggaaaccccgacctgcagataccttcccgagctccccagtgtgtgtttgggtacacaaccaatccaggctaccaggcttatgtgattttgatttctctcatttctttcttcatacccttcctggtaatactgtactcatttatgggcatactcaacacccttcggcacaatgccttgaggatccatagctaccctgaaggtatatgcctcagccaggccagcaaactgggtctcatgagtctgcagagacctttccagatgagcattgacatgggctttaaaacacgtgccttcaccactattttgattctctttgctgtcttcattgtctgctgggccccattcaccacttacagccttgtggcaacattcagtaagcacttttactatcagcacaacttttttgagattagcacctggctactgtggctctgctacctcaagtctgcattgaatccgctgatctactactggaggattaagaaattccatgatgcttgcctggacatgatgcctaagtccttcaagtttttgccgcagctccctggtcacacaaagcgacggatacgtcctagtgctgtctatgtgtgtggggaacatcggacggtggtgtgaatattggaactggctgacattttgggtgatgcttgttctttattgacattgaattctctttctcatagcctctccactttatttttttttatagggtttgtgtatgtatgtgtgtgagcagtgtaaagaaagaatggtaattatagttctgttaccaagaataaataataggaaagtgattacaaatattacctccagggttcaatagaaatcctcaatttagggtgaggagacttttttttggttttggggtttttccttgattgattttgttttcatagtgggaatcaggattgtgctttattgagcctgcagttacattgaattgtaggtgtttcgtgtgctgctaaggtatgcttatttgagtttatcaagactttttttttctggaagacactgctgcttttaccatcacattggagccaaacatctcaatcaatatatatttagttttatttta

SEQ ID NO: 11634 - DNA, 2080 bp, Homo sapiens; identical to SEQ ID NO: 11631

SEQ ID NO: 11635 - DNA, 3594 bp, Homo sapiens
tgcacagaggttctccactttgttttctgaactcgcggtcaggatggttttctctgtcaggcagtgtggccatgttggcagaactgaagaagttttactgacgttcaagatattccttgtcatcatttgtcttcatgtcgttctggtaacatccctggaagaagatactgataattccagtttgtcaccaccacctgaggttgaaacaacaagcctcaatgatgttactttaagcttactcccttcaaacgaaacaggcgtcaaaccccagagaaatatctgcaatttgtcatctatttgcaatgactcagcattttttagaggtgagatcatgtttcaatatgataaagaaagcactgttccccagaatcaacatataacgaatggcaccttaactggagtcctgtctctaagtgaattaaaacgctcagagctcaacaaaaccctgcaaaccctaagtgagacttactttataatgtgtgctacagcagaggcccaaagcacattaaattgtacattcacaataaaactgaataatacaatgaatgcatgtgctgtaatagctgctttggaaagagtaaagattcgaccaatggaacactgctgctgttctgtcaggataccctgcccttcctccccagaagagttggaaaagcttcagtgtgacctgcaggatcccattgtctgtcttgctgaccatccacgtggcccaccattttcttccagccaatccatcccagtggtgcctcgggccactgtgctttcccaggtccccaaagctacctcttttgctgagcctccagattattcacctgtgacccacaatgttccctctccaataggggagattcaacccctttcaccccagccttcagctcccatagcttccagccctgccattgacatgcccccacagtctgaaacgatctcttcccctatgccccaaacccatgtctccggcaccccacctcctgtgaaagcctcattttcctctcccaccgtgtctgcccctgcgaatgtcaacactaccagcgcacctcctgtccagacagacatcgtcaacaccagcagtatttctgatcttgagaaccaagtgttgcagatggagaaggctctgtccttgggcagcctggagcctaacctcgcaggagaaatgatcaaccaagtcagcagactccttcattccccgcctgacatgctggcccctctggctcaaagattgctgaaagtagtggatgacattggcctacagctgaacttttcaaacacgactataagtctaacctccccttctttggctctggctgtgatcagagtgaatgccagtagtttcaacacaactacctttgtggcccaagaccctgcaaatcttcaggatgagttaacagtgagatgtgtattttgggacttgggcagaaatggtggcagaggaggctggtcagacaatggctgctctgtcaaagacaggagattgaatgaaaccatctgtacctgtagccatctaacaagcttcggcgttctgctggacctatctaggacatctgtgctgcctgctcaaatgatggctctgacgttcattacatatattggttgtgggctttcatcaatttttctgtcagtgactcttgtaacctacatagcttttgaaaagatccggagggattacccttccaaaatcctcatccagctgtgtgctgctctgcttctgctgaacctggtcttcctcctggactcgtggattgctctgtataagatgcaaggcctctgcatctcagtggctgtatttcttcattattttctcttggtctcattcacatggatgggcctagaagcattccatatgtacctggcccttgtcaaagtatttaatacttacatccgaaaatacatccttaaattctgcattgtcggttggggggtaccagctgtggttgtgaccatcatcctgactatatccccagataactatgggcttggatcctatgggaaattccccaatggttcaccggatgacttctgctggatcaacaacaatgcagtattctacattacggtggtgggatatttctgtgtgatatttttgctgaacgtcagcatgttcattgtggtcctggttcagctctgtcgaattaaaaagaagaagcaactgggagcccagcgaaaaaccagtattcaagacctcaggagtatcgctggccttacatttttactgggaataacttggggctttgccttctttgcctggggaccagttaacgtgaccttcatgtatctgtttgccatctttaataccttacaaggatttttcatattcatcttttactgtgtggccaaagaaaatgtcaggaagcaatggaggcggtatctttgttgtggaaagttacggctggctgaaaattctgactggagtaaaactgctactaatggtttaaagaagcagactgtaaaccaaggagtgtccagctcttcaaattccttacagtcaagcagtaactccactaactccaccacactgctagtgaataatgattgctcagtacacgcaagcgggaatggaaatgcttctacagagaggaatggggtctcttttagtgttcagaatggagatgtgtgccttcacgatttcactggaaaacagcacatgtttaacgagaaggaagattcctgcaatgggaaaggccgtatggctctcagaaggacttcaaagcggggaagcttacactttattgagcaaatgtgattcctttcttctaaaatcaaagcatgatgcttgacagtgtgaaatgtccaattttaccttttacacaatgtgagatgtatgaaaatcaactcattttattctcggcaacatctggagaagcataagctaattaagggcgatgattattattacaagaagaaaccaagacattacaccatggtttttagacatttctgatttggtttcttatctttcattttataagaaggttggttttaaacaatacactaagaatgactcctataaagaaaacaaaaaaaggtagtgaactttcagctaccttttaaagaggctaagttatctttgataacatcatataaagcaactgttgacttcagcctgttggtgagtttagttgtgcatgcctttgttgtatataagctaaattctagtgacccatgtgtcaaaaatcttacttctacatttttttgtatttattttctactgtgtaaatgtattcctttgtagaatcatggttgttttgtctcacgtgataattcagaaaatccttgctcgttccgcaaatcctaaagctccttttggagatgatataggatgtgaaatacagaaacctcagtgaaatcaagaaataatgatcccagccagactgagaaaatgtaagcagacagtgccacagttagctcatacagtgcctttgagcaagttaggaaaagatgcccccactgggcagacacagccctatgggctcatggtttgacaaacagagtggagagaccatattttagccccactcaccctcttgggtgcacgacctgtacagccaaacacagcatccaatatgaatacccatcccctgaccgcatccccagtag

SEQ ID NO: 11636 - DNA, 4803 bp, Homo sapiens
gcgcccagcctcgccgccgccgagcgcccgacgcgccacgccgcgctgggcagctggagagctggcggcggagcgggccgggagcggcgggggcggcgccgaggccgcgggcggggggaggagggccgcagccccggagaggggaaaaggcgggccggacggcgccagcagccagccccgaggacgcgagcggcaggtgtgcacagaggttctccactttgttttctgaactcgcggtcaggatggttttctctgtcaggcagtgtggccatgttggcagaactgaagaagttttactgacgttcaagatattccttgtcatcatttgtcttcatgtcgttctggtaacatccctggaagaagatactgataattccagtttgtcaccaccacctgatgaggaaactggggcttgttcagatgttactttaagcttactcccttcaaacgaaacagaaaaaactaaaatcactatagtaaaaaccttcaatgcatcaggcgtcaaaccccagagaaatatctgcaatttgtcatctatttgcaatgactcagcattttttagaggtgagatcatgtttcaatatgataaagaaagcactgttccccagaatcaacatataacgaatggcaccttaactggagtcctgtctctaagtgaattaaaacgctcagagctcaacaaaaccctgcaaaccctaagtgagacttactttataatgtgtgctacagcagaggcccaaagcacattaaattgtacattcacaataaaactgaataatacaatgaatgcatgtgctgtaatagctgctttggaaagagtaaagattcgaccaatggaacactgctgctgttctgtcaggataccctgcccttcctccccagaagagttggaaaagcttcagtgtgacctgcaggatcccattgtctgtcttgctgaccatccacgtggcccaccattttcttccagccaatccatcccagtggtgcctcgggccactgtgctttcccaggtccccaaagctacctcttttgctgagcctccagattattcacctgtgacccacaatgttccctctccaataggggagattcaacccctttcaccccagccttcagctcccatagcttccagccctgccattgacatgcccccacagtctgaaacgatctcttcccctatgccccaaacccatgtctccggcaccccacctcctgtgaaagcctcattttcctctcccaccgtgtctgcccctgcgaatgtcaacactaccagcgcacctcctgtccagacagacatcgtcaacaccagcagtatttctgatcttgagaaccaagtgttgcagatggagaaggctctgtccttgggcagcctggagcctaacctcgcaggagaaatgatcaaccaagtcagcagactccttcattccccgcctgacatgctggcccctctggctcaaagattgctgaaagtagtggatgacattggcctacagctgaacttttcaaacacgactataagtctaacctccccttctttggctctggctgtgatcagagtgaatgccagtagtttcaacacaactacctttgtggcccaagaccctgcaaatcttcaggtttctctggaaacccaagctcctgagaacagtattggcacaattactcttccttcatcgctgatgaataatttaccagctcatgacatggagctagcttccagggttcagttcaatttttttgaaacacctgctttgtttcaggatccttccctggagaacctctctctgatcagctacgtcatatcatcgagtgttgcaaacctgaccgtcaggaacttgacaagaaacgtgacagtcacattaaagcacatcaacccgagccaggatgagttaacagtgagatgtgtattttgggacttgggcagaaatggtggcagaggaggctggtcagacaatggctgctctgtcaaagacaggagattgaatgaaaccatctgtacctgtagccatctaacaagcttcggcgttctgctggacctatctaggacatctgtgctgcctgctcaaatgatggctctgacgttcattacatatattggttgtgggctttcatcaatttttctgtcagtgactcttgtaacctacatagcttttgaaaagatccggagggattacccttccaaaatcctcatccagctgtgtgctgctctgcttctgctgaacctggtcttcctcctggactcgtggattgctctgtataagatgcaaggcctctgcatctcagtggctgtatttcttcattattttctcttggtctcattcacatggatgggcctagaagcattccatatgtacctggcccttgtcaaagtatttaatacttacatccgaaaatacatccttaaattctgcattgtcggttggggggtaccagctgtggttgtgaccatcatcctgactatatccccagataactatgggcttggatcctatgggaaattccccaatggttcaccggatgacttctgctggatcaacaacaatgcagtattctacattacggtggtgggatatttctgtgtgatatttttgctgaacgtcagcatgttcattgtggtcctggttcagctctgtcgaattaaaaagaagaagcaactgggagcccagcgaaaaaccagtattcaagacctcaggagtatcgctggccttacatttttactgggaataacttggggctttgccttctttgcctggggaccagttaacgtgaccttcatgtatctgtttgccatctttaataccttacaaggatttttcatattcatcttttactgtgtggccaaagaaaatgtcaggaagcaatggaggcggtatctttgttgtggaaagttacggctggctgaaaattctgactggagtaaaactgctactaatggtttaaagaagcagactgtaaaccaaggagtgtccagctcttcaaattccttacagtcaagcagtaactccactaactccaccacactgctagtgaataatgattgctcagtacacgcaagcgggaatggaaatgcttctacagagaggaatggggtctcttttagtgttcagaatggagatgtgtgccttcacgatttcactggaaaacagcacatgtttaacgagaaggaagattcctgcaatgggaaaggccgtatggctctcagaaggacttcaaagcggggaagcttacactttattgagcaaatgtgattcctttcttctaaaatcaaagcatgatgcttgacagtgtgaaatgtccaattttaccttttacacaatgtgagatgtatgaaaatcaactcattttattctcggcaacatctggagaagcataagctaattaagggcgatgattattattacaagaagaaaccaagacattacaccatggtttttagacatttctgatttggtttcttatctttcattttataagaaggttggttttaaacaatacactaagaatgactcctataaagaaaacaaaaaaaggtagtgaactttcagctaccttttaaagaggctaagttatctttgataacatcatataaagcaactgttgacttcagcctgttggtgagtttagttgtgcatgcctttgttgtatataagctaaattctagtgacccatgtgtcaaaaatcttacttctacatttttttgtatttattttctactgtgtaaatgtattcctttgtagaatcatggttgttttgtctcacgtgataattcagaaaatccttgctcgttccgcaaatcctaaagctccttttggagatgatataggatgtgaaatacagaaacctcagtgaaatcaagaaataatgatcccagccagactgagaaaatgtaagcagacagtgccacagttagctcatacagtgcctttgagcaagttaggaaaagatgcccccactgggcagacacagccctatgggctcatggtttgacaaacagagtggagagaccatattttagccccactcaccctcttgggtgcacgacctgtacagccaaacacagcatccaatatgaatacccatcccctgaccgcatccccagtagtcagattatagaatctgcaccaagatgtttagctttataccttggccacagagagggatgaactgtcatccagaccatgtgtcaggaaaattgtgaacgtagatgaggtacatacactgccgcttctcaaatccccagagcctttaggaacaggagagtagactaggattccttctcttaaaaaggtacatatatatggaaaaaaatcatattgccgttctttaaaaggcaactgcatggtacattgttgattgttatgactggtacactctggcccagccagagctataattgttttttaaatgtgtcttgaagaatgcacagtgacaaggggagtagctattgggaacagggaactgtcctacactgctattgttgctacatgtatcgagccttgattgctcctagttatatacagggtctatcttgcttcctacctacatctgcttgagcagtgcctcaagtacatccttattaggaacatttcaaaccccttttagttaagtctttcactaaggttctcttgcatatatttcaagtgaatgttggatctcagactaaccatagtaataatacacatttctgtgagtgctgacttgtctttgcaatatttcttttctgatttatttaattttcttgtatttatatgttaaaatcaaaaatgttaaaatcaatgaaataaatttgcagttaagatcttt

SEQ ID NO: 11637 - DNA, 4630 bp, Homo sapiens
agccccgaggacgcgagcggcaggtgtgcacagaggttctccactttgttttctgaactcgcggtcaggatggttttctctgtcaggcagtgtggccatgttggcagaactgaagaagttttactgacgttcaagatattccttgtcatcatttgtcttcatgtcgttctggtaacatccctggaagaagatactgataattccagtttgtcaccaccacctgctaaattatctgttgtcagttttgccccctcctccaatggtactccagaggttgaaacaacaagcctcaatgatgttactttaagcttactcccttcaaacgaaacaggcgtcaaaccccagagaaatatctgcaatttgtcatctatttgcaatgactcagcattttttagaggtgagatcatgtttcaatatgataaagaaagcactgttccccagaatcaacatataacgaatggcaccttaactggagtcctgtctctaagtgaattaaaacgctcagagctcaacaaaaccctgcaaaccctaagtgagacttactttataatgtgtgctacagcagaggcccaaagcacattaaattgtacattcacaataaaactgaataatacaatgaatgcatgtgctgtaatagctgctttggaaagagtaaagattcgaccaatggaacactgctgctgttctgtcaggataccctgcccttcctccccagaagagttggaaaagcttcagtgtgacctgcaggatcccattgtctgtcttgctgaccatccacgtggcccaccattttcttccagccaatccatcccagtggtgcctcgggccactgtgctttcccaggtccccaaagctacctcttttgctgagcctccagattattcacctgtgacccacaatgttccctctccaataggggagattcaacccctttcaccccagccttcagctcccatagcttccagccctgccattgacatgcccccacagtctgaaacgatctcttcccctatgccccaaacccatgtctccggcaccccacctcctgtgaaagcctcattttcctctcccaccgtgtctgcccctgcgaatgtcaacactaccagcgcacctcctgtccagacagacatcgtcaacaccagcagtatttctgatcttgagaaccaagtgttgcagatggagaaggctctgtccttgggcagcctggagcctaacctcgcaggagaaatgatcaaccaagtcagcagactccttcattccccgcctgacatgctggcccctctggctcaaagattgctgaaagtagtggatgacattggcctacagctgaacttttcaaacacgactataagtctaacctccccttctttggctctggctgtgatcagagtgaatgccagtagtttcaacacaactacctttgtggcccaagaccctgcaaatcttcaggtttctctggaaacccaagctcctgagaacagtattggcacaattactcttccttcatcgctgatgaataatttaccagctcatgacatggagctagcttccagggttcagttcaatttttttgaaacacctgctttgtttcaggatccttccctggagaacctctctctgatcagctacgtcatatcatcgagtgttgcaaacctgaccgtcaggaacttgacaagaaacgtgacagtcacattaaagcacatcaacccgagccaggatgagttaacagtgagatgtgtattttgggacttgggcagaaatggtggcagaggaggctggtcagacaatggctgctctgtcaaagacaggagattgaatgaaaccatctgtacctgtagccatctaacaagcttcggcgttctgctggacctatctaggacatctgtgctgcctgctcaaatgatggctctgacgttcattacatatattggttgtgggctttcatcaatttttctgtcagtgactcttgtaacctacatagcttttgaaaagatccggagggattacccttccaaaatcctcatccagctgtgtgctgctctgcttctgctgaacctggtcttcctcctggactcgtggattgctctgtataagatgcaaggcctctgcatctcagtggctgtatttcttcattattttctcttggtctcattcacatggatgggcctagaagcattccatatgtacctggcccttgtcaaagtatttaatacttacatccgaaaatacatccttaaattctgcattgtcggttggggggtaccagctgtggttgtgaccatcatcctgactatatccccagataactatgggcttggatcctatgggaaattccccaatggttcaccggatgacttctgctggatcaacaacaatgcagtattctacattacggtggtgggatatttctgtgtgatatttttgctgaacgtcagcatgttcattgtggtcctggttcagctctgtcgaattaaaaagaagaagcaactgggagcccagcgaaaaaccagtattcaagacctcaggagtatcgctggccttacatttttactgggaataacttggggctttgccttctttgcctggggaccagttaacgtgaccttcatgtatctgtttgccatctttaataccttacaaggatttttcatattcatcttttactgtgtggccaaagaaaatgtcaggaagcaatggaggcggtatctttgttgtggaaagttacggctggctgaaaattctgactggagtaaaactgctactaatggtttaaagaagcagactgtaaaccaaggagtgtccagctcttcaaattccttacagtcaagcagtaactccactaactccaccacactgctagtgaataatgattgctcagtacacgcaagcgggaatggaaatgcttctacagagaggaatggggtctcttttagtgttcagaatggagatgtgtgccttcacgatttcactggaaaacagcacatgtttaacgagaaggaagattcctgcaatgggaaaggccgtatggctctcagaaggacttcaaagcggggaagcttacactttattgagcaaatgtgattcctttcttctaaaatcaaagcatgatgcttgacagtgtgaaatgtccaattttaccttttacacaatgtgagatgtatgaaaatcaactcattttattctcggcaacatctggagaagcataagctaattaagggcgatgattattattacaagaagaaaccaagacattacaccatggtttttagacatttctgatttggtttcttatctttcattttataagaaggttggttttaaacaatacactaagaatgactcctataaagaaaacaaaaaaaggtagtgaactttcagctaccttttaaagaggctaagttatctttgataacatcatataaagcaactgttgacttcagcctgttggtgagtttagttgtgcatgcctttgttgtatataagctaaattctagtgacccatgtgtcaaaaatcttacttctacatttttttgtatttattttctactgtgtaaatgtattcctttgtagaatcatggttgttttgtctcacgtgataattcagaaaatccttgctcgttccgcaaatcctaaagctccttttggagatgatataggatgtgaaatacagaaacctcagtgaaatcaagaaataatgatcccagccagactgagaaaatgtaagcagacagtgccacagttagctcatacagtgcctttgagcaagttaggaaaagatgcccccactgggcagacacagccctatgggctcatggtttgacaaacagagtggagagaccatattttagccccactcaccctcttgggtgcacgacctgtacagccaaacacagcatccaatatgaatacccatcccctgaccgcatccccagtagtcagattatagaatctgcaccaagatgtttagctttataccttggccacagagagggatgaactgtcatccagaccatgtgtcaggaaaattgtgaacgtagatgaggtacatacactgccgcttctcaaatccccagagcctttaggaacaggagagtagactaggattccttctcttaaaaaggtacatatatatggaaaaaaatcatattgccgttctttaaaaggcaactgcatggtacattgttgattgttatgactggtacactctggcccagccagagctataattgttttttaaatgtgtcttgaagaatgcacagtgacaaggggagtagctattgggaacagggaactgtcctacactgctattgttgctacatgtatcgagccttgattgctcctagttatatacagggtctatcttgcttcctacctacatctgcttgagcagtgcctcaagtacatccttattaggaacatttcaaaccccttttagttaagtctttcactaaggttctcttgcatatatttcaagtgaatgttggatctcagactaaccatagtaataatacacatttctgtgagtgctgacttgtctttgcaatatttcttttctgatttatttaattttcttgtatttatatgttaaaatcaaaaatgttaaaatcaatgaaataaatttgcagttaag

SEQ ID NO: 11638 - DNA, 4678 bp, Homo sapiens
cgggagcggcgggggcggcgccgaggccgcgggcggggggaggagggccgcagccccggagaggggaaaaggcgggccggacggcgccagcagccagccccgaggacgcgagcggcaggtgtgcacagaggttctccactttgttttctgaactcgcggtcaggatggttttctctgtcaggcagtgtggccatgttggcagaactgaagaagttttactgacgttcaagatattccttgtcatcatttgtcttcatgtcgttctggtaacatccctggaagaagatactgataattccagtttgtcaccaccacctgaggttgaaacaacaagcctcaatgatgttactttaagcttactcccttcaaacgaaacaggcgtcaaaccccagagaaatatctgcaatttgtcatctatttgcaatgactcagcattttttagaggtgagatcatgtttcaatatgataaagaaagcactgttccccagaatcaacatataacgaatggcaccttaactggagtcctgtctctaagtgaattaaaacgctcagagctcaacaaaaccctgcaaaccctaagtgagacttactttataatgtgtgctacagcagaggcccaaagcacattaaattgtacattcacaataaaactgaataatacaatgaatgcatgtgctgtaatagctgctttggaaagagtaaagattcgaccaatggaacactgctgctgttctgtcaggataccctgcccttcctccccagaagagttggaaaagcttcagtgtgacctgcaggatcccattgtctgtcttgctgaccatccacgtggcccaccattttcttccagccaatccatcccagtggtgcctcgggccactgtgctttcccaggtccccaaagctacctcttttgctgagcctccagattattcacctgtgacccacaatgttccctctccaataggggagattcaacccctttcaccccagccttcagctcccatagcttccagccctgccattgacatgcccccacagtctgaaacgatctcttcccctatgccccaaacccatgtctccggcaccccacctcctgtgaaagcctcattttcctctcccaccgtgtctgcccctgcgaatgtcaacactaccagcgcacctcctgtccagacagacatcgtcaacaccagcagtatttctgatcttgagaaccaagtgttgcagatggagaaggctctgtccttgggcagcctggagcctaacctcgcaggagaaatgatcaaccaagtcagcagactccttcattccccgcctgacatgctggcccctctggctcaaagattgctgaaagtagtggatgacattggcctacagctgaacttttcaaacacgactataagtctaacctccccttctttggctctggctgtgatcagagtgaatgccagtagtttcaacacaactacctttgtggcccaagaccctgcaaatcttcaggtttctctggaaacccaagctcctgagaacagtattggcacaattactcttccttcatcgctgatgaataatttaccagctcatgacatggagctagcttccagggttcagttcaatttttttgaaacacctgctttgtttcaggatccttccctggagaacctctctctgatcagctacgtcatatcatcgagtgttgcaaacctgaccgtcaggaacttgacaagaaacgtgacagtcacattaaagcacatcaacccgagccaggatgagttaacagtgagatgtgtattttgggacttgggcagaaatggtggcagaggaggctggtcagacaatggctgctctgtcaaagacaggagattgaatgaaaccatctgtacctgtagccatctaacaagcttcggcgttctgctggacctatctaggacatctgtgctgcctgctcaaatgatggctctgacgttcattacatatattggttgtgggctttcatcaatttttctgtcagtgactcttgtaacctacatagcttttgaaaagatccggagggattacccttccaaaatcctcatccagctgtgtgctgctctgcttctgctgaacctggtcttcctcctggactcgtggattgctctgtataagatgcaaggcctctgcatctcagtggctgtatttcttcattattttctcttggtctcattcacatggatgggcctagaagcattccatatgtacctggcccttgtcaaagtatttaatacttacatccgaaaatacatccttaaattctgcattgtcggttggggggtaccagctgtggttgtgaccatcatcctgactatatccccagataactatgggcttggatcctatgggaaattccccaatggttcaccggatgacttctgctggatcaacaacaatgcagtattctacattacggtggtgggatatttctgtgtgatatttttgctgaacgtcagcatgttcattgtggtcctggttcagctctgtcgaattaaaaagaagaagcaactgggagcccagcgaaaaaccagtattcaagacctcaggagtatcgctggccttacatttttactgggaataacttggggctttgccttctttgcctggggaccagttaacgtgaccttcatgtatctgtttgccatctttaataccttacaaggatttttcatattcatcttttactgtgtggccaaagaaaatgtcaggaagcaatggaggcggtatctttgttgtggaaagttacggctggctgaaaattctgactggagtaaaactgctactaatggtttaaagaagcagactgtaaaccaaggagtgtccagctcttcaaattccttacagtcaagcagtaactccactaactccaccacactgctagtgaataatgattgctcagtacacgcaagcgggaatggaaatgcttctacagagaggaatggggtctcttttagtgttcagaatggagatgtgtgccttcacgatttcactggaaaacagcacatgtttaacgagaaggaagattcctgcaatgggaaaggccgtatggctctcagaaggacttcaaagcggggaagcttacactttattgagcaaatgtgattcctttcttctaaaatcaaagcatgatgcttgacagtgtgaaatgtccaattttaccttttacacaatgtgagatgtatgaaaatcaactcattttattctcggcaacatctggagaagcataagctaattaagggcgatgattattattacaagaagaaaccaagacattacaccatggtttttagacatttctgatttggtttcttatctttcattttataagaaggttggttttaaacaatacactaagaatgactcctataaagaaaacaaaaaaaggtagtgaactttcagctaccttttaaagaggctaagttatctttgataacatcatataaagcaactgttgacttcagcctgttggtgagtttagttgtgcatgcctttgttgtatataagctaaattctagtgacccatgtgtcaaaaatcttacttctacatttttttgtatttattttctactgtgtaaatgtattcctttgtagaatcatggttgttttgtctcacgtgataattcagaaaatccttgctcgttccgcaaatcctaaagctccttttggagatgatataggatgtgaaatacagaaacctcagtgaaatcaagaaataatgatcccagccagactgagaaaatgtaagcagacagtgccacagttagctcatacagtgcctttgagcaagttaggaaaagatgcccccactgggcagacacagccctatgggctcatggtttgacaaacagagtggagagaccatattttagccccactcaccctcttgggtgcacgacctgtacagccaaacacagcatccaatatgaatacccatcccctgaccgcatccccagtagtcagattatagaatctgcaccaagatgtttagctttataccttggccacagagagggatgaactgtcatccagaccatgtgtcaggaaaattgtgaacgtagatgaggtacatacactgccgcttctcaaatccccagagcctttaggaacaggagagtagactaggattccttctcttaaaaaggtacatatatatggaaaaaaatcatattgccgttctttaaaaggcaactgcatggtacattgttgattgttatgactggtacactctggcccagccagagctataattgttttttaaatgtgtcttgaagaatgcacagtgacaaggggagtagctattgggaacagggaactgtcctacactgctattgttgctacatgtatcgagccttgattgctcctagttatatacagggtctatcttgcttcctacctacatctgcttgagcagtgcctcaagtacatccttattaggaacatttcaaaccccttttagttaagtctttcactaaggttctcttgcatatatttcaagtgaatgttggatctcagactaaccatagtaataatacacatttctgtgagtgctgacttgtctttgcaatatttcttttctgatttatttaattttcttgtatttatatgttaaaatcaaaaatgttaaaatcaatgaaataaatttgcagttaaga

SEQ ID NO: 11639 - DNA, 4661 bp, Homo sapiens
cccgaggacgcgagcggcaggtgtgcacagaggttctccactttgttttctgaactcgcggtcaggatggttttctctgtcaggcagtgtggccatgttggcagaactgaagaagttttactgacgttcaagatattccttgtcatcatttgtcttcatgtcgttctggtaacatccctggaagaagatactgataattccagtttgtcaccaccacctgctaaattatctgttgtcagttttgccccctcctccaatgaggttgaaacaacaagcctcaatgatgttactttaagcttactcccttcaaacgaaacagaaaaaactaaaatcactatagtaaaaaccttcaatgcatcaggcgtcaaaccccagagaaatatctgcaatttgtcatctatttgcaatgactcagcattttttagaggtgagatcatgtttcaatatgataaagaaagcactgttccccagaatcaacatataacgaatggcaccttaactggagtcctgtctctaagtgaattaaaacgctcagagctcaacaaaaccctgcaaaccctaagtgagacttactttataatgtgtgctacagcagaggcccaaagcacattaaattgtacattcacaataaaactgaataatacaatgaatgcatgtgctgtaatagctgctttggaaagagtaaagattcgaccaatggaacactgctgctgttctgtcaggataccctgcccttcctccccagaagagttggaaaagcttcagtgtgacctgcaggatcccattgtctgtcttgctgaccatccacgtggcccaccattttcttccagccaatccatcccagtggtgcctcgggccactgtgctttcccaggtccccaaagctacctcttttgctgagcctccagattattcacctgtgacccacaatgttccctctccaataggggagattcaacccctttcaccccagccttcagctcccatagcttccagccctgccattgacatgcccccacagtctgaaacgatctcttcccctatgccccaaacccatgtctccggcaccccacctcctgtgaaagcctcattttcctctcccaccgtgtctgcccctgcgaatgtcaacactaccagcgcacctcctgtccagacagacatcgtcaacaccagcagtatttctgatcttgagaaccaagtgttgcagatggagaaggctctgtccttgggcagcctggagcctaacctcgcaggagaaatgatcaaccaagtcagcagactccttcattccccgcctgacatgctggcccctctggctcaaagattgctgaaagtagtggatgacattggcctacagctgaacttttcaaacacgactataagtctaacctccccttctttggctctggctgtgatcagagtgaatgccagtagtttcaacacaactacctttgtggcccaagaccctgcaaatcttcaggtttctctggaaacccaagctcctgagaacagtattggcacaattactcttccttcatcgctgatgaataatttaccagctcatgacatggagctagcttccagggttcagttcaatttttttgaaacacctgctttgtttcaggatccttccctggagaacctctctctgatcagctacgtcatatcatcgagtgttgcaaacctgaccgtcaggaacttgacaagaaacgtgacagtcacattaaagcacatcaacccgagccaggatgagttaacagtgagatgtgtattttgggacttgggcagaaatggtggcagaggaggctggtcagacaatggctgctctgtcaaagacaggagattgaatgaaaccatctgtacctgtagccatctaacaagcttcggcgttctgctggacctatctaggacatctgtgctgcctgctcaaatgatggctctgacgttcattacatatattggttgtgggctttcatcaatttttctgtcagtgactcttgtaacctacatagcttttgaaaagatccggagggattacccttccaaaatcctcatccagctgtgtgctgctctgcttctgctgaacctggtcttcctcctggactcgtggattgctctgtataagatgcaaggcctctgcatctcagtggctgtatttcttcattattttctcttggtctcattcacatggatgggcctagaagcattccatatgtacctggcccttgtcaaagtatttaatacttacatccgaaaatacatccttaaattctgcattgtcggttggggggtaccagctgtggttgtgaccatcatcctgactatatccccagataactatgggcttggatcctatgggaaattccccaatggttcaccggatgacttctgctggatcaacaacaatgcagtattctacattacggtggtgggatatttctgtgtgatatttttgctgaacgtcagcatgttcattgtggtcctggttcagctctgtcgaattaaaaagaagaagcaactgggagcccagcgaaaaaccagtattcaagacctcaggagtatcgctggccttacatttttactgggaataacttggggctttgccttctttgcctggggaccagttaacgtgaccttcatgtatctgtttgccatctttaataccttacaaggatttttcatattcatcttttactgtgtggccaaagaaaatgtcaggaagcaatggaggcggtatctttgttgtggaaagttacggctggctgaaaattctgactggagtaaaactgctactaatggtttaaagaagcagactgtaaaccaaggagtgtccagctcttcaaattccttacagtcaagcagtaactccactaactccaccacactgctagtgaataatgattgctcagtacacgcaagcgggaatggaaatgcttctacagagaggaatggggtctcttttagtgttcagaatggagatgtgtgccttcacgatttcactggaaaacagcacatgtttaacgagaaggaagattcctgcaatgggaaaggccgtatggctctcagaaggacttcaaagcggggaagcttacactttattgagcaaatgtgattcctttcttctaaaatcaaagcatgatgcttgacagtgtgaaatgtccaattttaccttttacacaatgtgagatgtatgaaaatcaactcattttattctcggcaacatctggagaagcataagctaattaagggcgatgattattattacaagaagaaaccaagacattacaccatggtttttagacatttctgatttggtttcttatctttcattttataagaaggttggttttaaacaatacactaagaatgactcctataaagaaaacaaaaaaaggtagtgaactttcagctaccttttaaagaggctaagttatctttgataacatcatataaagcaactgttgacttcagcctgttggtgagtttagttgtgcatgcctttgttgtatataagctaaattctagtgacccatgtgtcaaaaatcttacttctacatttttttgtatttattttctactgtgtaaatgtattcctttgtagaatcatggttgttttgtctcacgtgataattcagaaaatccttgctcgttccgcaaatcctaaagctccttttggagatgatataggatgtgaaatacagaaacctcagtgaaatcaagaaataatgatcccagccagactgagaaaatgtaagcagacagtgccacagttagctcatacagtgcctttgagcaagttaggaaaagatgcccccactgggcagacacagccctatgggctcatggtttgacaaacagagtggagagaccatattttagccccactcaccctcttgggtgcacgacctgtacagccaaacacagcatccaatatgaatacccatcccctgaccgcatccccagtagtcagattatagaatctgcaccaagatgtttagctttataccttggccacagagagggatgaactgtcatccagaccatgtgtcaggaaaattgtgaacgtagatgaggtacatacactgccgcttctcaaatccccagagcctttaggaacaggagagtagactaggattccttctcttaaaaaggtacatatatatggaaaaaaatcatattgccgttctttaaaaggcaactgcatggtacattgttgattgttatgactggtacactctggcccagccagagctataattgttttttaaatgtgtcttgaagaatgcacagtgacaaggggagtagctattgggaacagggaactgtcctacactgctattgttgctacatgtatcgagccttgattgctcctagttatatacagggtctatcttgcttcctacctacatctgcttgagcagtgcctcaagtacatccttattaggaacatttcaaaccccttttagttaagtctttcactaaggttctcttgcatatatttcaagtgaatgttggatctcagactaaccatagtaataatacacatttctgtgagtgctgacttgtctttgcaatatttcttttctgatttatttaattttcttgtatttatatgttaaaatcaaaaatgttaaaatcaatgaaataaatttgcagttaaga

SEQ ID NO: 11640 - DNA, 4702 bp, Homo sapiens
cgggagcggcgggggcggcgccgaggccgcgggcggggggaggagggccgcagccccggagaggggaaaaggcgggccggacggcgccagcagccagccccgaggacgcgagcggcaggtgtgcacagaggttctccactttgttttctgaactcgcggtcaggatggttttctctgtcaggcagtgtggccatgttggcagaactgaagaagttttactgacgttcaagatattccttgtcatcatttgtcttcatgtcgttctggtaacatccctggaagaagatactgataattccagtttgtcaccaccacctgctaaattatctgttgtcagttttgccccctcctccaatggtactccagatgttactttaagcttactcccttcaaacgaaacaggcgtcaaaccccagagaaatatctgcaatttgtcatctatttgcaatgactcagcattttttagaggtgagatcatgtttcaatatgataaagaaagcactgttccccagaatcaacatataacgaatggcaccttaactggagtcctgtctctaagtgaattaaaacgctcagagctcaacaaaaccctgcaaaccctaagtgagacttactttataatgtgtgctacagcagaggcccaaagcacattaaattgtacattcacaataaaactgaataatacaatgaatgcatgtgctgtaatagctgctttggaaagagtaaagattcgaccaatggaacactgctgctgttctgtcaggataccctgcccttcctccccagaagagttggaaaagcttcagtgtgacctgcaggatcccattgtctgtcttgctgaccatccacgtggcccaccattttcttccagccaatccatcccagtggtgcctcgggccactgtgctttcccaggtccccaaagctacctcttttgctgagcctccagattattcacctgtgacccacaatgttccctctccaataggggagattcaacccctttcaccccagccttcagctcccatagcttccagccctgccattgacatgcccccacagtctgaaacgatctcttcccctatgccccaaacccatgtctccggcaccccacctcctgtgaaagcctcattttcctctcccaccgtgtctgcccctgcgaatgtcaacactaccagcgcacctcctgtccagacagacatcgtcaacaccagcagtatttctgatcttgagaaccaagtgttgcagatggagaaggctctgtccttgggcagcctggagcctaacctcgcaggagaaatgatcaaccaagtcagcagactccttcattccccgcctgacatgctggcccctctggctcaaagattgctgaaagtagtggatgacattggcctacagctgaacttttcaaacacgactataagtctaacctccccttctttggctctggctgtgatcagagtgaatgccagtagtttcaacacaactacctttgtggcccaagaccctgcaaatcttcaggtttctctggaaacccaagctcctgagaacagtattggcacaattactcttccttcatcgctgatgaataatttaccagctcatgacatggagctagcttccagggttcagttcaatttttttgaaacacctgctttgtttcaggatccttccctggagaacctctctctgatcagctacgtcatatcatcgagtgttgcaaacctgaccgtcaggaacttgacaagaaacgtgacagtcacattaaagcacatcaacccgagccaggatgagttaacagtgagatgtgtattttgggacttgggcagaaatggtggcagaggaggctggtcagacaatggctgctctgtcaaagacaggagattgaatgaaaccatctgtacctgtagccatctaacaagcttcggcgttctgctggacctatctaggacatctgtgctgcctgctcaaatgatggctctgacgttcattacatatattggttgtgggctttcatcaatttttctgtcagtgactcttgtaacctacatagcttttgaaaagatccggagggattacccttccaaaatcctcatccagctgtgtgctgctctgcttctgctgaacctggtcttcctcctggactcgtggattgctctgtataagatgcaaggcctctgcatctcagtggctgtatttcttcattattttctcttggtctcattcacatggatgggcctagaagcattccatatgtacctggcccttgtcaaagtatttaatacttacatccgaaaatacatccttaaattctgcattgtcggttggggggtaccagctgtggttgtgaccatcatcctgactatatccccagataactatgggcttggatcctatgggaaattccccaatggttcaccggatgacttctgctggatcaacaacaatgcagtattctacattacggtggtgggatatttctgtgtgatatttttgctgaacgtcagcatgttcattgtggtcctggttcagctctgtcgaattaaaaagaagaagcaactgggagcccagcgaaaaaccagtattcaagacctcaggagtatcgctggccttacatttttactgggaataacttggggctttgccttctttgcctggggaccagttaacgtgaccttcatgtatctgtttgccatctttaataccttacaaggatttttcatattcatcttttactgtgtggccaaagaaaatgtcaggaagcaatggaggcggtatctttgttgtggaaagttacggctggctgaaaattctgactggagtaaaactgctactaatggtttaaagaagcagactgtaaaccaaggagtgtccagctcttcaaattccttacagtcaagcagtaactccactaactccaccacactgctagtgaataatgattgctcagtacacgcaagcgggaatggaaatgcttctacagagaggaatggggtctcttttagtgttcagaatggagatgtgtgccttcacgatttcactggaaaacagcacatgtttaacgagaaggaagattcctgcaatgggaaaggccgtatggctctcagaaggacttcaaagcggggaagcttacactttattgagcaaatgtgattcctttcttctaaaatcaaagcatgatgcttgacagtgtgaaatgtccaattttaccttttacacaatgtgagatgtatgaaaatcaactcattttattctcggcaacatctggagaagcataagctaattaagggcgatgattattattacaagaagaaaccaagacattacaccatggtttttagacatttctgatttggtttcttatctttcattttataagaaggttggttttaaacaatacactaagaatgactcctataaagaaaacaaaaaaaggtagtgaactttcagctaccttttaaagaggctaagttatctttgataacatcatataaagcaactgttgacttcagcctgttggtgagtttagttgtgcatgcctttgttgtatataagctaaattctagtgacccatgtgtcaaaaatcttacttctacatttttttgtatttattttctactgtgtaaatgtattcctttgtagaatcatggttgttttgtctcacgtgataattcagaaaatccttgctcgttccgcaaatcctaaagctccttttggagatgatataggatgtgaaatacagaaacctcagtgaaatcaagaaataatgatcccagccagactgagaaaatgtaagcagacagtgccacagttagctcatacagtgcctttgagcaagttaggaaaagatgcccccactgggcagacacagccctatgggctcatggtttgacaaacagagtggagagaccatattttagccccactcaccctcttgggtgcacgacctgtacagccaaacacagcatccaatatgaatacccatcccctgaccgcatccccagtagtcagattatagaatctgcaccaagatgtttagctttataccttggccacagagagggatgaactgtcatccagaccatgtgtcaggaaaattgtgaacgtagatgaggtacatacactgccgcttctcaaatccccagagcctttaggaacaggagagtagactaggattccttctcttaaaaaggtacatatatatggaaaaaaatcatattgccgttctttaaaaggcaactgcatggtacattgttgattgttatgactggtacactctggcccagccagagctataattgttttttaaatgtgtcttgaagaatgcacagtgacaaggggagtagctattgggaacagggaactgtcctacactgctattgttgctacatgtatcgagccttgattgctcctagttatatacagggtctatcttgcttcctacctacatctgcttgagcagtgcctcaagtacatccttattaggaacatttcaaaccccttttagttaagtctttcactaaggttctcttgcatatatttcaagtgaatgttggatctcagactaaccatagtaataatacacatttctgtgagtgctgacttgtctttgcaatatttcttttctgatttatttaattttcttgtatttatatgttaaaatcaaaaatgttaaaatcaatgaaataaatttgcagttaaga

SEQ ID NO: 11641 - DNA, 4768 bp, Homo sapiens
cgggagcggcgggggcggcgccgaggccgcgggcggggggaggagggccgcagccccggagaggggaaaaggcgggccggacggcgccagcagccagccccgaggacgcgagcggcaggtgtgcacagaggttctccactttgttttctgaactcgcggtcaggatggttttctctgtcaggcagtgtggccatgttggcagaactgaagaagttttactgacgttcaagatattccttgtcatcatttgtcttcatgtcgttctggtaacatccctggaagaagatactgataattccagtttgtcaccaccacctgctaaattatctgttgtcagttttgccccctcctccaatggtactccagaggttgaaacaacaagcctcaatgatgttactttaagcttactcccttcaaacgaaacagaaaaaactaaaatcactatagtaaaaaccttcaatgcatcaggcgtcaaaccccagagaaatatctgcaatttgtcatctatttgcaatgactcagcattttttagaggtgagatcatgtttcaatatgataaagaaagcactgttccccagaatcaacatataacgaatggcaccttaactggagtcctgtctctaagtgaattaaaacgctcagagctcaacaaaaccctgcaaaccctaagtgagacttactttataatgtgtgctacagcagaggcccaaagcacattaaattgtacattcacaataaaactgaataatacaatgaatgcatgtgctgtaatagctgctttggaaagagtaaagattcgaccaatggaacactgctgctgttctgtcaggataccctgcccttcctccccagaagagttggaaaagcttcagtgtgacctgcaggatcccattgtctgtcttgctgaccatccacgtggcccaccattttcttccagccaatccatcccagtggtgcctcgggccactgtgctttcccaggtccccaaagctacctcttttgctgagcctccagattattcacctgtgacccacaatgttccctctccaataggggagattcaacccctttcaccccagccttcagctcccatagcttccagccctgccattgacatgcccccacagtctgaaacgatctcttcccctatgccccaaacccatgtctccggcaccccacctcctgtgaaagcctcattttcctctcccaccgtgtctgcccctgcgaatgtcaacactaccagcgcacctcctgtccagacagacatcgtcaacaccagcagtatttctgatcttgagaaccaagtgttgcagatggagaaggctctgtccttgggcagcctggagcctaacctcgcaggagaaatgatcaaccaagtcagcagactccttcattccccgcctgacatgctggcccctctggctcaaagattgctgaaagtagtggatgacattggcctacagctgaacttttcaaacacgactataagtctaacctccccttctttggctctggctgtgatcagagtgaatgccagtagtttcaacacaactacctttgtggcccaagaccctgcaaatcttcaggtttctctggaaacccaagctcctgagaacagtattggcacaattactcttccttcatcgctgatgaataatttaccagctcatgacatggagctagcttccagggttcagttcaatttttttgaaacacctgctttgtttcaggatccttccctggagaacctctctctgatcagctacgtcatatcatcgagtgttgcaaacctgaccgtcaggaacttgacaagaaacgtgacagtcacattaaagcacatcaacccgagccaggatgagttaacagtgagatgtgtattttgggacttgggcagaaatggtggcagaggaggctggtcagacaatggctgctctgtcaaagacaggagattgaatgaaaccatctgtacctgtagccatctaacaagcttcggcgttctgctggacctatctaggacatctgtgctgcctgctcaaatgatggctctgacgttcattacatatattggttgtgggctttcatcaatttttctgtcagtgactcttgtaacctacatagcttttgaaaagatccggagggattacccttccaaaatcctcatccagctgtgtgctgctctgcttctgctgaacctggtcttcctcctggactcgtggattgctctgtataagatgcaaggcctctgcatctcagtggctgtatttcttcattattttctcttggtctcattcacatggatgggcctagaagcattccatatgtacctggcccttgtcaaagtatttaatacttacatccgaaaatacatccttaaattctgcattgtcggttggggggtaccagctgtggttgtgaccatcatcctgactatatccccagataactatgggcttggatcctatgggaaattccccaatggttcaccggatgacttctgctggatcaacaacaatgcagtattctacattacggtggtgggatatttctgtgtgatatttttgctgaacgtcagcatgttcattgtggtcctggttcagctctgtcgaattaaaaagaagaagcaactgggagcccagcgaaaaaccagtattcaagacctcaggagtatcgctggccttacatttttactgggaataacttggggctttgccttctttgcctggggaccagttaacgtgaccttcatgtatctgtttgccatctttaataccttacaaggatttttcatattcatcttttactgtgtggccaaagaaaatgtcaggaagcaatggaggcggtatctttgttgtggaaagttacggctggctgaaaattctgactggagtaaaactgctactaatggtttaaagaagcagactgtaaaccaaggagtgtccagctcttcaaattccttacagtcaagcagtaactccactaactccaccacactgctagtgaataatgattgctcagtacacgcaagcgggaatggaaatgcttctacagagaggaatggggtctcttttagtgttcagaatggagatgtgtgccttcacgatttcactggaaaacagcacatgtttaacgagaaggaagattcctgcaatgggaaaggccgtatggctctcagaaggacttcaaagcggggaagcttacactttattgagcaaatgtgattcctttcttctaaaatcaaagcatgatgcttgacagtgtgaaatgtccaattttaccttttacacaatgtgagatgtatgaaaatcaactcattttattctcggcaacatctggagaagcataagctaattaagggcgatgattattattacaagaagaaaccaagacattacaccatggtttttagacatttctgatttggtttcttatctttcattttataagaaggttggttttaaacaatacactaagaatgactcctataaagaaaacaaaaaaaggtagtgaactttcagctaccttttaaagaggctaagttatctttgataacatcatataaagcaactgttgacttcagcctgttggtgagtttagttgtgcatgcctttgttgtatataagctaaattctagtgacccatgtgtcaaaaatcttacttctacatttttttgtatttattttctactgtgtaaatgtattcctttgtagaatcatggttgttttgtctcacgtgataattcagaaaatccttgctcgttccgcaaatcctaaagctccttttggagatgatataggatgtgaaatacagaaacctcagtgaaatcaagaaataatgatcccagccagactgagaaaatgtaagcagacagtgccacagttagctcatacagtgcctttgagcaagttaggaaaagatgcccccactgggcagacacagccctatgggctcatggtttgacaaacagagtggagagaccatattttagccccactcaccctcttgggtgcacgacctgtacagccaaacacagcatccaatatgaatacccatcccctgaccgcatccccagtagtcagattatagaatctgcaccaagatgtttagctttataccttggccacagagagggatgaactgtcatccagaccatgtgtcaggaaaattgtgaacgtagatgaggtacatacactgccgcttctcaaatccccagagcctttaggaacaggagagtagactaggattccttctcttaaaaaggtacatatatatggaaaaaaatcatattgccgttctttaaaaggcaactgcatggtacattgttgattgttatgactggtacactctggcccagccagagctataattgttttttaaatgtgtcttgaagaatgcacagtgacaaggggagtagctattgggaacagggaactgtcctacactgctattgttgctacatgtatcgagccttgattgctcctagttatatacagggtctatcttgcttcctacctacatctgcttgagcagtgcctcaagtacatccttattaggaacatttcaaaccccttttagttaagtctttcactaaggttctcttgcatatatttcaagtgaatgttggatctcagactaaccatagtaataatacacatttctgtgagtgctgacttgtctttgcaatatttcttttctgatttatttaattttcttgtatttatatgttaaaatcaaaaatgttaaaatcaatgaaataaatttgcagttaaga

SEQ ID NO: 11642 - DNA, 4698 bp, Homo sapiens
gcgcccagcctcgccgccgccgagcgcccgacgcgccacgccgcgctgggcagctggagagctggcggcggagcgggccgggagcggcgggggcggcgccgaggccgcgggcggggggaggagggccgcagccccggagaggggaaaaggcgggccggacggcgccagcagccagccccgaggacgcgagcggcaggtgtgcacagaggttctccactttgttttctgaactcgcggtcaggatggttttctctgtcaggcagtgtggccatgttggcagaactgaagaagttttactgacgttcaagatattccttgtcatcatttgtcttcatgtcgttctggtaacatccctggaagaagatactgataattccagtttgtcaccaccacctgctaaattatctgttgtcagttttgccccctcctccaatggtactccagaggttgaaacaacaagcctcaatgatgttactttaagcttactcccttcaaacgaaacagaaaaaactaaaatcactatagtaaaaaccttcaatgcatcaggcgtcaaaccccagagaaatatctgcaatttgtcatctatttgcaatgactcagcattttttagaggtgagatcatgtttcaatatgataaagaaagcactgttccccagaatcaacatataacgaatggcaccttaactggagtcctgtctctaagtgaattaaaacgctcagagctcaacaaaaccctgcaaaccctaagtgagacttactttataatgtgtgctacagcagaggcccaaagcacattaaattgtacattcacaataaaactgaataatacaatgaatgcatgtgctgtaatagctgctttggaaagagtaaagattcgaccaatggaacactgctgctgttctgtcaggataccctgcccttcctccccagaagagttggaaaagcttcagtgtgacctgcaggatcccattgtctgtcttgctgaccatccacgtggcccaccattttcttccagccaatccatcccagtggtgcctcgggccactgtgctttcccaggtccccaaagctacctcttttgctgagcctccagattattcacctgtgacccacaatgttccctctccaataggggagattcaacccctttcaccccagccttcagctcccatagcttccagccctgccattgacatgcccccacagtctgaaacgatctcttcccctatgccccaaacccatgtctccggcaccccacctcctgtgaaagcctcattttcctctcccaccgtgtctgcccctgcgaatgtcaacactaccagcgcacctcctgtccagacagacatcgtcaacaccagcagtatttctgatcttgagaaccaagtgttgcagatggagaaggctctgtccttgggcagcctggagcctaacctcgcaggagaaatgatcaaccaagtcagcagactccttcattccccgcctgacatgctggcccctctggctcaaagattgctgaaagtagtggatgacattggcctacagctgaacttttcaaacacgactataagtctaacctccccttctttggctctggctgtgatcagagtgaatgccagtagtttcaacacaactacctttgtggcccaagaccctgcaaatcttcaggtttctctggaaacccaagctcctgagaacagtattggcacaattactcttccttcatcgctgatgaataatttaccagctcatgacatggagctagcttccagggttcagttcaatttttttgaaacacctgctttgtttcaggatccttccctggagaacctctctctgatcagctacgtcatatcatcgagtgttgcaaacctgaccgtcaggaacttgacaagaaacgtgacagtcacattaaagcacatcaacccgagccaggatgagttaacagtgagatgtgtattttgggacttgggcagaaatggtggcagaggaggctggtcagacaatggctgctctgtcaaagacaggagattgaatgaaaccatctgtacctgtagccatctaacaagcttcggcgttctgctggacctatctaggacatctgtgctgcctgctcaaatgatggctctgacgttcattacatatattggttgtgggctttcatcaatttttctgtcagtgactcttgtaacctacatagcttttgaaaagatccggagggattacccttccaaaatcctcatccagctgtgtgctgctctgcttctgctgaacctggtcttcctcctggactcgtggattgctctgtataagatgcaaggcctctgcatctcagtggctgtatttcttcattattttctcttggtctcattcacatggatgggcctagaagcattccatatgtacctggcccttgtcaaagtatttaatacttacatccgaaaatacatccttaaattctgcattgtcggttggggggtaccagctgtggttgtgaccatcatcctgactatatccccagataactatgggcttggatcctatgggaaattccccaatggttcaccggatgacttctgctggatcaacaacaatgcagtattctacattacggtggtgggatatttctgtgtgatatttttgctgaacgtcagcatgttcattgtggtcctggttcagctctgtcgaattaaaaagaagaagcaactgggagcccagcgaaaaaccagtattcaagacctcaggagtatcgctggccttacatttttactgggaataacttggggctttgccttctttgcctggggaccagttaacgtgaccttcatgtatctgtttgccatctttaataccttacaaggatttttcatattcatcttttactgtgtggccaaagaaaatgtcaggaagcaatggaggcggtatctttgttgtggaaagttacggctggctgaaaattctggaaatgcttctacagagaggaatggggtctcttttagtgttcagaatggagatgtgtgccttcacgatttcactggaaaacagcacatgtttaacgagaaggaagattcctgcaatgggaaaggccgtatggctctcagaaggacttcaaagcggggaagcttacactttattgagcaaatgtgattcctttcttctaaaatcaaagcatgatgcttgacagtgtgaaatgtccaattttaccttttacacaatgtgagatgtatgaaaatcaactcattttattctcggcaacatctggagaagcataagctaattaagggcgatgattattattacaagaagaaaccaagacattacaccatggtttttagacatttctgatttggtttcttatctttcattttataagaaggttggttttaaacaatacactaagaatgactcctataaagaaaacaaaaaaaggtagtgaactttcagctaccttttaaagaggctaagttatctttgataacatcatataaagcaactgttgacttcagcctgttggtgagtttagttgtgcatgcctttgttgtatataagctaaattctagtgacccatgtgtcaaaaatcttacttctacatttttttgtatttattttctactgtgtaaatgtattcctttgtagaatcatggttgttttgtctcacgtgataattcagaaaatccttgctcgttccgcaaatcctaaagctccttttggagatgatataggatgtgaaatacagaaacctcagtgaaatcaagaaataatgatcccagccagactgagaaaatgtaagcagacagtgccacagttagctcatacagtgcctttgagcaagttaggaaaagatgcccccactgggcagacacagccctatgggctcatggtttgacaaacagagtggagagaccatattttagccccactcaccctcttgggtgcacgacctgtacagccaaacacagcatccaatatgaatacccatcccctgaccgcatccccagtagtcagattatagaatctgcaccaagatgtttagctttataccttggccacagagagggatgaactgtcatccagaccatgtgtcaggaaaattgtgaacgtagatgaggtacatacactgccgcttctcaaatccccagagcctttaggaacaggagagtagactaggattccttctcttaaaaaggtacatatatatggaaaaaaatcatattgccgttctttaaaaggcaactgcatggtacattgttgattgttatgactggtacactctggcccagccagagctataattgttttttaaatgtgtcttgaagaatgcacagtgacaaggggagtagctattgggaacagggaactgtcctacactgctattgttgctacatgtatcgagccttgattgctcctagttatatacagggtctatcttgcttcctacctacatctgcttgagcagtgcctcaagtacatccttattaggaacatttcaaaccccttttagttaagtctttcactaaggttctcttgcatatatttcaagtgaatgttggatctcagactaaccatagtaataatacacatttctgtgagtgctgacttgtctttgcaatatttcttttctgatttatttaattttcttgtatttatatgttaaaatcaaaaatgttaaaatcaatgaaataaatttgcagttaagatcttt

SEQ ID NO: 11643 - DNA, 4779 bp, Homo sapiens
gcgcccagcctcgccgccgccgagcgcccgacgcgccacgccgcgctgggcagctggagagctggcggcggagcgggccgggagcggcgggggcggcgccgaggccgcgggcggggggaggagggccgcagccccggagaggggaaaaggcgggccggacggcgccagcagccagccccgaggacgcgagcggcaggtgtgcacagaggttctccactttgttttctgaactcgcggtcaggatggttttctctgtcaggcagtgtggccatgttggcagaactgaagaagttttactgacgttcaagatattccttgtcatcatttgtcttcatgtcgttctggtaacatccctggaagaagatactgataattccagtttgtcaccaccacctgatgttactttaagcttactcccttcaaacgaaacagaaaaaactaaaatcactatagtaaaaaccttcaatgcatcaggcgtcaaaccccagagaaatatctgcaatttgtcatctatttgcaatgactcagcattttttagaggtgagatcatgtttcaatatgataaagaaagcactgttccccagaatcaacatataacgaatggcaccttaactggagtcctgtctctaagtgaattaaaacgctcagagctcaacaaaaccctgcaaaccctaagtgagacttactttataatgtgtgctacagcagaggcccaaagcacattaaattgtacattcacaataaaactgaataatacaatgaatgcatgtgctgtaatagctgctttggaaagagtaaagattcgaccaatggaacactgctgctgttctgtcaggataccctgcccttcctccccagaagagttggaaaagcttcagtgtgacctgcaggatcccattgtctgtcttgctgaccatccacgtggcccaccattttcttccagccaatccatcccagtggtgcctcgggccactgtgctttcccaggtccccaaagctacctcttttgctgagcctccagattattcacctgtgacccacaatgttccctctccaataggggagattcaacccctttcaccccagccttcagctcccatagcttccagccctgccattgacatgcccccacagtctgaaacgatctcttcccctatgccccaaacccatgtctccggcaccccacctcctgtgaaagcctcattttcctctcccaccgtgtctgcccctgcgaatgtcaacactaccagcgcacctcctgtccagacagacatcgtcaacaccagcagtatttctgatcttgagaaccaagtgttgcagatggagaaggctctgtccttgggcagcctggagcctaacctcgcaggagaaatgatcaaccaagtcagcagactccttcattccccgcctgacatgctggcccctctggctcaaagattgctgaaagtagtggatgacattggcctacagctgaacttttcaaacacgactataagtctaacctccccttctttggctctggctgtgatcagagtgaatgccagtagtttcaacacaactacctttgtggcccaagaccctgcaaatcttcaggtttctctggaaacccaagctcctgagaacagtattggcacaattactcttccttcatcgctgatgaataatttaccagctcatgacatggagctagcttccagggttcagttcaatttttttgaaacacctgctttgtttcaggatccttccctggagaacctctctctgatcagctacgtcatatcatcgagtgttgcaaacctgaccgtcaggaacttgacaagaaacgtgacagtcacattaaagcacatcaacccgagccaggatgagttaacagtgagatgtgtattttgggacttgggcagaaatggtggcagaggaggctggtcagacaatggctgctctgtcaaagacaggagattgaatgaaaccatctgtacctgtagccatctaacaagcttcggcgttctgctggacctatctaggacatctgtgctgcctgctcaaatgatggctctgacgttcattacatatattggttgtgggctttcatcaatttttctgtcagtgactcttgtaacctacatagcttttgaaaagatccggagggattacccttccaaaatcctcatccagctgtgtgctgctctgcttctgctgaacctggtcttcctcctggactcgtggattgctctgtataagatgcaaggcctctgcatctcagtggctgtatttcttcattattttctcttggtctcattcacatggatgggcctagaagcattccatatgtacctggcccttgtcaaagtatttaatacttacatccgaaaatacatccttaaattctgcattgtcggttggggggtaccagctgtggttgtgaccatcatcctgactatatccccagataactatgggcttggatcctatgggaaattccccaatggttcaccggatgacttctgctggatcaacaacaatgcagtattctacattacggtggtgggatatttctgtgtgatatttttgctgaacgtcagcatgttcattgtggtcctggttcagctctgtcgaattaaaaagaagaagcaactgggagcccagcgaaaaaccagtattcaagacctcaggagtatcgctggccttacatttttactgggaataacttggggctttgccttctttgcctggggaccagttaacgtgaccttcatgtatctgtttgccatctttaataccttacaaggatttttcatattcatcttttactgtgtggccaaagaaaatgtcaggaagcaatggaggcggtatctttgttgtggaaagttacggctggctgaaaattctgactggagtaaaactgctactaatggtttaaagaagcagactgtaaaccaaggagtgtccagctcttcaaattccttacagtcaagcagtaactccactaactccaccacactgctagtgaataatgattgctcagtacacgcaagcgggaatggaaatgcttctacagagaggaatggggtctcttttagtgttcagaatggagatgtgtgccttcacgatttcactggaaaacagcacatgtttaacgagaaggaagattcctgcaatgggaaaggccgtatggctctcagaaggacttcaaagcggggaagcttacactttattgagcaaatgtgattcctttcttctaaaatcaaagcatgatgcttgacagtgtgaaatgtccaattttaccttttacacaatgtgagatgtatgaaaatcaactcattttattctcggcaacatctggagaagcataagctaattaagggcgatgattattattacaagaagaaaccaagacattacaccatggtttttagacatttctgatttggtttcttatctttcattttataagaaggttggttttaaacaatacactaagaatgactcctataaagaaaacaaaaaaaggtagtgaactttcagctaccttttaaagaggctaagttatctttgataacatcatataaagcaactgttgacttcagcctgttggtgagtttagttgtgcatgcctttgttgtatataagctaaattctagtgacccatgtgtcaaaaatcttacttctacatttttttgtatttattttctactgtgtaaatgtattcctttgtagaatcatggttgttttgtctcacgtgataattcagaaaatccttgctcgttccgcaaatcctaaagctccttttggagatgatataggatgtgaaatacagaaacctcagtgaaatcaagaaataatgatcccagccagactgagaaaatgtaagcagacagtgccacagttagctcatacagtgcctttgagcaagttaggaaaagatgcccccactgggcagacacagccctatgggctcatggtttgacaaacagagtggagagaccatattttagccccactcaccctcttgggtgcacgacctgtacagccaaacacagcatccaatatgaatacccatcccctgaccgcatccccagtagtcagattatagaatctgcaccaagatgtttagctttataccttggccacagagagggatgaactgtcatccagaccatgtgtcaggaaaattgtgaacgtagatgaggtacatacactgccgcttctcaaatccccagagcctttaggaacaggagagtagactaggattccttctcttaaaaaggtacatatatatggaaaaaaatcatattgccgttctttaaaaggcaactgcatggtacattgttgattgttatgactggtacactctggcccagccagagctataattgttttttaaatgtgtcttgaagaatgcacagtgacaaggggagtagctattgggaacagggaactgtcctacactgctattgttgctacatgtatcgagccttgattgctcctagttatatacagggtctatcttgcttcctacctacatctgcttgagcagtgcctcaagtacatccttattaggaacatttcaaaccccttttagttaagtctttcactaaggttctcttgcatatatttcaagtgaatgttggatctcagactaaccatagtaataatacacatttctgtgagtgctgacttgtctttgcaatatttcttttctgatttatttaattttcttgtatttatatgttaaaatcaaaaatgttaaaatcaatgaaataaatttgcagttaagatcttt

SEQ ID NO: 11644 - DNA, 4803 bp, Homo sapiens
gcgcccagcctcgccgccgccgagcgcccgacgcgccacgccgcgctgggcagctggagagctggcggcggagcgggccgggagcggcgggggcggcgccgaggccgcgggcggggggaggagggccgcagccccggagaggggaaaaggcgggccggacggcgccagcagccagccccgaggacgcgagcggcaggtgtgcacagaggttctccactttgttttctgaactcgcggtcaggatggttttctctgtcaggcagtgtggccatgttggcagaactgaagaagttttactgacgttcaagatattccttgtcatcatttgtcttcatgtcgttctggtaacatccctggaagaagatactgataattccagtttgtcaccaccacctgaggttgaaacaacaagcctcaatgatgttactttaagcttactcccttcaaacgaaacagaaaaaactaaaatcactatagtaaaaaccttcaatgcatcaggcgtcaaaccccagagaaatatctgcaatttgtcatctatttgcaatgactcagcattttttagaggtgagatcatgtttcaatatgataaagaaagcactgttccccagaatcaacatataacgaatggcaccttaactggagtcctgtctctaagtgaattaaaacgctcagagctcaacaaaaccctgcaaaccctaagtgagacttactttataatgtgtgctacagcagaggcccaaagcacattaaattgtacattcacaataaaactgaataatacaatgaatgcatgtgctgtaatagctgctttggaaagagtaaagattcgaccaatggaacactgctgctgttctgtcaggataccctgcccttcctccccagaagagttggaaaagcttcagtgtgacctgcaggatcccattgtctgtcttgctgaccatccacgtggcccaccattttcttccagccaatccatcccagtggtgcctcgggccactgtgctttcccaggtccccaaagctacctcttttgctgagcctccagattattcacctgtgacccacaatgttccctctccaataggggagattcaacccctttcaccccagccttcagctcccatagcttccagccctgccattgacatgcccccacagtctgaaacgatctcttcccctatgccccaaacccatgtctccggcaccccacctcctgtgaaagcctcattttcctctcccaccgtgtctgcccctgcgaatgtcaacactaccagcgcacctcctgtccagacagacatcgtcaacaccagcagtatttctgatcttgagaaccaagtgttgcagatggagaaggctctgtccttgggcagcctggagcctaacctcgcaggagaaatgatcaaccaagtcagcagactccttcattccccgcctgacatgctggcccctctggctcaaagattgctgaaagtagtggatgacattggcctacagctgaacttttcaaacacgactataagtctaacctccccttctttggctctggctgtgatcagagtgaatgccagtagtttcaacacaactacctttgtggcccaagaccctgcaaatcttcaggtttctctggaaacccaagctcctgagaacagtattggcacaattactcttccttcatcgctgatgaataatttaccagctcatgacatggagctagcttccagggttcagttcaatttttttgaaacacctgctttgtttcaggatccttccctggagaacctctctctgatcagctacgtcatatcatcgagtgttgcaaacctgaccgtcaggaacttgacaagaaacgtgacagtcacattaaagcacatcaacccgagccaggatgagttaacagtgagatgtgtattttgggacttgggcagaaatggtggcagaggaggctggtcagacaatggctgctctgtcaaagacaggagattgaatgaaaccatctgtacctgtagccatctaacaagcttcggcgttctgctggacctatctaggacatctgtgctgcctgctcaaatgatggctctgacgttcattacatatattggttgtgggctttcatcaatttttctgtcagtgactcttgtaacctacatagcttttgaaaagatccggagggattacccttccaaaatcctcatccagctgtgtgctgctctgcttctgctgaacctggtcttcctcctggactcgtggattgctctgtataagatgcaaggcctctgcatctcagtggctgtatttcttcattattttctcttggtctcattcacatggatgggcctagaagcattccatatgtacctggcccttgtcaaagtatttaatacttacatccgaaaatacatccttaaattctgcattgtcggttggggggtaccagctgtggttgtgaccatcatcctgactatatccccagataactatgggcttggatcctatgggaaattccccaatggttcaccggatgacttctgctggatcaacaacaatgcagtattctacattacggtggtgggatatttctgtgtgatatttttgctgaacgtcagcatgttcattgtggtcctggttcagctctgtcgaattaaaaagaagaagcaactgggagcccagcgaaaaaccagtattcaagacctcaggagtatcgctggccttacatttttactgggaataacttggggctttgccttctttgcctggggaccagttaacgtgaccttcatgtatctgtttgccatctttaataccttacaaggatttttcatattcatcttttactgtgtggccaaagaaaatgtcaggaagcaatggaggcggtatctttgttgtggaaagttacggctggctgaaaattctgactggagtaaaactgctactaatggtttaaagaagcagactgtaaaccaaggagtgtccagctcttcaaattccttacagtcaagcagtaactccactaactccaccacactgctagtgaataatgattgctcagtacacgcaagcgggaatggaaatgcttctacagagaggaatggggtctcttttagtgttcagaatggagatgtgtgccttcacgatttcactggaaaacagcacatgtttaacgagaaggaagattcctgcaatgggaaaggccgtatggctctcagaaggacttcaaagcggggaagcttacactttattgagcaaatgtgattcctttcttctaaaatcaaagcatgatgcttgacagtgtgaaatgtccaattttaccttttacacaatgtgagatgtatgaaaatcaactcattttattctcggcaacatctggagaagcataagctaattaagggcgatgattattattacaagaagaaaccaagacattacaccatggtttttagacatttctgatttggtttcttatctttcattttataagaaggttggttttaaacaatacactaagaatgactcctataaagaaaacaaaaaaaggtagtgaactttcagctaccttttaaagaggctaagttatctttgataacatcatataaagcaactgttgacttcagcctgttggtgagtttagttgtgcatgcctttgttgtatataagctaaattctagtgacccatgtgtcaaaaatcttacttctacatttttttgtatttattttctactgtgtaaatgtattcctttgtagaatcatggttgttttgtctcacgtgataattcagaaaatccttgctcgttccgcaaatcctaaagctccttttggagatgatataggatgtgaaatacagaaacctcagtgaaatcaagaaataatgatcccagccagactgagaaaatgtaagcagacagtgccacagttagctcatacagtgcctttgagcaagttaggaaaagatgcccccactgggcagacacagccctatgggctcatggtttgacaaacagagtggagagaccatattttagccccactcaccctcttgggtgcacgacctgtacagccaaacacagcatccaatatgaatacccatcccctgaccgcatccccagtagtcagattatagaatctgcaccaagatgtttagctttataccttggccacagagagggatgaactgtcatccagaccatgtgtcaggaaaattgtgaacgtagatgaggtacatacactgccgcttctcaaatccccagagcctttaggaacaggagagtagactaggattccttctcttaaaaaggtacatatatatggaaaaaaatcatattgccgttctttaaaaggcaactgcatggtacattgttgattgttatgactggtacactctggcccagccagagctataattgttttttaaatgtgtcttgaagaatgcacagtgacaaggggagtagctattgggaacagggaactgtcctacactgctattgttgctacatgtatcgagccttgattgctcctagttatatacagggtctatcttgcttcctacctacatctgcttgagcagtgcctcaagtacatccttattaggaacatttcaaaccccttttagttaagtctttcactaaggttctcttgcatatatttcaagtgaatgttggatctcagactaaccatagtaataatacacatttctgtgagtgctgacttgtctttgcaatatttcttttctgatttatttaattttcttgtatttatatgttaaaatcaaaaatgttaaaatcaatgaaataaatttgcagttaagatcttt

SEQ ID NO: 11645 - DNA, 2977 bp, Homo sapiens
attctcttgacaatgcagcacataaacacgggcattgacatgcttaaccagctgggttgtgttttctttgcaggcgtcaaaccccagagaaatatctgcaatttgtcatctatttgcaatgactcagcattttttagaggtgagatcatgtttcaatatgataaagaaagcactgttccccagaatcaacatataacgaatggcaccttaactggagtcctgtctctaagtgaattaaaacgctcagagctcaacaaaaccctgcaaaccctaagtgagacttactttataatgtgtgctacagcagaggcccaaaggcacattaaattgtacattcacaataaaactgaataatacaatgaatgcatgtgctgtaatagctgctttggaaagagtaaagattcgaccaatggaacactgctgctgttctgtcaggataccctgcccttcctccccagaagagttggaaaagcttcagtgtgacctgcaggatcccattgtctgtcttgctgaccatccacgtggcccaccattttcttccagccaatccatcccagtggtgcctcgggccactgtgctttcccaggtccccaaagctacctcttttgctgagcctccagattattcacctgtgacccacaatgttccctctccaataggggagattcaacccctttcaccccagccttcagctcccatagcttccagccctgccattgacatgcccccacagtctgaaacgatctcttcccctatgccccaaacccatgtctccggcaccccacctcctgtgaaagcctcattttcctctcccaccgtgtctgcccctgcgaatgtcaacactaccagcgcacctcctgtccagacagacatcgtcaacaccagcagtatttctgatcttgagaaccaagtgttgcagatggagaaggctctgtccttgggcagcctggagcctaacctcgcaggagaaatgatcaaccaagtcagcagactccttcattccccgcctgacatgctggcccctctggctcaaagattgctgaaagtagtggatgacattggcctacagctgaacttttcaaacacgactataagtctaacctccccttctttggctctggctgtgatcagagtgaatgccagtagtttcaacacaactacctttgtggcccaagaccctgcaaatcttcaggtttctctggaaacccaagctcctgagaacagtattggcacaattactcttccttcatcgctgatgaataatttaccagctcatgacatggagctagcttccagggttcagttcaatttttttgaaacacctgctttgtttcaggatccttccctggagaacctctctctgatcagctacgtcatatcatcgagtgttgcaaacctgaccgtcaggaacttgacaagaaacgtgacagtcacattaaagcacatcaacccgagccaggatgagttaacagtgagatgtgtattttgggacttgggcagaaatggtggcagaggaggctggtcagacaatggctgctctgtcaaagacaggagattgaatgaaaccatctgtacctgtagccatctaacaagcttcggcgttctgctggacctatctaggacatctgtgctgcctgctcaaatgatggctctgacgttcattacatatattggttgtgggctttcatcaatttttctgtcagtgactcttgtaacctacatagcttttgaaaagatccggagggattacccttccaaaatcctcatccagctgtgtgctgctctgcttctgctgaacctggtcttcctcctggactcgtggattgctctgtataagatgcaaggcctctgcatctcagtggctgtatttcttcattattttctcttggtctcattcacatggatgggcctagaagcattccatatgtacctggcccttgtcaaagtatttaatacttacatccgaaaatacatccttaaattctgcattgtcggttggggggtaccagctgtggttgtgaccatcatcctgactatatccccagataactatgggcttggatcctatgggaaattccccaatggttcaccggatgacttctgctggatcaacaacaatgcagtattctacattacggtggtgggatatttctgtgtgatatttttgctgaacgtcagcatgttcattgtggtcctggttcagctctgtcgaattaaaaagaagaagcaactgggagcccagcgaaaaaccagtattcaagacctcaggagtatcgctggccttacatttttactgggaataacttggggctttgccttctttgcctggggaccagttaacgtgaccttcatgtatctgtttgccatctttaataccttacaaggatttttcatattcatcttttactgtgtggccaaagaaaatgtcaggaagcaatggaggcggtatctttgttgtggaaagttacggctggctgaaaattctgactggagtaaaactgctactaatggtttaaagaagcagactgtaaaccaaggagtgtccagctcttcaaattccttacagtcaagcagtaactccactaactccaccacactgctagtgaataatgattgctcagtacacgcaagcgggaatggaaatgcttctacagagaggaatggggtctcttttagtgttcagaatggagatgtgtgccttcacgatttcactggaaaacagcacatgtttaacgagaaggaagattcctgcaatgggaaaggccgtatggctctcagaaggacttcaaagcggggaagcttacactttattgagcaaatgtgattcctttcttctaaaatcaaagcatgatgcttgacagtgtgaaatgtccaattttaccttttacacaatgtgagatgtatgaaaatcaactcattttattctcggcaacatctggagaagcataagctaattaagggcgatgattattattac

SEQ ID NO: 11646 - DNA, 1786 bp, Homo sapiens
cctgtcccctcagcagtgttggtttctcttcttgacttgatgcaggcacagatttatcaagctcctcagtcaacaaacacatcaccggaagaaatatggaaggaaaggaattttaaaaggaaataccaatctctgtgcaaacaaagccttgtatattcatgtttgcaccaatctactgtgagatttatgaagaaaaacaaattgcggacaactctctatgtacacttacaaatgcctcagttgatgcttgtgggctgtttgtcagcgttctgtgataatgaacacatggacttctgtttattaaattcagttgacccctttagccaattgccaggagcctggatttttacttccaactgctgatatctgtgtaaaaattgatctacatccaccctttaaaagcattgatgaattaattagaactttagacaacaaagaaaaattgaaaaagaattctcagtaaaagcgaattcgatgttcaaaacaaactacaaagagacaagacttctctgtttactttctaagaactaatataattgctaccttaaaaaggaaaaaatgaacagcacatgtattgaagaacagcatgacctggatcactatttgtttcccattgtttacatctttgtgattatagtcagcattccagccaatattggatctctgtgtgtgtctttcctgcaagcaaagaaggaaagtgaactaggaatttacctcttcagtttgtcactatcagatttactctatgcattaactctccctttatggattgattatacctggaataaagacaactggactttctctcctgccttgtgcaaagggagtgcttttctcatgtacatgaatttttacagcagcacagcattcctcacctgcattgccgttgatcggtatttggctgttgtctaccctttgaagttttttttcctaaggacaagaagatttgcactcatggtcagcctgtccatctggatattggaaaccatcttcaatgctgtcatgttgtgggaagatgaaacagttgttgaatattgcgatgccgaaaagtctaattttactttatgctatgacaaataccctttagagaaatggcaaatcaacctcaacttgttcaggacgtgtacaggctatgcaatacctttggtcaccatcctgatctgcaaccggaaagtctaccaagctgtgcggcacaataaagccacggaaaacaaggaaaagaagagaatcataaaactacttgtcagcatcacagttacttttgtcttatgctttactccctttcatgtgatgttgctgattcgctgcattttagagcatgctgtgaacttcgaagaccacagcaattctgggaagcgaacttacacaatgtatagaatcacggttgcattaacaagtttaaattgtgttgctgatccaattctgtactgttttgtaaccgaaacaggaagatatgatatgtggaatatattaaaattctgcactgggaggtgtaatacatcacaaagacaaagaaaacgcatactttctgtgtctacaaaagatactatggaattagaggtccttgagtagaaccaaggatgttttgaagggaagggaagtttaagttatgcattattatatcatcaagattacattttgaaaaggaaatctagcatgtgaggggactaagtgttctcagagtgatgttttaatccagtccaataaaaatatcttaaaactgcattgtacagctccctccctgcgttttattaaatgatgtatattaaacaaagatcaatatttt

SEQ ID NO: 11647 - DNA, 2115 bp, Homo sapiens
gtgactgcgcctctgcgcccgcgtcttgccgcggctcccgggatgcgcggaggcggtggcgatggcgatgatgcctctagtcctgcatcatccagagcggcaggcggagctggggtccggactgcgagatggaggaggggcggcgctgcggccacccggcaggcttatctgtcttgggcctcttttgtcacatattgctcatctgtgagctgaggccctgactcactgagtatttttggggagcagaagaaggagacatttctctccgaaaatgaactcaacaggccaccttcaggatgcccccaatgccacctcgctccatgtgcctcactcacaggaaggaaacagcacctctctccaggagggtcttcaggatctcatccacacagccaccttggtgacctgtacttttctactggcggtcatcttctgcctgggttcctatggcaacttcattgtcttcttgtccttcttcgatccagccttcaggaaattcagaaccaactttgatttcatgatcctgaacctgtccttctgtgacctcttcatttgtggagtgacagcccccatgttcacctttgtgttattcttcagctcagccagtagtatcccggatgctttctgcttcactttccatctcaccagttcaggcttcatcatcatgtctctgaagacagtggcagtgatcgccctgcaccggctccggatggtgttggggaaacagcctaatcgcacggcctcctttccctgcaccgtactcctcaccctgcttctctgggccaccagtttcacccttgccaccttggctaccttgaaaaccagcaagtcccacctctgtcttcccatgtccagtctgattgctggaaaagggaaagccattttgtctctctatgtggtcgacttcaccttctgtgttgctgtggtctctgtctcttacatcatgattgctcagaccctgcggaagaacgctcaagtcagaaagtgcccccctgtaatcacagtcgatgcttccagaccacagcctttcatgggggtccctgtgcagggaggtggagatcccatccagtgtgccatgccggctctgtataggaaccagaattacaacaaactgcagcacgttcagacccgtggatataccaagagtcccaaccaactggtcacccctgcagcaagccgactccagctcgtatcagccatcaacctctccactgccaaggattccaaagccgtggtcacctgtgtgatcattgtgctgtcagtcctggtgtgctgtcttccactggggatttccttggtacaggtggttctctccagcaatgggagcttcattctttaccagtttgaattgtttggatttactcttatatttttcaagtcaggattaaacccttttatatattctcggaacagtgcagggctgagaaggaaagtgctctggtgcctccaatacataggcctgggttttttctgctgcaaacaaaagactcgacttcgagccatgggaaaagggaacctcgaagtcaacagaaacaaatcctcccatcatgaaacaaactctgcctacatgttatctccaaagccacagaagaaatttgtggaccaggcttgtggcccaagtcattcaaaagaaagtatggtgagtcccaagatctctgctggacatcaacactgtggtcagagcagctcgacccccatcaacactcggattgaaccttactacagcatctataacagcagcccttcccaggaggagagcagcccatgtaacttacagccagtaaactcttttggatttgccaattcatatattgccatgcattatcacaccactaatgacttagtgcaggaatatgacagcacttcagccaagcagattccagtcccctccgtttaaagtcatggaggctataggatcttatgtaaacagtttttgtttctgatagtaatggactttattctaacttgagatcagtggcggatcaaaacctacaagattcaactgaaaagttggcagttatggttttctttcatctgatgtgtcagtatctgttgatttgctttgtagtttgttgacatcttaagatttgatgtgaaagttttagattttttaccctg

SEQ ID NO: 11648 - DNA, 1694 bp, Homo sapiens
agaagcgcgcagagtcccatcctgccacgccacgaggagagaagaaggaaagatacagtgttaggaaagagacctccctcgcccctacgccccgcgcccctgcgcctcgcttcagcctcaggacagtcctgccgggacggtgagcgcattcagcaccctggacagcaccgcggttgcgctgcctccagggcggccccgggctgctcctgctccgcagagctacgccctccccccgggtgccccggaccctgcacttgccgccgctttcctcgcgctgctctggaccttgctagccggctctgcacctcccagaagccgtgggcgcgccgctcagctgctccatcgcctcactttcccaggctcgcgcccgaagcagagccatgagaaccccagggtgcctggcgagccgctagcgccatgggccccggcgaggcgctgctggcgggtctcctggtgatggtactggccgtggcgctgctatccaacgcactggtgctgctttgttgcgcctacagcgctgagctccgcactcgagcctcaggcgtcctcctggtgaatctgtctctgggccacctgctgctggcggcgctggacatgcccttcacgctgctcggtgtgatgcgcgggcggacaccgtcggcgcccggcgcatgccaagtcattggcttcctggacaccttcctggcgtccaacgcggcgctgagcgtggcggcgctgagcgcagaccagtggctggcagtgggcttcccactgcgctacgccggacgcctgcgaccgcgctatgccggcctgctgctgggctgtgcctggggacagtcgctggccttctcaggcgctgcacttggctgctcgtggcttggctacagcagcgccttcgcgtcctgttcgctgcgcctgccgcccgagcctgagcgtccgcgcttcgcagccttcaccgccacgctccatgccgtgggcttcgtgctgccgctggcggtgctctgcctcacctcgctccaggtgcaccgggtggcacgcagacactgccagcgcatggacaccgtcaccatgaaggcgctcgcgctgctcgccgacctgcaccccagtgtgcggcagcgctgcctcatccagcagaagcggcgccgccaccgcgccaccaggaagattggcattgctattgcgaccttcctcatctgctttgccccgtatgtcatgaccaggctggcggagctcgtgcccttcgtcaccgtgaacgcccagtggggcatcctcagcaagtgcctgacctacagcaaggcggtggccgacccgttcacgtactctctgctccgccggccgttccgccaagtcctggccggcatggtgcaccggctgctgaagagaaccccgcgcccagcatccacccatgacagctctctggatgtggccggcatggtgcaccagctgctgaagagaaccccgcgcccagcgtccacccacaacggctctgtggacacagagaatgattcctgcctgcagcagacacactgagggcctggcagggctcatcgcccccaccttctaagaagccctgtggaaagggcactggccctgccacagagatgccactggggacccccagacaccagtggcttgactttgagctaaggctgaagtacaggaggaggaggaggagagggccggatgtgggtgtggacagcagtagtggcggagga

SEQ ID NO: 11649 - DNA, 3349 bp, Homo sapiens
agttggtgtcatgcaagaatctattcacactgactaaagatattggaagagtgaagatcagagaattttaagtctgaaatttggcatcactgccctgaacaatataaccttagttggcataaactactcatacagacaaaggcattatccatcacaataagtaactttttgtctttatttcaaccggacaatcgtgattagaaaagctcctgtgacaaaattcaagaaaacctgacataaatgaacaacaatacaacatgtattcaaccatctatgatctcttccatggctttaccaatcatttacatcctcctttgtattgttggtgtttttggaaacactctctctcaatggatatttttaacaaaaataggtaaaaaaacatcaacgcacatctacctgtcacaccttgtgactgcaaacttacttgtgtgcagtgccatgcctttcatgagtatctatttcctgaaaggtttccaatgggaatatcaatctgctcaatgcagagtggtcaattttctgggaactctatccatgcatgcaagtatgtttgtcagtctcttaattttaagttggattgccataagccgctatgctaccttaatgcaaaaggattcctcgcaagagactacttcatgctatgagaaaatattttatggccatttactgaaaaaatttcgccagcccaactttgctagaaaactatgcatttacatatggggagttgtactgggcataatcattccagttaccgtatactactcagtcatagaggctacagaaggagaagagagcctatgctacaatcggcagatggaactaggagccatgatctctcagattgcaggtctcattggaaccacatttattggattttcctttttagtagtactaacatcatactactcttttgtaagccatctgagaaaaataagaacctgtacgtccattatggagaaagatttgacttacagttctgtgaaaagacatcttttggtcatccagattctactaatagtttgcttccttccttatagtatttttaaacccattttttatgttctacaccaaagagataactgtcagcaattgaattatttaatagaaacaaaaaacattctcacctgtcttgcttcggccagaagtagcacagaccccattatatttcttttattagataaaacattcaagaagacactatataatctctttacaaagtctaattcagcacatatgcaatcatatggttgacttttgaatggaaaaccccacaatattaagaaaagcattcatgtgactttattagggacactaaactacatcattaacatgtcacagcttggttgacaataatcaccaagaaaatctctttggtttttaaaaataaataaacatatattcataaaactcaaaaaacagttatactgaacgttgagatggcagaaactttcagaagcaaaaattaagcatattgaaaggatcccactcatatgaaactaacaggctgttttctgtttaaactcaactgtcagtgcttctgttcagaacacgttatttcatgactaggataaagaagcaaatggtttatgacttgtctgctttctggtagttagaatacaagggtcaatctatggctagtgtttattggtaattttaaaatctttaaaaataagtagctgggcacagtggcttacgcctgtaatcccagcactttgggaggctgaggtgggtggatcattttgaggtcaggagttcaagaccagcctgggcaacatggtgaaaccctgtctctactaaaaatacaaaaatcagctggacatggtggtgggcgcctgtaatcccagctactcgggaggctgaggcaggagaatcgcttgagcccgggacggaggttgcagtgagcggagatcgtgccactgcactacagcctgggaggcagagcgagactctgtctcataaaacaaaacaaaaaaataaaaataagtaaaaaaataaataagaaatatcctcattcacatcttacctaaatgcatgaataatacagtgaaaaaaatccaaggttttataaacatattatttatttgaaattatctggctcatgttattggggagaagcaatattcattgactatatttttaaagcagatgatacttataaaaatgcttaaatatttggattaggctttgtcaaagtaaaaagctatgtcattatatgcccatcttcatcacattgtgcatattttcttctgtattcaatataaataatgttattagtgacaaacagtacctggcagttaattttttgtgaaataaatgaatgaataataagggagtgtaatagtattgcagttaagagattgatctctgaagttatacttcttgggttcaatctggctctactttttatttagctggacaatcttaggcaaattaacttatcctctgtacgtgttaatttcttcatttgtagagcagaaaatactatcttatttacagatcctattattaaatcagctgttactattatgagtagctaacgcttagtaagcacttgctgtttgccaagcattctacttatatgctttacatatattattttaatcaccacaactctaaagtatactaatttactgatgaaaatattgaagtgggctgggtgcggtggctcatgcctgtaatcccagcactctgggaggccgaggtgggcagatcacctgaggtcaggagttcgagactagcctggccaacatggcgaaacccacctctactaaaaatacaaaaattagctgggcgtggtggtgtgtgcctgtagtcccagctacttgggaggctgaggcagaagaatcacttgaactcgggaggctgaggcaggagaatcacttgaactcaggaggcggaggttgcagtgagccaagatcatgccattgcactccagcctgggcgacagagtgagactctgtctcaaaaaaaaaaaaaaaaaaaaaaaaaaaaaaaaatatatatatatatatatatatatatgtatgtatgtatgtatatgtgcatagttaagtaaatcaccccaattttttctaatatttaagtgaacatttaaagataagcatttcttaatgttaatttcttttctttcatgtaatcttgtcagtagacaaatgatggtgactatattctgtaataagtacatatattatgattaaaaaaaaaagcgtgtactatctgcccaaagagatcataagcactttggagctataaacttcttgtctatttctacttccatggtactgatattctcttctcagataaccaaacaaaaacagctgaataaaatcaaccattaatagtaacttgc

SEQ ID NO: 11650 - DNA, 4282 bp, Homo sapiens
gtgccgaccgcgggctggtggcgggcggcgcggtgctccgcgcgtccgggctccctggctcctcgggacggccttgtatgctgtgcgccccgcaccccggctgcgcgctccgatcccagcgggaggggacgcccggcccgcaggctcccaggggaggggtggctcctgcaaaatggtccctcacctcttgctgctctgtctcctccccttggtgcgagccaccgagccccacgagggccgggccgacgagcagagcgcggaggcggccctggccgtgcccaatgcctcgcacttcttctcttggaacaactacaccttctccgactggcagaactttgtgggcaggaggcgctacggcgctgagtcccagaaccccacggtgaaagccctgctcattgtggcttactccttcatcattgtcttctcactctttggcaacgtcctggtctgtcatgtcatcttcaagaaccagcgaatgcactcggccaccagcctcttcatcgtcaacctggcagttgccgacataatgatcacgctgctcaacacccccttcactttggttcgctttgtgaacagcacatggatatttgggaagggcatgtgccatgtcagccgctttgcccagtactgctcactgcacgtctcagcactgacactgacagccattgcggtggatcgccaccaggtcatcatgcaccccttgaaaccccggatctcaatcacaaagggtgtcatctacatcgctgtcatctggaccatggctacgttcttttcactcccacatgctatctgccagaaattatttaccttcaaatacagtgaggacattgtgcgctccctctgcctgccagacttccctgagccagctgacctcttctggaagtacctggacttggccaccttcatcctgctctacatcctgcccctcctcatcatctctgtggcctacgctcgtgtggccaagaaactgtggctgtgtaatatgattggcgatgtgaccacagagcagtactttgccctgcggcgcaaaaagaagaagaccatcaagatgttgatgctggtggtagtcctctttgccctctgctggttccccctcaactgctacgtcctcctcctgtccagcaaggtcatccgcaccaacaatgccctctactttgccttccactggtttgccatgagcagcacctgctataaccccttcatatactgctggctgaacgagaacttcaggattgagctaaaggcattactgagcatgtgtcaaagacctcccaagcctcaggaggacaggccaccctccccagttccttccttcagggtggcctggacagagaagaatgatggccagagggctccccttgccaataacctcctgcccacctcccaactccagtctgggaagacagacctgtcatctgtggaacccattgtgacgatgagttagaagaggttgggaagagggagtgggaggggtctgtctccacctgaggcagggaaagagagcctattctcacacatgatcttcagagtgctggaaacacactcctgcagaagctgtaggactcttgaattcctaggaaactgtccagcctcctagccccatgtgatgtgaaaactaaaaggcaccaccaactagacatgtgttcataaattcccatctaagaaacactgggaggcacagcagcctgtatctctgaggaagaggagcgaggacaacgttggcccagatgggggctgaatcattcaactgcctccatctgtggggcagctgctgccttacagcccttcctactgctgagcatccctaagggagacctaaatcatactttgggtgtggtgacccagatgcacagagctctgcttgaaacaggtacacgggccagggaaatgccagcaagccagagcgggcgtggagatttttatgcctcactttctggagtcactgggccatgatgaatcataagtcttcagtggcctagcaatatccagataagaaaggaccaacttgggttccttaaaacaaagggaaattattattgccacttagaaaaattcagaaaagcacacactcacatacacacacacaaaatcactctcttatcccatccatttgtgataacatctgtgaacatgctgtggctctatttgcaacattttccttcgtgtgtgtgattgtgtgcatgtgtgcatgaccttttttttttctttttttttttttttttgagatggaatctcgctctgtcacccaggttggagttcagtggcacaatctcggctcactgcaagctctgcctcccaggttcatgccgttctcctgcctcagcctccctagtagctgggactacaggtgcccgccaccatgcccggctaatcttttgcatttttagtagagacggggtttcaccgtgttagccaggatggtctcgatctcctgacctcgtgatccacctgcctaggcctcccaaagtgttgggattacaggcgtgagccaccccgcccggcccttttttttcatttatactttttcatttagattgtaatgattaacagaaacaggggtacctttcccaggggtgtccaccagaagagttgaagaagaggtgagaagatcccaaggtgaagcctgtcaccacgcagacagaactgccccctattgtagacagtggtgggaagggcctggctcacatgcccctccttagaggcagcctcaagatgaaccagggaatcaaactcaaccaggaggcatgattccttctctcctgcaattgcacaaaaacaagtggtggtgaaacattgttctgttttcacaagagatgagggagcaggctttccaatatgctggaagtaattgtgcttagacacctcatcctcccaagctgtctagaaaggccatttcgctgtgttgtctaaataatgagggttttttcacaccatttctcaaaaggagattcgctgtcaacatcattttggtggttcaggtgtaactttcacttacagaaacttatgcatccttaagagatctcaattcttaagggtctaacttgccagagaaatctcattccagggactgattgtttttatcaccttctgtctggtcctgagtgactcactgtgtcacccagaaaagagacctgtcaggcagaatcgagcttaattcacctgctctaaacaattgttactgacacactgcttttaggttttcttctagcaccagataaactctgaaatcaaagcatggatatgagctcagtaggaaactaaggtttgagggagaaagagtttgtcacttagacctcttggctgttaactgaaactgaacttgctcacatcatctgcttccctgtaatgaactatgagggttctttatcctagtttctatttatgaagatggttgaaaattttcaagacacaagattttgaaaactcactgaattatgggcaaaaccatgactttcattgggcagacagagtcttctaagcccacagggatccccagatggatttttcaggacaaatggctcatgtgcctgtacttattgtctctgtggtgtgtcaagaagtagctaatggtttcatctgaaagctgccatagaaattctgtgaaccagaatgagacaaggcagcaggcatacagaaggtttgtcctgctctgggaagcatggaggatgttgtacttcactcctctctgagggtgtctaggaatacagaagctccttgacttacatctcaataaacccatcgtaagtccaaaatattggaagttgaaaatgcattgaatacacccaacctactgaacatcgtagcttagccaagcctaccttaaatgctctgagaacacttatattagcctacagctgggaaaaatcatttaacacaaagcctatcttctaatgaagtatggaatatctcatgtaatttattgaatactgtactgaaggtgaaaaccagaatggttgtatggatatgcgaagtatggtttctactgaatgtgtattgctttcccatcatcataaaatttttaaaaatcctaagttgaatcattgttagtccgggaccttcagtactgccaagtcccagagaaaacccttttactctggggagaacccactgatggctcattagatctgtcccttccccgaggtccgtgtgtgactttgagcaaaaagtgacttctttttgtgaatgtaaaatttgtgaaacttgagtttttccaatgtgctgtaaagtgttttattgtaaattgctcatctcaataaaatttacttcaggtttgtggactgtg

SEQ ID NO: 11651 - DNA, 1497 bp, Homo sapiens
taactgtccaccagaaaggactgctctttgggtgagttgaacttcttccattatagaaagaattgaaggctgagaaactcagcctctatcatgtggaacagctctgacgccaacttctcctgctaccatgagtctgtgctgggctatcgttatgttgcagttagctggggggtggtggtggctgtgacaggcaccgtgggcaatgtgctcaccctactggccttggccatccagcccaagctccgtacccgattcaacctgctcatagccaacctcacactggctgatctcctctactgcacgctccttcagcccttctctgtggacacctacctccacctgcactggcgcaccggtgccaccttctgcagggtatttgggctcctcctttttgcctccaattctgtctccatcctgaccctctgcctcatcgcactgggacgctacctcctcattgcccaccctaagctttttccccaagttttcagtgccaaggggatagtgctggcactggtgagcacctgggttgtgggcgtggccagctttgctcccctctggcctatttatatcctggtacctgtagtctgcacctgcagctttgaccgcatccgaggccggccttacaccaccatcctcatgggcatctactttgtgcttgggctcagcagtgttggcatcttctattgcctcatccaccgccaggtcaaacgagcagcacaggcactggaccaatacaagttgcgacaggcaagcatccactccaaccatgtggccaggactgatgaggccatgcctggtcgtttccaggagctggacagcaggttagcatcaggaggacccagtgaggggatttcatctgagccagtcagtgctgccaccacccagaccctggaaggggactcatcagaagtgggagaccagatcaacagcaagagagctaagcagatggcagagaaaagccctccagaagcatctgccaaagcccagccaattaaaggagccagaagagctccggattcttcatcggaatttgggaaggtgactcgaatgtgttttgctgtgttcctctgctttgccctgagctacatccccttcttgctgctcaacattctggatgccagagtccaggctccccgggtggtccacatgcttgctgccaacctcacctggctcaatggttgcatcaaccctgtgctctatgcagccatgaaccgccaattccgccaagcatatggctccattttaaaaagagggccccggagtttccataggctccattagaactgtgaccctagtcaccagaattcaggactgtctcctccaggaccaaagtggccaggtaataggagaataggtgaaataacacatgtgggcattttcacaacaatctctccccagcctcccaaatcaagtctctccatcacttgatcaatgtttcagccctagactgcccaaggagtattattaattattaataaatgaattctgtgcttttaa

SEQ ID NO: 11652 - DNA, 2041 bp, Homo sapiens
cctgcttgaagcctaactgtccaccagaaaggactgctctttgggtgagttgaacttcttccattatagaaagaattgaaggctgagaaactcaggtaagcacttttgttgtgggtatacttttaccttcttggtctcctcatctcccaggtggtaacaaacagaaatgactaaagcctatatgtgtgtgtagtggaaaggagcagagggaactgaatacagagaggatcctgaatacacgatgctgaatagagagaggggactcctgggggtctttggggatggggaaggaattaaaaaagttggagggcactgggtttactgagagcagcgggatggatatagaagaggactgaggtttggagcagaataagactaagatatttaggcaagagatatttagataaaaacttggggaaatatttgagaatgggaaaggactaagagaacctaaggagagagttagggatcttgagatgaagaggcctgggaatggttcaggaggatactgaattaaggtgaggtccaggaacagtttagatgtccagggtcccagaactgttcaagagatctaagttgaatgctaggttctgattccctcttcctcttccaccctctgcctctttagcctctatcatgtggaacagctctgacgccaacttctcctgctaccatgagtctgtgctgggctatcgttatgttgcagttagctggggggtggtggtggctgtgacaggcaccgtgggcaatgtgctcaccctactggccttggccatccagcccaagctccgtacccgattcaacctgctcatagccaacctcacactggctgatctcctctactgcacgctccttcagcccttctctgtggacacctacctccacctgcactggcgcaccggtgccaccttctgcagggtatttgggctcctcctttttgcctccaattctgtctccatcctgaccctctgcctcatcgcactgggacgctacctcctcattgcccaccctaagctttttccccaagttttcagtgccaaggggatagtgctggcactggtgagcacctgggttgtgggcgtggccagctttgctcccctctggcctatttatatcctggtacctgtagtctgcacctgcagctttgaccgcatccgaggccggccttacaccaccatcctcatgggcatctactttgtgcttgggctcagcagtgttggcatcttctattgcctcatccaccgccaggtcaaacgagcagcacaggcactggaccaatacaagttgcgacaggcaagcatccactccaaccatgtggccaggactgatgaggccatgcctggtcgtttccaggagctggacagcaggttagcatcaggaggacccagtgaggggatttcatctgagccagtcagtgctgccaccacccagaccctggaaggggactcatcagaagtgggagaccagatcaacagcaagagagctaagcagatggcagagaaaagccctccagaagcatctgccaaagcccagccaattaaaggagccagaagagctccggattcttcatcggaatttgggaaggtgactcgaatgtgttttgctgtgttcctctgctttgccctgagctacatccccttcttgctgctcaacattctggatgccagagtccaggctccccgggtggtccacatgcttgctgccaacctcacctggctcaatggttgcatcaaccctgtgctctatgcagccatgaaccgccaattccgccaagcatatggctccattttaaaaagagggccccggagtttccataggctccattagaactgtgaccctagtcaccagaattcaggactgtctcctccaggaccaaagtggccaggtaataggagaataggtgaaataacacatgtgggcattttcacaacaatctctccccagcctcccaaatcaagtctctccatcacttgatcaatgtttcagccctagactgcccaaggagtattattaattattaataaatgaattctgtgctttt

SEQ ID NO: 11653 - DNA, 3045 bp, Homo sapiens
tattttactgctgtctcaagatcagattattactgtagagaagatttttattttttgtttcattaacagattattataaagcaaaaagcatgcagaaaaagaagcagacgttttacattgggaattaatgaaagcgtgtctgctagttttgggtaggagaactgggaagttgttgcttaaaattttatatcacctccacaaacaaaactcttcggaaatggtaaaataagaaaatgcatgattctagaggcattcctaagcacccacgtgtcaggctttgtggtgtctgtggtatcatccgaccgtttggactggttagggcttactgagagctccatttctggaaagccttacaagactgaggaatatcagactgcgaatcaccgggaacggttcctttgcagcacagaagcaatctctctccccatcttcgcatattctgatggcaaaacaagtggaagaaaagaggaagcatgactgcagatcagatcagttctctttgtggattatattttcagtaaaatgtatggatctatcttttccttgttcttatatctagatcatgagacttgactgaggctgtatccttatcctccatccatctatggcgaactatagccatgcagctgacaacattttgcaaaatctctcgcctctaacagcctttctgaaactgacttccttgggtttcataataggagtcagcgtggtgggcaacctcctgatctccattttgctagtgaaagataagaccttgcatagagcaccttactacttcctgttggatctttgctgttcagatatcctcagatctgcaatttgtttcccatttgtgttcaactctgtcaaaaatggttctacctggacttatgggactctgacttgcaaagtgattgcctttctgggggttttgtcctgtttccacactgctttcatgctcttctgcatcagtgtcaccagatatttagctatcgcccatcaccgcttctatacaaagaggctgaccttttggacgtgtctggctgtgatctgtatggtgtggactctgtctgtggccatggcatttcccccggttttagacgtgggcacttactcattcattagggaggaagatcaatgcaccttccaacaccgctccttcagggctaatgattccttaggatttatgctgcttcttgctctcatcctcctagccacacagcttgtctacctcaagctgatatttttcgtccacgatcgaagaaaaatgaagccagtccagtttgtagcagcagtcagccagaactggacttttcatggtcctggagccagtggccaggcagctgccaattggctagcaggatttggaaggggtcccacaccacccaccttgctgggcatcaggcaaaatgcaaacaccacaggcagaagaaggctattggtcttagacgagttcaaaatggagaaaagaatcagcagaatgttctatataatgacttttctgtttctaaccttgtggggcccctacctggtggcctgttattggagagtttttgcaagagggcctgtagtaccagggggatttctaacagctgctgtctggatgagttttgcccaagcaggaatcaatccttttgtctgcattttctcaaacagggagctgaggcgctgtttcagcacaacccttctttactgcagaaaatccaggttaccaagggaaccttactgtgttatatgagggagcatctgtaaatctttagccttgtgaaaactaaccttctctgctgagcaattgtggcccatagccatattttgagaagaaattcaagaatggaatcagcagttttaaggatttgggcaacattctgcagtctttgcaatagttcacctataatcctattttaaatctcagagtgatcctgctgactgccagcaaaggtttgtaattaagaagggactgaaccactgccctaagtttctttatgtggtcaaaaactagataatgaaagtagcaggtgctaagtatcagtgctaaatgctctgtatgtcactacatatgaaaaaacatcaaaaaacaattagcattggacatcttaataaattaagttgacatgaggtaaatgtgttgataaaaactaattttagaagtttgaagactttaaaacatttcatactactattgttttgcaaagactaaaatatttggggacttaaagtactgtaatccactaaagacgtgccaatgaattattggaatatcacactttaaaaaccgccttgtaagttctggggagcattccaaagcagtatattggttccaattagagtttactttttttgtattaatacattgctatttctaaataccactttcctcatctactagtaagattgctagcattgaactgtattatgtggtttttgttgatttggtataaagtttttccaattcatttatattttacaaatgctagatattggtctgggaggcaacattaatggtaccagcctgtcacaactgagcagttctaataatgcagaataaatacatgttgccttaaagggttatctagtatccttcatcttatttagcactggagcaaatagccaagggaaatcaaatcagtaactggtcatggtcatgcatctaaaagtgcatggaagatcatttattactttttccttttttctcacatggtttgaaacttaaagtgcacatcactgaaataatgagattttcttctacggtgtgctaccctttctaaactgttctaagaagcaggcagttgatgtatgtttatattttaagtcagctgtcaaggggagaccacagccttagtatgacatcctgcacaatttgtgaagcatttattctactgaaggcacagtcttgtttatactttctgcacattcagtgtattggtaatttaaattatttcagttttaacttgtgaaagcttatattatgatttctggtattttagaaatacattagagtctgtgagtctcattctttaagatacagatgtgtgaacttcaatataaagttgcatttgccaaaattta

SEQ ID NO: 11654 - DNA, 2895 bp, Homo sapiens
cgccgccgagccctgcctggatgctcagtcaaggcactaaggcaaaaaaaaaaaaaaaaaaaacaaaaaacaaaaaaaaaaaaaaaaaaaagaaaaagaaaaaaagaaaaaaatcagcaatttatagaaagaagctatagtctgtcgggatatccaacaccaacagtagggcttactgagagctccatttctggaaagccttacaagactgaggaatatcagactgcgaatcaccgggaacggttcctttgcagcacagaagcaatctctctccccatcttcgcatattctgatggcaaaacaagtggaagaaaagaggaagcatgactgcagatcagatcagttctctttgtggattatattttcagtaaaatgtatggatctatcttttccttgttcttatatctagatcatgagacttgactgaggctgtatccttatcctccatccatctatggcgaactatagccatgcagctgacaacattttgcaaaatctctcgcctctaacagcctttctgaaactgacttccttgggtttcataataggagtcagcgtggtgggcaacctcctgatctccattttgctagtgaaagataagaccttgcatagagcaccttactacttcctgttggatctttgctgttcagatatcctcagatctgcaatttgtttcccatttgtgttcaactctgtcaaaaatggttctacctggacttatgggactctgacttgcaaagtgattgcctttctgggggttttgtcctgtttccacactgctttcatgctcttctgcatcagtgtcaccagatatttagctatcgcccatcaccgcttctatacaaagaggctgaccttttggacgtgtctggctgtgatctgtatggtgtggactctgtctgtggccatggcatttcccccggttttagacgtgggcacttactcattcattagggaggaagatcaatgcaccttccaacaccgctccttcagggctaatgattccttaggatttatgctgcttcttgctctcatcctcctagccacacagcttgtctacctcaagctgatatttttcgtccacgatcgaagaaaaatgaagccagtccagtttgtagcagcagtcagccagaactggacttttcatggtcctggagccagtggccaggcagctgccaattggctagcaggatttggaaggggtcccacaccacccaccttgctgggcatcaggcaaaatgcaaacaccacaggcagaagaaggctattggtcttagacgagttcaaaatggagaaaagaatcagcagaatgttctatataatgacttttctgtttctaaccttgtggggcccctacctggtggcctgttattggagagtttttgcaagagggcctgtagtaccagggggatttctaacagctgctgtctggatgagttttgcccaagcaggaatcaatccttttgtctgcattttctcaaacagggagctgaggcgctgtttcagcacaacccttctttactgcagaaaatccaggttaccaagggaaccttactgtgttatatgagggagcatctgtaaatctttagccttgtgaaaactaaccttctctgctgagcaattgtggcccatagccatattttgagaagaaattcaagaatggaatcagcagttttaaggatttgggcaacattctgcagtctttgcaatagttcacctataatcctattttaaatctcagagtgatcctgctgactgccagcaaaggtttgtaattaagaagggactgaaccactgccctaagtttctttatgtggtcaaaaactagataatgaaagtagcaggtgctaagtatcagtgctaaatgctctgtatgtcactacatatgaaaaaacatcaaaaaacaattagcattggacatcttaataaattaagttgacatgaggtaaatgtgttgataaaaactaattttagaagtttgaagactttaaaacatttcatactactattgttttgcaaagactaaaatatttggggacttaaagtactgtaatccactaaagacgtgccaatgaattattggaatatcacactttaaaaaccgccttgtaagttctggggagcattccaaagcagtatattggttccaattagagtttactttttttgtattaatacattgctatttctaaataccactttcctcatctactagtaagattgctagcattgaactgtattatgtggtttttgttgatttggtataaagtttttccaattcatttatattttacaaatgctagatattggtctgggaggcaacattaatggtaccagcctgtcacaactgagcagttctaataatgcagaataaatacatgttgccttaaagggttatctagtatccttcatcttatttagcactggagcaaatagccaagggaaatcaaatcagtaactggtcatggtcatgcatctaaaagtgcatggaagatcatttattactttttccttttttctcacatggtttgaaacttaaagtgcacatcactgaaataatgagattttcttctacggtgtgctaccctttctaaactgttctaagaagcaggcagttgatgtatgtttatattttaagtcagctgtcaaggggagaccacagccttagtatgacatcctgcacaatttgtgaagcatttattctactgaaggcacagtcttgtttatactttctgcacattcagtgtattggtaatttaaattatttcagttttaacttgtgaaagcttatattatgatttctggtattttagaaatacattagagtctgtgagtctcattctttaagatacagatgtgtgaacttcaatataaagttgcatttgccaaaattta

SEQ ID NO: 11655 - DNA, 591 bp, Homo sapiens
aaaaaaaaaaaaaaaaaagaaaaagaaaaaaagaaaaaaatcagcaatttatagaaagaagctatagtctgtcgggatatccaacaccaacagggcttactgagagctccatttctggaaagccttacaagactgaggaatatcagactgcgaatcaccgggaacggttcctttgcagcacagaagcaatctctctccccatcttcgcatattctgatggcaaaacaagtggaagaaaagaggaagcatgactgcagatcagatcagttctctttgtggattatattttcagtaaaatgtatggatctatcttttccttgttcttatatctagatcatgagacttgactgaggctgtatccttatcctccatccatctatggcgaactatagccatgcagctgacaacattttgcaaaatctctcgcctctaacagcctttctgaaactgacttccttgggtttcataataggagtcagcgtggtgggcaacctcctgatctccattttgctagtgaaagataagaccttgcatagagcaccttactacttcctgttggatctttgctgttcagatatcctcagatctgca

SEQ ID NO: 11656 - DNA, 1630 bp, Homo sapiens
atatccaacaccaacaggtaggaggatatactcttggttaagtttgggggatgtgggggaatgcacagtgttgatgaaactgcaggttcaccgagaaagagccctccctcaggttgtgtgtgtgtgtgtgtgtgtgtgtgtctctgtgtgtgtgtgtgtgtgtgtgtgtgtatgtgttttgtgacaataaactgcataatggaagtacattcagacaatgcatcttcagtagggcttactgagagctccatttctggaaagccttacaagactgaggaatatcagactgcgaatcaccgggaacggttcctttgcagcacagaagcaatctctctccccatcttcgcatattctgatggcaaaacaagtggaagaaaagaggaagcatgactgcagatcagatcagttctctttgtggattatattttcagtaaaatgtatggatctatcttttccttgttcttatatctagatcatgagacttgactgaggctgtatccttatcctccatccatctatggcgaactatagccatgcagctgacaacattttgcaaaatctctcgcctctaacagcctttctgaaactgacttccttgggtttcataataggagtcagcgtggtgggcaacctcctgatctccattttgctagtgaaagataagaccttgcatagagcaccttactacttcctgttggatctttgctgttcagatatcctcagatctgcaatttgtttcccatttgtgttcaactctgtcaaaaatggttctacctggacttatgggactctgacttgcaaagtgattgcctttctgggggttttgtcctgtttccacactgctttcatgctcttctgcatcagtgtcaccagatatttagctatcgcccatcaccgcttctatacaaagaggctgaccttttggacgtgtctggctgtgatctgtatggtgtggactctgtctgtggccatggcatttcccccggttttagacgtgggcacttactcattcattagggaggaagatcaatgcaccttccaacaccgctccttcagggctaatgattccttaggatttatgctgcttcttgctctcatcctcctagccacacagcttgtctacctcaagctgatatttttcgtccacgatcgaagaaaaatgaagccagtccagtttgtagcagcagtcagccagaactggacttttcatggtcctggagccagtggccaggcagctgccaattggctagcaggatttggaaggggtcccacaccacccaccttgctgggcatcaggcaaaatgcaaacaccacaggcagaagaaggctattggtcttagacgagttcaaaatggagaaaagaatcagcagaatgttctatataatgacttttctgtttctaaccttgtggggcccctacctggtggcctgttattggagagtttttgcaagagggcctgtagtaccagggggatttctaacagctgctgtctggatgagttttgcccaagcaggaatcaatccttttgtctgcattttctcaaacagggagctgaggcgctgtttcagcacaacccttctttactgcagaaaatccaggttaccaagggaaccttactgtgttatatga

SEQ ID NO: 11657 - DNA, 582 bp, Homo sapiens
aatttatagaaagaagctatagtctgtcgggatatccaacaccaacagatattctgatggcaaaacaagtggaagaaaagaggaagcatgactgcagatcagatcagttctctttgtggattatattttcagtaaaatgtatggatctatcttttccttgttcttatatctagatcatgagacttgactgaggctgtatccttatcctccatccatctatggcgaactatagccatgcagctgacaacattttgcaaaatctctcgcctctaacagcctttctgaaactgacttccttgggtttcataataggagtcagcgtggtgggcaacctcctgatctccattttgctagtgaaagataagaccttgcatagagcaccttactacttcctgttggatctttgctgttcagatatcctcagatctgcaatttgtttcccatttgtgttcaactctgtcaaaaatggttctacctggacttatgggactctgacttgcaaagtgattgcctttctgggggttttgtcctgtttccacactgctttcatgctcttctgcatcagtgtcaccagatatttag

SEQ ID NO: 11658 - DNA, 4933 bp, Homo sapiens
aatctcaccacccagcaatgaggtattttactgctgtctcaagatcagattattactgtagagaagatttttattttttgtttcattaacagattattataaagcaaaaagcatgcagaaaaagaagcagacgttttacattgggaattaatgaaagcgtgtctgctagttttgggtaggagaactgggaagttgttgcttaaaattttatatcacctccacaaacaaaactcttcggaaatggtaaaataagaaaatgcatgattctagaggcattcctaagcacccacgtgtcaggctttgtggtgtctgtggtatcatccgaccgtttggactggtggcttactgagagctccatttctggaaagccttacaagactgaggaatatcagactgcgaatcaccgggaacggttcctttgcagcacagaagcaatctctctccccatcttcgcatattctgatggcaaaacaagtggaagaaaagaggaagcatgactgcagatcagatcagttctctttgtggattatattttcagtaaaatgtatggatctatcttttccttgttcttatatctagatcatgagacttgactgaggctgtatccttatcctccatccatctatggcgaactatagccatgcagctgacaacattttgcaaaatctctcgcctctaacagcctttctgaaactgacttccttgggtttcataataggagtcagcgtggtgggcaacctcctgatctccattttgctagtgaaagataagaccttgcatagagcaccttactacttcctgttggatctttgctgttcagatatcctcagatctgcaatttgtttcccatttgtgttcaactctgtcaaaaatggttctacctggacttatgggactctgacttgcaaagtgattgcctttctgggggttttgtcctgtttccacactgctttcatgctcttctgcatcagtgtcaccagatatttagctatcgcccatcaccgcttctatacaaagaggctgaccttttggacgtgtctggctgtgatctgtatggtgtggactctgtctgtggccatggcatttcccccggttttagacgtgggcacttactcattcattagggaggaagatcaatgcaccttccaacaccgctccttcagggctaatgattccttaggatttatgctgcttcttgctctcatcctcctagccacacagcttgtctacctcaagctgatatttttcgtccacgatcgaagaaaaatgaagccagtccagtttgtagcagcagtcagccagaactggacttttcatggtcctggagccagtggccaggcagctgccaattggctagcaggatttggaaggggtcccacaccacccaccttgctgggcatcaggcaaaatgcaaacaccacaggcagaagaaggctattggtcttagacgagttcaaaatggagaaaagaatcagcagaatgttctatataatgacttttctgtttctaaccttgtggggcccctacctggtggcctgttattggagagtttttgcaagagggcctgtagtaccagggggatttctaacagctgctgtctggatgagttttgcccaagcaggaatcaatccttttgtctgcattttctcaaacagggagctgaggcgctgtttcagcacaacccttctttactgcagaaaatccaggttaccaagggaaccttactgtgttatatgagggagcatctgtaaatctttagccttgtgaaaactaaccttctctgctgagcaattgtggcccatagccatattttgagaagaaattcaagaatggaatcagcagttttaaggatttgggcaacattctgcagtctttgcaatagttcacctataatcctattttaaatctcagagtgatcctgctgactgccagcaaaggtttgtaattaagaagggactgaaccactgccctaagtttctttatgtggtcaaaaactagataatgaaagtagcaggtgctaagtatcagtgctaaatgctctgtatgtcactacatatgaaaaaacatcaaaaaacaattagcattggacatcttaataaattaagttgacatgaggtaaatgtgttgataaaaactaattttagaagtttgaagactttaaaacatttcatactactattgttttgcaaagactaaaatatttggggacttaaagtactgtaatccactaaagacgtgccaatgaattattggaatatcacactttaaaaaccgccttgtaagttctggggagcattccaaagcagtatattggttccaattagagtttactttttttgtattaatacattgctatttctaaataccactttcctcatctactagtaagattgctagcattgaactgtattatgtggtttttgttgatttggtataaagtttttccaattcatttatattttacaaatgctagatattggtctgggaggcaacattaatggtaccagcctgtcacaactgagcagttctaataatgcagaataaatacatgttgccttaaagggttatctagtatccttcatcttatttagcactggagcaaatagccaagggaaatcaaatcagtaactggtcatggtcatgcatctaaaagtgcatggaagatcatttattactttttccttttttctcacatggtttgaaacttaaagtgcacatcactgaaataatgagattttcttctacggtgtgctaccctttctaaactgttctaagaagcaggcagttgatgtatgtttatattttaagtcagctgtcaaggggagaccacagccttagtatgacatcctgcacaatttgtgaagcatttattctactgaaggcacagtcttgtttatactttctgcacattcagtgtattggtaatttaaattatttcagttttaacttgtgaaagcttatattatgatttctggtattttagaaatacattagagtctgtgagtctcattctttaagatacagatgtgtgaacttcaatataaagttgcatttgccaaaatttacccgtgtagcctgttaattttcttgaaataagttttacatttttggcacataacaactttttttttaatttgggaggcaagcacaaactaggaagactagctttattatggttttgctttttgattcttgtagctactacattccagactggaaatgtatgaatgataatcaacataatgctgataaactgacataatattatctgtaaaagcattatttggtagtttattataatcatccctctattattcttaaatgccagtagtatttagagatgtgtacctgcttagttaattggctcagaattttaatataaacatcacactttaatttggagcatagtaccatagaaatttggggttctaaatatacaacttgtaagaagaatggtttacactaacattatgacaaaactagaaaaagttattatttttgtttgctttctgttgttttgtttattggttggtttttgtgaagtttatttttttttggtatttgataattaagattaggaatctaataacacagaattccatattgctatagtacttctgtaaagagaatatcaatataaataaggaaaataaatcaatgaaatgtttcaatgatatatgcaactattcagttttgctcttataaggacagctcaagccatgaattagtgagcattctgacctcatttttactttacaccaaagttgattagatctgagacaaaatttaatgcacaacagtgagttggatctagcaataaagtctccttggtactgaaatcattatctaaaataaaggaaatgttatcaaaagatgttctgataacattgtgattgtaactcaaaaaaatttatagtagaaacgtaattgcaatgatgataataactaactctgcttagaggttcaaatatcaccagcaatcagtaaaaaattcagcaataatcttaaggccagagagaacaggttcaccattgcatagacaagaaaacagatatgggttaagagttggggactgaggagtcaagagcaacggccacgtgaagctgcctgactccacctagctatttggaataaccgattcccacagttttggtaagaaaccagccccagtaatcagtaagtcaggctgaactgcagtgacttttatttaagcctactcctgactaacttggcatttgcaggtcaagcaggaagcagttgacaagacacatcctcagtgaatcaatgccatttgtaactcaactggtaacagtagtaatcatacaaaataaaaacctgcttcagtgtcttaatgaccaaatcacattatctattttagcactcattccaaaattcagtatttaatgtaattaatctttaatccataaaaatacatccccactgtagcggggcagggggtgtccaacttccctgtgagactgattatcaataataatgtgtctccctcttggactgagcacacatctgagctgaacggcctttaaattgtttttcataatagtggtgatatgtttgcgtggatacgtctgtactatttcatctggttcattttgcatgtaatagatttatctgtgagatgcctggctgaagctaggcattcagtctgtgactgtggaatcctatgcaggtattaaccaaggcagaaagaggtgagtaacttgcccatttctccacagagaccccatttaaataacacaaaattgaccacagtgattagatgaaaaaattatttgtagataggataatctattgactgaattatcttttgcagatatcagctggttggatttctcaccaggattgtctatagaagttaactgatttatgattgttaacacataaatatggccacttatccatttgcctcaacttc

SEQ ID NO: 11659 - DNA, 1608 bp, Homo sapiens
agccctctgtgtttccttcaggtgaatcaccatctgattcctgcaggttcaggaaatactcttccccagtcgacaaatctcacctactcttagttatgagtcatttacattagcaagagagcaagttgttccagtagtcgcctggcaggagaatttgaaagggtgccccaaaggacaatctctaaaggggtaagggagatacctaccttgtctggtaggggagatgtttcgttttcatgctttaccagaaaatccacttccctgccgaccttagtttcaaagcttattcttaattagagacaagaaacctgtttcaacttgaagacaccgtatgaggtgaatggacagccagccaccacaatgaaagaaatcaaaccaggaataacctatgctgaacccacgcctcaatcgtccccaagtgtttcctgacacgcatctttgcttacagtgcatcacaactgaagaatggggttcaacttgacgcttgcaaaattaccaaataacgagctgcacggccaagagagtcacaattcaggcaacaggagcgacgggccaggaaagaacaccacccttcacaatgaatttgacacaattgtcttgccggtgctttatctcattatatttgtggcaagcatcttgctgaatggtttagcagtgtggatcttcttccacattaggaataaaaccagcttcatattctatctcaaaaacatagtggttgcagacctcataatgacgctgacatttccatttcgaatagtccatgatgcaggatttggaccttggtacttcaagtttattctctgcagatacacttcagttttgttttatgcaaacatgtatacttccatcgtgttccttgggctgataagcattgatcgctatctgaaggtggtcaagccatttggggactctcggatgtacagcataaccttcacgaaggttttatctgtttgtgtttgggtgatcatggctgttttgtctttgccaaacatcatcctaacaaatggtcagccaacagaggacaatatccatgactgctcaaaacttaaaagtcctttgggggtcaaatggcatacggcagtcacctatgtgaacagctgcttgtttgtggccgtgctggtgattctgatcggatgttacatagccatatccaggtacatccacaaatccagcaggcaattcataagtcagtcaagccgaaagcgaaaacataaccagagcatcagggttgttgtggctgtgttttttacctgctttctaccatatcacttgtgcagaattccttttacttttagtcacttagacaggcttttagatgaatctgcacaaaaaatcctatattactgcaaagaaattacacttttcttgtctgcgtgtaatgtttgcctggatccaataatttactttttcatgtgtaggtcattttcaagaaggctgttcaaaaaatcaaatatcagaaccaggagtgaaagcatcagatcactgcaaagtgtgagaagatcggaagttcgcatatattatgattacactgatgtgtaggccttttattgtttgttggaatcgatatgtacaaagtgtaaataaatgtttcttttcattatcctt

SEQ ID NO: 11660 - DNA, 2120 bp, Homo sapiens
agcttgatggcgtcgggctggagagccgcagtcccggctgcagcacctgggagaaggcagaccgtgtgagggggcctgtggccccagcgtgctgtggcctcggggagtgggaagtggaggcaggagccttccttacacttcgccatgagtttcctcatcgactccagcatcatgattacctcccagatactattttttggatttgggtggcttttcttcatgcgccaattgtttaaagactatgagatacgtcagtatgttgtacaggtgatcttctccgtgacgtttgcattttcttgcaccatgtttgagctcatcatctttgaaatcttaggagtattgaatagcagctcccgttattttcactggaaaatgaacctgtgtgtaattctgctgatcctggttttcatggtgcctttttacattggctattttattgtgagcaatatccgactactgcataaacaacgactgcttttttcctgtctcttatggctgacctttatgtatttcttctggaaactaggagatccctttcccattctcagcccaaaacatgggatcttatccatagaacagctcatcagccgggttggtgtgattggagtgactctcatggctcttctttctggatttggtgctgtcaactgcccatacacttacatgtcttacttcctcaggaatgtgactgacacggatattctagccctggaacggcgactgctgcaaaccatggatatgatcataagcaaaaagaaaaggatggcaatggcacggagaacaatgttccagaagggggaagtgcataacaaaccatcaggtttctggggaatgataaaaagtgttaccacttcagcatcaggaagtgaaaatcttactcttattcaacaggaagtggatgctttggaagaattaagcaggcagctttttctggaaacagctgatctatatgctaccaaggagagaatagaatactccaaaaccttcaaggggaaatattttaattttcttggttactttttctctatttactgtgtttggaaaattttcatggctaccatcaatattgtttttgatcgagttgggaaaacggatcctgtcacaagaggcattgagatcactgtgaattatctgggaatccaatttgatgtgaagttttggtcccaacacatttccttcattcttgttggaataatcatcgtcacatccatcagaggattgctgatcactcttaccaagttcttttatgccatctctagcagtaagtcctccaatgtcattgtcctgctattagcacagataatgggcatgtactttgtctcctctgtgctgctgatccgaatgagtatgcctttagaataccgcaccataatcactgaagtccttggagaactgcagttcaacttctatcaccgttggtttgatgtgatcttcctggtcagcgctctctctagcatactcttcctctatttggctcacaaacaggcaccagagaagcaaatggcaccttgaacttaagcctactacagactgttagaggccagtggtttcaaaatttagatataagaggggggaaaaatggaaccagggcctgacattttataaacaaacaaaatgctatggtagcatttttcaccttcatagcatactccttccccgtcaggtgatactatgaccatgagtagcatcagccagaacatgagagggagaactaactcaagacaatactcagcagagagcatcccgtgtggatatgaggctggtgtagaggcggagaggagccaagaaactaaaggtgaaaaatacactggaactctggggcaagacatgtctatggtagctgagccaaacacgtaggatttccgttttaaggttcacatggaaaaggttatagctttgccttgagattgactcattaaaatcagagactgtaacacttttgccttacgttcattttatcaagcatagcttggtatttattatgcttgtgtgatctaacatcagttagcatcccacacctcctcatctgatcctgccccattaaaataaccaagaaagaggttatctgttcttttccgggaaaggggtggtatgcacctgaaatagattttaccaaaaga

SEQ ID NO: 11661 - DNA, 1982 bp, Homo sapiens
atgtagacgctgattggctgactggggcgcagcttgatggcgtcgggctggagagccgcagtcccggctgcagcacctgggagaaggcagaccgtgtgagggggcctgtggccccagcgtgctgtggcctcggggagtgggaagtggaggcaggagccttccttacacttcgccatgagtttcctcatcgactccagcatcatgattacctcccagatactattttttggatttgggtggcttttcttcatgcgccaattgtttaaagactatgagatacgtcagtatgttgtacaggtgatcttctccgtgacgtttgcattttcttgcaccatgtttgagctcatcatctttgaaatcttaggagtattgaatagcagctcccgttattttcactggaaaatgaacctgtgtgtaattctgctgatcctggttttcatggtgcctttttacattggctattttattgtgagcaatatccgactacttttgtctcctctgtctcagtgcataaacaacgactgcttttttcctgtctcttatggctgacctttatgtatttcttctggaaactaggagatccctttcccattctcagcccaaaacatgggatcttatccatagaacagctcatcagccgggttggtgtgattggagtgactctcatggctcttctttctggatttggtgctgtcaactgcccatacacttacatgtcttacttcctcaggaatgtgactgacacggatattctagccctggaacggcgactgctgcaaaccatggatatgatcataagcaaaaagaaaaggatggcaatggcacggagaacaatgttccagaagggggaagtgcataacaaaccatcaggtttctggggaatgataaaaagtgttaccacttcagcatcaggaagtgaaaatcttactcttattcaacaggaagtggatgctttggaagaattaagcaggcagctttttctggaaacagctgatctatatgctaccaaggagagaatagaatactccaaaaccttcaaggggaaatattttaattttcttggttactttttctctatttactgtgtttggaaaattttcatggctaccatcaatattgtttttgatcgagttgggaaaacggatcctgtcacaagaggcattgagatcactgtgaattatctgggaatccaatttgatgtgaagttttggtcccaacacatttccttcattcttgttggaataatcatcgtcacatccatcagaggattgctgatcactcttaccaagttcttttatgccatctctagcagtaagtcctccaatgtcattgtcctgctattagcacagataatgggcatgtactttgtctcctctgtgctgctgatccgaatgagtatgcctttagaataccgcaccataatcactgaagtccttggagaactgcagttcaacttctatcaccgttggtttgatgtgatcttcctggtcagcgctctctctagcatactcttcctctatttggctcacaaacaggcaccagagaagcaaatggcaccttgaacttaagcctactacagactgttagaggccagtggtttcaaaatttagatataagaggggggaaaaatggaaccagggcctgacattttataaacaaacaaaatgctatggtagcatttttcaccttcatagcatactccttccccgtcaggtgatactatgaccatgagtagcatcagccagaacatgagagggagaactaactcaagacaatactcagcagagagcatcccgtgtggatatgaggctggtgtagaggcggagaggagccaagaaactaaaggtgaaaaatacactggaactctggggcaagacatgtctatggtagctgagccaaacacgtaggatttccgttttaaggttcacatggaaaaggttatagctttgccttgagattgactcattaaaatcagagactgt

SEQ ID NO: 11662 - DNA, 1934 bp, Homo sapiens
agcttgacggcgtcgggctggagagccgcagtcccggctgcagcacctgggagaaggcagaccgtgtgagggggcctgtggccccagcgtgctgtggcctccgggagtgggaagtggaggcaggagccttccttacacttcgccatgagtttcctgatcgactccagcatcatgattacctcccagatactattttttggatttgggtggcttttcttcatgcgccaattgtttaaagactatgagatacgtcagtatgttgtacaggtgatcttctccgtgacgtttgcattttcttgcaccatgtttgagctcatcatctttgaaatcttaggagtattgaatagcagctcccgttattttcactggaaaatgaacctgtgtgtaattctgctgatcctggttttcatggtgcctttttacattggctattttattgtgagcaatatccgactactgcataaacaacgactgcttttttcctgtctcttatggctgacctttatgtatttcttctggaaactaggagatccctttcccattctcagcccaaaacatgggatcttatccatagaacagctcatcagccgggttggtgtgattggagtgactctcatggctcttctttctggatttggtgctgtcaactgcccatacacttacatgtcttacttcctcaggaatgtgactgacacggatattctagccctggaacggcgactgctgcaaaccatggatatgatcataagcaaaaagaaaaggatggcaatggcacggagaacaatgttccagaagggggaagtgcataacaaaccatcaggtttctggggaatgataaaaagtgttaccacttcagcatcaggaagtgaaaatcttactcttattcaacaggaagtggatgctttggaagaattaagcaggcagctttttctggaaacagctgatctatatgctaccaaggagagaatagaatactccaaaaccttcaaggggaaatattttaattttcttggttactttttctctatttactgtgtttggaaaattttcatggctaccatcaatattgtttttgatcgagttgggaaaacggatcctgtcacaagaggcattgagatcactgtgaattatctgggaatccaatttgatgtgaagttttggtcccaacacatttccttcattcttgttggaataatcatcgtcacatccatcagaggattgctgatcactcttaccaagttcttttatgccatctctagcagtaagtcctccaatgtcattgtcctgctattagcacagataatgggcatgtactttgtctcctctgtgctgctgatccgaatgagtatgcctttagaataccgcaccataatcactgaagtccttggagaactgcagttcaacttctatcaccgttggtttgatgtgatcttcctggtcagcgctctctctagcatactcttcctctatttggctcacaaacaggcaccagagaagcaaatggcaccttgaacttaagcctactacagactgttagaggccagtggtttcaaaatttagatataagaggggggaaaaatggaaccagggcctgacattttataaacaaacaaaatgctatggtagcatttttcaccttcatagcatactccttccccctcaggtgatactatgaccatgagtagcatcagccagaacatgagagggagaactaactcaagacaatactcagcagagagcatcccgtgtggatatgaggctggtgtagaggcggagaggagccaagaaactaaaggtgaaaaatacactggaactctggggcaagagatgtctatggtagctgagccaaacacgtaggatttccgttttaaggttcacatggaaaaggttatagctttgccttgagattgactcattaaaatcagagactgtaa

SEQ ID NO: 11663 - DNA, 19237 bp, Homo sapiens
atggacattttcttagttttagggatgccctctgcatctttattagtaaatcttctttcagctttactcatcctatttgtgtttggagaaacagaaataagatttactggacaaactgaatttgttgttaatgaaacaagtacaacagttattcgtcttatcattgaaaggataggagagccagcaaatgttactgcaattgtatcgctgtatggagaggacgctggtgacttttttgacacatatgctgcagcttttatacctgccggagaaacaaacagaacagtgtacatagcagtatgtgatgatgacttaccagagcctgacgaaacttttatttttcacttaacattacagaaaccttcagcaaatgtgaagcttggatggccaaggactgttactgtgacaatattatcaaatgacaatgcatttggaattatttcatttaatatgcttccctcaatcgcagtgagtgagcccaagggcagaaatgagtctatgcctcttactctcatcagggaaaagggaacctatggaatggtcatggtgacttttgaggtagagggtggcccaaatccccctgatgaagatttgagtccagttaaaggaaatatcacctttccccctggcagagcaacagtaatttataacttgacagtactcgatgacgaggtaccagaaaatgatgaaatatttttaattcaactgaaaagtgtagaaggaggagctgagattaacacctctaggaattccattgagatcatcattaagaaaaatgatagtcccgtgagattccttcagagtatttatttggttcctgaggaagaccacatactcataattccagtagttcgtggaaaggacaacaatggaaatctgattggatctgatgaatatgaggtttcaatcagttatgctgtcacaactgggaattccacagcacatgcccagcaaaatctggacttcattgatcttcagccaaacacaactgttgtttttccaccttttattcatgaatctcacttgaaatttcaaatagttgatgacaccataccggagattgctgaatcgtttcacattatgttactaaaagataccttacagggagatgctgtgctaataagcccttctgttgtacaagtcaccattaagccaaatgataaaccttatggagtcctttcattcaacagtgttttgtttgaaaggacagttataattgatgaagatagaatatcaagatatgaagaaatcacagtggttagaaatggaggaacccatgggaatgtctctgcgaattgggtgttgacacggaacagcactgatccctcaccagtaacagcagatatcagaccgagctctggagttctccattttgcacaagggcagatgttggcaacaattcctcttactgtggttgatgatgatcttccagaagaggcagaagcttatctacttcaaattctgcctcatacaatacgaggaggtgcagaagtgagcgagccagcggagcttttgttctacattcaggatagtgatgatgtctatggcctaataacattttttcctatggaaaaccagaagattgaaagcagcccaggtgaacgatacttatccttgagttttacaagactaggagggactaaaggagatgtgaggttgctttattctgtactttacattcctgctggagctgtggaccccttgcaagcaaaagaaggcatcttaaatatatcaaggagaaatgacctcatttttccagagcaaaaaactcaagtcactacaaaattaccaataagaaatgatgcattccttcaaaatggagctcactttctagtacagttggaaactgtggagttgttaaacataattcctctaatcccacccataagccctagatttggggaaatctgcaatatttctttactggttactccagccattgcaaatggagaaattggctttctcagcaatcttccaattattttgcatgaaccagaagattttgctgctgaagtggtatacattcccttacatcgggatggaactgatggccaggctactgtctactggagtttgaagccctctggctttaattcaaaagcagtgaccccggatgatataggcccctttaatggctctgttttgtttttatctgggcaaagtgacacaacaatcaacattactatcaaaggtgatgacataccggaaatgaatgaaactgtaacactttctctagacagggttaacgtggaaaaccaagtgctgaaatctggatatactagccgtgacctaattattttggaaaatgatgaccctgggggagtttttgaattttctcctgcttccagaggaccctatgttataaaagaaggagaatctgtagagctccacatcatccgatcaagggggtcccttgttaagcagtttctacactaccgagtagagccaagagatagcaatgaattctatggaaacacgggagtactagaatttaaacctggagaaagggagatagtgatcaccttgctagcaagattggatgggataccagagttggatgaacactactgggtggtcctcagcagccacggagaacgggaaagcaagttgggaagtgccaccattgtcaatataacgattctgaaaaatgatgatcctcatggcattatagaatttgtttctgatggtctaattgtgatgataaatgaaagcaaaggagatgctatctatagtgctgtttatgatgtagtaagaaatcgaggcaactttggtgatgttagtgtatcatgggtggttagtccagactttacacaagatgtatttcctgtacaagggactgttgtctttggagatcaggaattttcaaaaaatatcaccatttactcccttccagatgagattccagaagaaatggaagaatttaccgttatcctactgaatggcactggaggagctaaagtgggaaatagaacaactgcaactctgaggattagaagaaatgatgaccccatttattttgcagaacctcgtgtagtgagggttcaggaaggtgagactgccaactttacagttctcagaaatggatctgttgatgtgacttgcatggtccagtatgctaccaaggatgggaaggctactgcaagagagagagatttcattcctgttgaaaaaggagaaacgctcatttttgaggttggaagtagacagcagagcatatccatatttgttaatgaagatggtatcccggaaacagatgagcccttttatataatcctcttgaattcaacaggtgatacagtagtatatcaatatggagtagctacagtaataattgaagctaatgatgacccaaatggcattttttctctggagcccatagacaaagcagtggaagaaggaaagactaatgcattttggattttgaggcaccgaggatactttggtagtgtttctgtatcttggcagctctttcagaatgattctgctttgcagcctgggcaggagttctatgaaacttcaggaactgttaacttcatggatggagaagaagcaaaaccaatcattctccatgcttttccagataaaattcctgaattcaatgaattttatttcctaaaacttgtaaacatttcaggtggatccccaggtcctgggggccagctagcagaaaccaacctccaggtgacagtaatggttccattcaatgatgatccctttggagtttttatcttggatccagagtgtttagagagagaagtggcagaagatgtcctgtctgaagatgatatgtcttatattaccaacttcaccattttgaggcagcagggtgtgtttggtgatgtacaactgggctgggaaatactgtccagtgagttccctgctggtttgccaccaatgatagattttttactggttggaattttccccaccaccgtgcatttacaacagcacatgcggcgtcaccacagtggaacggatgctttgtactttaccggactagagggtgcatttgggactgttaatccaaaataccatccctccaggaataatacaattgccaactttacattctcagcttgggtaatgcccaatgccaatacgaatggattcattatagcgaaggatgacggtaatggaagcatctactacggggtaaaaatacaaacaaacgaatcccatgtgacactttcccttcattataaaaccttgggttccaatgctacatacattgccaagacaacagtcatgaaatatttagaagaaagtgtttggcttcatctactaattatcctggaggatggtataatcgaattctacctggatggaaatgcaatgcccaggggaatcaagagtctgaaaggagaagccattactgacggtcctgggatactgagaattggagcagggataaatggcaatgacagatttacaggtctgatgcaggatgtgaggtcctatgagcggaaactgacgcttgaagaaatttatgaacttcatgccatgcccgcaaaaagtgatttacacccaatttctggatatctggagttcagacagggagaaactaacaaatcattcattatttctgcaagagatgacaatgacgaggaaggagaagaattattcattcttaaactagtttctgtatatggaggagctcgtatttcggaagaaaatactactgcaagattaacaatacaaaaaagtgacaatgcaaatggcttgtttggtttcacaggagcttgtataccagagattgcagaggagggatcaaccatttcttgtgtggttgagagaaccagaggagctctggattatgtgcatgttttttacaccatttcacagattgaaactgatggcattaattaccttgttgatgactttgctaatgccagtggaactattacattccttccttggcagagatcagaggttctgaatatatatgttcttgatgatgatattcctgaacttaatgagtatttccgtgtgacattggtttctgcaattcctggagatgggaagctaggctcaactcctaccagtggtgcaagcatagatcctgaaaaggaaacgactgatatcaccatcaaagctagtgatcatccatatggcttgctgcagttctccacagggctgcctcctcagcctaaggacgcaatgaccctgcctgcaagcagcgttccacatatcactgtggaggaggaagatggagaaatcaggttattggtcatccgtgcacagggacttctgggaagggtgactgcggaatttagaacagtgtccttgacagcattcagtcctgaggattaccagaatgttgctggcacattagaatttcaaccaggagaaagatataaatacattttcataaacatcactgataattctattcctgaactggaaaaatcttttaaagttgagttgttaaacttggaaggaggagtagctgaactctttagggttgatggaagtggtagtggtgatggggacatggaattcttccttccaactattcacaaacgtgccagtctaggagtggcttcccaaattctagtgacaattgcagcctctgaccacgctcatggcgtatttgaatttagccctgagtcactctttgtcagtggaactgaaccagaagatgggtatagcactgttacattaaatgttataagacatcatggaactctgtctccagtgactttgcattggaacatagactctgatcctgatggtgatctcgccttcacctctggcaacatcacatttgagattgggcagacgagcgccaatatcactgtggagatattgcctgacgaagacccagaactggataaggcattctctgtgtcagtcctcagtgtttccagtggttctttgggagctcatattaatgccacgttaacagttttggctagtgatgatccatatgggatattcattttttctgagaaaaacagacctgttaaagttgaggaagcaacccagaacatcacactatcaataataaggttgaaaggcctcatgggaaaagtccttgtctcatatgcaacactagatgatatggaaaaaccaccttattttccacctaatttagcgagagcaactcaaggaagagactatataccagcttctggatttgctctttttggagctaatcagagtgaggcaacaatagctatttcaattttggatgatgatgagccagaaaggtccgaatctgtctttatcgaactactcaactctactttagtagcgaaagtacagagtcgttcaattccaaattctccacgtcttgggcctaaggtagaaactattgcgcaactaattatcattgccaatgatgatgcatttggaactcttcagctctcagcaccaattgtccgagtggcagaaaatcatgttggacccattatcaatgtgactagaacaggaggagcatttgcagatgtctctgtgaagtttaaagctgtgccaataactgcaatagctggtgaagattatagtatagcttcatcagatgtggtcttgctagaaggggaaaccagtaaagccgtgccaatatatgtcattaatgatatctatcctgaactggaagaatcttttcttgtgcaactgatgaatgaaacaacaggaggagccagactaggggctttaacagaggcagtcattattattgaggcctctgatgacccctatggattatttggttttcagattactaaacttattgtagaggaacctgagtttaactcagtgaaggtaaacctgccaataattcgaaattctgggacactcggcaatgttactgttcagtgggttgccaccattaatggacagcttgctactggcgacctgcgagttgtctcaggtaatgtgacctttgcccctggggaaaccattcaaaccttgttgttagaggtcctggctgacgacgttccggagattgaagaggttatccaagtgcaactaactgatgcctctggtggaggtactattgggttagatcgaattgcaaatattattattcctgccaatgatgatccttatggtacagtagcctttgctcagatggtttatcgtgttcaagagcctctggaaagaagttcctgtgctaatataactgtcaggcgaagcggagggcactttggtcggctgttgttgttctacagtacttccgacattgatgtagtggctctggcaatggaggaaggtcaagatttactgtcctactatgaatctccaattcaaggggtgcctgacccactttggagaacttggatgaatgtctctgccgtgggggagcccctgtatacctgtgccactttgtgccttaaggaacaagcttgctcagcgttttcatttttcagtgcttctgagggtccccagtgtttctggatgacatcatggatcagcccagctgtcaacaattcagacttctggacctacaggaaaaacatgaccagggtagcatctctttttagtggtcaggctgtggctgggagtgactatgagcctgtgacaaggcaatgggccataatgcaggaaggtgatgaattcgcaaatctcacagtgtctattcttcctgatgatttcccagagatggatgagagttttctaatttctctccttgaagttcacctcatgaacatttcagccagtttgaaaaatcagccaaccataggacagccaaatatttctacagttgtcatagcactaaatggtgatgcctttggagtgtttgtgatctacaatattagtcccaatacttccgaagatggcttatttgttgaagttcaggagcagccccaaaccttggtggagctgatgatacacaggacagggggcagcttaggtcaagtggcagtcgaatggcgtgttgttggtggaacagctactgaaggtttagattttataggtgctggagagattctgacctttgctgaaggtgaaaccaaaaagacagtcattttaaccatcttggatgactctgaaccagaggatgacgaaagtatcatagttagtttggtgtacactgaaggtggaagtagaattttgccaagctccgacactgttagagtgaacattttggccaatgacaatgtggcaggaattgttagctttcagacagcttccagatctgtcataggtcatgaaggagaaattttacaattccatgtgataagaactttccctggtcgaggaaatgttactgttaactggaaaattattgggcaaaatctagaactcaattttgctaactttagcggacaacttttctttcctgaggggtcgttgaatacaacattgtttgtgcatttgttggatgacaacattcctgaggagaaagaagtataccaagtcattctgtatgatgtcaggacacaaggagttccaccagccggaatcgccctgcttgatgctcaaggatatgcagctgtcctcacagtagaagccagtgatgaaccacatggagttttaaattttgctctttcatcaagatttgtgttactacaagaggctaacataacaattcagcttttcatcaacagagaatttggatctctaggagctatcaatgtcacatataccacggttcctggaatgctgagtctgaagaaccaaacagtaggaaacctagcagagccagaagttgattttgtccctatcattggctttctgattttagaagaaggggaaacagcagcagccatcaacattaccattcttgaggatgatgtaccagagctagaagaatatttcctggtgaatttaacttacgttggacttaccatggctgcttcaacttcatttcctcccagactagattcagaaggtttgactgcacaagttattattgatgccaatgatggggcccgaggtgtaattgaatggcaacaaagcaggtttgaagtaaatgaaacccatggaagtttaacattggtagcccagaggagcagagaacctcttggccatgtttccttatttgtgtatgctcagaatttggaagcacaagtggggctggattatatcttcaccccaatgattcttcattttgctgatggagaaaggtataaaaatgtcaatatcatgattcttgatgatgacattccagaaggagatgaaaaatttcagctgattttaacaaatccttctcctggactagagctagggaaaaatacaatagccttaattattgtccttgctaatgatgacggccctggagttctatcatttaacaacagtgagcactttttcctaagagagccaacagctctctacgtccaggagagtgttgcagtattgtacattgttcgggaacctgcacaaggattgtttggaacagtgacagttcagttcattgtgacagaagtgaattcctcaaatgaatctaaagatctgactccttccaaaggctatattgttttagaagaaggtgttcgattcaaggccctacaaatatctgccatattagacacggaaccagaaatggatgagtattttgtttgcaccttgtttaatccaactggaggtgctagactaggggtgcatgttcaaaccctgataacagttttgcaaaaccaggcccctttggggctattcagtatctctgcagttgaaaatagagccacctccatagacatcgaagaagccaataggaccgtgtatttaaatgtatctcgaactaatggcattgatttggctgtgagtgtgcagtgggagacagtatctgaaacagcctttggcatgaggggaatggatgttgtgttttccgtatttcaaagttttttggatgaatcagcttctggctggtgtttctttactttggaaaatttaatatatggtataatgttaagaaaatcatctgttactgtttaccgatggcaggggatttttattccagttgaggatttaaatatagaaaatcctaaaacttgtgaggcctttaatattggtttttctccctactttgtgattactcatgaagaaagaaatgaagaaaagccttctcttaacagtgtgtttacattcacatctggatttaaattattcctggtacaaacaatcattattctggaaagttctcaagtaagatattttacttcagacagccaagattatttaatcattgcaagtcaaagagatgattccgaattaactcaggtcttcaggtggaatggaggaagcttcgtgttgcatcaaaaactccctgtccgaggtgtgctgaccgtggccttgttcaacaagggaggctctgtgttcttagccatttcccaggctaatgccaggctaaactcccttttattcagatggtctggcagtgggtttattaactttcaagaggtgcctgtcagtgggacaacagaagttgaggctttgtcttcagccaatgatatttacctaatatttgccgaaaatgtctttctaggagatcagaattcaattgatattttcatctgggagatgggacagtcttccttcaggtattttcagtctgtagattttgctgctgttaacagaatccactccttcacaccagcctcaggaatagcccacatacttcttattggccaagatatgtctgctctttactgctggaattcggagcgtaatcaattctcttttgttctggaagtaccttctgcttatgatgtggcttctgttacagtaaagtcccttaattcaagcaagaatttaatagctctagtgggagctcattcacatatatatgagctagcctacatttccagccattctgactttattcctagttcaggtgaactgatatttgaacctggtgagagagaagctacaatagcagtaaatatccttgatgatacagttccagaaaaagaagaatccttcaaagttcaacttaaaaatcccaaaggaggagcagagattggcattaatgattctgtaacaataaccattctgtctaatgatgatgcctatggaattgttgcatttgctcagaattcattatataagcaagtggaagaaatggagcaagatagcctagtaaccttgaacgttgaacgcttaaaaggaacatatggccgtataaccatagcatgggaagctgatggaagtattagtgatatatttcctacctcaggagtgattttatttactgaaggccaggtactgtcaacaatcactctaactattcttgctgataatataccagagttatcagaggttgtgattgtaaccctcacccgtatcaccacagaaggggttgaggactcatacaaaggtgctactattgatcaggacagaagcaagtctgttataacaactttgcccaatgactcaccttttggcttggtgggctggcgtgctgcgtctgtcttcattagagtagcagagcctaaagaaaacaccaccactcttcagttacaaatagctcgagataaaggactacttggggatattgccattcacttgagagctcaacccaatttcttactgcatgtcgataatcaagctactgagaatgaagattatgtattgcaagaaacaataataataatgaaagaaaacataaaagaagctcatgccgaagtttccattttgccggatgaccttcctgaattggaggaaggatttattgtcactatcactgaggtgaacctggtgaactctgacttctctacaggacagccaagtgtgcggaggcccggaatggaaatagctgagataatgatagaagaaaatgacgatcccagaggaatttttatgtttcatgttactagaggcgctggggaagttattactgcctatgaggtgcctccacccttgaacgttcttcaagttcctgtagtccggctggctggaagctttggggcagtaaatgtttattggaaagcatcaccagacagtgctggcctggaagactttaaaccatctcatgggattcttgaatttgcagataaacaggttactgcaatgatagaaatcaccataattgatgatgctgaatttgaattgacagagacgttcaatatttccttgatcagtgttgctggaggtggcagacttggtgatgatgttgtggtaactgttgttattccacaaaatgattctccatttggagtatttggatttgaagaaaagactgtaatgattgatgaatccctttcatccgatgaccctgattcatatgtgacattgacggttgtccggtccccaggaggaaaaggaaccgtccgacttgagtggaccatagatgagaaggctaaacataaccttagtcctttgaatgggacccttcattttgatgagactgagtcccagaagaccattgtgttgcacacacttcaagacacagtgttggaggaggacaggcgtttcaccattcagctgatatcaattgatgaggtagaaatatctccagtaaaaggtagtgcatcaataattattcggggtgataagcgagcatcaggagaagttgggatagctccgtcatctaggcacatcctcattggggaaccctcagcaaaatataatggtaccgctattatcagccttgttcgaggcccagggattttgggggaggtcacagtgttctggaggatattccctccttccgtgggggaatttgctgaaacatcaggaaaactgacaatgcgagacgaacagtctgcagtcattgtagtaatacaggctttgaacgatgacattcccgaggaaaaaagcttctatgagtttcagctcactgcagtcagtgagggaggagttctgagtgaatccagcagcactgccaacatcacggtggtggccagcgactctccctatggccgatttgccttttcacatgagcaacttcgagtgtcagaagcacagagggttaacatcacaatcatccgttccagtggagattttggccatgtgcgactctggtacaagacgatgagcgggacagcggaagcaggcttggattttgttcctgcagcaggggagctcctctttgaagcaggggagatgaggaaaagtctgcatgttgaaatccttgatgatgactatcctgaaggcccagaggaattttctctaacaattacaaaggtggaactccagggaagagggtatgattttaccattcaagaaaatggacttcagatagatcaacctcctgaaataggaaacatctccattgttcgcatcataataatgaaaaatgataacgcagaaggcatcattgaatttgacccaaagtatactgccttcgaagtggaggaagatgttgggctgatcatgatcccagtggtgaggctacatggaacttatggctatgtgacagctgatttcatctctcagagctcctctgccagtcccggaggtgttgattacattttgcatggcagtacagtcacctttcagcatgggcaaaacttaagttttataaatatctccatcattgatgacaatgaaagtgaatttgaggagcccattgaaattctactcactggagctactggaggagcggtccttgggcgccacctagtgagcagaatcataatagctaagagtgactctccctttggagttataaggtttctcaatcaaagcaaaatttctattgctaatcccaattccacaatgattttatcactggtgctggagcggactggaggactcttgggagagattcaggtgaactgggagacagtaggacccaactctcaagaagccttactgccacagaatagagacattgcagacccagtgagcgggttgttctattttggagaaggagaaggaggagtgagaaccataattctgacaatctatcctcatgaagaaattgaagttgaagagacattcattattaaacttcatcttgtgaaaggagaagctaaattagactccagagctaaagatgttacattaaccatacaagagtttggtgacccaaatggagttgttcagtttgctcctgaaactttgtctaagaagacttattcagagcctctggctctggaagggcccctgctcattaccttctttgtcagaagagtcaagggcacctttggagagattatggtttactgggaattaagtagtgagtttgacattactgaagactttctttccaccagtggatttttcaccattgctgatggagagagtgaagctagctttgatgttcatttgctaccagatgaggtacctgagatagaggaagattatgtgatccagcttgtttctgtagagggaggagccgaactggatctggagaagagtatcacatggttctctgtttatgcaaatgatgacccacatggagtatttgccctgtattcggatcgccagtcaatacttattgggcagaaccttattagatccatccaaattaacataacccggcttgctggaacatttggagatgtggctgttgggcttcgaatatcatcggatcataaagaacagccgattgttaccgaaaatgcagagaggcagctggtggtcaaagatggtgccacatataaagtggacgtggtgccaataaagaatcaggtcttcctatcactgggctctaatttcactttgcaactggtgactgtgatgcttgtcggtggacgtttctatggaatgccaacaattcttcaggaagcaaaatctgctgtccttccagtctctgagaaagctgccaattctcaggtcggatttgaatccactgcttttcaactcatgaacatcactgctggcacaagccacgttatgatttctaggagaggcacatatggagctctctcggttgcctggaccactggatatgctcctgggttagaaattcctgaattcattgttgttggcaacatgaccccaacactggggagcctttcattttcccacggtgaacaaaggaaaggagttttcctgtggacgtttcctagccctggttggccagaggcctttgttcttcacctatcaggagtgcagagcagtgctcctggcggagctcaactccgatcaggtttcattgttgctgaaattgaaccaatgggcgtcttccaattttccactagctcaagaaatatcatagtgtcagaagatacacagatgatcagattacatgtacaaagactatttgggttccacagcgatcttattaaagtttcttatcagaccactgcaggaagcgccaagccactggaagattttgagcctgttcagaatggggaactgttttttcaaaaattccaaactgaggttgattttgaaataaccattattaatgatcagctttctgagatagaagaatttttttacattaaccttacttcagtagaaattaggggattacaaaagtttgatgttaattggagcccacgcctgaatctagatttcagtgttgcagtgattacaatattggataatgatgacctggcaggaatggatatttccttccccgagacaactgtggctgtagcagttgacacaactctcattcctgtagaaactgaatccaccacatacctcagcacaagcaagacgactaccattctgcagccaaccaacgtggttgccattgttactgaggcaactggtgtatctgccatccctgagaaacttgtcacccttcatggcacacctgctgtgtctgaaaagcctgatgtggccactgtaactgccaatgtttccattcatggaacattcagccttgggccatccattgtttatattgaagaggagatgaagaatggcacattcaacactgcagaagttcttatccgaagaactggtgggtttactggcaatgtcagcataacagttaaaactttcggtgaaagatgtgctcagatggaaccaaatgcattgccctttcgtggtatctatgggatttccaacctaacatgggcagttgaagaagaagactttgaagaacaaactcttacccttatattcctagatggagaaagagaacgtaaagtatcagttcaaattttggatgatgatgagcctgaggggcaggaattcttctacgtgtttctcacaaaccctcaagggggagcacagattgtggaggagaaggatgatactggatttgcagcttttgccatggttattattacagggagtgaccttcacaatggcatcataggattcagtgaggagtcccagagtggactagaactcagggaaggagctgttatgagaagattgcaccttattgtcacaagacagccaaacagggcctttgaagatgtcaaggtcttttggcgagtcacacttaacaaaacagtcgtcgtgctccagaaggatggggtaaacctggtggaggaacttcagtctgtgtcagggaccacaacctgtacaatgggtcaaacaaaatgctttatcagcattgaactcaaaccagaaaaggtaccacaggttgaagtgtatttttttgtggaactatatgaagctactgctggagcagcaataaacaacagtgccagattcgcacagattaaaatcttagaaagtgatgaatctcaaagccttgtgtatttttctgtgggttctcggctggcagtggctcacaagaaggccactttaatcagtctgcaggtggccagagattctgggacaggactaatgatgtctgttaactttagtacccaggagttgaggagtgctgaaacaattggtcgtaccatcatatctccagctatttctggaaaggattttgtgataactgaaggcacattggtctttgaacctggccagagaagcactgtattggatgtcatcctaacgccagagacaggatctttaaattcatttcctaaacgcttccagattgtcctttttgacccaaaaggtggtgccagaattgataaagtgtatgggactgccaacatcactcttgtctcagatgcagattcgcaggccatttgggggcttgcagatcagctacatcagcctgtgaatgatgatattctcaacagagtgctccataccatcagcatgaaagtggccacagaaaacacagatgaacaactcagtgccatgatgcatttaatagaaaagataactactgaaggaaaaattcaagctttcagtgttgccagccgaactcttttctatgagattctttgttctcttattaacccaaagcgcaaggacactaggggattcagtcactttgctgaagtgactgagaattttgccttttctctgctgactaatgttacttgcggctctcctggtgaaaaaagcaaaaccatccttgatagttgcccatatttgtcaatattggctcttcactggtatcctcagcaaatcaatggacacaagtttgaaggaaaggaaggagattacattcgaattccagagaggctactggatgtccaggatgcagaaataatggctgggaaaagtacatgtaaattagtccagtttacagagtatagcagccaacagtggtttataagtggaaacaatcttcctaccctaaaaaataaggtattatctttgagtgtgaaaggtcagagttcacaactcctgactaatgacaatgaggttctctacaggatttatgctgctgagcctagaattattcctcagacatctctgtgtctcctttggaatcaggctgctgcaagctggttgtctgacagtcagttttgcaaagtggttgaggaaactgcagactatgtggaatgtgcctgttcacacatgtctgtgtatgctgtctatgctcggactgacaacttgtcttcatacaatgaagccttcttcacttctggatttatatgtatctcaggtctttgcttggctgttctttcccatatcttctgtgccaggtactccatgtttgcagctaaacttctgactcacatgatggcagccagcttaggtacacagattctgtttctggcgtctgcatacgcaagtccccaactcgctgaggagagctgttcagctatggctgctgtcacacattacctgtatctttgccagtttagctggatgctcattcagtctgtgaatttctggtacgtgctggtgatgaatgatgagcacacagagaggcgatatctgctgtttttccttctgagttggggactaccagcttttgtggtgattctcctcatagttattttgaaaggaatctatcatcagagcatgtcacagatctatggactcattcatggtgacctgtgttttattccaaacgtctatgctgctttgttcactgcagctcttgttcctttgacgtgcctcgtggtggtgttcgtggtgttcatccatgcctaccaggtgaagccacagtggaaagcatatgatgatgtcttcagaggaaggacaaatgctgcagaaattccactgattttatatctctttgctctgatttccgtgacatggctttggggaggactacacatggcctacagacacttctggatgttggttctctttgtcattttcaacagtctgcagggactttatgttttcatggtttatttcattttacacaaccaaatgtgttgccctatgaaggccagttacactgtggaaatgaatgggcatcctggacccagcacagcctttttcacgcccgggagtggaatgcctcctgctggaggggaaatcagcaagtccacccagaatctcatcggtgctatggaggaggtgccacctgactgggagagagcatccttccaacagggcagtcaggccagccctgatttaaagccaagtccacaaaatggagccacgttcccgtcctctggaggatatggccaggggtcactgatagccgatgaggagtcccaggagtttgatgatttaatatttgcattaaaaactggtgctggtctcagtgtcagtgataatgaatctggtcaaggcagccaggaggggggcaccttgactgactcccagatcgtggagctcaggaggatacccatcgccgacactcacctgtagcacctcactaaccattcgactgagcacactttcatatttgtatcagcttttgtgctaaaactctctaagtacatccacctgtgtaataggaacctgtgaattgtactggatgattaatacaaacgtgattgttgtatttggagtataaattactgattgtatgtgacctgaaaattcactgctataagaaaggtggagtcagtttgtatcagttaataggatgttcatattccaaggatattagttgtttttttaatcatcctatatggctaacattgtttaatgaaagtaataatcaataaagcaatagaatcta

SEQ ID NO: 11664 - DNA, 19184 bp, Homo sapiens
gtagatgtatttatgtttttagggatgccctctgcatctttattagtaaatcttctttcagctttactcatcctatttgtgtttggagaaacagaaataagatttactggacaaactgaatttgttgttaatgaaacaagtacaacagttattcgtcttatcattgaaaggataggagagccagcaaatgttactgcaattgtatcgctgtatggagaggacgctggtgacttttttgacacatatgctgcagcttttatacctgccggagaaacaaacagaacagtgtacatagcagtatgtgatgatgacttaccagagcctgacgaaacttttatttttcacttaacattacagaaaccttcagcaaatgtgaagcttggatggccaaggactgttactgtgacaatattatcaaatgacaatgcatttggaattatttcatttaatatgcttccctcaatcgcagtgagtgagcccaagggcagaaatgagtctatgcctcttactctcatcagggaaaagggaacctatggaatggtcatggtgacttttgaggtagagggtggcccaaatccccctgatgaagatttgagtccagttaaaggaaatatcacctttccccctggcagagcaacagtaatttataacttgacagtactcgatgacgaggtaccagaaaatgatgaaatatttttaattcaactgaaaagtgtagaaggaggagctgagattaacacctctaggaattccattgagatcatcattaagaaaaatgatagtcccgtgagattccttcagagtatttatttggttcctgaggaagaccacatactcataattccagtagttcgtggaaaggacaacaatggaaatctgattggatctgatgaatatgaggtttcaatcagttatgctgtcacaactgggaattccacagcacatgcccagcaaaatctggacttcattgatcttcagccaaacacaactgttgtttttccaccttttattcatgaatctcacttgaaatttcaaatagttgatgacaccataccggagattgctgaatcgtttcacattatgttactaaaagataccttacagggagatgctgtgctaataagcccttctgttgtacaagtcaccattaagccaaatgataaaccttatggagtcctttcattcaacagtgttttgtttgaaaggacagttataattgatgaagatagaatatcaagatatgaagaaatcacagtggttagaaatggaggaacccatgggaatgtctctgcgaattgggtgttgacacggaacagcactgatccctcaccagtaacagcagatatcagaccgagctctggagttctccattttgcacaagggcagatgttggcaacaattcctcttactgtggttgatgatgatcttccagaagaggcagaagcttatctacttcaaattctgcctcatacaatacgaggaggtgcagaagtgagcgagccagcggagcttttgttctacattcaggatagtgatgatgtctatggcctaataacattttttcctatggaaaaccagaagattgaaagcagcccaggtgaacgatacttatccttgagttttacaagactaggagggactaaaggagatgtgaggttgctttattctgtactttacattcctgctggagctgtggaccccttgcaagcaaaagaaggcatcttaaatatatcaaggagaaatgacctcatttttccagagcaaaaaactcaagtcactacaaaattaccaataagaaatgatgcattccttcaaaatggagctcactttctagtacagttggaaactgtggagttgttaaacataattcctctaatcccacccataagccctagatttggggaaatctgcaatatttctttactggttactccagccattgcaaatggagaaattggctttctcagcaatcttccaattattttgcatgaaccagaagattttgctgctgaagtggtatacattcccttacatcgggatggaactgatggccaggctactgtctactggagtttgaagccctctggctttaattcaaaagcagtgaccccggatgatataggcccctttaatggctctgttttgtttttatctgggcaaagtgacacaacaatcaacattactatcaaaggtgatgacataccggaaatgaatgaaactgtaacactttctctagacagggttaacgtggaaaaccaagtgctgaaatctggatatactagccgtgacctaattattttggaaaatgatgaccctgggggagtttttgaattttctcctgcttccagaggaccctatgttataaaagaaggagaatctgtagagctccacatcatccgatcaagggggtcccttgttaagcagtttctacactaccgagtagagccaagagatagcaatgaattctatggaaacacgggagtactagaatttaaacctggagaaagggagatagtgatcaccttgctagcaagattggatgggataccagagttggatgaacactactgggtggtcctcagcagccacggagaacgggaaagcaagttgggaagtgccaccattgtcaatataacgattctgaaaaatgatgatcctcatggcattatagaatttgtttctgatggtctaattgtgatgataaatgaaagcaaaggagatgctatctatagtgctgtttatgatgtagtaagaaatcgaggcaactttggtgatgttagtgtatcatgggtggttagtccagactttacacaagatgtatttcctgtacaagggactgttgtctttggagatcaggaattttcaaaaaatatcaccatttactcccttccagatgagattccagaagaaatggaagaatttaccgttatcctactgaatggcactggaggagctaaagtgggaaatagaacaactgcaactctgaggattagaagaaatgatgaccccatttattttgcagaacctcgtgtagtgagggttcaggaaggtgagactgccaactttacagttctcagaaatggatctgttgatgtgacttgcatggtccagtatgctaccaaggatgggaaggctactgcaagagagagagatttcattcctgttgaaaaaggagaaacgctcatttttgaggttggaagtagacagcagagcatatccatatttgttaatgaagatggtatcccggaaacagatgagcccttttatataatcctcttgaattcaacaggtgatacagtagtatatcaatatggagtagctacagtaataattgaagctaatgatgacccaaatggcattttttctctggagcccatagacaaagcagtggaagaaggaaagactaatgcattttggattttgaggcaccgaggatactttggtagtgtttctgtatcttggcagctctttcagaatgattctgctttgcagcctgggcaggagttctatgaaacttcaggaactgttaacttcatggatggagaagaagcaaaaccaatcattctccatgcttttccagataaaattcctgaattcaatgaattttatttcctaaaacttgtaaacatttcaggtggatccccaggtcctgggggccagctagcagaaaccaacctccaggtgacagtaatggttccattcaatgatgatccctttggagtttttatcttggatccagagtgtttagagagagaagtggcagaagatgtcctgtctgaagatgatatgtcttatattaccaacttcaccattttgaggcagcagggtgtgtttggtgatgtacaactgggctgggaaatactgtccagtgagttccctgctggtttgccaccaatgatagattttttactggttggaattttccccaccaccgtgcatttacaacagcacatgcggcgtcaccacagtggaacggatgctttgtactttaccggactagagggtgcatttgggactgttaatccaaaataccatccctccaggaataatacaattgccaactttacattctcagcttgggtaatgcccaatgccaatacgaatggattcattatagcgaaggatgacggtaatggaagcatctactacggggtaaaaatacaaacaaacgaatcccatgtgacactttcccttcattataaaaccttgggttccaatgctacatacattgccaagacaacagtcatgaaatatttagaagaaagtgtttggcttcatctactaattatcctggaggatggtataatcgaattctacctggatggaaatgcaatgcccaggggaatcaagagtctgaaaggagaagccattactgacggtcctgggatactgagaattggagcagggataaatggcaatgacagatttacaggtctgatgcaggatgtgaggtcctatgagcggaaactgacgcttgaagaaatttatgaacttcatgccatgcccgcaaaaagtgatttacacccaatttctggatatctggagttcagacagggagaaactaacaaatcattcattatttctgcaagagatgacaatgacgaggaaggagaagaattattcattcttaaactagtttctgtatatggaggagctcgtatttcggaagaaaatactactgcaagattaacaatacaaaaaagtgacaatgcaaatggcttgtttggtttcacaggagcttgtataccagagattgcagaggagggatcaaccatttcttgtgtggttgagagaaccagaggagctctggattatgtgcatgttttttacaccatttcacagattgaaactgatggcattaattaccttgttgatgactttgctaatgccagtggaactattacattccttccttggcagagatcagaggttctgaatatatatgttcttgatgatgatattcctgaacttaatgagtatttccgtgtgacattggtttctgcaattcctggagatgggaagctaggctcaactcctaccagtggtgcaagcatagatcctgaaaaggaaacgactgatatcaccatcaaagctagtgatcatccatatggcttgctgcagttctccacagggctgcctcctcagcctaaggacgcaatgaccctgcctgcaagcagcgttccacatatcactgtggaggaggaagatggagaaatcaggttattggtcatccgtgcacagggacttctgggaagggtgactgcggaatttagaacagtgtccttgacagcattcagtcctgaggattaccagaatgttgctggcacattagaatttcaaccaggagaaagatataaatacattttcataaacatcactgataattctattcctgaactggaaaaatcttttaaagttgagttgttaaacttggaaggaggagtagctgaactctttagggttgatggaagtggtagtggtgatggggacatggaattcttccttccaactattcacaaacgtgccagtctaggagtggcttcccaaattctagtgacaattgcagcctctgaccacgctcatggcgtatttgaatttagccctgagtcactctttgtcagtggaactgaaccagaagatgggtatagcactgttacattaaatgttataagacatcatggaactctgtctccagtgactttgcattggaacatagactctgatcctgatggtgatctcgccttcacctctggcaacatcacatttgagattgggcagacgagcgccaatatcactgtggagatattgcctgacgaagacccagaactggataaggcattctctgtgtcagtcctcagtgtttccagtggttctttgggagctcatattaatgccacgttaacagttttggctagtgatgatccatatgggatattcattttttctgagaaaaacagacctgttaaagttgaggaagcaacccagaacatcacactatcaataataaggttgaaaggcctcatgggaaaagtccttgtctcatatgcaacactagatgatatggaaaaaccaccttattttccacctaatttagcgagagcaactcaaggaagagactatataccagcttctggatttgctctttttggagctaatcagagtgaggcaacaatagctatttcaattttggatgatgatgagccagaaaggtccgaatctgtctttatcgaactactcaactctactttagtagcgaaagtacagagtcgttcaattccaaattctccacgtcttgggcctaaggtagaaactattgcgcaactaattatcattgccaatgatgatgcatttggaactcttcagctctcagcaccaattgtccgagtggcagaaaatcatgttggacccattatcaatgtgactagaacaggaggagcatttgcagatgtctctgtgaagtttaaagctgtgccaataactgcaatagctggtgaagattatagtatagcttcatcagatgtggtcttgctagaaggggaaaccagtaaagccgtgccaatatatgtcattaatgatatctatcctgaactggaagaatcttttcttgtgcaactgatgaatgaaacaacaggaggagccagactaggggctttaacagaggcagtcattattattgaggcctctgatgacccctatggattatttggttttcagattactaaacttattgtagaggaacctgagtttaactcagtgaaggtaaacctgccaataattcgaaattctgggacactcggcaatgttactgttcagtgggttgccaccattaatggacagcttgctactggcgacctgcgagttgtctcaggtaatgtgacctttgcccctgggatgtcaagttatccaagtgcaactaactgatgcctctggtggaggtactattgggttagatcgaattgcaaatattattattcctgccaatgatgatccttatggtacagtagcctttgctcagatggtttatcgtgttcaagagcctctggaaagaagttcctgtgctaatataactgtcaggcgaagcggagggcactttggtcggctgttgttgttctacagtacttccgacattgatgtagtggctctggcaatggaggaaggtcaagatttactgtcctactatgaatctccaattcaaggggtgcctgacccactttggagaacttggatgaatgtctctgccgtgggggagcccctgtatacctgtgccactttgtgccttaaggaacaagcttgctcagcgttttcatttttcagtgcttctgagggtccccagtgtttctggatgacatcatggatcagcccagctgtcaacaattcagacttctggacctacaggaaaaacatgaccagggtagcatctctttttagtggtcaggctgtggctgggagtgactatgagcctgtgacaaggcaatgggccataatgcaggaaggtgatgaattcgcaaatctcacagtgtctattcttcctgatgatttcccagagatggatgagagttttctaatttctctccttgaagttcacctcatgaacatttcagccagtttgaaaaatcagccaaccataggacagccaaatatttctacagttgtcatagcactaaatggtgatgcctttggagtgtttgtgatctacaatattagtcccaatacttccgaagatggcttatttgttgaagttcaggagcagccccaaaccttggtggagctgatgatacacaggacagggggcagcttaggtcaagtggcagtcgaatggcgtgttgttggtggaacagctactgaaggtttagattttataggtgctggagagattctgacctttgctgaaggtgaaaccaaaaagacagtcattttaaccatcttggatgactctgaaccagaggatgacgaaagtatcatagttagtttggtgtacactgaaggtggaagtagaattttgccaagctccgacactgttagagtgaacattttggccaatgacaatgtggcaggaattgttagctttcagacagcttccagatctgtcataggtcatgaaggagaaattttacaattccatgtgataagaactttccctggtcgaggaaatgttactgttaactggaaaattattgggcaaaatctagaactcaattttgctaactttagcggacaacttttctttcctgaggggtcgttgaatacaacattgtttgtgcatttgttggatgacaacattcctgaggagaaagaagtataccaagtcattctgtatgatgtcaggacacaaggagttccaccagccggaatcgccctgcttgatgctcaaggatatgcagctgtcctcacagtagaagccagtgatgaaccacatggagttttaaattttgctctttcatcaagatttgtgttactacaagaggctaacataacaattcagcttttcatcaacagagaatttggatctctaggagctatcaatgtcacatataccacggttcctggaatgctgagtctgaagaaccaaacagtaggaaacctagcagagccagaagttgattttgtccctatcattggctttctgattttagaagaaggggaaacagcagcagccatcaacattaccattcttgaggatgatgtaccagagctagaagaatatttcctggtgaatttaacttacgttggacttaccatggctgcttcaacttcatttcctcccagactagattcagaaggtttgactgcacaagttattattgatgccaatgatggggcccgaggtgtaattgaatggcaacaaagcaggtttgaagtaaatgaaacccatggaagtttaacattggtagcccagaggagcagagaacctcttggccatgtttccttatttgtgtatgctcagaatttggaagcacaagtggggctggattatatcttcaccccaatgattcttcattttgctgatggagaaaggtataaaaatgtcaatatcatgattcttgatgatgacattccagaaggagatgaaaaatttcagctgattttaacaaatccttctcctggactagagctagggaaaaatacaatagccttaattattgtccttgctaatgatgacggccctggagttctatcatttaacaacagtgagcactttttcctaagagagccaacagctctctacgtccaggagagtgttgcagtattgtacattgttcgggaacctgcacaaggattgtttggaacagtgacagttcagttcattgtgacagaagtgaattcctcaaatgaatctaaagatctgactccttccaaaggctatattgttttagaagaaggtgttcgattcaaggccctacaaatatctgccatattagacacggaaccagaaatggatgagtattttgtttgcaccttgtttaatccaactggaggtgctagactaggggtgcatgttcaaaccctgataacagttttgcaaaaccaggcccctttggggctattcagtatctctgcagttgaaaatagagccacctccatagacatcgaagaagccaataggaccgtgtatttaaatgtatctcgaactaatggcattgatttggctgtgagtgtgcagtgggagacagtatctgaaacagcctttggcatgaggggaatggatgttgtgttttccgtatttcaaagttttttggatgaatcagcttctggctggtgtttctttactttggaaaatttaatatatggtataatgttaagaaaatcatctgttactgtttaccgatggcaggggatttttattccagttgaggatttaaatatagaaaatcctaaaacttgtgaggcctttaatattggtttttctccctactttgtgattactcatgaagaaagaaatgaagaaaagccttctcttaacagtgtgtttacattcacatctggatttaaattattcctggtacaaacaatcattattctggaaagttctcaagtaagatattttacttcagacagccaagattatttaatcattgcaagtcaaagagatgattccgaattaactcaggtcttcaggtggaatggaggaagcttcgtgttgcatcaaaaactccctgtccgaggtgtgctgaccgtggccttgttcaacaagggaggctctgtgttcttagccatttcccaggctaatgccaggctaaactcccttttattcagatggtctggcagtgggtttattaactttcaagaggtgcctgtcagtgggacaacagaagttgaggctttgtcttcagccaatgatatttacctaatatttgccgaaaatgtctttctaggagatcagaattcaattgatattttcatctgggagatgggacagtcttccttcaggtattttcagtctgtagattttgctgctgttaacagaatccactccttcacaccagcctcaggaatagcccacatacttcttattggccaagatatgtctgctctttactgctggaattcggagcgtaatcaattctcttttgttctggaagtaccttctgcttatgatgtggcttctgttacagtaaagtcccttaattcaagcaagaatttaatagctctagtgggagctcattcacatatatatgagctagcctacatttccagccattctgactttattcctagttcaggtgaactgatatttgaacctggtgagagagaagctacaatagcagtaaatatccttgatgatacagttccagaaaaagaagaatccttcaaagttcaacttaaaaatcccaaaggaggagcagagattggcattaatgattctgtaacaataaccattctgtctaatgatgatgcctatggaattgttgcatttgctcagaattcattatataagcaagtggaagaaatggagcaagatagcctagtaaccttgaacgttgaacgcttaaaaggaacatatggccgtataaccatagcatgggaagctgatggaagtattagtgatatatttcctacctcaggagtgattttatttactgaaggccaggtactgtcaacaatcactctaactattcttgctgataatataccagagttatcagaggttgtgattgtaaccctcacccgtatcaccacagaaggggttgaggactcatacaaaggtgctactattgatcaggacagaagcaagtctgttataacaactttgcccaatgactcaccttttggcttggtgggctggcgtgctgcgtctgtcttcattagagtagcagagcctaaagaaaacaccaccactcttcagttacaaatagctcgagataaaggactacttggggatattgccattcacttgagagctcaacccaatttcttactgcatgtcgataatcaagctactgagaatgaagattatgtattgcaagaaacaataataataatgaaagaaaacataaaagaagctcatgccgaagtttccattttgccggatgaccttcctgaattggaggaaggatttattgtcactatcactgaggtgaacctggtgaactctgacttctctacaggacagccaagtgtgcggaggcccggaatggaaatagctgagataatgatagaagaaaatgacgatcccagaggaatttttatgtttcatgttactagaggcgctggggaagttattactgcctatgaggtgcctccacccttgaacgttcttcaagttcctgtagtccggctggctggaagctttggggcagtaaatgtttattggaaagcatcaccagacagtgctggcctggaagactttaaaccatctcatgggattcttgaatttgcagataaacaggttactgcaatgatagaaatcaccataattgatgatgctgaatttgaattgacagagacgttcaatatttccttgatcagtgttgctggaggtggcagacttggtgatgatgttgtggtaactgttgttattccacaaaatgattctccatttggagtatttggatttgaagaaaagactgtaatgattgatgaatccctttcatccgatgaccctgattcatatgtgacattgacggttgtccggtccccaggaggaaaaggaaccgtccgacttgagtggaccatagatgagaaggctaaacataaccttagtcctttgaatgggacccttcattttgatgagactgagtcccagaagaccattgtgttgcacacacttcaagacacagtgttggaggaggacaggcgtttcaccattcagctgatatcaattgatgaggtagaaatatctccagtaaaaggtagtgcatcaataattattcggggtgataagcgagcatcaggagaagttgggatagctccgtcatctaggcacatcctcattggggaaccctcagcaaaatataatggtaccgctattatcagccttgttcgaggcccagggattttgggggaggtcacagtgttctggaggatattccctccttccgtgggggaatttgctgaaacatcaggaaaactgacaatgcgagacgaacagtctgcagtcattgtagtaatacaggctttgaacgatgacattcccgaggaaaaaagcttctatgagtttcagctcactgcagtcagtgagggaggagttctgagtgaatccagcagcactgccaacatcacggtggtggccagcgactctccctatggccgatttgccttttcacatgagcaacttcgagtgtcagaagcacagagggttaacatcacaatcatccgttccagtggagattttggccatgtgcgactctggtacaagacgatgagcgggacagcggaagcaggcttggattttgttcctgcagcaggggagctcctctttgaagcaggggagatgaggaaaagtctgcatgttgaaatccttgatgatgactatcctgaaggcccagaggaattttctctaacaattacaaaggtggaactccagggaagagggtatgattttaccattcaagaaaatggacttcagatagatcaacctcctgaaataggaaacatctccattgttcgcatcataataatgaaaaatgataacgcagaaggcatcattgaatttgacccaaagtatactgccttcgaagtggaggaagatgttgggctgatcatgatcccagtggtgaggctacatggaacttatggctatgtgacagctgatttcatctctcagagctcctctgccagtcccggaggtgttgattacattttgcatggcagtacagtcacctttcagcatgggcaaaacttaagttttataaatatctccatcattgatgacaatgaaagtgaatttgaggagcccattgaaattctactcactggagctactggaggagcggtccttgggcgccacctagtgagcagaatcataatagctaagagtgactctccctttggagttataaggtttctcaatcaaagcaaaatttctattgctaatcccaattccacaatgattttatcactggtgctggagcggactggaggactcttgggagagattcaggtgaactgggagacagtaggacccaactctcaagaagccttactgccacagaatagagacattgcagacccagtgagcgggttgttctattttggagaaggagaaggaggagtgagaaccataattctgacaatctatcctcatgaagaaattgaagttgaagagacattcattattaaacttcatcttgtgaaaggagaagctaaattagactccagagctaaagatgttacattaaccatacaagagtttggtgacccaaatggagttgttcagtttgctcctgaaactttgtctaagaagacttattcagagcctctggctctggaagggcccctgctcattaccttctttgtcagaagagtcaagggcacctttggagagattatggtttactgggaattaagtagtgagtttgacattactgaagactttctttccaccagtggatttttcaccattgctgatggagagagtgaagctagctttgatgttcatttgctaccagatgaggtacctgagatagaggaagattatgtgatccagcttgtttctgtagagggaggagccgaactggatctggagaagagtatcacatggttctctgtttatgcaaatgatgacccacatggagtatttgccctgtattcggatcgccagtcaatacttattgggcagaaccttattagatccatccaaattaacataacccggcttgctggaacatttggagatgtggctgttgggcttcgaatatcatcggatcataaagaacagccgattgttaccgaaaatgcagagaggcagctggtggtcaaagatggtgccacatataaagtggacgtggtgccaataaagaatcaggtcttcctatcactgggctctaatttcactttgcaactggtgactgtgatgcttgtcggtggacgtttctatggaatgccaacaattcttcaggaagcaaaatctgctgtccttccagtctctgagaaagctgccaattctcaggtcggatttgaatccactgcttttcaactcatgaacatcactgctggcacaagccacgttatgatttctaggagaggcacatatggagctctctcggttgcctggaccactggatatgctcctgggttagaaattcctgaattcattgttgttggcaacatgaccccaacactggggagcctttcattttcccacggtgaacaaaggaaaggagttttcctgtggacgtttcctagccctggttggccagaggcctttgttcttcacctatcaggagtgcagagcagtgctcctggcggagctcaactccgatcaggtttcattgttgctgaaattgaaccaatgggcgtcttccaattttccactagctcaagaaatatcatagtgtcagaagatacacagatgatcagattacatgtacaaagactatttgggttccacagcgatcttattaaagtttcttatcagaccactgcaggaagcgccaagccactggaagattttgagcctgttcagaatggggaactgttttttcaaaaattccaaactgaggttgattttgaaataaccattattaatgatcagctttctgagatagaagaatttttttacattaaccttacttcagtagaaattaggggattacaaaagtttgatgttaattggagcccacgcctgaatctagatttcagtgttgcagtgattacaatattggataatgatgacctggcaggaatggatatttccttccccgagacaactgtggctgtagcagttgacacaactctcattcctgtagaaactgaatccaccacatacctcagcacaagcaagacgactaccattctgcagccaaccaacgtggttgccattgttactgaggcaactggtgtatctgccatccctgagaaacttgtcacccttcatggcacacctgctgtgtctgaaaagcctgatgtggccactgtaactgccaatgtttccattcatggaacattcagccttgggccatccattgtttatattgaagaggagatgaagaatggcacattcaacactgcagaagttcttatccgaagaactggtgggtttactggcaatgtcagcataacagttaaaactttcggtgaaagatgtgctcagatggaaccaaatgcattgccctttcgtggtatctatgggatttccaacctaacatgggcagttgaagaagaagactttgaagaacaaactcttacccttatattcctagatggagaaagagaacgtaaagtatcagttcaaattttggatgatgatgagcctgaggggcaggaattcttctacgtgtttctcacaaaccctcaagggggagcacagattgtggaggagaaggatgatactggatttgcagcttttgccatggttattattacagggagtgaccttcacaatggcatcataggattcagtgaggagtcccagagtggactagaactcagggaaggagctgttatgagaagattgcaccttattgtcacaagacagccaaacagggcctttgaagatgtcaaggtcttttggcgagtcacacttaacaaaacagtcgtcgtgctccagaaggatggggtaaacctggtggaggaacttcagtctgtgtcagggaccacaacctgtacaatgggtcaaacaaaatgctttatcagcattgaactcaaaccagaaaaggtaccacaggttgaagtgtatttttttgtggaactatatgaagctactgctggagcagcaataaacaacagtgccagattcgcacagattaaaatcttagaaagtgatgaatctcaaagccttgtgtatttttctgtgggttctcggctggcagtggctcacaagaaggccactttaatcagtctgcaggtggccagagattctgggacaggactaatgatgtctgttaactttagtacccaggagttgaggagtgctgaaacaattggtcgtaccatcatatctccagctatttctggaaaggattttgtgataactgaaggcacattggtctttgaacctggccagagaagcactgtattggatgtcatcctaacgccagagacaggatctttaaattcatttcctaaacgcttccagattgtcctttttgacccaaaaggtggtgccagaattgataaagtgtatgggactgccaacatcactcttgtctcagatgcagattcgcaggccatttgggggcttgcagatcagctacatcagcctgtgaatgatgatattctcaacagagtgctccataccatcagcatgaaagtggccacagaaaacacagatgaacaactcagtgccatgatgcatttaatagaaaagataactactgaaggaaaaattcaagctttcagtgttgccagccgaactcttttctatgagattctttgttctcttattaacccaaagcgcaaggacactaggggattcagtcactttgctgaagtgactgagaattttgccttttctctgctgactaatgttacttgcggctctcctggtgaaaaaagcaaaaccatccttgatagttgcccatatttgtcaatattggctcttcactggtatcctcagcaaatcaatggacacaagtttgaaggaaaggaaggagattacattcgaattccagagaggctactggatgtccaggatgcagaaataatggctgggaaaagtacatgtaaattagtccagtttacagagtatagcagccaacagtggtttataagtggaaacaatcttcctaccctaaaaaataaggtattatctttgagtgtgaaaggtcagagttcacaactcctgactaatgacaatgaggttctctacaggatttatgctgctgagcctagaattattcctcagacatctctgtgtctcctttggaatcaggctgctgcaagctggttgtctgacagtcagttttgcaaagtggttgaggaaactgcagactatgtggaatgtgcctgttcacacatgtctgtgtatgctgtctatgctcggactgacaacttgtcttcatacaatgaagccttcttcacttctggatttatatgtatctcaggtctttgcttggctgttctttcccatatcttctgtgccaggtactccatgtttgcagctaaacttctgactcacatgatggcagccagcttaggtacacagattctgtttctggcgtctgcatacgcaagtccccaactcgctgaggagagctgttcagctatggctgctgtcacacattacctgtatctttgccagtttagctggatgctcattcagtctgtgaatttctggtacgtgctggtgatgaatgatgagcacacagagaggcgatatctgctgtttttccttctgagttggggactaccagcttttgtggtgattctcctcatagttattttgaaaggaatctatcatcagagcatgtcacagatctatggactcattcatggtgacctgtgttttattccaaacgtctatgctgctttgttcactgcagctcttgttcctttgacgtgcctcgtggtggtgttcgtggtgttcatccatgcctaccaggtgaagccacagtggaaagcatatgatgatgtcttcagaggaaggacaaatgctgcagaaattccactgattttatatctctttgctctgatttccgtgacatggctttggggaggactacacatggcctacagacacttctggatgttggttctctttgtcattttcaacagtctgcagggactttatgttttcatggtttatttcattttacacaaccaaatgtgttgccctatgaaggccagttacactgtggaaatgaatgggcatcctggacccagcacagcctttttcacgcccgggagtggaatgcctcctgctggaggggaaatcagcaagtccacccagaatctcatcggtgctatggaggaggtgccacctgactgggagagagcatccttccaacagggcagtcaggccagccctgatttaaagccaagtccacaaaatggagccacgttcccgtcctctggaggatatggccaggggtcactgatagccgatgaggagtcccaggagtttgatgatttaatatttgcattaaaaactggtgctggtctcagtgtcagtgataatgaatctggtcaaggcagccaggaggggggcaccttgactgactcccagatcgtggagctcaggaggatacccatcgccgacactcacctgtagcacctcactaaccattcgactgagcacactttcatatttgtatcagcttttgtgctaaaactctctaagtacatccacctgtgtaataggaacctgtgaattgtactggatgattaatacaaacgtgattgttgtatttggagtataaattactgattgtatgtgacctgaaaattcactgctataagaaaggtggagtcagtttgtatcagttaataggatgttcatattccaaggatattagttgtttttttaatcatcctatatggctaacattgtttaatgaaagtaataatcaataaagcaatagaatcta

SEQ ID NO: 11665 - DNA, 19338 bp, Homo sapiens
agtaagaatcagcagcgcgggcaaggagtacggacgggagtcagaggcagagcgagggtgtgtggagggccggcggggaccgccgggagcgcgcggatgtcggtgttcctggggccagggatgccctctgcatctttattagtaaatcttctttcagctttactcatcctatttgtgtttggagaaacagaaataagatttactggacaaactgaatttgttgttaatgaaacaagtacaacagttattcgtcttatcattgaaaggataggagagccagcaaatgttactgcaattgtatcgctgtatggagaggacgctggtgacttttttgacacatatgctgcagcttttatacctgccggagaaacaaacagaacagtgtacatagcagtatgtgatgatgacttaccagagcctgacgaaacttttatttttcacttaacattacagaaaccttcagcaaatgtgaagcttggatggccaaggactgttactgtgacaatattatcaaatgacaatgcatttggaattatttcatttaatatgcttccctcaatcgcagtgagtgagcccaagggcagaaatgagtctatgcctcttactctcatcagggaaaagggaacctatggaatggtcatggtgacttttgaggtagagggtggcccaaatccccctgatgaagatttgagtccagttaaaggaaatatcacctttccccctggcagagcaacagtaatttataacttgacagtactcgatgacgaggtaccagaaaatgatgaaatatttttaattcaactgaaaagtgtagaaggaggagctgagattaacacctctaggaattccattgagatcatcattaagaaaaatgatagtcccgtgagattccttcagagtatttatttggttcctgaggaagaccacatactcataattccagtagttcgtggaaaggacaacaatggaaatctgattggatctgatgaatatgaggtttcaatcagttatgctgtcacaactgggaattccacagcacatgcccagcaaaatctggacttcattgatcttcagccaaacacaactgttgtttttccaccttttattcatgaatctcacttgaaatttcaaatagttgatgacaccataccggagattgctgaatcgtttcacattatgttactaaaagataccttacagggagatgctgtgctaataagcccttctgttgtacaagtcaccattaagccaaatgataaaccttatggagtcctttcattcaacagtgttttgtttgaaaggacagttataattgatgaagatagaatatcaagatatgaagaaatcacagtggttagaaatggaggaacccatgggaatgtctctgcgaattgggtgttgacacggaacagcactgatccctcaccagtaacagcagatatcagaccgagctctggagttctccattttgcacaagggcagatgttggcaacaattcctcttactgtggttgatgatgatcttccagaagaggcagaagcttatctacttcaaattctgcctcatacaatacgaggaggtgcagaagtgagcgagccagcggagcttttgttctacattcaggatagtgatgatgtctatggcctaataacattttttcctatggaaaaccagaagattgaaagcagcccaggtgaacgatacttatccttgagttttacaagactaggagggactaaaggagatgtgaggttgctttattctgtactttacattcctgctggagctgtggaccccttgcaagcaaaagaaggcatcttaaatatatcaaggagaaatgacctcatttttccagagcaaaaaactcaagtcactacaaaattaccaataagaaatgatgcattccttcaaaatggagctcactttctagtacagttggaaactgtggagttgttaaacataattcctctaatcccacccataagccctagatttggggaaatctgcaatatttctttactggttactccagccattgcaaatggagaaattggctttctcagcaatcttccaattattttgcatgaaccagaagattttgctgctgaagtggtatacattcccttacatcgggatggaactgatggccaggctactgtctactggagtttgaagccctctggctttaattcaaaagcagtgaccccggatgatataggcccctttaatggctctgttttgtttttatctgggcaaagtgacacaacaatcaacattactatcaaaggtgatgacataccggaaatgaatgaaactgtaacactttctctagacagggttaacgtggaaaaccaagtgctgaaatctggatatactagccgtgacctaattattttggaaaatgatgaccctgggggagtttttgaattttctcctgcttccagaggaccctatgttataaaagaaggagaatctgtagagctccacatcatccgatcaagggggtcccttgttaagcagtttctacactaccgagtagagccaagagatagcaatgaattctatggaaacacgggagtactagaatttaaacctggagaaagggagatagtgatcaccttgctagcaagattggatgggataccagagttggatgaacactactgggtggtcctcagcagccacggagaacgggaaagcaagttgggaagtgccaccattgtcaatataacgattctgaaaaatgatgatcctcatggcattatagaatttgtttctgatggtctaattgtgatgataaatgaaagcaaaggagatgctatctatagtgctgtttatgatgtagtaagaaatcgaggcaactttggtgatgttagtgtatcatgggtggttagtccagactttacacaagatgtatttcctgtacaagggactgttgtctttggagatcaggaattttcaaaaaatatcaccatttactcccttccagatgagattccagaagaaatggaagaatttaccgttatcctactgaatggcactggaggagctaaagtgggaaatagaacaactgcaactctgaggattagaagaaatgatgaccccatttattttgcagaacctcgtgtagtgagggttcaggaaggtgagactgccaactttacagttctcagaaatggatctgttgatgtgacttgcatggtccagtatgctaccaaggatgggaaggctactgcaagagagagagatttcattcctgttgaaaaaggagaaacgctcatttttgaggttggaagtagacagcagagcatatccatatttgttaatgaagatggtatcccggaaacagatgagcccttttatataatcctcttgaattcaacaggtgatacagtagtatatcaatatggagtagctacagtaataattgaagctaatgatgacccaaatggcattttttctctggagcccatagacaaagcagtggaagaaggaaagactaatgcattttggattttgaggcaccgaggatactttggtagtgtttctgtatcttggcagctctttcagaatgattctgctttgcagcctgggcaggagttctatgaaacttcaggaactgttaacttcatggatggagaagaagcaaaaccaatcattctccatgcttttccagataaaattcctgaattcaatgaattttatttcctaaaacttgtaaacatttcaggtggatccccaggtcctgggggccagctagcagaaaccaacctccaggtgacagtaatggttccattcaatgatgatccctttggagtttttatcttggatccagagtgtttagagagagaagtggcagaagatgtcctgtctgaagatgatatgtcttatattaccaacttcaccattttgaggcagcagggtgtgtttggtgatgtacaactgggctgggaaatactgtccagtgagttccctgctggtttgccaccaatgatagattttttactggttggaattttccccaccaccgtgcatttacaacagcacatgcggcgtcaccacagtggaacggatgctttgtactttaccggactagagggtgcatttgggactgttaatccaaaataccatccctccaggaataatacaattgccaactttacattctcagcttgggtaatgcccaatgccaatacgaatggattcattatagcgaaggatgacggtaatggaagcatctactacggggtaaaaatacaaacaaacgaatcccatgtgacactttcccttcattataaaaccttgggttccaatgctacatacattgccaagacaacagtcatgaaatatttagaagaaagtgtttggcttcatctactaattatcctggaggatggtataatcgaattctacctggatggaaatgcaatgcccaggggaatcaagagtctgaaaggagaagccattactgacggtcctgggatactgagaattggagcagggataaatggcaatgacagatttacaggtctgatgcaggatgtgaggtcctatgagcggaaactgacgcttgaagaaatttatgaacttcatgccatgcccgcaaaaagtgatttacacccaatttctggatatctggagttcagacagggagaaactaacaaatcattcattatttctgcaagagatgacaatgacgaggaaggagaagaattattcattcttaaactagtttctgtatatggaggagctcgtatttcggaagaaaatactactgcaagattaacaatacaaaaaagtgacaatgcaaatggcttgtttggtttcacaggagcttgtataccagagattgcagaggagggatcaaccatttcttgtgtggttgagagaaccagaggagctctggattatgtgcatgttttttacaccatttcacagattgaaactgatggcattaattaccttgttgatgactttgctaatgccagtggaactattacattccttccttggcagagatcagaggttctgaatatatatgttcttgatgatgatattcctgaacttaatgagtatttccgtgtgacattggtttctgcaattcctggagatgggaagctaggctcaactcctaccagtggtgcaagcatagatcctgaaaaggaaacgactgatatcaccatcaaagctagtgatcatccatatggcttgctgcagttctccacagggctgcctcctcagcctaaggacgcaatgaccctgcctgcaagcagcgttccacatatcactgtggaggaggaagatggagaaatcaggttattggtcatccgtgcacagggacttctgggaagggtgactgcggaatttagaacagtgtccttgacagcattcagtcctgaggattaccagaatgttgctggcacattagaatttcaaccaggagaaagatataaatacattttcataaacatcactgataattctattcctgaactggaaaaatcttttaaagttgagttgttaaacttggaaggaggagtagctgaactctttagggttgatggaagtggtagtggtgatggggacatggaattcttccttccaactattcacaaacgtgccagtctaggagtggcttcccaaattctagtgacaattgcagcctctgaccacgctcatggcgtatttgaatttagccctgagtcactctttgtcagtggaactgaaccagaagatgggtatagcactgttacattaaatgttataagacatcatggaactctgtctccagtgactttgcattggaacatagactctgatcctgatggtgatctcgccttcacctctggcaacatcacatttgagattgggcagacgagcgccaatatcactgtggagatattgcctgacgaagacccagaactggataaggcattctctgtgtcagtcctcagtgtttccagtggttctttgggagctcatattaatgccacgttaacagttttggctagtgatgatccatatgggatattcattttttctgagaaaaacagacctgttaaagttgaggaagcaacccagaacatcacactatcaataataaggttgaaaggcctcatgggaaaagtccttgtctcatatgcaacactagatgatatggaaaaaccaccttattttccacctaatttagcgagagcaactcaaggaagagactatataccagcttctggatttgctctttttggagctaatcagagtgaggcaacaatagctatttcaattttggatgatgatgagccagaaaggtccgaatctgtctttatcgaactactcaactctactttagtagcgaaagtacagagtcgttcaattccaaattctccacgtcttgggcctaaggtagaaactattgcgcaactaattatcattgccaatgatgatgcatttggaactcttcagctctcagcaccaattgtccgagtggcagaaaatcatgttggacccattatcaatgtgactagaacaggaggagcatttgcagatgtctctgtgaagtttaaagctgtgccaataactgcaatagctggtgaagattatagtatagcttcatcagatgtggtcttgctagaaggggaaaccagtaaagccgtgccaatatatgtcattaatgatatctatcctgaactggaagaatcttttcttgtgcaactgatgaatgaaacaacaggaggagccagactaggggctttaacagaggcagtcattattattgaggcctctgatgacccctatggattatttggttttcagattactaaacttattgtagaggaacctgagtttaactcagtgaaggtaaacctgccaataattcgaaattctgggacactcggcaatgttactgttcagtgggttgccaccattaatggacagcttgctactggcgacctgcgagttgtctcaggtaatgtgacctttgcccctggggaaaccattcaaaccttgttgttagaggtcctggctgacgacgttccggagattgaagaggttatccaagtgcaactaactgatgcctctggtggaggtactattgggttagatcgaattgcaaatattattattcctgccaatgatgatccttatggtacagtagcctttgctcagatggtttatcgtgttcaagagcctctggaaagaagttcctgtgctaatataactgtcaggcgaagcggagggcactttggtcggctgttgttgttctacagtacttccgacattgatgtagtggctctggcaatggaggaaggtcaagatttactgtcctactatgaatctccaattcaaggggtgcctgacccactttggagaacttggatgaatgtctctgccgtgggggagcccctgtatacctgtgccactttgtgccttaaggaacaagcttgctcagcgttttcatttttcagtgcttctgagggtccccagtgtttctggatgacatcatggatcagcccagctgtcaacaattcagacttctggacctacaggaaaaacatgaccagggtagcatctctttttagtggtcaggctgtggctgggagtgactatgagcctgtgacaaggcaatgggccataatgcaggaaggtgatgaattcgcaaatctcacagtgtctattcttcctgatgatttcccagagatggatgagagttttctaatttctctccttgaagttcacctcatgaacatttcagccagtttgaaaaatcagccaaccataggacagccaaatatttctacagttgtcatagcactaaatggtgatgcctttggagtgtttgtgatctacaatattagtcccaatacttccgaagatggcttatttgttgaagttcaggagcagccccaaaccttggtggagctgatgatacacaggacagggggcagcttaggtcaagtggcagtcgaatggcgtgttgttggtggaacagctactgaaggtttagattttataggtgctggagagattctgacctttgctgaaggtgaaaccaaaaagacagtcattttaaccatcttggatgactctgaaccagaggatgacgaaagtatcatagttagtttggtgtacactgaaggtggaagtagaattttgccaagctccgacactgttagagtgaacattttggccaatgacaatgtggcaggaattgttagctttcagacagcttccagatctgtcataggtcatgaaggagaaattttacaattccatgtgataagaactttccctggtcgaggaaatgttactgttaactggaaaattattgggcaaaatctagaactcaattttgctaactttagcggacaacttttctttcctgaggggtcgttgaatacaacattgtttgtgcatttgttggatgacaacattcctgaggagaaagaagtataccaagtcattctgtatgatgtcaggacacaaggagttccaccagccggaatcgccctgcttgatgctcaaggatatgcagctgtcctcacagtagaagccagtgatgaaccacatggagttttaaattttgctctttcatcaagatttgtgttactacaagaggctaacataacaattcagcttttcatcaacagagaatttggatctctaggagctatcaatgtcacatataccacggttcctggaatgctgagtctgaagaaccaaacagtaggaaacctagcagagccagaagttgattttgtccctatcattggctttctgattttagaagaaggggaaacagcagcagccatcaacattaccattcttgaggatgatgtaccagagctagaagaatatttcctggtgaatttaacttacgttggacttaccatggctgcttcaacttcatttcctcccagactagattcagaaggtttgactgcacaagttattattgatgccaatgatggggcccgaggtgtaattgaatggcaacaaagcaggtttgaagtaaatgaaacccatggaagtttaacattggtagcccagaggagcagagaacctcttggccatgtttccttatttgtgtatgctcagaatttggaagcacaagtggggctggattatatcttcaccccaatgattcttcattttgctgatggagaaaggtataaaaatgtcaatatcatgattcttgatgatgacattccagaaggagatgaaaaatttcagctgattttaacaaatccttctcctggactagagctagggaaaaatacaatagccttaattattgtccttgctaatgatgacggccctggagttctatcatttaacaacagtgagcactttttcctaagagagccaacagctctctacgtccaggagagtgttgcagtattgtacattgttcgggaacctgcacaaggattgtttggaacagtgacagttcagttcattgtgacagaagtgaattcctcaaatgaatctaaagatctgactccttccaaaggctatattgttttagaagaaggtgttcgattcaaggccctacaaatatctgccatattagacacggaaccagaaatggatgagtattttgtttgcaccttgtttaatccaactggaggtgctagactaggggtgcatgttcaaaccctgataacagttttgcaaaaccaggcccctttggggctattcagtatctctgcagttgaaaatagagccacctccatagacatcgaagaagccaataggaccgtgtatttaaatgtatctcgaactaatggcattgatttggctgtgagtgtgcagtgggagacagtatctgaaacagcctttggcatgaggggaatggatgttgtgttttccgtatttcaaagttttttggatgaatcagcttctggctggtgtttctttactttggaaaatttaatatatggtataatgttaagaaaatcatctgttactgtttaccgatggcaggggatttttattccagttgaggatttaaatatagaaaatcctaaaacttgtgaggcctttaatattggtttttctccctactttgtgattactcatgaagaaagaaatgaagaaaagccttctcttaacagtgtgtttacattcacatctggatttaaattattcctggtacaaacaatcattattctggaaagttctcaagtaagatattttacttcagacagccaagattatttaatcattgcaagtcaaagagatgattccgaattaactcaggtcttcaggtggaatggaggaagcttcgtgttgcatcaaaaactccctgtccgaggtgtgctgaccgtggccttgttcaacaagggaggctctgtgttcttagccatttcccaggctaatgccaggctaaactcccttttattcagatggtctggcagtgggtttattaactttcaagaggtgcctgtcagtgggacaacagaagttgaggctttgtcttcagccaatgatatttacctaatatttgccgaaaatgtctttctaggagatcagaattcaattgatattttcatctgggagatgggacagtcttccttcaggtattttcagtctgtagattttgctgctgttaacagaatccactccttcacaccagcctcaggaatagcccacatacttcttattggccaagatatgtctgctctttactgctggaattcggagcgtaatcaattctcttttgttctggaagtaccttctgcttatgatgtggcttctgttacagtaaagtcccttaattcaagcaagaatttaatagctctagtgggagctcattcacatatatatgagctagcctacatttccagccattctgactttattcctagttcaggtgaactgatatttgaacctggtgagagagaagctacaatagcagtaaatatccttgatgatacagttccagaaaaagaagaatccttcaaagttcaacttaaaaatcccaaaggaggagcagagattggcattaatgattctgtaacaataaccattctgtctaatgatgatgcctatggaattgttgcatttgctcagaattcattatataagcaagtggaagaaatggagcaagatagcctagtaaccttgaacgttgaacgcttaaaaggaacatatggccgtataaccatagcatgggaagctgatggaagtattagtgatatatttcctacctcaggagtgattttatttactgaaggccaggtactgtcaacaatcactctaactattcttgctgataatataccagagttatcagaggttgtgattgtaaccctcacccgtatcaccacagaaggggttgaggactcatacaaaggtgctactattgatcaggacagaagcaagtctgttataacaactttgcccaatgactcaccttttggcttggtgggctggcgtgctgcgtctgtcttcattagagtagcagagcctaaagaaaacaccaccactcttcagttacaaatagctcgagataaaggactacttggggatattgccattcacttgagagctcaacccaatttcttactgcatgtcgataatcaagctactgagaatgaagattatgtattgcaagaaacaataataataatgaaagaaaacataaaagaagctcatgccgaagtttccattttgccggatgaccttcctgaattggaggaaggatttattgtcactatcactgaggtgaacctggtgaactctgacttctctacaggacagccaagtgtgcggaggcccggaatggaaatagctgagataatgatagaagaaaatgacgatcccagaggaatttttatgtttcatgttactagaggcgctggggaagttattactgcctatgaggtgcctccacccttgaacgttcttcaagttcctgtagtccggctggctggaagctttggggcagtaaatgtttattggaaagcatcaccagacagtgctggcctggaagactttaaaccatctcatgggattcttgaatttgcagataaacaggttactgcaatgatagaaatcaccataattgatgatgctgaatttgaattgacagagacgttcaatatttccttgatcagtgttgctggaggtggcagacttggtgatgatgttgtggtaactgttgttattccacaaaatgattctccatttggagtatttggatttgaagaaaagactgtaatgattgatgaatccctttcatccgatgaccctgattcatatgtgacattgacggttgtccggtccccaggaggaaaaggaaccgtccgacttgagtggaccatagatgagaaggctaaacataaccttagtcctttgaatgggacccttcattttgatgagactgagtcccagaagaccattgtgttgcacacacttcaagacacagtgttggaggaggacaggcgtttcaccattcagctgatatcaattgatgaggtagaaatatctccagtaaaaggtagtgcatcaataattattcggggtgataagcgagcatcaggagaagttgggatagctccgtcatctaggcacatcctcattggggaaccctcagcaaaatataatggtaccgctattatcagccttgttcgaggcccagggattttgggggaggtcacagtgttctggaggatattccctccttccgtgggggaatttgctgaaacatcaggaaaactgacaatgcgagacgaacagtctgcagtcattgtagtaatacaggctttgaacgatgacattcccgaggaaaaaagcttctatgagtttcagctcactgcagtcagtgagggaggagttctgagtgaatccagcagcactgccaacatcacggtggtggccagcgactctccctatggccgatttgccttttcacatgagcaacttcgagtgtcagaagcacagagggttaacatcacaatcatccgttccagtggagattttggccatgtgcgactctggtacaagacgatgagcgggacagcggaagcaggcttggattttgttcctgcagcaggggagctcctctttgaagcaggggagatgaggaaaagtctgcatgttgaaatccttgatgatgactatcctgaaggcccagaggaattttctctaacaattacaaaggtggaactccagggaagagggtatgattttaccattcaagaaaatggacttcagatagatcaacctcctgaaataggaaacatctccattgttcgcatcataataatgaaaaatgataacgcagaaggcatcattgaatttgacccaaagtatactgccttcgaagtggaggaagatgttgggctgatcatgatcccagtggtgaggctacatggaacttatggctatgtgacagctgatttcatctctcagagctcctctgccagtcccggaggtgttgattacattttgcatggcagtacagtcacctttcagcatgggcaaaacttaagttttataaatatctccatcattgatgacaatgaaagtgaatttgaggagcccattgaaattctactcactggagctactggaggagcggtccttgggcgccacctagtgagcagaatcataatagctaagagtgactctccctttggagttataaggtttctcaatcaaagcaaaatttctattgctaatcccaattccacaatgattttatcactggtgctggagcggactggaggactcttgggagagattcaggtgaactgggagacagtaggacccaactctcaagaagccttactgccacagaatagagacattgcagacccagtgagcgggttgttctattttggagaaggagaaggaggagtgagaaccataattctgacaatctatcctcatgaagaaattgaagttgaagagacattcattattaaacttcatcttgtgaaaggagaagctaaattagactccagagctaaagatgttacattaaccatacaagagtttggtgacccaaatggagttgttcagtttgctcctgaaactttgtctaagaagacttattcagagcctctggctctggaagggcccctgctcattaccttctttgtcagaagagtcaagggcacctttggagagattatggtttactgggaattaagtagtgagtttgacattactgaagactttctttccaccagtggatttttcaccattgctgatggagagagtgaagctagctttgatgttcatttgctaccagatgaggtacctgagatagaggaagattatgtgatccagcttgtttctgtagagggaggagccgaactggatctggagaagagtatcacatggttctctgtttatgcaaatgatgacccacatggagtatttgccctgtattcggatcgccagtcaatacttattgggcagaaccttattagatccatccaaattaacataacccggcttgctggaacatttggagatgtggctgttgggcttcgaatatcatcggatcataaagaacagccgattgttaccgaaaatgcagagaggcagctggtggtcaaagatggtgccacatataaagtggacgtggtgccaataaagaatcaggtcttcctatcactgggctctaatttcactttgcaactggtgactgtgatgcttgtcggtggacgtttctatggaatgccaacaattcttcaggaagcaaaatctgctgtccttccagtctctgagaaagctgccaattctcaggtcggatttgaatccactgcttttcaactcatgaacatcactgctggcacaagccacgttatgatttctaggagaggcacatatggagctctctcggttgcctggaccactggatatgctcctgggttagaaattcctgaattcattgttgttggcaacatgaccccaacactggggagcctttcattttcccacggtgaacaaaggaaaggagttttcctgtggacgtttcctagccctggttggccagaggcctttgttcttcacctatcaggagtgcagagcagtgctcctggcggagctcaactccgatcaggtttcattgttgctgaaattgaaccaatgggcgtcttccaattttccactagctcaagaaatatcatagtgtcagaagatacacagatgatcagattacatgtacaaagactatttgggttccacagcgatcttattaaagtttcttatcagaccactgcaggaagcgccaagccactggaagattttgagcctgttcagaatggggaactgttttttcaaaaattccaaactgaggttgattttgaaataaccattattaatgatcagctttctgagatagaagaatttttttacattaaccttacttcagtagaaattaggggattacaaaagtttgatgttaattggagcccacgcctgaatctagatttcagtgttgcagtgattacaatattggataatgatgacctggcaggaatggatatttccttccccgagacaactgtggctgtagcagttgacacaactctcattcctgtagaaactgaatccaccacatacctcagcacaagcaagacgactaccattctgcagccaaccaacgtggttgccattgttactgaggcaactggtgtatctgccatccctgagaaacttgtcacccttcatggcacacctgctgtgtctgaaaagcctgatgtggccactgtaactgccaatgtttccattcatggaacattcagccttgggccatccattgtttatattgaagaggagatgaagaatggcacattcaacactgcagaagttcttatccgaagaactggtgggtttactggcaatgtcagcataacagttaaaactttcggtgaaagatgtgctcagatggaaccaaatgcattgccctttcgtggtatctatgggatttccaacctaacatgggcagttgaagaagaagactttgaagaacaaactcttacccttatattcctagatggagaaagagaacgtaaagtatcagttcaaattttggatgatgatgagcctgaggggcaggaattcttctacgtgtttctcacaaaccctcaagggggagcacagattgtggaggagaaggatgatactggatttgcagcttttgccatggttattattacagggagtgaccttcacaatggcatcataggattcagtgaggagtcccagagtggactagaactcagggaaggagctgttatgagaagattgcaccttattgtcacaagacagccaaacagggcctttgaagatgtcaaggtcttttggcgagtcacacttaacaaaacagtcgtcgtgctccagaaggatggggtaaacctggtggaggaacttcagtctgtgtcagggaccacaacctgtacaatgggtcaaacaaaatgctttatcagcattgaactcaaaccagaaaaggtaccacaggttgaagtgtatttttttgtggaactatatgaagctactgctggagcagcaataaacaacagtgccagattcgcacagattaaaatcttagaaagtgatgaatctcaaagccttgtgtatttttctgtgggttctcggctggcagtggctcacaagaaggccactttaatcagtctgcaggtggccagagattctgggacaggactaatgatgtctgttaactttagtacccaggagttgaggagtgctgaaacaattggtcgtaccatcatatctccagctatttctggaaaggattttgtgataactgaaggcacattggtctttgaacctggccagagaagcactgtattggatgtcatcctaacgccagagacaggatctttaaattcatttcctaaacgcttccagattgtcctttttgacccaaaaggtggtgccagaattgataaagtgtatgggactgccaacatcactcttgtctcagatgcagattcgcaggccatttgggggcttgcagatcagctacatcagcctgtgaatgatgatattctcaacagagtgctccataccatcagcatgaaagtggccacagaaaacacagatgaacaactcagtgccatgatgcatttaatagaaaagataactactgaaggaaaaattcaagctttcagtgttgccagccgaactcttttctatgagattctttgttctcttattaacccaaagcgcaaggacactaggggattcagtcactttgctgaagtgactgagaattttgccttttctctgctgactaatgttacttgcggctctcctggtgaaaaaagcaaaaccatccttgatagttgcccatatttgtcaatattggctcttcactggtatcctcagcaaatcaatggacacaagtttgaaggaaaggaaggagattacattcgaattccagagaggctactggatgtccaggatgcagaaataatggctgggaaaagtacatgtaaattagtccagtttacagagtatagcagccaacagtggtttataagtggaaacaatcttcctaccctaaaaaataaggtattatctttgagtgtgaaaggtcagagttcacaactcctgactaatgacaatgaggttctctacaggatttatgctgctgagcctagaattattcctcagacatctctgtgtctcctttggaatcaggctgctgcaagctggttgtctgacagtcagttttgcaaagtggttgaggaaactgcagactatgtggaatgtgcctgttcacacatgtctgtgtatgctgtctatgctcggactgacaacttgtcttcatacaatgaagccttcttcacttctggatttatatgtatctcaggtctttgcttggctgttctttcccatatcttctgtgccaggtactccatgtttgcagctaaacttctgactcacatgatggcagccagcttaggtacacagattctgtttctggcgtctgcatacgcaagtccccaactcgctgaggagagctgttcagctatggctgctgtcacacattacctgtatctttgccagtttagctggatgctcattcagtctgtgaatttctggtacgtgctggtgatgaatgatgagcacacagagaggcgatatctgctgtttttccttctgagttggggactaccagcttttgtggtgattctcctcatagttattttgaaaggaatctatcatcagagcatgtcacagatctatggactcattcatggtgacctgtgttttattccaaacgtctatgctgctttgttcactgcagctcttgttcctttgacgtgcctcgtggtggtgttcgtggtgttcatccatgcctaccaggtgaagccacagtggaaagcatatgatgatgtcttcagaggaaggacaaatgctgcagaaattccactgattttatatctctttgctctgatttccgtgacatggctttggggaggactacacatggcctacagacacttctggatgttggttctctttgtcattttcaacagtctgcagggactttatgttttcatggtttatttcattttacacaaccaaatgtgttgccctatgaaggccagttacactgtggaaatgaatgggcatcctggacccagcacagcctttttcacgcccgggagtggaatgcctcctgctggaggggaaatcagcaagtccacccagaatctcatcggtgctatggaggaggtgccacctgactgggagagagcatccttccaacagggcagtcaggccagccctgatttaaagccaagtccacaaaatggagccacgttcccgtcctctggaggatatggccaggggtcactgatagccgatgaggagtcccaggagtttgatgatttaatatttgcattaaaaactggtgctggtctcagtgtcagtgataatgaatctggtcaaggcagccaggaggggggcaccttgactgactcccagatcgtggagctcaggaggatacccatcgccgacactcacctgtagcacctcactaaccattcgactgagcacactttcatatttgtatcagcttttgtgctaaaactctctaagtacatccacctgtgtaataggaacctgtgaattgtactggatgattaatacaaacgtgattgttgtatttggagtataaattactgattgtatgtgacctgaaaattcactgctataagaaaggtggagtcagtttgtatcagttaataggatgttcatattccaaggatattagttgtttttttaatcatcctatatggctaacattgtttaatgaaagtaataatcaataaagcaatagaatctatttgg

SEQ ID NO: 11666 - DNA, 5322 bp, Homo sapiens
gccccccttcccgacaccctcgcggagagcggttcttgccgcatcctgcgcagcccctgcccagtttggtgcagaggcgtggggggcgggactcgtctttgccattcggatcgctgggaaagcggtgggaatccaactgaagagcagccagaggagagctgaagagaggagggggaggccgatgacctgggctctgggcctctgaaggtctggcgtattctgacaggacacagtgagcatctgtagaggagaggcttgaaataaaggaggagcacgaatattccctggatttctggaggcctgctttaaggctggccagttctgcaagaaaggcaaggaggaggagactggctcacacctctggaggacccccttctgtcagctgtggggcttgacactacttgaacaagaaaaggagggggaaactgcaccacataagtgaagatccacctccagtggctgctctgctggtggtggggttgctgctgacaaccaccctcaacgggtctgcacccatccaggaaatctctgtcttcctcaagcttggttgtgcctgttctacactctatctgtattattgaattactgactgagactgtgtttgggaaggaggctgagtgactactggactggatattgactctaactcttgtttccaagcttatatcctcaatcacctaaagatcagagtgtgaagaaacaaacctgtgacagatctgtggttgaggtttagactgggggaggagtatagtactggactttctttgtaacttgtaccatgactggggcagagattgagtctggtgcccaggtcaagcctgaaaagaagcctggggaagaggttgtaggtggggctgagatagagaatgatgtccctctggtggtcagacccaaggttaggacccaggcccagataatgcctggggcaaggcccaagaataagtccaaggttatgcctggagcaagcaccaaagttgagacaagtgcagtgggtggggcacgccctaagagtaaggccaaggcaatacctgtttcacgatttaaggaagaagcccagatgtgggctcagcccaggtttggtgctgaaagattgtctaagacagagagaaactcccagaccaatatcatagcctctccacttgtcagtactgattctgtcttggttgctaaaacaaagtacctgtctgaggatagagaactggttaatacagacactgagagctttcctagaaggaaggcccattaccaagcaggattccagccttcttttaggtcaaaggaggagaccaatatggggtcctggtgctgtcctaggcctacatccaaacaagaagcctctcctaattctgatttcaaatgggtagacaaatctgtgagttccttgttctggagtggagatgaggtcactgcaaaatttcatcctgggaatagggtaaaagacagtaacagatccatgcacatggccaatcaagaggctaataccatgtctaggtcccaaactaaccaggagctctatattgcatctagttctggttctgaggatgagtctgttaagacaccctggttctgggccagagataaaaccaatacctggtctgggcccagggaagatcccaatagcaggtccaggtttaggtctaagaaagaagtctatgttgaatcaagttctggatctgagcatgaagaccatttggagtcctggtttggggctggaaaggaggccaaattcaggtccaaaatgagagctgggaaggaggccaataacagggccaggcacagggccaagcgagaagcttgcattgatttcatgcctgggtctatagatgtaattaaaaaagagtcctgtttctggcctgaagaaaatgctaataccttttcaaggcccatgatcaagaaagaggccagggccagagcaatgacaaaggaagaggccaaaaccaaggcccgagccagggccaagcaagaagccaggtcagaggaggaagccctcattgggacctggttctgggctacagacgagtccagcatggcagatgaagccagcatagagtccagtctacaagtggaggatgagtccataattgggagttggttctggactgaagaagaggccagtatggggactggggctagcagtaaatccagaccaaggactgatggggagcgtattggtgattccttatttggggctagggaaaagaccagtatgaaaactggggctgaggccacctctgaatctatactagcagctgatgatgaacaggtcattattggttcctggttctgggctggtgaagaggtcaaccaagaggctgaggaagagaccatttttgggtcgtggttctgggtcattgatgcggccagtgtggaatctggtgttggggtcagctgtgagtccaggacaaggtctgaggaagaagaggtcattggtccctggttttggtctggagaacaagttgatatagaggctggaatcggagaagaggccaggccaggagctgaagaagagacaatattcgggtcctggttttgggctgaaaaccagacctatatggattgtagggctgaaactagctgtgacaccatgcaaggggctgaggaggaggagcccattattgggtcctggttttggaccagagtagaagcttgtgtggagggtgatgtcaacagcaagtctagcctggaggacaaggaagaggccatgataccatgttttggagccaaagaagaggtcagtatgaagcatgggactggtgtcagatgcagatttatggcaggggctgaggagaccaataataagtcttgcttctgggcagaaaaagaaccctgtatgtatcctgccggtggaggaagttggaagtctaggccagaggaggaagaggacattgtcaattcgtggttctggtccagaaaatacacaaagccagaggccattatagggtcctggttatgggctacagaagagagtaatatagatgggactggagaaaaggccaagttactgactgaagaggagaccataatcaattcctggttctggaaagaagatgaagccatttcagaggctactgacagagaagagtccaggccagaagctgaggagggggacattattggttcttggttctgggctggagaagaggacagactagagccagctgctgagactagagaagaagacaggctagcagctgagaaagaaggtattgttgggtcctggtttggggccagagaagagaccattagaagagaggctgggtcttgcagcaaatccagtcctaaagctgaagaggaagaagtcattattgggtcctggttctgggaagaagaggccagtccggaggcagtggcaggagtcggctttgagtcaaagcctgggactgaggaggaagaaatcactgttgggtcctggttctggcctgaagaagaagccagtatacaggctggatctcaggcagtagaggaaatggagtcagagactgaagaggaaaccatttttgggtcctggttctgggatggaaaagaagtcagtgaagaagcaggaccatgctgtgtatccaagccagaggatgatgaagagatgattgttgagtcctggttctggtctagagacaaagccattaaggaaactggaactgtggccacctgtgagtccaagccagaaaatgaggaaggggccattgttgggtcttggtttgaggctgaagatgaggtagataacaggactgacaatggaagcaactgtgggtccaggacattagctgatgaagatgaggccatagtggggtcctggttctgggcaggagatgaggcccattttgaatcaaatcctagccccgtgttcagggccatttgcaggtccacgtgttcagttgaacaggagcctgatccttcacgcaggcctcagagttgggaggaggtcactgttcagttcaagcctggtccatggggtagggtcggcttcccatctataagcccctttagatttccgaaagaggcagcatctttattctgtgaaatgtttgggggcaaacccaggaacatggtacttagcccagaaggggaagatcaggaatctttgcttcagcctgatcagcctagtcctgagttcccatttcagtatgatccttcctacaggtcagtccaggaaattcgagagcatcttagggccaaggagagtacagagcctgagagttcatcctgtaactgcatacaatgtgagctgaaaattggttctgaagagtttgaagaactccttttattaatggaaaaaattcgggatccttttattcatgaaatatctaaaatcgcaatgggtatgagaagtgcttctcaatttacccgagatttcattcgagattcaggtgttgtctcacttattgaaaccttgcttaattatccgtcctcccgagttagaacaagttttttggaaaatatgattcgcatggccccaccttatccgaatctaaacataattcagacatacatatgtaaagtgtgtgaggaaacccttgcttatagcgtggattccccggaacagctgtctggaataaggatgattagacatctcactactactactgactatcacacactggttgccaattatatgtctgggtttctctccttattagctacaggcaatgccaaaacaaggtttcatgttttgaaaatgctactgaatttgtctgaaaatcttttcatgacaaaagaactactcagtgctgaagcagtgtcagaatttataggcctctttaacagggaagagacaaatgacaatattcaaattgttcttgcaatatttgagaatattggcaacaatatcaaaaaagaaacagtgttctctgatgatgatttcaatattgagccgcttatttctgcattccacaaagttgagaaatttgctaaggaactgcaaggcaaaacagacaatcaaaatgaccctgaaggggaccaagaaaattagtaatggttaattgctggcctcagattgtccttatgttcctgagttatgatccttgagtaatgctttgattttaatagttggttctgtgttgcaacatatatctttagtgctgacactaactttgtccaactctgtctgtaagctggagcatttttctgatgccagctgaatattagagctgaaaacacatttgttgatatttgtcttgtccacattgtgatgttcagtatttgagcttatagtgaactgagcaatcataaataagccacccttctgattgtcgttctactgtatatatatatatatttgagtgttgtttgtgtttcaataaagtcctatgttaaagttggcagaaa

SEQ ID NO: 11667 - DNA, 5877 bp, Homo sapiens
gcactttcgcgccgtatccctccgccccccttcccgacaccctcgcggagagcggttcttgccgcatcctgcgcagcccctgcccagtttggtgcagaggcgtggggggcgggactcgtctttgccattcggatcgctgggaaagcggtgggaatccaactgaagagcagccagaggagagctgaagagaggagggggaggccgatgacctgggctctgggcctctgaaggcctgctttaaggctggccagttctgcaagaaaggcaaggaggaggagactggctcacacctctggaggacccccttctgtcagctgtggggcttgacactacttgaacaagaaaaggagggggaaactgcaccacataagtgaagatccacctccagtggctgctctgctggtggtggggttgctgctgacaaccaccctcaacgggtctgcacccatccaggaaatctctgtcttcctcaagcttggttgtgcctgttctacactctatctgtattattgaattactgactgagactgtgtttgggaaggaggctgagtgactactggactggatattgactctaactcttgtttccaagcttatatcctcaatcacctaaagatcagagtgtgaagaaacaaacctgtgacagatctgtggttgaggtttagactgggggaggagtatagtactggactttctttgtaacttgtaccatgactggggcagagattgagtctggtgcccaggtcaagcctgaaaagaagcctggggaagaggttgtaggtggggctgagatagagaatgatgtccctctggtggtcagacccaaggttaggacccaggcccagataatgcctggggcaaggcccaagaataagtccaaggttatgcctggagcaagcaccaaagttgagacaagtgcagtgggtggggcacgccctaagagtaaggccaaggcaatacctgtttcacgatttaaggaagaagcccagatgtgggctcagcccaggtttggtgctgaaagattgtctaagacagagagaaactcccagaccaatatcatagcctctccacttgtcagtactgattctgtcttggttgctaaaacaaagtacctgtctgaggatagagaactggttaatacagacactgagagctttcctagaaggaaggcccattaccaagcaggattccagccttcttttaggtcaaaggaggagaccaatatggggtcctggtgctgtcctaggcctacatccaaacaagaagcctctcctaattctgatttcaaatgggtagacaaatctgtgagttccttgttctggagtggagatgaggtcactgcaaaatttcatcctgggaatagggtaaaagacagtaacagatccatgcacatggccaatcaagaggctaataccatgtctaggtcccaaactaaccaggagctctatattgcatctagttctggttctgaggatgagtctgttaagacaccctggttctgggccagagataaaaccaatacctggtctgggcccagggaagatcccaatagcaggtccaggtttaggtctaagaaagaagtctatgttgaatcaagttctggatctgagcatgaagaccatttggagtcctggtttggggctggaaaggaggccaaattcaggtccaaaatgagagctgggaaggaggccaataacagggccaggcacagggccaagcgagaagcttgcattgatttcatgcctgggtctatagatgtaattaaaaaagagtcctgtttctggcctgaagaaaatgctaataccttttcaaggcccatgatcaagaaagaggccagggccagagcaatgacaaaggaagaggccaaaaccaaggcccgagccagggccaagcaagaagccaggtcagaggaggaagccctcattgggacctggttctgggctacagacgagtccagcatggcagatgaagccagcatagagtccagtctacaagtggaggatgagtccataattgggagttggttctggactgaagaagaggccagtatggggactggggctagcagtaaatccagaccaaggactgatggggagcgtattggtgattccttatttggggctagggaaaagaccagtatgaaaactggggctgaggccacctctgaatctatactagcagctgatgatgaacaggtcattattggttcctggttctgggctggtgaagaggtcaaccaagaggctgaggaagagaccatttttgggtcgtggttctgggtcattgatgcggccagtgtggaatctggtgttggggtcagctgtgagtccaggacaaggtctgaggaagaagaggtcattggtccctggttttggtctggagaacaagttgatatagaggctggaatcggagaagaggccaggccaggagctgaagaagagacaatattcgggtcctggttttgggctgaaaaccagacctatatggattgtagggctgaaactagctgtgacaccatgcaaggggctgaggaggaggagcccattattgggtcctggttttggaccagagtagaagcttgtgtggagggtgatgtcaacagcaagtctagcctggaggacaaggaagaggccatgataccatgttttggagccaaagaagaggtcagtatgaagcatgggactggtgtcagatgcagatttatggcaggggctgaggagaccaataataagtcttgcttctgggcagaaaaagaaccctgtatgtatcctgccggtggaggaagttggaagtctaggccagaggaggaagaggacattgtcaattcgtggttctggtccagaaaatacacaaagccagaggccattatagggtcctggttatgggctacagaagagagtaatatagatgggactggagaaaaggccaagttactgactgaagaggagaccataatcaattcctggttctggaaagaagatgaagccatttcagaggctactgacagagaagagtccaggccagaagctgaggagggggacattattggttcttggttctgggctggagaagaggacagactagagccagctgctgagactagagaagaagacaggctagcagctgagaaagaaggtattgttgggtcctggtttggggccagagaagagaccattagaagagaggctgggtcttgcagcaaatccagtcctaaagctgaagaggaagaagtcattattgggtcctggttctgggaagaagaggccagtccggaggcagtggcaggagtcggctttgagtcaaagcctgggactgaggaggaagaaatcactgttgggtcctggttctggcctgaagaagaagccagtatacaggctggatctcaggcagtagaggaaatggagtcagagactgaagaggaaaccatttttgggtcctggttctgggatggaaaagaagtcagtgaagaagcaggaccatgctgtgtatccaagccagaggatgatgaagagatgattgttgagtcctggttctggtctagagacaaagccattaaggaaactggaactgtggccacctgtgagtccaagccagaaaatgaggaaggggccattgttgggtcttggtttgaggctgaagatgaggtagataacaggactgacaatggaagcaactgtgggtccaggacattagctgatgaagatgaggccatagtggggtcctggttctgggcaggagatgaggcccattttgaatcaaatcctagccccgtgttcagggccatttgcaggtccacgtgttcagttgaacaggagcctgatccttcacgcaggcctcagagttgggaggaggtcactgttcagttcaagcctggtccatggggtagggtcggcttcccatctataagcccctttagatttccgaaagaggcagcatctttattctgtgaaatgtttgggggcaaacccaggaacatggtacttagcccagaaggggaagatcaggaatctttgcttcagcctgatcagcctagtcctgagttcccatttcagtatgatccttcctacaggtcagtccaggaaattcgagagcatcttagggccaaggagagtacagagcctgagagttcatcctgtaactgcatacaatgtgagctgaaaattggttctgaagagtttgaagaactccttttattaatggaaaaaattcgggatccttttattcatgaaatatctaaaatcgcaatgggtatgagaagtgcttctcaatttacccgagatttcattcgagattcaggtgttgtctcacttattgaaaccttgcttaattatccgtcctcccgagttagaacaagttttttggaaaatatgattcgcatggccccaccttatccgaatctaaacataattcagacatacatatgtaaagtgtgtgaggaaacccttgcttatagcgtggattccccggaacagctgtctggaataaggatgattagacatctcactactactactgactatcacacactggttgccaattatatgtctgggtttctctccttattagctacaggcaatgccaaaacaaggtttcatgttttgaaaatgctactgaatttgtctgaaaatcttttcatgacaaaagaactactcagtgctgaagcagtgtcagaatttataggcctctttaacagggaagagacaaatgacaatattcaaattgttcttgcaatatttgagaatattggcaacaatatcaaaaaagaaacagtgttctctgatgatgatttcaatattgagccgcttatttctgcattccacaaagttgagaaatttgctaaggaactgcaaggcaaaacagacaatcaaaatgaccctgaaggggaccaagaaaattagtaatggttaattgctggcctcagattgtccttatgttcctgagttatgatccttgagtaatgctttgattttaatagttggttctgtgttgcaacatatatctttagtgctgacactaactttgtccaactctgtctgtaagctggagcatttttctgatgccagctgaatattagagctgaaaacacatttgttgatatttgtcttgtccacattgtgatgttcagtatttgagcttatagtgaactgagcaatcataaataagccacccttctgattgtcgttctactgtatatatatatatatttgagtgttgtttgtgtttcaataaagtcctatgttaaagttggcagaaatcacccttcttcttgaaattaaaatacagacccaatgataacacatgaacacacatagagataattaatatatgaataatatgttcctttcaaaagtttttttctcagctttaaacgcaaaaattaccaggggctgctatgtagggcatacttcagagaaaaagtagctacttcggttggactctgaagtttgggaaagatattggtggtgtaaaaaaaaaaaaaagcatggagttaggaaaaattttcctatgggagtgaggtatcctgtttgcctagagtgagtgagaggaatatattgagcaacatagaggatgacataagttttaaagagctgaggatttgcattttacagctcaaagtacaactgctgcttccatactacctaaagggcaaaagaataagacaggaaagcatagggatttgattgagtcaggaagacaatttaatcatgatggtaccatggtaagtgttaaggcaacatcatacagccattaaacatgatgatgtatagggttttaggaaaagccctgacatttttgatatttcatataatagagaacactggtgtcatacatgggaagtatgatcccatttgaaaaataaatgtgaataaattgacc

SEQ ID NO: 11668 - DNA, 5809 bp, Homo sapiens
gcactttcgcgccgtatccctccgccccccttcccgacaccctcgcggagagcggttcttgccgcatcctgcgcagcccctgcccagtttggtgcagaggcgtggggggcgggactcgtctttgccattcggatcgctgggaaagcggtgggaatccaactgaagagcagccagaggagagctgaagagaggagggggaggccgatgacctgggctctgggcctctgaaggacccccttctgtcagctgtggggcttgacactacttgaacaagaaaaggagggggaaactgcaccacataagtgaagatccacctccagtggctgctctgctggtggtggggttgctgctgacaaccaccctcaacgggtctgcacccatccaggaaatctctgtcttcctcaagcttggttgtgcctgttctacactctatctgtattattgaattactgactgagactgtgtttgggaaggaggctgagtgactactggactggatattgactctaactcttgtttccaagcttatatcctcaatcacctaaagatcagagtgtgaagaaacaaacctgtgacagatctgtggttgaggtttagactgggggaggagtatagtactggactttctttgtaacttgtaccatgactggggcagagattgagtctggtgcccaggtcaagcctgaaaagaagcctggggaagaggttgtaggtggggctgagatagagaatgatgtccctctggtggtcagacccaaggttaggacccaggcccagataatgcctggggcaaggcccaagaataagtccaaggttatgcctggagcaagcaccaaagttgagacaagtgcagtgggtggggcacgccctaagagtaaggccaaggcaatacctgtttcacgatttaaggaagaagcccagatgtgggctcagcccaggtttggtgctgaaagattgtctaagacagagagaaactcccagaccaatatcatagcctctccacttgtcagtactgattctgtcttggttgctaaaacaaagtacctgtctgaggatagagaactggttaatacagacactgagagctttcctagaaggaaggcccattaccaagcaggattccagccttcttttaggtcaaaggaggagaccaatatggggtcctggtgctgtcctaggcctacatccaaacaagaagcctctcctaattctgatttcaaatgggtagacaaatctgtgagttccttgttctggagtggagatgaggtcactgcaaaatttcatcctgggaatagggtaaaagacagtaacagatccatgcacatggccaatcaagaggctaataccatgtctaggtcccaaactaaccaggagctctatattgcatctagttctggttctgaggatgagtctgttaagacaccctggttctgggccagagataaaaccaatacctggtctgggcccagggaagatcccaatagcaggtccaggtttaggtctaagaaagaagtctatgttgaatcaagttctggatctgagcatgaagaccatttggagtcctggtttggggctggaaaggaggccaaattcaggtccaaaatgagagctgggaaggaggccaataacagggccaggcacagggccaagcgagaagcttgcattgatttcatgcctgggtctatagatgtaattaaaaaagagtcctgtttctggcctgaagaaaatgctaataccttttcaaggcccatgatcaagaaagaggccagggccagagcaatgacaaaggaagaggccaaaaccaaggcccgagccagggccaagcaagaagccaggtcagaggaggaagccctcattgggacctggttctgggctacagacgagtccagcatggcagatgaagccagcatagagtccagtctacaagtggaggatgagtccataattgggagttggttctggactgaagaagaggccagtatggggactggggctagcagtaaatccagaccaaggactgatggggagcgtattggtgattccttatttggggctagggaaaagaccagtatgaaaactggggctgaggccacctctgaatctatactagcagctgatgatgaacaggtcattattggttcctggttctgggctggtgaagaggtcaaccaagaggctgaggaagagaccatttttgggtcgtggttctgggtcattgatgcggccagtgtggaatctggtgttggggtcagctgtgagtccaggacaaggtctgaggaagaagaggtcattggtccctggttttggtctggagaacaagttgatatagaggctggaatcggagaagaggccaggccaggagctgaagaagagacaatattcgggtcctggttttgggctgaaaaccagacctatatggattgtagggctgaaactagctgtgacaccatgcaaggggctgaggaggaggagcccattattgggtcctggttttggaccagagtagaagcttgtgtggagggtgatgtcaacagcaagtctagcctggaggacaaggaagaggccatgataccatgttttggagccaaagaagaggtcagtatgaagcatgggactggtgtcagatgcagatttatggcaggggctgaggagaccaataataagtcttgcttctgggcagaaaaagaaccctgtatgtatcctgccggtggaggaagttggaagtctaggccagaggaggaagaggacattgtcaattcgtggttctggtccagaaaatacacaaagccagaggccattatagggtcctggttatgggctacagaagagagtaatatagatgggactggagaaaaggccaagttactgactgaagaggagaccataatcaattcctggttctggaaagaagatgaagccatttcagaggctactgacagagaagagtccaggccagaagctgaggagggggacattattggttcttggttctgggctggagaagaggacagactagagccagctgctgagactagagaagaagacaggctagcagctgagaaagaaggtattgttgggtcctggtttggggccagagaagagaccattagaagagaggctgggtcttgcagcaaatccagtcctaaagctgaagaggaagaagtcattattgggtcctggttctgggaagaagaggccagtccggaggcagtggcaggagtcggctttgagtcaaagcctgggactgaggaggaagaaatcactgttgggtcctggttctggcctgaagaagaagccagtatacaggctggatctcaggcagtagaggaaatggagtcagagactgaagaggaaaccatttttgggtcctggttctgggatggaaaagaagtcagtgaagaagcaggaccatgctgtgtatccaagccagaggatgatgaagagatgattgttgagtcctggttctggtctagagacaaagccattaaggaaactggaactgtggccacctgtgagtccaagccagaaaatgaggaaggggccattgttgggtcttggtttgaggctgaagatgaggtagataacaggactgacaatggaagcaactgtgggtccaggacattagctgatgaagatgaggccatagtggggtcctggttctgggcaggagatgaggcccattttgaatcaaatcctagccccgtgttcagggccatttgcaggtccacgtgttcagttgaacaggagcctgatccttcacgcaggcctcagagttgggaggaggtcactgttcagttcaagcctggtccatggggtagggtcggcttcccatctataagcccctttagatttccgaaagaggcagcatctttattctgtgaaatgtttgggggcaaacccaggaacatggtacttagcccagaaggggaagatcaggaatctttgcttcagcctgatcagcctagtcctgagttcccatttcagtatgatccttcctacaggtcagtccaggaaattcgagagcatcttagggccaaggagagtacagagcctgagagttcatcctgtaactgcatacaatgtgagctgaaaattggttctgaagagtttgaagaactccttttattaatggaaaaaattcgggatccttttattcatgaaatatctaaaatcgcaatgggtatgagaagtgcttctcaatttacccgagatttcattcgagattcaggtgttgtctcacttattgaaaccttgcttaattatccgtcctcccgagttagaacaagttttttggaaaatatgattcgcatggccccaccttatccgaatctaaacataattcagacatacatatgtaaagtgtgtgaggaaacccttgcttatagcgtggattccccggaacagctgtctggaataaggatgattagacatctcactactactactgactatcacacactggttgccaattatatgtctgggtttctctccttattagctacaggcaatgccaaaacaaggtttcatgttttgaaaatgctactgaatttgtctgaaaatcttttcatgacaaaagaactactcagtgctgaagcagtgtcagaatttataggcctctttaacagggaagagacaaatgacaatattcaaattgttcttgcaatatttgagaatattggcaacaatatcaaaaaagaaacagtgttctctgatgatgatttcaatattgagccgcttatttctgcattccacaaagttgagaaatttgctaaggaactgcaaggcaaaacagacaatcaaaatgaccctgaaggggaccaagaaaattagtaatggttaattgctggcctcagattgtccttatgttcctgagttatgatccttgagtaatgctttgattttaatagttggttctgtgttgcaacatatatctttagtgctgacactaactttgtccaactctgtctgtaagctggagcatttttctgatgccagctgaatattagagctgaaaacacatttgttgatatttgtcttgtccacattgtgatgttcagtatttgagcttatagtgaactgagcaatcataaataagccacccttctgattgtcgttctactgtatatatatatatatttgagtgttgtttgtgtttcaataaagtcctatgttaaagttggcagaaatcacccttcttcttgaaattaaaatacagacccaatgataacacatgaacacacatagagataattaatatatgaataatatgttcctttcaaaagtttttttctcagctttaaacgcaaaaattaccaggggctgctatgtagggcatacttcagagaaaaagtagctacttcggttggactctgaagtttgggaaagatattggtggtgtaaaaaaaaaaaaaagcatggagttaggaaaaattttcctatgggagtgaggtatcctgtttgcctagagtgagtgagaggaatatattgagcaacatagaggatgacataagttttaaagagctgaggatttgcattttacagctcaaagtacaactgctgcttccatactacctaaagggcaaaagaataagacaggaaagcatagggatttgattgagtcaggaagacaatttaatcatgatggtaccatggtaagtgttaaggcaacatcatacagccattaaacatgatgatgtatagggttttaggaaaagccctgacatttttgatatttcatataatagagaacactggtgtcatacatgggaagtatgatcccatttgaaaaataaatgtgaataaattgacc

SEQ ID NO: 11669 - DNA, 5980 bp, Homo sapiens
gacaccctcgcggagagcggttcttgccgcatcctgcgcagcccctgcccagtttggtgcagaggcgtggggggcgggactcgtctttgccattcggatcgctgggaaagcggtgggaatccaactgaagagcagccagaggagagctgaagagaggagggggaggccgatgacctgggctctgggcctctgaagcctggcaacgaggagacgatccgttcggagccgggcgctagagagaggtctggcgtattctgacaggacacagtgagcatctgtagaggagaggcttgaaataaaggaggagcacgaatattccctggatttctggaggcctgctttaaggctggccagttctgcaagaaaggcaaggaggaggagactggctcacacctctggaggacccccttctgtcagctgtggggcttgacactacttgaacaagaaaaggagggggaaactgcaccacataagtgaagatccacctccagtggctgctctgctggtggtggggttgctgctgacaaccaccctcaacgggtctgcacccatccaggaaatctctgtcttcctcaagcttggttgtgcctgttctacactctatctgtattattgaattactgactgagactgtgtttgggaaggaggctgagtgactactggactggatattgactctaactcttgtttccaagcttatatcctcaatcacctaaagatcagagtgtgaagaaacaaacctgtgacagatctgtggttgaggtttagactgggggaggagtatagtactggactttctttgtaacttgtaccatgactggggcagagattgagtctggtgcccaggtcaagcctgaaaagaagcctggggaagaggttgtaggtggggctgagatagagaatgatgtccctctggtggtcagacccaaggttaggacccaggcccagataatgcctggggcaaggcccaagaataagtccaaggttatgcctggagcaagcaccaaagttgagacaagtgcagtgggtggggcacgccctaagagtaaggccaaggcaatacctgtttcacgatttaaggaagaagcccagatgtgggctcagcccaggtttggtgctgaaagattgtctaagacagagagaaactcccagaccaatatcatagcctctccacttgtcagtactgattctgtcttggttgctaaaacaaagtacctgtctgaggatagagaactggttaatacagacactgagagctttcctagaaggaaggcccattaccaagcaggattccagccttcttttaggtcaaaggaggagaccaatatggggtcctggtgctgtcctaggcctacatccaaacaagaagcctctcctaattctgatttcaaatgggtagacaaatctgtgagttccttgttctggagtggagatgaggtcactgcaaaatttcatcctgggaatagggtaaaagacagtaacagatccatgcacatggccaatcaagaggctaataccatgtctaggtcccaaactaaccaggagctctatattgcatctagttctggttctgaggatgagtctgttaagacaccctggttctgggccagagataaaaccaatacctggtctgggcccagggaagatcccaatagcaggtccaggtttaggtctaagaaagaagtctatgttgaatcaagttctggatctgagcatgaagaccatttggagtcctggtttggggctggaaaggaggccaaattcaggtccaaaatgagagctgggaaggaggccaataacagggccaggcacagggccaagcgagaagcttgcattgatttcatgcctgggtctatagatgtaattaaaaaagagtcctgtttctggcctgaagaaaatgctaataccttttcaaggcccatgatcaagaaagaggccagggccagagcaatgacaaaggaagaggccaaaaccaaggcccgagccagggccaagcaagaagccaggtcagaggaggaagccctcattgggacctggttctgggctacagacgagtccagcatggcagatgaagccagcatagagtccagtctacaagtggaggatgagtccataattgggagttggttctggactgaagaagaggccagtatggggactggggctagcagtaaatccagaccaaggactgatggggagcgtattggtgattccttatttggggctagggaaaagaccagtatgaaaactggggctgaggccacctctgaatctatactagcagctgatgatgaacaggtcattattggttcctggttctgggctggtgaagaggtcaaccaagaggctgaggaagagaccatttttgggtcgtggttctgggtcattgatgcggccagtgtggaatctggtgttggggtcagctgtgagtccaggacaaggtctgaggaagaagaggtcattggtccctggttttggtctggagaacaagttgatatagaggctggaatcggagaagaggccaggccaggagctgaagaagagacaatattcgggtcctggttttgggctgaaaaccagacctatatggattgtagggctgaaactagctgtgacaccatgcaaggggctgaggaggaggagcccattattgggtcctggttttggaccagagtagaagcttgtgtggagggtgatgtcaacagcaagtctagcctggaggacaaggaagaggccatgataccatgttttggagccaaagaagaggtcagtatgaagcatgggactggtgtcagatgcagatttatggcaggggctgaggagaccaataataagtcttgcttctgggcagaaaaagaaccctgtatgtatcctgccggtggaggaagttggaagtctaggccagaggaggaagaggacattgtcaattcgtggttctggtccagaaaatacacaaagccagaggccattatagggtcctggttatgggctacagaagagagtaatatagatgggactggagaaaaggccaagttactgactgaagaggagaccataatcaattcctggttctggaaagaagatgaagccatttcagaggctactgacagagaagagtccaggccagaagctgaggagggggacattattggttcttggttctgggctggagaagaggacagactagagccagctgctgagactagagaagaagacaggctagcagctgagaaagaaggtattgttgggtcctggtttggggccagagaagagaccattagaagagaggctgggtcttgcagcaaatccagtcctaaagctgaagaggaagaagtcattattgggtcctggttctgggaagaagaggccagtccggaggcagtggcaggagtcggctttgagtcaaagcctgggactgaggaggaagaaatcactgttgggtcctggttctggcctgaagaagaagccagtatacaggctggatctcaggcagtagaggaaatggagtcagagactgaagaggaaaccatttttgggtcctggttctgggatggaaaagaagtcagtgaagaagcaggaccatgctgtgtatccaagccagaggatgatgaagagatgattgttgagtcctggttctggtctagagacaaagccattaaggaaactggaactgtggccacctgtgagtccaagccagaaaatgaggaaggggccattgttgggtcttggtttgaggctgaagatgaggtagataacaggactgacaatggaagcaactgtgggtccaggacattagctgatgaagatgaggccatagtggggtcctggttctgggcaggagatgaggcccattttgaatcaaatcctagccccgtgttcagggccatttgcaggtccacgtgttcagttgaacaggagcctgatccttcacgcaggcctcagagttgggaggaggtcactgttcagttcaagcctggtccatggggtagggtcggcttcccatctataagcccctttagatttccgaaagaggcagcatctttattctgtgaaatgtttgggggcaaacccaggaacatggtacttagcccagaaggggaagatcaggaatctttgcttcagcctgatcagcctagtcctgagttcccatttcagtatgatccttcctacaggtcagtccaggaaattcgagagcatcttagggccaaggagagtacagagcctgagagttcatcctgtaactgcatacaatgtgagctgaaaattggttctgaagagtttgaagaactccttttattaatggaaaaaattcgggatccttttattcatgaaatatctaaaatcgcaatgggtatgagaagtgcttctcaatttacccgagatttcattcgagattcaggtgttgtctcacttattgaaaccttgcttaattatccgtcctcccgagttagaacaagttttttggaaaatatgattcgcatggccccaccttatccgaatctaaacataattcagacatacatatgtaaagtgtgtgaggaaacccttgcttatagcgtggattccccggaacagctgtctggaataaggatgattagacatctcactactactactgactatcacacactggttgccaattatatgtctgggtttctctccttattagctacaggcaatgccaaaacaaggtttcatgttttgaaaatgctactgaatttgtctgaaaatcttttcatgacaaaagaactactcagtgctgaagcagtgtcagaatttataggcctctttaacagggaagagacaaatgacaatattcaaattgttcttgcaatatttgagaatattggcaacaatatcaaaaaagaaacagtgttctctgatgatgatttcaatattgagccgcttatttctgcattccacaaagttgagaaatttgctaaggaactgcaaggcaaaacagacaatcaaaatgaccctgaaggggaccaagaaaattagtaatggttaattgctggcctcagattgtccttatgttcctgagttatgatccttgagtaatgctttgattttaatagttggttctgtgttgcaacatatatctttagtgctgacactaactttgtccaactctgtctgtaagctggagcatttttctgatgccagctgaatattagagctgaaaacacatttgttgatatttgtcttgtccacattgtgatgttcagtatttgagcttatagtgaactgagcaatcataaataagccacccttctgattgtcgttctactgtatatatatatatatttgagtgttgtttgtgtttcaataaagtcctatgttaaagttggcagaaatcacccttcttcttgaaattaaaatacagacccaatgataacacatgaacacacatagagataattaatatatgaataatatgttcctttcaaaagtttttttctcagctttaaacgcaaaaattaccaggggctgctatgtagggcatacttcagagaaaaagtagctacttcggttggactctgaagtttgggaaagatattggtggtgtaaaaaaaaaaaaaagcatggagttaggaaaaattttcctatgggagtgaggtatcctgtttgcctagagtgagtgagaggaatatattgagcaacatagaggatgacataagttttaaagagctgaggatttgcattttacagctcaaagtacaactgctgcttccatactacctaaagggcaaaagaataagacaggaaagcatagggatttgattgagtcaggaagacaatttaatcatgatggtaccatggtaagtgttaaggcaacatcatacagccattaaacatgatgatgtatagggttttaggaaaagccctgacatttttgatatttcatataatagagaacactggtgtcatacatgggaagtatgatcccatttgaaaaataaatgtgaataaattgacc

SEQ ID NO: 11670 - DNA, 2101 bp, Homo sapiens
acgggccacaggccaagggcagcagtcaggcctgctctgtctgtgaacgctcccggcttggcctcggctgatgggccctcacgcctgaagcgggcaggaagctccgggatggatttcgggtctttggagaccgtggtggccaactctgccttcatcgccgcccgaggcagctttgacggcagcagctcccaaccctcccgggacaagaagtacctggccaagctcaagctgcccccgctgtccaagtgtgagtccctccgcgacagcctcagcctggagtttgagagtgtgtgcttggagcagcccatcggcaagaagctctttcagcagttcctacaatcggcagagaagcacctgccggccctggagctctggaaagacatcgaggactatgacacggcagacaatgacctccagccacagaaggcccagaccatcctggcccagtacctggacccccaggccaaactcttctgcagcttcctggatgaggggatagtggcgaagtttaaggaggggcctgtggagatccaggacgggctcttccagcccctgctgcaggccaccctggcacacctgggccaagcccccttccaggagtacctgggcagcctgtacttcctgaggttcctgcagtggaagtggctggaagcccagcccatgggggaggactggttcctggacttcagggtcctagggaaagggggcttcggggaggtgtcggcctgccagatgaaggcgaccggcaagctgtatgcctgcaagaagctgaacaagaagcggctgaagaagaggaagggctaccagggtgctatggtggagaagaagattctgatgaaagtacacagcaggttcatcgtgtctctggcctatgcgtttgaaaccaaagccgacctctgtctggtgatgaccatcatgaacggaggtgacatcaggtaccacatctacaacgtgaatgaggagaaccctggcttcccggagccgcgcgccctcttctacacggcgcagatcatctgcggcctggagcacctgcaccagaggcggatcgtctaccgcgacctcaagcccgagaacgtgctgctggacaatgacggcaatgtccggatctctgaccttgggctggccgtggagctgctggacggacagagcaagaccaagggctacgcagggaccccaggtttcatggcccccgagctcctgcagggcgaggagtacgacttctccgtggactactttgccctgggggtcaccctgtatgagatgattgcggccagaggacccttccgagcccgtggagagaaggtggagaacaaggagctgaagcaccggatcatctcagagcccgtgaagtaccctgataagttcagccaggccagcaaggacttctgcgaggcgctgctggagaaggacccggagaagcgcctggggttcagagatgagacctgcgacaagctccgtgcccaccccctcttcaaggaccttaactggaggcagctggaggctgggatgctgatgccccctttcatcccagactccaaaactgtctacgcaaaggatattcaggacgtgggtgccttttccaccgtcaaaggtgtggcctttgacaaaacagacacagaattctttcaggaatttgccactggcaactgccccatcccctggcaggaggagatgatcgagacgggcatctttggcgagctgaacgtgtggcgctcggacggtcagatgccggacgacatgaagggcatctccgggggctccagctcctcgtccaagtcagggatgtgtctggtttcctaggtgacgccccagagtccacgtggaggaaaaggacccatacggctcgatgggggccgcctgcctccgtggtgccagcctggggtctgctagcaaggggacacgtggttccctccacccaggtccccatcacgccatctccttgcggcccaaggaggagaaagcccacatcggcctgagccgccagacgcacatgctggtgccgtgagcccccgactgcatatttcacgtcttttgctccatctcactgagaagacataagatgctctccagagggagtaagccaaaaatctacaaactctta

SEQ ID NO: 11671 - DNA, 548 bp, Homo sapiens
atgcgcggtcctagtttgagttcaggggcgggagaatttgtgaacagagcaggtttcatggcccccgagctcctgcagggcgaggagtacgacttctccgtggactactttgccctgggggtcaccctgtatgagatgattgcggccagaggacccttccgagcccgtggagagaaggtggagaacaaggagctgaagcaccggatcatctcagagcccgtgaagtaccctgataagttcagccaggccagcaaggacttctgcgaggcgctgctggagaaggacccggagaagcgcctggggttcagagatgagacctgcgacaagctccgtgcccaccccctcttcaaggaccttaactggaggcagctggaggctgggatgctgatgccccctttcatcccagactccaaaactgtctacgcaaaggatattcaggacgtgggtgccttttccaccgtcaaaggtgtggcctttgacaaaacagacacagaattctttcaggaatttgccactggcaactgccccatcccctggcaggaggagat

SEQ ID NO: 11672 - DNA, 1031 bp, Homo sapiens
aaagcatccgagggagccggaggggaggagaatggagtgacagagacacgcggagggtggggggtgggggggagcgtgttgagggaggggggaggggggacacagagggaggaagaagcggcggcggcggcggcggcggcggcggctcctctttgcagagggggaaactcttgggctgagagcaggaataatgcggtaggcaaggcgggctgctggctcccccggctccggcagcagcggcggcagcccgagcagcggcagcagcagcggcagcaccccaggcgctgacagccccgccggccggctccgttgctgaccgccgactgtcaatggagctggaaaacatcgtggccaacacggtcttgctgaaagccagggaagggggcggaggaaagcgcaaagggaaaagcaagaagtggaaagaaatcctgaagttccctcacattagccagtgtgaagacctccgaaggaccataggggagctgagcggatcgctgatctcctggagctcatccaccaaggagcatgggagaccaactgaaattaagatgagatgacaaatcaagaaagttccacagggtatggagcaggttgctgagctgcagaaccaaggcaaagatctatccccacttccctggaggaagtggcgtccctcctggcttaaaggatctctctgcgagctccctgagggcctggaccacaggctctccatctgggcgtctccattgctgtagcagcatgagtgggtggatggatgttgccttctcttcaacctggaagccaggactgtgagtggcagccatgagcactgagacagattcctaggccaggtgcagcggtgcaggcctgagcattgagacagattcctaggccagctgcagcggcgcaagcctggaaccccagtgctttgaggggcggaggcaggaggattgctcaaacccaggagtccgaggatacagtgagctatgaatgtgctgctgcaccgctccagcctaggtgacagagcgagaccctctaaaaaaaagaaaaag

SEQ ID NO: 11673 - DNA, 1748 bp, Homo sapiens
gttttagagtgccttcttcaacatacgctacttagaccgggcgaattcctcccaaaaaaaccttgccctcagacagagattactgcagtttatgtgacaagcagccaatcgggaggctgcttttccggcagttttgtgaaaccaggcctgggctggagtgttacattcagttcctggactccgtggcagaatatgaagttactccagatgaaaaactgggagagaaagggaaggaaattatgaccaagtacctcaccccaaagtcccctgttttcatagcccaagttggccaagacctggtctcccagacggaggagaagctcctacagaagccgtgcaaagaactcttttctgcctgtgcacagtctgtccacgagtacctgaggggagaaccattccacgaatatctggacagcatgttttttgaccgctttctccagtggaagtggttggaaaggcaaccggtgaccaaaaacactttcaggcagtatcgagtgctaggaaaagggggcttcggggaggtctgtgcctgccaggttcgggccacgggtaaaatgtatgcctgcaagcgcttggagaagaagaggatcaaaaagaggaaaggggagtccatggccctcaatgagaagcagatcctcgagaaggtcaacagtcagtttgtggtcaacctggcctatgcctacgagaccaaggatgcactgtgcttggtcctgaccatcatgaatgggggtgacctgaagttccacatctacaacatgggcaaccctggcttcgaggaggagcgggccttgttttatgcggcagagatcctctgcggcttagaagacctccaccgtgagaacaccgtctaccgagatctgaaacctgaaaacatcctgttagatgattatggccacattaggatctcagacctgggcttggctgtgaagatccccgagggagacctgatccgcggccgggtgggcactgttggctacatggctccagaggtcctgaacaaccagaggtacggcctgagccccgactactggggccttggctgcctcatctatgagatgatcgagggccagtcgccgttccgcggccgcaaggagaaggtgaagcgggaggaggtggaccgccgggtcctggagacggaggaggtgtactcccacaagttctccgaggaggccaagtccatctgcaagatgctgctcacgaaagatgcgaagcagaggctgggctgccaggaggagggggctgcagaggtcaagagacaccccttcttcaggaacatgaacttcaagcgcttagaagccgggatgttggaccctcccttcgttccagacccccgcgctgtgtactgtaaggacgtgctggacatcgagcagttctccactgtgaagggcgtcaatctggaccacacagacgacgacttctactccaagttctccacgggctctgtgtccatcccatggcaaaacgagatgatagaaacagaatgctttaaggagctgaacgtgtttggacctaatggtaccctcccgccagatctgaacagaaaccaccctccggaaccgcccaagaaagggctgctccagagactcttcaagcggcagcatcagaacaattccaagagttcgcccagctccaagaccagttttaaccaccacataaactcaaaccatgtcagctcgaactccaccggaagcagctagtttcggctctggcctccaagtccacagtggaaccagcccagacccttctcc

SEQ ID NO: 11674 - DNA, 2654 bp, Homo sapiens
aaagcatccgagggagccggaggggaggagaatggagtgacagagacacgcggagggtggggggtgggggggagcgtgttgagggaggggggaggggggacacagagggaggaagaagcggcggcggcggcggcggcggcggcggctcctctttgcagagggggaaactcttgggctgagagcaggaataatgcggtaggcaaggcgggctgctggctcccccggctccggcagcagcggcggcagcccgagcagcggcagcagcagcggcagcaccccaggcgctgacagccccgccggccggctccgttgctgaccgccgactgtcaatggagctggaaaacatcgtggccaacacggtcttgctgaaagccagggaagggggcggaggaaagcgcaaagggaaaagcaagaagtggaaagaaatcctgaagttccctcacattagccagtgtgaagacctccgaaggaccatagacagagattactgcagtttatgtgacaagcagccaatcgggaggctgcttttccggcagttttgtgaaaccaggcctgggctggagtgttacattcagttcctggactccgtggcagaatatgaagttactccagatgaaaaactgggagagaaagggaaggaaattatgaccaagtacctcaccccaaagtcccctgttttcatagcccaagttggccaagacctggtctcccagacggaggagaagctcctacagaagccgtgcaaagaactcttttctgcctgtgcacagtctgtccacgagtacctgaggggagaaccattccacgaatatctggacagcatgttttttgaccgctttctccagtggaagtggttggaaaggcaaccggtgaccaaaaacactttcaggcagtatcgagtgctaggaaaagggggcttcggggaggtctgtgcctgccaggttcgggccacgggtaaaatgtatgcctgcaagcgcttggagaagaagaggatcaaaaagaggaaaggggagtccatggccctcaatgagaagcagatcctcgagaaggtcaacagtcagtttgtggtcaacctggcctatgcctacgagaccaaggatgcactgtgcttggtcctgaccatcatgaatgggggtgacctgaagttccacatctacaacatgggcaaccctggcttcgaggaggagcgggccttgttttatgcggcagagatcctctgcggcttagaagacctccaccgtgagaacaccgtctaccgagatctgaaacctgaaaacatcctgttagatgattatggccacattaggatctcagacctgggcttggctgtgaagatccccgagggagacctgatccgcggccgggtgggcactgttggctacatggctccagaggtcctgaacaaccagaggtacggcctgagccccgactactggggccttggctgcctcatctatgagatgatcgagggccagtcgccgttccgcggccgcaaggagaaggtgaagcgggaggaggtggaccgccgggtcctggagacggaggaggtgtactcccacaagttctccgaggaggccaagtccatctgcaagatgctgctcacgaaagatgcgaagcagaggctgggctgccaggaggagggggctgcagaggtcaagagacaccccttcttcaggaacatgaacttcaagcgcttagaagccgggatgttggaccctcccttcgttccagacccccgcgctgtgtactgtaaggacgtgctggacatcgagcagttctccactgtgaagggcgtcaatctggaccacacagacgacgacttctactccaagttctccacgggctctgtgtccatcccatggcaaaacgagatgatagaaacagaatgctttaaggagctgaacgtgtttggacctaatggtaccctcccgccagatctgaacagaaaccaccctccggaaccgcccaagaaagggctgctccagagactcttcaagcggcagcatcagaacaattccaagagttcgcccagctccaagaccagttttaaccaccacataaactcaaaccatgtcagctcgaactccaccggaagcagctagtttcggctctggcctccaagtccacagtggaaccagcccagacccttctccttagaagtggaagtagtggagcccctgctctggtggggctgccaggggagaccccgggagccggggaaggaggccgtccatcccgtcgacgtagaacctcgaggtttctcaaagaaatttccactcaggtctgttttccgaggcggccccggccggggtggattggatttgtctttggtgaacattgcaatagaaatccaattggatacgacaacttgcacgtattttaatagcgtcataactagaactgaattttgtctttatgatttttaaagaaaagttttgtaaatttctctactgtctcagtttacattttgtatatttgtatttaaatgaaagtgagactttgagggtgtatattttctgtgcagccactgttaagccatgtgttccaaggcattttagcggggagggggttatcaaaaaaaaaaaaatgtgactcaagacttccagagcctcaaatgagaaaatgtctttattaaatgtagaaagtgatccata

SEQ ID NO: 11675 - DNA, 1949 bp, Homo sapiens
agactattgctggaaaccatccgctgggatgtttcttagggaaatcccgtcgtgtggaaggaagccttttaaaggcaaagtcagatgttgaggaattagccttttcatagaattatcaaaggatggctgtacagaccacctagaaaataattcagtatttcaggtttttcttttctgggagtgtgataactgaaattgttagattttggctcagttaagaaaagaaagggggcggaggaaagcgcaaagggaaaagcaagaagtggaaagaaatcctgaagttccctcacattagccagtgtgaagacctccgaaggaccatagacagagattactgcagtttatgtgacaagcagccaatcgggaggctgcttttccggcagttttgtgaaaccaggcctgggctggagtgttacattcagttcctggactccgtggcagaatatgaagttactccagatgaaaaactgggagagaaagggaaggaaattatgaccaagtacctcaccccaaagtcccctgttttcatagcccaagttggccaagacctggtctcccagacggaggagaagctcctacagaagccgtgcaaagaactcttttctgcctgtgcacagtctgtccacgagtacctgaggggagaaccattccacgaatatctggacagcatgttttttgaccgctttctccagtggaagtggttggaaaggcaaccggtgaccaaaaacactttcaggcagtatcgagtgctaggaaaagggggcttcggggaggtctgtgcctgccaggttcgggccacgggtaaaatgtatgcctgcaagcgcttggagaagaagaggatcaaaaagaggaaaggggagtccatggccctcaatgagaagcagatcctcgagaaggtcaacagtcagtttgtggtcaacctggcctatgcctacgagaccaaggatgcactgtgcttggtcctgaccatcatgaatgggggtgacctgaagttccacatctacaacatgggcaaccctggcttcgaggagggggctgcagaggtcaagagacaccccttcttcaggaacatgaacttcaagcgcttagaagccgggatgttggaccctcccttcgttccagacccccgcgctgtgtactgtaaggacgtgctggacatcgagcagttctccactgtgaagggcgtcaatctggaccacacagacgacgacttctactccaagttctccacgggctctgtgtccatcccatggcaaaacgagatgatagaaacagaatgctttaaggagctgaacgtgtttggacctaatggtaccctcccgccagatctgaacagaaaccaccctccggaaccgcccaagaaagggctgctccagagactcttcaagcggcagcatcagaacaattccaagagttcgcccagctccaagtccacagtggaaccagcccagacccttctccttagaagtggaagtagtggagcccctgctctggtggggctgccaggggagaccccgggagccggggaaggaggccgtccatcccgtcgacgtagaacctcgaggtttctcaaagaaatttccactcaggtctgttttccgaggcggccccggccggggtggattggatttgtctttggtgaacattgcaatagaaatccaattggatacgacaacttgcacgtattttaatagcgtcataactagaactgaattttgtctttatgatttttaaagaaaagttttgtaaatttctctactgtctcagtttacattttgtatatttgtatttaaatgaaagtgagactttgagggtgtatattttctgtgcagccactgttaagccatgtgttccaaggcattttagcggggagggggttatcaaaaaaaaaaaaatgtgactcaagacttccagagcctcaaatgagaaaatgtctttattaaatgtag

SEQ ID NO: 11676 - DNA, 2939 bp, Homo sapiens
agagtgcgcggctggctgcggcggccggggaggccggggaggccgcggcgcggtcactgcgagccgagccgagccgcgccgagccgcgccgatcgccatccggcctcggcactcgcgcgcgatcccggccggcggcgcggcccggcgggccaggcggcgccacagcccatggagctcgagaacatcgtagcgaacacggtgctactcaaggcccgggaaggtggcggtggaaatcgcaaaggcaaaagcaagaaatggcggcagatgctccagttccctcacatcagccagtgcgaagagctgcggctcagcctcgagcgtgactatcacagcctgtgcgagcggcagcccattgggcgcctgctgttccgagagttctgtgccacgaggccggagctgagccgctgcgtcgccttcctggatggggtggccgagtatgaagtgaccccggatgacaagcggaaggcatgtgggcggcagctaacgcagaattttctgagccacacgggtcctgacctcatccctgaggtcccccggcagctggtgacgaactgcacccagcggctggagcagggtccctgcaaagaccttttccaggaactcacccggctgacccacgagtacctgagcgtggccccttttgccgactacctcgacagcatctacttcaaccgtttcctgcagtggaagtggctggaaaggcagccagtgaccaaaaacaccttcaggcaataccgagtcctgggcaaaggtggctttggggaggtgtgcgcctgccaggtgcgggccacaggtaagatgtatgcctgcaagaagctagagaaaaagcggatcaagaagcggaaaggggaggccatggcgctgaacgagaagcagatcctggagaaagtgaacagtaggtttgtagtgagcttggcctacgcctatgagaccaaggacgcgctgtgcctggtgctgacactgatgaacgggggcgacctcaagttccacatctaccacatgggccaggctggcttccccgaagcgcgggccgtcttctacgccgccgagatctgctgtggcctggaggacctgcaccgggagcgcatcgtgtacagggacctgaagcccgagaacatcttgctggatgaccacggccacatccgcatctctgacctgggactagctgtgcatgtgcccgagggccagaccatcaaagggcgtgtgggcaccgtgggttacatggctccggaggtggtgaagaatgaacggtacacgttcagccctgactggtgggcgctcggctgcctcctgtacgagatgatcgcaggccagtcgcccttccagcagaggaagaagaagatcaagcgggaggaggtggagcggctggtgaaggaggtccccgaggagtattccgagcgcttttccccgcaggcccgctcactttgctcacagctcctctgcaaggaccctgccgaacgcctggggtgtcgtgggggcagtgcccgcgaggtgaaggagcaccccctctttaagaagctgaacttcaagcggctgggagctggcatgctggagccgccgttcaagcctgacccccaggccatttactgcaaggatgttctggacattgaacagttctctacggtcaagggcgtggagctggagcctaccgaccaggacttctaccagaagtttgccacaggcagtgtgcccatcccctggcagaacgagatggtggagaccgagtgcttccaagagctgaatgtctttgggctggatggctcagttcccccagacctggactggaagggccagccacctgcacctcctaaaaagggactgctgcagagactcttcagtcgccaagattgctgtggaaactgcagcgacagcgaggaagagctccccacccgcctctagcccccagcccgaggcccccaccagcagttggcggtagcagctactccgagcgccgtttacagttttgcacagtgatcttccccattgtccactcaagtcgtggcctggggaacacagacggagctgtccccagtgtcctccgtccctcagcccctggcctggctgagtttggcagggcctgggccatccctgggacaaaggtgcgtcccttcagctcttctccgtggagctcggggctttctgtatttatgtatttgtacgaatgtatatagcgaccagagcattcttaattcccgccgcagacctggcgcccccgccttggctcctgggggcagccagccctggctgggagagcgggagctggcagaggagccactgccaaactcaaggctcctctggcccagcttggatggctgagggtggtcacacccctgagccttcagcactgtgctggccaccccggcctctgagtaagactcgtgcctccccctgctgccctgggctcaggctgctaccctctggggcccaaagctgtcccttctcagtgcttgtcagcgctgggtctggggcctctgtatgccctaggcctgtgccaaagtggccagagattgggctgcctgtgatacccatcagcccactgccccggccggcccagataggtctgcctctgccttccagctcccacagcctggtccctgatactgggctctgtcctgcagacacctctttcagaaacgcccaagcccagcccctaggagggggtggggcatccctggtcaaccctcaaacattccggactcccctcataacaatagacacatgtgcccagcaataatccgccccttcctgtgtgcgcctgtggggtgcgtgcgcgcgcgtgtgtacctgtgtgggtgaaggggatagggcgaggctgtgcctgtgccccaggtcccagccctggcccttcccagactgtgatggccatcctggtcccagtgttagggtagcatgggattacagggccctgttttttccatatttaaagccaatttttatta

SEQ ID NO: 11677 - DNA, 1789 bp, Homo sapiens
cccatggagctcgagaacatcgtagcgaacacggtgctactcaaggcccgggaaggtggcggtggaaatcgcaaaggcaaaagcaagaaatggcggcagatgctccagttccctcacatcagccagtgcgaagagctgcggctcagcctcgagcgtgactatcacagcctgtgcgagcggcagcccattgggcgcctgctgttccgagagttctgtgccacgaggccggagctgagccgctgcgtcgccttcctggatggggtggccgagtatgaagtgaccccggatgacaagcggaaggcatgtgggcggcagctaacgcagaattttctgagccacacgggtcctgacctcatccctgaggtcccccggcagctggtgacgaactgcacccagcggctggagcagggtccctgcaaagaccttttccaggaactcacccggctgacccacgagtacctgagcgtggccccttttgccgactacctcgacagcatctacttcaaccgtttcctgcagtggaagtggctggaaaggcagccagtgaccaaaaacaccttcaggcaataccgagtcctgggcaaaggtggctttggggaggtgtgcgcctgccaggtgcgggccacaggtaagatgtatgcctgcaagaagctagagaaaaagcggatcaagaagcggaaaggggaggccatggcgctgaacgagaagcagatcctggagaaagtgaacagtaggtttgtagtgagcttggcctacgcctatgagaccaaggacgcgctgtgcctggtgctgacactgatgaacgggggcgacctcaagttccacatctaccacatgggccaggctggcttccccgaagcgcgggccgtcttctacgccgccgagatctgctgtggcctggaggacctgcaccgggagcgcatcgtgtacagggacctgaagcccgagaacatcttgctggatgaccacggccacatccgcatctctgacctgggactagctgtgcatgtgcccgagggccagaccatcaaagggcgtgtgggcaccgtgggttacatggctccggaggtggtgaagaatgaacggtacacgttcagccctgactggtgggcgctcggctgcctcctgtacgagatgatcgcaggccagtcgcccttccagcagaggaagaagaagatcaagcgggaggaggtggagcggctggtgaaggaggtccccgaggagtattccgagcgcttttccccgcaggcccgctcactttgctcacagctcctctgcaaggaccctgccgaacgcctggggtgtcgtgggggcagtgcccgcgaggtgaaggagcaccccctctttaagaagctgaacttcaagcggctgggagctggcatgctggagccgccgttcaagcctgacccccaggccatttactgcaaggatgttctggacattgaacagttctctacggtcaagggcgtggagctggagcctaccgaccaggacttctaccagaagtttgccacaggcagtgtgcccatcccctggcagaacgagatggtggagaccgagtgcttccaagagctgaatgtctttgggctggatggctcagttcccccagacctggactggaagggccagccacctgcacctcctaaaaagggactgctgcagagactcttcagtcgccaaaggtgagcagtgtgggctccccgtgggttggccttgctgcctggcctcggggagccacgggcagcccttccatggcaaaggcaagatgtgggagaaagaagtctggtgc

SEQ ID NO: 11678 - DNA, 2571 bp, Homo sapiens
cccatggagctcgagaacatcgtagcgaacacggtgctactcaaggcccgggaaggtggcggtggaaatcgcaaaggcaaaagcaagaaatggcggcagatgctccagttccctcacatcagccagtgcgaagagctgcggctcagcctcgagcgtgactatcacagcctgtgcgagcggcagcccattgggcgcctgctgttccgagagttctgtgccacgaggccggagctgagccgctgcgtcgccttcctggatggggtggccgagtatgaagtgaccccggatgacaagcggaaggcatgtgggcggcagctaacgcagaattttctgagccacacgggtcctgacctcatccctgaggtcccccggcagctggtgacgaactgcacccagcggctggagcagggtccctgcaaagaccttttccaggaactcacccggctgacccacgagtacctgagcgtggccccttttgccgactacctcgacagcatctacttcaaccgtttcctgcagtggaagtggctggaaaggcagccagtgaccaaaaacaccttcaggcaataccgagtcctgggcaaaggtggctttggggaggtgtgcgcctgccaggtgcgggccacaggtaagatgtatgcctgcaagaagctagagaaaaagcggatcaagaagcggaaaggggaggccatggcgctgaacgagaagcagatcctggagaaagtgaacagtaggtttgtagtgagcttggcctacgcctatgagaccaaggacgcgctgtgcctggtgctgacactgatgaacgggggcgacctcaagttccacatctaccacatgggccaggctggcttccccgaagcgcgggccgtcttctacgccgccgagatctgctgtggcctggaggacctgcaccgggagcgcatcgtgtacagggacctgaagcccgagaacatcttgctggatgaccacggccacatccgcatctctgacctgggactagctgtgcatgtgcccgagggccagaccatcaaagggcgtgtgggcaccgtgggttacatggctccggaggtggtgaagaatgaacggtacacgttcagccctgactggtgggcgctcggctgcctcctgtacgagatgatcgcaggccagtcgcccttccagcagaggaagaagaagatcaagcgggaggaggtggagcggctggtgaaggaggtccccgaggagtattccgagcgcttttccccgcaggcccgctcactttgctcacagctcctctgcaaggaccctgccgaacgcctggggtgtcgtgggggcagtgcccgcgaggtgaaggagcaccccctctttaagaagctgaacttcaagcggctgggagctggcatgctggagccgccgttcaagcctgacccccaggccatttactgcaaggatgttctggacattgaacagttctctacggtcaagggcgtggagctggagcctaccgaccaggacttctaccagaagtttgccacaggcagtgtgcccatcccctggcagaacgagatggtggagaccgagtgcttccaagagctgaatgtctttgggctggatggctcagttcccccagacctggactggaagggccagccacctgcacctcctaaaaagggactgctgcagagactcttcagtcgccaaaggattgctgtggaaactgcagcgacagcgaggaagagctccccacccgcctctagcccccagcccgaggcccccaccagcagttggcggtagcagctactccgagcgccgtttacagttttgcacagtgatcttccccattgtccactcaagtcgtggcctggggaacacagacggagctgtccccagtgtcctccgtccctcagcccctggcctggctgagtttggcagggcctgggccatccctgggacaaaggtgcgtcccttcagctcttctccgtggagctcggggctttctgtatttatgtatttgtacgaatgtatatagcgaccagagcattcttaattcccgccgcagacctggcgcccccgccttggctcctgggggcagccagccctggctgggagagcgggagctggcagaggagccactgccaaactcaaggctcctctggcccagcttggatggctgagggtggtcacacccctgagccttcagcactgtgctggccaccccggcctctgagtaagactcgtgcctccccctgctgccctgggctcaggctgctaccctctggggcccaaagctgtcccttctcagtgcttgtcagcgctgggtctggggcctctgtatgccctaggcctgtgccaaagtggccagagattgggctgcctgtgatacccatcagcccactgccccggccggcccagataggtctgcctctgccttccagctcccacagcctggtccctgatactgggctctgtcctgcagacacctctttcagaaacgcccaagcccagcccctaggagggggtggggcatccctggtcaaccctcaaacattccggactcccctcataacaatagacacatgtgcccagcaataa

SEQ ID NO: 11679 - DNA, 3239 bp, Homo sapiens
accctccacgggtcccacccacaggccacaggactcactgtaaatcccttggacgttgtctcacccgggaagggaaagcagccagcagccctccagccctcttgtgctttccctgggagtgcgccccgtgctcagccatggtggacatgggggccctggacaacctgatcgccaacaccgcctacctgcaggcccggaagccctcggactgcgacagcaaagagctgcagcggcggcggcgtagcctggccctgcccgggctgcagggctgcgcggagctccgccagaagctgtccctgaacttccacagcctgtgtgagcagcagcccatcggtcgccgcctcttccgtgacttcctagccacagtgcccacgttccgcaaggcggcaaccttcctagaggacgtgcagaactgggagctggccgaggagggacccaccaaagacagcgcgctgcaggggctggtggccacttgtgcgagtgcccctgccccggggaacccgcaacccttcctcagccaggccgtggccaccaagtgccaagcagccaccactgaggaagagcgagtggctgcagtgacgctggccaaggctgaggccatggctttcttgcaagagcagccctttaaggatttcgtgaccagcgccttctacgacaagtttctgcagtggaaactcttcgagatgcaaccagtgtcagacaagtacttcactgagttcagagtgctggggaaaggtggttttggggaggtatgtgccgtccaggtgaaaaacactgggaagatgtatgcctgtaagaaactggacaagaagcggctgaagaagaaaggtggcgagaagatggctctcttggaaaaggaaatcttggagaaggtcagcagccctttcattgtctctctggcctatgcctttgagagcaagacccatctctgccttgtcatgagcctgatgaatgggggagacctcaagttccacatctacaacgtgggcacgcgtggcctggacatgagccgggtgatcttttactcggcccagatagcctgtgggatgctgcacctccatgaactcggcatcgtctatcgggacatgaagcctgagaatgtgcttctggatgacctcggcaactgcaggttatctgacctggggctggccgtggagatgaagggtggcaagcccatcacccagagggctggaaccaatggttacatggctcctgagatcctaatggaaaaggtaagttattcctatcctgtggactggtttgccatgggatgcagcatttatgaaatggttgctggacgaacaccattcaaagattacaaggaaaaggtcagtaaagaggatctgaagcaaagaactctgcaagacgaggtcaaattccagcatgataacttcacagaggaagcaaaagatatttgcaggctcttcttggctaagaaaccagagcaacgcttaggaagcagagaaaagtctgatgatcccaggaaacatcatttctttaaaacgatcaactttcctcgcctggaagctggcctaattgaacccccatttgtgccagacccttcagtggtttatgccaaagacatcgctgaaattgatgatttctctgaggttcggggggtggaatttgatgacaaagataagcagttcttcaaaaactttgcgacaggtgctgttcctatagcatggcaggaagaaattatagaaacgggactgtttgaggaactgaatgaccccaacagacctacgggttgtgaggagggtaattcatccaagtctggcgtgtgtttgttattgtaaattgctctctttaccagacaggcagcaggagtctcggctgacataatcctcgaatgttccacacgtggaaatctgtggaatgagggctaatcagttaggagggacatcacaaccacaaaacaattcaaaagacaggcaagctcactactagaacacattttattttctttttctttcttcataaagatgagtaaagtctcagttttcactgagggcagggaaaaggaacactcaggtttattttgataaactgaaagcatcagccttttaccatcatgtccctgtgtattacgcaaagtcctaggaacagagaatggaactttgtggtgtgcccagaaaatgagcatttgcaattcttagtaaataatcattttagtttttctttgtttatatctttttttcccttcatctttcttcgcttctatacttataaaaaggattttgaagctggaaacaaatgtttctgacattctccccctaaaaaggagtggattacaatattttggcaatgttttaaatcacagaataattttcaatttcagtgacagtttcttttgcaattttgtggaaataatttactatcataatgttgaagcattttaaacataaacatccatgacatctgtgaattaaagcattctgtaaatttagttgagtcctttaagtaatatggtacaaattgcttcaacttgcactaccatatgccatcggttcccaaactctgctgaactttggaatcatctagggatcttttaaaaaactaatgcctgattcccatccatagacattctgatccccactcccaggtatgagaacagcttgaccatttagaatttcagaagctccccaggtgattctaatgtgcagcagagtttggcaggcactgctgtgcacatttgaatgttattacattcaatcttattttggttgctcaaaacttcaatcatacattttgatggcaacttttcaaatgtccccaaagcatgtcattttagtaattgcagtataaatgaaacaagacagtctattcatcttatggcttctcttgtccttgcacactttagtttctcacacgtatcttgggagctcggtctcttggctatttcaagtcctgaaggagacctatgggcttagaaattgagttgaacaggccaggtgcggtggctcatgcctgcaattccagcactttgggaggccaaggcagatggatcatgaggtcaggggctcaagactagcctggccaacatgttgtaaaccccgtctctactaaaaatacaaaaattagcccggtgtggtggtgcacatctataatcccagttacccgggagcctgaggcaggagaattgcttgaacccaggaggcggaggttgtagtgagccaagatcgcaacattgcactccaggctgggcagcaagagcaagactctatctcaaaaaaaaa

SEQ ID NO: 11680 - DNA, 3768 bp, Homo sapiens
agggggcggagagaggagccgcgagcggcggcggggcggcgcggggcggagggcgcccgagggcgagcgggcaggcgggcacggcgggttccgggccagccccggggcggacggttggccgggcgcgcggagcctcgccggggcctcgccggagccgggccgggcagcaggggccgccgccgccgcccgggcccgccgcccgcgccccccacgctggcccagagggctgcggccgcgtcgccgctgaggatgtcccgaaaggggccgcgagcggaggtgtgtgcggactgcagcgccccggaccctggctgggcatccatcagcaggggtgtgctggtgtgtgacgagtgctgcagcgtgcaccggagcctgggacgccacatctccattgtcaagcaccttcgccacagcgcctggcctcccacgctgctgcagatggtgcacacgcttgccagcaacggggccaactccatctgggagcactccctgctggaccccgcacaagtgcagagcggccggcgtaaagccaacccccaagacaaagtccaccccatcaagtcagagttcatcagggccaagtaccagatgctggcatttgtgcacaagcttccctgccgggacgatgatggagtcaccgccaaagacctcagcaagcaactacactcgagcgtgcggacaggcaacctggagacatgtctgcgcctgctctccctgggtgcccaggccaacttcttccacccagagaagggcaccacacctctgcacgtggctgccaaggcaggacagacactgcaggccgagctgcttgtagtgtatggggctgaccctggctcccctgatgttaatggccgcacacccattgactatgccaggcaggcggggcaccatgagctggcggaaaggctggttgagtgccaatatgagctcactgaccggctggccttctacctctgtggacgcaagccggatcacaagaatgggcattacatcatcccacagatggctgacagccttgacttatccgaattggccaaagctgctaagaagaagctgcaggcgctcagcaaccggctttttgaggaactcgccatggacgtgtatgacgaggtggatcgaagagaaaatgatgcagtgtggctggctacccaaaaccacagcactctggtgacagagcgcagtgccgtgcccttcctgcctgttaacccggaatactcagccacgcggaatcaggggcgacaaaagctggcccgctttaatgcccgagagtttgccaccttgatcatcgacattctcagtgaggccaagcggagacagcagggcaagagcctgagcagccccacagacaacctcgagctgtctctgcggagccagagtgacctcgacgaccaacacgactacgacagcgtggcctctgacgaggacacagaccaggagcccctgcgcagcaccggcgccactcggagcaaccgggcccggagcatggactcctcggacttgtctgacggggctgtgacgctgcaggagtacctggagctgaagaaggccctggctacatcggaggcaaaggtgcagcagctcatgaaggtcaacagtagcctgagcgacgagctccggaggctgcagcgagagatccacaagctgcaggcggagaacctgcagctccggcagcctccagggccggtgcccacacctccactccccagtgaacgggcggaacacacacccatggcgccaggcgggagcacacaccgcagggatcgccaggccttttccatgtatgaacctggctctgccctgaagccctttgggggcccccctggggacgagctcactacgcggctgcagcctttccacagcactgagctagaggacgacgccatctattcagtgcacgtccctgctggcctttaccggatccggaaaggggtgtctgcctcagctgtgcccttcactccctcctccccgctgctgtcctgctcccaggagggaagccgccacacgagcaagctttcccgccacggcagtggagccgacagtgactatgagaacacgcaaagtggggacccactgctggggctggaagggaagaggtttctagagctgggcaaagaggaagacttccacccagagctggaaagcctggatggagacctagatcctgggcttcccagcacagaggatgtcatcttgaagacagagcaggtcaccaagaacattcaggaactgttgcgggcagcccaggagttcaagcatgacagcttcgtgccctgctcagagaagatccatttggctgtgaccgagatggcctccctcttcccaaagaggccagccctggagccagtgcggagctcactgcggctgctcaacgccagcgcctaccggctgcagagtgagtgccggaagacagtgcccccagagcccggcgccccagtggacttccagctgctgactcagcaggtgatccagtgcgcctatgacatcgccaaggctgccaagcagctggtcaccatcaccacccgagagaagaagcagtgacctctctccccacaccctcacctgcaccctaggacctcactggccataggagctgggccactccagacattaatccccaccccaacagagccactggcacaagtgcccttagtgctgccacactccctggcagccaggtgccctggtgcccacccctgtcgagcccctaaggatggggaggtgggggggcaggagcttctgtcccccacattccatgcacctcccctctgtatatagcatctcccccctcctagtgagcaggggcctgcaaggcatcactcccagcccctcgccttctagggcaccctcagcaaaggggcaggtggggacactccaagtggggcagctctccgtacatgcgccccacccccatgagccagttcagccctactgggggctgagcgggggcatcccctcctttgtacatagtctccatggatgtccctgccctgtagccaccagccccttgctgctctccctttaatgccatatggcccctgcctagggcacaggccccaacctgtgtgctggggtccccagcagcaaacactggaaagtctgttttttttttttctttcttcttccccaccccttaattttaactttgtggtaactgagtgcccccgcgtgcctgcgtgttgagtgtgtgggcggcagtgccgttccggaggcctggtccatctggagttttgaggggtgaggggaccagagcagtgggaccagcatggggatcagcttcccttccccacctggagccagggactgtccgggtagccagttttggtcctgccagctgcctccctgatccctccccactctcgccccttctctatgaacttaaatcaaaaaccacttccctccatctcctcctgctcctgcgtggagggggaatgtgtgctggctagggtggaggactgagcacctgagcctggggctggctccccggggtccccgactcagctggtggctgtggagctgagtcccctccccgtaacctctgcaaggccagcacccaccatcactacctgcacctgctgtggtcccaccctctggaggcctgggaacctggctgcagcctgggaaggctggagaggcagacggtgggacccaccagctctctccccatcccgcttcttccctgggggccaggccctacctgtgtggtggtgggtgggctgtcaagacgtgtcatgtacatttgtatcaaaaataaagaagtgaccatgagctgtt

SEQ ID NO: 11681 - DNA, 748 bp, Homo sapiens
gcggcgcggggcggagggcgcccgagggcgagcgggcaggcgggcacggcgggttccgggccagccccggggcggacggttggccgggcgcgcggagcctcgccggggcctcgccggagccgggccgggcagcaggggccgccgccgccgcccgggcccgccgcccgcgccccccacgctggcccagagggctgcggccgcgtcgccgctgaggatgtcccgaaaggggccgcgagcggaggtgtgtgcggactgcagcgccccggaccctggctgggcatccatcagcaggggtgtgctggtgtgtgacgagtgctgcagcgtgcaccggagcctgggacgccacatctccattgtcaagcaccttcgccacagcgcctggcctcccacgctgctgcagatggtgcacacgcttgccagcaacggggccaactccatctgggagcactccctgctggaccccgcacaagtgcagagcggccggcgtaaagccaacccccaagacaaagtccaccccatcaagtcagagttcatcagggccaagtaccagatgctggcatttgtgcacaagcttccctgccgggacgatgatggagtcaccgccaaagacgacctcactggccataggagctgggccactccagacattaatccccaccccaacagagccactggcacaagtgcccttagtgctgccacactccctggcagccaggtgccctggtgcccacccctgtcgagcccctaa

SEQ ID NO: 11682 - DNA, 3711 bp, Homo sapiens
gcacggcgggttccgggccagccccggggcggacggttggccgggcgcgcggagcctcgccggggcctcgccggagccgggccgggcagcaggggccgccgccgccgcccgggcccgccgcccgcgccccccacgctggcccagagggctgcggccgcgtcgccgctgaggatgtcccgaaaggggccgcgagcggaggtgtgtgcggactgcagcgccccggaccctggctgggcatccatcagcaggggtgtgctggtgtgtgacgagtgctgcagcgtgcaccggagcctgggacgccacatctccattgtcaagcaccttcgccacagcgcctggcctcccacgctgctgcagatggtgcacacgcttgccagcaacggggccaactccatctgggagcactccctgctggaccccgcacaagtgcagagcggccggcgtaaagccaacccccaagacaaagtccaccccatcaagtcagagttcatcagggccaagtaccagatgctggcatttgtgcacaagcttccctgccgggacgatgatggagtcaccgccaaagacctcagcaagcaactacactcgagcgtgcggacaggcaacctggagacatgtctgcgcctgctctccctgggtgcccaggccaacttcttccacccagagaagggcaccacacctctgcacgtggctgccaaggcaggacagacactgcaggccgagctgcttgtagtgtatggggctgaccctggctcccctgatgttaatggccgcacacccattgactatgccaggcaggcggggcaccatgagctggcggaaaggctggttgagtgccaatatgagctcactgaccggctggccttctacctctgtggacgcaagccggatcacaagaatgggcattacatcatcccacagatggctgacagatctcggcaaaagtgcatgtctcagagccttgacttatccgaattggccaaagctgctaagaagaagctgcaggcgctcagcaaccggctttttgaggaactcgccatggacgtgtatgacgaggtggatcgaagagaaaatgatgcagtgtggctggctacccaaaaccacagcactctggtgacagagcgcagtgccgtgcccttcctgcctgttaacccggaatactcagccacgcggaatcaggggcgacaaaagctggcccgctttaatgcccgagagtttgccaccttgatcatcgacattctcagtgaggccaagcggagacagcagggcaagagcctgagcagccccacagacaacctcgagctgtctctgcggagccagagtgacctcgacgaccaacacgactacgacagcgtggcctctgacgaggacacagaccaggagcccctgcgcagcaccggcgccactcggagcaaccgggcccggagcatggactcctcggacttgtctgacggggctgtgacgctgcaggagtacctggagctgaagaaggccctggctacatcggaggcaaaggtgcagcagctcatgaaggtcaacagtagcctgagcgacgagctccggaggctgcagcgagagatccacaagctgcaggcggagaacctgcagctccggcagcctccagggccggtgcccacacctccactccccagtgaacgggcggaacacacacccatggcgccaggcgggagcacacaccgcagggatcgccaggccttttccatgtatgaacctggctctgccctgaagccctttgggggcccccctggggacgagctcactacgcggctgcagcctttccacagcactgagctagaggacgacgccatctattcagtgcacgtccctgctggcctttaccggatccggaaaggggtgtctgcctcagctgtgcccttcactccctcctccccgctgctgtcctgctcccaggagggaagccgccacacgagcaagctttcccgccacggcagtggagccgacagtgactatgagaacacgcaaagtggggacccactgctggggctggaagggaagaggtttctagagctgggcaaagaggaagacttccacccagagctggaaagcctggatggagacctagatcctgggcttcccagcacagaggatgtcatcttgaagacagagcaggtcaccaagaacattcaggaactgttgcgggcagcccaggagttcaagcatgacagcttcgtgccctgctcagagaagatccatttggctgtgaccgagatggcctccctcttcccaaagaggccagccctggagccagtgcggagctcactgcggctgctcaacgccagcgcctaccggctgcagagtgagtgccggaagacagtgcccccagagcccggcgccccagtggacttccagctgctgactcagcaggtgatccagtgcgcctatgacatcgccaaggctgccaagcagctggtcaccatcaccacccgagagaagaagcagtgacctctctccccacaccctcacctgcaccctaggacctcactggccataggagctgggccactccagacattaatccccaccccaacagagccactggcacaagtgcccttagtgctgccacactccctggcagccaggtgccctggtgcccacccctgtcgagcccctaaggatggggaggtgggggggcaggagcttctgtcccccacattccatgcacctcccctctgtatatagcatctcccccctcctagtgagcaggggcctgcaaggcatcactcccagcccctcgccttctagggcaccctcagcaaaggggcaggtggggacactccaagtggggcagctctccgtacatgcgccccacccccatgagccagttcagccctactgggggctgagcgggggcatcccctcctttgtacatagtctccatggatgtccctgccctgtagccaccagccccttgctgctctccctttaatgccatatggcccctgcctagggcacaggccccaacctgtgtgctggggtccccagcagcaaacactggaaagtctgttttttttttttctttcttcttccccaccccttaattttaactttgtggtaactgagtgcccccgcgtgcctgcgtgttgagtgtgtgggcggcagtgccgttccggaggcctggtccatctggagttttgaggggtgaggggaccagagcagtgggaccagcatggggatcagcttcccttccccacctggagccagggactgtccgggtagccagttttggtcctgccagctgcctccctgatccctccccactctcgccccttctctatgaacttaaatcaaaaaccacttccctccatctcctcctgctcctgcgtggagggggaatgtgtgctggctagggtggaggactgagcacctgagcctggggctggctccccggggtccccgactcagctggtggctgtggagctgagtcccctccccgtaacctctgcaaggccagcacccaccatcactacctgcacctgctgtggtcccaccctctggaggcctgggaacctggctgcagcctgggaaggctggagaggcagacggtgggacccaccagctctctccccatcccgcttcttccctgggggccaggccctacctgtgtggtggtgggtgggctgtcaagacgtgtcatgtacatttgtatcaaaaataaagaagtgaccatga

SEQ ID NO: 11683 - DNA, 4610 bp, Homo sapiens
gggccgcggccgctgcagcagcgcgggccgggccagggggcgcctcgcgcggcagcgactctggcaggcgctgcagtgaagctggacccgcaggcgggcgtgcgtggagcgggggccgcggccgcgccgcagagatgtgactcgggccgaaggccagctggagcgtcggcgctgcggggccgcgggggtcgaatgttcgtggcatcagagagaaagatgagagctcaccaggtgctcaccttcctcctgctcttcgtgatcacctcggtggcctctgaaaacgccagcacatcccgaggctgtgggctggacctcctccctcagtacgtgtccctgtgcgacctggacgccatctggggcattgtggtggaggcggtggccggggcgggcgccctgatcacactgctcctgatgctcatcctcctggtgcggctgcccttcatcaaggagaaggagaagaagagccctgtgggcctccactttctgttcctcctggggaccctgggcctctttgggctgacgtttgccttcatcatccaggaggacgagaccatctgctctgtccgccgcttcctctggggcgtcctctttgcgctctgcttctcctgcctgctgagccaggcatggcgcgtgcggaggctggtgcggcatggcacgggccccgcgggctggcagctggtgggcctggcgctgtgcctgatgctggtgcaagtcatcatcgctgtggagtggctggtgctcaccgtgctgcgtgacacaaggccagcctgcgcctacgagcccatggactttgtgatggccctcatctacgacatggtactgcttgtggtcaccctggggctggccctcttcactctgtgcggcaagttcaagaggtggaagctgaacggggccttcctcctcatcacagccttcctctctgtgctcatctgggtggcctggatgaccatgtacctcttcggcaatgtcaagctgcagcagggggatgcctggaacgaccccaccttggccatcacgctggcggccagcggctgggtcttcgtcatcttccacgccatccctgagatccactgcacccttctgccagccctgcaggagaacacgcccaactacttcgacacgtcgcagcccaggatgcgggagacggccttcgaggaggacgtgcagctgccgcgggcctatatggagaacaaggccttctccatggatgaacacaatgcagctctccgaacagcaggatttcccaacggcagcttgggaaaaagacccagtggcagcttggggaaaagacccagcgctccgtttagaagcaacgtgtatcagccaactgagatggccgtcgtgctcaacggtgggaccatcccaactgctccgccaagtcacacaggaagacacctttggtgaaagactttaagttccagagaatcagaatttctcttaccgatttgcctccctggctgtgtctttcttgagggagaaatcggtaacagttgccgaaccaggccgcctcacagccaggaaatttggaaatcctagccaaggggatttcgtgtaaatgtgaacactgacgaactgaaaagctaacaccgactgcccgcccctcccctgccacacacacagacacgtaataccagaccaacctcaatccccgcaaactaaagcaaagctaattgcaaatagtattaggctcactggaaaatgtggctgggaagactgtttcatcctctgggggtagaacagaaccaaattcacagctggtgggccagactggtgttggttggaggtggggggctcccactcttatcacctctccccagcaagtgctggaccccaggtagcctcttggagatgaccgttgcgttgaggacaaatggggactttgccaccggcttgcctggtggtttgcacatttcaggggggtcaggagagttaaggaggttgtgggtgggattccaaggtgaggcccaactgaatcgtggggtgagctttatagccagtagaggtggagggaccctggcatgtgccaaagaagaggccctctgggtgatgaagtgaccatcacatttggaaagtgatcaaccactgttccttctatggggctcttgctctagtgtctatggtgagaacacaggccccgccccttcccttgtagagccatagaaatattctggcttggggcagcagtcccttcttcccttgatcatctcgccctgttcctacacttacgggtgtatctccaaatcctctcccaattttattcccttattcatttcaagagctccaatggggtctccagctgaaagcccctccgggaggcaggttggaaggcaggcaccacggcaggttttccgcgatgatgtcacctagcagggcttcaggggttcccactaggatgcagagatgacctctcgctgcctcacaagcagtgacacctcgggtcctttccgttgctatggtgaaaattcctggatggaatggatcacatgagggtttcttgttgcttttggagggtgtgggggatattttgttttggtttttctgcaggttccatgaaaacagcccttttccaagcccattgtttctgtcatggtttccatctgtcctgagcaagtcattcctttgttatttagcatttcgaacatctcggccattcaaagcccccatgttctctgcactgtttggccagcataacctctagcatcgattcaaagcagagttttaacctgacggcatggaatgtataaatgagggtgggtccttctgcagatactctaatcactacattgctttttctataaaactacccataagcctttaacctttaaagaaaaatgaaaaaggttagtgtttgggggccgggggaggactgaccgcttcataagccagtacgtctgagctgagtatgtttcaataaaccttttgatatttctcaaggccctagtctctgctgtctcccctccccaccccatccttgcaaagcactggggaaagtaaggccaatctggccctccctgtgtgacccgccttcgagttttccttaacagttagtacatttccttgtgttaccacgcatggggaagaaaacgcatggccccagaatgccacccccacctgacctccccggaagcaccccgcctctgcccagagcatgtgcttgcttctagagaatcccgttccagtcattgcgtggacagaaaacgtaagagtcctggggaggggtgggagggaatgaagctaggacctggggtgggggtgggggcggttgcatgcggacccggtattctgaaaagaaagaaatcttcaaacacctcggtcctgtccggtgaaaaaacgacagcattacacattctcgtgccaggaaatggttactcacccccgctctctggagtcctttggagctttctgataccattcacacgatggagcaattcacacgttcgttttctaagttctttattgtccaagcatataaggtgagcacagcacaaatggctgccatggaaagtcgtgcttccccagcataagaacagagccatctttgagccatgggaagcctcatttaatgagacctttttccccccttttaaatctgatatgttatcgcacttagggttttgttttattttggcttttaaggttgagagtgggctgaacgccttcataatgggggcggaggcgggagtgagaggagaagggagagagctgttctttttctaatgactacacctgaaaagtatcaagagacatctttgccaagagactgtagcagccagctgccccccgtggagcaaggtttaaagacaaaattaaatggcacctctgtttaagatctgcgtgtgtaaacaagactcgtttggggaaaacgacccgggaggagagcatctgtgatcaaaatctctcattgtaagcacaaattgttccgtgtctggttattaaaatcgctttgggtctataacagccactcttgtccccccttttaatagaaaattgtcattctagcctggatttctccccactggaggtggagggtgggaagagaagggagtcagctctgacagcttacaaactgggaagttctgtgcatctccagggattccagagttgaagatctggttgttggaagctgggcgcccagtgcttttttttttttttttttttagcccagatgccgtcaggacccactgaacaagggtgaactcgggtggtggtctcggttggccaaggctgagttgaacgcctcaggccaaaccccaagttgaaagggagcattgtggcttttataatccaatgatgcaatgatgataccagcttacaggagttctcagcaggtgctttttattaactgatgaagagctaaggctcacttttgatagataatatatatttattaaatgcattaatgtgtgttttataatgtacctttatcttcccccggctgactgttgcatacttataaaaaagaagttaaagaaatttcaagacaatcaatatgtaccataaacgactatataaatattacaaatttaaaaggctgtaaaccatgggcagataggttttattttcaaaatgctgttcttaacacaaaaataaaggctttactatttacttaa

SEQ ID NO: 11684 - DNA, 1215 bp, Homo sapiens
atgttcgtggcatcagagagaaagatgagagctcaccaggtgctcaccttcctcctgctcttcgtgatcacctcggtggcctctgaaaacgccagcacatcccgaggctgtgggctggacctcctccctcagtacgtgtccctgtgcgacctggacgccatctggggcattgtggtggaggcggtggccggggcgggcgccctgatcacactgctcctgatgctcatcctcctggtgcggctgcccttcatcaaggagaaggagaagaagagccctgtgggcctccactttctgttcctcctggggaccctgggcctctttgggctgacgtttgccttcatcatccaggaggacgagaccatctgctctgtccgccgcttcctctggggcgtcctctttgcgctctgcttctcctgcctgctgagccaggcatggcgcgtgcggaggctggtgcggcatggcacgggccccgcgggctggcagctggtgggcctggcgctgtgcctgatgctggtgcaagtcatcatcgctgtggagtggctggtgctcaccgtgctgcgtgacacaaggccagcctgcgcctacgagcccatggactttgtgatggccctcatctacgacatggtactgcttgtggtcaccctggggctggccctcttcactctgtgcggcaagttcaagaggtggaagctgaacggggccttcctcctcatcacagccttcctctctgtgctcatctgggtggcctggatgaccatgtacctcttcggcaatgtcaagctgcagcagggggatgcctggaacgaccccaccttggccatcacgctggcggccagcggctgggtcttcgtcatcttccacgccatccctgagatccactgcacccttctgccagccctgcaggagaacacgcccaactacttcgacacgtcgcagcccaggatgcgggagacggccttcgaggaggacgtgcagctgccgcgggcctatatggagaacaaggccttctccatggatgaacacaatgcagctctccgaacagcaggatttcccaacggcagcttgggaaaaagacccagtggcagcttggggaaaagacccagcgctccgtttagaagcaacgtgtatcagccaactgagatggccgtcgtgctcaacggtgggaccgaaatggttactcacccccgctctctggagtcctttggagctttctga

SEQ ID NO: 11685 - DNA, 1613 bp, Homo sapiens
aaggaagcgggtgttggtcccagtgtgcgtaaacggacaacgacatctgggagttgggcagtgaggagagagaagagtgtgtccaggaggaacctgcctggaggaggcctagcggtgtgtgtgcgcctaggtgtataccggggcgttggtgacttcgagaggcaccgggcgggatcgatcctctctgcgtcctggacctggtgctggtgtgtttcggggaagttactgcttatgaaccccccttggagcgtggcctgggggcaggaaggcttccgcgctgggacccctgggtcgcgatacctccctcgaatgttcgtggcatcagagagaaagatgagagctcaccaggtgctcaccttcctcctgctcttcgtgatcacctcggtggcctctgaaaacgccagcacatcccgaggctgtgggctggacctcctccctcagtacgtgtccctgtgcgacctggacgccatctggggcattgtggtggaggcggtggccggggcgggcgccctgatcacactgctcctgatgctcatcctcctggtgcggctgcccttcatcaaggagaaggagaagaagagccctgtgggcctccactttctgttcctcctggggaccctgggcctctttgggctgacgtttgccttcatcatccaggaggacgagaccatctgctctgtccgccgcttcctctggggcgtcctctttgcgctctgcttctcctgcctgctgagccaggcatggcgcgtgcggaggctggtgcggcatggcacgggccccgcgggctggcagctggtgggcctggcgctgtgcctgatgctggtgcaagtcatcatcgctgtggagtggctggtgctcaccgtgctgcgtgacacaaggccagcctgcgcctacgagcccatggactttgtgatggccctcatctacgacatggtactgcttgtggtcaccctggggctggccctcttcactctgtgcggcaagttcaagaggtggaagctgaacggggccttcctcctcatcacagccttcctctctgtgctcatctgggtggcctggatgaccatgtacctcttcggcaatgtcaagctgcagcagggggatgcctggaacgaccccaccttggccatcacgctggcggccagcggctgggtcttcgtcatcttccacgccatccctgagatccactgcacccttctgccagccctgcaggagaacacgcccaactacttcgacacgtcgcagcccaggatgcgggagacggccttcgaggaggacgtgcagctgccgcgggcctatatggagaacaaggccttctccatggatgaacacaatgcagctctccgaacagcaggatttcccaacggcagcttgggaaaaagacccagtggcagcttggggaaaagacccagcgctccgtttagaagcaacgtgtatcagccaactgagatggccgtcgtgctcaacggtgggaccatcccaactgctccgccaagtcacacaggaagacacctttggtgaaagactttaagttccagagaatcagaatttctcttaccgatttgcctccctggctgtgtctttcttgagggagaaatcggtaacagttgccg

SEQ ID NO: 11686 - DNA, 2178 bp, Homo sapiens
atgttcgtggcatcagagagaaagatgagagctcaccaggtgctcaccttcctcctgctcttcgtgatcacctcggtggcctctgaaaacgccagcacatcccgaggctgtgggctggacctcctccctcagtacgtgtccctgtgcgacctggacgccatctggggcattgtggtggaggcggtggccggggcgggcgccctgatcacactgctcctgatgctcatcctcctggtgcggctgcccttcttcctcctcatcacagccttcctctctgtgctcatctgggtggcctggatgaccatgtacctcttcggcaatgtcaagctgcagcagggggatgcctggaacgaccccaccttggccatcacgctggcggccagcggctgggtcttcgtcatcttccacgccatccctgagatccactgcacccttctgccagccctgcaggagaacacgcccaactacttcgacacgtcgcagcccaggatgcgggagacggccttcgaggaggacgtgcagctgccgcgggcctatatggagaacaaggccttctccatggatgaacacaatgcagctctccgaacagcaggatttcccaacggcagcttgggaaaaagacccagtggcagcttggggaaaagacccagcgctccgtttagaagcaacgtgtatcagccaactgagatggccgtcgtgctcaacggtgggaccatcccaactgctccgccaagtcacacaggaagacacctttggtgaaagactttaagttccagagaatcagaatttctcttaccgatttgcctccctggctgtgtctttcttgagggagaaatcggtaacagttgccgaaccaggccgcctcacagccaggaaatttggaaatcctagccaaggggatttcgtgtaaatgtgaacactgacgaactgaaaagctaacaccgactgcccgcccctcccctgccacacacacagacacgtaataccagaccaacctcaatccccgcaaactaaagcaaagctaattgcaaatagtattaggctcactggaaaatgtggctgggaagactgtttcatcctctgggggtagaacagaaccaaattcacagctggtgggccagactggtgttggttggaggtggggggctcccactcttatcacctctccccagcaagtgctggaccccaggtagcctcttggagatgaccgttgcgttgaggacaaatggggactttgccaccggcttgcctggtggtttgcacatttcaggggggtcaggagagttaaggaggttgtgggtgggattccaaggtgaggcccaactgaatcgtggggtgagctttatagccagtagaggtggagggaccctggcatgtgccaaagaagaggccctctgggtgatgaagtgaccatcacatttggaaagtgatcaaccactgttccttctatggggctcttgctctagtgtctatggtgagaacacaggccccgccccttcccttgtagagccatagaaatattctggcttggggcagcagtcccttcttcccttgatcatctcgccctgttcctacacttacgggtgtatctccaaatcctctcccaattttattcccttattcatttcaagagctccaatggggtctccagctgaaagcccctccgggaggcaggttggaaggcaggcaccacggcaggttttccgcgatgatgtcacctagcagggcttcaggggttcccactaggatgcagagatgacctctcgctgcctcacaagcagtgacacctcgggtcctttccgttgctatggtgaaaattcctggatggaatggatcacatgagggtttcttgttgcttttggagggtgtgggggatattttgttttggtttttctgcaggttccatgaaaacagcccttttccaagcccattgtttctgtcatggtttccatctgtcctgagcaagtcattcctttgttatttagcatttcgaacatctcggccattcaaagcccccatgttctctgcactgtttggccagcataacctctagcatcgattcaaagcagagttttaacctgacggcatggaatgtataaatgagggtgggtccttctgcagatactctaatcactacattgctttttctataaaactacccataagcctttaaccttt

SEQ ID NO: 11687 - DNA, 1826 bp, Homo sapiens
aaagtacgagtcggctcagcctggagggacccaaccagagcctggcctgggagccaggatggccatccacaaagccttggtgatgtgcctgggactgcctctcttcctgttcccagagcaaagctaccagggggacatgtaccccacccggggcgtgggctatgagaccatcctgaaagagcagaagggtcagagcatgttcgtggagaacaaggccttttccatggatgagccggttgcagctaagaggccggtgtcaccatacagcgggtacaatgggcagctgctgaccagtgtgtaccagcccactgagatggccctgatgcacaaagttccgtccgaaggagcttacgacatcatcctcccacgggccaccgccaacagccaggtgatgggcagtgccaactcgaccctgcgggctgaagacatgtactcggcccagagccaccaggcggccacaccgccgaaagacggcaagaactctcaggtaagcgaactgacccagagaggccaggccaacaccaaccaggttttcctaagactctgacgtccagcagcctctctccgtggcccaccctgggctcagtccccacaaagtaaaacgagatggtagaagccctcttcccgggactgcacggcatcctgatcctcattcctctgtacccaggctggaccgggcccagcacctttcccatccttgtcattggagctgggaggggccggaggccaccaacctgaagcagtggaccgagtgggcccccgtgaagccctgagtgtgtgactggagcgcctagggccacctccctttcctgcccagcccatcttcctggtccccaggtggctgcagctacaaggagctgtccgcgggcccccaggctgcctccaactcccctcttgacacgcccccctccccccaaatcatagtccctgtgtccccaagctgtggttcagattgccttcttcccctctgtgaacaacaggcctcagtgccccgtcttgactctggaccttcctggccctgccatcttggtgtctggcactggcttgtcccaccctctgcctagatggatctcctccatgagtctttggagccaagccagggcagaagttggcccttgcccttctcaccagggcctcctgccaccacctggactgtggaaggccactgagatgggggcagagctcagcccgaggcttgggcacactgcttctctccacggcctgtgggtcctggatctgagcccttggggtgtttcactcaagagccactgagccgtccccatcttccacaaagcagtttccacaagcaagccagggccagccctgcctgcactctgcccgcagtgcccctcaacgtctgggatgaggatgagcctgctgagatgagggcagctctctccatccagcagtacctcatggagtgctcactaaggagttaggaatggcaggccacgctggcatctggggttcaaggtggctcctgtggcaggaacaggtgtccatgaccctgattacctggatctcacaggttctgggaatgcaataggggcctgctgtggctattccaacatctctggtcagggcctggaagtaccttaggacacatggggttggggtcaggactgcattctcagggaccagtggagagccctggaccagatgaactggagtctaggcctctctcgtgactgggacttgtgggacgtgggaggcctgtgagatccaggactaaagattatgctgtttcctaatgggcagatatgtaagtaggtaagtgggatcctcaggtaagcgggatccagaactaaagactgtgctatttcctg

SEQ ID NO: 11688 - DNA, 2502 bp, Homo sapiens
cccggagcgcagaggcccagggggtcgcgctaaacactgtacctcggggaacaaaaccgtgaaggctaattaggacaagtcggagcagggaacggggacgccgggaggggagagcgcgctccgagttgggcagaacctggaacggtcacaggaaacccgggcgcggggtagtcgggccgagggggacctttgcccacggtccagagtggtctggactcggcccacgcgtgagaggagcgcttggtgacgatcccacgtacgcttggtgactggtggaggtcccagagaaggaccgtgcgtgcaaaaggcgaacctcggtgtgcggtgtgtccacgtgtgcaagctggggaggggagggggcgcagaaggcgtgacaaagacggactctgtcttgagtgtgcgcctcgctccggcccgctcccagcgaactgtgcctgaagtgtgtctcacgggagggccaggacgaaggtgacaaaggctaggtgtcccccacggagacgcgccaaggtagccccgcgcgtgtccgtaggcgcgctctctggaagacgcggtggggggtgcgcagggctgcaccctcacaccaattgccccggcgaaggccgagcccagaaagtgagtgcgcgtgagtgtgcgcgcgcccgcatgcgggggcgtggcagtcaacagcaacaacccacacgccggcagggccagaaactcccatctccctcaccagccggaaagtacgagtcggctcagcctggagggacccaaccagagcctggcctgggagccaggatggccatccacaaagccttggtgatgtgcctgggactgcctctcttcctgttcccaggggcctgggcccagggccatgtcccacccggctgcagccaaggcctcaaccccctgtactacaacctgtgtgaccgctctggggcgtggggcatcgtcctggaggccgtggctggggcgggcattgtcaccacgtttgtgctcaccatcatcctggtggccagcctcccctttgtgcaggacaccaagaaacggagcctgctggggacccaggtattcttccttctggggaccctgggcctcttctgcctcgtgtttgcctgtgtggtgaagcccgacttctccacctgtgcctctcggcgcttcctctttggggttctgttcgccatctgcttctcttgtctggcggctcacgtctttgccctcaacttcctggcccggaagaaccacgggccccggggctgggtgatcttcactgtggctctgctgctgaccctggtagaggtcatcatcaatacagagtggctgatcatcaccctggttcggggcagtggcgagggcggccctcagggcaacagcagcgcaggctgggccgtggcctccccctgtgccatcgccaacatggactttgtcatggcactcatctacgtcatgctgctgctgctgggtgccttcctgggggcctggcccgccctgtgtggccgctacaagcgctggcgtaagcatggggtctttgtgctcctcaccacagccacctccgttgccatatgggtggtgtggatcgtcatgtatacttacggcaacaagcagcacaacagtcccacctgggatgaccccacgctggccatcgccctcgccgccaatgcctgggccttcgtcctcttctacgtcatccccgaggtctcccaggtgaccaagtccagcccagagcaaagctaccagggggacatgtaccccacccggggcgtgggctatgagaccatcctgaaagagcagaagggtcagagcatgttcgtggagaacaaggccttttccatggatgagccggttgcagctaagaggccggtgtcaccatacagcgggtacaatgggcagctgctgaccagtgtgtaccagcccactgagatggccctgatgcacaaagttccgtccgaaggagcttacgacatcatcctcccacgggccaccgccaacagccaggtgatgggcagtgccaactcgaccctgcgggctgaagacatgtactcggcccagagccaccaggcggccacaccgccgaaagacggcaagaactctcaggtctttagaaacccctacgtgtgggactgagtcagcggtggcgaggagaggcgggcggatttggggagggccctgaggacctggccccgggcaagggactctccaggctcctcctccccctggcaggcccagcaacatgtgccccagatctggaagggcctccctctctgccagtgtttgggtgggtgtcatgggtgtccccacccactcctcagtgtttgtggagtcgaggagccaaccccagcctcctgccaggatcacctcggcggtcacactccagccaaatagtgttctcggggtggtggctgggcagcgcctatgtttctctggagattcctgcaacctcaagagacttcccaggcgctcaggcctggatcttgctcctctgtgaggaacaagggtgcctaataaatacatttctgctttatt

SEQ ID NO: 11689 - DNA, 2988 bp, Homo sapiens
aaacactccgggccgcccgccccgccaccagctggctccgaccggcgcaccgctggcgatcccccaggcaattcggcgtcatgagaaccggcaccccgagactcggcgccctgccctccctccgcgtctccagggccctggccaggcccaacaacctctccctcctctgtgcgcctcagcccctacgggcctctggcgcgggctaactaggcctcgctgcgggcccccaggactgcgcaccccaccccccgcgaggccagcagccccgggggaaggcggccggaaaatctcttgtttatcgggctggataagtaccagcctggattcgcttcccaatttctgcggtccagcttcagcagattcctggggccggaggggaaagggtggcaacccacagatccaccccggaacagggagtggggggtggggctggtgggaacctgacctcctggaaaggacggactcggagtcagagccaacgtgtcccggagcgcagaggcccagggggtcgcgctaaacactgtacctcggggaacaaaaccgtgaaggctaattaggacaagtcggagcagggaacggggacgccgggaggggagagcgcgctccgagttgggcagaacctggaacggtcacaggaaacccgggcgcggggtagtcgggccgagggggacctttgcccacggtccagagtggtctggactcggcccacgcgtgagaggagcgcttggtgacgatcccacgtacgcttggtgactggtggaggtcccagagaaggaccgtgcgtgcaaaaggcgaacctcggtgtgcggtgtgtccacgtgtgcaagctggggaggggagggggcgcagaaggcgtgacaaagacggactctgtcttgagtgtgcgcctcgctccggcccgctcccagcgaactgtgcctgaagtgtgtctcacgggagggccaggacgaaggtgacaaaggctaggtgtcccccacggagacgcgccaaggtagccccgcgcgtgtccgtaggcgcgctctctggaagacgcggtggggggtgcgcagggctgcaccctcacaccaattgccccggcgaaggccgagcccagaaagtgagtgcgcgtgagtgtgcgcgcgcccgcatgcgggggcgtggcagtcaacagcaacaacccacacgccggcagggccagaaactcccatctccctcaccagccggaaagtacgagtcggctcagcctggagggacccaaccagagcctggcctgggagccaggatggccatccacaaagccttggtgatgtgcctgggactgcctctcttcctgttcccaggggcctgggcccagggccatgtcccacccggctgcagccaaggcctcaaccccctgtactacaacctgtgtgaccgctctggggcgtggggcatcgtcctggaggccgtggctggggcgggcattgtcaccacgtttgtgctcaccatcatcctggtggccagcctcccctttgtgcaggacaccaagaaacggagcctgctggggacccaggtattcttccttctggggaccctgggcctcttctgcctcgtgtttgcctgtgtggtgaagcccgacttctccacctgtgcctctcggcgcttcctctttggggttctgttcgccatctgcttctcttgtctggcggctcacgtctttgccctcaacttcctggcccggaagaaccacgggccccggggctgggtgatcttcactgtggctctgctgctgaccctggtagaggtcatcatcaatacagagtggctgatcatcaccctggttcggggcagtggcgagggcggccctcagggcaacagcagcgcaggctgggccgtggcctccccctgtgccatcgccaacatggactttgtcatggcactcatctacgtcatgctgctgctgctgggtgccttcctgggggcctggcccgccctgtgtggccgctacaagcgctggcgtaagcatggggtctttgtgctcctcaccacagccacctccgttgccatatgggtggtgtggatcgtcatgtatacttacggcaacaagcagcacaacagtcccacctgggatgaccccacgctggccatcgccctcgccgccaatgcctgggccttcgtcctcttctacgtcatccccgaggtctcccaggtgaccaagtccagcccagagcaaagctaccagggggacatgtaccccacccggggcgtgggctatgagaccatcctgaaagagcagaagggtcagagcatgttcgtggagaacaaggccttttccatggatgagccggttgcagctaagaggccggtgtcaccatacagcgggtacaatgggcagctgctgaccagtgtgtaccagcccactgagatggccctgatgcacaaagttccgtccgaaggagcttacgacatcatcctcccacgggccaccgccaacagccaggtgatgggcagtgccaactcgaccctgcgggctgaagacatgtactcggcccagagccaccaggcggccacaccgccgaaagacggcaagaactctcaggtctttagaaacccctacgtgtgggactgagtcagcggtggcgaggagaggcgggcggatttggggagggccctgaggacctggccccgggcaagggactctccaggctcctcctccccctggcaggcccagcaacatgtgccccagatctggaagggcctccctctctgccagtgtttgggtgggtgtcatgggtgtccccacccactcctcagtgtttgtggagtcgaggagccaaccccagcctcctgccaggatcacctcggcggtcacactccagccaaatagtgttctcggggtggtggctgggcagcgcctatgtttctctggagattcctgcaacctcaagagacttcccaggcgctcaggcctggatcttgctcctctgtgaggaacaagggtgcctaataaatacatttctgctttattaa

SEQ ID NO: 11690 - DNA, 2574 bp, Homo sapiens
ggacccaaccagagcctggcctgggagccaggatggccatccacaaagccttggtgatgtgcctgggactgcctctcttcctgttcccaggggcctgggcccagggccatgtcccacccggctgcagccaaggcctcaaccccctgtactacaacctgtgtgaccgctctggggcgtggggcatcgtcctggaggccgtggctggggcgggcattgtcaccacgtttgtgctcaccatcatcctggtggccagcctcccctttgtgcaggacaccaagaaacggagcctgctggggacccaggtattcttccttctggggaccctgggcctcttctgcctcgtgtttgcctgtgtggtgaagcccgacttctccacctgtgcctctcggcgcttcctctttggggttctgttcgccatctgcttctcttgtctggcggctcacgtctttgccctcaacttcctggcccggaagaaccacgggccccggggctgggtgatcttcactgtggctctgctgctgaccctggtagaggtcatcatcaatacagagtggctgatcatcaccctggttcggggcagtggcgagggcggccctcagggcaacagcagcgcaggctgggccgtggcctccccctgtgccatcgccaacatggactttgtcatggcactcatctacgtcatgctgctgctgctgggtgccttcctgggggcctggcccgccctgtgtggccgctacaagcgctggcgtaagcatggggtctttgtgctcctcaccacagccacctccgttgccatatgggtggtgtggatcgtcatgtatacttacggcaacaagcagcacaacagtcccacctgggatgaccccacgctggccatcgccctcgccgccaatgcctgggccttcgtcctcttctacgtcatccccgaggtctcccaggtgaccaagtccagcccagagcaaagctaccagggggacatgtaccccacccggggcgtgggctatgagaccatcctgaaagagcagaagggtcagagcatgttcgtggagaacaaggccttttccatggatgagccggttgcagctaagaggccggtgtcaccatacagcgggtacaatgggcagctgctgaccagtgtgtaccagcccactgagatggccctgatgcacaaagttccgtccgaaggagcttacgacatcatcctcccacgggccaccgccaacagccaggtgatgggcagtgccaactcgaccctgcgggctgaagacatgtactcggcccagagccaccaggcggccacaccgccgaaagacggcaagaactctcaggctcagtccccacaaagtaaaacgagatggtagaagccctcttcccgggactgcacggcatcctgatcctcattcctctgtacccaggctggaccgggcccagcacctttcccatccttgtcattggagctgggaggggccggaggccaccaacctgaagcagtggaccgagtgggcccccgtgaagccctgagtgtgtgactggagcgcctagggccacctccctttcctgcccagcccatcttcctggtccccaggtggctgcagctacaaggagctgtccgcgggcccccaggctgcctccaactcccctcttgacacgcccccctccccccaaatcatagtccctgtgtccccaagctgtggttcagattgccttcttcccctctgtgaacaacaggcctcagtgccccgtcttgactctggaccttcctggccctgccatcttggtgtctggcactggcttgtcccaccctctgcctagatggatctcctccatgagtctttggagccaagccagggcagaagttggcccttgcccttctcaccagggcctcctgccaccacctggactgtggaaggccactgagatgggggcagagctcagcccgaggcttgggcacactgcttctctccacggcctgtgggtcctggatctgagcccttggggtgtttcactcaagagccactgagccgtccccatcttccacaaagcagtttccacaagcaagccagggccagccctgcctgcactctgcccgcagtgcccctcaacgtctgggatgaggatgagcctgctgagatgagggcagctctctccatccagcagtacctcatggagtgctcactaaggagttaggaatggcaggccacgctggcatctggggttcaaggtggctcctgtggcaggaacaggtgtccatgaccctgattacctggatctcacaggttctgggaatgcaataggggcctgctgtggctattccaacatctctggtcagggcctggaagtaccttaggacacatggggttggggtcaggactgcattctcagggaccagtggagagccctggaccagatgaactggagtctaggcctctctcgtgactgggacttgtgggacgtgggaggcctgtgagatccaggactaaagattatgctgtttcctaatgggcagatatgtaagtaggtaagtgggatcctcaggtaagcgggatccagaactaaagactgtgctatttcctg

SEQ ID NO: 11691 - DNA, 1419 bp, Homo sapiens
ggggaacctccctgaagagtgccctggtcacagcacccttgaagacagccattggccatggggacccaaccagagcctggcctgggagccaggatggccatccacaaagccttggtgatgtgcctgggactgcctctcttcctgttcccaggggcctgggcccagggccatgtcccacccggctgcagccaaggcctcaaccccctgtactacaacctgtgtgaccgctctggggcgtggggcatcgtcctggaggccgtggctggggcgggcattgtcaccacgtttgtgctcaccatcatcctggtggccagcctcccctttgtgcaggacaccaagaaacggagcctgctggggacccaggtattcttccttctggggaccctgggcctcttctgcctcgtgtttgcctgtgtggtgaagcccgacttctccacctgtgcctctcggcgcttcctctttggggttctgttcgccatctgcttctcttgtctggcggctcacgtctttgccctcaacttcctggcccggaagaaccacgggccccggggctgggtgatcttcactgtggctctgctgctgaccctggtagaggtcatcatcaatacagagtggctgatcatcaccctggttcggggcagtggcgagggcggccctcagggcaacagcagcgcaggctgggccgtggcctccccctgtgccatcgccaacatggactttgtcatggcactcatctacgtcatgctgctgctgctgggtgccttcctgggggcctggcccgccctgtgtggccgctacaagcgctggcgtaagcatggggtctttgtgctcctcaccacagccacctccgttgccatatgggtggtgtggatcgtcatgtatacttacggcaacaagcagcacaacagtcccacctgggatgaccccacgctggccatcgccctcgccgccaatgcctgggccttcgtcctcttctacgtcatccccgaggtctcccaggtgaccaagtccagcccagagcaaagctaccagggggacatgtaccccacccggggcgtgggctatgagaccatcctgaaagagcagaagggtcagagcatgttcgtggagaacaaggccttttccatggatgagccggttgcagctaagaggccggtgtcaccatacagcgggtacaatgggcagctgctgaccagtgtgtaccagcccactgagatggccctgatgcacaaagttccgtccgaaggagcttacgacatcatcctcccacgggccaccgccaacagccaggtgatgggcagtgccaactcgaccctgcgggctgaagacatgtactcggcccagagccaccaggcggccacaccgccgaaagacggcaagaactctcaggtctttagaaacccctacgtgtgggactga

SEQ ID NO: 11692 - DNA, 1038 bp, Homo sapiens
atgtacaaggactgcatcgagtccactggagactattttcttctctgtgacgccgaggggccatggggcatcattctggagtccctggccatacttggcatcgtggtcacaattctgctactcttagcatttctcttcctcatgcgaaagatccaagactgcagccagtggaatgtcctccccacccagctcctcttcctcctgagtgtcctggggctcttcggactcgcttttgccttcatcatcgagctcaatcaacaaactgcccccgtacgctactttctctttggggttctctttgctctctgtttctcatgcctcttagctcatgcctccaatctagtgaagctggttcggggttgtgtctccttctcctggacgacaattctgtgcattgctattggttgcagtctgttgcaaatcattattgccactgagtatgtgactctcatcatgaccagaggtatgatgtttgtgaatatgacaccctgccagctcaatgtggactttgttgtactcctggtctatgtcctcttcctgatggccctcacattcttcgtctccaaagccaccttctgtggcccgtgtgagaactggaagcagcatggaaggctcatctttatcactgtgctcttctccatcatcatctgggtggtgtggatctccatgctcctgagaggcaacccgcagttccagcgacagccccagtgggacgacccggtcgtctgcattgctctggtcaccaacgcatgggttttcctgctgctgtacatcgtccctgagctctgcattctctacagatcgtgtagacaggagtgccctttacaaggcaatgcctgccccgtcacagcctaccaacacagcttccaagtggagaaccaggagctctccagagcccgagacagtgatggagctgaggaggatgtagcattaacttcatatggtactcccattcagccgcagactgttgatcccacacaagagtgtttcatcccacaggctaaactaagcccccagcaagatgcaggaggagtataa

SEQ ID NO: 11693 - DNA, 903 bp, Homo sapiens
atgtacaaggactgcatcgagtccactggagactattttcttctctgtgacgccgaggggccatggggcatcattctggagtccctggccatacttggcatcgtggtcacaattctgctactcttagcatttctcttcctcatgcgaaagatccaagactgcagccagtggaatgtcctccccacccagctcctcttcctcctgagtgtcctggggctcttcggactcgcttttgccttcatcatcgagctcaatcaacaaactgcccccgtacgctactttctctttggggttctctttgctctctgtttctcatgcctcttagctcatgcctccaatctagtgaagctggttcggggttgtgtctccttctcctggacgacaattctgtgcattgctattggttgcagtctgttgcaaatcattattgccactgagtatgtgactctcatcatgaccagaggtatgatgtttgtgaatatgacaccctgccagctcaatgtggactttgttgtactcctggtctatgtcctcttcctgatggccctcacattcttcgtctccaaagccaccttctgtggcccgtgtgagaactggaagcagcatggaaggctcatctttatcactgtgctcttctccatcatcatctgggtggtgtggatctccatgctcctgagaggcaacccgcagttccagcgacagccccagtgggacgacccggtcgtctgcattgctctggtcaccaacgcatgggttttcctgctgctgtacatcgtccctgagctctgcattctctacagatcgtgtagacaggagtgccctttacaaggcaatgcctgccccgtcacagcctaccaacacagcttccaagtggagaaccaggagctctccagagactgttga

SEQ ID NO: 11694 - DNA, 448 bp, Homo sapiens
ccagcactacagcctaagcttccagagtggacacggagaagggcatcagaaaaccattctggtgaggtccacacccataagtcaccatgtacaaggactgcatcgagtccactggagactattttcttctctgtgacgccgaggggccatggggcatcattctggagtccctggccatacttggcatcgtggtcacaattctgctactcttagcatttctcttcctcatgcgaaagatccaagactgcagccagtggaatgtcctccccacccagctcctcttcctcctgagtgtcctggggctcttcggactcgcttttgccttcatcatcgagctcaatcaacaaactgcccccgtacgctactttctctttggggttctctttgctctctgtttctcatgcctcttagctcatgcctccaatctagtgaagctggttcggggttg

SEQ ID NO: 11695 - DNA, 866 bp, Homo sapiens
gcggagtctccaactgggagagctgcagctgccgagaggaggagaacgctgaggtcggtcggaccaacggacgcgctgaccgctgccaactgcagctcgcgctgcctcctgctcgcgccgtgccactaaggtcattcccgcctccgagagcccagagccgagatggaaacggtccaggagctgatccccctggccaaggagatgatggcccagaagcgcaaggggaagatggtgaagctgtacgtgctgggcagcgtgctggccctcttcggcgtggtgctcggcctgatggagactgtgtgcagccccttcacggccgccagacgtctgcgggaccaggaggcagccgtggcggagctgcaggccgccctggagcgacaggctctccagaagcaagccctgcaggagaaaggcaagcagcaggacacggtcctcggcggccgggccctgtccaaccggcagcacgcctcctaggaactgtgggagaccagcggagtgggagggagacgcagtagacagagacagaccgagagaggaatggagagacagagggggcgcgcgcacaggagcctgactccgctgggagagtgcaggagcacgtgctgttttttatttggacttaacttcagagaaaccgctgacatctagaactgacctaccacaagcatccaccaaaggagtttgggattgagttttgctgctgtgcagcactgcattgtcatgacatttccaacactgtgtgaattatctaaatgcgtctaccattttgcactagggaggaaggataaatgctttttatgttattattattaattattacaatgaccaccattttgcattttgaaataaaaaaactttttatacca

SEQ ID NO: 11696 - DNA, 7172 bp, Homo sapiens
tatgagccacactgcagttttaagccggaatatctcacggttttattgtttcttccacgaaatgattacataaaatgaaatcagctttgcaatctgcaccggctttgaaatgaagggcaaaatctggctgggggtgaggagaaagaaggtggagagagaataaggtacggagactgtgaggcagagaacgcaggaaaggtggtgaaaagagagtacaagaattttcgggagctgagtgtatttttcttccccatgttatagatgctgtccgttttcccccagcctgtgtccagcaggccagagtggacccctcctatgggctaaaatactctcggtcttcggcccagcacagagctgcaccaaccagggcctgccgctgcccccccaccaggtgacaggtggggccgccgagcggccaccagacctccgcctcctcgcgttgcctgccgggagccggagccgcttccggttgcgccctgtccctgaacttcgactcccgtcggcccccgggaaaaccgcagcggggtagcgcgggcgctgccggaacttgtagttccacctcccgccgcgctaaatagccggaaacgggggcggccagaacagagaactaccgaggcgaagcacctgtggaatcctctcaagaggaacagtcattgtgtgaaggttcaaattcagctgttagcatggaactttcagaacctattgtagaaaatggagagacagaaatgtctccagaagaatcatgggagcacaaagaagaaataagtgaagcagagccagggggtggttccttgggagatggaaggccgccagaggaaagtgcccatgaaatgatggaggaggaagaggaaatcccaaaacctaagtctgtggttgcaccgccaggtgctcctaagaaagagcatgtaaatgtagtattcattgggcacgtagatgctggcaagtcaaccattggaggacaaataatgtatttgactggaatggttgacaaaaggacgcttgaaaagtatgaaagagaagctaaagagaaaaacagagaaacttggtacttgtcttgggccttagacacaaatcaggaagaacgagacaagggtaaaacagtagaagtgggtcgtgcctattttgaaaccgaaaagaagcatttcacaattctagatgcccctggccacaagagttttgtcccaaatatgattggtggtgcctctcaagctgatttggctgtgctggtaatctcagccaggaaaggagagtttgaaactggatttgaaaaaggaggacagacaagagaacatgcaatgttggcaaagacagcaggtgtaaaacacctaattgtgctaattaataagatggatgatccaacagtaaattggagcaatgagagatatgaagaatgtaaggagaaactagtgccatttttgaaaaaagttggcttcaatcccaaaaaggacattcactttatgccctgctcaggacttactggagcaaatctcaaagagcagtcggatttctgtccttggtacattggattaccgtttattccatatctggataatttgccgaacttcaatagatcagttgatggaccaatcaggctgccaattgtggataagtacaaggatatgggcactgtggtcctgggaaagctggaatcaggatctatttgtaaaggccagcagcttgtgatgatgccaaacaagcacaacgtggaagttcttggaatactttccgatgatgtagagactgataccgtagccccaggtgaaaacctcaaaatcagactgaaaggaattgaagaagaggagattcttccagggtttatactttgtgatcctaataatctttgtcattctggacgcacatttgatgcccagatagtgattatagagcacaaatccatcatctgcccaggctataatgcggtgctgcatattcatacctgtattgaggaggtggaaataacagccttaatctgcttggtagacaaaaaatcaggagaaaaaagtaagacccgaccccgttttgtcaaacaagatcaagtatgcattgctcgcttaaggacagcaggaaccatctgccttgagacctttaaagacttccctcagatgggtcgtttcaccttaagagatgagggtaagaccattgcaattggaaaagttctgaaactggttccagagaaagactaagcattttcttgatgaccctgcacaatactgtgaggaaaattgactgcagaagcctacttcacaccgccttctcttattttctgcccattgataaacctctccccatattttgcaaagaggaaattcacagcaaaagtccacattatgtcagctttctcatattgagagctctgctatgccactgttgaatttttcccaagattcctgtccctagccctcacttcaaactctgcttccttggacagatttggcaatagctttgtaagtgatgtggacataattgcctacaataatgaaaacctacaggaatttttttatttttcattttccccttaggcatatttagtatttttcccccaggcagatcattctgagtgtgcgagtgtgtgtgcacatgttacaaaggcaactaccatgttaataaaatattcaatttgaaatccttttcggtatttgaattgcttttgaataatgttttttatctggatgtaacattgttgcattagctttttaactttcccaagtaattgaatacattttattacttggacttttataaactctttccctacccactataaatgagacattcacagcgttcaagtttgtattaaaggaaaggattagtttgaccccttcttttgatggttaatgcatacatgcagttaaatccctttatgcaaatgtgacactgctttactaggtcttttagttatttatttattttttttttttttgccaatttatattgtaacatgatttcttgaacacagtaagttgttttaaaataaaagaacagcatactgtagtttttataagtaaagcgtaatgaaattgtacccctagagaaaattccattaacttgttaaattagtggaattaacaacaaataaagcatgtttgagacctggcaaaaattcctctggtagtatttataaatagagctgcatgcctctagtatgaaaaccgtatcagttgcaagtgccacttctacaagttactcagtttactctttgtatcagtaactttaaaggttggatgatccttgctggttaaagctaaatctcaacctagcaactaaatgaaaatatttagaatcatcagaatctgaacagactaaaattatcagcgataagcagaatcaagcagggtataagttttatctcaattatttgaaattgactgagttttcttaagtgtaaagctgaaatttgctaaccatgtttttgatgaaccacagtgcagcattgtgtgggttttagattgaatgactctctgctataattatcatgactttgaaatttttcatgagaataaatgaggaatggaggcaatttgtgggtttatccaaagcccccttgatgttgagtgttgccattgatcaaagatagcctcttttagattgtgatttctctctaaataagatactttgtatatttaatgacaagtctcttccctataattttgctcctcagaaaagaaaagcctagacagactgtatttccagtcacagaacataaaacttaatctaatgggtgttttgttttgttttgagacagaggctcactctgtcacctaggctggagtgcagtggctcgatctcagctcactgcagcctccacctcccggattcaagcaatttcctgcctcagcctcttgagtagctgggattacaggagccctccacgaggcccagttaatttttgtatctttagtggagacgaggtttccccctattggtcaggctggtctcaaacttctgacctcaagtgatccactcgcctcagcctctcaaaagtgctgggattacaggcatgaggcgccgcacttggcctagtgttttcttaactgtgaaattcccattcatttcttgaatgaggctacatcttatggacagagcaaagttattgtcctacagattcttaaaactataattatggctattgcatgaaatttaaatagattttattatgtctgcaaatctctgggcttttatttttctggaaaatataggagctttaatcaaaacataatagttctttttgtaattccatgttaataaaaacaaatactagcaattgcttgaattttaatgaatatttaaaagttcaagagccacggaaatcacttccagagataagagttccctttctaaatagaacacatttttaaaaaataagttatgtttgctactaaaacatttacactgttagactattatgtgcatgttgccaagactcttaagtaacttggatatcaactgtgaagggcctacctctaaaaagtaacaggtcatacaaatacaaatgtaactgtaaaaattccactggattcttgcatatttgcaagattagattattcaaaagaaatttcagtgctaaaattaaccagcaacataagttctatgggctttgaaaattgttctcatctttttaaagttgatgcattttcaatcctgcttacacaggctgttcatttggataagtaaataaaatgtctaaggtgaacttggcattatgtggagatgttggaccgttatagagcaatacaaattcctatgctgtcattctgttttctgcaaatgcaaacgtgcttatatggtcaacagtgcaaaaatagggtagttggctgcatatttagggtattacctaagcatttgttctctaacgttgctctactagaatgatttttttcttgcatcttttcacattaatgatgttctttatataactttcatgcgattatttagttttttaaattaataaagtgaatttaagaaatattgaaataaacatctaagtaattgccattttaaacccttgtttcttactgtgggagagggggaaatacagcactcatttcttgtttttaatttgcagaagtaagtgaaaatctatgtaaaatcaaaccaaaagagttggactgagtgtgtattgtcttgagattaagtgacaaatagtaaagtgttactgagtaattaagcccatgtattttttttttgtgagttgaaaatctttgaaatatgtgataaccgaatgtcaaaagttcctaaactctaacagtgcaggttgttcactgtaacgaggtaactcatatttgctggttacataaactacaagtactgctctcacaatatgggactttgaactgtgatgtagttcaacagttgccggcatcctctcagctgatacgctgcgaatattttgggttagacttgcagccagatgcagttttgcaacccaagaaaaaagttgaacctatgatcaaaaactgctcccaagatgaacctggaaaaaaatcagctaagctcccttggcgatctgcaggaacactagtaatgactggaattactccgtgatctttgatgactattacacataacagcactctagcaccttttcttactggcatggacttcctcatggactgctacttcatggatgatagcttcattgctttgggtagggatttaaggtagtcaaggggaaaatacgcagttttattacaggtcttaacatcaggcaactttcaactttaaaaccctttgtgaaaaatgtggttatagcactatagctctgattttaggatggttaaatgttatattcattgttggcttaccttatcaaactgtgccattaatcctttcacagacataggtaaggaagagaacaaccagtggattcaggggacaattatctatctccaaataataggcttttatttcttgcagctaactttttcagtgattctagcagatgccatctagtacatccttgatcttgtttctttcgtgagagatctcgccatggcagcatcttgttaagtaagtgtaattgcacatgcacaaaagacttaactagctttacatttagcagtcagttggttagattaggtttcatagtaaatgaataggaatagaaagaataggaagtgtttttattttccagtagtaattccgtggattccatttgacccagtttactatcagttcagttcaggtagatttggttcaacttttggtggtttttggctctaggatattcttgactttaatatcctagaacttactgagtcttcccttcaataaatacacttctcacatacctctaatcctatgcttccttgaaacaataatgctagctgagttgtttactaaggattattataagggcctgaaggtgtgggagtggagattaattaaaacctttatgttctccaatataagggaaaagcaggttggtactacttctgattaggcagaaaacaccaggattccttaagtgatccttgaaatggttattgttttctgccttgtcacatttgccactgtgccctttaaaacgatgtggaaacctcaggtttgtggacagcacaggtggaatgacatcttgtgcttcctgaggctcccctctaccaggcacattagcttagtgcttcagatgtcagcccaagtccttgttacctccttttcctgctgcccagggaagagtgtgtgtgctggagctggagcgcttgcactcttcaggtgactattctcacctccatttcctccacatgcattaggtgaaactgaggtctaagcctcctgcaaggtctacattttaaggactcacacatcaggctctcagaaatgtacacaggtattagttctgtttgttctaaaggaaatgtgggtatctctcaggccaggacttagtgactagttttcgctagacagcaggttaatacctagatctcatttaaaaaaaaaaaaaaaaaacaggattaaagggaactgatcaggtttgttgagttttttagcctaattccaaagcatggaagagtgctctaggtaggaaagaaagctttttcttacgatttgtagctacctactgtgcctgacttggtgcctgtgtgaggattaagcccttagtctgctcttgcaattattcaaatgacaaattaaatttgcttttgtaataacaataaaagttgtcatcttcccttttg

SEQ ID NO: 11697 - DNA, 7151 bp, Homo sapiens
gggaggagatccgctcacacacacgaggaggagggttgagctgccgccgccgccgcctctgtcgtcgtcgcgagtgtggagtcgggactggagctgctgccgcggcgacgccggggatctttgtcgctagctcccggcccttctgccccgccgccttccctcagtcagcgttgcccactcctctccggccgggcgcccctgcctccatttcccgctctctgtccaccacacacacggcccccccgatcatggatccgggcagtggcggcggcggcggcggcggcggcggcggcgggagcagcagcggcagcagcagcagcgactcggcgcctgactgctgggaccaggcggacatggaagcccccgggccgggcccttgcggcggcggcggctccctggcggcggcggccgaggcccagcgggagaacctcagcgcggccttcagccggcaactcaacgtcaacgccaagcccttcgtgcccaacgtccacgccgccgagttcgtgccgtccttcctgcggggcccggcagcgccgccacccccagttggcggcgccgccaataaccacggagccggcagcggcgcgggaggccgtgcggcacctgtggaatcctctcaagaggaacagtcattgtgtgaaggttcaaattcagctgttagcatggaactttcagaacctattgtagaaaatggagagacagaaatgtctccagaagaatcatgggagcacaaagaagaaataagtgaagcagagccagggggtggttccttgggagatggaaggccgccagaggaaagtgcccatgaaatgatggaggaggaagaggaaatcccaaaacctaagtctgtggttgcaccgccaggtgctcctaagaaagagcatgtaaatgtagtattcattgggcacgtagatgctggcaagtcaaccattggaggacaaataatgtatttgactggaatggttgacaaaaggacgcttgaaaagtatgaaagagaagctaaagagaaaaacagagaaacttggtacttgtcttgggccttagacacaaatcaggaagaacgagacaagggtaaaacagtagaagtgggtcgtgcctattttgaaaccgaaaagaagcatttcacaattctagatgcccctggccacaagagttttgtcccaaatatgattggtggtgcctctcaagctgatttggctgtgctggtaatctcagccaggaaaggagagtttgaaactggatttgaaaaaggaggacagacaagagaacatgcaatgttggcaaagacagcaggtgtaaaacacctaattgtgctaattaataagatggatgatccaacagtaaattggagcaatgagagatatgaagaatgtaaggagaaactagtgccatttttgaaaaaagttggcttcaatcccaaaaaggacattcactttatgccctgctcaggacttactggagcaaatctcaaagagcagtcggatttctgtccttggtacattggattaccgtttattccatatctggataatttgccgaacttcaatagatcagttgatggaccaatcaggctgccaattgtggataagtacaaggatatgggcactgtggtcctgggaaagctggaatcaggatctatttgtaaaggccagcagcttgtgatgatgccaaacaagcacaacgtggaagttcttggaatactttccgatgatgtagagactgataccgtagccccaggtgaaaacctcaaaatcagactgaaaggaattgaagaagaggagattcttccagggtttatactttgtgatcctaataatctttgtcattctggacgcacatttgatgcccagatagtgattatagagcacaaatccatcatctgcccaggctataatgcggtgctgcatattcatacctgtattgaggaggtggaaataacagccttaatctgcttggtagacaaaaaatcaggagaaaaaagtaagacccgaccccgttttgtcaaacaagatcaagtatgcattgctcgcttaaggacagcaggaaccatctgccttgagacctttaaagacttccctcagatgggtcgtttcaccttaagagatgagggtaagaccattgcaattggaaaagttctgaaactggttccagagaaagactaagcattttcttgatgaccctgcacaatactgtgaggaaaattgactgcagaagcctacttcacaccgccttctcttattttctgcccattgataaacctctccccatattttgcaaagaggaaattcacagcaaaagtccacattatgtcagctttctcatattgagagctctgctatgccactgttgaatttttcccaagattcctgtccctagccctcacttcaaactctgcttccttggacagatttggcaatagctttgtaagtgatgtggacataattgcctacaataatgaaaacctacaggaatttttttatttttcattttccccttaggcatatttagtatttttcccccaggcagatcattctgagtgtgcgagtgtgtgtgcacatgttacaaaggcaactaccatgttaataaaatattcaatttgaaatccttttcggtatttgaattgcttttgaataatgttttttatctggatgtaacattgttgcattagctttttaactttcccaagtaattgaatacattttattacttggacttttataaactctttccctacccactataaatgagacattcacagcgttcaagtttgtattaaaggaaaggattagtttgaccccttcttttgatggttaatgcatacatgcagttaaatccctttatgcaaatgtgacactgctttactaggtcttttagttatttatttattttttttttttttgccaatttatattgtaacatgatttcttgaacacagtaagttgttttaaaataaaagaacagcatactgtagtttttataagtaaagcgtaatgaaattgtacccctagagaaaattccattaacttgttaaattagtggaattaacaacaaataaagcatgtttgagacctggcaaaaattcctctggtagtatttataaatagagctgcatgcctctagtatgaaaaccgtatcagttgcaagtgccacttctacaagttactcagtttactctttgtatcagtaactttaaaggttggatgatccttgctggttaaagctaaatctcaacctagcaactaaatgaaaatatttagaatcatcagaatctgaacagactaaaattatcagcgataagcagaatcaagcagggtataagttttatctcaattatttgaaattgactgagttttcttaagtgtaaagctgaaatttgctaaccatgtttttgatgaaccacagtgcagcattgtgtgggttttagattgaatgactctctgctataattatcatgactttgaaatttttcatgagaataaatgaggaatggaggcaatttgtgggtttatccaaagcccccttgatgttgagtgttgccattgatcaaagatagcctcttttagattgtgatttctctctaaataagatactttgtatatttaatgacaagtctcttccctataattttgctcctcagaaaagaaaagcctagacagactgtatttccagtcacagaacataaaacttaatctaatgggtgttttgttttgttttgagacagaggctcactctgtcacctaggctggagtgcagtggctcgatctcagctcactgcagcctccacctcccggattcaagcaatttcctgcctcagcctcttgagtagctgggattacaggagccctccacgaggcccagttaatttttgtatctttagtggagacgaggtttccccctattggtcaggctggtctcaaacttctgacctcaagtgatccactcgcctcagcctctcaaaagtgctgggattacaggcatgaggcgccgcacttggcctagtgttttcttaactgtgaaattcccattcatttcttgaatgaggctacatcttatggacagagcaaagttattgtcctacagattcttaaaactataattatggctattgcatgaaatttaaatagattttattatgtctgcaaatctctgggcttttatttttctggaaaatataggagctttaatcaaaacataatagttctttttgtaattccatgttaataaaaacaaatactagcaattgcttgaattttaatgaatatttaaaagttcaagagccacggaaatcacttccagagataagagttccctttctaaatagaacacatttttaaaaaataagttatgtttgctactaaaacatttacactgttagactattatgtgcatgttgccaagactcttaagtaacttggatatcaactgtgaagggcctacctctaaaaagtaacaggtcatacaaatacaaatgtaactgtaaaaattccactggattcttgcatatttgcaagattagattattcaaaagaaatttcagtgctaaaattaaccagcaacataagttctatgggctttgaaaattgttctcatctttttaaagttgatgcattttcaatcctgcttacacaggctgttcatttggataagtaaataaaatgtctaaggtgaacttggcattatgtggagatgttggaccgttatagagcaatacaaattcctatgctgtcattctgttttctgcaaatgcaaacgtgcttatatggtcaacagtgcaaaaatagggtagttggctgcatatttagggtattacctaagcatttgttctctaacgttgctctactagaatgatttttttcttgcatcttttcacattaatgatgttctttatataactttcatgcgattatttagttttttaaattaataaagtgaatttaagaaatattgaaataaacatctaagtaattgccattttaaacccttgtttcttactgtgggagagggggaaatacagcactcatttcttgtttttaatttgcagaagtaagtgaaaatctatgtaaaatcaaaccaaaagagttggactgagtgtgtattgtcttgagattaagtgacaaatagtaaagtgttactgagtaattaagcccatgtattttttttttgtgagttgaaaatctttgaaatatgtgataaccgaatgtcaaaagttcctaaactctaacagtgcaggttgttcactgtaacgaggtaactcatatttgctggttacataaactacaagtactgctctcacaatatgggactttgaactgtgatgtagttcaacagttgccggcatcctctcagctgatacgctgcgaatattttgggttagacttgcagccagatgcagttttgcaacccaagaaaaaagttgaacctatgatcaaaaactgctcccaagatgaacctggaaaaaaatcagctaagctcccttggcgatctgcaggaacactagtaatgactggaattactccgtgatctttgatgactattacacataacagcactctagcaccttttcttactggcatggacttcctcatggactgctacttcatggatgatagcttcattgctttgggtagggatttaaggtagtcaaggggaaaatacgcagttttattacaggtcttaacatcaggcaactttcaactttaaaaccctttgtgaaaaatgtggttatagcactatagctctgattttaggatggttaaatgttatattcattgttggcttaccttatcaaactgtgccattaatcctttcacagacataggtaaggaagagaacaaccagtggattcaggggacaattatctatctccaaataataggcttttatttcttgcagctaactttttcagtgattctagcagatgccatctagtacatccttgatcttgtttctttcgtgagagatctcgccatggcagcatcttgttaagtaagtgtaattgcacatgcacaaaagacttaactagctttacatttagcagtcagttggttagattaggtttcatagtaaatgaataggaatagaaagaataggaagtgtttttattttccagtagtaattccgtggattccatttgacccagtttactatcagttcagttcaggtagatttggttcaacttttggtggtttttggctctaggatattcttgactttaatatcctagaacttactgagtcttcccttcaataaatacacttctcacatacctctaatcctatgcttccttgaaacaataatgctagctgagttgtttactaaggattattataagggcctgaaggtgtgggagtggagattaattaaaacctttatgttctccaatataagggaaaagcaggttggtactacttctgattaggcagaaaacaccaggattccttaagtgatccttgaaatggttattgttttctgccttgtcacatttgccactgtgccctttaaaacgatgtggaaacctcaggtttgtggacagcacaggtggaatgacatcttgtgcttcctgaggctcccctctaccaggcacattagcttagtgcttcagatgtcagcccaagtccttgttacctccttttcctgctgcccagggaagagtgtgtgtgctggagctggagcgcttgcactcttcaggtgactattctcacctccatttcctccacatgcattaggtgaaactgaggtctaagcctcctgcaaggtctacattttaaggactcacacatcaggctctcagaaatgtacacaggtattagttctgtttgttctaaaggaaatgtgggtatctctcaggccaggacttagtgactagttttcgctagacagcaggttaatacctagatctcatttaaaaaaaaaaaaaaaaaacaggattaaagggaactgatcaggtttgttgagttttttagcctaattccaaagcatggaagagtgctctaggtaggaaagaaagctttttcttacgatttgtagctacctactgtgcctgacttggtgcctgtgtgaggattaagcccttagtctgctcttgcaattattcaaatgacaaattaaatttgcttttgtaataacaataaaagttgtcatcttcccttttg

SEQ ID NO: 11698 - DNA, 7148 bp, Homo sapiens
gggaggagatccgctcacacacacgaggaggagggttgagctgccgccgccgccgcctctgtcgtcgtcgcgagtgtggagtcgggactggagctgctgccgcggcgacgccggggatctttgtcgctagctcccggcccttctgccccgccgccttccctcagtcagcgttgcccactcctctccggccgggcgcccctgcctccatttcccgctctctgtccaccacacacacggcccccccgatcatggatccgggcagtggcggcggcggcggcggcggcggcggcggcgggagcagcagcggcagcagcagcagcgactcggcgcctgactgctgggaccaggcggacatggaagcccccgggccgggcccttgcggcggcggcggctccctggcggcggcggccgaggcccagcgggagaacctcagcgcggccttcagccggcaactcaacgtcaacgccaagcccttcgtgcccaacgtccacgccgccgagttcgtgccgtccttcctgcggggcccggcagcgccgccacccccagttggcggcgccgccaataaccacggagccggcagcggcgcgggaggccgtgcggcacctgtggaatcctctcaagaggaacagtcattgtgtgaaggttcaaattcagctgttagcatggaactttcagaacctattgaaaatggagagacagaaatgtctccagaagaatcatgggagcacaaagaagaaataagtgaagcagagccagggggtggttccttgggagatggaaggccgccagaggaaagtgcccatgaaatgatggaggaggaagaggaaatcccaaaacctaagtctgtggttgcaccgccaggtgctcctaagaaagagcatgtaaatgtagtattcattgggcacgtagatgctggcaagtcaaccattggaggacaaataatgtatttgactggaatggttgacaaaaggacgcttgaaaagtatgaaagagaagctaaagagaaaaacagagaaacttggtacttgtcttgggccttagacacaaatcaggaagaacgagacaagggtaaaacagtagaagtgggtcgtgcctattttgaaaccgaaaagaagcatttcacaattctagatgcccctggccacaagagttttgtcccaaatatgattggtggtgcctctcaagctgatttggctgtgctggtaatctcagccaggaaaggagagtttgaaactggatttgaaaaaggaggacagacaagagaacatgcaatgttggcaaagacagcaggtgtaaaacacctaattgtgctaattaataagatggatgatccaacagtaaattggagcaatgagagatatgaagaatgtaaggagaaactagtgccatttttgaaaaaagttggcttcaatcccaaaaaggacattcactttatgccctgctcaggacttactggagcaaatctcaaagagcagtcggatttctgtccttggtacattggattaccgtttattccatatctggataatttgccgaacttcaatagatcagttgatggaccaatcaggctgccaattgtggataagtacaaggatatgggcactgtggtcctgggaaagctggaatcaggatctatttgtaaaggccagcagcttgtgatgatgccaaacaagcacaacgtggaagttcttggaatactttccgatgatgtagagactgataccgtagccccaggtgaaaacctcaaaatcagactgaaaggaattgaagaagaggagattcttccagggtttatactttgtgatcctaataatctttgtcattctggacgcacatttgatgcccagatagtgattatagagcacaaatccatcatctgcccaggctataatgcggtgctgcatattcatacctgtattgaggaggtggaaataacagccttaatctgcttggtagacaaaaaatcaggagaaaaaagtaagacccgaccccgttttgtcaaacaagatcaagtatgcattgctcgcttaaggacagcaggaaccatctgccttgagacctttaaagacttccctcagatgggtcgtttcaccttaagagatgagggtaagaccattgcaattggaaaagttctgaaactggttccagagaaagactaagcattttcttgatgaccctgcacaatactgtgaggaaaattgactgcagaagcctacttcacaccgccttctcttattttctgcccattgataaacctctccccatattttgcaaagaggaaattcacagcaaaagtccacattatgtcagctttctcatattgagagctctgctatgccactgttgaatttttcccaagattcctgtccctagccctcacttcaaactctgcttccttggacagatttggcaatagctttgtaagtgatgtggacataattgcctacaataatgaaaacctacaggaatttttttatttttcattttccccttaggcatatttagtatttttcccccaggcagatcattctgagtgtgcgagtgtgtgtgcacatgttacaaaggcaactaccatgttaataaaatattcaatttgaaatccttttcggtatttgaattgcttttgaataatgttttttatctggatgtaacattgttgcattagctttttaactttcccaagtaattgaatacattttattacttggacttttataaactctttccctacccactataaatgagacattcacagcgttcaagtttgtattaaaggaaaggattagtttgaccccttcttttgatggttaatgcatacatgcagttaaatccctttatgcaaatgtgacactgctttactaggtcttttagttatttatttattttttttttttttgccaatttatattgtaacatgatttcttgaacacagtaagttgttttaaaataaaagaacagcatactgtagtttttataagtaaagcgtaatgaaattgtacccctagagaaaattccattaacttgttaaattagtggaattaacaacaaataaagcatgtttgagacctggcaaaaattcctctggtagtatttataaatagagctgcatgcctctagtatgaaaaccgtatcagttgcaagtgccacttctacaagttactcagtttactctttgtatcagtaactttaaaggttggatgatccttgctggttaaagctaaatctcaacctagcaactaaatgaaaatatttagaatcatcagaatctgaacagactaaaattatcagcgataagcagaatcaagcagggtataagttttatctcaattatttgaaattgactgagttttcttaagtgtaaagctgaaatttgctaaccatgtttttgatgaaccacagtgcagcattgtgtgggttttagattgaatgactctctgctataattatcatgactttgaaatttttcatgagaataaatgaggaatggaggcaatttgtgggtttatccaaagcccccttgatgttgagtgttgccattgatcaaagatagcctcttttagattgtgatttctctctaaataagatactttgtatatttaatgacaagtctcttccctataattttgctcctcagaaaagaaaagcctagacagactgtatttccagtcacagaacataaaacttaatctaatgggtgttttgttttgttttgagacagaggctcactctgtcacctaggctggagtgcagtggctcgatctcagctcactgcagcctccacctcccggattcaagcaatttcctgcctcagcctcttgagtagctgggattacaggagccctccacgaggcccagttaatttttgtatctttagtggagacgaggtttccccctattggtcaggctggtctcaaacttctgacctcaagtgatccactcgcctcagcctctcaaaagtgctgggattacaggcatgaggcgccgcacttggcctagtgttttcttaactgtgaaattcccattcatttcttgaatgaggctacatcttatggacagagcaaagttattgtcctacagattcttaaaactataattatggctattgcatgaaatttaaatagattttattatgtctgcaaatctctgggcttttatttttctggaaaatataggagctttaatcaaaacataatagttctttttgtaattccatgttaataaaaacaaatactagcaattgcttgaattttaatgaatatttaaaagttcaagagccacggaaatcacttccagagataagagttccctttctaaatagaacacatttttaaaaaataagttatgtttgctactaaaacatttacactgttagactattatgtgcatgttgccaagactcttaagtaacttggatatcaactgtgaagggcctacctctaaaaagtaacaggtcatacaaatacaaatgtaactgtaaaaattccactggattcttgcatatttgcaagattagattattcaaaagaaatttcagtgctaaaattaaccagcaacataagttctatgggctttgaaaattgttctcatctttttaaagttgatgcattttcaatcctgcttacacaggctgttcatttggataagtaaataaaatgtctaaggtgaacttggcattatgtggagatgttggaccgttatagagcaatacaaattcctatgctgtcattctgttttctgcaaatgcaaacgtgcttatatggtcaacagtgcaaaaatagggtagttggctgcatatttagggtattacctaagcatttgttctctaacgttgctctactagaatgatttttttcttgcatcttttcacattaatgatgttctttatataactttcatgcgattatttagttttttaaattaataaagtgaatttaagaaatattgaaataaacatctaagtaattgccattttaaacccttgtttcttactgtgggagagggggaaatacagcactcatttcttgtttttaatttgcagaagtaagtgaaaatctatgtaaaatcaaaccaaaagagttggactgagtgtgtattgtcttgagattaagtgacaaatagtaaagtgttactgagtaattaagcccatgtattttttttttgtgagttgaaaatctttgaaatatgtgataaccgaatgtcaaaagttcctaaactctaacagtgcaggttgttcactgtaacgaggtaactcatatttgctggttacataaactacaagtactgctctcacaatatgggactttgaactgtgatgtagttcaacagttgccggcatcctctcagctgatacgctgcgaatattttgggttagacttgcagccagatgcagttttgcaacccaagaaaaaagttgaacctatgatcaaaaactgctcccaagatgaacctggaaaaaaatcagctaagctcccttggcgatctgcaggaacactagtaatgactggaattactccgtgatctttgatgactattacacataacagcactctagcaccttttcttactggcatggacttcctcatggactgctacttcatggatgatagcttcattgctttgggtagggatttaaggtagtcaaggggaaaatacgcagttttattacaggtcttaacatcaggcaactttcaactttaaaaccctttgtgaaaaatgtggttatagcactatagctctgattttaggatggttaaatgttatattcattgttggcttaccttatcaaactgtgccattaatcctttcacagacataggtaaggaagagaacaaccagtggattcaggggacaattatctatctccaaataataggcttttatttcttgcagctaactttttcagtgattctagcagatgccatctagtacatccttgatcttgtttctttcgtgagagatctcgccatggcagcatcttgttaagtaagtgtaattgcacatgcacaaaagacttaactagctttacatttagcagtcagttggttagattaggtttcatagtaaatgaataggaatagaaagaataggaagtgtttttattttccagtagtaattccgtggattccatttgacccagtttactatcagttcagttcaggtagatttggttcaacttttggtggtttttggctctaggatattcttgactttaatatcctagaacttactgagtcttcccttcaataaatacacttctcacatacctctaatcctatgcttccttgaaacaataatgctagctgagttgtttactaaggattattataagggcctgaaggtgtgggagtggagattaattaaaacctttatgttctccaatataagggaaaagcaggttggtactacttctgattaggcagaaaacaccaggattccttaagtgatccttgaaatggttattgttttctgccttgtcacatttgccactgtgccctttaaaacgatgtggaaacctcaggtttgtggacagcacaggtggaatgacatcttgtgcttcctgaggctcccctctaccaggcacattagcttagtgcttcagatgtcagcccaagtccttgttacctccttttcctgctgcccagggaagagtgtgtgtgctggagctggagcgcttgcactcttcaggtgactattctcacctccatttcctccacatgcattaggtgaaactgaggtctaagcctcctgcaaggtctacattttaaggactcacacatcaggctctcagaaatgtacacaggtattagttctgtttgttctaaaggaaatgtgggtatctctcaggccaggacttagtgactagttttcgctagacagcaggttaatacctagatctcatttaaaaaaaaaaaaaaaaaacaggattaaagggaactgatcaggtttgttgagttttttagcctaattccaaagcatggaagagtgctctaggtaggaaagaaagctttttcttacgatttgtagctacctactgtgcctgacttggtgcctgtgtgaggattaagcccttagtctgctcttgcaattattcaaatgacaaattaaatttgcttttgtaataacaataaaagttgtcatcttcccttttg

SEQ ID NO: 11699 - DNA, 2844 bp, Homo sapiens
ggttggggtttgggggaggagatccgctcacacacaagaggagagtgttgagccgccatatctgctgctgccgccgcagttgcgaatgcagcatcggcgcttagctgcctccgcggtgcagctaaggttcgtgtcgctaccccttggcccttcgctcttgctgccttaaccccgccggcggagcccgctcttctggcctgttgagcccgctccctcactgccacacagcaagttccgagaccatggattcgggcagcagcagcagcgactcggcgcccgattgctgggaccaggtggacatggaatccccggggtcggccccgagcggggatggagtctcctctgcggtggccgaggcccagcgcgagcccctcagctcggctttcagccgtaagctcaacgtcaacgccaagcccttcgtgcctaacgtacacgccgcggagttcgtgccgtccttcctgcggggcccgactcagccgcccaccctcccggccggctccggcagcaacgatgaaacctgcaccggcgcgggataccctcaaggtaaaaggatgggacggggggcacctgtggaaccttcccgagaggaaccgttagtgtcgcttgaaggttccaattcagccgttaccatggaactttcagaacctgttgtagaaaatggagaggtggaaatggccctagaagaatcatgggagcacagtaaagaagtaagtgaagccgagcctgggggtggttcctcgggagattcagggcccccagaagaaagtggccaggaaatgatggaggaaaaagaggaaataagaaaatccaaatctgtgatcgtaccctcaggtgcacctaagaaagaacacgtaaatgtagtattcattggccatgtagacgctggcaagtcaaccatcggaggacagataatgtttttgactggaatggttgacaaaagaacactggagaaatatgaaagagaagctaaggaaaaaaacagagaaacctggtatttgtcctgggccttagatacaaatcaggaggaacgagacaagggtaaaacagtcgaagtgggtcgtgcctattttgaaacagaaaggaaacatttcacaattttagatgcccctggccacaagagttttgtcccaaatatgattggtggtgcttctcaagctgatttggctgtgctggtcatctctgccaggaaaggagagtttgaaactggatttgaaaaaggtggacagacaagagaacatgcgatgttggcaaaaacggcaggggtaaaacatttaatagtgcttattaataagatggatgatcccacagtaaattggagcatcgagagatatgaagaatgtaaagaaaaactggtgccctttttgaaaaaagtaggcttcagtccaaaaaaggacattcactttatgccctgctcaggactgaccggagcaaatattaaagagcagtcagatttctgcccttggtacactggattaccatttattccgtatttggataacttgccaaacttcaacagatcaattgatggaccaataagactgccaattgtggataagtacaaagatatgggcactgtggtcctgggaaagctggaatccgggtccatttttaaaggccagcagctcgtgatgatgccaaacaagcacaatgtagaagttcttggaatactttctgatgatactgaaactgattttgtagccccaggtgaaaacctcaaaatcagactgaagggaattgaagaagaagagattcttccaggattcatactttgtgatcctagtaacctctgccattctggacgcacgtttgatgttcagatagtgattattgagcacaaatccatcatctgcccaggttataatgcggtgctgcacattcatacttgtattgaggaagttgagataacagcgttaatctccttggtagacaaaaaatcaggagaaaaaagtaagacacgaccccgcttcgtgaaacaagatcaagtatgcattgctcgtttaaggacagcaggaaccatctgcctcgagacgttcaaagattttcctcagatgggtcgttttactttaagagatgagggtaagaccattgcaattggaaaagttctgaaattggtcccagagaaggactaagcaattttcttgatgcctctgcaagatactgtgaggagaattgacagcaaaagttcaccacctactcttatttactgcccattgattgacttttcttcatattttgcaaagagaaatttcacagcaaaaattcatgttttgtcagctttctcatgttgagatctgttatgtcactgatgaatttaccctcaagtttccttcctctgtaccactctgcttccttggacaatatcagtaatagctttgtaagtgatgtggacgtaattgcctacagtaatgaaaaattaatgtactttaatttttcattttcttttaggatatttagaccacccttgttccacgcaaaccagagtgtgtcagtgtttgtgtgtgtgttaaaatgataactaacatgtgaataaaatactccatttgaaactcttcggttatttgaaatgcttttgaataatgtttaaatgtcattatgtaatgctattcaattagctttattactttctcaaatagttgaatatgttctatcacttaaaaacttaaaaactcttcaccacttactgttttaagtgaggaatttacaaacaatgcataagtgtgtattaaaggaataattttaattttgagaaaaaaacgtatgttaaggctcttcccagtgggctttgttttctctgtccaagtccagtcaataaaggagctcttctgcttccccacttgtgatttg

SEQ ID NO: 11700 - DNA, 1872 bp, Homo sapiens
atatctgctgctgccgccgcagttgcgaatgcagcatcggcgcttagctgcctccgcggtgcagctaaggttcgtgtcgctaccccttggcccttcgctcttgctgccttaaccccgccggcggagcccgctcttctggcctgttgagcccgctccctcactgccacacagcaagttccgagaccatggattcgggcagcaacgatgaaacctgcaccggcgcgggataccctcaaggtaaaaggatgggacggggggcacctgtggaaccttcccgagaggaaccgttagtgtcgcttgaaggttccaattcagccgttaccatggaactttcagaacctgttgtagaaaatggagaggtggaaatggccctagaagaatcatgggagcacagtaaagaagtaagtgaagccgagcctgggggtggttcctcgggagattcagggcccccagaagaaagtggccaggaaatgatggaggaaaaagaggaaataagaaaatccaaatctgtgatcgtaccctcaggtgcacctaagaaagaacacgtaaatgtagtattcattggccatgtagacgctggcaagtcaaccatcggaggacagataatgtttttgactggaatggttgacaaaagaacactggagaaatatgaaagagaagctaaggaaaaaaacagagaaacctggtatttgtcctgggccttagatacaaatcaggaggaacgagacaagggtaaaacagtcgaagtgggtcgtgcctattttgaaacagaaaggaaacatttcacaattttagatgcccctggccacaagagttttgtcccaaatatgattggtggtgcttctcaagctgatttggctgtgctggtcatctctgccaggaaaggagagtttgaaactggatttgaaaaaggtggacagacaagagaacatgcgatgttggcaaaaacggcaggggtaaaacatttaatagtgcttattaataagatggatgatcccacagtaaattggagcatcgagagatatgaagaatgtaaagaaaaactggtgccctttttgaaaaaagtaggcttcagtccaaaaaaggacattcactttatgccctgctcaggactgaccggagcaaatattaaagagcagtcagatttctgcccttggtacactggattaccatttattccgtatttggataacttgccaaacttcaacagatcaattgatggaccaataagactgccaattgtggataagtacaaagatatgggcactgtggtcctgggaaagctggaatccgggtccatttttaaaggccagcagctcgtgatgatgccaaacaagcacaatgtagaagttcttggaatactttctgatgatactgaaactgattttgtagccccaggtgaaaacctcaaaatcagactgaagggaattgaagaagaagagattcttccaggattcatactttgtgatcctagtaacctctgccattctggacgcacgtttgatgttcagatagtgattattgagcacaaatccatcatctgcccaggttataatgcggtgctgcacattcatacttgtattgaggaagttgagataacagcgttaatctccttggtagacaaaaaatcaggagaaaaaagtaagacacgaccccgcttcgtgaaacaagatcaagtatgcattgctcgtttaaggacagcaggaaccatctgcctcgagacgttcaaagattttcctcagatgggtcgttttactttaagagatgagggtaagaccattgcaattggaaaagttctgaaattggtcccagagaaggactaagcaattttcttgatgcctctgcaagatactgtgaggagaattgacagca

SEQ ID NO: 11701 - DNA, 5120 bp, Homo sapiens
gccccagccaggctgcgggcccgagacccccgggcctccctgccccccgcgccgccccgatttgccctcagagagggtatcgatcttatttctgggtctacggcaaactccaaggtctacaaacgtagaggtcagctgtgaccccgggccaggccgtgaaggtccccaggacacagagctgctctctcctcctagtaaaggtgagaggcagcccaggcctcgtgaaaaaacccagaactggagtcccaaaaggccacgctgatctagctaccctcccagtcaccttgcactcagtcccgagctgccaaagcctccgccgccaccacctccgctctacttccggccctggctccgcccccacacgcctacccgccatcgcaatgcattatgggccgccgtttcagtcggtcgacgctcaccggacaggaagcgtctcggagacagtctgcgaccggacgggtctaggtgagacagaagccaaacaggaggaggaagtggagggactgatcctttgaaatactccagccatgactaaaagagaagcagaggagctgatagaaattgagattgatggaacagagaaagcagagtgcacagaagaaagcattgtagaacaaacctacgcgccagctgaatgtgtaagccaggccatagacatcaatgaaccaataggcaatttaaagaaactgctagaaccaagactacagtgttctttggatgctcatgaaatttgtctgcaagatatccagctggatccagaacgaagtttatttgaccaaggagtaaaaacagatggaactgtacagcttagtgtacaggtaatttcttaccaaggaattgaaccaaagttaaacatccttgaaattgttaaacctgcggacactgttgaggttgttattgatccagatgcccaccatgctgaatcagaagcacatcttgttgaagaagctcaagtgataactcttgatggcacaaaacacatcacaaccatttcagatgaaacttcagaacaagtgacaagatgggctgctgcactggaaggctataggaaagaacaagaacgccttgggataccctatgatcccatacagtggtccacagaccaagtcctgcattgggtggtttgggtaatgaaggaattcagcatgaccgatatagacctcaccacactcaacatttcggggagagaattatgtagtctcaaccaagaagatttttttcagcgggttcctcggggagaaattctctggagtcatctggaacttctccgaaaatatgtattggcaagtcaagaacaacagatgaatgaaatagttacaattgatcaacctgtgcaaattattccagcatcagtgcaatctgctacacctactaccattaaagttataaatagtagtgcgaaagcagccaaagtacaaagagcgccgaggatttcaggagaagatagaagctcacctgggaacagaacaggaaacaatggccaaatccaactatggcagtttttgctagaacttcttactgataaggacgctcgagactgcatttcttgggttggtgatgaaggtgaatttaagctaaatcagcctgaactggttgcacagaaatggggacagcgtaaaaataagcctacgatgaactatgagaaactcagtcgtgcattaagatattattacgatggggacatgatttgtaaagttcaaggcaagagatttgtgtacaagtttgtctgtgacttgaagactcttattggatacagtgcagcggagttgaaccgtttggtcacagaatgtgaacagaagaaacttgcaaagatgcagctccatggaattgcccagccagtcacagcagtagctctggctactgcttctctgcaaacggaaaaggataattgagccccaggacattctgagactccaaagtctttcttaaaatgtttagagcaagtatagctcttacctttattactgaatttgaatcttcttttatttctaggctgtacagtctgatgcatgatttttttataaatatttcatactcttgtgaatttggatctttttactttgagcatatattttagaatatgtgtatgttaaaggatctccacaatgtctgcagtgtgaaggcaggttcattgtggaatagtttaacagtcaggaaggctaaactggtcagtattaatgtgtagccctaccaaaaatagccagtagtatctgaaaatgaaaaataaatgaagtatctctaggaaacagtctggcttaactatttttgaaaatataactgtttcccctctctgctgctttagatgttgctttacatagaaccagaaaatggaatttctcagctaaagcatgtgtgcctgtttcatctaatcaagcagagctaaaatgttcataccgaataaatttatattaataaattactaaactaagagtatcaggttatttatatatttgcaagcaaaggacagtaagaagttgactggcaaaagagcagtgctgaaggaggagatccaggtttaaatctggcttattaactcaagccaattttaaggattttctgtatagattactcatgtcagaccaagaatttaaattattttgagagaggcatttaattctaataaaccagctgttataaaaattataaaatgatctctgtttttcctgtcagagatttaaaaaactgaaaaggtatacctcaacccaaaaataaaggtttgttttggtttgttatggcttccttttttaaaaaattaccctgtagtgccagtttattatgcaaagcagcttatattcctttgtttctgataaaatgaagactttaaatcagtcagtagtactttacctttcaaggcattagtaaattacttgcaaatagttttaaaaggaaaatacgacctttgttataggcagtcttctctttaagacaatacttttccacttgttttccttttccatattatatatgtgtattcatatagctgtatacatattcagttgatcattttataaacatatgaaggcataaagatatacagaagaaaaattattaaacaactcattttaagattcaaattaactaattcctgcatatatgacattccttacataagcgaacactaaacaaaaatggctagaaatgtctttttctttcttttctctctttgttgtttaaggtattaagcacgaattattacatgagactggcagatagctattaatcctcttacagatttgagaaagttgattctcaaatatttatgcaccttctccttcattgttttctttaaatctgtcctcttaaaaagcttcttaagagctcagttaatgcttttgacttaactaggagaaaaaggcatgataatacaggcaagatggcattgttagcaattctggtagtggtttggaatgaatcctaagaggcagggatcttaaggacaaggaagagaagagagagagggagggatctttgatctctttctctggtaatcttaatgcataattttactaatacatgttctcaattcattcatattattaagctcttcctgcagttgatatctgagcagagtaagatttgtatttccatttttacttttttgaaagagaatatatggacagattattagtacaatttgggcactgtggttttaagaatatctgagtaaaataacaatatgaaataataaacagaagctctaacgtcaggtaacaaatagacagcaagaaaggttttgcaccatcctcttacggcctagagagttgacaagttgcttgtagttttaaaaaaataataaagtatacccttctggtatatcatcaagagcttaagaatcttggctttcatatttaaaatgcttttggggagacatatattaaaattttagccaagatgatagacatgtctcaattatatatgtgtgtgtatgtttttaaagctaaaaacattacttttagatccctagaatgaaaatttttttctcatctatgcaattcccatatggtttttttttaaatcatattttattcattttctccctttagcaattttcattttatttctcataatttgaacagagacagttctcatacatgatcagatgctttttttttcttcttaccatcatttatgcatgacataggtaatgtgactaatttctccagttgattcaagaaactcattactttgcctcaaattatatgtaaaatatttgttttacttaggttacagttatcagaaaggtagtttttttcttctattaaaatataacattgtgaaagaaaataaaatttatgctattctttgctttgtttttataaatgaatttttcatagaatttacagtatattcaaaggaagaaagataaaattattggtcatcatttgtaccttagaagtacaagaatttaagtaaaagaaatgttcatttttgttttaaaatttgttttccatgtgaagtttttattgagccaactttcatacatatcttgctagcctaaagtctaaatatttgtgttggcatcagaaaaacaaatgaggcagaattgctatgtgtggttgatcttcagataaattgactgatcacagttatttttgtatcagtctatgttattaggaaaaattgtttagttgttttctcccctgattaatggtgatattcaagtatgatacaaaaagaattgtaccaccaaatatttttgtgaggtctgctgttttccatattcattttatgctactgcctttaagaaagaactagtgtatccttgaaatagcacaaaaatgttttaaaattcataattgcaaaacaaatctgtgactaacttaatgtcttcagatctaaagggtgtaaaaatattgatacttcaatatttcacttgctgccaggaaaaacaaaattctcaatcttttgtaaatgggaggaggacttttgcatacatttttactctttaaataacgacaacgacacttatactgtcataataacaattatgtatttctttgtggttttaattttttttgtaattttacataaaacagttattttctatttttacgcagataaatatttgtgcataaaatgtaaaaatagtaaaatgagaaaaataaaactattatacagta

SEQ ID NO: 11702 - DNA, 4814 bp, Homo sapiens
aggtgcctgggaggcgggaggggggttggggcttctcagcgccgattccgcgggaagggccctgggacctcacacttctagtcgcgggagctgcaggtcttacccggagagacgctgcacgtggagccctcgccgctgccgttctcagccggctctggagtgcgggcgggggcgacagggccgattccggagtgggactgatcctttgaaatactccagccatgactaaaagagaagcagaggagctgatagaaattgagattgatggaacagagaaagcagagtgcacagaagaaagcattgtagaacaaacctacgcgccagctgaatgtgtaagccaggccatagacatcaatgaaccaataggcaatttaaagaaactgctagaaccaagactacagtgttctttggatgctcatgaaatttgtctgcaagatatccagctggatccagaacgaagtttatttgaccaaggagtaaaaacagatggaactgtacagcttagtgtacaggtaatttcttaccaaggaattgaaccaaagttaaacatccttgaaattgttaaacctgcggacactgttgaggttgttattgatccagatgcccaccatgctgaatcagaagcacatcttgttgaagaagctcaagtgataactcttgatggcacaaaacacatcacaaccatttcagatgaaacttcagaacaagtgacaagatgggctgctgcactggaaggctataggaaagaacaagaacgccttgggataccctatgatcccatacagtggtccacagaccaagtcctgcattgggtggtttgggtaatgaaggaattcagcatgaccgatatagacctcaccacactcaacatttcggggagagaattatgtagtctcaaccaagaagatttttttcagcgggttcctcggggagaaattctctggagtcatctggaacttctccgaaaatatgtattggcaagtcaagaacaacagatgaatgaaatagttacaattgatcaacctgtgcaaattattccagcatcagtgcaatctgctacacctactaccattaaagttataaatagtagtgcgaaagcagccaaagtacaaagagcgccgaggatttcaggagaagatagaagctcacctgggaacagaacaggaaacaatggccaaatccaactatggcagtttttgctagaacttcttactgataaggacgctcgagactgcatttcttgggttggtgatgaaggtgaatttaagctaaatcagcctgaactggttgcacagaaatggggacagcgtaaaaataagcctacgatgaactatgagaaactcagtcgtgcattaagatattattacgatggggacatgatttgtaaagttcaaggcaagagatttgtgtacaagtttgtctgtgacttgaagactcttattggatacagtgcagcggagttgaaccgtttggtcacagaatgtgaacagaagaaacttgcaaagatgcagctccatggaattgcccagccagtcacagcagtagctctggctactgcttctctgcaaacggaaaaggataattgagccccaggacattctgagactccaaagtctttcttaaaatgtttagagcaagtatagctcttacctttattactgaatttgaatcttcttttatttctaggctgtacagtctgatgcatgatttttttataaatatttcatactcttgtgaatttggatctttttactttgagcatatattttagaatatgtgtatgttaaaggatctccacaatgtctgcagtgtgaaggcaggttcattgtggaatagtttaacagtcaggaaggctaaactggtcagtattaatgtgtagccctaccaaaaatagccagtagtatctgaaaatgaaaaataaatgaagtatctctaggaaacagtctggcttaactatttttgaaaatataactgtttcccctctctgctgctttagatgttgctttacatagaaccagaaaatggaatttctcagctaaagcatgtgtgcctgtttcatctaatcaagcagagctaaaatgttcataccgaataaatttatattaataaattactaaactaagagtatcaggttatttatatatttgcaagcaaaggacagtaagaagttgactggcaaaagagcagtgctgaaggaggagatccaggtttaaatctggcttattaactcaagccaattttaaggattttctgtatagattactcatgtcagaccaagaatttaaattattttgagagaggcatttaattctaataaaccagctgttataaaaattataaaatgatctctgtttttcctgtcagagatttaaaaaactgaaaaggtatacctcaacccaaaaataaaggtttgttttggtttgttatggcttccttttttaaaaaattaccctgtagtgccagtttattatgcaaagcagcttatattcctttgtttctgataaaatgaagactttaaatcagtcagtagtactttacctttcaaggcattagtaaattacttgcaaatagttttaaaaggaaaatacgacctttgttataggcagtcttctctttaagacaatacttttccacttgttttccttttccatattatatatgtgtattcatatagctgtatacatattcagttgatcattttataaacatatgaaggcataaagatatacagaagaaaaattattaaacaactcattttaagattcaaattaactaattcctgcatatatgacattccttacataagcgaacactaaacaaaaatggctagaaatgtctttttctttcttttctctctttgttgtttaaggtattaagcacgaattattacatgagactggcagatagctattaatcctcttacagatttgagaaagttgattctcaaatatttatgcaccttctccttcattgttttctttaaatctgtcctcttaaaaagcttcttaagagctcagttaatgcttttgacttaactaggagaaaaaggcatgataatacaggcaagatggcattgttagcaattctggtagtggtttggaatgaatcctaagaggcagggatcttaaggacaaggaagagaagagagagagggagggatctttgatctctttctctggtaatcttaatgcataattttactaatacatgttctcaattcattcatattattaagctcttcctgcagttgatatctgagcagagtaagatttgtatttccatttttacttttttgaaagagaatatatggacagattattagtacaatttgggcactgtggttttaagaatatctgagtaaaataacaatatgaaataataaacagaagctctaacgtcaggtaacaaatagacagcaagaaaggttttgcaccatcctcttacggcctagagagttgacaagttgcttgtagttttaaaaaaataataaagtatacccttctggtatatcatcaagagcttaagaatcttggctttcatatttaaaatgcttttggggagacatatattaaaattttagccaagatgatagacatgtctcaattatatatgtgtgtgtatgtttttaaagctaaaaacattacttttagatccctagaatgaaaatttttttctcatctatgcaattcccatatggtttttttttaaatcatattttattcattttctccctttagcaattttcattttatttctcataatttgaacagagacagttctcatacatgatcagatgctttttttttcttcttaccatcatttatgcatgacataggtaatgtgactaatttctccagttgattcaagaaactcattactttgcctcaaattatatgtaaaatatttgttttacttaggttacagttatcagaaaggtagtttttttcttctattaaaatataacattgtgaaagaaaataaaatttatgctattctttgctttgtttttataaatgaatttttcatagaatttacagtatattcaaaggaagaaagataaaattattggtcatcatttgtaccttagaagtacaagaatttaagtaaaagaaatgttcatttttgttttaaaatttgttttccatgtgaagtttttattgagccaactttcatacatatcttgctagcctaaagtctaaatatttgtgttggcatcagaaaaacaaatgaggcagaattgctatgtgtggttgatcttcagataaattgactgatcacagttatttttgtatcagtctatgttattaggaaaaattgtttagttgttttctcccctgattaatggtgatattcaagtatgatacaaaaagaattgtaccaccaaatatttttgtgaggtctgctgttttccatattcattttatgctactgcctttaagaaagaactagtgtatccttgaaatagcacaaaaatgttttaaaattcataattgcaaaacaaatctgtgactaacttaatgtcttcagatctaaagggtgtaaaaatattgatacttcaatatttcacttgctgccaggaaaaacaaaattctcaatcttttgtaaatgggaggaggacttttgcatacatttttactctttaaataacgacaacgacacttatactgtcataataacaattatgtatttctttgtggttttaattttttttgtaattttacataaaacagttattttctatttttacgcagataaatatttgtgcataaaatgtaaaaatagtaaaatgagaaaaataaaactattatacagta

SEQ ID NO: 11703 - DNA, 2726 bp, Homo sapiens
ggggattttgggcgccgaccagacgcggcattttcggaaaatagcgccctgtgcagctgaagcgctttgtgtgtagcggggccgcgtcagcccggccgggtacgaggcgcctcgggtccccgcaccacctcctgctgccttcccgtcgccgctcccgaagcttttccagatgtccctggtagatttgggaaagaagcttttagaagcggcacgagcaggtcaagatgatgaagttcgtattttgatggcaaatggagctccctttactacagactggctgggaacttctccacttcatctagcagcacagtatggtcattattccaccacagaggtactgctgcgagctggtgtgagcagagatgccagaaccaaagtggaccgaacaccattacatatggcagcttctgagggccatgccagcatagtagaggttttacttaagcatggtgctgatgtcaatgcaaaggacatgttaaagatgacagctctccattgggccacagaacacaatcatcaagaggtggtggaacttttaatcaaatatggtgctgatgtacacacgcaaagtaaattttgtaaaactgcatttgatatttcaatagacaatggaaatgaagatttagcagagatattacagattgctatgcagaaccaaatcaacacaaacccagagagtcctgacactgtgacaatacatgctgcaacaccacagtttatcattggacctggaggggtggtgaacctaacaggtctggtatcttcagaaaattcatccaaggcaacagatgaaacgggtgtatctgctgttcagtttggaaactcttctacatcagtattagctacattagctgccttagctgaagcatctgctccattgtccaattcttcagaaactccagtagtggccacagaagaagtagttactgcagaatctgtggatggtgccattcagcaagtagttagttcagggggtcagcaagtcatcacaatagttacagatggaattcagcttggaaatttgcactctattccaaccagtggaattggtcagcccatcattgtgaccatgccagatggacaacaagtattaacagtaccagcaacagacattgctgaagaaactgttataagtgaagaaccaccagctaagagacaatgtatcgaaataattgaaaaccgggtggaatctgcagaaatagaagagagagaagctcttcagaaacagctggatgaagcaaatcgagaagcacaaaaatatcgacagcagctcctaaagaaagaacaggaagcagaggcctacagacagaagttggaagctatgactcgtcttcagactaataaagaagctgtttaattgaaatgaacatgtagtttgattttacttttggtcaagaaagaatacaatcttgaactgtacacaacaaaggtacagccatgggaatacagaatgatagaagagactacagatggataattggacttaagccatgagctctgagttcttgtaacataaaactttactttagaagttgtgaaatgtatttaaaactgaattctgtaaatagtttttttttttttacagttccaaatgagttgataaagattgttgaagagatccaaaaccagaataagccactgtttttgtgaattctttttgattttagtacaaaccttaatttctcagaaacggaacagttttaagggtgatcgttgttggttaggccaaatgttgtgtaataattatggtggactgatgctggaattactcctgtaggtataaacctctgtatgaagagaagatttctcccaggaaatctttgtacagctttaagttgtgtcagattctctgaaaacattttttagaaagcaaaatttttatatttgttcaatttcagctatacccaagtagatttacatgtatatgaagcaaatatttttaaaaatttctgtttgtacatattctgcatgttttataatttcaaaatgcatcacttacataggtatttctcccacagaaatgatgaaagtgaccagaaaaaaacaaaaacaaaacccctttactctgtaggtcattgaaacgaagtaagctggcagctggttttattggaatgacagtgttctcggaaggagcagcctacaagataacttgaatttgccaattctgcaaaatctgtgcttttttgaaaatttaagagtggggacgtgaaactgtattctgtgccttccatcatgatttccacatgaaagcactttaaggcactgattttaagataatgtttttggaaaacccaatgcatatgggtttctgaaatattttatggacttatttctccccaggaaatgattcttacggaaaaaaattgcttttgtatgtagaacaggaactttttgtattacagtgatgcaatagacatgtctaatgtaacttctacttttccttttgaaagctcagtgtctgtgctatgacttgctctcatcacaatattgttgaattccacaatgtatggacattaaacactggcagactgttcactttttcttttttttttttggtaaaatattacttcaaacccctttttcttgctttatttttcagtgttttattgctttatgaactgtttaaccctgaaatccctctaggttatctatactgtataaaaaagcaattacccttaaaactgtactctggcctacttttctattttgcaattaaatatcttttt

SEQ ID NO: 11704 - DNA, 1633 bp, Homo sapiens
gctttctttgtgtggctgaagcgctagaaatggcatattttctttcccttcgttaaaaaatcagaccctctttcccctctctccccgcgggaacacagctagggagtgggtaggagcaggatctgccgacgagggcagaggcggaaaatcctcgggcgatgagctgaagagggccgggtccgggagggatgctgggagcttgactcactcgcacaccatgtgtccctccgcgcgcagcacgggggacttttcggtggggattttgggcgccgaccagacgcggcattttcggaaaatagcgccctgtgcagctgaagcgctttgtgtgtagcggggccgcgtcagcccggccgggtacgaggcgcctcgggtccccgcaccacctcctgctgccttcccgtcgccgctcccgaagcttttccaggtcacagcatatttgtggaggaagatgtccctggtagatttgggaaagaagcttttagaagcggcacgagcaggtcaagatgatgaagttcgtattttgatggcaaatggagctccctttactacagactggctgggaacttctccacttcatctagcagcacagtatggtcattattccaccacagaggtactgctgcgagctggtgtgagcagagatgccagaaccaaagtggaccgaacaccattacatatggcagcttctgagggccatgccagcatagtagaggttttacttaagcatggtgctgatgtcaatgcaaaggacatgttaaagatgacagctctccattgggccacagaacacaatcatcaagaggtggtggaacttttaatcaaatatggtgctgatgtacacacgcaaagtaaattttgtaaaactgcatttgatatttcaatagacaatggaaatgaagatttagcagagatattacagattgctatgcagaaccaaatcaacacaaacccagagagtcctgacactgtgacaatacatgctgcaacaccacagtttatcattggacctggaggggtggtgaacctaacagatgaaacgggtgtatctgctgttcagtttggaaactcttctacatcagtattagctacattagctgccttagctgaagcatctgctccattgtccaattcttcagaaactccagtagtggccacagaagaagtagttactgcagaatctgtggatggtgccattcagcaagtagttagttcagggggtcagcaagtcatcacaatagttacagatggaattcagcttggaaatttgcactctattccaaccagtggaattggtcagcccatcattgtgaccatgccagatggacaacaagtattaacagtaccagcaacagacattgctgaagaaactgttataagtgaagaaccaccagctaagagacaatgtatcgaaataattgaaaaccgggtggaatctgcagaaatagaagtaaggagtcttttacccggtgtgctttgccgcagtcatccaaaataaattcaattttttttgtcttttatatttattactgacagtattgttttgatacagaatgaaagtgcgtagtattttcattttgtttatttttgccttatacatatagcaagccctcaataaataaatattgaatgaatg

SEQ ID NO: 11705 - DNA, 3016 bp, Homo sapiens
gctttctttgtgtggctgaagcgctagaaatggcatattttctttcccttcgttaaaaaatcagaccctctttcccctctctccccgcgggaacacagctagggagtgggtaggagcaggatctgccgacgagggcagaggcggaaaatcctcgggcgatgagctgaagagggccgggtccgggagggatgctgggagcttgactcactcgcacaccatgtgtccctccgcgcgcagcacgggggacttttcggtggggattttgggcgccgaccagacgcggcattttcggaaaatagcgccctgtgcagctgaagcgctttgtgtgtagcggggccgcgtcagcccggccgggtacgaggcgcctcgggtccccgcaccacctcctgctgccttcccgtcgccgctcccgaagcttttccagatgtccctggtagatttgggaaagaagcttttagaagcggcacgagcaggtcaagatgatgaagttcgtattttgatggcaaatggagctccctttactacagactggctgggaacttctccacttcatctagcagcacagtatggtcattattccaccacagaggtactgctgcgagctggtgtgagcagagatgccagaaccaaagtggaccgaacaccattacatatggcagcttctgagggccatgccagcatagtagaggttttacttaagcatggtgctgatgtcaatgcaaaggacatgttaaagatgacagctctccattgggccacagaacacaatcatcaagaggtggtggaacttttaatcaaatatggtgctgatgtacacacgcaaagtaaattttgtaaaactgcatttgatatttcaatagacaatggaaatgaagatttagcagagatattacagattgctatgcagaaccaaatcaacacaaacccagagagtcctgacactgtgacaatacatgctgcaacaccacagtttatcattggacctggaggggtggtgaacctaacagatgaaacgggtgtatctgctgttcagtttggaaactcttctacatcagtattagctacattagctgccttagctgaagcatctgctccattgtccaattcttcagaaactccagtagtggccacagaagaagtagttactgcagaatctgtggatggtgccattcagcaagtagttagttcagggggtcagcaagtcatcacaatagttacagatggaattcagcttggaaatttgcactctattccaaccagtggaattggtcagcccatcattgtgaccatgccagatggacaacaagtattaacagtaccagcaacagacattgctgaagaaactgttataagtgaagaaccaccagctaagagacaatgtatcgaaataattgaaaaccgggtggaatctgcagaaatagaagagagagaagctcttcagaaacagctggatgaagcaaatcgagaagcacaaaaatatcgacagcagctcctaaagaaagaacaggaagcagaggcctacagacagaagttggaagctatgactcgtcttcagactaataaagaagctgtttaattgaaatgaacatgtagtttgattttacttttggtcaagaaagaatacaatcttgaactgtacacaacaaaggtacagccatgggaatacagaatgatagaagagactacagatggataattggacttaagccatgagctctgagttcttgtaacataaaactttactttagaagttgtgaaatgtatttaaaactgaattctgtaaatagtttttttttttttacagttccaaatgagttgataaagattgttgaagagatccaaaaccagaataagccactgtttttgtgaattctttttgattttagtacaaaccttaatttctcagaaacggaacagttttaagggtgatcgttgttggttaggccaaatgttgtgtaataattatggtggactgatgctggaattactcctgtaggtataaacctctgtatgaagagaagatttctcccaggaaatctttgtacagctttaagttgtgtcagattctctgaaaacattttttagaaagcaaaatttttatatttgttcaatttcagctatacccaagtagatttacatgtatatgaagcaaatatttttaaaaatttctgtttgtacatattctgcatgttttataatttcaaaatgcatcacttacataggtatttctcccacagaaatgatgaaagtgaccagaaaaaaacaaaaacaaaacccctttactctgtaggtcattgaaacgaagtaagctggcagctggttttattggaatgacagtgttctcggaaggagcagcctacaagataacttgaatttgccaattctgcaaaatctgtgcttttttgaaaatttaagagtggggacgtgaaactgtattctgtgccttccatcatgatttccacatgaaagcactttaaggcactgattttaagataatgtttttggaaaacccaatgcatatgggtttctgaaatattttatggacttatttctccccaggaaatgattcttacggaaaaaaattgcttttgtatgtagaacaggaactttttgtattacagtgatgcaatagacatgtctaatgtaacttctacttttccttttgaaagctcagtgtctgtgctatgacttgctctcatcacaatattgttgaattccacaatgtatggacattaaacactggcagactgttcactttttcttttttttttttggtaaaatattacttcaaacccctttttcttgctttatttttcagtgttttattgctttatgaactgtttaaccctgaaatccctctaggttatctatactgtataaaaaagcaattacccttaaaactgtactctggcctacttttctattttgcaattaaatatctttttcacatatgttcattgtagacttatgtttttatcacatcttattaacacattaaaaatgttatcctactgca

SEQ ID NO: 11706 - DNA, 1401 bp, Homo sapiens
gcacaccatgtgtccctccgcgcgcagcacgggggacttttcggtggggattttgggcgccgaccagacgcggcattttcggaaaatagcgccctgtgcagctgaagcgctttgtgtgtagcggggccgcgtcagcccggccgggtacgaggcgcctcgggtccccgcaccacctcctgctgccttcccgtcgccgctcccgaagcttttccagatgtccctggtagatttgggaaagaagcttttagaagcggcacgagcaggtcaagatgatgaagttcgtattttgatggcaaatggagctccctttactacagactggctgggaacttctccacttcatctagcagcacagtatggtcattattccaccacagaggtactgctgcgagctggtgtgagcagagatgccagaaccaaagtggaccgaacaccattacatatggcagcttctgagggccatgccagcatagtagaggttttacttaagcatggtgctgatgtcaatgcaaaggacatgttaaagatgacagctctccattgggccacagaacacaatcatcaagaggtggtggaacttttaatcaaatatggtgctgatgtacacacgcaaagtaaattttgtaaaactgcatttgatatttcaatagacaatggaaatgaagatttagcagagatattacagattgctatgcagaaccaaatcaacacaaacccagagagtcctgacactgtgacaatacatgctgcaacaccacagtttatcattggacctggaggggtggtgaacctaacagatgaaacgggtgtatctgctgttcagtttggaaactcttctacatcagtattagctacattagctgccttagctgaagcatctgctccattgtccaattcttcagaaactccagtagtggccacagaagaagtagttactgcagaatctgtggatggtgccattcagcaagtagttagttcagggggtcagcaagtcatcacaatagttacagatggaattcagcttggaaatttgcactctattccaaccagtggaattggtcagcccatcattgtgaccatgccagatggacaacaagtattaacagtaccagcaacagacattgctgaagaaactgttataagtgaagaaccaccagctaagagacaatgtatcgaaataattgaaaaccgggtggaatctgcagaaatagaagtaaggagtcttttacccggtgtgctttgccgcagtcatccaaaataaattcaattttttttgtcttttatatttattactgacagtattgttttgatacagaatgaaagtgcgtagtattttcattttgtttatttttgccttatacatatagcaagccctcaataaataaatattgaatgaatgaa

SEQ ID NO: 11707 - DNA, 1392 bp, Homo sapiens
ggggattttgggcgccgaccagacgcggcattttcggaaaatagcgccctgtgcagctgaagcgctttgtgtgtagcggggccgcgtcagcccggccgggtacgaggcgcctcgggtccccgcaccacctcctgctgccttcccgtcgccgctcccgaagcttttccagatgtccctggtagatttgggaaagaagcttttagaagcggcacgagcaggtcaagatgatgaagttcgtattttgatggcaaatggagctccctttactacagactggctgggaacttctccacttcatctagcagcacagtatggtcattattccaccacagaggtactgctgcgagctggtgtgagcagagatgccagaaccaaagtggaccgaacaccattacatatggcagcttctgagggccatgccagcatagtagaggttttacttaagcatggtgctgatgtcaatgcaaaggacatgttaaagatgacagctctccattgggccacagaacacaatcatcaagaggtggtggaacttttaatcaaatatggtgctgatgtacacacgcaaagtaaattttgtaaaactgcatttgatatttcaatagacaatggaaatgaagatttagcagagatattacagattgctatgcagaaccaaatcaacacaaacccagagagtcctgacactgtgacaatacatgctgcaacaccacagtttatcattggacctggaggggtggtgaacctaacaggtctggtatcttcagaaaattcatccaaggcaacagatgaaacgggtgtatctgctgttcagtttggaaactcttctacatcagtattagctacattagctgccttagctgaagcatctgctccattgtccaattcttcagaaactccagtagtggccacagaagaagtagttactgcagaatctgtggatggtgccattcagcaagtagttagttcagggggtcagcaagtcatcacaatagttacagatggaattcagcttggaaatttgcactctattccaaccagtggaattggtcagcccatcattgtgaccatgccagatggacaacaagtattaacagtaccagcaacagacattgctgaagaaactgttataagtgaagaaccaccagctaagagacaatgtatcgaaataattgaaaaccgggtggaatctgcagaaatagaagtaaggagtcttttacccggtgtgctttgccgcagtcatccaaaataaattcaattttttttgtcttttatatttattactgacagtattgttttgatacagaatgaaagtgcgtagtattttcattttgtttatttttgccttatacatatagcaagccctcaataaataaatattgaatgaatgaa

SEQ ID NO: 11708 - DNA, 406 bp, Homo sapiens
aggaggggatgtgtatgagaacttctgagaagaaaggatcagaatgtatgcattctttttttgagcagaatattgatggttcatttttgtgacttacaagaaccagcagtttattggcttcattttgtaggaagcagatgtccctggtagatttgggaaagaagcttttagaagcggcacgagcaggtcaagatgatgaagttcgtattttgatggcaaatggagctccctttactacagactggctgggaacttctccacttcatctagcagcacagtatggtcattattccaccacagaggtactgctgcgagctggtgtgagcagagatgccagaaccaaagtggaccgaacaccattacatatggcagcttctgagggccatgccagcatagtagaggtttt

SEQ ID NO: 11709 - DNA, 730 bp, Homo sapiens
atgtgtccctccgcgcgcagcacgggggacttttcggtggggattttgggcgccgaccagacgcggcattttcggaaaatagcgccctgtgcagctgaagcgctttgtgtgtagcggggccgcgtcagcccggccgggtacgaggcgcctcgggtccccgcaccacctcctgctgccttcccgtcgccgctcccgaagcttttccaggattattccctcctttgctggacctctagtatccatggcacttgcccattaaatgctagcagagcatcctcaccttcagtctccaaaatgcctctataaacatacaaagggccctgaagggggcagtgctgctaccaatgagaaccactgatttccaagaatccatctacattaatctaccatatggcggccgggcgcggtggctcacgcctgtaatcccagcactatgggaggccgaggcgggcagatcacgagatgtccctggtagatttgggaaagaagcttttagaagcggcacgagcaggtcaagatgatgaagttcgtattttgatggcaaatggagctccctttactacagactggctgggaacttctccacttcatctagcagcacagtatggtcattattccaccacagaggtactgctgcgagctggtgtgagcagagatgccagaaccaaagtggaccgaacaccattacatatggcagcttctgagggccatgccagcatagtagaggttt

SEQ ID NO: 11710 - DNA, 1317 bp, Homo sapiens
tggcgcaaattcgtggatcgctccgctgaatccgcccgcgcgtcgccgccgtcgtcgccgccccccgtcccggcccccctgggttccctcagcccagccctgtccagcccggttcccgggaggatgaagttcgtgtacaaagaagagcatccgttcgagaagcgccgctctgagggcgagaagatccgaaagaaatacccggaccgggtgccggtgatagtagaaaaggctcccaaagctcggataggagacctggacaaaaagaaatacctggtgccttctgatctcacagttggtcagttctacttcttgatccggaagcgaattcatctccgagctgaggatgccttgtttttctttgtcaacaatgtcattccacccaccagtgccacaatgggtcagctgtaccaggaacaccatgaagaagacttctttctctacattgcctacagtgacgaaagtgtctacggtctgtgaagctgctgcccctgagctggaggggggtctcattctacaaagagagaggtggcccccctttcttgacctcctcctccttcaagctcaaacaccacctcccttattcaggaccggcacttcttaatgtttgtggctttctctccagcctctcttaggaggggtaatggtggagttggcatcttgtaactctcctttctcctttcttcccctttctctgcccgcctttcccatcctgctgtagacttcttgattgtcagtctgtgtcacatccagtgattgttttggtttctgttccctttctgactgcccaaggggctcagaaccccagcaatcccttcctttcactaccttcttttttgggggtagttggaagggactgaaattgtggggggaaggtaggaggcacatcaataaagaggaaaccaccaagctgaactgaattttgccttgtgttgctcccctcgtcccgctgattttaagtctttccaaggtgtcagtgggtttcagtggtggggaaagaagagtactgggtacaagctggagggatagaagtatattttggtttattctgttcatgttgggcttttccctgtctgcaaaaagagggtgcttttgttgtgatggaatggaatactgaggattatttcttgaaactttagttttataacacgcatgtgaaactaaatgttaaaaatgctcatgtaaaaaaaaatttttttttactgtgggttcctgtggagaaagttccgaagtacctgctttaggtgaacatccacatttgctagaacattctaactaagatattttcatgtgtgcaagctagtaaaacggctgttctca

SEQ ID NO: 11711 - DNA, 1955 bp, Homo sapiens
ctgggcgcctggcgcatggggggcggggcggggctcgcggggtgacgtcacagcccgacgcgccacccagctgtttttgtgctcccagctctagcgaaaagccgccggtatttctccatctggctctcctctacctccaggcaggctcacccgagatccccgccccgaaccccccctgcacactcggcccagcgctgttgcccccggagcggacgtttctgcagctattctgagcacaccttgacgtcggctgagggagcgggacagggtcagcggcgaaggaggcaggccccgcgcggggatctcggaagccctgcggtgcatcatgaagttccagtacaaggaggaccatccctttgagtatcggaaaaaggaaggagaaaagatccggaagaaatatccggacagggtccccgtgattgtagagaaggctccaaaagccagggtgcctgatctggacaagaggaagtacctagtgccctctgaccttactgttggccagttctacttcttaatccggaagagaatccacctgagacctgaggacgccttattcttctttgtcaacaacaccatccctcccaccagtgctaccatgggccaactgtatgaggacaatcatgaggaagactattttctgtatgtggcctacagtgatgagagtgtctatgggaaatgagtggttggaagcccagcagatgggagcacctggacttgggggtaggggaggggtgtgtgtgcgcgacatggggaaagagggtggctcccaccgcaaggagacagaaggtgaagacatctagaaacattacaccacacacaccgtcatcacattttcacatgctcaattgatattttttgctgcttcctcggcccagggagaaagcatgtcaggacagagctgttggattggctttgatagaggaatggggatgatgtaagtttacagtattcctggggtttaattgttgtgcagtttcatagatgggtcaggaggtggacaagttggggccagagatgatggcagtccagcagcaactccctgtgctcccttctctttgggcagagattctatttttgacatttgcacaagacaggtagggaaaggggacttgtggtagtggaccatacctggggaccaaaagagacccactgtaattgatgcattgtggcccctgatcttccctgtctcacacttcttttctcccatcccggttgcaatctcactcagacatcacagtaccaccccaggggtggcagtagacaacaacccagaaatttagacagggatctcttacctttggaaaataggggttaggcatgaaggtggttgtgattaagaagatggttttgttattaaatagcattaaactggaattgacaagagtgttgagcatccctgtctaacctgctctttctctttggtgccccttatctcaccccttccttggaatttaataagtctcaggcatttccaattgtagactaaaaccactcttagcatctcctctagtattttccatgtatcaggacagaggtgtcttatgtagggagggggcaagtatgaagtaaggtaattatatactactctcattcaggattcttgctcccatgctgctgtcccttcaggctcacatgcacaggaatgctacatgatggccagctgcttccctccttggttatcatccactgcagctgctagttagaaaggtttggagggatgacttttagtaaatcatggggattttattgatttattttcacttttgggattttgtggggtgggagtggggagcaggaattgcactcagacatgacatttcaattcatctctgctaatgaaaagggttctttctcttgggggaaatgtgtgtgtcagttctgtcagctgcaagttcttgtataatgaagtcaatgccatcaggccaaggaaataaaataattgcttaccttaaaaa

SEQ ID NO: 11712 - DNA, 855 bp, Homo sapiens
ggctcgcggggtgacgtcacagcccgacgcgccacccagctgtttttgtgctcccagctctagcgaaaagccgccggtatttctccatctggctctcctctacctccaggcaggctcacccgagatccccgccccgaaccccccctgcacactcggcccagcgctgttgcccccggagcggacgtttctgcagctattctgagcacaccttgacgtcggctgagggagcgggacagggtcagcggcgaaggaggcaggccccgcgcggggatctcggaagccctgcggtgcatcatgaagttccagtacaaggaggaccatccctttgagtatcggaaaaaggaaggagaaaagatccggaagaaatatccggacagggtccccgtgattgtagagaaggctccaaaagccagggtgcctgatctggacaagaggaagtacctagtgccctctgaccttactgttggccagttctacttcttaatccggaagagaatccacctgagacctgaggacgccttattcttctttgtcaacaacaccatccctcccaccagtgctaccatgggccaactgtatgaggtaatggttctggttgcacaatactggatgccgtccagtgcagtctggcatcctctagcccttgttctagatgcgttgataacacatctgagaagtggggcagaaggtgttatttatccggatcctcttacatatggcagtgtaaggctctgagagattagatacctcttgttttttagggattagccactctactagatttaatccttctgaaatcttgtctgactatagtcttgtctgactatagtgttttaatgctggactgtttattga

SEQ ID NO: 11713 - DNA, 653 bp, Homo sapiens
gtgctcccagctctagcgaaaagccgccggtatttctccatctggctctcctctacctccaggcaggctcacccgagatccccgccccgaaccccccctgcacactcggccccgcgcggggatctcggaagccctgcggtgcatcatgaagttccagtacaaggaggaccatccctttgagtatcggaaaaaggaaggagaaaagatccggaagaaatatccggacagggtccccgtgattgtagagaaggctccaaaagccagggtgcctgatctggacaagaggaagtacctagtgccctctgaccttactgttggccagttctacttcttaatccggaagagaatccacctgagacctgaggacgccttattcttctttgtcaacaacaccatccctcccaccagtgctaccatgggccaactgtatgaggtaatggttctggttgcacaatactggatgccgtccagtgcagtctggcatcctctagcccttgttctagatgcgttgataacacatctgagaagtggggcagaaggtgttatttatccggatcctcttacatatggcagtgtaaggctctgagagattagatacctcttgttttttagggattagccactctactagatttaatccttctgaaatcttg

SEQ ID NO: 11714 - DNA, 553 bp, Homo sapiens
gtatttgttttggggcccaaccaagaaaaacagtggagggggaataaaacatgtttaaatcttttttttgtcttaaaaccatctttaatttcacagtcacaaaataaaacataactcgaatgttttgatgtttgcagtgacatcgattgtgaaaaaggcaggctcacccgagatccccgccccgaaccccccctgcacactcggcccagcgctgttgcccccggagcggacgtttctgcagctattctgagcacaccttgacgtcggctgagggagcgggacagggtcagcggcgaaggaggcaggccccgcgcggggatctcggaagccctgcggtgcatcatgaagttccagtacaaggaggaccatccctttgagtatcggaaaaaggaaggagaaaagatccggaagaaatatccggacagggtccccgtgattgtagagaaggctccaaaagccagggtgcctgatctggacaagaggaagtacctagtgccctctgaccttactgttggccagttctacttcttaatccggaagagaatccacctga

SEQ ID NO: 11715 - DNA, 571 bp, Homo sapiens
ctctcctctacctccaggcaggctcacccgagatccccgccccgaaccccccctgcacactcggccccgcgcggggatctcggaagccctgcggtgcatcatgaagttccagtacaaggaggaccatccctttgagtatcggaaaaaggaaggagaaaagatccggaagaaatatccggacagggtccccgtgattgtagagaaggctccaaaagccagggtgcctgatctggacaagaggaagtacctagtgccctctgaccttactgttggccagttctacttcttaatccggaagagaatccacctgagacctgaggacgccttattcttctttgtcaacaacaccatccctcccaccagtgctaccatgggccaactgtatgaggacaatcatgaggaagactattttctgtatgtggcctacagtgatgagagtgtctatgggaaatgagtggttggaagcccagcagatgggagcacctggacttgggggtaggggaggggtgtgtgtgcgcgacatggggaaagagggtggctcccaccgcaaggagacagaaggtgaagacat

SEQ ID NO: 11716 - DNA, 1002 bp, Homo sapiens
cgacagccggaagtcccgcctgccgtgtagtcgccgccgtcgctgccgctgccgctgccgccgtcgttgttgttgtgctcggtgcgctgagctccgcggctccgcgagccggttccgtccccttcccgccgccgccatgaagtggatgttcaaggaggaccactcgctggaacacagatgcgtggagtccgcgaagattcgagcgaaatatcccgacagggttccggtgattgtggaaaaggtctcaggctctcagattgttgacattgacaaacggaagtacttggttccatctgatatcactgtggctcagttcatgtggatcatcaggaaaaggatccagcttccttctgaaaaggcgatcttcctgtttgtggataagacagtcccacagtccagcctaactatgggacagctttacgagaaggaaaaagatgaagatggattcttatatgtggcctacagcggagagaacacttttggcttctgagggccattgctgggctaggtgcaccgtaactgcttgtgtatcttgtaaatagccagccattttcagttattataccagaacctcttcacatagacctattagtgcatttgtaactggatttatttcttaatatattggaaggttttgtttccttagactagtaaattatcatacagagttttattttgagtttttctttttgtgcattgtcctcatgcctgtattctccaggaaacttgtccttctggaaatcatattgaatgatatttctatatcgaagtgaggtaggtgcggtattaaagtgaaagggaaggtgatgcatttattctgggttatgcttgaagtgttagatggctaagtattaaaattatccaaattaaatccttagcagtcagaacacttgcttcactagaatatgccaactgccaatcatgttggactgagctaatttgttcctctttctgaaactattaaggtaaataattaacaataaaaattctcttataaaggca

SEQ ID NO: 11717 - DNA, 3222 bp, Homo sapiens
gtttcctccgaagtggttggtgccttagcaactaaagctggcaactgggacatcgtccggtgctgcaggtctcagccgaagggcgtcggaaactgcgctcgcatcgagcagtttccagcctcctgggtaaaggagcagtctcctcccttgcttgggactctggacgcatctcattccggtgaaagtaagggacagcttaggaccagaagcctttcgcggagaaaaggctgacatgcccgtcctatatgacaggttactgaagctaaaggagatgtttaactccaagtttggatctattcccaagttttatgttcgagcaccaggaagagtcaacataataggagagcatatagattattgtggatattctgttcttcctatggctgtagaacaagatgtgctaatagctgtagaacctgtgaaaacgtacgctctccaactggccaatacaaatcccttgtatccggacttcagtactagtgctaataacatccagattgataaaaccaagcctttgtggcacaactatttcttatgtggacttaaaggaattcaggaacactttggtcttagtaacctgactggaatgaactgcctggtagatggaaatatcccaccaagttctggcctctccagctccagtgctttggtctgttgtgctggcttggtgacgctcacagtgctgggaaggaatctatccaaggtggaacttgcagaaatctgtgccaagagtgagcgttacattggcactgaaggaggaggcatggaccagtctatatcatttcttgcagaagaaggaactgccaagttgatagaatttagtcctctgagggcaaccgatgtaaaactcccaagtggagcagtgtttgtgattgccaacagttgtgtggagatgaataaggcagcaacttcccatttcaatatcagggtgatggagtgtcggctggctgcgaagctcctggctaaatacaaaagcttgcaatgggacaaagtactgaggctggaggaggtgcaggctaaactagggattagtctagaagaaatgctgttggtcacagaagatgcccttcatcctgaaccctataaccctgaggagatctgcaggtgtctgggaattagcctggaggaactccgaacccaaatcctgagtccaaacactcaagatgtgctcatcttcaaactctatcagcgggcaaagcatgtgtacagcgaggctgcgcgagtgctccagtttaagaagatatgtgaagaagcacctgaaaacatggtccagctgctgggagagttgatgaaccagagccacatgagctgccgggacatgtatgagtgcagctgccccgagctggatcagctggtggacatctgtcggaagtttggggctcaagggtcacgacttactggagcaggatggggaggctgcacagtatcaatggtacctgcggacaagctgcccagctttctagcaaatgtgcacaaagcttattaccagaggagtgatggaagcttagcaccggagaagcaaagtttgtttgctaccaaacctggaggtggggctttggttttgcttgaggcctgaaaaaatgtaaaaagtctgagagaaactacttagggcacttaggaattggcaggactttctgtgccacagtaaattaatcttccttctgttttgtattatgatgaacggttgctattatatcaagatatattttcaaagaaatggttgaaagctctctatgcttcataatgattctttttccatcttaaaatatggttttactattaagagccaagatcatgcttggacagatcttttaagaataacttactgagatttattgatttgaagattttaaagatgaatggtaaaacacactcttaatactgattacatggattggacttgaattaaatatattgttacaattaaactgataccactgaattgtatgcattattcttgaatagagttcatttctggtttctcttagtattcttcttcctcaaagttgtagttgtctgttgatgatggtgatgatgatgatgatgacgatagtgatgccacacattctctctcaatttcagcttcggaacgctatgaaaataatacatgattaaagtttcacagatcttcttggacattgtataattgaatttgaatgtgagatttctccagttatcaagagactaaggatttttttttttttttgacaaaaggaggatacaggaagaaaattcagactcatttgaatatttgtaaaccatgtaatatataaataaccactttcaattcttttggccctgagctatctccattacttaatagaaaaacttagataaaaaacactttaagactcttctattcacattgaaataaagaattatctagatgataattcagataattcagtttgttcatagaattactttcttatcactctttttctactactttttctcaaatacctctctaatccaagaggcacttccaagaaattccacacattccttatatcccttttttgcttgtctagcaaagcttgtttgtatatatgcaccccattgtaaagcaggtatgcaggtatgtgggtgaaagtgactatgaaaagacttaatgaattctgggatttgtaatggtattgatgggtatctctgtatgtatatcaagagtgggcagaaatgtttggctggtgatggcaaatgactggctttctcttgtggatggactataggaagcactttctgaattatgtaatgatttggaccaaaaagtattttgctgaaatactcaggtaattgagatagcaatggttttatggcatgaattatccaaaaaaatatcagaattacttattattctgtgatttcattagctcattaatgtttaactcacagattgggcatcaccatctagaatttcagtttaagggaggcctgcgcaaagctagttttatttcttaaaggataacagtcatacatagaatactaggaaagccaatattctatttaaaaataaacttctgatgcattttcattcttagcagaaaggtaaatgcttgagaaagcttgagtcaaatttgttaaaagaattttgagttctataaatccaaaaatctgaaacctgaatttatttaaatttataatcctttattttttaataccgtgccattttccacaaaggatttgtggttggtatataattctttaaagatacctggatcagtg

SEQ ID NO: 11718 - DNA, 1834 bp, Homo sapiens
agggcgggagctgtttatctcccggaagaaaacggctcctgtcacagaagtctcgtgattgctctgggagctttgcttagacacttgaaactacaggagaaagaaggatctagcgaaatatggctacagagagccctgctacgcgtcgggtccaggttactgaagctaaaggagatgtttaactccaagtttggatctattcccaagttttatgttcgagcaccaggaagagtcaacataataggagagcatatagattattgtggatattctgttcttcctatggctgtagaacaagatgtgctaatagctgtagaacctgtgaaaacgtacgctctccaactggccaatacaaatcccttgtatccggacttcagtactagtgctaataacatccagattgataaaaccaagcctttgtggcacaactatttcttatgtggacttaaaggaattcaggaacactttggtcttagtaacctgactggaatgaactgcctggtagatggaaatatcccaccaagttctggcctctccagctccagtgctttggtctgttgtgctggcttggtgacgctcacagtgctgggaaggaatctatccaaggtggaacttgcagaaatctgtgccaagagtgagcgttacattggcactgaaggaggaggcatggaccagtctatatcatttcttgcagaagaaggaactgccaagttgatagaatttagtcctctgagggcaaccgatgtaaaactcccaagtggagcagtgtttgtgattgccaacagttgtgtggagatgaataaggcagcaacttcccatttcaatatcagggtgatggagtgtcggctggctgcgaagctcctggctaaatacaaaagcttgcaatgggacaaagtactgaggctggaggaggtgcaggctaaactagggattagtctagaagaaatgctgttggtcacagaagatgcccttcatcctgaaccctataaccctgaggagatctgcaggtgtctgggaattagcctggaggaactccgaacccaaatcctgagtccaaacactcaagatgtgctcatcttcaaactctatcagcgggcaaagcatgtgtacagcgaggctgcgcgagtgctccagtttaagaagatatgtgaagaagcacctgaaaacatggtccagctgctgggagagttgatgaaccagagccacatgagctgccgggacatgtatgagtgcagctgccccgagctggatcagctggtggacatctgtcggaagtttggggctcaagggtcacgacttactggagcaggatggggaggctgcacagtatcaatggtacctgcggacaagctgcccagctttctagcaaatgtgcacaaagcttattaccagaggagtgatggaagcttagcaccggagaagcaaagtttgtttgctaccaaacctggaggtggggctttggttttgcttgaggcctgaaaaaatgtaaaaagtctgagagaaactacttagggcacttaggaattggcaggactttctgtgccacagtaaattaatcttccttctgttttgtattatgatgaacggttgctattatatcaagatatattttcaaagaaatggttgaaagctctctatgcttcataatgattctttttccatcttaaaatatggttttactattaagagccaagatcatgcttggacagatcttttaagaataacttactgagatttattgatttgaagattttaaagatgaatggtaaaacacactcttaatactgattacatggattggacttgaattaaatatattgttacaattaaactg

SEQ ID NO: 11719 - DNA, 2053 bp, Homo sapiens
gattgctctgggagctttgcttagacacttgaaactacaggagaaagaaggatctagcgaaatatggctacagagagccctgctacgcgtcgggtccaggttactgaagctaaaggagatgtttaactccaagtttggatctattcccaagttttatgttcgagcaccaggaagagtcaacataataggagagcatatagattattgtggatattctgttcttcctatggctgtagaacaagatgtgctaatagctgtagaacctgtgaaaacgtacgctctccaactggccaatacaaatcccttgtatccgaaataaaaagggtcagttggaggtagtttagtcactaaggccactgcaacttcctctcttaactcttagcagctggagatgttttgctgtagacacacagtttgaacataaaagggacttcagtactagtgctaataacatccagattgataaaaccaagcctttgtggcacaactatttcttatgtggacttaaaggaattcaggaacactttggtcttagtaacctgactggaatgaactgcctggtagatggaaatatcccaccaagttctggcctctccagctccagtgctttggtctgttgtgctggcttggtgacgctcacagtgctgggaaggaatctatccaaggtggaacttgcagaaatctgtgccaagagtgagcgttacattggcactgaaggaggaggcatggaccagtctatatcatttcttgcagaagaaggaactgccaagttgatagaatttagtcctctgagggcaaccgatgtaaaactcccaagtggagcagtgtttgtgattgccaacagttgtgtggagatgaataaggcagcaacttcccatttcaatatcagggtgatggagtgtcggctggctgcgaagctcctggctaaatacaaaagcttgcaatgggacaaagtactgaggctggaggaggtgcaggctaaactagggattagtctagaagaaatgctgttggtcacagaagatgcccttcatcctgaaccctataaccctgaggagatctgcaggtgtctgggaattagcctggaggaactccgaacccaaatcctgagtccaaacactcaagatgacggagtcgtgctctatcgcccaggctggagtgcaacggcgtgatctcagctcactgcaacctctgcctcccaggttcaagcaattctcccacttcagtctctcaaatagctgggattacatgcacccaccatcatcatgcccagtgctcatcttcaaactctatcagcgggcaaagcatgtgtacagcgaggctgcgcgagtgctccagtttaagaagatatgtgaagaagcacctgaaaacatggtccagctgctgggagagttgatgaaccagagccacatgagctgccgggacatgtatgagtgcagctgccccgagctggatcagctggtggacatctgtcggaagtttggggctcaagggtcacgacttactggagcaggatggggaggctgcacagtatcaatggtacctgcggacaagctgcccagctttctagcaaatgtgcacaaagcttattaccagaggagtgatggaagcttagcaccggagaagcaaagtttgtttgctaccaaacctggaggtggggctttggttttgcttgaggcctgaaaaaatgtaaaaagtctgagagaaactacttagggcacttaggaattggcaggactttctgtgccacagtaaattaatcttccttctgttttgtattatgatgaacggttgctattatatcaagatatattttcaaagaaatggttgaaagctctctatgcttcataatgattctttttccatcttaaaatatggttttactattaagagccaagatcatgcttggacagatcttttaagaataacttactgagatttattgatttgaagattttaaagatgaatggtaaaacacactcttaatactgattacatggattggacttgaattaaatatattgttacaattaaactgataccactgaattgt

SEQ ID NO: 11720 - DNA, 1950 bp, Homo sapiens
agacacttgaaactacaggagaaagaaggatctagcgaaatatggctacagagagccctgctacgcgtcgggtccaggtggcagaacatcctagatggagtctcgctctgtcacctgtgctggaggctagagtgcaagtggcacgatcttggctcactgcaacctccgcctcctgggttgaagtgattctcctgcctccgcctccggagtagctgggattacaggttactgaagctaaaggagatgtttaactccaagtttggatctattcccaagttttatgttcgagcaccaggaagagtcaacataataggagagcatatagattattgtggatattctgttcttcctatggctgtagaacaagatgtgctaatagctgtagaacctgtgaaaacgtacgctctccaactggccaatacaaatcccttgtatccggacttcagtactagtgctaataacatccagattgataaaaccaagcctttgtggcacaactatttcttatgtggacttaaaggaattcaggaacactttggtcttagtaacctgactggaatgaactgcctggtagatggaaatatcccaccaagttctggcctctccagctccagtgctttggtctgttgtgctggcttggtgacgctcacagtgctgggaaggaatctatccaaggtggaacttgcagaaatctgtgccaagagtgagcgttacattggcactgaaggaggaggcatggaccagtctatatcatttcttgcagaagaaggaactgccaagttgatagaatttagtcctctgagggcaaccgatgtaaaactcccaagtggagcagtgtttgtgattgccaacagttgtgtggagatgaataaggcagcaacttcccatttcaatatcagggtgatggagtgtcggctggctgcgaagctcctggctaaatacaaaagcttgcaatgggacaaagtactgaggctggaggaggtgcaggctaaactagggattagtctagaagaaatgctgttggtcacagaagatgcccttcatcctgaaccctataaccctgaggagatctgcaggtgtctgggaattagcctggaggaactccgaacccaaatcctgagtccaaacactcaagatgtgctcatcttcaaactctatcagcgggcaaagcatgtgtacagcgaggctgcgcgagtgctccagtttaagaagatatgtgaagaagcacctgaaaacatggtccagctgctgggagagttgatgaaccagagccacatgagctgccgggacatgtatgagtgcagctgccccgagctggatcagctggtggacatctgtcggaagtttggggctcaagggtcacgacttactggagcaggatggggaggctgcacagtatcaatggtacctgcggacaagctgcccagctttctagcaaatgtgcacaaagcttattaccagaggagtgatggaagcttagcaccggagaagcaaagtttgtttgctaccaaacctggaggtggggctttggttttgcttgaggcctgaaaaaatgtaaaaagtctgagagaaactacttagggcacttaggaattggcaggactttctgtgccacagtaaattaatcttccttctgttttgtattatgatgaacggttgctattatatcaagatatattttcaaagaaatggttgaaagctctctatgcttcataatgattctttttccatcttaaaatatggttttactattaagagccaagatcatgcttggacagatcttttaagaataacttactgagatttattgatttgaagattttaaagatgaatggtaaaacacactcttaatactgattacatggattggacttgaattaaatatattgttacaattaaactgataccactgaattgtatgcattattcttgaatagagttcatttctgg

SEQ ID NO: 11721 - DNA, 1768 bp, Homo sapiens
cggggagcaagtggaacccttgggattctataaggacacgtggctgggcttgcaaaaaagatcacgccgcaaacacattctaccttgactactacgaagggttactgaagctaaaggagatgtttaactccaagtttggatctattcccaagttttatgttcgagcaccaggaagagtcaacataataggagagcatatagattattgtggatattctgttcttcctatggctgtagaacaagatgtgctaatagctgtagaacctgtgaaaacgtacgctctccaactggccaatacaaatcccttgtatccggacttcagtactagtgctaataacatccagattgataaaaccaagcctttgtggcacaactatttcttatgtggacttaaaggaattcaggaacactttggtcttagtaacctgactggaatgaactgcctggtagatggaaatatcccaccaagttctggcctctccagctccagtgctttggtctgttgtgctggcttggtgacgctcacagtgctgggaaggaatctatccaaggtggaacttgcagaaatctgtgccaagagtgagcgttacattggcactgaaggaggaggcatggaccagtctatatcatttcttgcagaagaaggaactgccaagttgatagaatttagtcctctgagggcaaccgatgtaaaactcccaagtggagcagtgtttgtgattgccaacagttgtgtggagatgaataaggcagcaacttcccatttcaatatcagggtgatggagtgtcggctggctgcgaagctcctggctaaatacaaaagcttgcaatgggacaaagtactgaggctggaggaggtgcaggctaaactagggattagtctagaagaaatgctgttggtcacagaagatgcccttcatcctgaaccctataaccctgaggagatctgcaggtgtctgggaattagcctggaggaactccgaacccaaatcctgagtccaaacactcaagatgtgctcatcttcaaactctatcagcgggcaaagcatgtgtacagcgaggctgcgcgagtgctccagtttaagaagatatgtgaagaagcacctgaaaacatggtccagctgctgggagagttgatgaaccagagccacatgagctgccgggacatgtatgagtgcagctgccccgagctggatcagctggtggacatctgtcggaagtttggggctcaagggtcacgacttactggagcaggatggggaggctgcacagtatcaatggtacctgcggacaagctgcccagctttctagcaaatgtgcacaaagcttattaccagaggagtgatggaagcttagcaccggagaagcaaagtttgtttgctaccaaacctggaggtggggctttggttttgcttgaggcctgaaaaaatgtaaaaagtctgagagaaactacttagggcacttaggaattggcaggactttctgtgccacagtaaattaatcttccttctgttttgtattatgatgaacggttgctattatatcaagatatattttcaaagaaatggttgaaagctctctatgcttcataatgattctttttccatcttaaaatatggttttactattaagagccaagatcatgcttggacagatcttttaagaataacttactgagatttattgatttgaagattttaaagatgaatggtaaaacacactcttaatactgattacatggattggacttgaattaaatatattgtta

SEQ ID NO: 11722 - DNA, 2043 bp, Homo sapiens
tagtcagcttcgcacgtgctctgcgcaggggctcctgcgaggccctagtccctccctgggagctaagagcaggacggaggctgtacctgactgctgcttggagggaaccctggctgagtccagggaggaggagccagaggaggggccgattggaagcagccacctcagcgaagctgcaggatttccgcagggcgggagctgtttatctcccggaagaaaacggctcctgtcacagaagtctcgtgattgctctgggagctttgcttagacacttgaaactacaggagaaagaaggatctagcgaaatatggctacagagagccctgctacgcgtcgggtccaggtggcagaacatcctaggttactgaagctaaaggagatgtttaactccaagtttggatctattcccaagttttatgttcgagcaccaggaagagtcaacataataggagagcatatagattattgtggatattctgttcttcctatggctgtagaacaagatgtgctaatagctgtagaacctgtgaaaacgtacgctctccaactggccaatacaaatcccttgtatccggacttcagtactagtgctaataacatccagattgataaaaccaagcctttgtggcacaactatttcttatgtggacttaaaggaattcaggaacactttggtcttagtaacctgactggaatgaactgcctggtagatggaaatatcccaccaagttctggcctctccagctccagtgctttggtctgttgtgctggcttggtgacgctcacagtgctgggaaggaatctatccaaggtggaacttgcagaaatctgtgccaagagtgagcgttacattggcactgaaggaggaggcatggaccagtctatatcatttcttgcagaagaaggaactgccaagttgatagaatttagtcctctgagggcaaccgatgtaaaactcccaagtggagcagtgtttgtgattgccaacagttgtgtggagatgaataaggcagcaacttcccatttcaatatcagggtgatggagtgtcggctggctgcgaagctcctggctaaatacaaaagcttgcaatgggacaaagtactgaggctggaggaggtgcaggctaaactagggattagtctagaagaaatgctgttggtcacagaagatgcccttcatcctgaaccctataaccctgaggagatctgcaggtgtctgggaattagcctggaggaactccgaacccaaatcctgagtccaaacactcaagatgtgctcatcttcaaactctatcagcgggcaaagcatgtgtacagcgaggctgcgcgagtgctccagtttaagaagatatgtgaagaagcacctgaaaacatggtccagctgctgggagagttgatgaaccagagccacatgagctgccgggacatgtatgagtgcagctgccccgagctggatcagctggtggacatctgtcggaagtttggggctcaagggtcacgacttactggagcaggatggggaggctgcacagtatcaatggtacctgcggacaagctgcccagctttctagcaaatgtgcacaaagcttattaccagaggagtgatggaagcttagcaccggagaagcaaagtttgtttgctaccaaacctggaggtggggctttggttttgcttgaggcctgaaaaaatgtaaaaagtctgagagaaactacttagggcacttaggaattggcaggactttctgtgccacagtaaattaatcttccttctgttttgtattatgatgaacggttgctattatatcaagatatattttcaaagaaatggttgaaagctctctatgcttcataatgattctttttccatcttaaaatatggttttactattaagagccaagatcatgcttggacagatcttttaagaataacttactgagatttattgatttgaagattttaaagatgaatggtaaaacacactcttaatactgattacatggattggacttgaattaaatatattgttacaattaaactgatac

SEQ ID NO: 11723 - DNA, 1728 bp, Homo sapiens
agggtctcactgtgtcatccagagctggagtgcagcggcacagtcatggctcactggaactcaggctcaagcaatcctcccgcctcagccttccaagtaactaggactacaggcatgtgccaccacgcctggtgtctgagatgctgccaccgcagaagaagccctgggagtccatggctaaggggctggtgctgggcgcgctcttcactagtttcctgctgctggtgtactcctatgccgtgcccccgctgcatgccggcctggcctccacgaccccggaggccgcagcgtcctgctctccacctgcactcgagccagaggcagtgatccgggccaacggctcggcgggggagtgccagccgcggcgcaacatcgtgttcttgaagacgcacaagacggccagcagcaccctgctcaacatcctgttccgcttcggccagaagcaccggctcaagttcgccttccctaacggccgcaatgacttcgactacccgaccttcttcgcccgcagcctggtgcaggactatcggcccggggcctgcttcaacatcatctgcaaccacatgcgcttccactacgacgaggtgcgcggcctggtgccgaccaacgccatcttcatcacggtgctccgcgaccccgcccgcttgttcgagtcctccttccactacttcgggccggtggtgcccctcacgtggaagctctcggccggcgacaagctgaccgagttcctgcaagacccggatcgctactacgaccccaacggcttcaatgcccactacctccgaaacctgctcttcttcgacctgggctatgacaacagcctggaccccagcagcccgcaggtgcaggagcacatcctggaggtggagcgtcgcttccacctggtgctccttcaagagtacttcgacgagtcgctggtgctgctgaaggacctgctgtgctgggagctggaggacgtgctctacttcaagctcaacgcccgccgcgactcgcccgtgccgcggctctcgggggagctgtatgggcgcgccaccgcctggaacatgctggactcccacctctaccgccacttcaacgccagcttctggcgcaaggtggaggccttcgggcgggagcgcatggcccgcgaggtggccgccctgcgccatgccaacgagcgcatgcggaccatctgcatcgacgggggccacgccgtggacgccgccgccatccaggacgaggccatgcagccctggcagccgctgggcaccaagtccatcctgggctacaacctcaagaagagcatcgggcagcggcacgcgcagctctgccggcgcatgctcacgcccgagatccagtacctgatggacctcggcgccaacctgtgggtcaccaagctctggaagttcattcgcgatttcctgcggtggtgacgtcccaccgcccagcggcttgcctgcctgctcgctccctgcagaggggctgagcaggacgccgctggtgctggccgcccccagccccctcctggtgccacctcagaccccggggtgagggggggctccctggggggaggcagccagccaagactgggcccatgaacacagagagggcctaaccgagatcagtatttaactaattataccagtttttattaaacccctttccctccccgataaagaatgttctatttctgcctccccttaaaggggagacctcagaagtaaaggaatttgatgttgtgtttttgtt

SEQ ID NO: 11724 - DNA, 1791 bp, Homo sapiens
ggcagcctgggagttggacgtggctcaggcagtgggtagaaaggggcagccagccacagcccgagggtctcactgtgtcatccagagctggagtgcagcggcacagtcatggctcactggaactcaggctcaagcaatcctcccgcctcagccttccaagtaactaggactacaggcatgtgccaccacgcctggtgtctgagatgctgccaccgcagaagaagccctgggagtccatggctaaggggctggtgctgggcgcgctcttcactagtttcctgctgctggtgtactcctatgccgtgcccccgctgcatgccggcctggcctccacgaccccggaggccgcagcgtcctgctctccacctgcactcgagccagaggcagtgatccgggccaacggctcggcgggggagtgccagccgcggcgcaacatcgtgttcttgaagacgcacaagacggccagcagcaccctgctcaacatcctgttccgcttcggccagaagcaccggctcaagttcgccttccctaacggccgcaatgacttcgactacccgaccttcttcgcccgcagcctggtgcaggactatcggcccggggcctgcttcaacatcatctgcaaccacatgcgcttccactacgacgaggtgcgcggcctggtgccgaccaacgccatcttcatcacggtgctccgcgaccccgcccgcttgttcgagtcctccttccactacttcgggccggtggtgcccctcacgtggaagctctcggccggcgacaagctgaccgagttcctgcaagacccggatcgctactacgaccccaacggcttcaatgcccactacctccgaaacctgctcttcttcgacctgggctatgacaacagcctggaccccagcagcccgcaggtgcaggagcacatcctggaggtggagcgtcgcttccacctggtgctccttcaagagtacttcgacgagtcgctggtgctgctgaaggacctgctgtgctgggagctggaggacgtgctctacttcaagctcaacgcccgccgcgactcgcccgtgccgcggctctcgggggagctgtatgggcgcgccaccgcctggaacatgctggactcccacctctaccgccacttcaacgccagcttctggcgcaaggtggaggccttcgggcgggagcgcatggcccgcgaggtggccgccctgcgccatgccaacgagcgcatgcggaccatctgcatcgacgggggccacgccgtggacgccgccgccatccaggacgaggccatgcagccctggcagccgctgggcaccaagtccatcctgggctacaacctcaagaagagcatcgggcagcggcacgcgcagctctgccggcgcatgctcacgcccgagatccagtacctgatggacctcggcgccaacctgtgggtcaccaagctctggaagttcattcgcgatttcctgcggtggtgacgtcccaccgcccagcggcttgcctgcctgctcgctccctgcagaggggctgagcaggacgccgctggtgctggccgcccccagccccctcctggtgccacctcagaccccggggtgagggggggctccctggggggaggcagccagccaagactgggcccatgaacacagagagggcctaaccgagatcagtatttaactaattataccagtttttattaaacccctttccctccccgataaagaatgttctatttctgcctccccttaaaggggagacctcagaagtaaaggaatttgatgttgtgtttttgtt

SEQ ID NO: 11725 - DNA, 1908 bp, Homo sapiens
gaatctttctgtgcccttggatgaaagagctgcttgcttgttggggtccaaagagaggtgaggactggccagagctgtccagtggaggcagaaggcctgggcaacacctgcagggtactggggtgtgccacctgctatccccaggaagcaaactcatgaatattcacaccactggagtgggagggagccagccagcttgctgctgggtgtcattggagcattcctgtctcccagtgatcgcagaggcagcctgggagttggacgtggctcaggcagtgggtagaaaggggcagccagccacagcccgaggtgtctgagatgctgccaccgcagaagaagccctgggagtccatggctaaggggctggtgctgggcgcgctcttcactagtttcctgctgctggtgtactcctatgccgtgcccccgctgcatgccggcctggcctccacgaccccggaggccgcagcgtcctgctctccacctgcactcgagccagaggcagtgatccgggccaacggctcggcgggggagtgccagccgcggcgcaacatcgtgttcttgaagacgcacaagacggccagcagcaccctgctcaacatcctgttccgcttcggccagaagcaccggctcaagttcgccttccctaacggccgcaatgacttcgactacccgaccttcttcgcccgcagcctggtgcaggactatcggcccggggcctgcttcaacatcatctgcaaccacatgcgcttccactacgacgaggtgcgcggcctggtgccgaccaacgccatcttcatcacggtgctccgcgaccccgcccgcttgttcgagtcctccttccactacttcgggccggtggtgcccctcacgtggaagctctcggccggcgacaagctgaccgagttcctgcaagacccggatcgctactacgaccccaacggcttcaatgcccactacctccgaaacctgctcttcttcgacctgggctatgacaacagcctggaccccagcagcccgcaggtgcaggagcacatcctggaggtggagcgtcgcttccacctggtgctccttcaagagtacttcgacgagtcgctggtgctgctgaaggacctgctgtgctgggagctggaggacgtgctctacttcaagctcaacgcccgccgcgactcgcccgtgccgcggctctcgggggagctgtatgggcgcgccaccgcctggaacatgctggactcccacctctaccgccacttcaacgccagcttctggcgcaaggtggaggccttcgggcgggagcgcatggcccgcgaggtggccgccctgcgccatgccaacgagcgcatgcggaccatctgcatcgacgggggccacgccgtggacgccgccgccatccaggacgaggccatgcagccctggcagccgctgggcaccaagtccatcctgggctacaacctcaagaagagcatcgggcagcggcacgcgcagctctgccggcgcatgctcacgcccgagatccagtacctgatggacctcggcgccaacctgtgggtcaccaagctctggaagttcattcgcgatttcctgcggtggtgacgtcccaccgcccagcggcttgcctgcctgctcgctccctgcagaggggctgagcaggacgccgctggtgctggccgcccccagccccctcctggtgccacctcagaccccggggtgagggggggctccctggggggaggcagccagccaagactgggcccatgaacacagagagggcctaaccgagatcagtatttaactaattataccagtttttattaaacccctttccctccccgataaagaatgttctatttctgcctccccttaaaggggagacctcagaagtaaaggaatttgatgttgtgtttttgttaa

SEQ ID NO: 11726 - DNA, 1712 bp, Homo sapiens
aggcctggtggagcggggggcccggccgggtgcgccccgccgcccagtgagcgcccgggcggcgcggcccgggccgagccagccacgctgaggcggaggaggacggggacaaggtgtctgagatgctgccaccgcagaagaagccctgggagtccatggctaaggggctggtgctgggcgcgctcttcactagtttcctgctgctggtgtactcctatgccgtgcccccgctgcatgccggcctggcctccacgaccccggaggccgcagcgtcctgctctccacctgcactcgagccagaggcagtgatccgggccaacggctcggcgggggagtgccagccgcggcgcaacatcgtgttcttgaagacgcacaagacggccagcagcaccctgctcaacatcctgttccgcttcggccagaagcaccggctcaagttcgccttccctaacggccgcaatgacttcgactacccgaccttcttcgcccgcagcctggtgcaggactatcggcccggggcctgcttcaacatcatctgcaaccacatgcgcttccactacgacgaggtgcgcggcctggtgccgaccaacgccatcttcatcacggtgctccgcgaccccgcccgcttgttcgagtcctccttccactacttcgggccggtggtgcccctcacgtggaagctctcggccggcgacaagctgaccgagttcctgcaagacccggatcgctactacgaccccaacggcttcaatgcccactacctccgaaacctgctcttcttcgacctgggctatgacaacagcctggaccccagcagcccgcaggtgcaggagcacatcctggaggtggagcgtcgcttccacctggtgctccttcaagagtacttcgacgagtcgctggtgctgctgaaggacctgctgtgctgggagctggaggacgtgctctacttcaagctcaacgcccgccgcgactcgcccgtgccgcggctctcgggggagctgtatgggcgcgccaccgcctggaacatgctggactcccacctctaccgccacttcaacgccagcttctggcgcaaggtggaggccttcgggcgggagcgcatggcccgcgaggtggccgccctgcgccatgccaacgagcgcatgcggaccatctgcatcgacgggggccacgccgtggacgccgccgccatccaggacgaggccatgcagccctggcagccgctgggcaccaagtccatcctgggctacaacctcaagaagagcatcgggcagcggcacgcgcagctctgccggcgcatgctcacgcccgagatccagtacctgatggacctcggcgccaacctgtgggtcaccaagctctggaagttcattcgcgatttcctgcggtggtgacgtcccaccgcccagcggcttgcctgcctgctcgctccctgcagaggggctgagcaggacgccgctggtgctggccgcccccagccccctcctggtgccacctcagaccccggggtgagggggggctccctggggggaggcagccagccaagactgggcccatgaacacagagagggcctaaccgagatcagtatttaactaattataccagtttttattaaacccctttccctccccgataaagaatgttctatttctgcctccccttaaaggggagacctcagaagtaaaggaatttgatgttgtgtttttgttaa

SEQ ID NO: 11727 - DNA, 1819 bp, Homo sapiens
gcatggaccaggcctggtggagcggggggcccggccgggtgcgccccgccgcccagtgagcgcccgggcggcgcggcccgggccgagccagccacgctgaggcggaggaggacggggacaagggtctcactgtgtcatccagagctggagtgcagcggcacagtcatggctcactggaactcaggctcaagcaatcctcccgcctcagccttccaagtaactaggactacaggtgtctgagatgctgccaccgcagaagaagccctgggagtccatggctaaggggctggtgctgggcgcgctcttcactagtttcctgctgctggtgtactcctatgccgtgcccccgctgcatgccggcctggcctccacgaccccggaggccgcagcgtcctgctctccacctgcactcgagccagaggcagtgatccgggccaacggctcggcgggggagtgccagccgcggcgcaacatcgtgttcttgaagacgcacaagacggccagcagcaccctgctcaacatcctgttccgcttcggccagaagcaccggctcaagttcgccttccctaacggccgcaatgacttcgactacccgaccttcttcgcccgcagcctggtgcaggactatcggcccggggcctgcttcaacatcatctgcaaccacatgcgcttccactacgacgaggtgcgcggcctggtgccgaccaacgccatcttcatcacggtgctccgcgaccccgcccgcttgttcgagtcctccttccactacttcgggccggtggtgcccctcacgtggaagctctcggccggcgacaagctgaccgagttcctgcaagacccggatcgctactacgaccccaacggcttcaatgcccactacctccgaaacctgctcttcttcgacctgggctatgacaacagcctggaccccagcagcccgcaggtgcaggagcacatcctggaggtggagcgtcgcttccacctggtgctccttcaagagtacttcgacgagtcgctggtgctgctgaaggacctgctgtgctgggagctggaggacgtgctctacttcaagctcaacgcccgccgcgactcgcccgtgccgcggctctcgggggagctgtatgggcgcgccaccgcctggaacatgctggactcccacctctaccgccacttcaacgccagcttctggcgcaaggtggaggccttcgggcgggagcgcatggcccgcgaggtggccgccctgcgccatgccaacgagcgcatgcggaccatctgcatcgacgggggccacgccgtggacgccgccgccatccaggacgaggccatgcagccctggcagccgctgggcaccaagtccatcctgggctacaacctcaagaagagcatcgggcagcggcacgcgcagctctgccggcgcatgctcacgcccgagatccagtacctgatggacctcggcgccaacctgtgggtcaccaagctctggaagttcattcgcgatttcctgcggtggtgacgtcccaccgcccagcggcttgcctgcctgctcgctccctgcagaggggctgagcaggacgccgctggtgctggccgcccccagccccctcctggtgccacctcagaccccggggtgagggggggctccctggggggaggcagccagccaagactgggcccatgaacacagagagggcctaaccgagatcagtatttaactaattataccagtttttattaaacccctttccctccccgataaagaatgttctatttctgcctccccttaaaggggagacctcagaagtaaaggaatttgatgttg

SEQ ID NO: 11728 - DNA, 1635 bp, Homo sapiens
actattgcagcctccctgattccagaaggtaccttggtgtctgagatgctgccaccgcagaagaagccctgggagtccatggctaaggggctggtgctgggcgcgctcttcactagtttcctgctgctggtgtactcctatgccgtgcccccgctgcatgccggcctggcctccacgaccccggaggccgcagcgtcctgctctccacctgcactcgagccagaggcagtgatccgggccaacggctcggcgggggagtgccagccgcggcgcaacatcgtgttcttgaagacgcacaagacggccagcagcaccctgctcaacatcctgttccgcttcggccagaagcaccggctcaagttcgccttccctaacggccgcaatgacttcgactacccgaccttcttcgcccgcagcctggtgcaggactatcggcccggggcctgcttcaacatcatctgcaaccacatgcgcttccactacgacgaggtgcgcggcctggtgccgaccaacgccatcttcatcacggtgctccgcgaccccgcccgcttgttcgagtcctccttccactacttcgggccggtggtgcccctcacgtggaagctctcggccggcgacaagctgaccgagttcctgcaagacccggatcgctactacgaccccaacggcttcaatgcccactacctccgaaacctgctcttcttcgacctgggctatgacaacagcctggaccccagcagcccgcaggtgcaggagcacatcctggaggtggagcgtcgcttccacctggtgctccttcaagagtacttcgacgagtcgctggtgctgctgaaggacctgctgtgctgggagctggaggacgtgctctacttcaagctcaacgcccgccgcgactcgcccgtgccgcggctctcgggggagctgtatgggcgcgccaccgcctggaacatgctggactcccacctctaccgccacttcaacgccagcttctggcgcaaggtggaggccttcgggcgggagcgcatggcccgcgaggtggccgccctgcgccatgccaacgagcgcatgcggaccatctgcatcgacgggggccacgccgtggacgccgccgccatccaggacgaggccatgcagccctggcagccgctgggcaccaagtccatcctgggctacaacctcaagaagagcatcgggcagcggcacgcgcagctctgccggcgcatgctcacgcccgagatccagtacctgatggacctcggcgccaacctgtgggtcaccaagctctggaagttcattcgcgatttcctgcggtggtgacgtcccaccgcccagcggcttgcctgcctgctcgctccctgcagaggggctgagcaggacgccgctggtgctggccgcccccagccccctcctggtgccacctcagaccccggggtgagggggggctccctggggggaggcagccagccaagactgggcccatgaacacagagagggcctaaccgagatcagtatttaactaattataccagtttttattaaacccctttccctccccgataaagaatgttctatttctgcctccccttaaaggggagacctcagaagtaaaggaatttgatgttgtgtttttgttaa

SEQ ID NO: 11729 - DNA, 572 bp, Homo sapiens
gatgcacaaatggaattctgggcccggctgcaggctcctgaagggctccttgcttcactttgactgggtgaggaatatggatgagcccttttaggggctccacacgactccaaacagggcagagcaggatggaacacaggtgcccatgggggtcatcaggctggggactgctggaatctccagccttagagcctgttctgggctctctgcaggcgtctgcggttgctgtgtccttggcccaaggatacctggaatctttctgtgcccttggatgaaagagctgcttgcttgttggggtccaaagagaggtgtctgagatgctgccaccgcagaagaagccctgggagtccatggctaaggggctggtgctgggcgcgctcttcactagtttcctgctgctggtgtactcctatgccgtgcccccgctgcatgccggcctggcctccacgaccccggaggccgcagcgtcctgctctccacctgcactcgagccagaggcagtgatccgggccaacggctcggcgggggagtgccagccgcggcgcaacatcgtgttcttgaagacgcacaag

SEQ ID NO: 11730 - DNA, 582 bp, Homo sapiens
acaaatggaattctgggcccggctgcaggctcctgaagggctccttgcttcactttgactgggtgtctgagatgctgccaccgcagaagaagccctgggagtccatggctaaggggctggtgctgggcgcgctcttcactagtttcctgctgctggtgtactcctatgccgtgcccccgctgcatgccggcctggcctccacgaccccggaggccgcagcgtcctgctctccacctgcactcgagccagaggcagtgatccgggccaacggctcggcgggggagtgccagccgcggcgcaacatcgtgttcttgaagacgcacaagacggccagcagcaccctgctcaacatcctgttccgcttcggccagaagcaccggctcaagttcgccttccctaacggccgcaatgacttcgactacccgaccttcttcgcccgcagcctggtgcaggactatcggcccggggcctgcttcaacatcatctgcaaccacatgcgcttccactacgacgaggtgcgcggcctggtgccgaccaacgccatcttcatcacggtgctccgcgaccccgcccgcttgttcg

SEQ ID NO: 11731 - DNA, 656 bp, Homo sapiens
attcctgtctcccagtgatcgcagaggcagcctgggagttggacgtggctcaggcagtgggtagaaaggggcagccagccacagcccgagggtctcactgtgtcatccagagctggagtgcagcggcacagtcatggctcactggaactcaggctcaagcaatcctcccgcctcagccttccaagtaactaggactacaggtgtctgagatgctgccaccgcagaagaagccctgggagtccatggctaaggggctggtgctgggcgcgctcttcactagtttcctgctgctggtgtactcctatgccgtgcccccgctgcatgccggcctggcctccacgaccccggaggccgcagcgtcctgctctccacctgcactcgagccagaggcagtgatccgggccaacggctcggcgggggagtgccagccgcggcgcaacatcgtgttcttgaagacgcacaagacggccagcagcaccctgctcaacatcctgttccgcttcggccagaagcaccggctcaagttcgccttccctaacggccgcaatgacttcgactacccgaccttcttcgcccgcagcctggtgcaggactatcggcccggggcctgcttcaacatcatctgcaaccacatgcgcttccactacgacgaggtg

SEQ ID NO: 11732 - DNA, 563 bp, Homo sapiens
tcctgaagggctccttgcttcactttgactgggtgaggaatatggatgagcccttttaggggctccacacgactccaaacagggcagagcaggatggaacacaggtgcccatgggggtcatcaggctggggactgctggaatctccagggtctcactgtgtcatccagagctggagtgcagcggcacagtcatggctcactggaactcaggctcaagcaatcctcccgcctcagccttccaagtaactaggactacaggtgtctgagatgctgccaccgcagaagaagccctgggagtccatggctaaggggctggtgctgggcgcgctcttcactagtttcctgctgctggtgtactcctatgccgtgcccccgctgcatgccggcctggcctccacgaccccggaggccgcagcgtcctgctctccacctgcactcgagccagaggcagtgatccgggccaacggctcggcgggggagtgccagccgcggcgcaacatcgtgttcttgaagacgcacaagacggccagcagcaccctgctcaacatcctgttccgcttcgg

SEQ ID NO: 11733 - DNA, 553 bp, Homo sapiens
agtgatcgcagaggcagcctgggagttggacgtggctcaggcagtgggtagaaaggggcagccagccacagcccgaggatgctaaataaacctgcgctttgactgagacctgtcacgtgaggtcagggtctcactgtgtcatccagagctggagtgcagcggcacagtcatggctcactggaactcaggctcaagcaatcctcccgcctcagccttccaagtaactaggactacaggtgtctgagatgctgccaccgcagaagaagccctgggagtccatggctaaggggctggtgctgggcgcgctcttcactagtttcctgctgctggtgtactcctatgccgtgcccccgctgcatgccggcctggcctccacgaccccggaggccgcagcgtcctgctctccacctgcactcgagccagaggcagtgatccgggccaacggctcggcgggggagtgccagccgcggcgcaacatcgtgttcttgaagacgcacaagacggccagcagcaccctgctcaacatcctgttccgcttcggccagaagcaccg

SEQ ID NO: 11734 - DNA, 755 bp, Homo sapiens
gattccagaaggtaccttgggtctcactgtgtcatccagagctggagtgcagcggcacagtcatggctcactggaactcaggctcaagcaatcctcccgcctcagccttccaagtaactaggactacaggcatgtgccaccacgcctggtgtctgagatgctgccaccgcagaagaagccctgggagtccatggctaaggggctggtgctgggcgcgctcttcactagtttcctgctgctggtgtactcctatgccgtgcccccgctgcatgccggcctggcctccacgaccccggaggccgcagcgtcctgctctccacctgcactcgagccagaggcagtgatccgggccaacggctcggcgggggagtgccagccgcggcgcaacatcgtgttcttgaagacgcacaagacggccagcagcaccctgctcaacatcctgttccgcttcggccagaagcaccggctcaagttcgccttccctaacggccgcaatgacttcgactacccgaccttcttcgcccgcagcctggtgcaggactatcggcccggggcctgcttcaacatcatctgcaaccacatgcgcttccactacgacgaggtgcgcggcctggtgccgaccaacgccatcttcatcacggtgctccgcgaccccgcccgcttgttcgagtcctccttccactacttcgggccggtggtgcccctcacgtggaagctctcggccggcgacaagctgaccgagttcctgcaagacc

SEQ ID NO: 11735 - DNA, 894 bp, Homo sapiens
cctagagagaaggcgactctggtctgccttgtggcagtttaagctctggtgtctgagatgctgccaccgcagaagaagccctgggagtccatggctaaggggctggtgctgggcgcgctcttcactagtttcctgctgctggtgtactcctatgccgtgcccccgctgcatgccggcctggcctccacgaccccggaggccgcagcgtcctgctctccacctgcactcgagccagaggcagtgatccgggccaacggctcggcgggggagtgccagccgcggcgcaacatcgtgttcttgaagacgcacaagacggccagcagcaccctgctcaacatcctgttccgcttcggccagaagcaccggctcaagttcgccttccctaacggccgcaatgacttcgactacccgaccttcttcgcccgcagcctggtgcaggactatcggcccggggcctgcttcaacatcatctgcaaccacatgcgcttccactacgacgaggtgcgcggcctggtgccgaccaacgccatcttcatcacggtgctccgcgaccccgcccgcttgttcgagtcctccttccactacttcgggccggtggtgcccctcacgtggaagctctcggccggcgacaagctgaccgagttcctgcaagacccggatcgctactacgaccccaacggcttcaatgcccactacctccgaaacctgctcttcttcgacctgggctatgacaacagcctggaccccagcagcccgcaggtgcaggagcacatcctggaggtggagcgtcgcttccacctggtgctccttcaagagtacttcgacgagtcgctggtgctgctgaaggacctgctgtgctgggagctggaggacgtgctctacttcaagctcaac

SEQ ID NO: 11736 - DNA, 1425 bp, Homo sapiens
gaagggctccttgcttcactttgactgggtgaggaatatggatgagcccttttaggggctccacacgactccaaacagggcagagcaggatggaacacaggtgcccatgggggtcatcaggctggggactgctggaatctccaggtgtctgagatgctgccaccgcagaagaagccctgggagtccatggctaaggggctggtgctgggcgcgctcttcactagtttcctgctgctggtgtactcctatgccgtgcccccgctgcatgccggcctggcctccacgaccccggaggccgcagcgtcctgctctccacctgcactcgagccagaggcagtgatccgggccaacggctcggcgggggagtgccagccgcggcgcaacatcgtgttcttgaagacgcacaagacggccagcagcaccctgctcaacatcctgttccgcttcggccagaagcaccggctcaagttcgccttccctaacggccgcaatgacttcgactacccgaccttcttcgcccgcagcctggtgcaggactatcggcccggggcctgcttcaacatcatctgcaaccacatgcgcttccactacgacgaggtgcgcggcctggtgccgaccaacgccatcttcatcacggtgctccgcgaccccgcccgcttgttcgagtcctccttccactacttcgggccggtggtgcccctcacgtggaagctctcggccggcgacaagctgaccgagttcctgcaagacccggatcgctactacgaccccaacggcttcaatgcccactacctccgaaacctgctcttcttcgacctgggctatgacaacagcctggaccccagcagcccgcaggtgcaggagcacatcctggaggtggagcgtcgcttccacctggtgctccttcaagagtacttcgacgagtcgctggtgctgctgaaggacctgctgtgctgggagctggaggacgtgctctacttcaagctcaacgcccgccgcgactcgcccgtgccgcggctctcgggggagctgtatgggcgcgccaccgcctggaacatgctggactcccacctctaccgccacttcaacgccagcttctggcgcaaggtggaggccttcgggcgggagcgcatggcccgcgaggtggccgccctgcgccatgccaacgagcgcatgcggaccatctgcatcgacgggggccacgccgtggacgccgccgccatccaggacgaggccatgcagccctggcagccgctgggcaccaagtccatcctgggctacaacctcaagaagagcatcgggcagcggcacgcgcagctctgccggcgcatgctcacgcccgagatccagtacctgatggacctcggcgccaacctgtgggtcaccaagctctggaagttcattcgcgatttcctgcggtggtga

SEQ ID NO: 11737 - DNA, 584 bp, Homo sapiens
gaagggctccttgcttcactttgactgggtgaggaatatggatgagcccttttaggggctccacacgactccaaacagggcagagcaggatggaacacaggtgcccatgggggtcatcaggctggggactgctggaatctccaggtgtctgagatgctgccaccgcagaagaagccctgggagtccatggctaaggggctggtgctgggcgcgctcttcactagtttcctgctgctggtgtactcctatgccgtgcccccgctgcatgccggcctggcctccacgaccccggaggccgcagcgtcctgctctccacctgcactcgagccagaggcagtgatccgggccaacggctcggcgggggagtgccagccgcggcgcaacatcgtgttcttgaagacgcacaagacggccagcagcaccctgctcaacatcctgttccgcttcggccagaagcaccggctcaagttcgccttccctaacggccgcaatgacttcgactacccgaccttcttcgcccgcagcctggtgcaggactatcggcccggggcctgcttcaacatcatctgcaaccacatgcgctt

SEQ ID NO: 11738 - DNA, 567 bp, Homo sapiens
ggaattctgggcccggctgcaggctcctgaagggctccttgcttcactttgactgggtgaggaatatggatgagcccttttaggggctccacacgactccaaacagggcagagcaggatggaacacaggtgcccatgggggtcatcaggctggggactgctggaatctccaggatgctaaataaacctgcgctttgactgagacctgtcacgtgaggtcagggtctcactgtgtcatccagagctggagtgcagcggcacagtcatggctcactggaactcaggctcaagcaatcctcccgcctcagccttccaagtaactaggactacaggtgtctgagatgctgccaccgcagaagaagccctgggagtccatggctaaggggctggtgctgggcgcgctcttcactagtttcctgctgctggtgtactcctatgccgtgcccccgctgcatgccggcctggcctccacgaccccggaggccgcagcgtcctgctctccacctgcactcgagccagaggcagtgatccgggccaacggctcggcgggggagtgccagccgcggcg

SEQ ID NO: 11739 - DNA, 567 bp, Homo sapiens
gattccagaaggtaccttgaaaagttctccagagaatggctaggggcgcctccagctttctcattttacagatgaaaaactgagactccatgagggttcttggcttgtctgaaatcacagtgctggattgaaacacaggcttgagggtcccagagcctgagggtctcactgtgtcatccagagctggagtgcagcggcacagtcatggctcactggaactcaggctcaagcaatcctcccgcctcagccttccaagtaactaggactacaggtgtctgagatgctgccaccgcagaagaagccctgggagtccatggctaaggggctggtgctgggcgcgctcttcactagtttcctgctgctggtgtactcctatgccgtgcccccgctgcatgccggcctggcctccacgaccccggaggccgcagcgtcctgctctccacctgcactcgagccagaggcagtgatccgggccaacggctcggcgggggagtgccagccgcggcgcaacatcgtgttcttgaagacgcacaagacggccagcagcaccctgctcaacatcctgtt

SEQ ID NO: 11740 - DNA, 575 bp, Homo sapiens
gatgcacaaatggaattctgggcccggctgcaggctcctgaagggctccttgcttcactttgactggccttagagcctgttctgggctctctgcaggcgtctgcggttgctgtgtccttggcccaaggatacctggaatctttctgtgcccttggatgaaagagctgcttgcttgttggggtccaaagagaggatgctaaataaacctgcgctttgactgagacctgtcacgtgaggtcagggtctcactgtgtcatccagagctggagtgcagcggcacagtcatggctcactggaactcaggctcaagcaatcctcccgcctcagccttccaagtaactaggactacaggtgtctgagatgctgccaccgcagaagaagccctgggagtccatggctaaggggctggtgctgggcgcgctcttcactagtttcctgctgctggtgtactcctatgccgtgcccccgctgcatgccggcctggcctccacgaccccggaggccgcagcgtcctgctctccacctgcactcgagccagaggcagtgatccgggccaacggctcggcgggggagtg

SEQ ID NO: 11741 - DNA, 882 bp, Homo sapiens
actattgcagcctccctgattccagaaggtaccttgggtctcactgtgtcatccagagctggagtgcagcggcacagtcatggctcactggaactcaggctcaagcaatcctcccgcctcagccttccaagtaactaggactacaggtgtctgagatgctgccaccgcagaagaagccctgggagtccatggctaaggggctggtgctgggcgcgctcttcactagtttcctgctgctggtgtactcctatgccgtgcccccgctgcatgccggcctggcctccacgaccccggaggccgcagcgtcctgctctccacctgcactcgagccagaggcagtgatccgggccaacggctcggcgggggagtgccagccgcggcgcaacatcgtgttcttgaagacgcacaagacggccagcagcaccctgctcaacatcctgttccgcttcggccagaagcaccggctcaagttcgccttccctaacggccgcaatgacttcgactacccgaccttcttcgcccgcagcctggtgcaggactatcggcccggggcctgcttcaacatcatctgcaaccacatgcgcttccactacgacgaggtgcgcggcctggtgccgaccaacgccatcttcatcacggtgctccgcgaccccgcccgcttgttcgagtcctccttccactacttcgggccggtggtgcccctcacgtggaagctctcggccggcgacaagctgaccgagttcctgcaagacccggatcgctactacgaccccaacggcttcaatgcccactacctccgaaacctgctcttcttcgacctgggctatgacaacagcctggaccccagcagcccgcaggtgcaggagcacatcctggaggtgg

SEQ ID NO: 11742 - DNA, 639 bp, Homo sapiens
tcagccagcttaaaaattaaaaggagtggaaagtttggggccctggttctctacccggttcattttaatttttaaattttaaccttctccctgccccattccccaacctctctttgagttgcttcacccaccgtctctgcaaccctggggctgtctctttccaggtggttgtcagtctatctctccagtgcctctctgtccctgtctggaccctgctggggggccacagagcaggcaaaggcagggctcaactgccaggcctgggcagccttgggggctccctggggccagcttcctgacacttgccctactctgtgctgcccctgcaggtgtctgagatgctgccaccgcagaagaagccctgggagtccatggctaaggggctggtgctgggcgcgctcttcactagtttcctgctgctggtgtactcctatgccgtgcccccgctgcatgccggcctggcctccacgaccccggaggccgcagcgtcctgctctccacctgcactcgagccagaggcagtgatccgggccaacggctcggcgggggagtgccagccgcggcgcaacatcgtgttcttgaagacgcacaagacggccagcagcaccctgctcaacatcctgttccgcttcggccaga

SEQ ID NO: 11743 - DNA, 1370 bp, Homo sapiens
tcacctgccccacagccgcaccctgcctgtgcctgcaccctggggagcccagagccggcaggggccgaggcggtgggacctcgggggagctcaagcctcgactgtcccctcgctggaggccagaggccaagatgatgtccatgctgggcggcttgcagagatacttccgggtcatcctcctcctcctcctggccctgactctgctcctgctggccggattcctgcactcggacttagagctggacacacccctgtttgggggccaggctgaggggccgccggtcaccaacatcatgttcctgaagacgcacaagacggccagcagcacggtgctcaacatcctctaccgcttcgccgagacccacaacctgtccgtggcgctgcccgccggctcacgcgtccacctgggctacccctggctcttcctggcgcgctacgtggaaggcgtggggtcgcagcagcgcttcaacatcatgtgcaaccacctgaggttcaacctgcctcaggtgcagaaagtcatgcccaacgacaccttctacttctccatcctgaggaaccccgtgttccagctggagtcctccttcatctactacaaaacctacgcccccgccttccggggcgccccgagcctggacgcgttcctggcctcgccgcggacgttctacaacgacagccgccacctcaggaacgtctacgccaagaacaacatgtggttcgacttcggcttcgaccccaacgcgcagtgcgaggagggctacgtgcgcgcgcgcatcgccgaggtggagcggcgcttccggctggtgctcatcgccgagcacctggacgagtccctggtgctgctgcggcgccggctgcgctgggcgctggacgacgtggtggccttcaggctcaactcccgcagcgcgcgctccgtggcccgcctgtcgcccgagacccgggagcgcgcgcggagctggtgcgcgctggactggcgcctgtacgagcatttcaaccgcaccctctgggcgcagctgcgcgccgagctggggccgcggcggctgcgcggggaggtggagcggctgcgcgcccggaggcgcgaactcgcgagcctgtgcctgcaggacggcggcgcgctcaagaaccacacgcagatcagagacccgcgcctgcgcccctaccagtccggcaaggccgacatcctgggttacaacctccggccgggcctggacaaccagacgctgggcgtgtgccagaggcttgtgatgcctgagctccagtacatggcccgcctgtacgccctgcagttcccggagaagcccctcaagaacatcccgttcctgggggcgtagaggggccgggccggggacgaggcctcctgcggacaccagctc

SEQ ID NO: 11744 - DNA, 2133 bp, Homo sapiens
ctagcggacgctgccacctgatcccatccaggcgctgagaggcaagccaccggcactcggcgcgcagggccccgggcaccctcggaccccgtgcggatttcgagacaagggtccagagatagcggcggccgcccccaacccgggccagaggcagagcccaggcgtgcggtgcttctcgggaacactggccctgctaccagagccgcaggatcccccatgagtgcctgtgaagggagtcctggatagtgaggccctggctggtccaggggtgggtactccgccatgccacccatcctccagcgcctgcagcaggccaccaagatgatgagccgccggaaaatcctgctgctggtgctagggtgcagcaccgtaagccttctcatccaccagggggcgcagctcagctggtaccccaagctgttccccttgagctgccctcctctgcggaactcgccgccgcgccccaagcacatgactgtggccttcctgaagactcacaagacggcaggcacgacggtgcagaacatcctgtttcgctttgccgagcgccacaacctgacggtggccctgccgcacccgagctgcgagcaccagttctgctacccccgcaacttctcggcgcacttcgtgcacccggccacgcggccgccgcacgtgctggccagccacctgcgcttcgaccgtgcggagctggagcgcctcatgccgcccagcaccgtctatgtcaccatcctgcgcgagccggccgccatgttcgagtcgctcttcagctactacaaccagtactgcccggccttccggcgcgtacccaacgcctcgctcgaggccttcctgcgcgcgcccgaggcatactaccgcgctggcgagcacttcgccatgttcgcacacaacacgctggcctacgacctgggcggcgacaatgagcgcagcccgcgcgacgacgccgcctacctggcgggcctcatccgccaggtggaggaggttttctcgctcgtcatgatcgccgagtacttcgacgagtcgctagtgctgctgcggcgcctactggcctgggacctggacgacgtgctctacgccaagctcaacgcgcgcgccgccagctcgcgcctggccgccatccccgcggcgctggcgcgggcggcgcgcacctggaacgccctggacgccggcctctacgaccacttcaacgccaccttctggcgccacgtggcgcgcgcgggccgcgcgtgcgtggagcgcgaggcgcgcgagctgcgcgaggcccgccagcgcctactgcggcgctgcttcggggacgagccactgctgcggcctgccgcgcagatccgcaccaagcagctgcagccgtggcagcccagccgcaaggtggacattatgggctatgacctgcccggcggcggcgccggcccggccaccgaggcctgcctcaagctggccatgcccgaggtccagtactcgaactacctgttgcgcaagcagaagcgccggggcggtgcgcgggctcggcccgagcccgtcctggacaatcccccgcctcggcccatccgagtgctgcctcgcggccctcaaggtccctgagctccgcaggcctccaggagtatgggtcctgccctgccctcccaggagtccagccaggggctgcctccatgtcctgcccccatgagagccctttcttttcaaggggcttgagtccctcgctgaactttggggtacgcctccctatctgagcccccgctcccgatcgtgggctgaaccttgccttcgggcacggcgctgataggctggatccagcgctgggccaccctctccttcccagctggttggtgattttgacaagaggcctgagggctgtccagaactgctcaccctgcctttttctgggggctgagcccccacaacctgtcttttccaagtggataagcccaggccccatggagagaggctcagccctagggaaaggctgctcttgctctccctcccagggcttgaggctccctatacttttctgtcttccaggttctaccctccccacagacctaagctgctcccagtctcccagaaccaagagttcttgggttgggatttttgtttggttggtttttcttttttttaataaaacatctttaaaatgtg

SEQ ID NO: 11745 - DNA, 1599 bp, Homo sapiens
atcccatctcctctgcccactgcaaacccgtctgccttcttctgccaggcttctcgggaacactggccctgctaccagagccgcaggatcccccatgagtgcctgtgaagggagtcctggatagtgaggccctggctggtccaggggtgggtactccgccatgccacccatcctccagcgcctgcagcaggccaccaagatgatgagccgccggaaaatcctgctgctggtgctagggtgcagcaccgtaagccttctcatccaccagggggcgcagctcagctggtaccccaagctgttccccttgagctgccctcctctgcggaactcgccgccgcgccccaagcacatgactgtggccttcctgaagactcacaagacggcaggcacgacggtgcagaacatcctgtttcgctttgccgagcgccacaacctgacggtggccctgccgcacccgagctgcgagcaccagttctgctacccccgcaacttctcggcgcacttcgtgcacccggccacgcggccgccgcacgtgctggccagccacctgcgcttcgaccgtgcggagctggagcgcctcatgccgcccagcaccgtctatgtcaccatcctgcgcgagccggccgccatgttcgagtcgctcttcagctactacaaccagtactgcccggccttccggcgcgtacccaacgcctcgctcgaggccttcctgcgcgcgcccgaggcatactaccgcgctggcgagcacttcgccatgttcgcacacaacacgctggcctacgacctgggcggcgacaatgagcgcagcccgcgcgacgacgccgcctacctggcgggcctcatccgccaggtggaggaggttttctcgctcgtcatgatcgccgagtacttcgacgagtcgctagtgctgctgcggcgcctactggcctgggacctggacgacgtgctctacgccaagctcaacgcgcgcgccgccagctcgcgcctggccgccatccccgcggcgctggcgcgggcggcgcgcacctggaacgccctggacgccggcctctacgaccacttcaacgccaccttctggcgccacgtggcgcgcgcgggccgcgcgtgcgtggagcgcgaggcgcgcgagctgcgcgaggcccgccagcgcctactgcggcgctgcttcggggacgagccactgctgcggcctgccgcgcagatccgcaccaagcagctgcagccgtggcagcccagccgcaaggtggacattatgggctatgacctgcccggcggcggcgccggcccggccaccgaggcctgcctcaagctggccatgcccgaggtccagtactcgaactacctgttgcgcaagcagaagcgccggggcggtgcgcgggctcggcccgagcccgtcctggacaatcccccgcctcggcccatccgagtgctgcctcgcggccctcaaggtccctgagctccgcaggcctccaggagtatgggtcctgccctgccctcccaggagtccagccaggggctgcctccatgtcctgcccccatgagagccctttcttttcaaggggcttgagtccctcgctgaactttggggtacgcctccct

SEQ ID NO: 11746 - DNA, 2537 bp, Homo sapiens
gaggggaagatgcagcgagggagagacctagaaccgcgatcaaagctgcagcagctgctggggctggcggcacaaagggaggagggaggagcctgggcgctgagaaagttcttggggaaagttgagctgagccaagagtcgggcggtggctgggatgggcgggagggcccggcccgatttcccttgctgctccccttgtggcctgacgctgacagaggcaaaaatctgctaactcagggggcagactcaaccaagactgtgagcaggcctggggaatgaccccccgatctccaaccagtgccttccgcagctgcacggctgtctccagctgtctctgcccctcttcctggccctggctccatctctctgtcacctcacccttccctgtgccacatgggccctctctctcctgccaggacgctgcggctctggggacctcggagcctgggggtggctctgggagtcttcatgaccattggctttgcactccagctcttgggagggcccttccagaggaggctacctgggctacagctccgacagccctcggccccatccctacgaccagcccttccgtcctgcccaccccggcagcgactggtgttcctgaagacacataaatccgggagcagctctgtgctgagcctgcttcaccgctatggggaccagcacgggctgcgcttcgccctccctgcccgctaccagtttggctacccaaagctcttccaggcctctagggtaaaaggctaccgcccacagggtggaggcacccagctccccttccacatcctctgtcaccacatgaggttcaacctgaaagaggtacttcaggtcatgccttctgacagcttctttttttccattgtccgagacccagcggctctggctcgctctgccttctcctactataaatccacctcatcagccttccgcaagtcaccatctttggctgccttcctggccaatcctcgaggcttctacaggcctggggcccgtggggaccactacgctcgcaacttactatggtttgactttggcctgccctttcccccagagaagagggccaagagagggaatattcatccccccagagaccccaaccccccacagctgcaggtcttgccttctggtgctggccctcgagcccaaaccctcaatcccaatgccctcatccatcctgtttccactgttactgatcatcgcagccagatatcaagccctgcctctttcgatttggggtcttcatccttcatccagtggggtctggcatggctggactctgtctttgacctggtcatggtggctgagtacttcgatgagtcattggttctgctggcagatgccctgtgctggggtctagatgacgtggtgggcttcatgcacaatgcccaggctggacataagcagggcctcagcactgtcagcaacagtggactgactgcggaggaccggcagctgactgcacgggcccgagcctggaacaacctggactgggctctctatgtccacttcaaccgcagtctctgggcacggatagagaaatacggccagggccggctgcagacagctgtggccgagctccgggctcgccgagaggccctagcgaaacattgtctggtagggggtgaggcttctgaccccaaatacatcactgatcgccggttccgccccttccagtttgggtcagctaaggttttgggctatatacttcggagtggattgagcccccaagaccaagaggaatgtgagcgcctagctacccctgagctccagtacaaggacaagctggatgccaagcagttcccccctaccgtctcactgcccctcaagacttcaaggccactctccccataaacatcagactacagatttaggtggaagagcagccatgtttgaagggcacatgtgatgagtggggggcagcaagatgccatttctgcatctcccagaagggatgagtctttgtcccgatgcaagccccctcttcgctgggctcccagcagtgcttccctcctccaccctccactcattttgttctttccccccaactttttttttttttgaaacggagtcttgctctgtcccccaggctggagtgcagtggcatgatctcggctcactgcaacctctgcctcccaggttcaagcgattctcctgcctcagcctccagagtagctaggattacagatacgtgccaccatacccggctaatttttatatttttagagacagggattcaacatgttggttaggctggtcttgaactcctcacctcaggtgatccacatgactctgcctcccaaagtgctgccattacaggcgtgagccactaggcctgacctccccttcccctttcctgccccaaggcagatccacatcaccgaagctccctagaggggcaaaagatggagtgagccacaggaagtttggggcgtggtgagttggaatgatacgtccatttctctatgaaatatttgctactagactgttcatttctctctgacatgtttgttgaatgaataaataatttgaaactt

SEQ ID NO: 11747 - DNA, 2334 bp, Homo sapiens
gacgctgacagaggcaaaaatctgctaactcagggggcagactcaaccaagactgtgagcaggcctggggaatgaccccccgatctccaaccagtgccttccgcagctgcacggctgtctccagctgtctctgcccctcttcctggccctggctccatctctctgtcacctcacccttccctgtgccacatgggccctctctctcctgccaggacgctgcggctctggggacctcggagcctgggggtggctctgggagtcttcatgaccattggctttgcactccagctcttgggagggcccttccagaggaggctacctgggctacagctccgacagccctcggccccatccctacgaccagcccttccgtcctgcccaccccggcagcgactggtgttcctgaagacacataaatccgggagcagctctgtgctgagcctgcttcaccgctatggggaccagcacgggctgcgcttcgccctccctgcccgctaccagtttggctacccaaagctcttccaggcctctagggtaaaaggctaccgcccacagggtggaggcacccagctccccttccacatcctctgtcaccacatgaggttcaacctgaaagaggtacttcaggtcatgccttctgacagcttctttttttccattgtccgagacccagcggctctggctcgctctgccttctcctactataaatccacctcatcagccttccgcaagtcaccatctttggctgccttcctggccaatcctcgaggcttctacaggcctggggcccgtggggaccactacgctcgcaacttactatggtttgactttggcctgccctttcccccagagaagagggccaagagagggaatattcatccccccagagaccccaaccccccacagctgcaggtcttgccttctggtgctggccctcgagcccaaaccctcaatcccaatgccctcatccatcctgtttccactgttactgatcatcgcagccagatatcaagccctgcctctttcgatttggggtcttcatccttcatccagtggggtctggcatggctggactctgtctttgacctggtcatggtggctgagtacttcgatgagtcattggttctgctggcagatgccctgtgctggggtctagatgacgtggtgggcttcatgcacaatgcccaggctggacataagcagggcctcagcactgtcagcaacagtggactgactgcggaggaccggcagctgactgcacgggcccgagcctggaacaacctggactgggctctctatgtccacttcaaccgcagtctctgggcacggatagagaaatacggccagggccggctgcagacagctgtggccgagctccgggctcgccgagaggccctagcgaaacattgtctggtagggggtgaggcttctgaccccaaatacatcactgatcgccggttccgccccttccagtttgggtcagctaaggttttgggctatatacttcggagtggattgagcccccaagaccaagaggaatgtgagcgcctagctacccctgagctccagtacaaggacaagctggatgccaagcagttcccccctaccgtctcactgcccctcaagacttcaaggccactctccccataaacatcagactacagatttaggtggaagagcagccatgtttgaagggcacatgtgatgagtggggggcagcaagatgccatttctgcatctcccagaagggatgagtctttgtcccgatgcaagccccctcttcgctgggctcccagcagtgcttccctcctccaccctccactcattttgttctttccccccaactttttttttttttgaaacggagtcttgctctgtcccccaggctggagtgcagtggcatgatctcggctcactgcaacctctgcctcccaggttcaagcgattctcctgcctcagcctccagagtagctaggattacagatacgtgccaccatacccggctaatttttatatttttagagacagggattcaacatgttggttaggctggtcttgaactcctcacctcaggtgatccacatgactctgcctcccaaagtgctgccattacaggcgtgagccactaggcctgacctccccttcccctttcctgccccaaggcagatccacatcaccgaagctccctagaggggcaaaagatggagtgagccacaggaagtttggggcgtggtgagttggaatgatacgtccatttctctatgaaatatttgctactagactgttcatttctctctgacatgtttgttgaatgaataaataatttgaaacttc

SEQ ID NO: 11748 - DNA, 1404 bp, Homo sapiens
gtgagcaggcctggggaatgaccccccgatctccaaccagtgccttccgcagctgcacggctgtctccagctgtctctgcccctcttcctggccctggctccatctctctgtcacctcacccttccctgtgccacatgggccctctctctcctgccaggacgctgcggctctggggacctcggagcctgggggtggctctgggagtcttcatgaccattggctttgcactccagctcttgggagggcccttccagaggaggtacttcaggtcatgccttctgacagcttctttttttccattgtccgagacccagcggctctggctcgctctgccttctcctactataaatccacctcatcagccttccgcaagtcaccatctttggctgccttcctggccaatcctcgaggcttctacaggcctggggcccgtggggaccactacgctcgcaacttactatggtttgactttggcctgccctttcccccagagaagagggccaagagagggaatattcatccccccagagaccccaaccccccacagctgcaggtcttgccttctggtgctggccctcgagcccaaaccctcaatcccaatgccctcatccatcctgtttccactgttactgatcatcgcagccagatatcaagccctgcctctttcgatttggggtcttcatccttcatccagtggggtctggcatggctggactctgtctttgacctggtcatggtggctgagtacttcgatgagtcattggttctgctggcagatgccctgtgctggggtctagatgacgtggtgggcttcatgcacaatgcccaggctggacataagcagggcctcagcactgtcagcaacagtggactgactgcggaggaccggcagctgactgcacgggcccgagcctggaacaacctggactgggctctctatgtccacttcaaccgcagtctctgggcacggatagagaaatacggccagggccggctgcagacagctgtggccgagctccgggctcgccgagaggccctagcgaaacattgtctggtagggggtgaggcttctgaccccaaatacatcactgatcgccggttccgccccttccagtttgggtcagctaaggttttgggctatatacttcggagtggattgagcccccaagaccaagaggaatgtgagcgcctagctacccctgagctccagtacaaggacaagctggatgccaagcagttcccccctaccgtctcactgcccctcaagacttcaaggccactctccccataaacatcagactacagatttaggtggaagagcagccatgtttgaagggcacatgtgatgagtggggggcagcaagatgccatttctgcatctcccagaagggatgagtctttgt

SEQ ID NO: 11749 - DNA, 2018 bp, Homo sapiens
agtcaagtgacgcgaagcggccggcctgggcgccgactgcagagccgggaggctggtggtcatgccggggttcctggttcgcatcctccctctgttgctggttctgctgcttctgggccctacgcgcggcttgcgcaatgccacccagaggatgtttgaaattgactatagccgggactccttcctcaaggatggccagccatttcgctacatctcaggaagcattcactactcccgtgtgccccgcttctactggaaggaccggctgctgaagatgaagatggctgggctgaacgccatccagacattacctggcagctgtggacaagtggttgggagtccttctgcccaagatgaagcctctcctctatcagaatggagggccagttataacagtgcaggcagcaacatcacagatgctttcctaagccagaggaagtgtgagcccaaaggacccttgatcaattctgaattctatactggctggctagatcactggggccaacctcactccacaatcaagaccgaagcagtggcttcctccctctatgatatacttgcccgtggggcgagtgtgaacttgtacatgtttataggtgggaccaattttgcctattggaatggggccaactcaccctatgcagcacagcccaccagctacgactatgatgccccactgagtgaggctggggacctcactgagaagtattttgctctgcgaaacatcatccagaagtttgaaaaagtaccagaaggtcctatccctccatctacaccaaagtttgcatatggaaaggtcactttggaaaagttaaagacagtgggagcagctctggacattctgtgtccctctgggcccatcaaaagcctttatcccttgacatttatccaggtgaaacagcattatgggtttgtgctgtaccggacaacacttcctcaagattgcagcaacccagcacctctctcttcacccctcaatggagtccacgatcgagcatatgttgctgtggatgggatcccccagggagtccttgagcgaaacaatgtgatcactctgaacataacagggaaagctggagccactctggaccttctggtagagaacatgggacgtgtgaactatggtgcatatatcaacgattttaagggtttggtttctaacctgactctcagttccaatatcctcacggactggacgatctttccactggacactgaggatgcagtgtgcagccacctggggggctggggacaccgtgacagtggccaccatgatgaagcctgggcccacaactcatccaactacacgctcccggccttttatatggggaacttctccattcccagtgggatcccagacttgccccaggacacctttatccagtttcctggatggaccaagggccaggtctggattaatggctttaaccttggccgctattggccagcccggggccctcagttgaccttgtttgtgccccagcacatcctgatgacctcggccccaaacaccatcaccgtgctggaactggagtgggcaccctgcagcagtgatgatccagaactatgtgctgtgacgttcgtggacaggccagttattggctcatctgtgacctacgatcatccctccaaacctgttgaaaaaagactcatgcccccacccccgcaaaaaaacaaagattcatggctggaccatgtatgatgatgaaagcctgtgtctttgagggattctaccctgaacatacctcacagatcctccctgtcatgccacatttcactgattggaatgtggaaatggaaaaggaatttaggatgtgcattttcacctgaggtttccctgcatccctgcagtgccaaagccccaccttcagggaccacctggaatgtgtgaggggctgacagcacagtaacgtgcatacatatctgcagggctggaatggaagctttaaaggtggtagtgatttttattttggaagaatcatgttacctttttgttaaataaaatttgtactcaaatg

SEQ ID NO: 11750 - DNA, 2501 bp, Homo sapiens
gggcgggccgggcggggcgcgcgtccttccaggcagctcggtcgcttgtgcgttccgctccggccgccctttgcgcttggatccacttccccatctgtaacgaggtgttgagacgagaatgccacccagaggatgtttgaaattgactatagccgggactccttcctcaaggatggccagccatttcgctacatctcaggaagcattcactactcccgtgtgccccgcttctactggaaggaccggctgctgaagatgaagatggctgggctgaacgccatccagacgtatgtgccctggaactttcatgagccctggccaggacagtaccagttttctgaggaccatgatgtggaatattttcttcggctggctcatgagctgggactgctggttatcctgaggcccgggccctacatctgtgcagagtgggaaatgggaggattacctgcttggctgctagagaaagagtctattcttctccgctcctccgacccagattacctggcagctgtggacaagtggttgggagtccttctgcccaagatgaagcctctcctctatcagaatggagggccagttataacagtgcaggttgaaaatgaatatggcagctactttgcctgtgattttgactacctgcgcttcctgcagaagcgctttcgccaccatctgggggatgatgtggttctgtttaccactgatggagcacataaaacattcctgaaatgtggggccctgcagggcctctacaccacggtggactttggaacaggcagcaacatcacagatgctttcctaagccagaggaagtgtgagcccaaaggacccttgatcaattctgaattctatactggctggctagatcactggggccaacctcactccacaatcaagaccgaagcagtggcttcctccctctatgatatacttgcccgtggggcgagtgtgaacttgtacatgtttataggtgggaccaattttgcctattggaatggggccaactcaccctatgcagcacagcccaccagctacgactatgatgccccactgagtgaggctggggacctcactgagaagtattttgctctgcgaaacatcatccagaagtttgaaaaagtaccagaaggtcctatccctccatctacaccaaagtttgcatatggaaaggtcactttggaaaagttaaagacagtgggagcagctctggacattctgtgtccctctgggcccatcaaaagcctttatcccttgacatttatccaggtgaaacagcattatgggtttgtgctgtaccggacaacacttcctcaagattgcagcaacccagcacctctctcttcacccctcaatggagtccacgatcgagcatatgttgctgtggatgggatcccccagggagtccttgagcgaaacaatgtgatcactctgaacataacagggaaagctggagccactctggaccttctggtagagaacatgggacgtgtgaactatggtgcatatatcaacgattttaagggtttggtttctaacctgactctcagttccaatatcctcacggactggacgatctttccactggacactgaggatgcagtgtgcagccacctggggggctggggacaccgtgacagtggccaccatgatgaagcctgggcccacaactcatccaactacacgctcccggccttttatatggggaacttctccattcccagtgggatcccagacttgccccaggacacctttatccagtttcctggatggaccaagggccaggtctggattaatggctttaaccttggccgctattggccagcccggggccctcagttgaccttgtttgtgccccagcacatcctgatgacctcggccccaaacaccatcaccgtgctggaactggagtgggcaccctgcagcagtgatgatccagaactatgtgctgtgacgttcgtggacaggccagttattggctcatctgtgacctacgatcatccctccaaacctgttgaaaaaagactcatgcccccacccccgcaaaaaaacaaagattcatggctggaccatgtatgatgatgaaagcctgtgtctttgagggattctaccctgaacatacctcacagatcctccctgtcatgccacatttcactgattggaatgtggaaatggaaaaggaatttaggatgtgcattttcacctgaggtttccctgcatccctgcagtgccaaagccccaccttcagggaccacctggaatgtgtgaggggctgacagcacagtaacgtgcatacatatctgcagggctggaatggaagctttaaaggtggtagtgatttttattttggaagaatcatgttacctttttgttaaataaaatttgtactcaaatgatgatgtcactgtttttaatgtgcaggtattgaattatatggtctgacttaaatcataactagacttgagtgggctgaataaaccacttcactaacttgaagttcaaaa

SEQ ID NO: 11751 - DNA, 2604 bp, Homo sapiens
cacagcggggcggggcgcggggctgagcaggcgcgagggctggctgctgggccgacgaggggcggtgccaggccgtgggtccttagtcaagtgacgcgaagcggccggcctgggcgccgactgcagagccgggaggctggtggtcatgccggggttcctggttcgcatcctccctctgttgctggttctgctgcttctgggccctacgcgcggcttgcgcaatgccacccagaggatgtttgaaattgactatagccgggactccttcctcaaggatggccagccatttcgctacatctcaggaagcattcactactcccgtgtgccccgcttctactggaaggaccggctgctgaagatgaagatggctgggctgaacgccatccagacgtatgtgccctggaactttcatgagccctggccaggacagtaccagttttctgaggaccatgatgtggaatattttcttcggctggctcatgagctgggactgctggttatcctgaggcccgggccctacatctgtgcagagtgggaaatgggaggattacctgcttggctgctagagaaagagtctattcttctccgctcctccgacccagattacctggcagctgtggacaagtggttgggagtccttctgcccaagatgaagcctctcctctatcagaatggagggccagttataacagtgcaggttgaaaatgaatatggcagctactttgcctgtgattttgactacctgcgcttcctgcagaagcgctttcgccaccatctgggggatgatgtggttctgtttaccactgatggagcacataaaacattcctgaaatgtggggccctgcagggcctctacaccacggtggactttggaacaggcagcaacatcacagatgctttcctaagccagaggaagtgtgagcccaaaggacccttgatcaattctgaattctatactggctggctagatcactggggccaacctcactccacaatcaagaccgaagcagtggcttcctccctctatgatatacttgcccgtggggcgagtgtgaacttgtacatgtttataggtgggaccaattttgcctattggaatggggccaactcaccctatgcagcacagcccaccagctacgactatgatgccccactgagtgaggctggggacctcactgagaagtattttgctctgcgaaacatcatccagaagtttgaaaaagtaccagaaggtcctatccctccatctacaccaaagtttgcatatggaaaggtcactttggaaaagttaaagacagtgggagcagctctggacattctgtgtccctctgggcccatcaaaagcctttatcccttgacatttatccaggtgaaacagcattatgggtttgtgctgtaccggacaacacttcctcaagattgcagcaacccagcacctctctcttcacccctcaatggagtccacgatcgagcatatgttgctgtggatgggatcccccagggagtccttgagcgaaacaatgtgatcactctgaacataacagggaaagctggagccactctggaccttctggtagagaacatgggacgtgtgaactatggtgcatatatcaacgattttaagggtttggtttctaacctgactctcagttccaatatcctcacggactggacgatctttccactggacactgaggatgcagtgtgcagccacctggggggctggggacaccgtgacagtggccaccatgatgaagcctgggcccacaactcatccaactacacgctcccggccttttatatggggaacttctccattcccagtgggatcccagacttgccccaggacacctttatccagtttcctggatggaccaagggccaggtctggattaatggctttaaccttggccgctattggccagcccggggccctcagttgaccttgtttgtgccccagcacatcctgatgacctcggccccaaacaccatcaccgtgctggaactggagtgggcaccctgcagcagtgatgatccagaactatgtgctgtgacgttcgtggacaggccagttattggctcatctgtgacctacgatcatccctccaaacctgttgaaaaaagactcatgcccccacccccgcaaaaaaacaaagattcatggctggaccatgtatgatgatgaaagcctgtgtctttgagggattctaccctgaacatacctcacagatcctccctgtcatgccacatttcactgattggaatgtggaaatggaaaaggaatttaggatgtgcattttcacctgaggtttccctgcatccctgcagtgccaaagccccaccttcagggaccacctggaatgtgtgaggggctgacagcacagtaacgtgcatacatatctgcagggctggaatggaagctttaaaggtggtagtgatttttattttggaagaatcatgttacctttttgttaaataaaatttgtactcaaatgatgatgtcactgtttttaatgtgcaggtattgaattatatggtctgacttaaatcataactagacttgagtgggctgaataaaccacttcactaacttgaagttcaaaa

SEQ ID NO: 11752 - DNA, 2557 bp, Homo sapiens
agtcaagtgacgcgaagcggccggcctgggcgccgactgcagagccgggaggctggtggtcatgccggggttcctggttcgcatcctccctctgttgctggttctgctgcttctgggccctacgcgcggcttgcgctctcgattccttccttgggcttttcatctgccacggcaagcgcctaagtctcagctgccgcttcacaaaagaggtaccaagactgcaccgaatgagcacgcaagcagcaacaggagtgggagaagaaggaggcggcagcagtggaatgccacccagaggatgtttgaaattgactatagccgggactccttcctcaaggatggccagccatttcgctacatctcaggaagcattcactactcccgtgtgccccgcttctactggaaggaccggctgctgaagatgaagatggctgggctgaacgccatccagacgtatgtgccctggaactttcatgagccctggccaggacagtaccagttttctgaggaccatgatgtggaatattttcttcggctggctcatgagctgggactgctggttatcctgaggcccgggccctacatctgtgcagagtgggaaatgggaggattacctgcttggctgctagagaaagagtctattcttctccgctcctccgacccagattacctggcagctgtggacaagtggttgggagtccttctgcccaagatgaagcctctcctctatcagaatggagggccagttataacagtgcaggttgaaaatgaatatggcagctactttgcctgtgattttgactacctgcgcttcctgcagaagcgctttcgccaccatctgggggatgatgtggttctgtttaccactgatggagcacataaaacattcctgaaatgtggggccctgcagggcctctacaccacggtggactttggaacaggcagcaacatcacagatgctttcctaagccagaggaagtgtgagcccaaaggacccttgatcaattctgaattctatactggctggctagatcactggggccaacctcactccacaatcaagaccgaagcagtggcttcctccctctatgatatacttgcccgtggggcgagtgtgaacttgtacatgtttataggtgggaccaattttgcctattggaatggggccaactcaccctatgcagcacagcccaccagctacgactatgatgccccactgagtgaggctggggacctcactgagaagtattttgctctgcgaaacatcatccagaagtttgaaaaagtaccagaaggtcctatccctccatctacaccaaagtttgcatatggaaaggtcactttggaaaagttaaagacagtgggagcagctctggacattctgtgtccctctgggcccatcaaaagcctttatcccttgacatttatccaggtgaaacagcattatgggtttgtgctgtaccggacaacacttcctcaagattgcagcaacccagcacctctctcttcacccctcaatggagtccacgatcgagcatatgttgctgtggatgggatcccccagggagtccttgagcgaaacaatgtgatcactctgaacataacagggaaagctggagccactctggaccttctggtagagaacatgggacgtgtgaactatggtgcatatatcaacgattttaagggtttggtttctaacctgactctcagttccaatatcctcacggactggacgatctttccactggacactgaggatgcagtgtgcagccacctggggggctggggacaccgtgacagtggccaccatgatgaagcctgggcccacaactcatccaactacacgctcccggccttttatatggggaacttctccattcccagtgggatcccagacttgccccaggacacctttatccagtttcctggatggaccaagggccaggtctggattaatggctttaaccttggccgctattggccagcccggggccctcagttgaccttgtttgtgccccagcacatcctgatgacctcggccccaaacaccatcaccgtgctggaactggagtgggcaccctgcagcagtgatgatccagaactatgtgctgtgacgttcgtggacaggccagttattggctcatctgtgacctacgatcatccctccaaacctgttgaaaaaagactcatgcccccacccccgcaaaaaaacaaagattcatggctggaccatgtatgatgatgaaagcctgtgtctttgagggattctaccctgaacatacctcacagatcctccctgtcatgccacatttcactgattggaatgtggaaatggaaaaggaatttaggatgtgcattttcacctgaggtttccctgcatccctgcagtgccaaagccccaccttcagggaccacctggaatgtgtgaggggctgacagcacagtaacgtgcatacatatctgcagggctggaatggaagctttaaaggtggtagtgatttttattttggaagaatcatgttacctttttgttaaataaaatttgtactcaaatgat

SEQ ID NO: 11753 - DNA, 3883 bp, Homo sapiens
actcaaaatggcggcggcggcgtcagcatcagcggcctcctgcccgtatctatcgtggcggcgacgggacccgcctccctgggcgccggagtcatgtgacccacacaatggctgagtggctactctcggcttcctggcaacgccgagcgaaagctatgactgcggccgcgggttcggcgggccgcgccgcggtgcccttgctgctgtgtgcgctgctggcgcccggcggcgcgtacgtgctcgacgactccgacgggctgggccgggagttcgacggcatcggcgcggtcagcggcggcggggcaacctcccgacttctagtaaattacccagagccctatcgttctcagatattggattatctctttaagccgaattttggtgcctctttgcatattttaaaagtggaaataggtggtgatgggcagacaacagacggcactgagccctcccacatgcattatgcactagatgagaattatttccgaggatacgagtggtggttgatgaaagaagctaagaagaggaatcccaatattacactcattgggttgccatggtcattccctggatggctgggaaaaggtttcgactggccttatgtcaatcttcagctgactgcctattatgtcgtgacctggattgtgggcgccaagcgttaccatgatttggacattgattatattggaatttggaatgagaggtcatataatgccaattatattaagatattaagaaaaatgctgaattatcaaggtctccagcgagtgaaaatcatagcaagtgataatctctgggagtccatctctgcatccatgctccttgatgccgaactcttcaaggtggttgatgttataggggctcattatcctggaacccattcagcaaaagatgcaaagttgactgggaagaagctttggtcttctgaagactttagcactttaaatagtgacatgggtgcaggctgctggggtcgcattttaaatcagaattatatcaatggctatatgacttccacaatcgcatggaatttagtggctagttactatgaacagttgccttatgggagatgcgggttgatgacggcccaggagccatggagtgggcactacgtggtagaatctcctgtctgggtatcagctcataccactcagtttactcaacctggctggtattacctgaagacagttggccatttagagaaaggaggaagctacgtagctctgactgatggcttagggaacctcaccatcatcattgaaaccatgagtcataaacattctaagtgcatacggccatttcttccttatttcaatgtgtcacaacaatttgccacctttgttcttaagggatcttttagtgaaataccagagctacaggtatggtataccaaacttggaaaaacatccgaaagatttctttttaagcagctggattctctatggctccttgacagcgatggcagtttcacactgagcctgcatgaagatgagctgttcacactcaccactctcaccactggtcgcaaaggcagctacccgcttcctccaaaatcccagcccttcccaagtacctataaggatgatttcaatgttgattacccattttttagtgaagctccaaactttgctgatcaaactggtgtatttgaatattttacaaatattgaagaccctggcgagcatcacttcacgctacgccaagttctcaaccagagacccattacatgggctgccgatgcatccaacacaatcagtattataggagactacaactggaccaatctgactataaagtgtgatgtatacatagagacccctgacacaggaggtgtgttcattgcaggaagagtaaataaaggtggtattttgattagaagtgccagaggaattttcttctggatttttgcaaatggatcttacagggttacaggtgatttagctggatggattatatatgctttaggacgtgttgaagttacagcaaaaaaatggtatacactcacgttaactattaagggtcatttcacctctggcatgctgaatgacaagtctctgtggacagacatccctgtgaattttccaaagaatggctgggctgcaattggaactcactcctttgaatttgcacagtttgacaactttcttgtggaagccacacgctaatacttaacagggcatcatagaatactctggattttcttcccttctttttggttttggttcagagccaattcttgtttcattggaacagtatatgaggcttttgagactaaaaataatgaagagtaaaaggggagagaaatttatttttaatttaccctgtggaagattttattagaattaattccaaggggaaaactggtgaatctttaacattacctggtgtgttccctaacattcaaactgtgcattggccatacccttaggagtggtttgagtagtacagacctcgaagccttgctgctaacactgaggtagctctcttcatcttatttgcaagcggtcctgtagatggcagtaacttgatcatcactgagatgtatttatgcatgctgaccgtgtgtccaagtgagccagtgtcttcatcacaagatgatgctgccataatagaaagctgaagaacactagaagtagctttttgaaaaccacttcaacctgttatgctttatgctctaaaaagtatttttttattttcctttttaagatgatacttttgaaatgcaggatatgatgagtgggatgattttaaaaatgcctctttaataaactacctctaacactatttctgcagtaatagatattagcagattaattgggttatttgcattatttaatttttttgattccaagttttggtcttgtaaccactataactctctgtgaacgtttttccaggtggctggaagaaggaagaaaacctgatatagccaatgctgttgtagtcgtttcctcagcctcatctcactgtgctgtggtctgtcctcacatgtgcactggtaacagactcacacagctgatgaatgcttttctctccttatgtgtggaaggaggggagcacttagacatttgctaactcccagaattggatcatctcctaagatgtacttactttttaaagtccaaatatgtttatatttaaatatacgtgagcgtgttcatcatgttgtatgatttatactaagcattaatgtggctctatgtagcaaatcagttattcatgtaggtaaagtaaatctagaattatttataagaattactcattgaactaattctactatttaggaatttgtaagagtctaacataggcttagctacagtgaagttttgcattgcttttgaagacaagaagataagtgctagaataaataagattacagagaaaattttttgttaaaaccaagtgatttccagctgatgtatctaatattttttaaaacgaacattatagaggtgtaatttatttacaataaaatgttcctactttaaatatacaattcagtgagttttgataaattgatatacccatgtaaccaacactccagtcaagcttcagaatatttccatcaccccagaaggttctcttgtatacctgctcagtcagttcctttcactcccaattgttggcagccattgataggaattctatcactataggttagttttctttgttccagaacatcatgaaagcggcgtcatgtactgtgtattcttatgaatggtttctttccatcagcataatgatttgagatttgtccatgttgtgtgattcagtggtttgttccttcttatttctgaagagttttccattgtatgaatataccacaatttgtttcctccccaccagtttctgatactacaattaaaactgtctacatttacaa

SEQ ID NO: 11754 - DNA, 2054 bp, Homo sapiens
atgtgacccacacaatggctgagtggctactctcggcttcctggcaacgccgagcgaaagctatgactgcggccgcgggttcggcgggccgcgccgcggtgcccttgctgctgtgtgcgctgctggcgcccggcggcgcgtacgtgctcgacgactccgacgggctgggccgggagttcgacggcatcggcgcggtcagcggcggcgggccgaattttggtgcctctttgcatattttaaaagtggaaataggtggtgatgggcagacaacagacggcactgagccctcccacatgcattatgcactagatgagaattatttccgaggatacgagtggtggttgatgaaagaagctaagaagaggaatcccaatattacactcattgggttgccatggtcattccctggatggctgggaaaaggtttcgactggccttatgtcaatcttcagctgactgcctattatgtcgtgacctggattgtgggcgccaagcgttaccatgatttggacattgattatattggaatttggaatgagaggtcatataatgccaattatattaagatattaagaaaaatgctgaattatcaaggtctccagcgagtgaaaatcatagcaagtgataatctctgggagtccatctctgcatccatgctccttgatgccgaactcttcaaggtggttgatgttataggggctcattatcctggaacccattcagcaaaagatgcaaagttgactgggaagaagctttggtcttctgaagactttagcactttaaatagtgacatgggtgcaggctgctggggtcgcattttaaatcagaattatatcaatggctatatgacttccacaatcgcatggaatttagtggctagttactatgaacagttgccttatgggagatgcgggttgatgacggcccaggagccatggagtgggcactacgtggtagaatctcctgtctgggtatcagctcataccactcagtttactcaacctggctggtattacctgaagacagttggccatttagagaaaggaggaagctacgtagctctgactgatggcttagggaacctcaccatcatcattgaaaccatgagtcataaacattctaagtgcatacggccatttcttccttatttcaatgtgtcacaacaatttgccacctttgttcttaagggatcttttagtgaaataccagagctacaggtatggtataccaaacttggaaaaacatccgaaagatttctttttaagcagctggattctctatggctccttgacagcgatggcagtttcacactgagcctgcatgaagatgagctgttcacactcaccactctcaccactggtcgcaaaggcagctacccgcttcctccaaaatcccagcccttcccaagtacctataaggatgatttcaatgttgattacccattttttagtgaagctccaaactttgctgatcaaactggtgtatttgaatattttacaaatattgaagaccctggcgagcatcacttcacgctacgccaagttctcaaccagagacccattacatgggctgccgatgcatccaacacaatcagtattataggagactacaactggaccaatctgactataaagtgtgatgtatacatagagacccctgacacaggaggtgtgttcattgcaggaagagtaaataaaggtggtattttgattagaagtgccagaggaattttcttctggatttttgcaaatggatcttacagggttacaggtgatttagctggatggattatatatgctttaggacgtgttgaagttacagcaaaaaaatggtatacactcacgttaactattaagggtcatttcacctctggcatgctgaatgacaagtctctgtggacagacatccctgtgaattttccaaagaatggctgggctgcaattggaactcactcctttgaatttgcacagtttgacaactttcttgtggaagccacacgctaatacttaacagggcatcatagaatactctggattttcttcccttctttttgg

SEQ ID NO: 11755 - DNA, 2547 bp, Homo sapiens
gtgcttattaacttttctctcagtccctcactctgctgctcttctcgcctcatctcacataagggaaaactcaggctccaaaagcaaagtgattccaccaagatgacaatggaatcgggacctggtgtccaagcctggtcctcgcacgaggtagatactccctgagatgctggggaagagccatggtagggccactcatggccctcttcctttggcggaccttggaatccaccttccctgcgttaaagtgctccaccaggtgacgccggaagagaagccagcagcaacctcccgacttctagtaaattacccagagccctatcgttctcagatattggattatctctttaagccgaattttggtgcctctttgcatattttaaaagtggaaataggtggtgatgggcagacaacagacggcactgagccctcccacatgcattatgcactagatgagaattatttccgaggatacgagtggtggttgatgaaagaagctaagaagaggaatcccaatattacactcattgggttgccatggtcattccctggatggctgggaaaaggtttcgactggccttatgtcaatcttcagctgactgcctattatgtcgtgacctggattgtgggcgccaagcgttaccatgatttggacattgattatattggaatttggaatgagaggtcatataatgccaattatattaagatattaagaaaaatgctgaattatcaaggtctccagcgagtgaaaatcatagcaagtgataatctctgggagtccatctctgcatccatgctccttgatgccgaactcttcaaggtggttgatgttataggggctcattatcctggaacccattcagcaaaagatgcaaagttgactgggaagaagctttggtcttctgaagactttagcactttaaatagtgacatgggtgcaggctgctggggtcgcattttaaatcagaattatatcaatggctatatgacttccacaatcgcatggaatttagtggctagttactatgaacagttgccttatgggagatgcgggttgatgacggcccaggagccatggagtgggcactacgtggtagaatctcctgtctgggtatcagctcataccactcagtttactcaacctggctggtattacctgaagacagttggccatttagagaaaggaggaagctacgtagctctgactgatggcttagggaacctcaccatcatcattgaaaccatgagtcataaacattctaagtgcatacggccatttcttccttatttcaatgtgtcacaacaatttgccacctttgttcttaagggatcttttagtgaaataccagagctacaggtatggtataccaaacttggaaaaacatccgaaagatttctttttaagcagctggattctctatggctccttgacagcgatggcagtttcacactgagcctgcatgaagatgagctgttcacactcaccactctcaccactggtcgcaaaggcagctacccgcttcctccaaaatcccagcccttcccaagtacctataaggatgatttcaatgttgattacccattttttagtgaagctccaaactttgctgatcaaactggtgtatttgaatattttacaaatattgaagaccctggcgagcatcacttcacgctacgccaagttctcaaccagagacccattacatgggctgccgatgcatccaacacaatcagtattataggagactacaactggaccaatctgactataaagtgtgatgtatacatagagacccctgacacaggaggtgtgttcattgcaggaagagtaaataaaggtggtattttgattagaagtgccagaggaattttcttctggatttttgcaaatggatcttacagggttacaggtgatttagctggatggattatatatgctttaggacgtgttgaagttacagcaaaaaaatggtatacactcacgttaactattaagggtcatttcacctctggcatgctgaatgacaagtctctgtggacagacatccctgtgaattttccaaagaatggctgggctgcaattggaactcactcctttgaatttgcacagtttgacaactttcttgtggaagccacacgctaatacttaacagggcatcatagaatactctggattttcttcccttctttttggttttggttcagagccaattcttgtttcattggaacagtatatgaggcttttgagactaaaaataatgaagagtaaaaggggagagaaatttatttttaatttaccctgtggaagattttattagaattaattccaaggggaaaactggtgaatctttaacattacctggtgtgttccctaacattcaaactgtgcattggccatacccttaggagtggtttgagtagtacagacctcgaagccttgctgctaacactgaggtagctctcttcatcttatttgcaagcggtcctgtagatggcagtaacttgatcatcactgagatgtatttatgcatgctgaccgtgtgt

SEQ ID NO: 11756 - DNA, 2276 bp, Homo sapiens
atgtgacccacacaatggctgagtggctactctcggcttcctggcaacgccgagcgaaagctatgactgcggccgcgggttcggcgggccgcgccgcggtgcccttgctgctgtgtgcgctgctggcgcccggcggcgcgtacgtgctcgacgactccgacgggctgggccgggagttcgacggcatcggcgcggtcagcggcggcggggcaacctcccgacttctagtaaattacccagagccctatcgttctcagatattggattatctctttaagccgaattttggtgcctctttgcatattttaaaagtggaaataggtggtgatgggcagacaacagacggcactgagccctcccacatgcattatgcactagatgagaattatttccgaggatacgagtggtggttgatgaaagaagctaagaagaggaatcccaatattacactcattgggttgccatggtcattccctggatggctggattgtgggcgccaagcgttaccatgatttggacattgattatattggaatttggaatgagaggtcatataatgccaattatattaagatattaagaaaaatgctgaattatcaaggtctccagcgagtgaaaatcatagcaagtgataatctctgggagtccatctctgcatccatgctccttgatgccgaactcttcaaggtggttgatgttataggggctcattatcctggaacccattcagcaaaagatgcaaagttgactgggaagaagctttggtcttctgaagactttagcactttaaatagtgacatgggtgcaggctgctggggtcgcattttaaatcagaattatatcaatggctatatgacttccacaatcgcatggaatttagtggctagttactatgaacagttgccttatgggagatgcgggttgatgacggcccaggagccatggagtgggcactacgtggtagaatctcctgtctgggtatcagctcataccactcagtttactcaacctggctggtattacctgaagacagttggccatttagagaaaggaggaagctacgtagctctgactgatggcttagggaacctcaccatcatcattgaaaccatgagtcataaacattctaagtgcatacggccatttcttccttatttcaatgtgtcacaacaatttgccacctttgttcttaagggatcttttagtgaaataccagagctacaggtatggtataccaaacttggaaaaacatccgaaagatttctttttaagcagctggattctctatggctccttgacagcgatggcagtttcacactgagcctgcatgaagatgagctgttcacactcaccactctcaccactggtcgcaaaggcagctacccgcttcctccaaaatcccagcccttcccaagtacctataaggatgatttcaatgttgattacccattttttagtgaagctccaaactttgctgatcaaactggtgtatttgaatattttacaaatattgaagaccctggcgagcatcacttcacgctacgccaagttctcaaccagagacccattacatgggctgccgatgcatccaacacaatcagtattataggagactacaactggaccaatctgactataaagtgtgatgtatacatagagacccctgacacaggaggtgtgttcattgcaggaagagtaaataaaggtggtattttgattagaagtgccagaggaattttcttctggatttttgcaaatggatcttacagggttacaggtgatttagctggatggattatatatgctttaggacgtgttgaagttacagcaaaaaaatggtatacactcacgttaactattaagggtcatttcacctctggcatgctgaatgacaagtctctgtggacagacatccctgtgaattttccaaagaatggctgggctgcaattggaactcactcctttgaatttgcacagtttgacaactttcttgtggaagccacacgctaatacttaacagggcatcatagaatactctggattttcttcccttctttttggttttggttcagagccaattcttgtttcattggaacagtatatgaggcttttgagactaaaaataatgaagagtaaaaggggagagaaatttatttttaatttaccctgtggaagattttattagaattaattccaaggggaaaactggtgaatctttaacattacctggtgtgttccctaacattcaaactgtgcattggccatacccttaggag

SEQ ID NO: 11757 - DNA, 2528 bp, Homo sapiens
agtcagcaggcggttggggcgggcccgctgcggggctggggcgggtgctttctcgtttaacacgaaccagacaggcagttaggtttgaacaaatgaggatccggaggtccagagagtataggtgcagagagtaaagtgacaggtctaagtagtgaagtagccggggctggaaccctcgtcccaggcagtggggcacaggctgtcttcatcgcggagatggcagtcggggagcgtcgctccagaaagggccagggagtgcgggagcgtccgtgtgcgaaagagaacgccccagtgggatgctttggctgtgtctctcccttttggaggagttggtgggtggtggagtcgttaagtcccgtgcagttgttagtgcagggtaagaatgggctcctccagagagggtagcgccgaataggatttcgtttggaggcaggactggtgcctcaaggtctctttaaaaggaagataagcgagcggcctgaaactaccgggtactccctctgggcccatgggcttcatggtggccgacctttgggcaacctcccgacttctagtaaattacccagagccctatcgttctcagatattggattatctctttaagccgaattttggtgcctctttgcatattttaaaagtggaaataggtggtgatgggcagacaacagacggcactgagccctcccacatgcattatgcactagatgagaattatttccgaggatacgagtggtggttgatgaaagaagctaagaagaggaatcccaatattacactcattgggttgccatggtcattccctggatggctgggaaaaggtttcgactggccttatgtcaatcttcagctgactgcctattatgtcgtgacctggattgtgggcgccaagcgttaccatgatttggacattgattatattggaatttggaatgagaggtcatataatgccaattatattaagatattaagaaaaatgctgaattatcaaggtctccagcgagtgaaaatcatagcaagtgataatctctgggagtccatctctgcatccatgctccttgatgccgaactcttcaaggtggttgatgttataggggctcattatcctggaacccattcagcaaaagatgcaaagttgactgggaagaagctttggtcttctgaagactttagcactttaaatagtgacatgggtgcaggctgctggggtcgcattttaaatcagaattatatcaatggctatatgacttccacaatcgcatggaatttagtggctagttactatgaacagttgccttatgggagatgcgggttgatgacggcccaggagccatggagtgggcactacgtggtagaatctcctgtctgggtatcagctcataccactcagtttactcaacctggctggtattacctgaagacagttggccatttagagaaaggaggaagctacgtagctctgactgatggcttagggaacctcaccatcatcattgaaaccatgagtcataaacattctaagtgcatacggccatttcttccttatttcaatgtgtcacaacaatttgccacctttgttcttaagggatcttttagtgaaataccagagctacaggtatggtataccaaacttggaaaaacatccgaaagatttctttttaagcagctggattctctatggctccttgacagcgatggcagtttcacactgagcctgcatgaagatgagctgttcacactcaccactctcaccactggtcgcaaaggcagctacccgcttcctccaaaatcccagcccttcccaagtacctataaggatgatttcaatgttgattacccattttttagtgaagctccaaactttgctgatcaaactggtgtatttgaatattttacaaatattgaagaccctggcgagcatcacttcacgctacgccaagttctcaaccagagacccattacatgggctgccgatgcatccaacacaatcagtattataggagactacaactggaccaatctgactataaagtgtgatgtatacatagagacccctgacacaggaggtgtgttcattgcaggaagagtaaataaaggtggtattttgattagaagtgccagaggaattttcttctggatttttgcaaatggatcttacagggttacaggtgatttagctggatggattatatatgctttaggacgtgttgaagttacagcaaaaaaatggtatacactcacgttaactattaaggtggctggaagaaggaagaaaacctgatatagccaatgctgttgtagtcgtttcctcagcctcatctcactgtgctgtggtctgtcctcacatgtgcactggtaacagactcacacagctgatgaatgcttttctctccttatgtgtggaaggaggggagcacttagacatttgctaactcccagaattggatcatctcctaagatgtacttactttttaaagtccaaatatgtttatatttaaatatacgtgagcgtgttcatcatgttgtatgat

SEQ ID NO: 11758 - DNA, 818 bp, Homo sapiens
ccggtgacgcgactccgggcggctcccgggtgcgccgcatatatagcagcggcggcggtggcggcggccacaccgggcggcggacacgtggagggacccggcccgcgccttctgcccctgctgccggccgcgccatgcggtgagcgccccaggccgccagagcccacccgacccggcccgacgcccggacctgccgcccagacccgccaccgcacccggaccccgacgctccgaacccgggcgcagccgcagctcaagatggcccgaggcagcgccctcctgctcgcctccctcctcctcgccgcggccctttctgcctctgcggggctctggtcgccggccaaggaaaaacgaggctggaccctgaacagcgcgggctacctgctgggcccacatgccgttggcaaccacaggtcattcagcgacaagaatggcctcaccagcaagcgggagctgcggcccgaagatgacatgaaaccaggaagctttgacaggtccatacctgaaaacaatatcatgcgcacaatcattgagtttctgtctttcttgcatctcaaagaggccggtgccctcgaccgcctcctggatctccccgccgcagcctcctcagaagacatcgagcggtcctgagagcctcctgggcatgtttgtctgtgtgctgtaacctgaagtcaaaccttaagataatggataatcttcggccaatttatgcagagtcagccattcctgttctctttgccttgatgttgtgttgttatcatttaagattttttttttttggtaattattttgagtggcaaaataaagaatagcaatta

SEQ ID NO: 11759 - DNA, 1050 bp, Homo sapiens
atggagctggcggtcgggaacctcagcgagggcaacgcgagctggccggagccccccgccccggagcccgggccgctgttcggcatcggcgtggagaacttcgtcacgctggtggtgttcggcctgatcttcgcgctgggtgtgctgggcaacagcctagtgatcaccgtgctggcgcgcagcaagccgggcaagccgcggagcaccaccaacctgttcatcctcaacctgagcatcgccgacctggcctacctgctcttctgcatccccttccaggccaccgtgtacgcgctgcccacctgggtgctgggcgccttcatctgcaagttcatccactacttcttcaccgtgtccatgctggtgagcatcttcaccctggccgcgatgtccgtggaccgctacgtggccatcgtgcactcgcggcgctcctcctccctcagggtgtcccgcaacgcgctgctgggcgtgggctgcatctgggcgctgtccattgccatggcctcgcccgtggcctaccaccagggcctcttccacccgcgcgccagcaaccagaccttctgctgggagcagtggcccgaccctcgccacaagaaggcctacgtggtgtgcaccttcgtcttcggctacctgctgccgctcctgctcatctgcttctgctatgccaaggtccttaatcacttgcataaaaagttgaagaacatgtcaaagaagtctgaagcatccaagaaaaagactgcacagacagttctggtggtggttgtggtgtttggaatctcctggctgccgcaccacatcatccatctctgggctgagtttggagttttcccgctgacgccggcttccttcctcttcagaatcaccgcccactgcctggcgtacagcaattcctccgtgaatcctatcatttatgcatttctctctgaaaatttcaggaaggcctataaacaagtgttcaagtgtcacattcgcaaagattcacacctgagtgatactaaagaaagtaaaagtcgaatagacaccccaccatcaaccaattgtactcatgtgtga

SEQ ID NO: 11760 - DNA, 1364 bp, Homo sapiens
gagttgcagcggccgcagccccgggagcttcccgctcgcggagacccagacggctgcaggagcccgggcagcctcggggtcagcggcaccatgaacgtctcgggctgcccaggggccgggaacgcgagccaggcgggcggcgggggaggctggcaccccgaggcggtcatcgtgcccctgctcttcgcgctcatcttcctcgtgggcaccgtgggcaacacgctggtgctggcggtgctgctgcgcggcggccaggcggtcagcactaccaacctgttcatccttaacctgggcgtggccgacctgtgtttcatcctgtgctgcgtgcccttccaggccaccatctacaccctggacggctgggtgttcggctcgctgctgtgcaaggcggtgcacttcctcatcttcctcaccatgcacgccagcagcttcacgctggccgccgtctccctggacaggtatctggccatccgctacccgctgcactcccgcgagctgcgcacgcctcgaaacgcgctggcagccatcgggctcatctgggggctgtcgctgctcttctccgggccctacctgagctactaccgccagtcgcagctggccaacctgaccgtgtgccatcccgcgtggagcgcccctcgccgccgcgccatggacatctgcaccttcgtcttcagctacctgcttcctgtgctggttctcggcctgacctacgcgcgcaccttgcgctacctctggcgcgccgtcgacccggtggccgcgggctcgggtgcccggcgcgccaagcgcaaggtgacacgcatgatcctcatcgtggccgcgctcttctgcctctgctggatgccccaccacgcgctcatcctctgcgtgtggttcggccagttcccgctcacgcgcgccacttatgcgcttcgcatcctctcgcacctggtctcctacgccaactcctgcgtcaaccccatcgtttacgcgctggtctccaagcacttccgcaaaggcttccgcacgatctgcgcgggcctgctgggccgtgccccaggccgagcctcgggccgtgtgtgcgctgccgcgcggggcacccacagtggcagcgtgttggagcgcgagtccagcgacctgttgcacatgagcgaggcggcgggggcccttcgtccctgccccggcgcttcccagccatgcatcctcgagccctgtcctggcccgtcctggcagggcccaaaggcaggcgacagcatcctgacggttgatgtggcctgaaagcacttagcgggcgcgctgggatgtcacagagttggagtcattgttgggggaccgtggggagagctttgcctgttaataaaacgcacaaaccatttcacacacagtga

SEQ ID NO: 11761 - DNA, 1157 bp, Homo sapiens
tcccaggtgcccgtctgatggggagatggctgatgcccagaacatttcactggacagcccagggagtgtgggggccgtggcagtgcctgtggtctttgccctaatcttcctgctgggcacagtgggcaatgggctggtgctggcagtgctcctgcagcctggcccgagtgcctggcaggagcctggcagcaccacggacctgttcatcctcaacctggcggtggctgacctctgcttcatcctgtgctgcgtgcccttccaggccaccatctacacgctggatgcctggctctttggggccctcgtctgcaaggccgtgcacctgctcatctacctcaccatgtacgccagcagctttacgctggctgctgtctccgtggacaggtacctggccgtgcggcacccgctgcgctcgcgcgccctgcgcacgccgcgtaacgcccgcgccgcagtggggctggtgtggctgctggcggcgctcttctcggcgccctacctcagctactacggcaccgtgcgctacggcgcgctggagctctgcgtgcccgcctgggaggacgcgcgccgccgcgccctggacgtggccaccttcgctgccggctacctgctgcccgtggctgtggtgagcctggcctacgggcgcacgctgcgcttcctgtgggccgccgtgggtcccgcgggcgcggcggcggccgaggcgcggcggagggcgacgggccgcgcggggcgcgccatgctggcggtggccgcgctctacgcgctctgctggggtccgcaccacgcgctcatcctgtgcttctggtacggccgcttcgccttcagcccggccacctacgcctgccgcctggcctcacactgcctggcctacgccaactcctgcctcaacccgctcgtctacgcgctcgcctcgcgccacttccgcgcgcgcttccgccgcctgtggccgtgcggccgccgacgccgccaccgtgcccgccgcgccttgcgtcgcgtccgccccgcgtcctcgggcccacccggctgccccggagacgcccggcctagcgggaggctgctggctggtggcggccagggcccggagcccagggagggacccgtccacggcggagaggctgcccgaggaccggaataaaccctgccgcctggactccgcctgt

SEQ ID NO: 11762 - DNA, 2151 bp, Homo sapiens
agaaggcctgggggcgaggaacaagacctcggagtatttcaaggggagacctagttccctgccctgccccgggcccagggcgccgcggtctgaactctgctcggctggaggactcgtctccgagctccgtcagaaatggggaacttgcagtcggagccatccgcgggcgggggctcccgaaaagtgcagccctcggaccgcgcccccgactcccgccggacgtccctggtggagcccgagatgacctcccaggccatgcgcctgactcgtgggctgggtgtctggttccctggcagcgccacacccccgggactcatggtaccccgggagccccaggcctcaccctcgaccctgcccctcaccttagaacggccctctccagtgatgccccctcctgaagaggcggccgcggtctctgcaccacccccggcccccgcggggactctgctgcccggcccgtctaaatggcaaaagcccgcgggcactccagttccccggatccgccgcctgctggaggcgagccatcgcggccagggcgaccctccgagcctccgcccgctgaagccgccgccgccgccccggcaactatccgtgaaggacactgtcccgagggccccatcccaatttccgccgcccctggagacttggaagccgccaccaccattaccttctgaacggcagccggcggaccgcagaatcactcctgctctggccacacccgcctcacccccgacagaaagccaggctgggccccgcaaccagggccagacggccggcagggctcgcggaggggcgcctccccatgcgggcgaaggcgaaatggcccagcctgcggattccgagtccggtctgagcctgctgtgtaaaatcaccttcaagtcgaggccctctttggcccctccggcagcctcgagttccttagcagccaaagcttcgctggggggcggcggaggcggcggcctctttgctgcctcaggtgccatctcttacgccgaggtcctgaagcaagggcccctgcctcctggagccgctcgccccttgggagaggtttctcgaggggcacaggaagccgagggaggtgatggagacggcgaagggtgctctggtcctccctcggcgcctgcgtcccaagcccgggccctaccgccgccaccctacaccaccttcccaggctcgaagcccaaattcgactgggttagcgctcccgacggccctgaacgccacttccgcttcaacggggctggcggaggcatcggggcgccgcgacggcgtgcggccgcactctctgggccttggggctcccctccgccaccaccagagcagatacactcagctcccgggccccggaggcccgcacctgccctgctggcgccgcctacgttcatcttcccagcacccaccaatggcgagcccatgcgcccggggcctccaggcctgcaggagttaccaccgctgccaccgcccacaccgccgcccacactgcagccaccagcgctccagccaacgccgctgccggtggctcccccgctcaccccgggtctgggccacaaggagtcagccctggctcccaccgcagcccctgctctgcccccagccttagccgccgaccaggccccggccccatccccggctccagctcccaccgtggctgagccctcgccgcctgtgtccgcgcccgcacccgcggctgcgcccatcaagacccgcacgcgcaggaacaagggttcccgtgcagcccggggcgcgacccgtaaggatggcttgcatggagatggtcctcgcgaacgagctacagctaccgtgcctgacagcagtggtggagggggtggtggcagcggggcctctcagactggggcagctaacacccgcgctgcgcgccactggctgcccttccaggtgcttaactcctgtccctgcaagtgttactgccaccaccagccacgccatcgccgcctgccacgcaacgtctctgcctggctgagcacatccaccaaccacctgggcgagccaccctgggttgccaccatcaagctgtccggctctctggtggccaagctggagcactacgacttgcaggccacccattccaactgagtgtagtcggctcaacaccctccaccttcccctccatgccaataaaataaccaatcc

SEQ ID NO: 11763 - DNA, 672 bp, Homo sapiens
atggggaacttgcagtcggagccatccgcgggcgggggctcccgaaaagtgcagccctcggaccgcgcccccgactcccgccggacgtccctggtggagcccgagatgacctcccaggccatgcgcctgactcgtgggctgggtgtctggttccctggcagcgccacacccccgggactcatggtaccccgggagccccaggcctcaccctcgaccctgcccctcaccttagaacggccctctccagtgatgccccctcctgaagaggcggccgcggtctctgcaccacccccggcccccgcggggactctgctgcccggcccgtctaaatggcaaaagcccgcgggcactccagttccccggatccgccgcctgctggaggcgagccatcgcggccagggcgaccctccgagcctccgcccgctgaagccgccgccgccgccccggcaactatccgtgaaggacactgtcccgagggccccatcccaatttccgccgcccctggagacttggaagccgccaccaccattaccttctgaacggcagccggcggaccgcagaatcactcctgctctggccacacccgcctgtgtccgcgcccgcacccgcggctgcgcccatcaagacccgcacgcgcaggaacaagggttcccgtgcagcccggggcgcgac

SEQ ID NO: 11764 - DNA, 2803 bp, Homo sapiens
gcgagcggctgactgcccgtagaggaaacgacattcggagctgcgctcccgcccaggccggccctgacgcgggcctcgtcagccagtaacagggagcagaggtgggagttagcgaggcgaccacgaaaacggtgaaggtcggaaccgacagcctcctccgagaagggcaggagctgggaggaggcggcagcggcggcggcagaaacagcagcggcggcggcggcggcagctgggaggaggtggtgacggtggcaacggcagcgtcggggacgatggcgcgactcgtggcagtgtgcagggacggggaggaggagttccccttcgagaggaggcagattcccctctacatagacgacaccctgacgatggtgatggaatttcctgataatgtgttaaatctcgatggacatcagaataatggtgcacagctaaagcagttcattcagcgacatggtatgcttaagcaacaggatctaagtattgccatggtggtgacatcacgcgaagtcctgagtgcactttctcagcttgtcccatgtgttggttgtcgtcgcagtgtggagcgtctcttttcccagcttgtagagtctggaaatcctgctcttgaacccctaacagtagggcccaagggagtcctgtctgtaactagaagctgcatgactgatgcaaagaagctttatacattattttatgtacatgggtccaaactaaatgacatgatagatgctattccaaaaagtaagaagaataagagatgtcagttgcactccttagatacgcacaagccaaaacctttgggaggttgttggatggatgtatgggaactaatgtcgcaggaatgcagggatgaagtagttttaattgactcgagttgtcttttagaaacactagaaacatatctgcgaaaacacaggttttgcactgattgcaaaaataaagtcctccgagcatacaatatccttattggtgaacttgactgcagcaaagaaaagggctactgtgctgcactttatgaaggcttgcggtgctgtccacatgaacgacacatacatgtttgctgtgaaacagacttcattgcacatcttttgggtcgtgctgagccagagttcgcaggagggcgaagagaaaggcatgcaaagacaatagatatagctcaagaagaagttctgacctgcttgggaattcatctttatgaaagactgcatcgaatctggcagaagctacgggcagaagagcagacatggcagatgcttttctatcttggtgttgatgctttacgcaagagttttgagatgaccgtggaaaaagtacagggtattagcagattggaacaactttgtgaggaattttcagaagaggaacgagtaagagaactcaagcaagaaaagaaacgccaaaaacggaagaatagacgaaaaaataagtgtgtgtgtgatattcctactcccttacaaacagcagatgaaaaggaagtaagccaagagaaggaaacagacttcatagaaaatagcagctgcaaagcctgtggcagcactgaagatggtaatacttgtgtagaagtaattgttaccaatgaaaatacatcatgtacctgtcctagcagtggcaatcttttggggtcccctaaaataaagaaaggcttatctccacactgtaatggtagtgattgtggatattcatctagcatggaagggagtgaaacaggttctcgggagggttcggatgttgcctgcactgaaggcatttgtaatcatgatgaacacggtgatgactcttgtgttcatcactgtgaagacaaagaggatgatggtgatagttgtgttgaatgttgggcaaattctgaagagaacgacacaaaaggaaaaaataaaaagaagaagaagaaaagcaagatactgaaatgtgatgaacatatccagaagcttggaagctgtattacagatccaggtaatcgagagacctcaggaaataccatgcacacagtgtttcaccgtgacaagaccaaagatacacatcctgaaagctgttgcagctctgaaaagggtgggcagccattgccttggtttgagcataggaaaaatgtaccacagtttgcagaacctacagaaacgttgtttggtcccgattccggaaaaggtgccaagagcttagttgaactccttgatgagtctgaatgtacttcagatgaggaaatctttatctcacaagatgaaatacagtcatttatggctaataaccagtctttctacagcaatagagaacaataccgacagcatctgaaggagaaatttaataaatactgccggttaaatgatcacaagaggcccatttgtagtggctggttgacaacggctggagcaaattaaataaataaaatagctctgtctttcaatgaaacactcacgatgactactgcgccttctctttcgaaaaactcttaatttagtgacttatggcaaaattttatcttaaatcaatgtgattctttcttgttttgggagacggtggaggtatcctcattagttctttcttcaggcttgtgtctttagttgcgtggctgcgcaggcctgccatatgatttaagccatctcttttcattaaatgtttctcttcctgtgagacttactaaagcaacttagtggcaaaaagtaatgttgtacttataattctgtacagaaatgacaatgagctgaatatatggttttacaaagtagacatccacttgcaaaatgtttggatgtaatgttaaagcgcaatgtgcaaaatttaaaataaagaatatttattaatacgcacagtaaaa

SEQ ID NO: 11765 - DNA, 3927 bp, Homo sapiens
cagagtgacgctttgatggtatctgcaagcgtttttgctgatcttatctctgccccctgaatattaattccctaatctggtagcaatccatctccccagtgaaggacctactagaggcaggtggggggagccaccatcagatcataagcataagaataatacaaaggggagggattcttctgcaaccaagaggcaagaggcgagagaaggaaaaaaaaaaaagcgatgagttcgccaaatatatggagcacaggaagctcagtctactcgactcctgtattttcacagaaaatgacggtgtggattctgctcctgctgtcgctctaccctggcttcactagccagaaatctgatgatgactatgaagattatgcttctaacaaaacatgggtcttgactccaaaagttcctgagggtgatgtcactgtcatcttaaacaacctgctggaaggatatgacaataaacttcggcctgatataggagtgaagccaacgttaattcacacagacatgtatgtgaatagcattggtccagtgaacgctatcaatatggaatacactattgatatattttttgcgcaaacgtggtatgacagacgtttgaaatttaacagcaccattaaagtcctccgattgaacagcaacatggtggggaaaatctggattccagacactttcttcagaaattccaaaaaagctgatgcacactggatcaccacccccaacaggatgctgagaatttggaatgatggtcgagtgctctacaccctaaggttgacaattgatgctgagtgccaattacaattgcacaactttccaatggatgaacactcctgccccttggagttctccagttggtctcgttctattgcccaggctggaatgtgcagtggtgtgatctcggctcactacagccttcgcttctggggctcaactgatcctcccaccttggcctccagagtagctgggatttcagatggctatccacgtgaagaaattgtttatcaatggaagcgaagttctgttgaagtgggcgacacaagatcctggaggctttatcaattctcatttgttggtctaagaaataccaccgaagtagtgaagacaacttccggagattatgtggtcatgtctgtctactttgatctgagcagaagaatgggatactttaccatccagacctatatcccctgcacactcattgtcgtcctatcctgggtgtctttctggatcaataaggatgctgttccagccagaacatctttaggtatcaccactgtcctgacaatgaccaccctcagcaccattgcccggaaatcgctccccaaggtctcctatgtcacagcgatggatctctttgtatctgtttgtttcatctttgtcttctctgctctggtggagtatggcaccttgcattattttgtcagcaaccggaaaccaagcaaggacaaagataaaaagaagaaaaaccctcttcttcggatgttttccttcaaggcccctaccattgatatccgcccaagatcagcaaccattcaaatgaataatgctacacaccttcaagagagagatgaagagtacggctatgagtgtctggacggcaaggactgtgccagttttttctgctgttttgaagattgtcgaacaggagcttggagacatgggaggatacatatccgcattgccaaaatggactcctatgctcggatcttcttccccactgccttctgcctgtttaatctggtctattgggtctcctacctctacctgtgaggaggtatgggttttactgatatggttcttattcactgagtctcatggagagatgtctgttctaagtccacttaaataatcctctatgtggttgataatgatctgaatctgtttctatgtccaaacctggtaaattttataatgtcatattgtttgtgcccagccctcctttggttagtgtactttgaacttcgatgtttgctgtgtttcaaacctgcaaggcaaagtaaaattagagcaagaacattcaaaccaaataagatatttttcagctacagcaaataaaacagtgaaagccctgactatttacagtagtggtatccttactagattcataatgcaattagatagaaaaggtccaaaactgtaccctatgttcactccgggtcaagttgtgataaatttgatcccaatagaatacctccctcatttaagaaaaatcataactcactttaaatatgaaagcctagtccagaaatctattacacctttatctcaagataggaagaaaatttcctccacattcatgtacaatgatgtaaatatttcaataacttagaatgcttcaagtttagtgcatgcatctctttagatccaaaataaatggactgaagttatcatcctattgtcttttattttgtgtccttgggctataaaagattcctgaatgtaattataaggatttgggtttggaaatggagggaggaattttcattgccttctccctcatgcatgaagattcgaacagcttattttttccttgtatgacatattacaacactttaagtaaaatatagactggataatcaacatttgccacctctaaatatgcccaatttcataactagagtataaagtaattgtatgtgcttgccgctatttttttcttccttttaggatgatagatcataacagaacttattctccatctcaagatctgcttctagtgattgtgagtgccttgtgggcagaatccttgtcatttcctctttgggtctgtagcaccttgcatagtgcctggcatatagttggtgctcaataaatatggtttgaagtgaattgccctcacatgcttctggcaaatctctgtgctggcctgaaaccagtgactcatcttctcacataggtgttgtcaagtgatatttgattttgtaaaaataaccagtaggatccaaagaactttagctatttatgttcatcttcaaaaaattattttaggcaaagtccatactccttttaaaacaatatttatgtcctatgtttgtgtatagacatgactctactagggcataattagagtttgtgtattatttttccaggtttggggatgagtcagtccttgcccatccacaattttgtttgtgaacttataacaggaataagcaaaattcatacctgactagtgttcagaatgtagcattctgtgcgaaaaagtattgaagattagcttttaaaaactgaaaaaaaaaaatgaatgactcacatagaggttgagccaatgactgtggcctcattagattacattgtagttaaacaaagcaatttctccagacttaaaacatgatgagttgagctctatcttcatgtactcatcctgaatccttatttttctaaaatagcaccctttgttaattatttttatggaaattattactctgtcataattaaatcatagctagtataactttacagataacctaaaaagaatagaaaagaagagagagtggctttgtcagtataaaaccatgtaaagtcatcatcaagtcatctggatgaatcttgaaacacatttagctgccagttttacaaacctttaatatatcagtgctccagtatataacctcaaacaaatgtaaatagaacgaattattttcttgttttgaattgtcaatatattaaatgttgactctttgggagagttgttggcaagtttcaatggtgagaaacattattgtcaacttgaaatgtgttctgtaatggggacactacaaaaagctagctttccaatgtgtgcatagtattggcaatatgaatatatattatatataatctaatacttattataagctgctccctgtctatgtatttggaaaccttttcacaaagggaattgcctaacatgtggacttttacaataaaaatgctgcattctaa

SEQ ID NO: 11766 - DNA, 1405 bp, Homo sapiens
agagtagatacctgtcccgcccgccgcggccagcagcctcggaggaagccagggcaaagagggccggcggagaccaggtccgcgccggaggaagccgcgcccggccgaggccccggaccctgcgccccgagctccacggcaccatggccccgaagctgctgctcctcctctgcctgttctcgggcttgcacgcgcggtccagaaaggtggaagaggatgaatatgaagattcatcatcaaaccaaaagtgggtcttggctccaaaatcccaagacaccgacgtgactcttattctcaacaagttgctaagagaatatgataaaaagctgaggccagatattggaataaaaccgaccgtaattgacgttgacatttatgttaacagcattggtcctgtgtcatcaataaacatggaataccaaattgacatattttttgctcagacctggacagatagtcgccttcgattcaacagcacaatgaaaattcttactctgaacagcaacatggtggggttaatctggatcccagacaccatcttccgcaattctaaaaccgcagaggctcactggatcaccacacccaatcagctcctccggatttggaatgacgggaaaatcctttacactttgaggctcaccatcaatgctgagtgccagctgcagctgcacaacttccccatggacgaacactcctgcccgctgattttctccagctatggctatcccaaagaagaaatgatttatagatggagaaaaaattcagtggaggcagctgaccagaaatcatggcggctttatcagtttgacttcatgggcctcagaaacaccacagaaatcgtgacaacgtctgcaggtaggaatttactgaaagaggcacagctctcaaaagccagagaggcctaaggccatatgtagtcatatccttaatgtacaagccttttgggcaaccatgatacataagtgatatttgagacaaaacaagtgattcaaagtgaaactatgttttcatgttttaattggtatgggagagggatgttagaaataattcatatttttgaatccaggctgtgtttgcataatgtctataaacctagctataaacttaacctaactcattactgaccatatttacataaaccaattttgctgatggggagagttctgcaaatttccacgtacataagaagaatcaaatattattgagaatccacacataaaagaagctggtgtgatatgtcctttgagtttcaattgcttttatttactctaagttttatctttaactttgagtttctttttcaatgattgaaagtaattacctaccaatttgattttatgaagtgatcattatatgcatattcaaaatcctgtaattaaataaaaagagttgttctgcctatgaa

SEQ ID NO: 11767 - DNA, 2083 bp, Homo sapiens
aacagaagatgccggagaaggggggggaaaagtagatgcggatttcgtcctgacttctaaaaattcctcctctccctctcccattttcctaatccgagaatgatggagctcgaggcaaaggaatgattccggaaatggagatatgattctcaaacctagaaatgatcggagtgatttattagttaaatattcttcgtccaggaacccagcacaattcagagctgcagattggatattgggaagcaaatttgggtgtgaaatcttcagcaaaggagcacgcagagtccatgatggctcagaccaagtgagtgagaggcagagcgaggacgcccctctgctctggcgcgcccggactcggactcgcagactcgcgctggctccagtctctccacgattctctctcccagacttttccccggtcttaagagatcctgtgtccagagggggccttagctgctccagcccgcgatgaggaaaagtccaggtctgtctgactgtctttgggcctggatcctccttctgagcacactgactggaagaagctatggacagccgtcattacaagatgaacttaaagacaataccactgtcttcaccaggattttggacagactcctagatggttatgacaatcgcctgagaccaggattgggagagcgtgtaaccgaagtgaagactgatatcttcgtcaccagtttcggacccgtttcagaccatgatatggaatatacaatagatgtatttttccgtcaaagctggaaggatgaaaggttaaaatttaaaggacctatgacagtcctccggttaaataacctaatggcaagtaaaatctggactccggacacatttttccacaatggaaagaagtcagtggcccacaacatgaccatgcccaacaaactcctgcggatcacagaggatggcaccttgctgtacaccatgaggctgacagtgagagctgaatgtccgatgcatttggaggacttccctatggatgcccatgcttgcccactaaaatttggaagttatgcttatacaagagcagaagttgtttatgaatggaccagagagccagcacgctcagtggttgtagcagaagatggatcacgtctaaaccagtatgaccttcttggacaaacagtagactctggaattgtccagtcaagtacaggagaatatgttgttatgaccactcatttccacttgaagagaaagattggctactttgttattcaaacatacctgccatgcataatgacagtgattctctcacaagtctccttctggctcaacagagagtctgtaccagcaagaactgtctttggagtaacaactgtgctcaccatgacaacattgagcatcagtgccagaaactccctccctaaggtggcttatgcaacagctatggattggtttattgccgtgtgctatgcctttgtgttctcagctctgattgagtttgccacagtaaactatttcactaagagaggttatgcatgggatggcaaaagtgtggttccagaaaagccaaagaaagtaaaggatcctcttattaagaaaaacaacacttacgctccaacagcaaccagctacacccctaatttggccaggggcgacccgggcttagccaccattgctaaaagtgcaaccatagaacctaaagaggtcaagcccgaaacaaaaccaccagaacccaagaaaacctttaacagtgtcagcaaaattgaccgactgtcaagaatagccttcccgctgctatttggaatctttaacttagtctactgggctacgtatttaaacagagagcctcagctaaaagcccccacaccacatcaatagatcttttactcacattctgttgttcagtcctctgcactgggaatttatttatgttctcaacgcagtaattcccatctgctttattgcctctgtcttaaagaatttgaaagtttccttattttcataattcatttaagaacaagagacccctgtctggcagtctggagcaaagcagactatgcagcttggagacaggattctgacagagcaagcgaaagagcaaagtcatgtcagaaggagacag

SEQ ID NO: 11768 - DNA, 2119 bp, Homo sapiens
aaaaagagaagcttgcagcagattgtagaaggatttgagcctgcagctagagagaaggggattagggccagagtggtgcaagttaaattgtgctgcatataaaaaatgggcggattggtctccagatccagaggctggtaccaccttcctttctaaaataaaatctctctggcatgaagtcaccgcctatttcacatccggtttgccctgggacgtattactactgtcttggtaaagagaaatcttttgttgtatagctgcagattggatattgggaagcaaatttgggtgtgaaatcttcagcaaaggagcacgcagagtccatgatggctcagaccaagtgagtgagaggcagagcgaggacgcccctctgctctggcgcgcccggactcggactcgcagactcgcgctggctccagtctctccacgattctctctcccagacttttccccggtcttaagagatcctgtgtccagagggggccttagctgctccagcccgcgatgaggaaaagtccaggtctgtctgactgtctttgggcctggatcctccttctgagcacactgactggaagaagctatggacagccgtcattacaagatgaacttaaagacaataccactgtcttcaccaggattttggacagactcctagatggttatgacaatcgcctgagaccaggattgggagagcgtgtaaccgaagtgaagactgatatcttcgtcaccagtttcggacccgtttcagaccatgatatggaatatacaatagatgtatttttccgtcaaagctggaaggatgaaaggttaaaatttaaaggacctatgacagtcctccggttaaataacctaatggcaagtaaaatctggactccggacacatttttccacaatggaaagaagtcagtggcccacaacatgaccatgcccaacaaactcctgcggatcacagaggatggcaccttgctgtacaccatgaggctgacagtgagagctgaatgtccgatgcatttggaggacttccctatggatgcccatgcttgcccactaaaatttggaagttatgcttatacaagagcagaagttgtttatgaatggaccagagagccagcacgctcagtggttgtagcagaagatggatcacgtctaaaccagtatgaccttcttggacaaacagtagactctggaattgtccagtcaagtacaggagaatatgttgttatgaccactcatttccacttgaagagaaagattggctactttgttattcaaacatacctgccatgcataatgacagtgattctctcacaagtctccttctggctcaacagagagtctgtaccagcaagaactgtctttggagtaacaactgtgctcaccatgacaacattgagcatcagtgccagaaactccctccctaaggtggcttatgcaacagctatggattggtttattgccgtgtgctatgcctttgtgttctcagctctgattgagtttgccacagtaaactatttcactaagagaggttatgcatgggatggcaaaagtgtggttccagaaaagccaaagaaagtaaaggatcctcttattaagaaaaacaacacttacgctccaacagcaaccagctacacccctaatttggccaggggcgacccgggcttagccaccattgctaaaagtgcaaccatagaacctaaagaggtcaagcccgaaacaaaaccaccagaacccaagaaaacctttaacagtgtcagcaaaattgaccgactgtcaagaatagccttcccgctgctatttggaatctttaacttagtctactgggctacgtatttaaacagagagcctcagctaaaagcccccacaccacatcaatagatcttttactcacattctgttgttcagtcctctgcactgggaatttatttatgttctcaacgcagtaattcccatctgctttattgcctctgtcttaaagaatttgaaagtttccttattttcataattcatttaagaacaagagacccctgtctggcagtctggagcaaagcagactatgcagcttggagacaggattctgacagagcaagcgaaagagcaaagtcatgtcagaaggagacag

SEQ ID NO: 11769 - DNA, 4067 bp, Homo sapiens
ggaaggcacgctcttgtcctggctgcaaaattgcctgtttttccctttccagtggacgctggtgaaatgccctcttgtgtaggggtctctcccattctgaacacgaaaactcaacttagtctttgatatggatggcatgggatgctgctccagcccgcgatgaggaaaagtccaggtctgtctgactgtctttgggcctggatcctccttctgagcacactgactggaagaagctatggacagccgtcattacaagatgaacttaaagacaataccactgtcttcaccaggattttggacagactcctagatggttatgacaatcgcctgagaccaggattgggagagcgtgtaaccgaagtgaagactgatatcttcgtcaccagtttcggacccgtttcagaccatgatatggaatatacaatagatgtatttttccgtcaaagctggaaggatgaaaggttaaaatttaaaggacctatgacagtcctccggttaaataacctaatggcaagtaaaatctggactccggacacatttttccacaatggaaagaagtcagtggcccacaacatgaccatgcccaacaaactcctgcggatcacagaggatggcaccttgctgtacaccatgaggctgacagtgagagctgaatgtccgatgcatttggaggacttccctatggatgcccatgcttgcccactaaaatttggaagttatgcttatacaagagcagaagttgtttatgaatggaccagagagccagcacgctcagtggttgtagcagaagatggatcacgtctaaaccagtatgaccttcttggacaaacagtagactctggaattgtccagtcaagtacaggagaatatgttgttatgaccactcatttccacttgaagagaaagattggctactttgttattcaaacatacctgccatgcataatgacagtgattctctcacaagtctccttctggctcaacagagagtctgtaccagcaagaactgtctttggagtaacaactgtgctcaccatgacaacattgagcatcagtgccagaaactccctccctaaggtggcttatgcaacagctatggattggtttattgccgtgtgctatgcctttgtgttctcagctctgattgagtttgccacagtaaactatttcactaagagaggttatgcatgggatggcaaaagtgtggttccagaaaagccaaagaaagtaaaggatcctcttattaagaaaaacaacacttacgctccaacagcaaccagctacacccctaatttggccaggggcgacccgggcttagccaccattgctaaaagtgcaaccatagaacctaaagaggtcaagcccgaaacaaaaccaccagaacccaagaaaacctttaacagtgtcagcaaaattgaccgactgtcaagaatagccttcccgctgctatttggaatctttaacttagtctactgggctacgtatttaaacagagagcctcagctaaaagcccccacaccacatcaatagatcttttactcacattctgttgttcagtcctctgcactgggaatttatttatgttctcaacgcagtaattcccatctgctttattgcctctgtcttaaagaatttgaaagtttccttattttcataattcatttaagaacaagagacccctgtctggcagtctggagcaaagcagactatgcagcttggagacaggattctgacagagcaagcgaaagagcaaagtcatgtcagaaggagacagaatgagagagaaaagagggggaagatggttcaaagatacaagaaaaagtagaaaaaaaaataacacttaactaaaacccctaggtcatttgtagatatatatttccaaatattctaaaaaagatactgtatatgtcaaaaatatttttatgtgaaggtgtttcaaagggtaaattataaatgtttcatgaagaaaaaattttaaaaatctacgtctttattacacaaactatggtgtgcttatgtttttgttttgctttttaaactgatgtatagctttaacattttgtttccaaagctgaagatccccattctttctctttgaaaaaaaaaaaggcctaatgcattattttgtcataaaatgctattttaaaattcatggaactttcatacgtaaaggtgcagttgctcattgtagagcacatttagtccaatgaagataaatgctttaaatagtttacttcactttcatctgagcttttaccactagactcaaggaagaataattttaacagacatgtatactccatagaaactaaactaaaatagtttaaaaatattccctttttcaccctattttcagatagcacatgagcccaacactcacttaattctcattatgaagatgtttttagaggggcaaaaatattttgcaagctctggaattgttgaatgtattcttttatataactacattaaaagctttagattgaaatttatgactagcaaacaaaaatagaatatataaacgatatatgtaaatatacagcatgagattgtacattttttacttttttaaaattgtgttcttaaaatattgtgtaagaatcactgcacttagctgttggaatgttgttaaatgctatggaaatacatttagaacctgcatttaagaacagaacagcaagtatgaaccacatggaacttaaaacatatgggtgtgaagtccacttatgtagacaaaacttataatttccaaactgttgtctagtatacagtgatcagttgctctctgttcaagtcattccacacatttccctattttaggctattataatatagaaagaaaatgggaagcattagttggagctagaaaatgaactgtatattattgctatatttgctaataccaactatttcaataagtgttgtaccatatgtagcattaaatataaaatacataaaagaatgtacagaaaatagcttttattgagtaatattacatttcatttatactgtagcaatatatttgtaggtatactatgtaagggctttaaataaaagaggtccattaatacttccttataaaaattctagtctgtttcattactgcccagatgttttagagataaatatttatgcagaaggtatttttgaagtctccttttgtctgatagagtttaacagatatttaaatttagtgctcagaatccacaagtcacggtctaaacacacttagaatactacagcataaatctgttagcattattgccaaataagacagttgggatccaaacccaagtcttgagcaatgtttttctcaaaaagctgctatccaatgatataggaaaatacattgtgttttcctaaacacacttttctttttaaatgtgcttcattgtttgatttggtcctgcctaaatttcacaagctaggccaatgaaggctgaatcaaagacatttcatccaccaatatcatgtgtagatattatgtatagaaaataaaataaattatggctctaacttctgtgttgctgtttatcttgttatttttcggcgttatactaatgtgtttattgagagcattttaccttccagacttctcatggctaacttttggtctgtattttgctccttagatgtgaatatttcttattagtctgcttcctgctacgcaatgactgcatttctatcatttctcagtttgttagtatatgtggatagtattctactgtataaatgattgcaaagtttatcaaaaacaaattattatatgtagcttttctacagtgctttgctaaaccatgtagtactagttaagtcttccttgaaaataaagatacactcttataggggacagttcctgttcactcccaggaaacttttttaaaagatgacactgaatgtttattgcactttagtgcagtgaagtggcaataaaacctaacatgaatcaaggttgtttatggcagatgcatgtgttgctttacagagtttagcaaaagctcttaattttatgtcatactgtattctactgaataataaagctaacattattcaataataaaatggaa

SEQ ID NO: 11770 - DNA, 4273 bp, Homo sapiens
gggagagaggcgagacgagtgctctccccacacgtgtaaccctgcatctcccagtttcagagcttgcgttcattcatatgcaggcagtggtttaatatttgatcaaagctgcagattggatattgggaagcaaatttgggtgtgaaatcttcagcaaaggagcacgcagagtccatgatggctcagaccaagtgagtgagaggcagagcgaggacgcccctctgctctggcgcgcccggactcggactcgcagactcgcgctggctccagtctctccacgattctctctcccagacttttccccggtcttaagagatcctgtgtccagagggggccttagctgctccagcccgcgatgaggaaaagtccaggtctgtctgactgtctttgggcctggatcctccttctgagcacactgactggaagaagctatggacagccgtcattacaagatgaacttaaagacaataccactgtcttcaccaggattttggacagactcctagatggttatgacaatcgcctgagaccaggattgggagagcgtgtaaccgaagtgaagactgatatcttcgtcaccagtttcggacccgtttcagaccatgatatggaatatacaatagatgtatttttccgtcaaagctggaaggatgaaaggttaaaatttaaaggacctatgacagtcctccggttaaataacctaatggcaagtaaaatctggactccggacacatttttccacaatggaaagaagtcagtggcccacaacatgaccatgcccaacaaactcctgcggatcacagaggatggcaccttgctgtacaccatgaggctgacagtgagagctgaatgtccgatgcatttggaggacttccctatggatgcccatgcttgcccactaaaatttggaagttatgcttatacaagagcagaagttgtttatgaatggaccagagagccagcacgctcagtggttgtagcagaagatggatcacgtctaaaccagtatgaccttcttggacaaacagtagactctggaattgtccagtcaagtacaggagaatatgttgttatgaccactcatttccacttgaagagaaagattggctactttgttattcaaacatacctgccatgcataatgacagtgattctctcacaagtctccttctggctcaacagagagtctgtaccagcaagaactgtctttggagtaacaactgtgctcaccatgacaacattgagcatcagtgccagaaactccctccctaaggtggcttatgcaacagctatggattggtttattgccgtgtgctatgcctttgtgttctcagctctgattgagtttgccacagtaaactatttcactaagagaggttatgcatgggatggcaaaagtgtggttccagaaaagccaaagaaagtaaaggatcctcttattaagaaaaacaacacttacgctccaacagcaaccagctacacccctaatttggccaggggcgacccgggcttagccaccattgctaaaagtgcaaccatagaacctaaagaggtcaagcccgaaacaaaaccaccagaacccaagaaaacctttaacagtgtcagcaaaattgaccgactgtcaagaatagccttcccgctgctatttggaatctttaacttagtctactgggctacgtatttaaacagagagcctcagctaaaagcccccacaccacatcaatagatcttttactcacattctgttgttcagtcctctgcactgggaatttatttatgttctcaacgcagtaattcccatctgctttattgcctctgtcttaaagaatttgaaagtttccttattttcataattcatttaagaacaagagacccctgtctggcagtctggagcaaagcagactatgcagcttggagacaggattctgacagagcaagcgaaagagcaaagtcatgtcagaaggagacagaatgagagagaaaagagggggaagatggttcaaagatacaagaaaaagtagaaaaaaaaataacacttaactaaaacccctaggtcatttgtagatatatatttccaaatattctaaaaaagatactgtatatgtcaaaaatatttttatgtgaaggtgtttcaaagggtaaattataaatgtttcatgaagaaaaaattttaaaaatctacgtctttattacacaaactatggtgtgcttatgtttttgttttgctttttaaactgatgtatagctttaacattttgtttccaaagctgaagatccccattctttctctttgaaaaaaaaaaaggcctaatgcattattttgtcataaaatgctattttaaaattcatggaactttcatacgtaaaggtgcagttgctcattgtagagcacatttagtccaatgaagataaatgctttaaatagtttacttcactttcatctgagcttttaccactagactcaaggaagaataattttaacagacatgtatactccatagaaactaaactaaaatagtttaaaaatattccctttttcaccctattttcagatagcacatgagcccaacactcacttaattctcattatgaagatgtttttagaggggcaaaaatattttgcaagctctggaattgttgaatgtattcttttatataactacattaaaagctttagattgaaatttatgactagcaaacaaaaatagaatatataaacgatatatgtaaatatacagcatgagattgtacattttttacttttttaaaattgtgttcttaaaatattgtgtaagaatcactgcacttagctgttggaatgttgttaaatgctatggaaatacatttagaacctgcatttaagaacagaacagcaagtatgaaccacatggaacttaaaacatatgggtgtgaagtccacttatgtagacaaaacttataatttccaaactgttgtctagtatacagtgatcagttgctctctgttcaagtcattccacacatttccctattttaggctattataatatagaaagaaaatgggaagcattagttggagctagaaaatgaactgtatattattgctatatttgctaataccaactatttcaataagtgttgtaccatatgtagcattaaatataaaatacataaaagaatgtacagaaaatagcttttattgagtaatattacatttcatttatactgtagcaatatatttgtaggtatactatgtaagggctttaaataaaagaggtccattaatacttccttataaaaattctagtctgtttcattactgcccagatgttttagagataaatatttatgcagaaggtatttttgaagtctccttttgtctgatagagtttaacagatatttaaatttagtgctcagaatccacaagtcacggtctaaacacacttagaatactacagcataaatctgttagcattattgccaaataagacagttgggatccaaacccaagtcttgagcaatgtttttctcaaaaagctgctatccaatgatataggaaaatacattgtgttttcctaaacacacttttctttttaaatgtgcttcattgtttgatttggtcctgcctaaatttcacaagctaggccaatgaaggctgaatcaaagacatttcatccaccaatatcatgtgtagatattatgtatagaaaataaaataaattatggctctaacttctgtgttgctgtttatcttgttatttttcggcgttatactaatgtgtttattgagagcattttaccttccagacttctcatggctaacttttggtctgtattttgctccttagatgtgaatatttcttattagtctgcttcctgctacgcaatgactgcatttctatcatttctcagtttgttagtatatgtggatagtattctactgtataaatgattgcaaagtttatcaaaaacaaattattatatgtagcttttctacagtgctttgctaaaccatgtagtactagttaagtcttccttgaaaataaagatacactcttataggggacagttcctgttcactcccaggaaacttttttaaaagatgacactgaatgtttattgcactttagtgcagtgaagtggcaataaaacctaacatgaatcaaggttgtttatggcagatgcatgtgttgctttacagagtttagcaaaagctcttaattttatgtcatactgtattctactgaataataaagctaacattattcaataataaaatggaatacttgactc

SEQ ID NO: 11771 - DNA, 4087 bp, Homo sapiens
gatacacagacagagctttgaacgtggcttttcctagctggagagacaggaatgttatagtcggggggggggggcggggggagacggggggagagagagagagagagaagaaggagagcgagcgagcgagcaagggagcgagcaggacaggagcctgatcccacagcagctgctccagcccgcgatgaggaaaagtccaggtctgtctgactgtctttgggcctggatcctccttctgagcacactgactggaagaagctatggacagccgtcattacaagatgaacttaaagacaataccactgtcttcaccaggattttggacagactcctagatggttatgacaatcgcctgagaccaggattgggagagcgtgtaaccgaagtgaagactgatatcttcgtcaccagtttcggacccgtttcagaccatgatatggaatatacaatagatgtatttttccgtcaaagctggaaggatgaaaggttaaaatttaaaggacctatgacagtcctccggttaaataacctaatggcaagtaaaatctggactccggacacatttttccacaatggaaagaagtcagtggcccacaacatgaccatgcccaacaaactcctgcggatcacagaggatggcaccttgctgtacaccatgaggctgacagtgagagctgaatgtccgatgcatttggaggacttccctatggatgcccatgcttgcccactaaaatttggaagttatgcttatacaagagcagaagttgtttatgaatggaccagagagccagcacgctcagtggttgtagcagaagatggatcacgtctaaaccagtatgaccttcttggacaaacagtagactctggaattgtccagtcaagtacaggagaatatgttgttatgaccactcatttccacttgaagagaaagattggctactttgttattcaaacatacctgccatgcataatgacagtgattctctcacaagtctccttctggctcaacagagagtctgtaccagcaagaactgtctttggagtaacaactgtgctcaccatgacaacattgagcatcagtgccagaaactccctccctaaggtggcttatgcaacagctatggattggtttattgccgtgtgctatgcctttgtgttctcagctctgattgagtttgccacagtaaactatttcactaagagaggttatgcatgggatggcaaaagtgtggttccagaaaagccaaagaaagtaaaggatcctcttattaagaaaaacaacacttacgctccaacagcaaccagctacacccctaatttggccaggggcgacccgggcttagccaccattgctaaaagtgcaaccatagaacctaaagaggtcaagcccgaaacaaaaccaccagaacccaagaaaacctttaacagtgtcagcaaaattgaccgactgtcaagaatagccttcccgctgctatttggaatctttaacttagtctactgggctacgtatttaaacagagagcctcagctaaaagcccccacaccacatcaatagatcttttactcacattctgttgttcagtcctctgcactgggaatttatttatgttctcaacgcagtaattcccatctgctttattgcctctgtcttaaagaatttgaaagtttccttattttcataattcatttaagaacaagagacccctgtctggcagtctggagcaaagcagactatgcagcttggagacaggattctgacagagcaagcgaaagagcaaagtcatgtcagaaggagacagaatgagagagaaaagagggggaagatggttcaaagatacaagaaaaagtagaaaaaaaaataacacttaactaaaacccctaggtcatttgtagatatatatttccaaatattctaaaaaagatactgtatatgtcaaaaatatttttatgtgaaggtgtttcaaagggtaaattataaatgtttcatgaagaaaaaattttaaaaatctacgtctttattacacaaactatggtgtgcttatgtttttgttttgctttttaaactgatgtatagctttaacattttgtttccaaagctgaagatccccattctttctctttgaaaaaaaaaaaggcctaatgcattattttgtcataaaatgctattttaaaattcatggaactttcatacgtaaaggtgcagttgctcattgtagagcacatttagtccaatgaagataaatgctttaaatagtttacttcactttcatctgagcttttaccactagactcaaggaagaataattttaacagacatgtatactccatagaaactaaactaaaatagtttaaaaatattccctttttcaccctattttcagatagcacatgagcccaacactcacttaattctcattatgaagatgtttttagaggggcaaaaatattttgcaagctctggaattgttgaatgtattcttttatataactacattaaaagctttagattgaaatttatgactagcaaacaaaaatagaatatataaacgatatatgtaaatatacagcatgagattgtacattttttacttttttaaaattgtgttcttaaaatattgtgtaagaatcactgcacttagctgttggaatgttgttaaatgctatggaaatacatttagaacctgcatttaagaacagaacagcaagtatgaaccacatggaacttaaaacatatgggtgtgaagtccacttatgtagacaaaacttataatttccaaactgttgtctagtatacagtgatcagttgctctctgttcaagtcattccacacatttccctattttaggctattataatatagaaagaaaatgggaagcattagttggagctagaaaatgaactgtatattattgctatatttgctaataccaactatttcaataagtgttgtaccatatgtagcattaaatataaaatacataaaagaatgtacagaaaatagcttttattgagtaatattacatttcatttatactgtagcaatatatttgtaggtatactatgtaagggctttaaataaaagaggtccattaatacttccttataaaaattctagtctgtttcattactgcccagatgttttagagataaatatttatgcagaaggtatttttgaagtctccttttgtctgatagagtttaacagatatttaaatttagtgctcagaatccacaagtcacggtctaaacacacttagaatactacagcataaatctgttagcattattgccaaataagacagttgggatccaaacccaagtcttgagcaatgtttttctcaaaaagctgctatccaatgatataggaaaatacattgtgttttcctaaacacacttttctttttaaatgtgcttcattgtttgatttggtcctgcctaaatttcacaagctaggccaatgaaggctgaatcaaagacatttcatccaccaatatcatgtgtagatattatgtatagaaaataaaataaattatggctctaacttctgtgttgctgtttatcttgttatttttcggcgttatactaatgtgtttattgagagcattttaccttccagacttctcatggctaacttttggtctgtattttgctccttagatgtgaatatttcttattagtctgcttcctgctacgcaatgactgcatttctatcatttctcagtttgttagtatatgtggatagtattctactgtataaatgattgcaaagtttatcaaaaacaaattattatatgtagcttttctacagtgctttgctaaaccatgtagtactagttaagtcttccttgaaaataaagatacactcttataggggacagttcctgttcactcccaggaaacttttttaaaagatgacactgaatgtttattgcactttagtgcagtgaagtggcaataaaacctaacatgaatcaaggttgtttatggcagatgcatgtgttgctttacagagtttagcaaaagctcttaattttatgtcatactgtattctactgaataataaagctaacattattcaataataaaa

SEQ ID NO: 11772 - DNA, 4223 bp, Homo sapiens
agcttaaaaattttaatgcacagttcactgtggaaactgaaatcttaaaagtccaaatatttagatgataaacaacaagaagagaataaaccaaactatattctaaatataaaacctagagataaacaactcacagtttttatgttgagcaatactgtcacctgaaagcgtttcagcttgtattcttttacaggagaataaggacactgatatatttctgaatggagaaatggaagggaaagtggagaatggatggtccaggtttccattgcttccaatgaggtgtcatatcccagtgagctgctccagcccgcgatgaggaaaagtccaggtctgtctgactgtctttgggcctggatcctccttctgagcacactgactggaagaagctatggacagccgtcattacaagatgaacttaaagacaataccactgtcttcaccaggattttggacagactcctagatggttatgacaatcgcctgagaccaggattgggagagcgtgtaaccgaagtgaagactgatatcttcgtcaccagtttcggacccgtttcagaccatgatatggaatatacaatagatgtatttttccgtcaaagctggaaggatgaaaggttaaaatttaaaggacctatgacagtcctccggttaaataacctaatggcaagtaaaatctggactccggacacatttttccacaatggaaagaagtcagtggcccacaacatgaccatgcccaacaaactcctgcggatcacagaggatggcaccttgctgtacaccatgaggctgacagtgagagctgaatgtccgatgcatttggaggacttccctatggatgcccatgcttgcccactaaaatttggaagttatgcttatacaagagcagaagttgtttatgaatggaccagagagccagcacgctcagtggttgtagcagaagatggatcacgtctaaaccagtatgaccttcttggacaaacagtagactctggaattgtccagtcaagtacaggagaatatgttgttatgaccactcatttccacttgaagagaaagattggctactttgttattcaaacatacctgccatgcataatgacagtgattctctcacaagtctccttctggctcaacagagagtctgtaccagcaagaactgtctttggagtaacaactgtgctcaccatgacaacattgagcatcagtgccagaaactccctccctaaggtggcttatgcaacagctatggattggtttattgccgtgtgctatgcctttgtgttctcagctctgattgagtttgccacagtaaactatttcactaagagaggttatgcatgggatggcaaaagtgtggttccagaaaagccaaagaaagtaaaggatcctcttattaagaaaaacaacacttacgctccaacagcaaccagctacacccctaatttggccaggggcgacccgggcttagccaccattgctaaaagtgcaaccatagaacctaaagaggtcaagcccgaaacaaaaccaccagaacccaagaaaacctttaacagtgtcagcaaaattgaccgactgtcaagaatagccttcccgctgctatttggaatctttaacttagtctactgggctacgtatttaaacagagagcctcagctaaaagcccccacaccacatcaatagatcttttactcacattctgttgttcagtcctctgcactgggaatttatttatgttctcaacgcagtaattcccatctgctttattgcctctgtcttaaagaatttgaaagtttccttattttcataattcatttaagaacaagagacccctgtctggcagtctggagcaaagcagactatgcagcttggagacaggattctgacagagcaagcgaaagagcaaagtcatgtcagaaggagacagaatgagagagaaaagagggggaagatggttcaaagatacaagaaaaagtagaaaaaaaaataacacttaactaaaacccctaggtcatttgtagatatatatttccaaatattctaaaaaagatactgtatatgtcaaaaatatttttatgtgaaggtgtttcaaagggtaaattataaatgtttcatgaagaaaaaattttaaaaatctacgtctttattacacaaactatggtgtgcttatgtttttgttttgctttttaaactgatgtatagctttaacattttgtttccaaagctgaagatccccattctttctctttgaaaaaaaaaaaggcctaatgcattattttgtcataaaatgctattttaaaattcatggaactttcatacgtaaaggtgcagttgctcattgtagagcacatttagtccaatgaagataaatgctttaaatagtttacttcactttcatctgagcttttaccactagactcaaggaagaataattttaacagacatgtatactccatagaaactaaactaaaatagtttaaaaatattccctttttcaccctattttcagatagcacatgagcccaacactcacttaattctcattatgaagatgtttttagaggggcaaaaatattttgcaagctctggaattgttgaatgtattcttttatataactacattaaaagctttagattgaaatttatgactagcaaacaaaaatagaatatataaacgatatatgtaaatatacagcatgagattgtacattttttacttttttaaaattgtgttcttaaaatattgtgtaagaatcactgcacttagctgttggaatgttgttaaatgctatggaaatacatttagaacctgcatttaagaacagaacagcaagtatgaaccacatggaacttaaaacatatgggtgtgaagtccacttatgtagacaaaacttataatttccaaactgttgtctagtatacagtgatcagttgctctctgttcaagtcattccacacatttccctattttaggctattataatatagaaagaaaatgggaagcattagttggagctagaaaatgaactgtatattattgctatatttgctaataccaactatttcaataagtgttgtaccatatgtagcattaaatataaaatacataaaagaatgtacagaaaatagcttttattgagtaatattacatttcatttatactgtagcaatatatttgtaggtatactatgtaagggctttaaataaaagaggtccattaatacttccttataaaaattctagtctgtttcattactgcccagatgttttagagataaatatttatgcagaaggtatttttgaagtctccttttgtctgatagagtttaacagatatttaaatttagtgctcagaatccacaagtcacggtctaaacacacttagaatactacagcataaatctgttagcattattgccaaataagacagttgggatccaaacccaagtcttgagcaatgtttttctcaaaaagctgctatccaatgatataggaaaatacattgtgttttcctaaacacacttttctttttaaatgtgcttcattgtttgatttggtcctgcctaaatttcacaagctaggccaatgaaggctgaatcaaagacatttcatccaccaatatcatgtgtagatattatgtatagaaaataaaataaattatggctctaacttctgtgttgctgtttatcttgttatttttcggcgttatactaatgtgtttattgagagcattttaccttccagacttctcatggctaacttttggtctgtattttgctccttagatgtgaatatttcttattagtctgcttcctgctacgcaatgactgcatttctatcatttctcagtttgttagtatatgtggatagtattctactgtataaatgattgcaaagtttatcaaaaacaaattattatatgtagcttttctacagtgctttgctaaaccatgtagtactagttaagtcttccttgaaaataaagatacactcttataggggacagttcctgttcactcccaggaaacttttttaaaagatgacactgaatgtttattgcactttagtgcagtgaagtggcaataaaacctaacatgaatcaaggttgtttatggcagatgcatgtgttgctttacagagtttagcaaaagctcttaattttatgtcatactgtattctactgaataataaagctaacattattcaataataaaatggaa

SEQ ID NO: 11773 - DNA, 583 bp, Homo sapiens
atatttctgaatggagaaatggaagggaaagtggagaatggatggtccaggtttccattgcttccaatgaggtgtcatatcccagtgaggtcatttcctgacttcaaagcattcatctaaactgcctcagtcagccctggtggttataacctgatgtttcttgctagagacattgatctctacttattctacttttcagctgctccagcccgcgatgaggaaaagtccaggtctgtctgactgtctttgggcctggatcctccttctgagcacactgactggaagaagctatggacagccgtcattacaagatgaacttaaagacaataccactgtcttcaccaggattttggacagactcctagatggttatgacaatcgcctgagaccaggattgggagagcgtgtaaccgaagtgaagactgatatcttcgtcaccagtttcggacccgtttcagaccatgatatggaatatacaatagatgtatttttccgtcaaagctggaaggatgaaaggttaaaatttaaaggacctatgacagtcctccggttaaataacctaatggcaagtaaaatctggact

SEQ ID NO: 11774 - DNA, 2770 bp, Homo sapiens
aaacgcgtcgtttcgcagcacttgatcggaacccggctgcctctaagacttggtcttgggcaaccgtgggtgggcaggaagggaaattatttattttattttgttaaggggagtgaagaaaagaagacgtgaggaccgcagttcactgtaatgtagagtaattgcaaaagtgggctgcctgcccctagcttttcccgctgtggttgcggaggtggtcttggttgagggggttgtggcgtgaagtacccatctctcctctcctctcctttcctcccctcccctccaacccattccctttccagctgctatgccagtttaaagtccagggtgttattattacgtgtgcgcaaaacagtgtttgctgacgatgaggctgggggacgttcctggcagagagaagtctgattacttggtcatcttgctgttaaagaaagaaagaaagaaaaaaagaaagaaagaaacagaaaggaaaagggtgggggtgggggtccataaaaaagaaatcgtctctcaatcatcaagtcctacacagagtccaggaagtaatctccatagctttaacacgaatccctaactaaaaggatattctttggggttacttggatagtgaaactgaaggcaattttaagtgtattttgtttttcattccatggctttgtaaagagcggcggtgatgaagacaaaattgaacatctacaacatgcagttcctgctttttgttttcttggtgtgggaccctgccaggttggtgctggctaacatccaagaagatgaggctaaaaataacattaccatctttacgagaattcttgacagacttctggatggttacgataatcggcttagaccaggactgggagacagtattactgaagtcttcactaacatctacgtgaccagttttggccctgtctcagatacagatatggaatatacaattgatgttttctttcgacaaaaatggaaagatgaacgtttaaaatttaaaggtcctatgaatatccttcgactaaacaatttaatggctagcaaaatctggactccagataccttttttcacaatgggaaaaaatcagtagctcataatatgacaatgccaaataagttgcttcgaattcaggatgatgggactctgctgtataccatgaggcttacagttcaagctgaatgcccaatgcacttggaggatttcccaatggatgctcattcatgtcctctgaaatttggcagctatgcatatacaacttcagaggtcacttatatttggacttacaatgcatctgattcagtacaggttgctcctgatggctctaggttaaatcaatatgacctgctgggccaatcaatcggaaaggagacaattaaatccagtacaggtgaatatactgtaatgacagctcatttccacctgaaaagaaaaattgggtattttgtgattcaaacctatctgccttgcatcatgactgtcattctctcccaagtttcattctggcttaacagagaatctgtgcctgcaagaactgtgtttggagtaacaactgtcctaacaatgacaactctaagcatcagtgctcggaattctctccccaaagtggcttatgcaactgccatggactggtttattgctgtttgttatgcatttgtgttctctgccctaattgaatttgcaactgttaattacttcaccaaaagaggatgggcttgggatgggaagagtgtagtaaatgacaagaaaaaagaaaaggcttccgttatgatacagaacaacgcttatgcagtggctgttgccaattatgccccgaatctttcaaaagatccagttctctccaccatctccaagagtgcaaccacgccagaacccaacaagaagccagaaaacaagccagctgaagcaaagaaaactttcaacagtgttagcaaaattgacagaatgtccagaatagtttttccagttttgtttggtacctttaatttagtttactgggctacatatttaaacagagaacctgtattaggggtcagtccttgaattgagacccatgttatctttgggatgtatagcaacattaaatttggtttgttttgctatgtacagtctgactaataactgctaatttgtgatccaacatgtacagtatgtatatagtgacatagcttaccagtagacctttaatggagacatgcatttgctaactcatggaactgcagacagaaagcactccatgcgaaaacagccattgccttttttaaagatttaccctaggacctgatttaaagtgaatttcaagtgacctgattaatttcctattcttccaaatgagatgaaaatggggatcctgtacaaccctttgtggacccttttggtttagctcttaagtaggggtattttctactgttgcttaattatgatggaagataacattgtcattcctagatgaatcctttgaagtaacaaacattgtatctgacatcagctctgttcatgagtgctcagagtccctgctaatgtaattggaagcttggtacacataagaaaaactagagatttgaaatcagctatgaattactctatatagtatctatagccatgtacatattacagcatgacaagctcaaataattatgagtcagcccgaaaggatgttaattatgcctacgatgtaataactattggaatgtcatggtcattacatttttagcttcagagtttatttgaaagtaataattgaaatcctacaatttattttaatcattggaaactaccttaatt

SEQ ID NO: 11775 - DNA, 2525 bp, Homo sapiens
cctagcgctcctctccggcttccaccagcccatcgctccacgctctcttggctgctgcagtctcggtctctctctctctctctctctctctctctctctctctctctctctctctctctctctctcccaagtttcctatctcgtcaagatcagggcaaaaggaagaaaacaccgaattctgcttgccgtttcagagcggcggtgatgaagacaaaattgaacatctacaacatgcagttcctgctttttgttttcttggtgtgggaccctgccaggttggtgctggctaacatccaagaagatgaggctaaaaataacattaccatctttacgagaattcttgacagacttctggatggttacgataatcggcttagaccaggactgggagacagtattactgaagtcttcactaacatctacgtgaccagttttggccctgtctcagatacagatatggaatatacaattgatgttttctttcgacaaaaatggaaagatgaacgtttaaaatttaaaggtcctatgaatatccttcgactaaacaatttaatggctagcaaaatctggactccagataccttttttcacaatgggaaaaaatcagtagctcataatatgacaatgccaaataagttgcttcgaattcaggatgatgggactctgctgtataccatgaggcttacagttcaagctgaatgcccaatgcacttggaggatttcccaatggatgctcattcatgtcctctgaaatttggcagctatgcatatacaacttcagaggtcacttatatttggacttacaatgcatctgattcagtacaggttgctcctgatggctctaggttaaatcaatatgacctgctgggccaatcaatcggaaaggagacaattaaatccagtacaggtgaatatactgtaatgacagctcatttccacctgaaaagaaaaattgggtattttgtgattcaaacctatctgccttgcatcatgactgtcattctctcccaagtttcattctggcttaacagagaatctgtgcctgcaagaactgtgtttggagtaacaactgtcctaacaatgacaactctaagcatcagtgctcggaattctctccccaaagtggcttatgcaactgccatggactggtttattgctgtttgttatgcatttgtgttctctgccctaattgaatttgcaactgttaattacttcaccaaaagaggatgggcttgggatgggaagagtgtagtaaatgacaagaaaaaagaaaaggcttccgttatgatacagaacaacgcttatgcagtggctgttgccaattatgccccgaatctttcaaaagatccagttctctccaccatctccaagagtgcaaccacgccagaacccaacaagaagccagaaaacaagccagctgaagcaaagaaaactttcaacagtgttagcaaaattgacagaatgtccagaatagtttttccagttttgtttggtacctttaatttagtttactgggctacatatttaaacagagaacctgtattaggggtcagtccttgaattgagacccatgttatctttgggatgtatagcaacattaaatttggtttgttttgctatgtacagtctgactaataactgctaatttgtgatccaacatgtacagtatgtatatagtgacatagcttaccagtagacctttaatggagacatgcatttgctaactcatggaactgcagacagaaagcactccatgcgaaaacagccattgccttttttaaagatttaccctaggacctgatttaaagtgaatttcaagtgacctgattaatttcctattcttccaaatgagatgaaaatggggatcctgtacaaccctttgtggacccttttggtttagctcttaagtaggggtattttctactgttgcttaattatgatggaagataacattgtcattcctagatgaatcctttgaagtaacaaacattgtatctgacatcagctctgttcatgagtgctcagagtccctgctaatgtaattggaagcttggtacacataagaaaaactagagatttgaaatcagctatgaattactctatatagtatctatagccatgtacatattacagcatgacaagctcaaataattatgagtcagcccgaaaggatgttaattatgcctacgatgtaataactattggaatgtcatggtcattacatttttagcttcagagtttatttgaaagtaataattgaaatcctacaatttattttaatcattggaaactaccttaattaaaaaaaaagaaaagaaatgtgtcttaacatttccaggtatgtgttgtattgaaattgatcagctaaattttacgggtgctggagactggaaaaagcatccagtttggttgctgtggagcaacatgcatattggattagaaaattgtgccaaaaactcccactgatgagaattcataggtgccccacactatgacaaacacttatatgattctcctctttcctg

SEQ ID NO: 11776 - DNA, 596 bp, Homo sapiens
agcacttgatcggaacccggctgcctctaagacttggtcttgggcaaccgtgggtgggcaggaagggaaattatttattttattttgttaaggggagtgaagaaaagaagacgtgaggaccgcagttcactagcggcggtgatgaagacaaaattgaacatctacaacatgcagttcctgctttttgttttcttggtgtgggaccctgccaggttggtgctggctaacatccaagaagatgaggctaaaaataacattaccatctttacgagaattcttgacagacttctggatggttacgataatcggcttagaccaggactgggagacagtattactgaagtcttcactaacatctacgtgaccagttttggccctgtctcagatacagatatggaatatacaattgatgttttctttcgacaaaaatggaaagatgaacgtttaaaatttaaaggtcctatgaatatccttcgactaaacaatttaatggctagcaaaatctggactccagataccttttttcacaatgggaaaaaatcagtagctcataatatgacaatgccaaataagttgcttcgaattcaggatgatgg

SEQ ID NO: 11777 - DNA, 582 bp, Homo sapiens
gtcaaacgcgtcgtttcgcagcacttgatcggaacccggctgcctctaagacttggtcttgggcaaccgtgggtgggcaggaagggaaattatttattttattttgttaaggggagtgaagaaaagaagacgtgaggaccgcagttcactgtaatgtagaagcggcggtgatgaagacaaaattgaacatctacaacatgcagttcctgctttttgttttcttggtgtgggaccctgccaggttggtgctggctaacatccaagaagatgaggctaaaaataacattaccatctttacgagaattcttgacagacttctggatggttacgataatcggcttagaccaggactgggagacagtattactgaagtcttcactaacatctacgtgaccagttttggccctgtctcagatacagatatggaatatacaattgatgttttctttcgacaaaaatggaaagatgaacgtttaaaatttaaaggtcctatgaatatccttcgactaaacaatttaatggctagcaaaatctggactccagataccttttttcacaatgggaaaaaatcagtagctcata

SEQ ID NO: 11778 - DNA, 1562 bp, Homo sapiens
ggcggtgatgaagacaaaattgaacatctacaacatgcagttcctgctttttgttttcttggtgtgggaccctgccaggttggtgctggctaacatccaagaagatgaggctaaaaataacattaccatctttacgagaattcttgacagacttctggatggttacgataatcggcttagaccaggactgggagacagtattactgaagtcttcactaacatctacgtgaccagttttggccctgtctcagatacagatatggaatatacaattgatgttttctttcgacaaaaatggaaagatgaacgtttaaaatttaaaggtcctatgaatatccttcgactaaacaatttaatggctagcaaaatctggactccagataccttttttcacaatgggaaaaaatcagtagctcataatatgacaatgccaaataagttgcttcgaattcaggatgatgggactctgctgtataccatgaggcttacagttcaagctgaatgcccaatgcacttggaggatttcccaatggatgctcattcatgtcctctgaaatttggcagctatgcatatacaacttcagaggtcacttatatttggacttacaatgcatctgattcagtacaggttgctcctgatggctctaggttaaatcaatatgacctgctgggccaatcaatcggaaaggagacaattaaatccagtacaggtgaatatactgtaatgacagctcatttccacctgaaaagaaaaattgggtattttgtgattcaaacctatctgccttgcatcatgactgtcattctctcccaagtttcattctggcttaacagagaatctgtgcctgcaagaactgtgtttggagtaacaactgtcctaacaatgacaactctaagcatcagtgctcggaattctctccccaaagtggcttatgcaactgccatggactggtttattgctgtttgttatgcatttgtgttctctgccctaattgaatttgcaactgttaattacttcaccaaaagaggatgggcttgggatgggaagagtgtagtaaatgacaagtccccttcaataaaagctgaaggcattacattaacatacaactcagtgaaagcaattcttcaaggagctaagctaatatggtccaagtatatagctttctcatggcccagtttattccaagaaaagactttagagtacttagagaagtggatggactgtttaaccttcaaacaatcttctaaaaaagaaaaggcttccgttatgatacagaacaacgcttatgcagtggctgttgccaattatgccccgaatctttcaaaagatccagttctctccaccatctccaagagtgcaaccacgccagaacccaacaagaagccagaaaacaagccagctgaagcaaagaaaactttcaacagtgttagcaaaattgacagaatgtccagaatagtttttccagttttgtttggtacctttaatttagtttactgggctacatatttaaacagagaacctgtattaggggtcagtccttgaattgagacccatgttatct

SEQ ID NO: 11779 - DNA, 3411 bp, Homo sapiens
gagaacaagctttagagatgataaaagcacagtatcttggcaaccttttgtgttgggttatttttaaaaaatggataatattgtgctctagttctcatttattcagctacttgctgagtgatagcaacattacaactacagaacctgtatgtcatcttgacattagcggcggtgatgaagacaaaattgaacatctacaacatgcagttcctgctttttgttttcttggtgtgggaccctgccaggttggtgctggctaacatccaagaagatgaggctaaaaataacattaccatctttacgagaattcttgacagacttctggatggttacgataatcggcttagaccaggactgggagacagtattactgaagtcttcactaacatctacgtgaccagttttggccctgtctcagatacagatatggaatatacaattgatgttttctttcgacaaaaatggaaagatgaacgtttaaaatttaaaggtcctatgaatatccttcgactaaacaatttaatggctagcaaaatctggactccagataccttttttcacaatgggaaaaaatcagtagctcataatatgacaatgccaaataagttgcttcgaattcaggatgatgggactctgctgtataccatgaggcttacagttcaagctgaatgcccaatgcacttggaggatttcccaatggatgctcattcatgtcctctgaaatttggcagctatgcatatacaacttcagaggtcacttatatttggacttacaatgcatctgattcagtacaggttgctcctgatggctctaggttaaatcaatatgacctgctgggccaatcaatcggaaaggagacaattaaatccagtacaggtgaatatactgtaatgacagctcatttccacctgaaaagaaaaattgggtattttgtgattcaaacctatctgccttgcatcatgactgtcattctctcccaagtttcattctggcttaacagagaatctgtgcctgcaagaactgtgtttggagtaacaactgtcctaacaatgacaactctaagcatcagtgctcggaattctctccccaaagtggcttatgcaactgccatggactggtttattgctgtttgttatgcatttgtgttctctgccctaattgaatttgcaactgttaattacttcaccaaaagaggatgggcttgggatgggaagagtgtagtaaatgacaagaaaaaagaaaaggcttccgttatgatacagaacaacgcttatgcagtggctgttgccaattatgccccgaatctttcaaaagatccagttctctccaccatctccaagagtgcaaccacgccagaacccaacaagaagccagaaaacaagccagctgaagcaaagaaaactttcaacagtgttagcaaaattgacagaatgtccagaatagtttttccagttttgtttggtacctttaatttagtttactgggctacatatttaaacagagaacctgtattaggggtcagtccttgaattgagacccatgttatctttgggatgtatagcaacattaaatttggtttgttttgctatgtacagtctgactaataactgctaatttgtgatccaacatgtacagtatgtatatagtgacatagcttaccagtagacctttaatggagacatgcatttgctaactcatggaactgcagacagaaagcactccatgcgaaaacagccattgccttttttaaagatttaccctaggacctgatttaaagtgaatttcaagtgacctgattaatttcctattcttccaaatgagatgaaaatggggatcctgtacaaccctttgtggacccttttggtttagctcttaagtaggggtattttctactgttgcttaattatgatggaagataacattgtcattcctagatgaatcctttgaagtaacaaacattgtatctgacatcagctctgttcatgagtgctcagagtccctgctaatgtaattggaagcttggtacacataagaaaaactagagatttgaaatcagctatgaattactctatatagtatctatagccatgtacatattacagcatgacaagctcaaataattatgagtcagcccgaaaggatgttaattatgcctacgatgtaataactattggaatgtcatggtcattacatttttagcttcagagtttatttgaaagtaataattgaaatcctacaatttattttaatcattggaaactaccttaattaaaaaaaaagaaaagaaatgtgtcttaacatttccaggtatgtgttgtattgaaattgatcagctaaattttacgggtgctggagactggaaaaagcatccagtttggttgctgtggagcaacatgcatattggattagaaaattgtgccaaaaactcccactgatgagaattcataggtgccccacactatgacaaacacttatatgattctcctctttcctgtttactgcaaattctgccttaaggcttcttttcaagactcagaagccactaattataaaggaaagggcagttaattggcacatttttctcttgtgaaagcagttctttcagataagaattaatgtaaatctgcttttgtaaattgcaactttaaatttcgctgactcaaatttacaacagctttgtataccagaagaggttttggtaagggttgaacatttttacactgcaactttaaaacatcaccaatagattgtggattatttcacgtgcacaaacatacacacacacacacacacacacacacatacacagctaaattagaaaacacaattttaaattttatataattactagttattaatgggtaaaattcatttttcttttaatatcttaaaatattatttatgccccgaaatatgctaataaaagttaaagattgtgtattatgcctagattcaaagtttttggcaaacttcaaatacttttgattgacatgtacattagcagttattagttgacttttactaaaacatgcacctttacgatggtgtttttgtagaaacataagtagtcaaatagtaacatttattgcagttttgtacagtatttgagtatagtgcataaataggtatgttcataaaatcaataaaaggagtatctatggaaataagcaaaatatcagcaaaaattgctattcctttgcctcatttaatttttaaaatttctttgtttccatgtgattctattatatgctttgcatgcttgtataaaaccaaggtcacaaatgcaacttattaacggaatttgccaagaagacagccttgacattaaaaattccctcacaagaggtaatccataatccttaataaaataaaattgttacatgagccaataaatgtatttctttaattcc

SEQ ID NO: 11780 - DNA, 3401 bp, Homo sapiens
tcaaacgcgtcgtttcgcagcacttgatcggaacccggctgcctctaagacttggtcttgggcaaccgtgggtgggcaggaagggaaattatttattttattttgttaaggggagtgaagaaaagaagacgtgaggaccgcagttcactgtaatgtagagtaattgcaaaaagcggcggtgatgaagacaaaattgaacatctacaacatgcagttcctgctttttgttttcttggtgtgggaccctgccaggttggtgctggctaacatccaagaagatgaggctaaaaataacattaccatctttacgagaattcttgacagacttctggatggttacgataatcggcttagaccaggactgggagacagtattactgaagtcttcactaacatctacgtgaccagttttggccctgtctcagatacagatatggaatatacaattgatgttttctttcgacaaaaatggaaagatgaacgtttaaaatttaaaggtcctatgaatatccttcgactaaacaatttaatggctagcaaaatctggactccagataccttttttcacaatgggaaaaaatcagtagctcataatatgacaatgccaaataagttgcttcgaattcaggatgatgggactctgctgtataccatgaggcttacagttcaagctgaatgcccaatgcacttggaggatttcccaatggatgctcattcatgtcctctgaaatttggcagctatgcatatacaacttcagaggtcacttatatttggacttacaatgcatctgattcagtacaggttgctcctgatggctctaggttaaatcaatatgacctgctgggccaatcaatcggaaaggagacaattaaatccagtacaggtgaatatactgtaatgacagctcatttccacctgaaaagaaaaattgggtattttgtgattcaaacctatctgccttgcatcatgactgtcattctctcccaagtttcattctggcttaacagagaatctgtgcctgcaagaactgtgtttggagtaacaactgtcctaacaatgacaactctaagcatcagtgctcggaattctctccccaaagtggcttatgcaactgccatggactggtttattgctgtttgttatgcatttgtgttctctgccctaattgaatttgcaactgttaattacttcaccaaaagaggatgggcttgggatgggaagagtgtagtaaatgacaagaaaaaagaaaaggcttccgttatgatacagaacaacgcttatgcagtggctgttgccaattatgccccgaatctttcaaaagatccagttctctccaccatctccaagagtgcaaccacgccagaacccaacaagaagccagaaaacaagccagctgaagcaaagaaaactttcaacagtgttagcaaaattgacagaatgtccagaatagtttttccagttttgtttggtacctttaatttagtttactgggctacatatttaaacagagaacctgtattaggggtcagtccttgaattgagacccatgttatctttgggatgtatagcaacattaaatttggtttgttttgctatgtacagtctgactaataactgctaatttgtgatccaacatgtacagtatgtatatagtgacatagcttaccagtagacctttaatggagacatgcatttgctaactcatggaactgcagacagaaagcactccatgcgaaaacagccattgccttttttaaagatttaccctaggacctgatttaaagtgaatttcaagtgacctgattaatttcctattcttccaaatgagatgaaaatggggatcctgtacaaccctttgtggacccttttggtttagctcttaagtaggggtattttctactgttgcttaattatgatggaagataacattgtcattcctagatgaatcctttgaagtaacaaacattgtatctgacatcagctctgttcatgagtgctcagagtccctgctaatgtaattggaagcttggtacacataagaaaaactagagatttgaaatcagctatgaattactctatatagtatctatagccatgtacatattacagcatgacaagctcaaataattatgagtcagcccgaaaggatgttaattatgcctacgatgtaataactattggaatgtcatggtcattacatttttagcttcagagtttatttgaaagtaataattgaaatcctacaatttattttaatcattggaaactaccttaattaaaaaaaaagaaaagaaatgtgtcttaacatttccaggtatgtgttgtattgaaattgatcagctaaattttacgggtgctggagactggaaaaagcatccagtttggttgctgtggagcaacatgcatattggattagaaaattgtgccaaaaactcccactgatgagaattcataggtgccccacactatgacaaacacttatatgattctcctctttcctgtttactgcaaattctgccttaaggcttcttttcaagactcagaagccactaattataaaggaaagggcagttaattggcacatttttctcttgtgaaagcagttctttcagataagaattaatgtaaatctgcttttgtaaattgcaactttaaatttcgctgactcaaatttacaacagctttgtataccagaagaggttttggtaagggttgaacatttttacactgcaactttaaaacatcaccaatagattgtggattatttcacgtgcacaaacatacacacacacacacacacacacacacatacacagctaaattagaaaacacaattttaaattttatataattactagttattaatgggtaaaattcatttttcttttaatatcttaaaatattatttatgccccgaaatatgctaataaaagttaaagattgtgtattatgcctagattcaaagtttttggcaaacttcaaatacttttgattgacatgtacattagcagttattagttgacttttactaaaacatgcacctttacgatggtgtttttgtagaaacataagtagtcaaatagtaacatttattgcagttttgtacagtatttgagtatagtgcataaataggtatgttcataaaatcaataaaaggagtatctatggaaataagcaaaatatcagcaaaaattgctattcctttgcctcatttaatttttaaaatttctttgtttccatgtgattctattatatgctttgcatgcttgtataaaaccaaggtcacaaatgcaacttattaacggaatttgccaagaagacagccttgacattaaaaattccctcacaagaggtaatccataatccttaataaaataaaattgttacatgagccaataaa

SEQ ID NO: 11781 - DNA, 2366 bp, Homo sapiens
aagcggcctcggggagcagcccgaggctgcgcgtgggctccgctcctccggcgaggtgtgggcgaggggagcggcgctccgagcgcacccaggcgcccgacgccgcccgggtctgcgccgctgctagtgccaggcgggcgacgagcggcggtgatgaagacaaaattgaacatctacaacatgcagttcctgctttttgttttcttggtgtgggaccctgccaggttggtgctggctaacatccaagaagatgaggctaaaaataacattaccatctttacgagaattcttgacagacttctggatggttacgataatcggcttagaccaggactgggagacagtattactgaagtcttcactaacatctacgtgaccagttttggccctgtctcagatacagatatggaatatacaattgatgttttctttcgacaaaaatggaaagatgaacgtttaaaatttaaaggtcctatgaatatccttcgactaaacaatttaatggctagcaaaatctggactccagataccttttttcacaatgggaaaaaatcagtagctcataatatgacaatgccaaataagttgcttcgaattcaggatgatgggactctgctgtataccatgaggcttacagttcaagctgaatgcccaatgcacttggaggatttcccaatggatgctcattcatgtcctctgaaatttggcagctatgcatatacaacttcagaggtcacttatatttggacttacaatgcatctgattcagtacaggttgctcctgatggctctaggttaaatcaatatgacctgctgggccaatcaatcggaaaggagacaattaaatccagtacaggtgaatatactgtaatgacagctcatttccacctgaaaagaaaaattgggtattttgtgattcaaacctatctgccttgcatcatgactgtcattctctcccaagtttcattctggcttaacagagaatctgtgcctgcaagaactgtgtttggagtaacaactgtcctaacaatgacaactctaagcatcagtgctcggaattctctccccaaagtggcttatgcaactgccatggactggtttattgctgtttgttatgcatttgtgttctctgccctaattgaatttgcaactgttaattacttcaccaaaagaggatgggcttgggatgggaagagtgtagtaaatgacaaggtaagtgagagcttccgtgttatcattattaagaaaataccctaatgaattccgcttgtaacagatatgtttctaaaaactgacattaaagacatccatatatatatgaatttgaatcatatcaatttcttttaaagtgttcttgcctgaaatcctttaggagttcttgtagtactaatacttccattaaaaccactccgtagcatctgttgagctgtatgtgtcaggcactgtgctaagtgttttacatatgctctctcacataatctttatagcatccttatgactagactgccttcttattcttatttttactcatgaagaatctgaagcagtaaagttattttcttgcccaagcttacacaacttgttagtaagtatacttgaactccgatctacctgtctgactgttaagttcatggttttaacaccacactgcattattataaagagattagaaaaagaaaatgggcattaattttacttattatagaattccaggctctatcaatgaattgaatcctcttcacctgttccagtctctgctgattgattgtaaaagcccggatagcatttttttaaaatctttcccatgttgtatggaataaatatgtcggtgctggaatgcttaggaattttaaattgttcatatggtctaaaagggaaaagttatttgtttttaagattaacttcttttgagattattgctgtccatatttaggtttcaagtactgaatctaatgggagatttgtgcattgatataacagctgtttcctttcatactctgtagattatgtatctgcctaagaggaggctttgaatgtatcataatcatctatattcttaataatggtaaaaagttgtattcagaggatatctttaacattgtatcaacctaaatgcttcttttattaaatttggattaacatacttgcagatttgatttctttttcagttatttgaatatattttttcatttctatgaccatgttacagtttaaatatacaagcagtaaatgttatagtttaaaagtcttggtctttttccttaattttgtaagccatagaaattttaataagactgattatttatttcattttataagttgtgttttccctactaacggagccaacaaataaatattaaaaggaa

SEQ ID NO: 11782 - DNA, 2273 bp, Homo sapiens
tcgtcaagatcagggcaaaaggaagaaaacaccgaattctgcttgccgtttcagagcggcggtgatgaagacaaaattgaacatctacaacatgcagttcctgctttttgttttcttggtgtgggaccctgccaggttggtgctggctaacatccaagaagatgaggctaaaaataacattaccatctttacgagaattcttgacagacttctggatggttacgataatcggcttagaccaggactgggaggaatatacaattgatgttttctttcgacaaaaatggaaagatgaacgtttaaaatttaaaggtcctatgaatatccttcgactaaacaatttaatggctagcaaaatctggactccagataccttttttcacaatgggaaaaaatcagtagctcataatatgacaatgccaaataagttgcttcgaattcaggatgatgggactctgctgtataccatgaggcttacagttcaagctgaatgcccaatgcacttggaggatttcccaatggatgctcattcatgtcctctgaaatttggcagctatgcatatacaacttcagaggtcacttatatttggacttacaatgcatctgattcagtacaggttgctcctgatggctctaggttaaatcaatatgacctgctgggccaatcaatcggaaaggagacaattaaatccagtacaggtgaatatactgtaatgacagctcatttccacctgaaaagaaaaattgggtattttgtgattcaaacctatctgccttgcatcatgactgtcattctctcccaagtttcattctggcttaacagagaatctgtgcctgcaagaactgtgtttggagtaacaactgtcctaacaatgacaactctaagcatcagtgctcggaattctctccccaaagtggcttatgcaactgccatggactggtttattgctgtttgttatgcatttgtgttctctgccctaattgaatttgcaactgttaattacttcaccaaaagaggatgggcttgggatgggaagagtgtagtaaatgacaagtccccttcaataaaagctgaaggcattacattaacatacaactcagtgaaagcaattcttcaaggagctaagctaatatggtccaagtatatagctttctcatggcccagtttattccaagaaaagactttagagtacttagagaagtggatggactgtttaaccttcaaacaatcttctaaaaaagaaaaggcttccgttatgatacagaacaacgcttatgcagtggctgttgccaattatgccccgaatctttcaaaagatccagttctctccaccatctccaagagtgcaaccacgccagaacccaacaagaagccagaaaacaagccagctgaagcaaagaaaactttcaacagtgttagcaaaattgacagaatgtccagaatagtttttccagttttgtttggtacctttaatttagtttactgggctacatatttaaacagagaacctgtattaggggtcagtccttgaattgagacccatgttatctttgggatgtatagcaacattaaatttggtttgttttgctatgtacagtctgactaataactgctaatttgtgatccaacatgtacagtatgtatatagtgacatagcttaccagtagacctttaatggagacatgcatttgctaactcatggaactgcagacagaaagcactccatgcgaaaacagccattgccttttttaaagatttaccctaggacctgatttaaagtgaatttcaagtgacctgattaatttcctattcttccaaatgagatgaaaatggggatcctgtacaaccctttgtggacccttttggtttagctcttaagtaggggtattttctactgttgcttaattatgatggaagataacattgtcattcctagatgaatcctttgaagtaacaaacattgtatctgacatcagctctgttcatgagtgctcagagtccctgctaatgtaattggaagcttggtacacataagaaaaactagagatttgaaatcagctatgaattactctatatagtatctatagccatgtacatattacagcatgacaagctcaaataattatgagtcagcccgaaaggatgttaattatgcctacgatgtaataactattggaatgtcatggtcattacatttttagcttcagagtttatttgaaagtaataattgaaatcctacaatttattttaatcattggaaactaccttaatt

SEQ ID NO: 11783 - DNA, 1785 bp, Homo sapiens
tttgatgtacatttttctagctcattattgtccccagagatggaatctgaacagacaggattgtcaaacctttatttgcagcctgggttagaaggcacgcccataaggatataagggagacagagggaaaaaggaggaagctcactcttcagtctcggagcagcaagtaagcatcacacatcagctacaactgtgaatctcacaggtctctccaagtttgtgcctaagaagatgataatcacacaaacaagtcactgttacatgaccagccttgggattcttttcctgattaatattctccctggaaccactggtcaaggggaatcaagacgacaagaacccggggactttgtgaagcaggacattggcgggctgtctcctaagcatgccccagatattcctgatgacagcactgacaacatcactatcttcaccagaatcttggatcgtcttctggacggctatgacaaccggctgcgacctgggcttggagatgcagtgactgaagtgaagactgacatctacgtgaccagttttggccctgtgtcagacactgacatggagtacactattgatgtattttttcggcagacatggcatgatgaaagactgaaatttgatggccccatgaagatccttccactgaacaatctcctggctagtaagatctggacaccggacaccttcttccacaatggcaagaaatcagtggctcataacatgaccacgcccaacaagctgctcagattggtggacaacggaaccctcctctatacaatgaggttaacaattcatgctgagtgtcccatgcatttggaagattttcccatggatgtgcatgcctgcccactgaagtttggaagctatgcctatacaacagctgaagtggtttattcttggactctcggaaagaacaaatccgtggaagtggcacaggatggttctcgcttgaaccagtatgaccttttgggccatgttgttgggacagagataatccggtctagtacaggagaatatgtcgtcatgacaacccacttccatctcaagcgaaaaattggctactttgtgatccagacctacttgccatgtatcatgactgtcattctgtcacaagtgtcgttctggctcaacagagagtctgttcctgcccgtacagtctttggtgtcaccactgtgcttaccatgaccaccttgagtatcagtgccagaaattccttacctaaagtggcatatgcgacggccatggactggttcatagccgtctgttatgcctttgtattttctgcactgattgaatttgccactgtcaactatttcaccaagcggagttgggcttgggaaggcaagaaggtgccagaggccctggagatgaagaagaaaacaccagcagccccagcaaagaaaaccagcactaccttcaacatcgtggggaccacctatcccatcaacctggccaaggacactgaattttccaccatctccaagggcgctgctcccagtgcctcctcaaccccaacaatcattgcttcacccaaggccacctacgtgcaggacagcccgactgagaccaagacctacaacagtgtcagcaaggttgacaaaatttcccgcatcatctttcctgtgctctttgccatattcaatctggtctattgggccacatatgtcaaccgggagtcagctatcaagggcatgatccgcaaacagtagatagtggtggcagtgcagcaaccagagcactgtataccccgtgaagcatccaggcacccaaaccccggggctccc

SEQ ID NO: 11784 - DNA, 3712 bp, Homo sapiens
agagagagagagagagagagagagagagagagcgagagagcgtgagcgcgcgcaagctagcgagcaaaccagagagacagaccgagagagggaccaggagagagacccagagagagaagaagaagccagaagccgagctctgtcagggctcaacctccaacttgtttcagttcattcatccttctctcctttccgctcagactgtagagctcggtctctccaagtttgtgcctaagaagatgataatcacacaaacaagtcactgttacatgaccagccttgggattcttttcctgattaatattctccctggaaccactggtcaaggggaatcaagacgacaagaacccggggactttgtgaagcaggacattggcgggctgtctcctaagcatgccccagatattcctgatgacagcactgacaacatcactatcttcaccagaatcttggatcgtcttctggacggctatgacaaccggctgcgacctgggcttggagatgcagtgactgaagtgaagactgacatctacgtgaccagttttggccctgtgtcagacactgacatggagtacactattgatgtattttttcggcagacatggcatgatgaaagactgaaatttgatggccccatgaagatccttccactgaacaatctcctggctagtaagatctggacaccggacaccttcttccacaatggcaagaaatcagtggctcataacatgaccacgcccaacaagctgctcagattggtggacaacggaaccctcctctatacaatgaggttaacaattcatgctgagtgtcccatgcatttggaagattttcccatggatgtgcatgcctgcccactgaagtttggaagctatgcctatacaacagctgaagtggtttattcttggactctcggaaagaacaaatccgtggaagtggcacaggatggttctcgcttgaaccagtatgaccttttgggccatgttgttgggacagagataatccggtctagtacaggagaatatgtcgtcatgacaacccacttccatctcaagcgaaaaattggctactttgtgatccagacctacttgccatgtatcatgactgtcattctgtcacaagtgtcgttctggctcaacagagagtctgttcctgcccgtacagtctttggtgtcaccactgtgcttaccatgaccaccttgagtatcagtgccagaaattccttacctaaagtggcatatgcgacggccatggactggttcatagccgtctgttatgcctttgtattttctgcactgattgaatttgccactgtcaactatttcaccaagcggagttgggcttgggaaggcaagaaggtgccagaggccctggagatgaagaagaaaacaccagcagccccagcaaagaaaaccagcactaccttcaacatcgtggggaccacctatcccatcaacctggccaaggacactgaattttccaccatctccaagggcgctgctcccagtgcctcctcaaccccaacaatcattgcttcacccaaggccacctacgtgcaggacagcccgactgagaccaagacctacaacagtgtcagcaaggttgacaaaatttcccgcatcatctttcctgtgctctttgccatattcaatctggtctattgggccacatatgtcaaccgggagtcagctatcaagggcatgatccgcaaacagtagatagtggtggcagtgcagcaaccagagcactgtataccccgtgaagcatccaggcacccaaaccccggggctccccttcgcgtatttcaggattctcctttttacccctctaccaagctgtgaccctcaattcatatttatgaatctctacgcaaaaaataactacagaaaaattacttgtccctccaatattgcccagtataaccccatcaaagccaaacactgccatttgtccagttgctcatcttagtctgccaatctcccctagctgagggcactgcatgtattttattgcactctgcccgctgcaaaaagaacaagagattctactctccatagtggaagccttggctgtttgagaggcccagaacaaggagaattgttgactcccatctagatcagatgactctaacttactaggcagccaggttaggctaggccatgtgatcctgcgtgccacctcccctgccttcagcaaggcctactaggcataagtactgatagcaaaggtgggagccagttctacacccccaacccatttattggtttggaaattagtggggacaattggtactaaccaccgtctaccatgtatggccaaaataaatagaactagctctgccagcctggcaccaagatggctggtgccctgccatgtccagcccctcgggaaaatagtcccctccttggtacatctctcctccagaaaatcttcttcccccactgcctttggcacccttgtagccaactgagcactacttaatttggactcattaccacctgtaaacttttcaggaaaaaatgatcaagcattttttatttatatcgaaaagttgcaaatagaaacaaagtgatctagatttaaaaaaaacatttttttaaaatatgggagagatacaaaagtcacctccctgccaaggcaactagcctatactggattgggtaagaggtttggagtggatggtagttgaggattgaagtctggctcaaaagagaaggctactggcagatgaaagtcaaattcttccttccatacactccacattccacaccctggcccaggcacttttctcccaccatatcgggaacctccggtcctctgttgatgccgattctatgaggggtgaattggaaattcatacaaataaatatctctagtcaatattgagtcaactagatcattaactttattgccaattttataatatattatttagaggccatttgttcttaatcttaatgtgagtaaaagacacaggcataaatacgcaatttttataaggtagataaactgaatcccagaagtttgaatgatttgcctaggctccttacaagtgtctttaataaagagctatcgtgcgcccctttccaaaggccaaaataaaggactgagaagccaggtccaccgtgacctcagaatcagcacaatctcagcgggccttctgggtcactagtggaacttggttgggcaccaaaaaggtttttagaaagtcacaatgtgtcacccaagaagatcacttttaatagtctcagcccaagagaatgagactgtttatgatggcagccccagccactttggctctgaatacctgcactagtccagagtatcctagaagcccagggtaaagccacagagggcaccacaagcagattctccctgcccaccggctgaacaaagctcctaaggggtgtatcattagctgctggttgccttttcatccatcctttccccgtcccctgcttccttgccattgctgggataatgcatgcccgtcccattattcctaagactgtgtctgtaggtaaattcatgactagaagagtgtagtcttgtggatatgtggggatatggggggtgggagggcggggctgttaatggttgtcttaaggaacttagaatggaagcctgatctttgcctctctgtagaaattgtgtttccaaatgctttggtgcaatgtttagctgctgtttattaaaccctttctgaattgta

SEQ ID NO: 11785 - DNA, 338 bp, Homo sapiens
gagtacactattgatgtattttttcggcagacatggcatgatgaaagactgaaatttgatggccccatgaagatccttccactgaacaatctcctggctagtaagatctggacaccggacaccttcttccacaatggcaagaaatcagtggctcataacatgaccacgcccaacaagctgctcagattggtggacaacggaaccctcctctatacaatgagaatagaggaagtacagaagcacagaagcatgatgaagccatcggtttcctacacagtagcaccttggatccaggaaggtgggcctggagggagacataggctcaaaatggaaaaata

SEQ ID NO: 11786 - DNA, 1697 bp, Homo sapiens
agtgccgcttcatcacgcagcatggttgtctgggaatgtgccgtgggatctccatttgcattaattccttcagctcctggaccaaagccatttttaaaaattcatgttctgtgtatcacataacacagtatttgtgattgcacctgtactatgtccatttatttctgcatcatggctacttcctcctgtttcgtctctccaagtttgtgcctaagaagatgataatcacacaaacaagtcactgttacatgaccagccttgggattcttttcctgattaatattctccctggaaccactggtcaaggggaatcaagacgacaagaacccggggactttgtgaagcaggacattggcgggctgtctcctaagcatgccccagatattcctgatgacagcactgacaacatcactatcttcaccagaatcttggatcgtcttctggacggctatgacaaccggctgcgacctgggcttggagatgcagtgactgaagtgaagactgacatctacgtgaccagttttggccctgtgtcagacactgacatggagtacactattgatgtattttttcggcagacatggcatgatgaaagactgaaatttgatggccccatgaagatccttccactgaacaatctcctggctagtaagatctggacaccggacaccttcttccacaatggcaagaaatcagtggctcataacatgaccacgcccaacaagctgctcagattggtggacaacggaaccctcctctatacaatgaggttaacaattcatgctgagtgtcccatgcatttggaagattttcccatggatgtgcatgcctgcccactgaagtttggaagctatgcctatacaacagctgaagtggtttattcttggactctcggaaagaacaaatccgtggaagtggcacaggatggttctcgcttgaaccagtatgaccttttgggccatgttgttgggacagagataatccggtctagtacaggagaatatgtcgtcatgacaacccacttccatctcaagcgaaaaattggctactttgtgatccagacctacttgccatgtatcatgactgtcattctgtcacaagtgtcgttctggctcaacagagagtctgttcctgcccgtacagtctttggtgtcaccactgtgcttaccatgaccaccttgagtatcagtgccagaaattccttacctaaagtggcatatgcgacggccatggactggttcatagccgtctgttatgcctttgtattttctgcactgattgaatttgccactgtcaactatttcaccaagcggagttgggcttgggaaggcaagaaggtgccagaggccctggagatgaagaagaaaacaccagcagccccagcaaagaaaaccagcactaccttcaacatcgtggggaccacctatcccatcaacctggccaaggacactgaattttccaccatctccaagggcgctgctcccagtgcctcctcaaccccaacaatcattgcttcacccaaggccacctacgtgcaggacagcccgactgagaccaagacctacaacagtgtcagcaaggttgacaaaatttcccgcatcatctttcctgtgctctttgccatattcaatctggtctattgggccacatatgtcaaccgggagtcagctatcaagggcatgatccgcaaacagtag

SEQ ID NO: 11787 - DNA, 11973 bp, Homo sapiens
agtcaacctctggaagtaagtcaactccattctgaaaaagaagagtgtcgcaagaagtgaaagtgattttgaccagaggtcgcttgtctccacctctcccctcctctccagaaaaggatggagcagcaaagcggagggtgtgcgcgtgtctggtggaggcgggtaaagaaatggggtgtctttaaagcaatagcttagcaaatactgggactagagtgcggctcgagtccacttcccaatagtttggcgagagtccgccgggtgagctgcaacccctgttaccaggaagaatctttctgctttcattgctctccctaccgccccccataacacctgaatgggagggtctcaaaggtggtttgagcccggacttgatcccctctcctcaccaccgctaccacccgacgcccagcagtccccgtcacccgccctttctccacctccaaccttgactctgggtacaaacaggtcctcgcacaacctgatgacagaggagcttcattggttagatccaaatcccagcggaagggagggggccaggaggtaggaggacgaacactgctgtgggcggggagcccacttggggtcgggggctgcgaagccggaggaggggcgagagaccccgttcctcatccccggagttacagtcggaacaaacttgccgagtcttgcagcgcaagcgcgcggatacgaaccccagaaccttcagcgcgcgggcacgaaagggtgtggagcggtatacatagctctacatacacattgagcgctgagcgagaaaggagggggcgaggaaggcaggttccgcctcccctggccccgtgcacacacacgcccaccgcggctcgggctggctgagcgcgggcgagtgtgagcgcgagtgtgcgcacgccgcgggagcctctctgccctctcctcgcaccctgctcagggcatctgaagagcctggaaacgtgaacaggcttgaagtatggcatgttgcaaagatggtttctgccaagaaggtacccgcgatcgctctgtccgccggggtcagtttcgccctcctgcgcttcctgtgcctggcggtttgtttaaacgaatccccaggacagaaccaaaaggaggagaaattgtgcacagaaaatttcacccgcatcctggacagtttgctcgatggttatgacaacaggctgcgtcctggatttgggggtcctgttacagaagtgaaaactgacatatatgtcaccagctttggacctgtttctgatgttgaaatggaatacacaatggatgtgttcttcaggcagacatggattgacaaaagattaaaatatgacggccccattgaaattttgagattgaacaatatgatggtaacgaaagtgtggacccctgatactttcttcaggaatggaaagaaatctgtctcacataatatgacagctccaaataagctttttagaattatgagaaatggtactattttatacacaatgagactcaccataagtgcggagtgtcccatgagattggtggattttcccatggatggtcatgcatgccctttgaaattcgggagttatgcctatccaaagagtgagatgatctatacctggacaaaaggtcctgagaaatcagttgaagttccgaaggagtcttccagcttagttcaatatgatttgattgggcaaaccgtatcaagtgaaaccatcaaatcaattacgggtgaatatattgttatgacggtttacttccacctcagacggaagatgggttattttatgattcagacctatattccgtgcattatgacagtgattctttctcaagtttcattttggataaataaagaatcagttcccgctaggactgtatttggaataacaactgtcctcaccatgaccacactaagcatcagtgcacgacattctttgcccaaagtgtcctatgctaccgccatggactggttcatagctgtctgctttgcttttgtattttcggcccttatcgagtttgctgctgtcaactatttcaccaatattcaaatggaaaaagccaaaaggaagacatcaaagccccctcaggaagttcccgctgctccagtgcagagagagaagcatcctgaagcccctctgcagaatacaaatgccaatttgaacatgagaaaaagaacaaatgctttggttcactctgaatctgatgttggcaacagaactgaggtgggaaaccattcaagcaaatcttccacagttgttcaagaatcttctaaaggcacacctcggtcttacttagcttccagtccaaacccattcagccgtgcaaatgcagctgaaaccatatctgcagcaagagcacttccatctgcttctcctacttctatccgaactggatatatgcctcgaaaggcttcagttggatctgcttctactcgtcacgtgtttggatcaagactgcagaggataaagaccacagttaataccataggggctactgggaagttgtcagctactcctcctccatcggctccaccaccttctggatctggcacaagtaaaatagacaaatatgcccgtattctctttccagtcacatttggggcatttaacatggtttattgggttgtttatttatctaaggacactatggagaaatcagaaagtctaatgtaatttcgttgctatagtagtttgctaaaagatgatgaaaatgcagaatgtctttttaaatgtttttaaatataaacaaatattctttactaaaataaaaactctgtgtaatttttccatttaaagatataagccagttattgggagagttaattaattcctgagtgaaaaagtgaactatgttttttttcagaaaaattattttaaaagaactcagcattcagttagatagaatacacaccatcctggaaagttgggataagagaaatagagctattagagacaagtggcgcatattttttcattgatatttgaaaacagactatgacattttaaaaatctgccctatgagtatcaacctgccaccctaaatttcccagtggcactacccttaaccagaattgtttattagatgtcatatgcagtgacctttggtgatcttcttaggaacttcaagaaaaggaattttcctgttaaattaaacattggcaaaaggaaatggaatagtataaacactgatcaatagagtaaaatatctgctgcataaaaaactaagacaaagaccagaggaaatatcttccctttcttatgttggctaaacagtacttaacagttgacttgaaattttgttctctgagccaaagtttaactcattgtatgaattctttttcatggtagttcattcagttatgtgtttatttactacatagttattcagagcctactgtgttccaggaactatgctagaaactgtctctctaggaaagctcttgcacctttatctacaatattacttaaaaagtagaacagtcaatgcatgccaaagaaccataaactagcagaggacattgcattctttagtgaaggacatttatttagagtctgacaacatattcaaaatatttttcagcctctactgatagtggataacaaatatatttgttcacataaccactttgatgtcagtacaacttcagcaattggttttcaaaatagatgagaatatggtacagattgttctataagtgaaaagcattatgtacttgaaagtaaaaatcagggcaatataagacttaatagattaactgtcgcaaatttgatcagagtcacagagtagaatttgatcagaatcacagaatcatcagacataggaactgagcacaggctttttcaggtgctttccccaagatagatctagatattagctagtgaaatgctaaattttgaagagttttgtgtccgtagttctgtaattctgggcagtcatcatgttggtttttttgggagtttttttaaggtttaataactaaggggaatattttaaaattaagagagcagcaaatgaaaggagtaaagaaaaaaatagctgtcgggtaggatgccactgactctgctatgtgatttatcagggttttcatctactgacttctttctcattaggtaggcttaacaacttacttgagaattttgcaactgtctatgcagctgaatctaagtatggttttttgtcatattgcctctagattttcttctgtgcttctctctatctgctctggaatggatgagtgaatgtgttctgggtgttttagggaacatattgatagaaatgaccaccttgcagacaaaatctctctctctctttttgtttttatagaaaagaagtgatagtagttaattggcatcgatttttcagatattgcactaccttataatggttgtttttgatacctgaaaattgtgcaaatgccaaatattaattgtaagtcatatctgagaaatcattcttggctgtctttctaggtattccatagaatcaacacattttaaggctgaaagatactgtcgaaatcacccagtcccaaccccccaatttaaaattgattctagtaaaattaggtccagtaacacctgtatatatgtatatatttaataaagagtacttgtacaaaaaagcttatcataaattatttcatgaatgtgaatagatttctggccttgaggacgatgtttggaaatatggttggaagcacaattcattcgctactagttattcagagcgtactttgttccaggaactatgctggaaactgatagttcactattctgatgaaaaggctggttttgttgttgttgttgttgttgttgttgttgtttttggtgaggaactcttactctttgctaatctattggcctatcttaagaaataattatttggttattcattggcttcctttaaaaaaaagtgttcttctacaaatcttacagagtgtaaagagataaaaagaaatgattttttttcttacctttacatatgaaggtttaaaaatacatcatgtggccaaagaatgagaaaggacagaattaaccaaggattcttaattgttaatttgaagaacacattaaccagaaagcttaaacattattattaaaataaattatttcatttgcacacaatgataataatgatgataataataataataataataataataataataataataataatatgttgtttgctttccttaactgaatttcatcaaattcattcagtgatttttattttggtcattatttctatcttcccaataacccagaggtacatcaagtaaaaacacttttgcaaagagccagtcacttttccctcttagaaaatctcagaagaatgattaggggcacccaaagttctggttatctatgaataataatgaataattttggctgagaatggtacctttatataactcttttaaagatgaaattcagaataattttattcaggacctagtatctgcagtccatgttggccactaactgctacataattactttcaatttcctccaggcatgactaggtataaacatatatttacatgattaatccacattttaaaatgacttgcacttgtgcatatacatagtactttgaataatgtatattttaaattggacctcacaaatcttgtattaaagtaggtagagagtagagtcacactttttttgatgaaatgagtcacagagaagttacatgacaaagataaaatcacagggttggaaagaactttgaaaggtcatttttcaataatctcaccttaaaagtgaccccttttcaaacaaagcataaacaatttatttgtggcttattttacccatgagctggccaatacttcctggcctagaaaaatatctccactctccccattcctgttcttaatggtcttctcttctcaatttgtaaatattctccagtaaaagacaccaggtgtggagatgggtcacttaatttcaagttctgagtgtcttgtggttttaaacaagtctcttaacctctctaagactgattcctcatttataacagggaggaggtggattatgtaatatctaagagcttttcagttttaatactctctgattctcatagtaaatacaagcatactcttgtaagaaaaacactgaatactttgaaccacaaataagtgtttatggacaaaaatttagttctactgcttgattactttaagttcattgcttgcttcaaactaaggtttccctaccttcaaaaatatatataacatctctccatttagataaagtatattcttccccagggaagactgtattctttaaagacagtagaatattggctatttctcttttctgggatttcctgggcttttattcactaaatgggctcctgcccagtttgggtactgtgctgatttttagatatacagagataaaaatagcccctttccttgcaggtagtcacagtccggaagagatgatagatgcatagacaaaaaattatgggatgtaactaatgcttcagtagaatacagcagggccaaaactagagtgatactcatctcaggcacaaatatatatggggacatcaaaacttcaataatcaagatacctaatatttaagtgaatatttttaaaactcaaaattaatgcaaaagatttatgatgaacagaatatacaaattttaaataaattaatagaatcagtagtaataatattttcttctgcctcaggctccaaaattgctcagcatagcactgatctagatagaggtggataaaagatccacataacttaattacattgttgaaggagaggaacaagagtgatagcagagaaggtttcacagatataatcttaagctaaattttatagaatgatttggagttcttatagcctccattcccacttccacaaacaaacaaaaaaatgaaagcgcaattttatcagcacctgaggcaggagaagagatgaggatgtggaaagtcaaggggaactcttactacaaattcttagttctgtgtttggaggtaagggtgaatgcagggaagtgagagttgttgatgttggaaagacctaaagagcctggattaggaagagttttgtgtaaattactgaaggaatggaatttgatcaggattagtggcaatttattaaaaatcttgaagaataatacgatgaaaactaacatccttatttttctgttttagagaaagcacctgattattgtgtgaactatggtttggagggccacaaatctagaggtagtggaacagttgagatctcttattttttctttcctgtcttaaactttgccttctattccttttttctttttttgaccgcaatgacttcattgtcatttgtaaaagtgatacatgactgttaaagatagacattgtagaaacttaaaaacaatctcaaaattctaccacccagaaatcagaaatattttgtatttggatatgtttgtctagaagagtagattgcttgattaaaagacagagttttataaatgtagaagccaatatgacatacatgctgccattaaataataaaaaattaaattgacttttatctcaagataagattaaaattggagggtaaaactgaagaaattgttgaaatttggatggtgcttctttaaagcaagagatttagagagtcagagctttttatcccaggtttcaatctttatttcaggaaaattttctgcaattttgtctaagttaattttttttttttaagaaatgccaattatgtcaaatcccttttgtctctatacaatagtccccaactgttttggcaacaggcacgggtgagggtgggggaatggttttcagatgaaattgttccatctcagatcatcaggcattagtcgattctcataaggagcggacaaccttgcatgccctcctatgagaatctaatgccgccgctaatctgacaggaggcagagctcaggcgataatgctcaatgggtgccactcacctcctgttgtgctgcccaattcctaacaggtcatggataagtactggtcagtggcccaggggttggggaccactgctctgtaactatttacagtattctttgtaactactttggtatctttaaaattttctttaacttttgtcaaccataaccctagtgagttttcagttgtgattattctattttgtaacttccaatgtacttttcaacttcataatggttaattttgttttccattgctttcttggtcactgtcatttcatttttcttctctttctctatttttaccattgctttattgaaatatcttctttgagcttctcatgtttctctattaatgagatcatgtctataatattttttgagactacagagacctatttatataaactcttcctctatttcttgaaaaagtttttatctggcgtgagcttcatctgctttttcattgaggttttatctcccttgcctatttttggggctggtttctttctattaatcactgagcagagccagctatttactgaactacagtgtgggaagtggtgggagggtgagtcagatcagcccacagaagctatttaaatttcaggtttcaagcccacctccccaaaaccgttttatgtgttttttcttctgcccaggcaccatatttttatatctatttttgacatttgggcggcctatgtagttcacagtgtaaaactctctgttttactttctttatgttattgctagtgattattgcttgtagtcccacccccttccccacattagccttagtattctatattattcagcaagcttgttcacaactctcaaatatagtctatcagaatttttatctttacctctacattccactattcggaagtatatagtaaaatcgtatgaagacagattttgtctttttcttgcctgtttacactctatcttacagaggtttcaaacaaaccatctttgtttgaaacatcgcaggataatgatacttattgaaatctacatcctgcccaagatatatgccagtcaatttcctttctcctattagtgcaaatggctacctacttaaaagctgctgactatagtttgtcatcaattacttgttaattacagatatggttttcatttttttttctcaatttttcattatgttatttttggagactgtcttaggtggggagtgaattataaatatttttatttcaccacctttaactgagtcaccatatgttatttgcacttccaatagaccagggattgaccagagtatcttttactgatatgaccaccagagctacatggcttttaccttctgtatatcagatgtcactggaatcaagcattaaacctagattaaatctggattaaaccagctgtatggcaccttagaaaattgagaaggactaggaagctgatagaaagaactcctgtataaaaaataaattctttttacattttccttggtagtatttctgcaagcttctttagtttctataggggaatcccagagttttcctctgagattgcttccctttcctttgtattttcatttttccctcttgggctttacttttcagtcgtgtatttctatcccaatgttaatttattacactgtttatattttcctgtccttcaattcatcagtagattagtgaagtacttattcctttaattataagtataaacgtttttaatttctttttggataacgatacatttaatggaaaatttttaaatgctatggtttcttaatagcttttctctaccactaattacttccgttaaaaaaaaaaagaaatacccatgcgtaatataaaagaaattttgaataaaatgttatcctttccttttactagagacaaacatctccacttcaaaatggaaaaatggaactatgcaaaggaaatttacgatattcaagagtatgatattatcactgaaccgattaatttaattgaaaatactaacctgcaaaaaagaattacacaaatgtatttgaaatgtcatcagatacctcaagctatgacagagttgattatgttacacaagtagtaaaggataaattaaatatattctatattaacactaagatttaaaactaattatagtcttctttaatttttctactgtatacatttcatctagttttcagtaaaacaaacttttcattacttttacttatcccatgcaaatctagttgctataagatataacctaatttggaaatacctccctgtaatacattggaattttggtgtgagtgtgtgtgatcagagaggataaacaaatggtgtcagcaaaatagaatgtaaaatatggagataatgtggatttacacaatttgataaaaattctcccttgaattttgcagatcatatatgaatatcatcatgtgaagtgcaattaggattttttcatatattaatacatatacatcatctctttaataaaatattttgctgaactcgtttaatatttctcatgtctcatatttcatattttctcatatgtctcatattttatattttctcatatgtgtctcatttttattattactatagtatccattaaaggagactggcaaatacctgaacaaagttatgttgttggcaatataagatattaccaattgcataatattatttccaaaggcaaattaatatgcaaactatagatttccatgggtatctatacaaattattacttgaagtccatagaaaacagcttccttagagggaagtaaaagaagctctgataacagacaatgtatagcatttcagttaaagtttgattgacatatttttttctcagtcttttatacttgtgaattatagtctacattttgtctttacagatgttgctaacacagtgcagcatgttggcttgtcattttactgattatgtatattgtctcctagttcaagtatacagtaaatcagagctttcatttttcaaggggcagaaaaataattgttggttgataaggtaaggttatatgattttgagggagcttcattgtaaattgaatgagaatccggttttcatgcaaaggtgtatctatgcgataatactttgaatgtctgtagtttgaaatagaaggttaattttttccactggcttatccttaatgaaggaaatcccctgataattactttgattctgaaaatgttgaaaactccagaagaaataaagcttttctttgatttctcagctgaagtgttgtacaaactgaggaatatgaagtccattcccttctttcttctcttgaataattttaaaattgtttgtttagttgtacaattgaaaatattccttattatagaagtaaaaaaacaataatgcatatttcctcatatcataaaaactaaatttgttatcatctgagcttcaatattcttgctcaattagaatagtaaatataaagtgtgatatttataacagttcaaggtttgataggagatagaggtgttttgattttatgggaaaattacttcctcaagaacacatttcttgaggttttagtaatcacatttgactccctgaaattggcaattttattcaatgtaggaatattatcatggtatattatagtgaggagcacatagtcattattattttgtttttgcaaatttattttgaaaaaaaggagcattatcaaatattggtttactattttaaagtaattcatcaggaaatgattttttaaacactgtccctttaagtaaatgtcccttgcttttcaaagctcaacttattacttatggtaatagagttactttgcttcttaaaacaaagtttatactagagcatagcattgtagaattattcaggtctcaatttctcactggaaaatgagtctttaaaatagtaaggatttaaatttctataaaatttaatcacagatacttatattttaagataaatgtgttggagctaaactctggaattattaaaatataaaacattatatccctctaatgtattttttctatttaaatttaaaacaataaacataaatatctttggaa

SEQ ID NO: 11788 - DNA, 3251 bp, Homo sapiens
aggaactgcaccactaggacggacgacacaccgacgtaatgaccatagtaagaccccatgtacgtggctaatgaggcagtgacccgacgtggctcggaagccctgctggggagatcccgccccgtcaccccagaggcgctctccgacctgcagcccccagggctcctggccctttcccgtttgccactgcggcttgttgtcaagaaatggaacttcagaaaacccccagatatacactgcgttaggtaaggatttcattctaatcgagtccaatgtgaccctggctttccctcccgtagttatgcattcctgtctatgagtgagatgaaaagaatgtccacaggccagcttctttcagaagcgcctaagagatgcgcatgtaaggggtgccatggagcacccgggaaggacccaggcctgggcagggaggcgttggggccggctctagggagcaaagctgtcggagtccaggcctctatcacccgactgctgacactgccctcccatccctgctctacaagcgggcggtggtgactacacgaggcgccgaagatgctgttgagggccctggagaaacttcagcagaacagggcctctccccttgcaggccgagccgggggccctgcgccctccccctccgcccagctcggccaagggcgcatttgctgagcgtctggcggcctctaccggagcacctctgcagagggccgatcctccagcccagagacgacatgtggcgctcgggcgagtgccttgcagagagaggagtagcttgctggctttgaacgcgtggcgtggcagatatttcagaaagcttcaagaacaagctggagaagggaagagttattcctccatattcacctgcttcaactactattcttattgggaatggacaatggaatgttctctggttttatcatgatcaaaaacctccttctcttttgtatttccatgaacttatccagtcactttggcttttcacagatgccaaccagttcagtgaaagatgagaccaatgacaacatcacgatatttaccaggatcttggatgggctcttggatggctacgacaacagacttcggcccgggctgggagagcgcatcactcaggtgaggaccgacatctacgtcaccagcttcggcccggtgtccgacacggaaatggagtacaccatagacgtgtttttccgacaaagctggaaagatgaaaggcttcggtttaaggggcccatgcagcgcctccctctcaacaacctccttgccagcaagatctggaccccagacacgttcttccacaacgggaagaagtccatcgctcacaacatgaccacgcccaacaagctgctgcggctggaggacgacggcaccctgctctacaccatgcgcttgaccatctctgcagagtgccccatgcagcttgaggacttcccgatggatgcgcacgcttgccctctgaaatttggcagctatgcgtaccctaattctgaagtcgtttacgtctggaccaacggctccaccaagtcggtggtggtggcggaagatggctccagactgaaccagtaccacctgatggggcagacggtgggcactgagaacatcagcaccagcacaggcgaatacacaatcatgacagctcacttccacctgaaaaggaagattggctactttgtcatccagacctaccttccctgcataatgaccgtgatcttatcacaggtgtccttttggctgaaccgggaatcagtcccagccaggacagtttttggggtcaccacggtgctgaccatgacgaccctcagcatcagcgccaggaactctctgcccaaagtggcctacgccaccgccatggactggttcatagccgtgtgctatgccttcgtcttctcggcgctgatagagtttgccacggtcaattactttaccaagagaggctgggcctgggatggcaaaaaagccttggaagcagccaagatcaagaaaaagcgtgaagtcatactaaataagtcaacaaacgcttttacaactgggaagatgtctcaccccccaaacattccgaaggaacagaccccagcagggacgtcgaatacaacctcagtctcagtaaaaccctctgaagagaagacttctgaaagcaaaaagacttacaacagtatcagcaaaattgacaaaatgtcccgaatcgtattcccagtcttgttcggcactttcaacttagtttactgggcaacgtatttgaatagggagccggtgataaaaggagccgcctctccaaaataaccggccacactcccaaactccaagacagccatacttccagcgaaatggtaccaaggagaggtcttgctcacagggactctccatatgtgagcactatctttcaggaaatttttgcatgtttaataatatgtacaaataatattgccttgatgtttctatatgtaacttcagatgtttccaagatgtcccattgataattcgagcaaacaactttctggaaaaacaggatacgatgactgacactcagatgcccagtatcatacgttgatagtttacaaacaagatacgtatatttttaactgcttcaagtgttacctaacaatgttttttatacttcaaatgtcatttcatacaaattttcccagtgaataaatattttaggaaactctccatgattattagttgaccaactatattgcgagaaacagagatcataaagagcacgttttccattatgaggaaacttggacatttatgtacaaaatgaattgcctttgataattcttactgttctgaaattaggaaagtactgcatgatcttacacgaagaaatagaataggcaaacttttatgcaggcagattaataacagaaatacatcatatgttagatacacaaaatatttccctgaggaaaaaaaatcaactgcttaaattttttgggaagaaaaagaaacatttcttaccccacaccacccactacctgaacaatagccaagaaaggaaaggagatgttaaaacaaacagtgttttgatgacattctcagcacttggcccatgtgatcgctgtctctgaaacactgaccacctctccctacagccagcgtgtagtgcttcagtggtgagaaattgtaattgagttattttccattttatttccttgtatgtatttcatgactggacttactgctctgtcagcttttgtatatgaatcttaaatgttcattaaaaaataaaaaatgaactgatcttgtgg

SEQ ID NO: 11789 - DNA, 2183 bp, Homo sapiens
gaagatgctgttgagggccctggagaaacttcagcagaacagggcctctccccttgcaggccgagccgggggccctgcgccctccccctccgcccagctcggccaagggcgcatttgctgagcgtctggcggcctctaccggagcacctctgcagagggccgatcctccagcccagagacgacatgtggcgctcgggcgagcttcaagaacaagctggagaagggaagagttattcctccatattcacctgcttcaactactattcttattgggaatggacaatggaatgttctctggttttatcatgatcaaaaacctccttctcttttgtatttccatgaacttatccagtcactttggcttttcacagatgccaaccagttcagtgaaagatgagaccaatgacaacatcacgatatttaccaggatcttggatgggctcttggatggctacgacaacagacttcggcccgggctgggagagcgcatcactcaggtgaggaccgacatctacgtcaccagcttcggcccggtgtccgacacggaaatggagtacaccatagacgtgtttttccgacaaagctggaaagatgaaaggcttcggtttaaggggcccatgcagcgcctccctctcaacaacctccttgccagcaagatctggaccccagacacgttcttccacaacgggaagaagtccatcgctcacaacatgaccacgcccaacaagctgctgcggctggaggacgacggcaccctgctctacaccatgcgcttgaccatctctgcagagtgccccatgcagcttgaggacttcccgatggatgcgcacgcttgccctctgaaatttggcagctatgcgtaccctaattctgaagtcgtttacgtctggaccaacggctccaccaagtcggtggtggtggcggaagatggctccagactgaaccagtaccacctgatggggcagacggtgggcactgagaacatcagcaccagcacaggcgaatacacaatcatgacagctcacttccacctgaaaaggaagattggctactttgtcatccagacctaccttccctgcataatgaccgtgatcttatcacaggtgtccttttggctgaaccgggaatcagtcccagccaggacagtttttggggtcaccacggtgctgaccatgacgaccctcagcatcagcgccaggaactctctgcccaaagtggcctacgccaccgccatggactggttcatagccgtgtgctatgccttcgtcttctcggcgctgatagagtttgccacggtcaattactttaccaagagaggctgggcctgggatggcaaaaaagccttggaagcagccaagatcaagaaaaagcgtgaagtcatactaaataagtcaacaaacgcttttacaactgggaagatgtctcaccccccaaacattccgaaggaacagaccccagcagggacgtcgaatacaacctcagtctcagtaaaaccctctgaagagaagacttctgaaagcaaaaagacttacaacagtatcagcaaaattgacaaaatgtcccgaatcgtattcccagtcttgttcggcactttcaacttagtttactgggcaacgtatttgaatagggagccggtgataaaaggagccgcctctccaaaataaccggccacactcccaaactccaagacagccatacttccagcgaaatggtaccaaggagaggtcttgctcacagggactctccatatgtgagcactatctttcaggaaatttttgcatgtttaataatatgtacaaataatattgccttgatgtttctatatgtaacttcagatgtttccaagatgtcccattgataattcgagcaaacaactttctggaaaaacaggatacgatgactgacactcagatgcccagtatcatacgttgatagtttacaaacaagatacgtatatttttaactgcttcaagtgttacctaacaatgttttttatacttcaaatgtcatttcatacaaattttcccagtgaataaatattttaggaaactctccatgattattagttgaccaactatattgcgagaaacagagatcataaagagcacgttttccattatgaggaaacttggacatttatgtacaaaatgaattgcctttgataattcttactgttctgaaat

SEQ ID NO: 11790 - DNA, 2761 bp, Homo sapiens
gagtgcgccgggggcgctggggggctctgcggcgggcggcgcgcggcccggggcgcggcgcggagcggagctgcagggcggcggcgggagcgcggggcgcaagagccgctccgccgggagtgccggggaagttcgcgctggcagcatggggcggtgacgccgcaccggccttccgcgcctgccagccgggcgagagcaggcggaggagaaggaggatgcatcctcaccgacggctcgcctcccggggccggcgcgcaggtgccttgcagagagaggagtagcttgctggctttgaacgcgtggcgtggcagatatttcagaaagcttcaagaacaagctggagaagggaagagttattcctccatattcacctgcttcaactactattcttattgggaatggacaatggaatgttctctggttttatcatgatcaaaaacctccttctcttttgtatttccatgaacttatccagtcactttggcttttcacagatgccaaccagttcagtgaaagatgagaccaatgacaacatcacgatatttaccaggatcttggatgggctcttggatggctacgacaacagacttcggcccgggctgggagagcgcatcactcaggtgaggaccgacatctacgtcaccagcttcggcccggtgtccgacacggaaatggagtacaccatagacgtgtttttccgacaaagctggaaagatgaaaggcttcggtttaaggggcccatgcagcgcctccctctcaacaacctccttgccagcaagatctggaccccagacacgttcttccacaacgggaagaagtccatcgctcacaacatgaccacgcccaacaagctgctgcggctggaggacgacggcaccctgctctacaccatgcgcttgaccatctctgcagagtgccccatgcagcttgaggacttcccgatggatgcgcacgcttgccctctgaaatttggcagctatgcgtaccctaattctgaagtcgtttacgtctggaccaacggctccaccaagtcggtggtggtggcggaagatggctccagactgaaccagtaccacctgatggggcagacggtgggcactgagaacatcagcaccagcacaggcgaatacacaatcatgacagctcacttccacctgaaaaggaagattggctactttgtcatccagacctaccttccctgcataatgaccgtgatcttatcacaggtgtccttttggctgaaccgggaatcagtcccagccaggacagtttttggggtcaccacggtgctgaccatgacgaccctcagcatcagcgccaggaactctctgcccaaagtggcctacgccaccgccatggactggttcatagccgtgtgctatgccttcgtcttctcggcgctgatagagtttgccacggtcaattactttaccaagagaggctgggcctgggatggcaaaaaagccttggaagcagccaagatcaagaaaaagcgtgaagtcatactaaataagtcaacaaacgcttttacaactgggaagatgtctcaccccccaaacattccgaaggaacagaccccagcagggacgtcgaatacaacctcagtctcagtaaaaccctctgaagagaagacttctgaaagcaaaaagacttacaacagtatcagcaaaattgacaaaatgtcccgaatcgtattcccagtcttgttcggcactttcaacttagtttactgggcaacgtatttgaatagggagccggtgataaaaggagccgcctctccaaaataaccggccacactcccaaactccaagacagccatacttccagcgaaatggtaccaaggagaggtcttgctcacagggactctccatatgtgagcactatctttcaggaaatttttgcatgtttaataatatgtacaaataatattgccttgatgtttctatatgtaacttcagatgtttccaagatgtcccattgataattcgagcaaacaactttctggaaaaacaggatacgatgactgacactcagatgcccagtatcatacgttgatagtttacaaacaagatacgtatatttttaactgcttcaagtgttacctaacaatgttttttatacttcaaatgtcatttcatacaaattttcccagtgaataaatattttaggaaactctccatgattattagttgaccaactatattgcgagaaacagagatcataaagagcacgttttccattatgaggaaacttggacatttatgtacaaaatgaattgcctttgataattcttactgttctgaaattaggaaagtactgcatgatcttacacgaagaaatagaataggcaaacttttatgcaggcagattaataacagaaatacatcatatgttagatacacaaaatatttccctgaggaaaaaaaatcaactgcttaaattttttgggaagaaaaagaaacatttcttaccccacaccacccactacctgaacaatagccaagaaaggaaaggagatgttaaaacaaacagtgttttgatgacattctcagcacttggcccatgtgatcgctgtctctgaaacactgaccacctctccctacagccagcgtgtagtgcttcagtggtgagaaattgtaattgagttattttccattttatttccttgtatgtatttcatgactggacttactgctctgtcagcttttgtatatgaatcttaaatgttcattaaaaaataaaaaatgaactgatcttgtgg

SEQ ID NO: 11791 - DNA, 653 bp, Homo sapiens
ggcgcgcggcccggggcgcggcgcggagcggagctgcagggcggcggcgggagcgcggggcgcaagagccgctccgccgggagtgccggggaagttcgcgctggcagcatggggcggtgacgccgcaccggccttccgcgcctgccagccgggcgagagcaggcggaggagaaggaggatgcatcctcaccgacggctcgcctcccggggccggcgcgcagggtgagccctgggcgcgctgggccggggcagtgggtgccttgcagagagaggagtagcttgctggctttgaacgcgtggcgtggcagatatttcagaaagcttcaagaacaagctggagaagggaagagttattcctccatattcacctgcttcaactactattcttattgggaatggacaatggaatgttctctggttttatcatgatcaaaaacctccttctcttttgtatttccatgaacttatccagtcactttggcttttcacagatgccaaccagttcagtgaaagatgagaccaatgacaacatcacgatatttaccaggatcttggatgggctcttggatggctacgacaacagacttcggcccgggctgggagagcgcatcactcaggtgaggaccgacatctacgtcaccagcttcggcccg

SEQ ID NO: 11792 - DNA, 728 bp, Homo sapiens
ggagtgccggggaagttcgcgctggcagcatggggcggtgacgccgcaccggccttccgcgcctgccagccgggcgagagcaggcggaggagaaggaggatgcatcctcaccgacggctcgcctcccggggccggcgcgcaggtgccttgcagagagaggagtagcttgctggctttgaacgcgtggcgtggcagatatttcagaaagcttcaagaacaagctggagaagggaagagttattcctccatattcacctgcttcaactactattcttattgggaatggacaatggaatgttctctggttttatcatgatcaaaaacctccttctcttttgtatttccatgaacttatccagtcactttggcttttcacagatgccaaccagttcagtgaaagatgagaccaatgacaacatcacgatatttaccaggatcttggatgggctcttggatggctacgacaacagacttcggcccgggctgggagagcgcatcactcaggtgaggaccgacatctacgtcaccagcttcggcccggtgtccgacacggaaatggagtacaccatagacgtgtttttccgacaaagctggaaagatgaaaggcttcggtttaaggggcccatgcagcgcctccctctcaacaacctccttgccagcaagatctggaccccagacacgttcttccacaacgggaagaagtccatcgctcacaacatgaccacgcc

SEQ ID NO: 11793 - DNA, 653 bp, Homo sapiens
acgtactttctcagtgccttgcagagagaggagtagcttgctggctttgaacgcgtggcgtggcagatatttcagaaagcttcaagaacaagctggagaagggaagagttattcctccatattcacctgcttcaactactattcttattgggaatggacaatggaatgttctctggttttatcatgatcaaaaacctccttctcttttgtatttccatgaacttatccagtcactttggcttttcacagatgccaaccagttcagtgaaagatgagaccaatgacaacatcacgatatttaccaggatcttggatgggctcttggatggctacgacaacagacttcggcccgggctgggagagcgcatcactcaggtgaggaccgacatctacgtcaccagcttcggcccggtgtccgacacggaaatggagtacaccatagacgtgtttttccgacaaagctggaaagatgaaaggcttcggtttaaggggcccatgcagcgcctccctctcaacaacctccttgccagcaagatctggaccccagacacgttcttccacaacgggaagaagtccatcgctcacaacatgaccacgcccaacaagctgctgcggctggaggacgacggcaccctgctctacaccatgcgctt

SEQ ID NO: 11794 - DNA, 458 bp, Homo sapiens
gctcgaggccaggggacttggagtcgctgctgcaccgcgcgctcccagcccaggaggaaggcgctgcctggcggagcgcttggctcgtacccggggcaggagcaggggaagtctgcgaaagccgggagcgagccggggagggccggggagctggagaccctcggcgtgccgctgcggaccgcgcgggtggcgaccgcgggtgccagggcgacccaggctgcggctccgcagtgcagcccccgcgcccacctgccctggcgcgccggccctgtgccttgcagagagaggagtagcttgctggctttgaacgcgtggcgtggcagatatttcagaaagcttcaagaacaagctggagaagggaagagttattcctccatattcacctgcttcaactactattcttattgggaatggacaatggaatgttctctggttttatcatgatcaaaaacctcctt

SEQ ID NO: 11795 - DNA, 2128 bp, Homo sapiens
aagatgccaatgctttccagatttcctcacagggccctgctaattccatgccaaaactggcagtggatttcttccttctaatctcccttaatgccttattcgattattgtcactgctctccgaccatgcactgtcccttcagactctcctttcccaactgagtcagtcagaggagcctgggtgtctgcaggacataatctaagaccacaaaccaccttgttccacgtgagaaggaaacaagaaagaagggagccaggggaatcctgcaaatttttaggcaacctctttatctattggattactgacttgaggcaaacaaggaacagagatatgaagggtttgaaagatttctccagttgattggcagagaagagctggctagcagggaggacgaccctaggagggtgaattctgcatttcagtgcactgcaggatggcgtcgtctctgccctggctgtgcattattctgtggctagaaaatgccctagggaaactcgaagttgaaggcaacttctactcagaaaacgtcagtcggatcctggacaacttgcttgaaggctatgacaatcggctgcggccgggatttggaggtgctgtcactgaagtcaaaacagacatttatgtgaccagttttgggcccgtgtcagatgtggagatggagtatacgatggatgtttttttccgccagacctggactgatgagaggttgaagtttggggggccaactgagattctgagtctgaataatttgatggtcagtaaaatctggacgcctgacacctttttcagaaatggtaaaaagtccattgctcacaacatgacaactcctaataaactcttcagaataatgcagaatggaaccattttatacaccatgaggcttaccatcaatgctgactgtcccatgaggctggttaactttcctatggatgggcatgcttgtccactcaagtttgggagctatgcttatcccaaaagtgaaatcatatatacgtggaaaaaaggaccactttactcagtagaagtcccagaagaatcttcaagccttctccagtatgatctgattggacaaacagtatctagtgagacaattaaatctaacacaggtgaatacgttataatgacagtttacttccacttgcaaaggaagatgggctacttcatgatacagatatacactccttgcattatgacagtcattctttcccaggtgtctttctggattaataaggagtccgtcccagcaagaactgtttttgggatcaccactgttttaactatgaccactttgagcatcagtgcccggcactctttgccaaaagtgtcatatgccactgccatggattggttcatagctgtttgctttgcattcgtcttctctgcgcttatcgagttcgcagctgtcaactactttaccaatcttcagacacagaaggccaaaaggaaggcacagtttgcagccccacccacagtgacaatatcaaaagctactgaacctttggaagctgagattgttttgcatcctgactccaaatatcatctgaagaaaaggatcacttctctgtctttgccaatagtttcatcttccgaggccaataaagtgctcacgagagcgcccatcttacaatcaacacctgtcacacccccaccactctcgccagcctttggaggcaccagtaaaatagaccagtattctcgaattctcttcccagttgcatttgcaggattcaaccttgtgtactgggtagtttatctttccaaagatacaatggaagtcagtagcagtgttgaatagcttgcggccaggacaacctgaattctataagttcttgttttctgtttcctatgttttcttaaaaaatagcattgagacttgtgtagatgcttctcagaacatgaaatcaaattggaaatctgtaacgcagcttccgtaagcatgtgtgggcaaaaaagcaataatcctactcctcaaaatagaaagttgaagattgctgaaaaatatgacttttctgtatgttagagaaaaactttatgaggatgaaatgggttcaagatgaatttgtcaacttttgtcttccattgttcagtatttttaattgtcactgtaaataacatttaccacaaggca

SEQ ID NO: 11796 - DNA, 2393 bp, Homo sapiens
acataatctaagaccacaaaccaccttgttccacgtgagaaggaaacaagaaagaagggagccaggggaatcctgcaaatttttaggcaacctctttatctattggattactgacttgaggcaaacaaggaacagagatatgaagggtttgaaagatttctccagttgattggcagagaagagctggctagcagggaggacgaccctaggagggtgaattctgcatttcagtgcactgcaggatggcgtcgtctctgccctggctgtgcattattctgtggctagaaaatgccctagggaaactcgaagttgaaggcaacttctactcagaaaacgtcagtcggatcctggacaacttgcttgaaggctatgacaatcggctgcggccgggatttggaggtgctgtcactgaagtcaaaacagacatttatgtgaccagttttgggcccgtgtcagatgtggagatgacctggactgatgagaggttgaagtttggggggccaactgagattctgagtctgaataatttgatggtcagtaaaatctggacgcctgacacctttttcagaaatggtaaaaagtccattgctcacaacatgacaactcctaataaactcttcagaataatgcagaatggaaccattttatacaccatgaggcttaccatcaatgctgactgtcccatgaggctggttaactttcctatggatgggcatgcttgtccactcaagtttgggagctatgcttatcccaaaagtgaaatcatatatacgtggaaaaaaggaccactttactcagtagaagtcccagaagaatcttcaagccttctccagtatgatctgattggacaaacagtatctagtgagacaattaaatctaacacaggtgaatacgttataatgacagtttacttccacttgcaaaggaagatgggctacttcatgatacagatatacactccttgcattatgacagtcattctttcccaggtgtctttctggattaataaggagtccgtcccagcaagaactgtttttgggatcaccactgttttaactatgaccactttgagcatcagtgcccggcactctttgccaaaagtgtcatatgccactgccatggattggttcatagctgtttgctttgcattcgtcttctctgcgcttatcgagttcgcagctgtcaactactttaccaatcttcagacacagaaggccaaaaggaaggcacagtttgcagccccacccacagtgacaatatcaaaagctactgaacctttggaagctgagattgttttgcatcctgactccaaatatcatctgaagaaaaggatcacttctctgtctttgccaatagtttcatcttccgaggccaataaagtgctcacgagagcgcccatcttacaatcaacacctgtcacacccccaccactctcgccagcctttggaggcaccagtaaaatagaccagtattctcgaattctcttcccagttgcatttgcaggattcaaccttgtgtactgggtagtttatctttccaaagatacaatggaagtcagtagcagtgttgaatagcttgcggccaggacaacctgaattctataagttcttgttttctgtttcctatgttttcttaaaaaatagcattgagacttgtgtagatgcttctcagaacatgaaatcaaattggaaatctgtaacgcagcttccgtaagcatgtgtgggcaaaaaagcaataatcctactcctcaaaatagaaagttgaagattgctgaaaaatatgacttttctgtatgttagagaaaaactttatgaggatgaaatgggttcaagatgaatttgtcaacttttgtcttccattgttcagtatttttaattgtcactgtaaataacatttaccacaaggcagataaaataagaaatgctgacacttccaaaggttgccttaaaatatgtttattttggcttagttcccgagagggcaaaatataaatacagtctaaatatttatcagtaggttaataccagcatgttggaggcctttatgctagtaaaatggctttcagtggcattgtaaagcctacattgagcttagccatttgtttttaacctcgctgtgctcttttacctcaataaaatgtggtgtttgtatacatataaattatacatagctcataaattatgtatgcatatgtacatagctgtagttggactaaaattcagtgtgttttatcctactaaattctccttttaaaataatacacttaccataattctatgaggttgtagaaaaaagtactcattataaggaagccttgtatattatgactatggttatctcttgtgttttccacatttccaattataacactaaataaaacaacaataaacatg

SEQ ID NO: 11797 - DNA, 2143 bp, Homo sapiens
aatgcatgaaggaaactccgtttacacatgctcgtaggatcccctgcgtggaaacagcagcttgtctctgactacccggaggacatggagcaccccaaataggaactttagagggattgaaatctgttgcctgttccactaggaatattgtttgcaaggcacaaggtgtcttttggtagtgagcgcgctctgcgcatgcgcaggtccattcgggaattactgcccagcagccgactaagttgcattccttgaatcttcgcagaaaagacaattcttttaatcagagttagtaatgtggacagtacaaaatcgagagagtctggggcttctctctttccctgtgatgattaccatggtctgttgtgcacacagcaccaatgaacccagcaacatgtcatacgtgaaagagacagtggacagattgctcaaaggatatgacattcgcttgcggccggacttcggagggccccccgtcgacgttgggatgcggatcgatgtcgccagcatagacatggtctccgaagtgaatatggattatacactcaccatgtatttccagcagtcttggaaagacaaaaggctttcttattctggaatcccactgaacctcaccctagacaatagggtagctgaccaactctgggtaccagacacctactttctgaatgacaagaaatcatttgtgcatggggtcacagtgaaaaatcgaatgattcgactgcatcctgatggaacagttctctatggactccgaatcacaaccacagctgcatgtatgatggatcttcgaagatatccattggatgagcagaactgcaccctggagatcgaaagttatggctataccactgatgacattgaattttactggaatggaggagaaggggcagtcactggtgttaataaaatcgaacttcctcaattttcaattgttgactacaagatggtgtctaagaaggtggagttcacaacaggagcgtatccacgactgtcactaagttttcgtctaaagagaaacattggttacttcattttgcaaacctacatgccttctacactgattacaattctgtcctgggtgtctttttggatcaactatgatgcatctgcagccagagtcgcactaggaatcacgacagtgcttacaatgacaaccatcagcacccacctcagggagaccctgccaaagatcccttatgtcaaagcgattgatatttatctgatgggttgctttgtgtttgtgttcctggctctgctggagtatgcctttgtaaattacatcttctttgggaaaggccctcagaaaaagggagctagcaaacaagaccagagtgccaatgagaagaataaactggagatgaataaagtccaggtcgacgcccacggtaacattctcctcagcaccctggaaatccggaatgagacgagtggctcggaagtgctcacgagcgtgagcgaccccaaggccaccatgtactcctatgacagcgccagcatccagtaccgcaagcccctgagcagccgcgaggcctacgggcgcgccctggaccggcacggggtacccagcaaggggcgcatccgcaggcgtgcctcccagctcaaagtcaagatccccgacttgactgatgtgaattccatagacaagtggtcccgaatgtttttccccatcaccttttctctttttaatgtcgtctattggctttactatgtacactgaggtctgttctaatggttccatttagactactttcctcttctattgttttttaaccttacaggtccccaacagcgatactgctgtttctcgaggtaagagattcagccatccaattggttttaggtcttgcatatcagttttattactgcaccatgtttacttcaaaaagacaaaacaaaaaaaaaattatttttccagtctaccgtggtccaggttatcagctctttaagagctctattaattgccatgtttacaaacaaacacaaagagagaagttagacaggtagatctttagcagtcttttctagtttccctggatttcactgatttattttttagggaaaatgaaaagaggaccttgctgtccgcctgcactgcttcctggtaaactataacaaacttatgctgccaaaaaaaaaaaaaaaa

SEQ ID NO: 11798 - DNA, 1498 bp, Homo sapiens
cttttaatcagagttagtaatgtggacagtacaaaatcgagagagtctggggcttctctctttccctgtgatgattaccatggtctgttgtgcacacagcaccaatgaacccagcaacatgtcatacgtgaaagagacagtggacagattgctcaaaggatatgacattcgcttgcggccggacttcggaggattatacactcaccatgtatttccagcagtcttggaaagacaaaaggctttcttattctggaatcccactgaacctcaccctagacaatagggtagctgaccaactctgggtaccagacacctactttctgaatgacaagaaatcatttgtgcatggggtcacagtgaaaaatcgaatgattcgactgcatcctgatggaacagttctctatggactccgaatcacaaccacagctgcatgtatgatggatcttcgaagatatccattggatgagcagaactgcaccctggagatcgaaagttatggctataccactgatgacattgaattttactggaatggaggagaaggggcagtcactggtgttaataaaatcgaacttcctcaattttcaattgttgactacaagatggtgtctaagaaggtggagttcacaacaggagcgtatccacgactgtcactaagttttcgtctaaagagaaacattggttacttcattttgcaaacctacatgccttctacactgattacaattctgtcctgggtgtctttttggatcaactatgatgcatctgcagccagagtcgcactaggaatcacgacagtgcttacaatgacaaccatcagcacccacctcagggagaccctgccaaagatcccttatgtcaaagcgattgatatttatctgatgggttgctttgtgtttgtgttcctggctctgctggagtatgcctttgtaaattacatcttctttgggaaaggccctcagaaaaagggagctagcaaacaagaccagagtgccaatgagaagaataaactggagatgaataaagtccaggtcgacgcccacggtaacattctcctcagcaccctggaaatccggaatgagacgagtggctcggaagtgctcacgagcgtgagcgaccccaaggccaccatgtactcctatgacagcgccagcatccagtaccgcaagcccctgagcagccgcgaggcctacgggcgcgccctggaccggcacggggtacccagcaaggggcgcatccgcaggcgtgcctcccagctcaaagtcaagatccccgacttgactgatgtgaattccatagacaagtggtcccgaatgtttttccccatcaccttttctctttttaatgtcgtctattggctttactatgtacactgaggtctgttctaatggttccatttagactactttcctcttctattgttttttaaccttacaggtccccaacagcgatactgctgtttctcgaggtaagagattcagccatccaattggtttta

SEQ ID NO: 11799 - DNA, 7385 bp, Homo sapiens
gcgcggggaagggaagaagaggacgaggtggcgcggagaccgcgggagaacacagtgcctccggaggaaatctgctcggtccccggcagccgccgcttcccctttgatgttttggtacgccgtgcgcatgcgcctcacattagaattactgcactgggcagactaagttggatctcctctcttcagtgaaaccctcaattccatcaaaaactaaagggatgtggagagtgcggaaaaggggctactttgggatttggtccttccccttaataatcgccgctgtctgtgcgcagagtgtcaatgaccctagtaatatgtcgctggttaaagagacggtggatagactcctgaaaggctatgacattcgtctgagaccagattttggaggtccccccgtggctgtggggatgaacattgacattgccagcatcgatatggtttctgaagtcaatatggattataccttgacaatgtactttcaacaagcctggagagataagaggctgtcctataatgtaatacctttaaacttgactctggacaacagagtggcagaccagctctgggtgcctgatacctatttcctgaacgataagaagtcatttgtgcacggagtgactgttaagaaccgcatgattcgcctgcatcctgatggcaccgtcctttatggactcagaatcacaaccacagctgcctgcatgatggacctaaggaggtacccactggatgaacaaaactgcaccttggaaattgagagctatggatacacaactgatgacattgagttttactggcgtggcgatgataatgcagtaacaggagtaacgaaaattgaacttccacagttctctattgtagattacaaacttatcaccaagaaggttgttttttccacaggttcctatcccaggttatccctcagctttaagcttaagagaaacattggctactttatcctgcaaacatacatgccttccatcctgattaccatcctctcctgggtctccttctggattaattacgatgcttcagctgcaagggtggcattaggaatcacaactgtcctcacaatgaccacaatcaacacccacctccgggaaactctccctaaaatcccctatgtgaaggccattgacatgtacctgatggggtgctttgtcttcgttttcatggcccttctggaatatgccctagtcaactacatcttctttgggagggggccccaacgccaaaagaaagcagctgagaaggctgccagtgccaacaatgagaagatgcgcctggatgtcaacaagattttttataaagatattaaacaaaatgggacccaatatcgatccttgtgggaccctactggaaacctctccccaactagacggactaccaattacgatttctctctgtatacgatggacccccatgagaacatcttactgagcactctcgagataaaaaatgaaatggccacatctgaggctgtgatgggacttggagaccccagaagcacaatgctagcctatgatgcctccagcatccagtatcggaaagctgggttgcccaggcatagttttggccgaaatgctctggaacgacatgtggcgcaaaagaaaagtcgcctgaggagacgcgcctcccaactgaaaatcaccatccctgacttgactgatgtgaatgccatagatcggtggtcccgcatattcttcccagtggttttttccttcttcaacatcgtctattggctttattatgtgaactaaaacatggcctcccactggaagcaaggactagattcctcctcaaaccagttgtacagcctgatgtaggacttggaaaacacatcaatccaggacaaaagtgacgctaaaataccttagttgctggcctatcctgtggtccatttcataccatttgggttgcttctgctaagtaatgaatacactaaggtccttgtggttttccagttaaaacgcaagtgatttttacacatggtggctagacagcctgagtgctccatgttgtctgtttagtatgcagcctactcagaggggaataatttggaagatattcttagaaggctcaacagcattgtcagtcatttggtcataaccagatactcctcatcttcctttttaaggtcggcatgctgttgagatggcattgtccttatgaaacattatctgtaatgccatgcaaacacattacttgaagatgatctatgattttcttactgagatgataatggtgtcatgggaagattattcccactggtttctaaaagattctcttgtgatttgagcaggctaggggaatcaagacagagactcaggaaaccgatttggccagtccctttgcttgagcacggagaatcaactatgatgtctttcattttggcatttagagatgaggagacttctggacaatatcatgcatggtggccaagaaaatttttgctaaacggctatttcctaggtggttaaagtaagagttaacaacacagagcagagtagaaaatcagaaacgacggttgtaacaaaaagcaagcaagcaagaaagcatgacccttatcagctccacacagcatctggtctatacatactgtgtctagtggcagagggtgagtaagagagattgtttttccaacatcactagcttttgacagcatacctaaagaggtttttatagtttaatcgaagataaccatgaaatacaaaaattagagaaatgagaattgtcttagatattcaggttagattcagagtcattcaaatatacaaatacagagcacaaactagcaaacagattgtttttctcagacgaagtcagctgtccctgcaatttttgtccctataattttatttcttaatttaatagagtatttcaagagaaggatttgttcatcactttaaaggattcatggtcctctccagctttttttttgcttccaaaattctgattatattcttaggagactggcaaagtaaggctttggagagattgagtgaactatattttcttatatgcaatgaaattcaccattgtatttttcaaagcaaataatacttcaaggagtatgaacacacagagagttaatttgtgcattcattggtttggggcttgattttcttaagagtgctttcattgtatatgttgcaatctgcctaatcaaggaaaatatgaaaactagtggaaaataataacaaagccacattaacatgataaatgttatgagcctcagttgatattgcagaaaaatatataactgttaatcaggcaggcatgatgtattttttttctatttttaagttatgccattgtgcttctttctacactaattggacataagcattcatatgttggacaagaggagaataagctaatatgtcttccttctatcaatataaggctcatattttgcttttcttatagaaaatagtgaattgctaaattttccttaaagttgaatttgattgaactttttcttggaggatgactttgctatttctattttgaaaacaaagaaagctcttctttttagagtaatatccctaattgtgcatagcagccagtatccacctgtgaataatgtatgttttcttgattccttgtttccttcatgatttagcagcttggaatatgatggagtactattgcccttgcattccagctgtccaagaacaacaacaaacctttatccttcagctttctgaatttgccccaaaatggaatggtattttgtttttcaccagtgtaggaaaccttggccattatattttgattacataatcttgagcacctctgagtatcatctttgggcagaatctgaccaagattcttctcacaggctcagagtagagattcctcatgtttctccaggacacactttctcctaggcaatcattttggggcatcacactaagtaaagtgcctgccccttgtcaacagggggtaaagtttgactaaaaaacatcaggaaggaacatattgataactcaggggcacaactccaaaatgccattctgaaaaggctcttctagagtcaactcagagcccaagtgtagaagtgggctcttatgtgcaatcactgtacaagccataaaaatctttgatattgccatttatgattacaacaaaattttagatgtccaagaaagtcaacagaacaatccagatcaaagtgtagagaagcatctttgcagcttgagcctcaaaagcataaaaccaggaattcatttctgctctcagtgatacaagaaacaaggcaaaggaaaaaagatgggaccttagaagcaatgccctagagtaaaaagcatacattggcactcagtaaccacagagatagaaacaactgactcagcctctccagaaataacagtagatgtagaatttgttcttaaatatatgtttcgttgaaatgaaatgcagtcatcaaatgcgaggaggggtgctagacctgataagtctaggaagaccagtcagcttgatagccagttgttaaactaaaggaccacaaaggtgtgtttagtagttctgatatgggattactatcagtttatacatatgtatagattttcttttaattataaacagccagatagccagcaattaaggtgttttttcatctttgtgaaattcatggacaaattctgactctaaaatgcacagtctacatgaaatctttgatctcaatctgtatatatatatattgtacatgaccgctagtaggtatgaaatgcatttcagagttgaaaactcatgcaacataatcatgtgtttgcataaggaatgttaaaattctttctactacaatttattaacaggggaaaagattcaagcagtgccatctagaccttttctcttctcatttcttcaaaagcagtgctaagtaaaataataataataaaaatggtttatgaaccaaaagactttacattctagcattaggaacacacacaaaaaaatctgtcagcttacaaaagcacaacacataaagaaagagcagtggaatgcgtaatggggaaatgaatcatgtttaaagcaagacttgcattaaattggcaactaagataatttccattttctataggtaaccgtgttccagtttaatgattaccttcatactcaacaagaaaaatggcaaagcaacatcatcaaaataggtcttacaacatatctacatgtatatatgtgtatatatagattcatataaacatacatacatatatatgcattcatatgttggaaaacaaaaggaataagctaatatgttttatttccttcattaaaccagtatatgagtatttttaatttggcaaacaaaaatcaacatactgaaataagtaatacagggtactgagcatttctctatcagcaaatcaatgcctacagtttttatgaaccattgcacagttcaactcgacaatagtactgtaccccagaacatcagaagttaagtagttgtcacattgcttgtctaattgctctctttttcaaggaaacaaataacattgtccattggtgagtcaaaaacaaacatgtcttaagaaaatgaaaaatgataaaaattcctccaaagaggaagaaaaaaaaaaaactaaaccccaccatgttggttagggcaaaatactaagtattcacaactgtagcaatcatgccatttggctaaatgtacagagtacatgtaatgtgagcaaccataactttcactgaacgtgtgtaaatattaaaacagatttcttaaatatttttaacttctaatttgtattttatggtaaggcaatgtgctaattccgtttatggcttaagttgatgtgttataatatgtaaataattaaacatgctgtaaatgaatagtcaatagatacaaataattgtttagtttttttcttaatttttatttattttttactaagtactattactgcagtgcccccagcagagtaatttaaacacccttttgcataaatggtttgggaatcccagacagaagggtttcaatttgctatcacacacacagtcacacacagtcacacacacacacacacacacactcaaacacacataatcttttgctcacccactctgtctctctgcccgtctatgggaaacactctactatttatgtagtcaatataacaaacaagagatagcctttgaaatggcaattgggaaaagcaaaaatgatcattgataacttaatagacttttttatatgtcagagttcaagaaaccaaagtttgcaacttaaatctcagttttcaaacagtaaaagtttgtatagatggcactacagaaaaataaaaatggttattcctaccagctccagaaatgtgttacacaatatacactagaagactttttttttaataatagtattttgtccttaggtagtattgttcctttcaaccaaagactccagaattattgaaaaacaaaaaaggaaaaaaaaaatgagataatgggggaaaaaaaggacgctgcttcacaccaaaggtttaaaaaaatattttccaaatgcactaggaacattgtaaaaaccagaaaggagtgaacagaatgctaatgaagatactgccctaaagaaatctgtacaaaaaaaaaaaaaaaaagcagcactcttaaaaagctactaggtttttggaaattgaagtaaaatatttctgtagatatattcaaaattctgacatcaaattttaatttgcttaaagaagttttatttgtgatgaagatcaatatgattcaaatgatgaaaaacaaaactgtatgtcctttgagttcccaaaccaaatgtcactgccgtgtcacatcctctaatctgatgcccatgtgtgtgtccttgcgccatttgaagcaagttgacagttccatcagtttgtttttgtttttgtttttggttcaataatttgagttcaaccatcgtcattttaaacataattaatcccaacaaagttgcctatagtttaatttaaacctcacagcatttttaatttattttgcatgggtgtttaaatagttctgttacgaatattgtccctgcacagttctaaattgtccttttataaaaaaaaaaagtgatattctagtttcttcacaatgtagtgattatcagccttactaattaccttgtagcctttcttaatatgcacataatgcacattttccgatggctagaaaaatgcaaaacacagtggatatcattgcatctattttcatgtctttctaaaaacaggactattaaaatctctgggatacatgagatagtaaaaaatgaggattataaatgaatagcacataagaattattttcttgaatttaaacttattgcagccagtttcagcatgtaaatatataataatgttggctagtgtgtaattcttgaactaagaaat

SEQ ID NO: 11800 - DNA, 1963 bp, Homo sapiens
accccaagcttgctgcctcctccgggtcccggcggccacggcgaggcggcctgagcttcaggaggaagggaagaggcagcctctgggtgtgcgagtcccctgggcgcggggaagggaagaagaggacgaggtggcgcggagaccgcgggagaacacagtgcctccggaggaaatctgctcggtccccggcagccgccgcttcccctttgatgttttggtacgccgtgcgcatgcgcctcacattagaattactgcactgggcagactaagttggatctcctctcttcagtgaaaccctcaattccatcaaaaactaaagggatgtggagagtgcggaaaaggggctactttgggatttggtccttccccttaataatcgccgctgtctgtgcgcagagtgtcaatgaccctagtaatatgtcgctggttaaagagacggtggatagactcctgaaaggctatgacattcgtctgagaccagattttggaggtccccccgtggctgtggggatgaacattgacattgccagcatcgatatggtttctgaagtcaatatggattataccttgacaatgtactttcaacaagcctggagagataagaggctgtcctataatgtaatacctttaaacttgactctggacaacagagtggcagaccagctctgggtgcctgatacctatttcctgaacgataagaagtcatttgtgcacggagtgactgttaagaaccgcatgattcgcctgcatcctgatggcaccgtcctttatggactcagaatcacaaccacagctgcctgcatgatggacctaaggaggtacccactggatgaacaaaactgcaccttggaaattgagagctatggatacacaactgatgacattgagttttactggcgtggcgatgataatgcagtaacaggagtaacgaaaattgaacttccacagttctctattgtagattacaaacttatcaccaagaaggttgttttttccacaggttcctatcccaggttatccctcagctttaagcttaagagaaacattggctactttatcctgcaaacatacatgccttccatcctgattaccatcctctcctgggtctccttctggattaattacgatgcttcagctgcaagggtggcattaggaatcacaactgtcctcacaatgaccacaatcaacacccacctccgggaaactctccctaaaatcccctatgtgaaggccattgacatgtacctgatggggtgctttgtcttcgttttcatggcccttctggaatatgccctagtcaactacatcttctttgggagggggccccaacgccaaaagaaagcagctgagaaggctgccagtgccaacaatgagaagatgcgcctggatgtcaacaagatggacccccatgagaacatcttactgagcactctcgagataaaaaatgaaatggccacatctgaggctgtgatgggacttggagaccccagaagcacaatgctagcctatgatgcctccagcatccagtatcggaaagctgggttgcccaggcatagttttggccgaaatgctctggaacgacatgtggcgcaaaagaaaagtcgcctgaggagacgcgcctcccaactgaaaatcaccatccctgacttgactgatgtgaatgccatagatcggtggtcccgcatattcttcccagtggttttttccttcttcaacatcgtctattggctttattatgtgaactaaaacatggcctcccactggaagcaaggactagattcctcctcaaaccagttgtacagcctgatgtaggacttggaaaacacatcaatccaggacaaaagtgacgctaaaataccttagttgctggcctatcctgtggtccatttcataccatttgggttgcttctgctaagtaatgaatacactaaggtccttgtggttttccagttaaaacgcaagt

SEQ ID NO: 11801 - DNA, 7191 bp, Homo sapiens
atgtggagagtgcggaaaaggggctactttgggatttggtccttccccttaataatcgccgctgtctgtgcgcagagtgtcaatgaccctagtaatatgtcgctggttaaagagacggtggatagactcctgaaaggctatgacattcgtctgagaccagattttggaggtccccccgtggctgtggggatgaacattgacattgccagcatcgatatggtttctgaagtcaatatggattataccttgacaatgtactttcaacaagcctggagagataagaggctgtcctataatgtaatacctttaaacttgactctggacaacagagtggcagaccagctctgggtgcctgatacctatttcctgaacgataagaagtcatttgtgcacggagtgactgttaagaaccgcatgattcgcctgcatcctgatggcaccgtcctttatggactcagaatcacaaccacagctgcctgcatgatggacctaaggaggtacccactggatgaacaaaactgcaccttggaaattgagagctatggatacacaactgatgacattgagttttactggcgtggcgatgataatgcagtaacaggagtaacgaaaattgaacttccacagttctctattgtagattacaaacttatcaccaagaaggttgttttttccacaggttcctatcccaggttatccctcagctttaagcttaagagaaacattggctactttatcctgcaaacatacatgccttccatcctgattaccatcctctcctgggtctccttctggattaattacgatgcttcagctgcaagggtggcattaggaatcacaactgtcctcacaatgaccacaatcaacacccacctccgggaaactctccctaaaatcccctatgtgaaggccattgacatgtacctgatggggtgctttgtcttcgttttcatggcccttctggaatatgccctagtcaactacatcttctttgggagggggccccaacgccaaaagaaagcagctgagaaggctgccagtgccaacaatgagaagatgcgcctggatgtcaacaagattttttataaagatattaaacaaaatgggacccaatatcgatccttgtgggaccctactggaaacctctccccaactagacggactaccaattacgatttctctctgtatacgatggacccccatgagaacatcttactgagcactctcgagataaaaaatgaaatggccacatctgaggctgtgatgggacttggagaccccagaagcacaatgctagcctatgatgcctccagcatccagtatcggaaagctgggttgcccaggcatagttttggccgaaatgctctggaacgacatgtggcgcaaaagaaaagtcgcctgaggagacgcgcctcccaactgaaaatcaccatccctgacttgactgatgtgaatgccatagatcggtggtcccgcatattcttcccagtggttttttccttcttcaacatcgtctattggctttattatgtgaactaaaacatggcctcccactggaagcaaggactagattcctcctcaaaccagttgtacagcctgatgtaggacttggaaaacacatcaatccaggacaaaagtgacgctaaaataccttagttgctggcctatcctgtggtccatttcataccatttgggttgcttctgctaagtaatgaatacactaaggtccttgtggttttccagttaaaacgcaagtgatttttacacatggtggctagacagcctgagtgctccatgttgtctgtttagtatgcagcctactcagaggggaataatttggaagatattcttagaaggctcaacagcattgtcagtcatttggtcataaccagatactcctcatcttcctttttaaggtcggcatgctgttgagatggcattgtccttatgaaacattatctgtaatgccatgcaaacacattacttgaagatgatctatgattttcttactgagatgataatggtgtcatgggaagattattcccactggtttctaaaagattctcttgtgatttgagcaggctaggggaatcaagacagagactcaggaaaccgatttggccagtccctttgcttgagcacggagaatcaactatgatgtctttcattttggcatttagagatgaggagacttctggacaatatcatgcatggtggccaagaaaatttttgctaaacggctatttcctaggtggttaaagtaagagttaacaacacagagcagagtagaaaatcagaaacgacggttgtaacaaaaagcaagcaagcaagaaagcatgacccttatcagctccacacagcatctggtctatacatactgtgtctagtggcagagggtgagtaagagagattgtttttccaacatcactagcttttgacagcatacctaaagaggtttttatagtttaatcgaagataaccatgaaatacaaaaattagagaaatgagaattgtcttagatattcaggttagattcagagtcattcaaatatacaaatacagagcacaaactagcaaacagattgtttttctcagacgaagtcagctgtccctgcaatttttgtccctataattttatttcttaatttaatagagtatttcaagagaaggatttgttcatcactttaaaggattcatggtcctctccagctttttttttgcttccaaaattctgattatattcttaggagactggcaaagtaaggctttggagagattgagtgaactatattttcttatatgcaatgaaattcaccattgtatttttcaaagcaaataatacttcaaggagtatgaacacacagagagttaatttgtgcattcattggtttggggcttgattttcttaagagtgctttcattgtatatgttgcaatctgcctaatcaaggaaaatatgaaaactagtggaaaataataacaaagccacattaacatgataaatgttatgagcctcagttgatattgcagaaaaatatataactgttaatcaggcaggcatgatgtattttttttctatttttaagttatgccattgtgcttctttctacactaattggacataagcattcatatgttggacaagaggagaataagctaatatgtcttccttctatcaatataaggctcatattttgcttttcttatagaaaatagtgaattgctaaattttccttaaagttgaatttgattgaactttttcttggaggatgactttgctatttctattttgaaaacaaagaaagctcttctttttagagtaatatccctaattgtgcatagcagccagtatccacctgtgaataatgtatgttttcttgattccttgtttccttcatgatttagcagcttggaatatgatggagtactattgcccttgcattccagctgtccaagaacaacaacaaacctttatccttcagctttctgaatttgccccaaaatggaatggtattttgtttttcaccagtgtaggaaaccttggccattatattttgattacataatcttgagcacctctgagtatcatctttgggcagaatctgaccaagattcttctcacaggctcagagtagagattcctcatgtttctccaggacacactttctcctaggcaatcattttggggcatcacactaagtaaagtgcctgccccttgtcaacagggggtaaagtttgactaaaaaacatcaggaaggaacatattgataactcaggggcacaactccaaaatgccattctgaaaaggctcttctagagtcaactcagagcccaagtgtagaagtgggctcttatgtgcaatcactgtacaagccataaaaatctttgatattgccatttatgattacaacaaaattttagatgtccaagaaagtcaacagaacaatccagatcaaagtgtagagaagcatctttgcagcttgagcctcaaaagcataaaaccaggaattcatttctgctctcagtgatacaagaaacaaggcaaaggaaaaaagatgggaccttagaagcaatgccctagagtaaaaagcatacattggcactcagtaaccacagagatagaaacaactgactcagcctctccagaaataacagtagatgtagaatttgttcttaaatatatgtttcgttgaaatgaaatgcagtcatcaaatgcgaggaggggtgctagacctgataagtctaggaagaccagtcagcttgatagccagttgttaaactaaaggaccacaaaggtgtgtttagtagttctgatatgggattactatcagtttatacatatgtatagattttcttttaattataaacagccagatagccagcaattaaggtgttttttcatctttgtgaaattcatggacaaattctgactctaaaatgcacagtctacatgaaatctttgatctcaatctgtatatatatatattgtacatgaccgctagtaggtatgaaatgcatttcagagttgaaaactcatgcaacataatcatgtgtttgcataaggaatgttaaaattctttctactacaatttattaacaggggaaaagattcaagcagtgccatctagaccttttctcttctcatttcttcaaaagcagtgctaagtaaaataataataataaaaatggtttatgaaccaaaagactttacattctagcattaggaacacacacaaaaaaatctgtcagcttacaaaagcacaacacataaagaaagagcagtggaatgcgtaatggggaaatgaatcatgtttaaagcaagacttgcattaaattggcaactaagataatttccattttctataggtaaccgtgttccagtttaatgattaccttcatactcaacaagaaaaatggcaaagcaacatcatcaaaataggtcttacaacatatctacatgtatatatgtgtatatatagattcatataaacatacatacatatatatgcattcatatgttggaaaacaaaaggaataagctaatatgttttatttccttcattaaaccagtatatgagtatttttaatttggcaaacaaaaatcaacatactgaaataagtaatacagggtactgagcatttctctatcagcaaatcaatgcctacagtttttatgaaccattgcacagttcaactcgacaatagtactgtaccccagaacatcagaagttaagtagttgtcacattgcttgtctaattgctctctttttcaaggaaacaaataacattgtccattggtgagtcaaaaacaaacatgtcttaagaaaatgaaaaatgataaaaattcctccaaagaggaagaaaaaaaaaaaactaaaccccaccatgttggttagggcaaaatactaagtattcacaactgtagcaatcatgccatttggctaaatgtacagagtacatgtaatgtgagcaaccataactttcactgaacgtgtgtaaatattaaaacagatttcttaaatatttttaacttctaatttgtattttatggtaaggcaatgtgctaattccgtttatggcttaagttgatgtgttataatatgtaaataattaaacatgctgtaaatgaatagtcaatagatacaaataattgtttagtttttttcttaatttttatttattttttactaagtactattactgcagtgcccccagcagagtaatttaaacacccttttgcataaatggtttgggaatcccagacagaagggtttcaatttgctatcacacacacagtcacacacagtcacacacacacacacacacacactcaaacacacataatcttttgctcacccactctgtctctctgcccgtctatgggaaacactctactatttatgtagtcaatataacaaacaagagatagcctttgaaatggcaattgggaaaagcaaaaatgatcattgataacttaatagacttttttatatgtcagagttcaagaaaccaaagtttgcaacttaaatctcagttttcaaacagtaaaagtttgtatagatggcactacagaaaaataaaaatggttattcctaccagctccagaaatgtgttacacaatatacactagaagactttttttttaataatagtattttgtccttaggtagtattgttcctttcaaccaaagactccagaattattgaaaaacaaaaaaggaaaaaaaaaatgagataatgggggaaaaaaaggacgctgcttcacaccaaaggtttaaaaaaatattttccaaatgcactaggaacattgtaaaaaccagaaaggagtgaacagaatgctaatgaagatactgccctaaagaaatctgtacaaaaaaaaaaaaaaaaagcagcactcttaaaaagctactaggtttttggaaattgaagtaaaatatttctgtagatatattcaaaattctgacatcaaattttaatttgcttaaagaagttttatttgtgatgaagatcaatatgattcaaatgatgaaaaacaaaactgtatgtcctttgagttcccaaaccaaatgtcactgccgtgtcacatcctctaatctgatgcccatgtgtgtgtccttgcgccatttgaagcaagttgacagttccatcagtttgtttttgtttttgtttttggttcaataatttgagttcaaccatcgtcattttaaacataattaatcccaacaaagttgcctatagtttaatttaaacctcacagcatttttaatttattttgcatgggtgtttaaatagttctgttacgaatattgtccctgcacagttctaaattgtccttttataaaaaaaaaaagtgatattctagtttcttcacaatgtagtgattatcagccttactaattaccttgtagcctttcttaatatgcacataatgcacattttccgatggctagaaaaatgcaaaacacagtggatatcattgcatctattttcatgtctttctaaaaacaggactattaaaatctctgggatacatgagatagtaaaaaatgaggattataaatgaatagcacataagaattattttcttgaatttaaacttattgcagccagtttcagcatgtaaatatataataatgttggctagtgtgtaattcttgaactaagaaatataaataaaaataaaaagattgtg

SEQ ID NO: 11802 - DNA, 1349 bp, Homo sapiens
aagttggatctcctctcttcagtgaaaccctcaattccatcaaaaactaaagggatgtggagagtgcggaaaaggggctactttgggatttggtccttccccttaataatcgccgctgtctgtgcgcagaggtccccccgtggctgtggggatgaacattgacattgccagcatcgatatggtttctgaagtcaatatgaatcacaaccacagctgcctgcatgatggacctaaggaggtacccactggatgaacaaaactgcaccttggaaattgagagctatggatacacaactgatgacattgagttttactggcgtggcgatgataatgcagtaacaggagtaacgaaaattgaacttccacagttctctattgtagattacaaacttatcaccaagaaggttgttttttccacaggttcctatcccaggttatccctcagctttaagcttaagagaaacattggctactttatcctgcaaacatacatgccttccatcctgattaccatcctctcctgggtctccttctggattaattacgatgcttcagctgcaagggtggcattaggaatcacaactgtcctcacaatgaccacaatcaacacccacctccgggaaactctccctaaaatcccctatgtgaaggccattgacatgtacctgatggggtgctttgtcttcgttttcatggcccttctggaatatgccctagtcaactacatcttctttgggagggggccccaacgccaaaagaaagcagctgagaaggctgccagtgccaacaatgagaagatgcgcctggatgtcaacaagatggacccccatgagaacatcttactgagcactctcgagataaaaaatgaaatggccacatctgaggctgtgatgggacttggagaccccagaagcacaatgctagcctatgatgcctccagcatccagtatcggaaagctgggttgcccaggcatagttttggccgaaatgctctggaacgacatgtggcgcaaaagaaaagtcgcctgaggagacgcgcctcccaactgaaaatcaccatccctgacttgactgatgtgaatgccatagatcggtggtcccgcatattcttcccagtggttttttccttcttcaacatcgtctattggctttattatgtgaactaaaacatggcctcccactggaagcaaggactagattcctcctcaaaccagttgtacagcctgatgtaggacttggaaaacacatcaatccaggacaaaagtgacgctaaaataccttagttgctggcctatcctgtggtccatttcataccatttgggttgcttctgctaagtaatgaatacact

SEQ ID NO: 11803 - DNA, 1779 bp, Homo sapiens
gagtcccctgggcgcggggaagggaagaagaggacgaggtggcgcggagaccgcgggagaacacagtgcctccggaggaaatctgctcggtccccggcagccgccgcttcccctttgatgttttggtacgccgtgcgcatgcgcctcacattagaattactgcactgggcagactaagttggatctcctctcttcagtgaaaccctcaattccatcaaaaactaaagggatgtggagagtgcggaaaaggggctactttgggatttggtccttccccttaataatcgccgctgtctgtgcgcagaggtccccccgtggctgtggggatgaacattgacattgccagcatcgatatggtttctgaagtcaatatggattataccttgacaatgtactttcaacaagcctggagagataagaggctgtcctataatgtaatacctttaaacttgactctggacaacagagtggcagaccagctctgggtgcctgatacctatttcctgaacgataagaagtcatttgtgcacggagtgactgttaagaaccgcatgattcgcctgcatcctgatggcaccgtcctttatggactcagaatcacaaccacagctgcctgcatgatggacctaaggaggtacccactggatgaacaaaactgcaccttggaaattgagagctatggatacacaactgatgacattgagttttactggcgtggcgatgataatgcagtaacaggagtaacgaaaattgaacttccacagttctctattgtagattacaaacttatcaccaagaaggttgttttttccacaggttcctatcccaggttatccctcagctttaagcttaagagaaacattggctactttatcctgcaaacatacatgccttccatcctgattaccatcctctcctgggtctccttctggattaattacgatgcttcagctgcaagggtggcattaggaatcacaactgtcctcacaatgaccacaatcaacacccacctccgggaaactctccctaaaatcccctatgtgaaggccattgacatgtacctgatggggtgctttgtcttcgttttcatggcccttctggaatatgccctagtcaactacatcttctttgggagggggccccaacgccaaaagaaagcagctgagaaggctgccagtgccaacaatgagaagatgcgcctggatgtcaacaagatggacccccatgagaacatcttactgagcactctcgagataaaaaatgaaatggccacatctgaggctgtgatgggacttggagaccccagaagcacaatgctagcctatgatgcctccagcatccagtatcggaaagctgggttgcccaggcatagttttggccgaaatgctctggaacgacatgtggcgcaaaagaaaagtcgcctgaggagacgcgcctcccaactgaaaatcaccatccctgacttgactgatgtgaatgccatagatcggtggtcccgcatattcttcccagtggttttttccttcttcaacatcgtctattggctttattatgtgaactaaaacatggcctcccactggaagcaaggactagattcctcctcaaaccagttgtacagcctgatgtaggacttggaaaacacatcaatccaggacaaaagtgacgctaaaataccttagttgctggcctatcctgtggtccatttcataccatttgggttgcttctgctaagtaatgaatacactaaggtccttgtggttttccagttaaaacgcaagt

SEQ ID NO: 11804 - DNA, 2030 bp, Homo sapiens
gcgcggggaagggaagaagaggacgaggtggcgcggagaccgcgggagaacacagtgcctccggaggtgaggggctcttcctcattttgcctgccttctagggaccgctccggcttcttgtatccagaggtacagcccctgaacagccgggagtccccgtcccctgtcccggacgaggggccgggggcgccagctccgcacgccgcgggagtgggcggcgagcgcgggcctgcgaggaaatctgctcggtccccggcagccgccgcttcccctttgatgttttggtacgccgtgcgcatgcgcctcacattagaattactgcactgggcagactaagttggatctcctctcttcagtgaaaccctcaattccatcaaaaactaaagggatgtggagagtgcggaaaaggggctactttgggatttggtccttccccttaataatcgccgctgtctgtgcgcagagtgtcaatgaccctagtaatatgtcgctggttaaagagacggtggatagactcctgaaaggctatgacattcgtctgagaccagattttggaggtccccccgtggctgtggggatgaacattgacattgccagcatcgatatggtttctgaagtcaatatggattataccttgacaatgtactttcaacaagcctggagagataagaggctgtcctataatgtaatacctttaaacttgactctggacaacagagtggcagaccagctctgggtgcctgatacctatttcctgaacgataagaagtcatttgtgcacggagtgactgttaagaaccgcatgattcgcctgcatcctgatggcaccgtcctttatggactcagaatcacaaccacagctgcctgcatgatggacctaaggaggtacccactggatgaacaaaactgcaccttggaaattgagagctatggatacacaactgatgacattgagttttactggcgtggcgatgataatgcagtaacaggagtaacgaaaattgaacttccacagttctctattgtagattacaaacttatcaccaagaaggttgttttttccacaggttcctatcccaggttatccctcagctttaagcttaagagaaacattggctactttatcctgcaaacatacatgccttccatcctgattaccatcctctcctgggtctccttctggattaattacgatgcttcagctgcaagggtggcattaggaatcacaactgtcctcacaatgaccacaatcaacacccacctccgggaaactctccctaaaatcccctatgtgaaggccattgacatgtacctgatggggtgctttgtcttcgttttcatggcccttctggaatatgccctagtcaactacatcttctttgggagggggccccaacgccaaaagaaagcagctgagaaggctgccagtgccaacaatgagaagatgcgcctggatgtcaacaagatggacccccatgagaacatcttactgagcactctcgagataaaaaatgaaatggccacatctgaggctgtgatgggacttggagaccccagaagcacaatgctagcctatgatgcctccagcatccagtatcggaaagctgggttgcccaggcatagttttggccgaaatgctctggaacgacatgtggcgcaaaagaaaagtcgcctgaggagacgcgcctcccaactgaaaatcaccatccctgacttgactgatgtgaatgccatagatcggtggtcccgcatattcttcccagtggttttttccttcttcaacatcgtctattggctttattatgtgaactaaaacatggcctcccactggaagcaaggactagattcctcctcaaaccagttgtacagcctgatgtaggacttggaaaacacatcaatccaggacaaaagtgacgctaaaataccttagttgctggcctatcctgtggtccatttcataccatttgggttgcttctgctaagtaatgaatacactaaggtccttgtggttttccagttaaaacgcaagt

SEQ ID NO: 11805 - DNA, 3107 bp, Homo sapiens
tttggctgctcggagagtaggggggagagcggatcccagcaggttaggccggaggaacagcgccatgtgctccgggctcctggagctcctgctgcccatctggctctcctggaccctggggacccgaggctctgagccccgcagtgtgaacgatcccgggaacatgtcctttgtgaaggagacggtggacaagctgttgaaaggctacgacattcgcctaagacccgacttcgggggtcccccggtctgcgtggggatgaacatcgacatcgccagcatcgacatggtttccgaagtcaacatggattataccttaaccatgtattttcaacaatattggagagataaaaggctcgcctattctgggatccctctcaacctcacgcttgacaatcgagtggctgaccagctatgggtgcccgacacatatttcttaaatgacaaaaagtcatttgtgcatggagtgacagtgaaaaaccgcatgatccgtcttcaccctgatgggacagtgctgtatgggctcagaatcaccacgacagcagcatgcatgatggacctcaggagataccccctggacgagcagaactgcactctggaaattgaaagctatggctacaccacggatgacattgagttttactggcgaggcggggacaaggctgttaccggagtggaaaggattgagctcccgcagttctccatcgtggagcaccgtctggtctcgaggaatgttgtcttcgccacaggtgcctatcctcgactgtcactgagctttcggttgaagaggaacattggatacttcattcttcagacttatatgccctctatactgataacgattctgtcgtgggtgtccttctggatcaattatgatgcatctgctgctagagttgccctcgggatcacaactgtgctgacaatgacaaccatcaacacccaccttcgggagaccttgcccaaaatcccctatgtcaaagccattgacatgtaccttatgggctgcttcgtctttgtgttcctggcccttctggagtatgcctttgtcaactacattttctttggaagaggccctcaaaggcagaagaagcttgcagaaaagacagccaaggcaaagaatgaccgttcaaagagcgaaagcaaccgggtggatgctcatggaaatattctgttgacatcgctggaagttcacaatgaaatgaatgaggtctcaggcggcattggcgataccaggaattcagcaatatcctttgacaactcaggaatccagtacaggaaacagagcatgcctcgagaagggcatgggcgattcctgggggacagaagcctcccgcacaagaagacccatctacggaggaggtcttcacagctcaaaattaaaatacctgatctaaccgatgtgaatgccatagacagatggtccaggatcgtgtttccattcactttttctcttttcaacttagtttactggctgtactatgttaactgagtgactgtacttgatttttcaaagacttcatttaacactgagtgaaatattactctgcctgtcaagtttttatacctgtacacacacagacacacaagcagacacacacatatatacatacgcaattgtatatatatgtgaactttctcagcatatatataaaatacacgtgtatatgaggatgtatgtgtatatgtttatacacacaggagtcagtgcccatgtgtatggaagacaaatacacatacatatatacattttgcagctatggacaatttaccacaggatgcatattaaagaaagtcatagtttttttcttttttaattgaaagggacaagtatcatctaaatattatgccttgagaatgagggcgtgaaacacaatatcatccccaaatgtgtcttgtattatcataagttagatgttttagtttaaaaatcagaaagacattcttagttaatctttgaaaactcatacagtggtattgctagtttaaaatgagtcacttacttcatatcctctcgttcagtttagtaagcaaaggcttcttggcttctctggtgatggggtttgttttcatcgggcatacgttttctgcaatggtttagtggctggggtgagccactggcagtgtgcttacctgttgtctgaaacatagatagatcccacgttgatgtctgaacgaccgtcttttgaaaactcatcgggagtgaatggcatctcgttgtaagtactctaatatacagtgtgtagtttgtttctgttgttcacttggagtggatccagcttcactgtcatgtgcgaacacagtgacacgtttggccagtgacatttcaatcactgaaaatgtgctctacatctcgtatggatttctaggcctgatatccaacagaaagcatagacgtctcaggttattcgttactctaaggtaaaaccatctaggatgattttcccccttgcagttatgttatcattcttataacattgtatgttaatagaaaatatatttgcataatatgcatatatatgtatatttaccaagattttgtttcttacgcttgctatcatggcagcatgcgatgtcatattttcctttatgtgatgtaactactttctgttatctagaaattaagattgaagctaaaacacttctactgttcaatttcagaaactaagaatcatcctcatgcctttatttctgtatctgacatatttcataagcacatccaactactcctagactgactaggattctgcaggaacatgacccgtacacaccacgcgtcacccaacgacccatgaccgttctctgaggcaaaggagggcaacctgacagcaaacacagtcactgttggttccttctgatccacagcctcatcagtatttggactttttaaagctcgtagaaacaagacaaggtgcaccggtttcatagacgcaaccttaacttactatttagatgagatctttctaaagaaaaaaaaaagagatgatatattttttgtaaacaatatttctatcacaggcatccataaactgaaatgactacagttgtgcaaacaggtgtcacagtgaagttgagcatttggagaaaaaaataaaaagcaaaatttgcaggaa

SEQ ID NO: 11806 - DNA, 5781 bp, Homo sapiens
tccgggccagcgcggcggcggcggcggcggcggcagcagcaggagcagccccggctgcgggtcgcgacggcggcggggcgccccctcccccgtgccggggcgcggcggagggatgtggggccttgcgggaggaaggcttttcggcatcttctcggccccggtgctggtggctgtggtgtgctgcgcccagagtgtgaacgatcccgggaacatgtcctttgtgaaggagacggtggacaagctgttgaaaggctacgacattcgcctaagacccgacttcgggggtcccccggtctgcgtggggatgaacatcgacatcgccagcatcgacatggtttccgaagtcaacatggattataccttaaccatgtattttcaacaatattggagagataaaaggctcgcctattctgggatccctctcaacctcacgcttgacaatcgagtggctgaccagctatgggtgcccgacacatatttcttaaatgacaaaaagtcatttgtgcatggagtgacagtgaaaaaccgcatgatccgtcttcaccctgatgggacagtgctgtatgggctcagaatcaccacgacagcagcatgcatgatggacctcaggagataccccctggacgagcagaactgcactctggaaattgaaagctatggctacaccacggatgacattgagttttactggcgaggcggggacaaggctgttaccggagtggaaaggattgagctcccgcagttctccatcgtggagcaccgtctggtctcgaggaatgttgtcttcgccacaggtgcctatcctcgactgtcactgagctttcggttgaagaggaacattggatacttcattcttcagacttatatgccctctatactgataacgattctgtcgtgggtgtccttctggatcaattatgatgcatctgctgctagagttgccctcgggatcacaactgtgctgacaatgacaaccatcaacacccaccttcgggagaccttgcccaaaatcccctatgtcaaagccattgacatgtaccttatgggctgcttcgtctttgtgttcctggcccttctggagtatgcctttgtcaactacattttctttggaagaggccctcaaaggcagaagaagcttgcagaaaagacagccaaggcaaagaatgaccgttcaaagagcgaaagcaaccgggtggatgctcatggaaatattctgttgacatcgctggaagttcacaatgaaatgaatgaggtctcaggcggcattggcgataccaggaattcagcaatatcctttgacaactcaggaatccagtacaggaaacagagcatgcctcgagaagggcatgggcgattcctgggggacagaagcctcccgcacaagaagacccatctacggaggaggtcttcacagctcaaaattaaaatacctgatctaaccgatgtgaatgccatagacagatggtccaggatcgtgtttccattcactttttctcttttcaacttagtttactggctgtactatgttaactgagtgactgtacttgatttttcaaagacttcatttaacactgagtgaaatattactctgcctgtcaagtttttatacctgtacacacacagacacacaagcagacacacacatatatacatacgcaattgtatatatatgtgaactttctcagcatatatataaaatacacgtgtatatgaggatgtatgtgtatatgtttatacacacaggagtcagtgcccatgtgtatggaagacaaatacacatacatatatacattttgcagctatggacaatttaccacaggatgcatattaaagaaagtcatagtttttttcttttttaattgaaagggacaagtatcatctaaatattatgccttgagaatgagggcgtgaaacacaatatcatccccaaatgtgtcttgtattatcataagttagatgttttagtttaaaaatcagaaagacattcttagttaatctttgaaaactcatacagtggtattgctagtttaaaatgagtcacttacttcatatcctctcgttcagtttagtaagcaaaggcttcttggcttctctggtgatggggtttgttttcatcgggcatacgttttctgcaatggtttagtggctggggtgagccactggcagtgtgcttacctgttgtctgaaacatagatagatcccacgttgatgtctgaacgaccgtcttttgaaaactcatcgggagtgaatggcatctcgttgtaagtactctaatatacagtgtgtagtttgtttctgttgttcacttggagtggatccagcttcactgtcatgtgcgaacacagtgacacgtttggccagtgacatttcaatcactgaaaatgtgctctacatctcgtatggatttctaggcctgatatccaacagaaagcatagacgtctcaggttattcgttactctaaggtaaaaccatctaggatgattttcccccttgcagttatgttatcattcttataacattgtatgttaatagaaaatatatttgcataatatgcatatatatgtatatttaccaagattttgtttcttacgcttgctatcatggcagcatgcgatgtcatattttcctttatgtgatgtaactactttctgttatctagaaattaagattgaagctaaaacacttctactgttcaatttcagaaactaagaatcatcctcatgcctttatttctgtatctgacatatttcataagcacatccaactactcctagactgactaggattctgcaggaacatgacccgtacacaccacgcgtcacccaacgacccatgaccgttctctgaggcaaaggagggcaacctgacagcaaacacagtcactgttggttccttctgatccacagcctcatcagtatttggactttttaaagctcgtagaaacaagacaaggtgcaccggtttcatagacgcaaccttaacttactatttagatgagatctttctaaagaaaaaaaaaagagatgatatattttttgtaaacaatatttctatcacaggcatccataaactgaaatgactacagttgtgcaaacaggtgtcacagtgaagttgagcatttggagaaaaaaataaaaagcaaaatttgcaggaagaactgctaaattaatactttatcccaaaatgccacgtatgcctcaccctctctgttctatccaaaaccaaggaccagagtgctccaatggtaggccccagttgtctcgatgtaggtagaggcaccaccctccccgaggatgcgtgtggtgtggactatccccatgagctgaccactacttgatttttctttggtggccgtaacaacctttaatttgtgggcatctgcaacagttcaaaacccaccatcagataaaacataatccacaaaatctcacgctagaggcaattacctacttttagacccttttccctctttcattcctatctttttcctcctaatcgctgctctctggttttattttcatctggagactagccagggatttctttggctttggcttttctctgaccattttttccatgggtaacaatgggggatcctaaaagttaaacagattgggaaaaaccttgttaagtggccttatcattattatcatgttaaagaaaaaaaatacatttgcaaagaccttatccctttcaatacttcaggtatctttttctgtatccagtaattaaaggtgtgaggtccacatgcagaagagggaccccaaaatgtaaatggatgtggacaaaaacagtcaatggtctatttaagtgtataatttatactattcagaactgtgacattaattctttctgggagaaaagtgatttaaaacttttttgatgcatagttgaggtacccaaatatcaaaggcagagaccccatggggctccaaagagctgcagtctccttcccaaggttttctggatataaatttgcatggtatagtcataatagcttttgagctttttatatgcatttggcaccaagactgggatccacaactttgtagacactgcgatgaagttaacatattagctatactataaatagtgtttgtaactacacacacacacacacacacacacacaaatacatacatatattctgtaaaaacaaaaaaaaactttttaagatccttgggtatgtgtttgctttactccatttcagaagaaaattacttttcttctaacaaaattattttatagcttctccatttttaaaacttgtgagagcattgagaagagaactctgactgtgttaacagaagagagttgaattggagtctctgttgtgttaaaatgacctctcgttactccacagtagttatttgagccagtgactgagtcgcgttgaggaattctgaacccggacctctgacgttgttgggaggtggctgttacccacacccagacctcttgagtaaggacagaaacgttatcattggggatataatgagatttctttcttaacaattgaaagtaataaagagttaattttctcagtagtcctgtctttccaaaatgcgccacaggggctcaagatctacagaagaatcttgttatgacagtttgttattacccatattcagatatccttgagataatggaagagccctgctacataactccctacagagaaagactgatagacttgagtagtccttaaaacaagtgttattcctgttcaccaaccccgggactgtggaggggtttcactgtctataccatgcgacatccatttcccctgaatctcaaacgaactagaaagtatgtcatgataatatttccattagatttggaagctacctgtacatctgcaatattgtgtttttaacgccagcacccagaactttgacatgttcagtcactccctgaaaggcacttctctcttgtccaaacacagcgttgacatttttactgaggagatcatctcaaaggtgatgccaaacgagtctggggctggttttaaggggacaggcacattgcagttgtaggtgttcattttcagcatctagtagataatccattggtgtttgtcccaccattggtgtattctaacaagaatgtgtccaactttgaatctcctggcttgaaagtataaaccatcacttaattcttattttaactctccacctgaaaaccagttcatatttctggccattttatgtaagcaaaactgaacaattggtgaaacattttgttactcttggaattgactctggctgtcagtgtgagccattagagtaacatcgaatcttggggcaaagaactgcccaggtgaattaaatttttccaggacactagctagtgtgccttggattgattacctcttctactgcattgaaaggcgccatgttttcctgaaatactaaattcccaacacctgggtaaacaatgaccttccagagagtggctcccgtatgcctctccctaggaccaaccccatgaacatgttttgtcacgtttgtctcatgtttctacttcacaagtcagtgagtgtgtttaaggtaagtacaggattattctagtaggaataggcgattgctgtcataatcaattctcatgttgatttcattttattgtaaagataaatttaaacccagttttgcttaagcacattgatgtaattttttggtattatttgacatgaaaaaacagcaaaattgagtgatagatacaatatgaaacttgttgatgaatgaattcaaatttattaaaaaaggagtaactgacctaaa

SEQ ID NO: 11807 - DNA, 1900 bp, Homo sapiens
agtcacaacttccggttagcgtggcggaggctctcggagtctttgggacctcagcaccgggataccgggagactccctcgtgtccccatgtgggccacctaccagacagaagaggattataccttaaccatgtattttcaacaatattggagagataaaaggctcgcctattctgggatccctctcaacctcacgcttgacaatcgagtggctgaccagctatgggtgcccgacacatatttcttaaatgacaaaaagtcatttgtgcatggagtgacagtgaaaaaccgcatgatccgtcttcaccctgatgggacagtgctgtatgggctcagaatcaccacgacagcagcatgcatgatggacctcaggagataccccctggacgagcagaactgcactctggaaattgaaagctatggctacaccacggatgacattgagttttactggcgaggcggggacaaggctgttaccggagtggaaaggattgagctcccgcagttctccatcgtggagcaccgtctggtctcgaggaatgttgtcttcgccacaggtgcctatcctcgactgtcactgagctttcggttgaagaggaacattggatacttcattcttcagacttatatgccctctatactgataacgattctgtcgtgggtgtccttctggatcaattatgatgcatctgctgctagagttgccctcgggatcacaactgtgctgacaatgacaaccatcaacacccaccttcgggagaccttgcccaaaatcccctatgtcaaagccattgacatgtaccttatgggctgcttcgtctttgtgttcctggcccttctggagtatgcctttgtcaactacattttctttggaagaggccctcaaaggcagaagaagcttgcagaaaagacagccaaggcaaagaatgaccgttcaaagagcgaaagcaaccgggtggatgctcatggaaatattctgttgacatcgctggaagttcacaatgaaatgaatgaggtctcaggcggcattggcgataccaggaattcagcaatatcctttgacaactcaggaatccagtacaggaaacagagcatgcctcgagaagggcatgggcgattcctgggggacagaagcctcccgcacaagaagacccatctacggaggaggtcttcacagctcaaaattaaaatacctgatctaaccgatgtgaatgccatagacagatggtccaggatcgtgtttccattcactttttctcttttcaacttagtttactggctgtactatgttaactgagtgactgtacttgatttttcaaagacttcatttaacactgagtgaaatattactctgcctgtcaagtttttatacctgtacacacacagacacacaagcagacacacacatatatacatacgcaattgtatatatatgtgaactttctcagcatatatataaaatacacgtgtatatgaggatgtatgtgtatatgtttatacacacaggagtcagtgcccatgtgtatggaagacaaatacacatacatatatacattttgcagctatggacaatttaccacaggatgcatattaaagaaagtcatagtttttttcttttttaattgaaagggacaagtatcatctaaatattatgccttgagaatgagggcgtgaaacacaatatcatccccaaatgtgtcttgtattatcataagttagatgttttagtttaaaaatcagaaagacattcttagttaatctttgaaaactcatacagtggtattgctagtttaaaatgagtcacttacttcatatcctctcgttcagtttagtaagcaaaggcttcttggcttctctggtgatggggtttgttttcatcgggcatacgttttctgcaatgg

SEQ ID NO: 11808 - DNA, 1494 bp, Homo sapiens
agagctgggctgttactggatatatgccatgtgagctggatggcctgtgaaagagaaaggcagttggtgataaaaataattggatgattcttaaagaaatagaagagacttgctgttggcagtgagaacccacaagaggcctctaaggagatgattataccttaaccatgtattttcaacaatattggagagataaaaggctcgcctattctgggatccctctcaacctcacgcttgacaatcgagtggctgaccagctatgggtgcccgacacatatttcttaaatgacaaaaagtcatttgtgcatggagtgacagtgaaaaaccgcatgatccgtcttcaccctgatgggacagtgctgtatgggctcagaatcaccacgacagcagcatgcatgatggacctcaggagataccccctggacgagcagaactgcactctggaaattgaaagctatggctacaccacggatgacattgagttttactggcgaggcggggacaaggctgttaccggagtggaaaggattgagctcccgcagttctccatcgtggagcaccgtctggtctcgaggaatgttgtcttcgccacaggtgcctatcctcgactgtcactgagctttcggttgaagaggaacattggatacttcattcttcagacttatatgccctctatactgataacgattctgtcgtgggtgtccttctggatcaattatgatgcatctgctgctagagttgccctcgggatcacaactgtgctgacaatgacaaccatcaacacccaccttcgggagaccttgcccaaaatcccctatgtcaaagccattgacatgtaccttatgggctgcttcgtctttgtgttcctggcccttctggagtatgcctttgtcaactacattttctttggaagaggccctcaaaggcagaagaagcttgcagaaaagacagccaaggcaaagaatgaccgttcaaagagcgaaagcaaccgggtggatgctcatggaaatattctgttgacatcgctggaagttcacaatgaaatgaatgaggtctcaggcggcattggcgataccaggaattcagcaatatcctttgacaactcaggaatccagtacaggaaacagagcatgcctcgagaagggcatgggcgattcctgggggacagaagcctcccgcacaagaagacccatctacggaggaggtcttcacagctcaaaattaaaatacctgatctaaccgatgtgaatgccatagacagatggtccaggatcgtgtttccattcactttttctcttttcaacttagtttactggctgtactatgttaactgagtgactgtacttgatttttcaaagacttcatttaacactgagtgaaatattactctgcctgtcaagtttttatacctgtacacacacagacacacaagcagacacacacatatatacatacgcaattgtatatatatgtgaactttctcagcatatatat

SEQ ID NO: 11809 - DNA, 515 bp, Homo sapiens
ggaaaactgcttacatggaaggcacttcaggggtaaggtccagggtgtgtgtctgtgcttggctctaggttgctccatttgggaggattataccttaaccatgtattttcaacaatattggagagataaaaggctcgcctattctgggatccctctcaacctcacgcttgacaatcgagtggctgaccagctatgggtgcccgacacatatttcttaaatgacaaaaagtcatttgtgcatggagtgacagtgaaaaaccgcatgatccgtcttcaccctgatgggacagtgctgtatgggctcagaatcaccacgacagcagcatgcatgatggacctcaggagataccccctggacgagcagaactgcactctggaaattgaaagctatggctacaccacggatgacattgagttttactggcgaggcggggacaaggctgttaccggagtggaaaggattgagctcccgcagttctccatcgtggagcaccgtctggtctcgaggaatgttg

SEQ ID NO: 11810 - DNA, 1913 bp, Homo sapiens
gctcagctcccgcccgcctgtgccgcctgtgcggccgccgggagccaagtttgcgcggaccccgtcccgagcccgccgcggccatggacgcgcccgcccggctgctggccccgctcctgctcctctgcgcgcagcagctccgcggcaccagagcgatgaatgacatcggcgactacgtgggctccaacctggagatctcctggctccccaacctggacgggctgatagccggctacgcccgcaacttccggcctggcatcggaggcccccccgtgaatgtggcccttgccctggaggtggccagcatcgaccacatctcagaggccaacatggagtacaccatgacggtgttcctgcaccagagctggcgggacagcaggctctcctacaaccacaccaacgagaccctgggtctggacagccgcttcgtggacaagctgtggctgcccgacaccttcatcgtgaacgccaagtcggcctggttccacgacgtgacggtggagaacaagctcatccggctgcagcccgacggcgtgatcctgtacagcatccgaatcacctccactgtggcctgcgacatggacctggccaaataccccatggacgagcaggagtgcatgctggacctggagagctacggttactcatcggaggacatcgtctactactggtcggagagccaggagcacatccacgggctggacaagctgcagctggcgcagttcaccatcaccagctaccgcttcaccacggagctgatgaacttcaagtccgctggccagttcccacggctcagcctgcacttccacctgcggaggaaccgcggcgtgtacatcatccaatcctacatgccctccgtcctgctggtcgccatgtcctgggtctccttctggatcagccaggcggcggtgcccgccagggtgtctctaggcatcaccacggtgctgacgatgaccacgctcatggtcagtgcccgctcctccctgccacgggcatcagccatcaaggcactggacgtctacttctggatctgctatgtcttcgtgtttgccgccctggtggagtacgcctttgctcatttcaacgccgactacaggaagaagcagaaggccaaggtcaaggtctccaggccgagggcagagatggacgtgaggaacgccattgtcctcttctccctctctgctgccggcgtcacgcaggagctggccatctcccgccggcagcgccgcgtcccggggaacctgatgggctcctacaggtcggtgggggtggagacaggggagacgaagaaggagggggcagcccgctcaggaggccaggggggcatccgtgcccggctcaggcccatcgacgcagacaccattgacatttacgcccgcgctgtgttccctgcggcgtttgcggccgtcaatgtcatctactgggcggcatacgccatgtgagcacaggactcaggccaccctcgcttgtcctggcgcccggcggcagctgcccagaaacttcctgggagaaagagccctcgggctgccttcccctctgcgtgtttcgaagtgggatgacagtcggccacggaaaacaagaggaagcctcggcctccctgagctctgaccccagcctcacccgaaaggccagcctggggctctccggcaggcagcccgagacctgcacagatgaaggagcagaggttctgaccgagaggctgagccaggccggggtctgggcccttcagggagccgcggatttttatgttcagaaagtgatcctggtttctaggtctttgctctgcaggatcgggatcagagcgtgggaggaggtgggggtggacgtccatccggtgaacagtgaaggcgtttgtgaggtctttctggtcccagcatgaaataaagccttggcctgggggccgcttcattctc

SEQ ID NO: 11811 - DNA, 3152 bp, Homo sapiens
gccagagcgtgagccgcgacctccgcgcaggtggtcgcgccggtctccgcggaaatgttgtccaaagttcttccagtcctcctaggcatcttattgatcctccagtcgagggtcgagggacctcagactgaatcaaagaatgaagcctcttcccgtgatgttgtctatggcccccagccccagcctctggaaaatcagctcctctctgaggaaacaaagtcaactgagactgagactgggagcagagttggcaaactgccagaagcctctcgcatcctgaacactatcctgagtaattatgaccacaaactgcgccctggcattggagagaagcccactgtggtcactgttgagatctccgtcaacagccttggtcctctctctatcctagacatggaatacaccattgacatcatcttctcccagacctggtacgacgaacgcctctgttacaacgacacctttgagtctcttgttctgaatggcaatgtggtgagccagctatggatcccggacaccttttttaggaattctaagaggacccacgagcatgagatcaccatgcccaaccagatggtccgcatctacaaggatggcaaggtgttgtacacaattaggatgaccattgatgccggatgctcactccacatgctcagatttccaatggattctcactcttgccctctatctttctctagcttttcctatcctgagaatgagatgatctacaagtgggaaaatttcaagcttgaaatcaatgagaagaactcctggaagctcttccagtttgattttacaggagtgagcaacaaaactgaaataatcacaaccccagttggtgacttcatggtcatgacgattttcttcaatgtgagcaggcggtttggctatgttgcctttcaaaactatgtcccttcttccgtgaccacgatgctctcctgggtttccttttggatcaagacagagtctgctccagcccggacctctctagggatcacctctgttctgaccatgaccacgttgggcaccttttctcgtaagaatttcccgcgtgtctcctatatcacagccttggatttctatatcgccatctgcttcgtcttctgcttctgcgctctgttggagtttgctgtgctcaacttcctgatctacaaccagacaaaagcccatgcttctcctaaactccgccatcctcgtatcaatagccgtgcccatgcccgtacccgtgcacgttcccgagcctgtgcccgccaacatcaggaagcttttgtgtgccagattgtcaccactgagggaagtgatggagaggagcgcccgtcttgctcagcccagcagccccctagcccaggtagccctgagggtccccgcagcctctgctccaagctggcctgctgtgagtggtgcaagcgttttaagaagtacttctgcatggtccccgattgtgagggcagtacctggcagcagggccgcctctgcatccatgtctaccgcctggataactactcgagagttgttttcccagtgactttcttcttcttcaatgtgctctactggcttgtttgccttaacttgtaggtaccagctggtaccctgtggggcaacctctccagttccccaggaggtccaagccccttgccaagggagttgggggaaagcagcagcagcagcaggagcgactagagtttttcctgccccattccccaaacagaagcttgcagagggtttgtctttgctgcccctctcccctacctggcccattcactgagtcttctcagcagaccatttcaaattattaataaatgggccacctccctcttcttcaaggagcatccgtgatgctcagtgttcaaaaccacagccacttagtgatcagctccctaaaaccatgcctaagtacaggcggattagctatcttccaacaatgctgaccaccagacaattactgcatttttccagaagcccactattgcctttgtagtgctttcggcccagttctggcctcagcctcaaagtgcaccgactagttgcttgcctatacctggcacctcattaagatgctgggcagcagtataacaggaggaagagatccctctcctttggtcagattattatgttctcagttctctctccctgctacccctttctctgcagatagatagacactggcattatccctttaggaagaggggggggcagcaagagagcctatttgggacagcattcctctctctctgctgctgtgacatctccctctccttgctggctccatctttcgtctgcactaccaattcaatgcccttcatccaatgggtatctatttttgtgtgtgattatagtaactactccctgctttatatgccaccctcttccttctctttgacccctgtgactctttctgtaactttcccagtgacttcccctagccctgacccaggcactaggccttggtgacttcctggggccaagaaactaaggaaactcggctttgcaacaggcattactcgccattgattggtgcccacccagggcacactgtcggagttctatcacttgcttgacccctggacccataaaccagtccactgttatacccggggcactctaaccatcacaatcaatcaatcaaattcccttaaatttgtatggcactggaactttggcaaagcacttttgacaagttgtgtctgattggagcttcatgatagccttgtgacatctttagggcaggattcttatccccattttgcagatgaaaaccctgagtcacagatttctgtgggactgtggatctcactggaagctatccaagagcccactgtcaccttctagaccacatgatagggctagacagctcagttcaccatgattctcttctgtcacctctgctggcacaccagtggcaaggcccagaatggcgacctctctttagctcaatttctgggcctgaggtgctcagactgcccccaagatcaaatctctcctggctgtagtaacccagtggaatgaatttggacatgccccaatgcttctatatgctaagtgaaatctgtgtctgtaatttgttggggggtggatagggtggggtctccatctactttttgtcaccatcatctgaaatggggaaatatgtaaataaatatatcagcaaagca

SEQ ID NO: 11812 - DNA, 1315 bp, Homo sapiens
gtgagccgcgacctccgcgcaggtggtcgcgccggtctccgcggaaatgttgtccaaagttcttccagtcctcctaggcatcttattgatcctccagtcgagaacatgtatacagagaagtgctcaaatcataagtgtacagctgatgagttgtcagaatatgaccacagcggtgtaaagaaagccaaatcaaggacccgaatgtgagcaggacctcagaagccccctttgtcactgcctcccagcaaaggcagcactatccggacttctaacaccatcgggtcgagggacctcagactgaatcaaagaatgaagcctcttcccgtgatgttgtctatggcccccagccccagcctctggaaaatcagctcctctctgaggaaacaaagtcaactgagactgagactgggagcagagttggcaaactgccagaagcctctcgcatcctgaacactatcctgagtaattatgaccacaaactgcgccctggcattggagagaagcccactgtggtcactgttgagatctccgtcaacagccttggtcctctctctatcctagacatggaatacaccattgacatcatcttctcccagacctggtacgacgaacgcctctgttacaacgacacctttgagtctcttgttctgaatggcaatgtggtgagccagctatggatcccggacaccttttttaggaattctaagaggacccacgagcatgagatcaccatgcccaaccagatggtccgcatctacaaggatggcaaggtgttgtacacaattagtttcctatcctgagaatgagatgatctacaagtgggaaaatttcaagcttgaaatcaatgagaagaactcctggaagctcttccagtttgattttacaggagtgagcaacaaaactgaaataatcacaaccccagttggtgacctgaatgaggagccaagggacctccccagggtagctcccagagcaaccctggaaacactcttcacacatcctgaccaagttcagggcagtgaaggcactgccctcatcgtttccagaatgtggatggagccagtcacccaaccagccatttgtcgtgagaggcatcttgttctgctaccattcaagatcccacggcaagaggacttttgataaatacattctggccagtaggcaagtgcgagggtggtccgtgcagcagctctggaggagttctatcccaaagctatactcaacacacaggtttcccactgacaacaggtcgctcccttgccttcttccagaagaatctgagaagctttgctccttgagtttcagtgctgccaag

SEQ ID NO: 11813 - DNA, 6785 bp, Homo sapiens
attggctccctggctcaattctgctgggagtcgcatcctacctgtttgggaggtgcactgcctttccacactctcccttctgtactcagccagctgctgctgaggtgggaggaaaagtcctggctgggagaattgagctagtgcagcacacgtaaaaaagcgattccgatgggtcctttgaaagcttttctcttctccccttttcttctgcggagtcaaagtagaggggtgaggttggtcttcttgttactgaccctgcatttgggaaactgtgttgataaggcagatgatgaagatgatgaggatttaacggtgaacaaaacctgggtcttggccccaaaaattcatgaaggagatatcacacaaattctgaattcattgcttcaaggctatgacaataaacttcgtccagatataggagtgaggcccacagtaattgaaactgatgtttatgtaaacagcattggaccagttgatccaattaatatggaatatacaatagatataatttttgcccaaacctggtttgacagtcgtttaaaattcaatagtaccatgaaagtgcttatgcttaacagtaatatggttggaaaaatttggattcctgacactttcttcagaaactcaagaaaatctgatgctcactggataacaactcctaatcgtctgcttcgaatttggaatgatggacgagttctgtatactctaagattgacaattaatgcagaatgttatcttcagcttcataactttcccatggatgaacattcctgtccactggaattttcaagctatggataccctaaaaatgaaattgagtataagtggaaaaagccctccgtagaagtggctgatcctaaatactggagattatatcagtttgcatttgtagggttacggaactcaactgaaatcactcacacgatctctggggattatgttatcatgacaattttttttgacctgagcagaagaatgggatatttcactattcagacctacattccatgcattctgacagttgttctttcttgggtgtctttttggatcaataaagatgcagtgcctgcaagaacatcgttgggtatcactacagttctgactatgacaaccctgagtacaattgccaggaagtctttacctaaggtttcttatgtgactgcgatggatctctttgtttctgtttgtttcatttttgtttttgcagccttgatggaatatggaaccttgcattattttaccagcaaccaaaaaggaaagactgctactaaagacagaaagctaaaaaataaagcctcgatgactcctggtctccatcctggatccactctgattccaatgaataatatttctgtgccgcaagaagatgattatgggtatcagtgtttggagggcaaagattgtgccagcttcttctgttgctttgaagactgcagaacaggatcttggagggaaggaaggatacacatacgcattgccaaaattgactcttattctagaatatttttcccaaccgcttttgccctgttcaacttggtttattgggttggctatctttacttataaaatctacttcataagcaaaaatcaaaagaagtctgactaaattcagtagaatcttttgtgcttcagtaacttgaagtttaaatttaaaatgcagagagaccaatggttaaaatgtgaatagtattgtaactattttaaggccttcagaagtaaataaagtagcagctttcaggctaatttacgtgaaactgattagttgcaaaatccagtaggttaaaatactcacatatttttacttaaattttctttaatttacttatatgttattataattttgaatttttaagttctatgattcatgttttaaagatggaataattttaatacatattttgtttaaatataatctataattgttttgtaatgtaagactaattactaatatttatgtagcaacttttgtgccagaaaaaagactgttaatttgttttttcttgcttttcatttgattaccctgcttgaaatacagttagttgataacataaagccatagttttcttggattttcttccaagatattgtattcccaagaagaaattgatttatttttaaactatcagttactgaagacttatgaaaaggtcaatttttacctgtcttttaatccagtccattttctgacacaatattaaacagaacgccagttgcatttactttggtgatttgcaaacttggaatgaagccaccagtcattttttaagaatgcaagatgaaaaaatcaggtaaaatctaaccattttattctctgcttcatagcatttataatgtatgatgaggttaacactgaaatattaaaatctgcaaatgcacattaatgcaaattaaatgcagagagaaatgattatttttttctttatgttttatgaaagtgttgcagtccctaaaataaaaatattgaggaacattgcttgtatttactcacgtggttaaaaaattattacctggcaaactgagttgccggtcatattgaggacaaaatcttaaatatgtgctattagcattgtttttagactagtaatatgcagaaaacagttttaggcctgcgttacatattgcctcttccagctccaaagttttggaccctgtcagttttgcaactacattatacattattataatattcttttttttttctagaaactgggggcagcctcaaaatcatgttaaagagggagttttgttagaggcatctttaatgaacatgaatgtgagtgctctctaaattcttagcatctcactggatgtaaaatctatcagttaatagttttaaaaatgtctcttttgttaagaataaatttaggcttcaatcattataatcctgtaagtagcttgacataccaattgtttataagattcatcacataaatttctggagaaccaccaggtttagcttggaaataacctttaaagattgtttctgttgccaagaccaatgaccatgatgaagagttttatgatcacagcctatcttacttaaggtttgagaggaaacctgtcacctctgcaattgttactctagtttttaatgttataattccgctgcgtggttagtgaatgtctggcatgattatacacgtgtattggaaatatctagttttttaaatttttaattaatttatttataatttactgtgtgttcccagctaactctattttttttttcacttgctcataaacttctggaaaaaaataagcatgaatcaaatggtaatgcccaatatccaccgacactgcttttcttgaatgaacagccaaactaaactttggccatctatatattcatttacagattattcatacattcattttaataacattgagtactgatggatgttttgaaagtgagcattcatttaaggataaataaaaaataaagtagtaataaagaataaaatactttactaaaatattgtatggctattttcatgtttgaagctatagcttactatcatgagacagttttgattttgggactctttcaagtgtatctgagcatgactgtattttaaaatacttaaaagtgcttgatataaatagcttttccttctgaaccacgttctatgtaaaagaaaaaaaatagctttgattttctcactggtgtttcattaacttggttttaaatgttgacaatatttacaagtggaaataaaatttgtaaatatatgaaagatgcctttccttgtatataccatcaagcaagcactttgttttcaaagcaagtggtattttgatcagttttatttaaatgtgtgatcagaaagaatggcgtacaaatcttattatttctaaaaataagaataaaaaggtaaaactacatttagacttctttctcaagaaatcaaatacagctttttttcaaagctgattcagttcatttcctgttcctctattccaagtataagtttcaccaccttgagaaataatttttttaaaaaatcttcctctttctctggggagttatataataatttattgaatttattggaacttgattttcctggatgctttcaatgtttttaatgctaacatagaccccaaaattagatataaagaattgggaaggatacctggagcacaaggaataagatcatttgtaaaaatgtttgtttatatagacctatcctctaaatatgtgacaaggatctagaaattctgagaggggaaaatgtgattttggatttacaatgacagggtaatattttatttatcttcgaattccatggacaaaattaggctcacttaaattaatttttgtaaacccaagtaagttctaaaaaaaagtaaaaaatacatagaatacttgagaatttagcagggacagggaaaaatttcccagtaagtctgaagtcttgatgtaagtgggaattagataactaattggaggcattttattttaagttaaagacagatttctttaataagtttttaaaattgatcaactttaaattaagcacagtaaatgtgtataaatatgaaggcaatcataaggattttttcacttgtgtttccatattctggcattagtatatcatcataaaatagacaatgtttttgtctcaagaacaagaataaaattgaaatctgcattcatgccaattcagcataaaaaagaataggctacagttctctcacaccaagggccccatagttataaatgtgaaattatattccaggtcaaaatttgtgaaaaatacacaaaacactttgattttacaagagaggagctttaaataagatgattttagtagattgaaataaataaccagtatttaagtaaatgtataacgaatgaataaatacatgcataatattttcaaagttctataccagtacctatttttactcttacaaaatttcctgtaaaaaaatactacatttgaaattatttcattggttttagaactggcattgaaggtacccagtagactcttaagcctttactgcttgtctcactagaaacatttatttctgacctaccaagttttcttcacatcatcaaatttattcagcttctcagtgctgtaccgtatgatggcaagacatacttggtatttccatttttgttggtcattctttattgctttttactgctaggaaggtcttgccaggcttctatacagttacaaaaaccattaccaaactttatcaaggactttccaaatggagttttcaaatactattgaccacattgctctagttaatgtaaggtcagctctgactttttgtgtttgcatttcggaagtgaggtaacctcattcaaatatatatgcagcactttctgtgtacaaagtactgttctaaatacaaaagggaatataaagatgactttcaaggaacatataatgtagtcagaaagatgagaggattagttatacaatttaaggaagggaggataactttgggaaggttttgtggaggatatgtgtttagagatgcgagctggggattcaacaggtaagagggagagagatcacaatttccaactgggtaaacagcttgaaaaaagaaacagaagcctgggcacaaatgaaaattccatattaattggaagttaagattcatatagagacaatgaaaggttaggttagaacaataaactgagaagtacgaatgtggacttcaggaggctaggggaaattacgaagtcataaaaagttcacagagatacttgagtacaaaagatacattattaaaatttctgcagaagtttcatcttatttgtgtgtgatggtttggaatataacaagccagttaggcgtataagcttatagtggctaatatgaggatgaaatccgtactcttgtgacacaagtcttcagcggagatgggggatgataggcccaaatagaaagaaaagtggcagacattaagctttgactaacagacaacataactgagagacatggtgtgttgggtggaagggatcctgtagtagatacttgcttgcatgtagatgggtacaaagacaccataaggaaattctgaatgtaatacaaaggcttatttttcctgttgatttatctttttcacacataaaagatgaagaaaaaaataatctgaaatgtaaatcctaaagtgatctgtctagattcttattttttgaaaaatgttcctcactaaaagagttttctattcaaataaccatttccagttttctaactgagacatacatacatatatatatgtataaaattatatatatatttggacaaagagaataagagaattgcaggtagaaatagtctactgtgtgtagacaaatccagaaagttgatttctgttcctcaaacaatttctgaaatatttatgtcagaataaataaaagaattgttattgttggacaatgaaacatacctggaccctttgagtgtgtgaatagtaaaggctgtgataactgaaatgcagctaagcaaaaagggctaattagaagacttttgagacatgatttacctaaatggaaatagtttggttttcaatccttcactgtaataacaattatttgcatctattaagtgtttgtagtcactttgtataataaagttttatggcttgtgattataatggcttctgttattctgctactgcctcattgttttgaggaacatttgtaattttgtggcaaaggtgtctcaatttttcagtgttctttactctcatgatccttagaacaaaaaaaataccagtaacttgttataaataaagagtcacattctcttaaa

SEQ ID NO: 11814 - DNA, 1885 bp, Homo sapiens
aattctgctgggagtcgcatcctacctgtttgggaggtgcactgcctttccacactctcccttctgtactcagccagctgctgctgaggtgggaggaaaagtcctggctgggagaattgagctagtgcagcacacgtaaaaaagcgattccgatgggtcctttgaaagcttttctcttctccccttttcttctgcggagtcaaagtagaggggtgaggttggtcttcttgttactgaccctgcatttgggaaactgtgttgataaggcagatgatgaagatgatgaggatttaacggtgaacaaaacctgggtcttggccccaaaaattcatgaaggagatatcacacaaattctgaattcattgcttcaaggctatgacaataaacttcgtccagatataggagtgaggcccacagtaattgaaactgatgtttatgtaaacagcattggaccagttgatccaattaatatggaatatacaatagatataatttttgcccaaacctggtttgacagtcgtttaaaattcaatagtaccatgaaagtgcttatgcttaacagtaatatggttggaaaaatttggattcctgacactttcttcagaaactcaagaaaatctgatgctcactggataacaactcctaatcgtctgcttcgaatttggaatgatggacgagttctgtatactctaagattgacaattaatgcagaatgttatcttcagcttcataactttcccatggatgaacattcctgtccactggaattttcaagctatggataccctaaaaatgaaattgagtataagtggaaaaagccctccgtagaagtggctgatcctaaatactggagattatatcagtttgcatttgtagggttacggaactcaactgaaatcactcacacgatctctggggattatgttatcatgacaattttttttgacctgagcagaagaatgggatatttcactattcagacctacattccatgcattctgacagttgttctttcttgggtgtctttttggatcaataaagatgcagtgcctgcaagaacatcgttgggtatcactacagttctgactatgacaaccctgagtacaattgccaggaagtctttacctaaggtttcttatgtgactgcgatggatctctttgtttctgtttgtttcatttttgtttttgcagccttgatggaatatggaaccttgcattattttaccagcaaccaaaaaggaaagactgctactaaagacagaaagctaaaaaataaagcctcgatgactcctggtctccatcctggatccactctgattccaatgaataatatttctgtgccgcaagaagatgattatgggtatcagtgtttggagggaaggaaggatacacatacgcattgccaaaattgactcttattctagaatatttttcccaaccgcttttgccctgttcaacttggtttattgggttggctatctttacttataaaatctacttcataagcaaaaatcaaaagaagtctgactaaattcagtagaatcttttgtgcttcagtaacttgaagtttaaatttaaaatgcagagagaccaatggttaaaatgtgaatagtattgtaactattttaaggccttcagaagtaaataaagtagcagctttcaggctaatttacgtgaaactgattagttgcaaaatccagtaggttaaaatactcacatatttttacttaaattttctttaatttacttatatgttattataattttgaatttttaagttctatgattcatgttttaaagatggaataattttaatacatattttgtttaaatataatctataattgttttgtaatgtaagactaattactaatatttatgtagc

SEQ ID NO: 11815 - DNA, 4056 bp, Homo sapiens
attttaaatacacacacccacagggctctgccccctgtaaaagaaaaaaaatcaaaacaaacaaataaataaccccaaagagatggacccaggggagaacgcgtaagtgtgaggggcatgagtatacacgagtgtgcgtgtctttccctctcccttatttgtctccgtatgagtctctccttgtaccctccccctgcctcgatgatattactcccccagacttggaagccgctgccagagtgacgctttgatggtatctgcaagcgtttttgctgatcttatctctgccccctgaatattaattccctaatctggtagcaatccatctccccagtgaaggacctactagaggcaggtggggggagccaccatcagatcataagcataagaataatacaaaggggagggattcttctgcaaccaagaggcaagaggcgagagaaggaaaaaaaaaaaagcgatgagttcgccaaatatatggagcacaggaagctcagtctactcgactcctgtattttcacagaaaatgacggtgtggattctgctcctgctgtcgctctaccctggcttcactagccagaaatctgatgatgactatgaagattatgcttctaacaaaacatgggtcttgactccaaaagttcctgagggtgatgtcactgtcatcttaaacaacctgctggaaggatatgacaataaacttcggcctgatataggagtgaagccaacgttaattcacacagacatgtatgtgaatagcattggtccagtgaacgctatcaatatggaatacactattgatatattttttgcgcaaacgtggtatgacagacgtttgaaatttaacagcaccattaaagtcctccgattgaacagcaacatggtggggaaaatctggattccagacactttcttcagaaattccaaaaaagctgatgcacactggatcaccacccccaacaggatgctgagaatttggaatgatggtcgagtgctctacaccctaaggttgacaattgatgctgagtgccaattacaattgcacaactttccaatggatgaacactcctgccccttggagttctccagttatggctatccacgtgaagaaattgtttatcaatggaagcgaagttctgttgaagtgggcgacacaagatcctggaggctttatcaattctcatttgttggtctaagaaataccaccgaagtagtgaagacaacttccggagattatgtggtcatgtctgtctactttgatctgagcagaagaatgggatactttaccatccagacctatatcccctgcacactcattgtcgtcctatcctgggtgtctttctggatcaataaggatgctgttccagccagaacatctttaggtatcaccactgtcctgacaatgaccaccctcagcaccattgcccggaaatcgctccccaaggtctcctatgtcacagcgatggatctctttgtatctgtttgtttcatctttgtcttctctgctctggtggagtatggcaccttgcattattttgtcagcaaccggaaaccaagcaaggacaaagataaaaagaagaaaaaccctcttcttcggatgttttccttcaaggcccctaccattgatatccgcccaagatcagcaaccattcaaatgaataatgctacacaccttcaagagagagatgaagagtacggctatgagtgtctggacggcaaggactgtgccagttttttctgctgttttgaagattgtcgaacaggagcttggagacatgggaggatacatatccgcattgccaaaatggactcctatgctcggatcttcttccccactgccttctgcctgtttaatctggtctattgggtctcctacctctacctgtgaggaggtatgggttttactgatatggttcttattcactgagtctcatggagagatgtctgttctaagtccacttaaataatcctctatgtggttgataatgatctgaatctgtttctatgtccaaacctggtaaattttataatgtcatattgtttgtgcccagccctcctttggttagtgtactttgaacttcgatgtttgctgtgtttcaaacctgcaaggcaaagtaaaattagagcaagaacattcaaaccaaataagatatttttcagctacagcaaataaaacagtgaaagccctgactatttacagtagtggtatccttactagattcataatgcaattagatagaaaaggtccaaaactgtaccctatgttcactccgggtcaagttgtgataaatttgatcccaatagaatacctccctcatttaagaaaaatcataactcactttaaatatgaaagcctagtccagaaatctattacacctttatctcaagataggaagaaaatttcctccacattcatgtacaatgatgtaaatatttcaataacttagaatgcttcaagtttagtgcatgcatctctttagatccaaaataaatggactgaagttatcatcctattgtcttttattttgtgtccttgggctataaaagattcctgaatgtaattataaggatttgggtttggaaatggagggaggaattttcattgccttctccctcatgcatgaagattcgaacagcttattttttccttgtatgacatattacaacactttaagtaaaatatagactggataatcaacatttgccacctctaaatatgcccaatttcataactagagtataaagtaattgtatgtgcttgccgctatttttttcttccttttaggatgatagatcataacagaacttattctccatctcaagatctgcttctagtgattgtgagtgccttgtgggcagaatccttgtcatttcctctttgggtctgtagcaccttgcatagtgcctggcatatagttggtgctcaataaatatggtttgaagtgaattgccctcacatgcttctggcaaatctctgtgctggcctgaaaccagtgactcatcttctcacataggtgttgtcaagtgatatttgattttgtaaaaataaccagtaggatccaaagaactttagctatttatgttcatcttcaaaaaattattttaggcaaagtccatactccttttaaaacaatatttatgtcctatgtttgtgtatagacatgactctactagggcataattagagtttgtgtattatttttccaggtttggggatgagtcagtccttgcccatccacaattttgtttgtgaacttataacaggaataagcaaaattcatacctgactagtgttcagaatgtagcattctgtgcgaaaaagtattgaagattagcttttaaaaactgaaaaaaaaaaatgaatgactcacatagaggttgagccaatgactgtggcctcattagattacattgtagttaaacaaagcaatttctccagacttaaaacatgatgagttgagctctatcttcatgtactcatcctgaatccttatttttctaaaatagcaccctttgttaattatttttatggaaattattactctgtcataattaaatcatagctagtataactttacagataacctaaaaagaatagaaaagaagagagagtggctttgtcagtataaaaccatgtaaagtcatcatcaagtcatctggatgaatcttgaaacacatttagctgccagttttacaaacctttaatatatcagtgctccagtatataacctcaaacaaatgtaaatagaacgaattattttcttgttttgaattgtcaatatattaaatgttgactctttgggagagttgttggcaagtttcaatggtgagaaacattattgtcaacttgaaatgtgttctgtaatggggacactacaaaaagctagctttccaatgtgtgcatagtattggcaatatgaatatatattatatataatctaatacttattataagctgctccctgtctatgtatttggaaaccttttcacaaagggaattgcctaacatgtggacttttacaataaaaatgctgcattctaatccatggtggcatc

SEQ ID NO: 11816 - DNA, 1739 bp, Homo sapiens
tgacgctttgatggtatctgcaagcgtttttgctgatcttatctctgccccctgaatattaattccctaatctggtagcaatccatctccccagtgaaggacctactagaggcaggtggggggagccaccatcagatcataagcataagaataatacaaaggggagggattcttctgcaaccaagaggcaagaggcgagagaaggaaaaaaaaaaaagcgatgagttcgccaaatatatggagcacaggaagctcagtctactcgactcctgtattttcacagaaaatgacggtgtggattctgctcctgctgtcgctctaccctggcttcactagccagaaatctgatgatgactatgaagattatgcttctaacaaaacatgggtcttgactccaaaagttcctgagggtgatgtcactgtcatcttaaacaacctgctggaaggatatgacaataaacttcggcctgatataggagtgaagccaacgttaattcacacagacatgtatgtgaatagcattggtccagtgaacgctatcaatatggaatacactattgatatattttttgcgcaaacgtggtatgacagacgtttgaaatttaacagcaccattaaagtcctccgattgaacagcaacatggtggggaaaatctggattccagacactttcttcagaaattccaaaaaagctgatgcacactggatcaccacccccaacaggatgctgagaatttggaatgatggtcgagtgctctacaccctaaggttgacaattgatgctgagtgccaattacaattgcacaactttccaatggatgaacactcctgccccttggagttctccagttatggctatccacgtgaagaaattgtttatcaatggaagcgaagttctgttgaagtgggcgacacaagatcctggaggctttatcaattctcatttgttggtctaagaaataccaccgaagtagtgaagacaacttccggagattatgtggtcatgtctgtctactttgatctgagcagaagaatgggatactttaccatccagacctatatcccctgcacactcattgtcgtcctatcctgggtgtctttctggatcaataaggatgctgttccagccagaacatctttaggtatcaccactgtcctgacaatgaccaccctcagcaccattgcccggaaatcgctccccaaggtctcctatgtcacagcgatggatctctttgtatctgtttgtttcatctttgtcttctctgctctggtggagtatggcaccttgcattattttgtcagcaaccggaaaccaagcaaggacaaagataaaaagaagaaaaaccctgcccctaccattgatatccgcccaagatcagcaaccattcaaatgaataatgctacacaccttcaagagagagatgaagagtacggctatgagtgtctggacggcaaggactgtgccagttttttctgctgttttgaagattgtcgaacaggagcttggagacatgggaggatacatatccgcattgccaaaatggactcctatgctcggatcttcttccccactgccttctgcctgtttaatctggtctattgggtctcctacctctacctgtgaggaggtatgggttttactgatatggttcttattcactgagtctcatggagagatgtctgttctaagtccacttaaataatcctctatgtggttgataatgatctgaatctgtttc

SEQ ID NO: 11817 - DNA, 1923 bp, Homo sapiens
ctactcgactcctgtattttcacagaaaatgacggtgtggattctgctcctgctgtcgctctaccctggaagaaaactttcttcttacccacataaattgagatttgaaaatgaatgaagaaaaacattgatagaaataacctcaatatcaagttggagatcctgacagagctaagtcatgttctacattcttcactagccagaaatctgatgatgactatgaagattatgcttctaacaaaacatgggtcttgactccaaaagttcctgagggtgatgtcactgtcatcttaaacaacctgctggaaggatatgacaataaacttcggcctgatataggagtgaagccaacgttaattcacacagacatgtatgtgaatagcattggtccagtgaacgctatcaatatggaatacactattgatatattttttgcgcaaacgtggtatgacagacgtttgaaatttaacagcaccattaaagtcctccgattgaacagcaacatggtggggaaaatctggattccagacactttcttcagaaattccaaaaaagctgatgcacactggatcaccacccccaacaggatgctgagaatttggaatgatggtcgagtgctctacaccctaaggttgacaattgatgctgagtgccaattacaattgcacaactttccaatggatgaacactcctgccccttggagttctccagttatggctatccacgtgaagaaattgtttatcaatggaagcgaagttctgttgaagtgggcgacacaagatcctggaggctttatcaattctcatttgttggtctaagaaataccaccgaagtagtgaagacaacttccggagattatgtggtcatgtctgtctactttgatctgagcagaagaatgggatactttaccatccagacctatatcccctgcacactcattgtcgtcctatcctgggtgtctttctggatcaataaggatgctgttccagccagaacatctttaggtatcaccactgtcctgacaatgaccaccctcagcaccattgcccggaaatcgctccccaaggtctcctatgtcacagcgatggatctctttgtatctgtttgtttcatctttgtcttctctgctctggtggagtatggcaccttgcattattttgtcagcaaccggaaaccaagcaaggacaaagataaaaagaagaaaaaccctgcccctaccattgatatccgcccaagatcagcaaccattcaaatgaataatgctacacaccttcaagagagagatgaagagtacggctatgagtgtctggacggcaaggactgtgccagttttttctgctgttttgaagattgtcgaacaggagcttggagacatgggaggatacatatccgcattgccaaaatggactcctatgctcggatcttcttccccactgccttctgcctgtttaatctggtctattgggtctcctacctctacctgtgaggaggtatgggttttactgatatggttcttattcactgagtctcatggagagatgtctgttctaagtccacttaaataatcctctatgtggttgataatgatctgaatctgtttctatgtccaaacctggtaaattttataatgtcatattgtttgtgcccagccctcctttggttagtgtactttgaacttcgatgtttgctgtgtttcaaacctgcaaggcaaagtaaaattagagcaagaacattcaaaccaaataagatatttttcagctacagcaaataaaacagtgaaagccctgactatttacagtagtggtatccttactagattcataatgcaattagatagaaaaggtccaaaactgtaccctatgttcactccgggtcaagttgtgataaatttgatcccaatagaatacctccctcatttaaga

SEQ ID NO: 11818 - DNA, 2004 bp, Homo sapiens
gccgcccggttgcgcggaccggcgctagtgcgcgggtgggggcggcgcgccgcggtggcccggcgtcccgtgtgcgtccagtgtgcgccccgcgggggcgcggccagcgccagagtagatacctgtcccgcccgccgcggccagcagcctcggaggaagccagggcaaagagggccggcggagaccaggtccgcgccggaggaagccgcgcccggccgaggccccggaccctgcgccccgagctccacggcaccatggccccgaagctgctgctcctcctctgcctgttctcgggcttgcacgcgcggtccagaaaggtggaagaggatgaatatgaagattcatcatcaaaccaaaagtgggtcttggctccaaaatcccaagacaccgacgtgactcttattctcaacaagttgctaagagaatatgataaaaagctgaggccagatattggaataaaaccgaccgtaattgacgttgacatttatgttaacagcattggtcctgtgtcatcaataaacatggaataccaaattgacatattttttgctcagacctggacagatagtcgccttcgattcaacagcacaatgaaaattcttactctgaacagcaacatggtggggttaatctggatcccagacaccatcttccgcaattctaaaaccgcagaggctcactggatcaccacacccaatcagctcctccggatttggaatgacgggaaaatcctttacactttgaggctcaccatcaatgctgagtgccagctgcagctgcacaacttccccatggacgaacactcctgcccgctgattttctccagctatggctatcccaaagaagaaatgatttatagatggagaaaaaattcagtggaggcagctgaccagaaatcatggcggctttatcagtttgacttcatgggcctcagaaacaccacagaaatcgtgacaacgtctgcaggtgattatgttgtcatgactatatattttgaattgagtagaagaatgggatacttcaccattcagacatacattccctgtatactgactgtggttttatcctgggtgtcattttggatcaaaaaagatgctacgccagcaagaacagcattaggcatcaccacggtgctgaccatgaccaccctgagcaccatcgccaggaagtccttgccacgcgtgtcctacgtgaccgccatggacctttttgtgaccgtgtgcttcctgtttgtcttcgccgcgctgatggagtatgccaccctcaactactattccagctgtagaaaaccaaccaccacgaagaagacaacatcgttactacatccagattcctcaagatggattcctgagcgaataagcctacaagccccttccaactattccctcctggacatgaggccaccaccaactgcgatgatcactttaaacaattccgtttactggcaggaatttgaagatacctgtgtctatgagtgtctggatggcaaagactgtcagagcttcttctgctgctatgaagaatgtaaatcaggatcctggaggaaagggcgtattcacatagacatcttggagctggactcgtactcccgggtctttttccccacgtccttcctgctctttaacctggtctactgggttggatacctgtatctctaagtgttgctcagagtgaagagtgaagagcatttggtacacacttgaccttctgtcgtccccagaccagtagtgaccaatcgggagtagcaaggaaggacactgcccagtgtatcttgttataaatgacctttcagcaacacaggaagtacccagcaaaggtttctattatgtattttacacacacacatacatacacacacacagctaattgagttttaaagtaatattcttgctaatccctactgaattgtagcttggtgttgtttctgaatggtttttggatattggaagcagccgctgattacccttgcaaagaaatctgtaaaatgtgcacgtgaatgtctga

SEQ ID NO: 11819 - DNA, 3310 bp, Homo sapiens
agagccactccatctgagggtggctgcgtgtccacatacgaggggacagggctgaggatgaggagaaccctggggacccagaagaccgtgccttgcctggaagtcctgcctgtaggcctgaaggacttgccctaacagagcctcaacaactacctggtgattcctacttcagccccttggtgtgagcagcttctcaacatgaactacagcctccacttggccttcgtgtgtctgagtctcttcactgagaggatgtgcatccaggggagtcagttcaacgtcgaggtcggcagaagtgacaagctttccctgcctggctttgagaacctcacagcaggatataacaaatttctcaggcccaattttggtggagaacccgtacagatagcgctgactctggacattgcaagtatctctagcatttcagagagtaacatggactacacagccaccatatacctccgacagcgctggatggaccagcggctggtgtttgaaggcaacaagagcttcactctggatgcccgcctcgtggagttcctctgggtgccagatacttacattgtggagtccaagaagtccttcctccatgaagtcactgtgggaaacaggctcatccgcctcttctccaatggcacggtcctgtatgccctcagaatcacgacaactgttgcatgtaacatggatctgtctaaataccccatggacacacagacatgcaagttgcagctggaaagctggggctatgatggaaatgatgtggagttcacctggctgagagggaacgactctgtgcgtggactggaacacctgcggcttgctcagtacaccatagagcggtatttcaccttagtcaccagatcgcagcaggagacaggaaattacactagattggtcttacagtttgagcttcggaggaatgttctgtatttcattttggaaacctacgttccttccactttcctggtggtgttgtcctgggtttcattttggatctctctcgattcagtccctgcaagaacctgcattggagtgacgaccgtgttatcaatgaccacactgatgatcgggtcccgcacttctcttcccaacaccaactgcttcatcaaggccatcgatgtgtacctggggatctgctttagctttgtgtttggggccttgctagaatatgcagttgctcactacagttccttacagcagatggcagccaaagatagggggacaacaaaggaagtagaagaagtcagtattactaatatcatcaacagctccatctccagctttaaacggaagatcagctttgccagcattgaaatttccagcgacaacgttgactacagtgacttgacaatgaaaaccagcgacaagttcaagtttgtcttccgagaaaagatgggcaggattgttgattatttcacaattcaaaaccccagtaatgttgatcactattccaaactactgtttcctttgatttttatgctagccaatgtattttactgggcatactacatgtatttttgagtcaatgttaaatttcttgcatgccataggtcttcaacaggacaagataatgatgtaaatggtattttaggccaagtgtgcacccacatccaatggtgctacaagtgactgaaataatatttgagtctttctgctcaaagaatgaagctccaaccattgttctaagctgtgtagaagtcctagcattataggatcttgtaatagaaacatcagtccattcctctttcatcttaatcaaggacattcccatggagcccaagattacaaatgtactcagggctgtttattcggtggctccctggtttgcatttacctcatataaagaatgggaaggagaccattgggtaaccctcaagtgtcagaagttgtttctaaagtaactatacatgttttttactaaatctctgcagtgcttataaaatacattgttgcctatttagggagtaacattttctagtttttgtttctggttaaaatgaaatatgggcttatgtcaattcattggaagtcaatgcactaactcaataccaagatgagtttttaaataatgaatattatttaataccacaacagaattatccccaatttccaataagtcctatcattgaaaattcaaatataagtgaagaaaaaattagtagatcaacaatctaaacaaatccctcggttctaagatacaatggattccccatactggaaggactctgaggctttattcccccactatgcatatcttatcattttattattatacacacatccatcctaaactatactaaagcccttttcccatgcatggatggaaatggaagatttttttttaacttgttctagaagtcttaatatgggctgttgccatgaaggcttgcagaattgagtccattttctagctgcctttattcacatagtgatggggtactaaaagtactgggttgactcagagagtcgctgtcattctgtcattgctgctactctaacactgagcaacactctcccagtggcagatcccctgtatcattccaagaggagcattcatccctttgctctaatgatcaggaatgatgcttattagaaaacaaactgcttgacccaggaacaagtggcttagcttaagtaaacttggctttgctcagatccctgatccttccagctggtctgctatgagtggcttatcccgcatgagcaggagcgtgctggccctgagtactgaactttctgagtaacaatgagatacgttacagaacctatgttcaggttgcgggtgagctgccctctccaaatccagccagagatgcacattcctcggccagtctcagccaacagtaccaaaagtgatttttgagtgtgccagggtaaaggcttccagttcagcctcagttattttagacaatctcgccatctttaatttcttagcttcctgttctaataaatgcacggctttacctttcctgtcagaaataaaccaaggctctaaaagatgatttcccttctgtaactccctagagccacaggttctcattccttttcccattatacttctcacaattcagtttctatgagtttgatcacctgatttttttaacaaaatatttctaacgggaatgggtgggagtgctggtgaaaagaggtgaaatgtggttgtatgagccaatcatatttgtgattttttaaaaaaagtttaaaaggaaatatctgttctgaaaccccacttaagcattgtttttatataaaaacaatgataaagatgtgaaactgtgaaataaatataccatattagctacccaccaaa

SEQ ID NO: 11820 - DNA, 582 bp, Homo sapiens
tttgctccccttcctttctctctctcccttcccggctcctagactgggtctaggcaggagcttcgccatgatgtcaggagggaaggagatgcctctgggcctcgtaccacagcctcagctctctctctgcccctccatctgagtccctcctggctcccagctccctcagggtgcaaggccaagcctccaaggaatccctccccttacctgcatggctggagccaagaagagccactccatctgagggtggctgcgtgtccacatacgaggggacagggctgaggatgaggagaaccctggggacccagaagaccgtgccttgcctggaagtcctgcctgtaggcctgaaggacttgccctaacagagcctcaacaactacctggtgattcctacttcagccccttggtgtgagcagcttctcaacatgaactacagcctccacttggccttcgtgtgtctgagtctcttcactgagaggatgtgcatccaggggagtcagttcaacgtcgaggtcggcagaagtgacaagctttccctgcctggctttgagaacctcacagcaggatataacaaatttctca

SEQ ID NO: 11821 - DNA, 3576 bp, Homo sapiens
ctgcccctccatttgctccccttcctttctctctctcccttcccggctcctagactgggtctaggcaggagcttcgccatgatgtcaggagggaaggagatgcctctgggcctcgtaccacagcctcagctctctctctgcccctccatctgagtccctcctggctcccagctccctcagggtgcaaggccaagcctccaaggaatccctccccttacctgcatggctggagccaagacaggtttagcagctccattcttccccagagagccactccatctgagggtggctgcgtgtccacatacgaggggacagggctgaggatgaggagaaccctggggacccagaagaccgtgccttgcctggaagtcctgcctgtaggcctgaaggacttgccctaacagagcctcaacaactacctggtgattcctacttcagccccttggtgtgagcagcttctcaacatgaactacagcctccacttggccttcgtgtgtctgagtctcttcactgagaggatgtgcatccaggggagtcagttcaacgtcgaggtcggcagaagtgacaagctttccctgcctggctttgagaacctcacagcaggatataacaaatttctcaggcccaattttggtggagaacccgtacagatagcgctgactctggacattgcaagtatctctagcatttcagagagtaacatggactacacagccaccatatacctccgacagcgctggatggaccagcggctggtgtttgaaggcaacaagagcttcactctggatgcccgcctcgtggagttcctctgggtgccagatacttacattgtggagtccaagaagtccttcctccatgaagtcactgtgggaaacaggctcatccgcctcttctccaatggcacggtcctgtatgccctcagaatcacgacaactgttgcatgtaacatggatctgtctaaataccccatggacacacagacatgcaagttgcagctggaaagctggggctatgatggaaatgatgtggagttcacctggctgagagggaacgactctgtgcgtggactggaacacctgcggcttgctcagtacaccatagagcggtatttcaccttagtcaccagatcgcagcaggagacaggaaattacactagattggtcttacagtttgagcttcggaggaatgttctgtatttcattttggaaacctacgttccttccactttcctggtggtgttgtcctgggtttcattttggatctctctcgattcagtccctgcaagaacctgcattggagtgacgaccgtgttatcaatgaccacactgatgatcgggtcccgcacttctcttcccaacaccaactgcttcatcaaggccatcgatgtgtacctggggatctgctttagctttgtgtttggggccttgctagaatatgcagttgctcactacagttccttacagcagatggcagccaaagatagggggacaacaaaggaagtagaagaagtcagtattactaatatcatcaacagctccatctccagctttaaacggaagatcagctttgccagcattgaaatttccagcgacaacgttgactacagtgacttgacaatgaaaaccagcgacaagttcaagtttgtcttccgagaaaagatgggcaggattgttgattatttcacaattcaaaaccccagtaatgttgatcactattccaaactactgtttcctttgatttttatgctagccaatgtattttactgggcatactacatgtatttttgagtcaatgttaaatttcttgcatgccataggtcttcaacaggacaagataatgatgtaaatggtattttaggccaagtgtgcacccacatccaatggtgctacaagtgactgaaataatatttgagtctttctgctcaaagaatgaagctccaaccattgttctaagctgtgtagaagtcctagcattataggatcttgtaatagaaacatcagtccattcctctttcatcttaatcaaggacattcccatggagcccaagattacaaatgtactcagggctgtttattcggtggctccctggtttgcatttacctcatataaagaatgggaaggagaccattgggtaaccctcaagtgtcagaagttgtttctaaagtaactatacatgttttttactaaatctctgcagtgcttataaaatacattgttgcctatttagggagtaacattttctagtttttgtttctggttaaaatgaaatatgggcttatgtcaattcattggaagtcaatgcactaactcaataccaagatgagtttttaaataatgaatattatttaataccacaacagaattatccccaatttccaataagtcctatcattgaaaattcaaatataagtgaagaaaaaattagtagatcaacaatctaaacaaatccctcggttctaagatacaatggattccccatactggaaggactctgaggctttattcccccactatgcatatcttatcattttattattatacacacatccatcctaaactatactaaagcccttttcccatgcatggatggaaatggaagatttttttttaacttgttctagaagtcttaatatgggctgttgccatgaaggcttgcagaattgagtccattttctagctgcctttattcacatagtgatggggtactaaaagtactgggttgactcagagagtcgctgtcattctgtcattgctgctactctaacactgagcaacactctcccagtggcagatcccctgtatcattccaagaggagcattcatccctttgctctaatgatcaggaatgatgcttattagaaaacaaactgcttgacccaggaacaagtggcttagcttaagtaaacttggctttgctcagatccctgatccttccagctggtctgctatgagtggcttatcccgcatgagcaggagcgtgctggccctgagtactgaactttctgagtaacaatgagatacgttacagaacctatgttcaggttgcgggtgagctgccctctccaaatccagccagagatgcacattcctcggccagtctcagccaacagtaccaaaagtgatttttgagtgtgccagggtaaaggcttccagttcagcctcagttattttagacaatctcgccatctttaatttcttagcttcctgttctaataaatgcacggctttacctttcctgtcagaaataaaccaaggctctaaaagatgatttcccttctgtaactccctagagccacaggttctcattccttttcccattatacttctcacaattcagtttctatgagtttgatcacctgatttttttaacaaaatatttctaacgggaatgggtgggagtgctggtgaaaagaggtgaaatgtggttgtatgagccaatcatatttgtgattttttaaaaaaagtttaaaaggaaatatctgttctgaaaccccacttaagcattgtttttatataaaaacaatgataaagatgtgaaactgtgaaataaatataccatattagctacccaccaaa

SEQ ID NO: 11822 - DNA, 689 bp, Homo sapiens
agacgcgaaggaggctttgggttggggagaagggcagcaatgagatgcggctgcagtccaggaatagtcagggaaacagataatttggttaaaatatctcagcctaataagggaactgggcaggtggggataactaaaaaagagtgcataaaagagtgttgtccaagttggcaccagagtcggggagttttcaggggtttagaagcctggccgtcaatacccacaacagttatggaggcaagggaaacaggcccttgaaaagaaggtaatgtggagtgggtagcctccgtattgactaaggggacggacttaccttccactgtgagagttacccgaagctcggagtccgtgatggtctacggagcttccgaggcgatcgggcagcatcagtcttcagctgctaagccgagaaggagtcagtcagagagccttgggccagagttccaggggctctgggagtggctgccaggtgattcctacttcagccccttggtgtgagcagcttctcaacatgaactacagcctccacttggccttcgtgtgtctgagtctcttcactgagaggatgtgcatccaggggagtcagttcaacgtcgaggtcggcagaagtgacaagctttccctgcctggctttgagaacctcacagcaggatataacaaatttctcaggcccaattttggtggagaac

SEQ ID NO: 11823 - DNA, 456 bp, Homo sapiens
aatcggacacgatcagcagggagaacacatgtgtttttatgagaattacgctgagataggtaacagatgaggatgaaatttgggcttgactgaagtaatgggggctgtctgtgaagccttgcggcagtacagcccaggtgattcctacttcagccccttggtgtgagcagcttctcaacatgaactacagcctccacttggccttcgtgtgtctgagtctcttcactgagaggatgtgcatccaggggagtcagttcaacgtcgaggtcggcagaagtgacaagctttccctgcctggctttgagaacctcacagcaggatataacaaatttctcaggcccaattttggtggagaacccgtacagatagcgctgactctggacattgcaagtatctctagcatttcagagagtaacatggactacacagccaccatatacctccgacagcgctgga

SEQ ID NO: 11824 - DNA, 721 bp, Homo sapiens
aggtgggaaggctaaactgaggaattatgtctgacagaagggaatgacaaggctaaactgaagaattatgtctgacagaagggaagaaatgactgcagtggccttctcagaccctgtaggaaaggactctacttatccggtgaaagtgtctacctagactaagaggtgattcctacttcagccccttggtgtgagcagcttctcaacatgaactacagcctccacttggccttcgtgtgtctgagtctcttcactgagaggatgtgcatccaggggagtcagttcaacgtcgaggtcggcagaagtgacaagctttccctgcctggctttgagaacctcacagcaggatataacaaatttctcaggcccaattttggtggagaacccgtacagatagcgctgactctggacattgcaagtatctctagcatttcagagagtaacatggactacacagccaccatatacctccgacagcgctggatggaccagcggctggtgtttgaaggcaacaagagcttcactctggatgcccgcctcgtggagttcctctgggtgccagatacttacattgtggagtccaagaagtccttcctccatgaagtcactgtgggaaacaggctcatccgcctcttctccaatggcacggtcctgtatgccctcagaatcacgacaactgttgcatgtaacatggatctgtctaaataccccatggacacac

SEQ ID NO: 11825 - DNA, 700 bp, Homo sapiens
agtcaaggagtgagggacagggaatgaacatgccatggcacagggcaggacctgctgaaagacagacaggcccagcagcgtagagaagcggtgattcctacttcagccccttggtgtgagcagcttctcaacatgaactacagcctccacttggccttcgtgtgtctgagtctcttcactgagaggatgtgcatccaggggagtcagttcaacgtcgaggtcggcagaagtgacaagctttccctgcctggctttgagaacctcacagcaggatataacaaatttctcaggcccaattttggtggagaacccgtacagatagcgctgactctggacattgcaagtatctctagcatttcagagagtaacatggactacacagccaccatatacctccgacagcgctggatggaccagcggctggtgtttgaaggcaacaagagcttcactctggatgcccgcctcgtggagttcctctgggtgccagatacttacattgtggagtccaagaagtccttcctccatgaagtcactgtgggaaacaggctcatccgcctcttctccaatggcacggtcctgtatgccctcagaatcacgacaactgttgcatgtaacatggatctgtctaaataccccatggacacacagacatgcaagttgcagctggaaagctggggctatgatggaaatgatgtggagt

SEQ ID NO: 11826 - DNA, 2942 bp, Homo sapiens
ttcttccccagagagccactccatctgagggtggctgcgtgtccacatacgaggggacagggctgaggatgaggagaaccctggggacccagaagaccgtgccttgcctggaagtcctgcctgtaggcctgaaggacttgccctaacagagcctcaacaactacctggtgattcctacttcagccccttggtgtgagcagcttctcaacatgaactacagcctccacttggccttcgtgtgtctgagtctcttcactgagaggagaacccgtacagatagcgctgactctggacattgcaagtatctctagcatttcagagagtaacatggactacacagccaccatatacctccgacagcgctggatggaccagcggctggtgtttgaaggcaacaagagcttcactctggatgaagtcactgtgggaaacaggctcatccgcctcttctccaatggcacggtcctgtatgccctcagaatcacgacaactgttgcatgtaacatggatctgtctaaataccccatggacacacagacatgcaagttgcagctggaaagctggggctatgatggaaatgatgtggagttcacctggctgagagggaacgactctgtgcgtggactggaacacctgcggcttgctcagtacaccatagagcggtatttcaccttagtcaccagatcgcagcaggagacaggaaattacactagattggtcttacagtttgagcttcggaggaatgttctgtatttcattttggaaacctacgttccttccactttcctggtggtgttgtcctgggtttcattttggatctctctcgattcagtccctgcaagaacctgcattggggacaacaaaggaagtagaagaagtcagtattactaatatcatcaacagctccatctccagctttaaacggaagatcagctttgccagcattgaaatttccagcgacaacgttgactacagtgacttgacaatgaaaaccagcgacaagttcaagtttgtcttccgagaaaagatgggcaggattgttgattatttcacaattcaaaaccccagtaatgttgatcactattccaaactactgtttcctttgatttttatgctagccaatgtattttactgggcatactacatgtatttttgagtcaatgttaaatttcttgcatgccataggtcttcaacaggacaagataatgatgtaaatggtattttaggccaagtgtgcacccacatccaatggtgctacaagtgactgaaataatatttgagtctttctgctcaaagaatgaagctccaaccattgttctaagctgtgtagaagtcctagcattataggatcttgtaatagaaacatcagtccattcctctttcatcttaatcaaggacattcccatggagcccaagattacaaatgtactcagggctgtttattcggtggctccctggtttgcatttacctcatataaagaatgggaaggagaccattgggtaaccctcaagtgtcagaagttgtttctaaagtaactatacatgttttttactaaatctctgcagtgcttataaaatacattgttgcctatttagggagtaacattttctagtttttgtttctggttaaaatgaaatatgggcttatgtcaattcattggaagtcaatgcactaactcaataccaagatgagtttttaaataatgaatattatttaataccacaacagaattatccccaatttccaataagtcctatcattgaaaattcaaatataagtgaagaaaaaattagtagatcaacaatctaaacaaatccctcggttctaagatacaatggattccccatactggaaggactctgaggctttattcccccactatgcatatcttatcattttattattatacacacatccatcctaaactatactaaagcccttttcccatgcatggatggaaatggaagatttttttttaacttgttctagaagtcttaatatgggctgttgccatgaaggcttgcagaattgagtccattttctagctgcctttattcacatagtgatggggtactaaaagtactgggttgactcagagagtcgctgtcattctgtcattgctgctactctaacactgagcaacactctcccagtggcagatcccctgtatcattccaagaggagcattcatccctttgctctaatgatcaggaatgatgcttattagaaaacaaactgcttgacccaggaacaagtggcttagcttaagtaaacttggctttgctcagatccctgatccttccagctggtctgctatgagtggcttatcccgcatgagcaggagcgtgctggccctgagtactgaactttctgagtaacaatgagatacgttacagaacctatgttcaggttgcgggtgagctgccctctccaaatccagccagagatgcacattcctcggccagtctcagccaacagtaccaaaagtgatttttgagtgtgccagggtaaaggcttccagttcagcctcagttattttagacaatctcgccatctttaatttcttagcttcctgttctaataaatgcacggctttacctttcctgtcagaaataaaccaaggctctaaaagatgatttcccttctgtaactccctagagccacaggttctcattccttttcccattatacttctcacaattcagtttctatgagtttgatcacctgatttttttaacaaaatatttctaacgggaatgggtgggagtgctggtgaaaagaggtgaaatgtggttgtatgagccaatcatatttgtgattttttaaaaaaagtttaaaaggaaatatctgttctgaaaccccacttaagcattgtttttatataaaaacaatgataaagatgtgaaactgtgaaataaatataccatattagctacccacc

SEQ ID NO: 11827 - DNA, 5761 bp, Homo sapiens
gccgcccctgagcagcctcgccttcgcctcccgcgtttcctgccgtccgccctcccccggccgagctccaggggctgccgcctagcagctcccggcgggagagcggttcagagcgcgcacgggggcgggcggaggcggcccggtgcggggcggccgcgctggagagaggcgcgcgcggagacgccggcccccctctccgcgtttgctcgcttgctccccgcctcccgcactccgctcgctcccaccccttcccggcgtgattgatccgtcacgggcgccgccgctgccgccgccgccgccgcggccgttctgagccgagccggaaccctagcccgagacggagccggggcccgggccggcgccattgcgcgggcgccgcgggaagaccttggcgcggggcggcgggccgggccaggccatgcgggccgagtgagccggcgcccgcagcccgcggcgcggcatggcttccccgcggagctccgggcagcccgggccgccgccgccgccgccaccgccgcccgcgcgcctgctactgctactgctgctgccgctgctgctgcctctggcgcccggggcctggggctgggcgcggggcgccccccggccgccgcccagcagcccgccgctctccatcatgggcctcatgccgctcaccaaggaggtggccaagggcagcatcgggcgcggtgtgctccccgccgtggaactggccatcgagcagatccgcaacgagtcactcctgcgcccctacttcctcgacctgcggctctatgacacggagtgcgacaacgcaaaagggttgaaagccttctacgatgcaataaaatacgggcctaaccacttgatggtgtttggaggcgtctgtccatccgtcacatccatcattgcagagtccctccaaggctggaatctggtgcagctttcttttgctgcaaccacgcctgttctagccgataagaaaaaatacccttatttctttcggaccgtcccatcagacaatgcggtgaatccagccattctgaagttgctcaagcactaccagtggaagcgcgtgggcacgctgacgcaagacgttcagaggttctctgaggtgcggaatgacctgactggagttctgtatggcgaggacattgagatttcagacaccgagagcttctccaacgatccctgtaccagtgtcaaaaagctgaaggggaatgatgtgcggatcatccttggccagtttgaccagaatatggcagcaaaagtgttctgttgtgcatacgaggagaacatgtatggtagtaaatatcagtggatcattccgggctggtacgagccttcttggtgggagcaggtgcacacggaagccaactcatcccgctgcctccggaagaatctgcttgctgccatggagggctacattggcgtggatttcgagcccctgagctccaagcagatcaagaccatctcaggaaagactccacagcagtatgagagagagtacaacaacaagcggtcaggcgtggggcccagcaagttccacgggtacgcctacgatggcatctgggtcatcgccaagacactgcagagggccatggagacactgcatgccagcagccggcaccagcggatccaggacttcaactacacggaccacacgctgggcaggatcatcctcaatgccatgaacgagaccaacttcttcggggtcacgggtcaagttgtattccggaatggggagagaatggggaccattaaatttactcaatttcaagacagcagggaggtgaaggtgggagagtacaacgctgtggccgacacactggagatcatcaatgacaccatcaggttccaaggatccgaaccaccaaaagacaagaccatcatcctggagcagctgcggaagatctccctacctctctacagcatcctctctgccctcaccatcctcgggatgatcatggccagtgcttttctcttcttcaacatcaagaaccggaatcagaagctcataaagatgtcgagtccatacatgaacaaccttatcatccttggagggatgctctcctatgcttccatatttctctttggccttgatggatcctttgtctctgaaaagacctttgaaacactttgcaccgtcaggacctggattctcaccgtgggctacacgaccgcttttggggccatgtttgcaaagacctggagagtccacgccatcttcaaaaatgtgaaaatgaagaagaagatcatcaaggaccagaaactgcttgtgatcgtggggggcatgctgctgatcgacctgtgtatcctgatctgctggcaggctgtggaccccctgcgaaggacagtggagaagtacagcatggagccggacccagcaggacgggatatctccatccgccctctcctggagcactgtgagaacacccatatgaccatctggcttggcatcgtctatgcctacaagggacttctcatgttgttcggttgtttcttagcttgggagacccgcaacgtcagcatccccgcactcaacgacagcaagtacatcgggatgagtgtctacaacgtggggatcatgtgcatcatcggggccgctgtctccttcctgacccgggaccagcccaatgtgcagttctgcatcgtggctctggtcatcatcttctgcagcaccatcaccctctgcctggtattcgtgccgaagctcatcaccctgagaacaaacccagatgcagcaacgcagaacaggcgattccagttcactcagaatcagaagaaagaagattctaaaacgtccacctcggtcaccagtgtgaaccaagccagcacatcccgcctggagggcctacagtcagaaaaccatcgcctgcgaatgaagatcacagagctggataaagacttggaagaggtcaccatgcagctgcaggacacaccagaaaagaccacctacattaaacagaaccactaccaagagctcaatgacatcctcaacctgggaaacttcactgagagcacagatggaggaaaggccattttaaaaaatcacctcgatcaaaatccccagctacagtggaacacaacagagccctctcgaacatgcaaagatcctatagaagatataaactctccagaacacatccagcgtcggctgtccctccagctccccatcctccaccacgcctacctcccatccatcggaggcgtggacgccagctgtgtcagcccctgcgtcagccccaccgccagcccccgccacagacatgtgccaccctccttccgagtcatggtctcgggcctgtaagggtgggaggcctgggcccggggcctcccccgtgacagaaccacactgggcagaggggtctgctgcagaaacactgtcggctctggctgcggagaagctgggcaccatggctggcctctcaggaccactcggatggcactcaggtggacaggacggggcagggggagacttggcacctgacctcgagccttatttgtgaagtccttatttcttcacaaagaagaggaacggaaatgggacgtcttccttaacatctgcaaacaaggaggcgctgggatatcaaacttgcaaaaaaaaaaaaaaaaaaaaaaaaacaaaaaaactagacaaggagagaggcactagaactccagctggaagtcacggagtggctcgagcagccttgggaagaggcaaggagcttctgaagaaactgcctctgcacacacatcactggctgtgacccctcaggctagcccttctccactctgggggaggaggtgggaagggccaccaggcccccagctgccaggccagctgaccccagccttcctggaacagggagtctgcaggagcgcagacaggcacagccctggagcaggcaggccgagggctgcggcactggagcaggctgacttacatgctccacatgggacctgtgtcacccaatgagatgtttgttactctggtaaatgccacacgttaacacaataacacccattcctgggaccgtggggatttagggcacgtcactgcagacacgctctgcagcattcaccgacagtctgtcatgcacccaccacgttggccatgtccttgtgttcctatcggatgctcccagtaaccagggggaccacccgagctaatcatggaatgtctgttcccagcaaacacgataaagaaagattgtgcactttaacctctctcatcagggcccaagggctggctgggattttttttttttttttcccactaactttgtttctgaccaaagtgaattggaggcactctgctaaaagacatccccgtagacataggggagagagttgctggctgagggcttcccttggcttccagaaggcagccttccatccagacaagccagtgagctctccccttgggatcactggggtgatcagtcagcagattgattctcattcataagatcattcctccctttaaattgagcccctaagagcactggcctgggagtcagacagacctgggttcaagtcctcagtcccctgcccactccctacgtgactttgatcaggtcactagtgtctctctgagcctcagtttcccctctgtaacttggggttgaactaaaacacctgtcctgcctacctcacaaggtcactctgaggattgaaacttgatcttgtccaggaaagctttgtaccaaacagtgaagccgccctgatccgtgaggtatgagtatgactctgaccttcagccctccctacagccgggggtgtggcccagagaagcttccagcacagccctctacccagaacatccgggctggagggaggctcccagtgacttttctgacattcctagacaggttcattctttgctcaagaaaggcctgaatgacaatgtccaggatgtctgcacaactgagcagctcgctcactccctaaagaaacctattggcagcttcaacaggcaggcaataatctcttcccagaaccactgcagtcaggaataaactgttttctccaccaggctttgacaaaagggcccacaggaatcttaccaatgccaacatttcaaagcaccctatttcacgtagcatagctttctgctccccttccccaaagagaggttatggaggtactgtagcttttagggaaaaaaaaatgttaacacatcacaggtcaagttgaagtcattctctgtttaggcactaaaaatcggtgttgtcactcactgtgtattaccagtatttacttgctttcttgatttcaccaaaaccaaatttaatttaaaggaccacattaatttttcaaagggaaagagacaattaattgtacataatgtatacacacacacaaaaaaaaatacctgtagaaatattattccagcatagcaggaaaacaaacaaaagtattggactgtcggaggtgagcctgtgcgtctgtaaccctttgtgactcctgagcgtgcgctgtcttctaggttaactcacgaagtacattctctgtcttactgatactgtaggttcacccatttttttttaatttcctcgcaaataacaagacccacagaagtgactctagctacttaatggttctgttcttttatatgcagcaaacacaccgtccatttctgaagaggcttcggcctgaaggcattttccaatgatgttagtgcacaaaacgctttaaattagactggaactgccagaatcaaatgtaaatgaggaatttctcgtacccctactgcatggtatcgatttttaataaattgttgcaaatttgtttttatgaa

SEQ ID NO: 11828 - DNA, 1823 bp, Homo sapiens
caagatggccgaataggaacagctcccgtctacagctcccagcgtgagcgacgcagaagacggatatttttgatctgcacttggttgaatctacagatgtaaaacccacggatgcagagggctgactgtggctagaaaatgtgctgcagggagcacgtggaaacagctgatgagcacctgcagcccctgtttgggagcagctggggtgtgctgcctgccgttcacccatcagtcaaatcgaggcttcatgaaggcaaaggcagtggcatctcagaatttgacaaacctcctttcatcagtgactggttccatttcaggctggcccaaagtcaaagccccaaagacaaagacgagaagtacatgaagatgcccacaagcaagtcagcccaattctgagacgaagtcctgacatcaccaaatcgcctctgacaaagtcagaacagcttctgaggatagatgaccatgatttcagcatgaggcctggctttggaggccctgccattcctgttggtgtggatgtgcaggtggagagtttggatagcatctcagaggttgacatggactttacgatgaccctctacctgaggcactactggaaggacgagaggctgtcttttccaagcaccaacaacctcagcatgacgtttgacggccggctggtcaagaagatctgggtccctgacatgtttttcgtgcactccaaacgctccttcatccacgacaccaccacagacaacgtcatgttgcgggtccagcctgatgggaaagtgctctatagtctcagggttacagtaactgcaatgtgcaacatggacttcagccgatttcccttggacacacaaacgtgctctcttgaaattgaaagctatgcctatacagaagatgacctcatgctgtactggaaaaagggcaatgactccttaaagacagatgaacggatctcactctcccagttcctcattcaggaattccacaccaccaccaaactggctttctacagcagcacaggctggtacaaccgtctctacattaatttcacgttgcgtcgccacatcttcttcttcttgctccaaacttatttccccgctaccctgatggtcatgctgtcctgggtgtccttctggatcgaccgcagagccgtgcctgccagagtccccttaggtatcacaacggtgctgaccatgtccaccatcatcacgggcgtgaatgcctccatgccgcgcgtctcctacatcaaggccgtggacatctacctctgggtcagctttgtgttcgtgttcctctcggtgctggagtatgcggccgtcaactacctgaccactgtgcaggagaggaaggaacagaagctgcgggagaagcttccctgcaccagcggattacctccgccccgcactgcgatgctggacggcaactacagtgatggggaggtgaatgacctggacaactacatgccagagaatggagagaagcccgacaggatgatggtgcagctgaccctggcctcagagaggagctccccacagaggaaaagtcagagaagcagctatgtgagcatgagaatcgacacccacgccattgataaatactccaggatcatctttccagcagcatacattttattcaatttaatatactggtctattttctcctagatgcttgtaattctacaaatttcacatttccatggcatgcactacagaaataactgtataatgaaaaagtatttaaggatatggttaaaaaaaaatcccaggacccacccatgttttcactatcccttctgcagctttccaaagctacattgacgagacacttactggttt

SEQ ID NO: 11829 - DNA, 3110 bp, Homo sapiens
taataatggccgtaagcttaaaatagatccagggaggagctcattaacgtgaacatagaaagcagttccgcacctctggccttactcctcttggaaattgctttggtccatttttacttccttttattcgacgcaccagaaaataagacttttaccaacatttttactgcatttgacgatgaactaatttagaccggctaaaataattgttccactgggacacaggaattcaacctcagttcagaaaatccctgacatctgacgtaggaggatttataggtttagtggaaattgctttctcctgctctccagattgcatcctgtgggttgattttttttttgcatgagtaaacatccttctaataatgaacagaccaataatgtcttaagagagaaaaagaacaatcttttcctttttgctgtttctggagagagctgtttgaatttggaaacccatgttggctgtcccaaatatgagatttggcatctttcttttgtggtggggatgggttttggccactgaaagcagaatgcactggcccggaagagaagtccacgagatgtctaagaaaggcagcccaattctgagacgaagtcctgacatcaccaaatcgcctctgacaaagtcagaacagcttctgaggatagatgaccatgatttcagcatgaggcctggctttggaggccctgccattcctgttggtgtggatgtgcaggtggagagtttggatagcatctcagaggttgacatggactttacgatgaccctctacctgaggcactactggaaggacgagaggctgtcttttccaagcaccaacaacctcagcatgacgtttgacggccggctggtcaagaagatctgggtccctgacatgtttttcgtgcactccaaacgctccttcatccacgacaccaccacagacaacgtcatgttgcgggtccagcctgatgggaaagtgctctatagtctcagggttacagtaactgcaatgtgcaacatggacttcagccgatttcccttggacacacaaacgtgctctcttgaaattgaaagctatgcctatacagaagatgacctcatgctgtactggaaaaagggcaatgactccttaaagacagatgaacggatctcactctcccagttcctcattcaggaattccacaccaccaccaaactggctttctacagcagcacaggctggtacaaccgtctctacattaatttcacgttgcgtcgccacatcttcttcttcttgctccaaacttatttccccgctaccctgatggtcatgctgtcctgggtgtccttctggatcgaccgcagagccgtgcctgccagagtccccttaggtatcacaacggtgctgaccatgtccaccatcatcacgggcgtgaatgcctccatgccgcgcgtctcctacatcaaggccgtggacatctacctctgggtcagctttgtgttcgtgttcctctcggtgctggagtatgcggccgtcaactacctgaccactgtgcaggagaggaaggaacagaagctgcgggagaagcttccctgcaccagcggattacctccgccccgcactgcgatgctggacggcaactacagtgatggggaggtgaatgacctggacaactacatgccagagaatggagagaagcccgacaggatgatggtgcagctgaccctggcctcagagaggagctccccacagaggaaaagtcagagaagcagctatgtgagcatgagaatcgacacccacgccattgataaatactccaggatcatctttccagcagcatacattttattcaatttaatatactggtctattttctcctagatgcttgtaattctacaaatttcacatttccatggcatgcactacagaaataactgtataatgaaaaagtatttaaggatatggttaaaaaaaaatcccaggacccacccatgttttcactatcccttctgcagctttccaaagctacattgacgagacacttactggtttaatttgcacttattaaccatctattgaatacacagcattatattaggtgctgcaggaaatacgacactgtagcgactgatgttagttgttacccagatcccctggaaaagcacactaccagtgttgtgggcacatttagttccacccgttagacccttgatgctattcacatgaataatttattttcctcaagtgtcattacattgttcaggctacgtgaacttggaagcacctacaggccatttgcatgaaattcacatgcacctaaatcctcactttgacagaaactcatgcttcagtttataacctattacctattttgtatgcgactccacctccgcatgtttattttaataaaaggcaatgataacattcacattatttttctttatatgctgtggttcacaggctttaccccttcacaagaaaagctctttagattggcgcaattgcttctgattttggtgaaattttccctggtagggaaactttgaagataagagtacacacatgcattttgtctgttgtgtcatagaggtaactaggctagaaaatttgtgtttaaatgttccctattttatataatcaccacttcatgtttcttcttcttggagcatgtccttgttcaaagagaagtgctttctcagtgatgtgatatcttcactgaggaacttgggtagagaatgatttcttctgcataaacacttcaaggaaatacataatttgggactacttgtaactcattagaatgagaaatactcacatggtttcttaagagaaaaagaacatcggaaagcaaaataaatgggaagatatcactggacatctgcatttatactcgaaataccagcattttctatggaccagaaaactgccatcacctagaccacacagcccagataccaggcagacggatggcccaatggcaactgatgtcagggcatggggtaaaggagagggttctaatctggtgtatcacttaaaaacagttatttatattatatatctgctatatagatcaacctccaccaaacttacccaaacagcatttgttttatttgaaactcactttaataaagtgaattatatacacaa

SEQ ID NO: 11830 - DNA, 1766 bp, Homo sapiens
cagatatttttgatctgcacttggttgaatctacagatgtaaaacccacggatgcagagggctgactgtggctagaaaatgtgctgcagggagcacgtggaaacagctgatgagcacctgcagcccctgtttgggagcagctggggtgtgctgcctgccgttcacccatcagtcaaatcgaggcttcatgaaggcaaaggcagtggcatctcagaatttgacaaacctcctttcatcagtgactggttccatttcaggctggcccaaagtcaaataggccccaaagacaaagacgagaagtacatgaagatgcccacaagcaagtcagcccaattctgagacgaagtcctgacatcaccaaatcgcctctgacaaagtcagaacagcttctgaggatagatgaccatgatttcagcatgaggcctggctttggaggccctgccattcctgttggtgtggatgtgcaggtggagagtttggatagcatctcagaggttgacatggactttacgatgaccctctacctgaggcactactggaaggacgagaggctgtcttttccaagcaccaacaacctcagcatgacgtttgacggccggctggtcaagaagatctgggtccctgacatgtttttcgtgcactccaaacgctccttcatccacgacaccaccacagacaacgtcatgttgcgggtccagcctgatgggaaagtgctctatagtctcagggttacagtaactgcaatgtgcaacatggacttcagccgatttcccttggacacacaaacgtgctctcttgaaattgaaagctatgcctatacagaagatgacctcatgctgtactggaaaaagggcaatgactccttaaagacagatgaacggatctcactctcccagttcctcattcaggaattccacaccaccaccaaactggctttctacagcagcacaggctggtacaaccgtctctacattaatttcacgttgcgtcgccacatcttcttcttcttgctccaaacttatttccccgctaccctgatggtcatgctgtcctgggtgtccttctggatcgaccgcagagccgtgcctgccagagtccccttaggtatcacaacggtgctgaccatgtccaccatcatcacgggcgtgaatgcctccatgccgcgcgtctcctacatcaaggccgtggacatctacctctgggtcagctttgtgttcgtgttcctctcggtgctggagtatgcggccgtcaactacctgaccactgtgcaggagaggaaggaacagaagctgcgggagaagcttccctgcaccagcggattacctccgccccgcactgcgatgctggacggcaactacagtgatggggaggtgaatgacctggacaactacatgccagagaatggagagaagcccgacaggatgatggtgcagctgaccctggcctcagagaggagctccccacagaggaaaagtcagagaagcagctatgtgagcatgagaatcgacacccacgccattgataaatactccaggatcatctttccagcagcatacattttattcaatttaatatactggtctattttctcctagatgcttgtaattctacaaatttcacatttccatggcatgcactacagaaataactgtataatgaaaaagtatttaaggatatggttaaaaaaaaatcccaggacccacccatgttttcactatcccttctgcagctttccaaagctacattgacgagacacttactggttt

SEQ ID NO: 11831 - DNA, 2820 bp, Homo sapiens
tgagtaaacatccttctaataatgaacagaccaataatgtcttaagagagaaaaagaacaatcttttcctttttgctgtttctggagagagctgtttgaatttggaaacccatgttggctgtcccaaatatgagatttggcatctttcttttgtggtggggatgggttttggccactgaaagcagaatgcactggcccggaagagaagtccacgagatgtctaagaaaggcaggccccaaagacaaagacgagaagtacatgaagatgcccacaagcaagtcagcccaattctgagacgaagtcctgacatcaccaaatcgcctctgacaaagtcagaacagcttctgaggatagatgaccatgatttcagcatgaggcctggctttggaggccctgccattcctgttggtgtggatgtgcaggtggagagtttggatagcatctcagaggttgacatggactttacgatgaccctctacctgaggcactactggaaggacgagaggctgtcttttccaagcaccaacaacctcagcatgacgtttgacggccggctggtcaagaagatctgggtccctgacatgtttttcgtgcactccaaacgctccttcatccacgacaccaccacagacaacgtcatgttgcgggtccagcctgatgggaaagtgctctatagtctcagggttacagtaactgcaatgtgcaacatggacttcagccgatttcccttggacacacaaacgtgctctcttgaaattgaaagctatgcctatacagaagatgacctcatgctgtactggaaaaagggcaatgactccttaaagacagatgaacggatctcactctcccagttcctcattcaggaattccacaccaccaccaaactggctttctacagcagcacaggctggtacaaccgtctctacattaatttcacgttgcgtcgccacatcttcttcttcttgctccaaacttatttccccgctaccctgatggtcatgctgtcctgggtgtccttctggatcgaccgcagagccgtgcctgccagagtccccttaggtatcacaacggtgctgaccatgtccaccatcatcacgggcgtgaatgcctccatgccgcgcgtctcctacatcaaggccgtggacatctacctctgggtcagctttgtgttcgtgttcctctcggtgctggagtatgcggccgtcaactacctgaccactgtgcaggagaggaaggaacagaagctgcgggagaagcttccctgcaccagcggattacctccgccccgcactgcgatgctggacggcaactacagtgatggggaggtgaatgacctggacaactacatgccagagaatggagagaagcccgacaggatgatggtgcagctgaccctggcctcagagaggagctccccacagaggaaaagtcagagaagcagctatgtgagcatgagaatcgacacccacgccattgataaatactccaggatcatctttccagcagcatacattttattcaatttaatatactggtctattttctcctagatgcttgtaattctacaaatttcacatttccatggcatgcactacagaaataactgtataatgaaaaagtatttaaggatatggttaaaaaaaaatcccaggacccacccatgttttcactatcccttctgcagctttccaaagctacattgacgagacacttactggtttaatttgcacttattaaccatctattgaatacacagcattatattaggtgctgcaggaaatacgacactgtagcgactgatgttagttgttacccagatcccctggaaaagcacactaccagtgttgtgggcacatttagttccacccgttagacccttgatgctattcacatgaataatttattttcctcaagtgtcattacattgttcaggctacgtgaacttggaagcacctacaggccatttgcatgaaattcacatgcacctaaatcctcactttgacagaaactcatgcttcagtttataacctattacctattttgtatgcgactccacctccgcatgtttattttaataaaaggcaatgataacattcacattatttttctttatatgctgtggttcacaggctttaccccttcacaagaaaagctctttagattggcgcaattgcttctgattttggtgaaattttccctggtagggaaactttgaagataagagtacacacatgcattttgtctgttgtgtcatagaggtaactaggctagaaaatttgtgtttaaatgttccctattttatataatcaccacttcatgtttcttcttcttggagcatgtccttgttcaaagagaagtgctttctcagtgatgtgatatcttcactgaggaacttgggtagagaatgatttcttctgcataaacacttcaaggaaatacataatttgggactacttgtaactcattagaatgagaaatactcacatggtttcttaagagaaaaagaacatcggaaagcaaaataaatgggaagatatcactggacatctgcatttatactcgaaataccagcattttctatggaccagaaaactgccatcacctagaccacacagcccagataccaggcagacggatggcccaatggcaactgatgtcagggcatggggtaaaggagagggttctaatctggtgtatcacttaaaaacagttatttatattatatatctgctatatagatcaacctccaccaaacttacccaaacagcatttgttttatttgaaactcactttaataaagtgaattatatacacaataa

SEQ ID NO: 11832 - DNA, 1682 bp, Homo sapiens
ggccagccttgccctcacagcccctcagagcagcccgtcaggaggcagcagatggatcaatggtcaagccaggggggatttgctctgccacaggctactggaaagcagctttttgcctcacagatgtccacaaaatgccttattttacaagactcattttgttcttgttttgcttgatggttctcgtggagagcagaaaacccaagaggaagcgatggacagggcaggtggaaatgcccaagccaagtcacttatataagaagaaccttgatgtgaccaagatccggaagggaaagcctcagcagcttctcagagtggacgagcacgacttcagcatgagacccgccttcggaggccctgccatcccggtgggcgtggacgtacaggtggagagcctggacagcatctccgaggtggacatggacttcactatgaccctgtacctgcggcattactggaaggatgagaggctagctttctccagcgccagcaacaagagcatgaccttcgatggccggctggtgaagaagatctgggtccctgatgtcttctttgttcactccaaaagatcgttcactcatgacaccaccactgacaacatcatgctgagggtgttcccagatggacacgtgctgtacagcatgaggattacggtcactgccatgtgcaacatggacttcagccactttcccctggactcccagacctgttctttggagctggagagctatgcctatacagatgaagatctaatgctgtactggaagaatggggatgaatccctaaaaacagatgagaagatctccttgtctcagtttctgattcagaaatttcacacaacttccaggctggccttctacagcagcactggctggtacaaccgtctgtacattaacttcacgttgcgtcgccacatcttcttcttcttgctccaaacatatttccctgccactctgatggtcatgctgtcctgggtgtccttctggatcgaccgcagagctgtgcctgccagagtttcactgggtatcacgacggtgctgaccatgaccaccatcatcacgggcgtgaatgcctccatgccgcgcgtctcctacgtcaaggccgtggacatctacctctgggtcagctttgtgttcgtgttcctctcggtgctggagtatgcggctgtcaactacctgaccaccgtgcaggagcgcaaggaacggaagctgcgggagaagttcccgtgcatgtgtggaatgcttcattcaaaaaccatgatgctggatggaagctacagtgagtctgaggccaacagcctggctgggtaccccagaagccatatcctgacagaagaagaaaggcaagacaaaatagtggtccacctgggcctgagtggtgaagccaacgctgccagaaagaaggggcttctgaagggccagacgggttttcgtatcttccagaatacccatgccattgacaaatactctaggttgatattccctgcctcctacatatttttcaacttaatttattggtcagtgttttcctaggggctccaaggctgttcctagaagagggcatagacatcgagggggcctggccagtcattgacagacggacttgttgaccacacgcccctcaccaaacaatgcagcagctactggaccaccctgagcagcactcatctctcagagaagccc

SEQ ID NO: 11833 - DNA, 485 bp, Homo sapiens
gcgcccagaacgccccggccatgggcatccgaggcatgctgcgagccgcagtgatcctgctgctcatcaggacctggctcgcggagggcaactaccccagtcccatcccgaaattccacttcgagttctcctctgctgtgcccgaagtcgtcctgaacctcttcaactgcaaaaattgtgcaaatgaagctgtggttcaaaagattttggacagggtgctgtcaagatacgatgtccgcctgagaccgaattttggaggtgtcctagagactaacagtacctggggccttaatgatgatgagctcatggcccatggccaagagaaggacagtagctcagagtctgaggatagttgccccccaagccctgggtgctccttcactgaagggttctccttcgatctctttaatcctgactacgtcccaaaggtcgacaagtggtcccggttcctcttccctctggcctttgggttgttcaacattgtt

SEQ ID NO: 11834 - DNA, 6174 bp, Homo sapiens
gcgcccagaacgccccggccatgggcatccgaggcatgctgcgagccgcagtgatcctgctgctcatcaggacctggctcgcggagggcaactaccccagtcccatcccgaaattccacttcgagttctcctctgctgtgcccgaagtcgtcctgaacctcttcaactgcaaaaattgtgcaaatgaagctgtggttcaaaagattttggacagggtgctgtcaagatacgatgtccgcctgagaccgaattttggaggtgcccctgtgcctgtgagaatatctatttatgtcacgagcattgaacagatctcagaaatgaatatggactacacgatcacgatgttttttcatcagacttggaaagattcacgcttagcatactatgagaccaccctgaacttgaccctggactatcggatgcatgagaagttgtgggtccctgactgctactttctgaacagcaaggatgctttcgtgcatgatgtgactgtggagaatcgcgtgtttcagcttcacccagatggaacggtgcggtacggcatccgactcaccactacagcagcttgttccctggatctgcataaattccctatggacaagcaggcctgcaacctggtggtagagagctatggttacacggttgaagacatcatattattctgggatgacaatgggaacgccatccacatgactgaggagctgcatatccctcagttcactttcctgggaaggacgattactagcaaggaggtgtatttctacacaggttcctacatacgcctgatactgaagttccaggttcagagggaagttaacagctaccttgtgcaagtctactggcctactgtcctcaccactattacctcttggatatcgttttggatgaactatgattcctctgcagccagggtgacaattggcttaacttcaatgctcatcctgaccaccatcgactcacatctgcgggataagctccccaacatttcctgtatcaaggccattgatatctatatcctcgtgtgcttgttctttgtgttcctgtccttgctggagtatgtctacatcaactatcttttctacagtcgaggacctcggcgccagcctaggcgacacaggagaccccgaagagtcattgcccgctaccgctaccagcaagtggtggtaggaaacgtgcaggatggcctgattaacgtggaagacggagtcagctctctccccatcaccccagcgcaggcccccctggcaagcccggaaagcctcggttctttgacgtccacctccgagcaggcccagctggccacctcggaaagcctcagcccactcacttctctctcaggccaggcccccctggccactggagaaagcctgagcgatctcccctccacctcagagcaggcccggcacagctatggtgttcgctttaatggtttccaggctgatgacagtatttttcctaccgaaatccgcaaccgtgtcgaagcccatggccatggtgttacccatgaccatgaagattccaatgagagcttgagctcggatgagcgccatggccatggccccagtgggaagcccatgcttcaccatggcgagaagggtgtgcaagaagcaggctgggaccttgatgacaacaatgacaagagcgactgccttgccattaaggagcaattcaagtgtgatactaacagtacctggggccttaatgatgatgagctcatggcccatggccaagagaaggacagtagctcagagtctgaggatagttgccccccaagccctgggtgctccttcactgaagggttctccttcgatctctttaatcctgactacgtcccaaaggtcgacaagtggtcccggttcctcttccctctggcctttgggttgttcaacattgtttactgggtataccatatgtattagtcccccagtgctccagaacagcgggagcactgtgctgtgctcctttcagtttcttttgggtttgtttttccctctttcctttgttccttttattttgtggttatttgggcaatccaataagttcatacttctctttataaacatgaggtggggagtaattggaaagaacatgttctagctggaagggaagggattgaggaggagttggaggtatacagcacatggatttcctttcctgctagaagactctcaccttttcaaagacttgtaacaaggaataagcatagaaaagcccctggaaatgtttagaggacagagaagagccaggttgggggatggggcaaggatctgggccttttgcccacaaacatttctggggggcttttctgtcccccttgaggtgtcaacatttctttttcattacatgttttcttctttttttgtttcctcctagggattatgggtcttgttcaccctctgcttagggctttatagaagaaagtcaagctgggttgggctggggttcatagctaaagggctagccatggcttagaagttcagggaacttcctataggaaacttagggagcatttgtaagtgcctttcccccactgtatggcatttgactgtggtgttttgatgcaagcgtggaaggggaatgtgggtggatggggctgcagagtgagacatcagggtgagagagcacatactcagcttgtggggttggcagagggtggggggtgatgtcaggttggaaattacacagttgagctggcctcttcggagggattggaacttgcctatatttctgcttcagaacgcttggcaatagagactcaatacatctgtctaagtcaggagttagctttccgtcagttgctgagttgatcaccagttacagcacttggtgaataagcactaaggttaggataattcacacttgctattttaccatctgatctagactagcagatgaatatctatcgtaagtctatatactaatcctttctatttgtctagtgcatagtaagtgtcaacaagctccctgacccattacatcactggagcctcacaggagccctgtaagccagggaaggcaaagcacattgtccccagtgttccaaggaaaacgaatggagcttatgccgcatgcttgaggacatgcagccagtgagtggtagatccaccccacttgctctttcttgtctttttcctcctgactgtcccaactgaggcatttccttttcttccctccctaaagagggtgctccagagggcccccaccacatcctctagcacctggggcatctctgcaggaataggctggtgaccagccaatgagcgtgacgtgagcagatggagaacacactctctgcccactgagcagggcccctaacggaagtaggattggccagcattccaacttgccaagcagctccacctcactgatggaggttgtgagggagtgaactttgccgagcactcaacatatgccacctcttcctccctatgcagtctctccctcagtcccttacccctctacccactcaccctttaactgtgcttctgtgtttgtgtttctgtatatacctgggtgtatgcatatgcagcagggtgggtgtatgtacatatacaaccatttgagaagctgcatagtgccgtgtctagtggtgtaaatctacattggtgtgtacagaattgtatctacagcatgtggatgcatgcgtgtgtgtgcacatccctgtgaaagtgtggcttatgtatgtgtatgcttgtgtacacatgggtctatgctgagtgcatgtatataagggcatgtctgcatatctatgtttatctgatttgaatgggtgtgaaaggaaatacccctgaaagcatatgtattccctgttggtgacccttctagaaccactataattcccttggcctgctcccatatggtggaggggccctatttggccgggctgcttaactgactgtttctttccaacttcctgttccagggagcagcatctcccagttcccttccactgtttgccctgtccctccatccatctgtgctgtctcctagatagaagactggggaagtgaatgtagtcctaagaagtggtgagctagtgccttgaggtaggaagtggttaatccatggaagaagctgcaagtacagagcatttcactttgtcctagaggaacatgtttcggggtaacaggctggggagtgaggctgaaagaggcattgagaatagacacttgtacagtcacatacacatacacacacacaaatcttgtacaacagttgaaaacaagaaagttaccactggaagagctaaaattgcctctttatttttggataccccatatagagattcaggtggaggggagagcagtgactccatgtctgaagctcccaatgtggctattgaaaggctggcttcctggagcctaagcattggttggttgacgtggatttgggtctccagcaccctggaggtgctttcaaccctgtggtggcaagcagttcatttgggataaagtcataaagggagattggagcagtgtgaagaaaaggagggttttaagatttgtctggaagcaatgcacatgaaggcttcacagcacagaggaagggcagcgaggccagttgtaaatatctctatagatccatatagctagatataatactataccttaaaaaggatatcttgccctgacgtgctgcaatgagagcagttgaactctactgcgactcatactctgtaggttaagtgtcaaaatgaggtggagatttggcagtgacaccctttcgggaacgtgaaccttctgagtttgctatggatttggtcattttagcctgcacgttgccagatctccccttgttgagtcttgtatgtggtctgtcctctgtgtcatttgagtcctcagctgtccccaaccccttcccagcccctccccagcctgcagtcaccccctgtccagcaagctgcctccatcccatccctctcctcacctcacaccaggtaactctggaagtgcagaatgcttggtagtttggagcttgggcagcatctgggatgcaacaacccctattttactcttctacccaccttccatttctttccttcccatcgacttccccgacccaggatcccttctttgccactatcatgggaaggacacccctgtctgtctttctgaagtatcattttattgtggggatgtgtgacacgtttcctaccaagttcttgccagttccatctgccactgtggggtgcctttgcacaggtcatggacgatctgctgggtcttactagagcctgtcaaatgtattcttacaattcatgtcatcttgttaatagcaggacttcaaagtctttgcatatttagagctgagttttgctgagactgtggccattcctaatgaggtttcctcattccatatatataatagctaacccttaaagccattaactaatgaatgcatttattaagctatccactcgcatggtaccctgctgtggtgatgagcagtaactttctagctattccatagcccaacatcaaaggaaatcgtgactcgtcctactagaagtgtagtgtctttgtgtttgttgtgtagtgtcctgtgatcaatataaaatctatattatcagtgttgggttttcaggggagggagggagaggatgttaaagtctctctttgataaacttaaattatgaaatagcccagttgttcagggtcacttctattgactcaatttgtgtgagactttgcactcactatctcgccggccggactgcatgcccagggtcagtagtcagcagagctaaaggtgcccgaatttagcacagctggctgtggtgcctgacatagggcagtaccgggggattcttcagaggtcagccaagtcggtaacattctgtgaagcagattaaatacagtaaaatcaaacaaacggaggtctttggaagtgatgctgggcccaggcagtgaaaatcaagaaaagaggagaaagaccaagacctggatgtcctggacgacctgacccaaaaaggggcacaaagcagcagagcttcaccaggtgactgggtggcttctttgtcctcattaaatgtacatctttgcatgaaaaggaccttgactggtccggactttaacaaagtaaaatatgaagaaacgtaaaattatgcttctgaaaaatatactgaaataaaattttgtaaatagctaaaagaaaaataaataaatataataacaa

SEQ ID NO: 11835 - DNA, 3222 bp, Homo sapiens
cggagcctagggaagcaaattctcctggcggcctccgttcagacgcggcagctgtgacccacctgcctcctccgcagagcaatggcggtgtctgccgggtccgcgcggacctcgcccagctcagataaagtacagaaagacaaggctgaactgatctcagggcccaggcaggacagccgaatagggaaactcttgggttttgagtggacagatttgtccagttggcggaggctggtgaccctgctgaatcgaccaacggaccctgcaagcttagctgtctttcgttttctttttgggttcttgatggtgctagacattccccaggagcgggggctcagctctctggaccggaaataccttgatgggctggatgtgtgccgcttccccttgctggatgccctacgcccactgccacttgactggatgtatcttgtctacaccatcatgtttctgggggcactgggcatgatgctgggcctgtgctaccggataagctgtgtgttattcctgctgccatactggtatgtgtttctcctggacaagacatcatggaacaaccactcctatctgtatgggttgttggcctttcagctaacattcatggatgcaaaccactactggtctgtggacggtctgctgaatgcccataggaggaatgcccacgtgcccctttggaactatgcagtgctccgtggccagatcttcattgtgtacttcattgcgggtgtgaaaaagctggatgcagactgggttgaaggctattccatggaatatttgtcccggcactggctcttcagtcccttcaaactgctgttgtctgaggagctgactagcctgctggtcgtgcactggggtgggctgctgcttgacctctcagctggtttcctgctcttttttgatgtctcaagatccattggactgttctttgtgtcctacttccactgcatgaattcccagcttttcagcattggtatgttctcctacgtcatgctggccagcagccctctcttctgctcccctgagtggcctcggaagctggtgtcctactgcccccgaaggttgcaacaactgttgcccctcaaggcagcccctcagcccagtgtttcctgtgtgtataagaggagccggggcaaaagtggccagaagccagggctgcgccatcagctgggagctgccttcaccctgctctacctcctggagcagctattcctgccctattctcattttctcacccagggctataacaactggacaaatgggctgtatggctattcctgggacatgatggtgcactcccgctcccaccagcacgtgaagatcacctaccgtgatggccgcactggcgaactgggctaccttaaccctggggtatttacacagagtcggcgatggaaggatcatgcagacatgctgaagcaatatgccacttgcctgagccgcctgcttcccaagtataatgtcactgagccccagatctactttgatatttgggtctccatcaatgaccgcttccagcagaggatttttgaccctcgtgtggacatcgtgcaggccgcttggtcaccctttcagcgcacatcctgggtgcaaccactcttgatggacctgtctccctggagggccaagttacaggaaatcaagagcagcctagacaaccacactgaggtggtcttcattgcagatttccctggactgcacttggagaattttgtgagtgaagacctgggcaacactagcatccagctgctgcagggggaagtgactgtggagcttgtggcagaacagaagaaccagactcttcgagagggagaaaaaatgcagttgcctgctggtgagtaccataaggtgtatacgacatcacctagcccttcttgctacatgtacgtctatgtcaacactacagagcttgcactggagcaagacctggcatatctgcaagaattaaaggaaaaggtggagaatggaagtgaaacagggcctctacccccagagctgcagcctctgttggaaggggaagtaaaagggggccctgagccaacacctctggttcagacctttcttagacgccaacaaaggctccaggagattgaacgccggcgaaatactcctttccatgagcgattcttccgcttcttgttgcgaaagctctatgtctttcgccgcagcttcctgatgacttgtatctcacttcgaaatctgatattaggccgtccttccctggagcagctggcccaggaggtgacttatgcaaacttgagaccctttgaggcagttggagaactgaatccctcaaacacggattcttcacattctaatcctcctgagtcaaatcctgatcctgtccactcagagttctgaagggggccagatgttgggtgcagatgtagaagcagccagtcacagacccattctatgcaatggacatttatttgaaaaaaattctcaaaagttttttttttttttttgggggggcggggttctaaagctgtttttaactccgagattacaacttagaggaaccaaggaaataaagcaaataagatttaacaacccaagattaagaggccaggaagaggttagacgcaatgtgaaactgtcctcctaggataaggtttaaagtggctttttgggggctgggtgccgtggctcacgcctgtaatcccagcattttgggaggctgaggtgggcagatcacttgaggccaggagttcgagaccagcctggccaacatggcaaaaccccttctctactaaaaatacaaaaattagccagacgtggtggtgggtgcctgtaatccaactacccaggaggctgaggcatgagaatcgcttgggcccaggaggtggaggttgcagtgagccgagatcgagccactgcactcctgggcaacagagcaagacttcgtctcaaaataaataaataaagtggctcttggggaaaagcaatttaatgtaccacgatgaatagctaactgttcccaagtgtttgctatgtgcaacacaccgcgtgagcagtgttacctgcattattacattaggctgagaggtaaaataatttgcccgaagacatacagctagtgacgaatggactgatggtttgaacttaacgtctatttgacttaaggtcctgcaccctgccacttgtaattttcagaatcactgataatctgaaataatgcagcttaaaacatgttttcttaattaaaagtataattggatggtg

SEQ ID NO: 11836 - DNA, 2314 bp, Homo sapiens
acagccgctgacgcgtcgggaggcggagcctagggaagcaaattctcctggcggcctccgttcagacgcggcagctgtgacccacctgcctcctccgcagagcaatggcggtgtctgccgggtccgcgcggacctcgcccagctcagggttcttgatggtgctagacattccccaggagcgggggctcagctctctggaccggaaataccttgatgggctggatgtgtgccgcttccccttgctggatgccctacgcccactgccacttgactggatgtatcttgtctacaccatcatgtttctgggggcactgggcatgatgctgggcctgtgctaccggataagctgtgtgttattcctgctgccatactggtatgtgtttctcctggacaagacatcatggaacaaccactcctatctgtatgggttgttggcctttcagctaacattcatggatgcaaaccactactggtctgtggacggtctgctgaatgcccataggaggaatgcccacgtgcccctttggaactatgcagtgctccgtggccagatcttcattgtgtacttcattgcgggtgtgaaaaagctggatgcagactgggttgaaggctattccatggaatatttgtcccggcactggctcttcagtcccttcaaactgctgttgtctgaggagctgactagcctgctggtcgtgcactggggtgggctgctgcttgacctctcagctggtttcctgctcttttttgatgtctcaagatccattggactgttctttgtgtcctacttccactgcatgaattcccagcttttcagcattggtatgttctcctacgtcatgctggccagcagccctctcttctgctcccctgagtggcctcggaagctggtgtcctactgcccccgaaggttgcaacaactgttgcccctcaaggcagcccctcagcccagtgtttcctgtgtgtataagaggagccggggcaaaagtggccagaagccagggctgcgccatcagctgggagctgccttcaccctgctctacctcctggagcagctattcctgccctattctcattttctcacccagggctataacaactggacaaatgggctgtatggctattcctgggacatgatggtgcactcccgctcccaccagcacgtgaagatcacctaccgtgatggccgcactggcgaactgggctaccttaaccctggggtatttacacagagtcggcgatggaaggatcatgcagacatgctgaagcaatatgccacttgcctgagccgcctgcttcccaagtataatgtcactgagccccagatctactttgatatttgggtctccatcaatgaccgcttccagcagaggatttttgaccctcgtgtggacatcgtgcaggccgcttggtcaccctttcagcgcacatcctgggtgcaaccactcttgatggacctgtctccctggagggccaagttacaggaaatcaagagcagcctagacaaccacactgaggtggtcttcattgcagatttccctggactgcacttggagaattttgtgagtgaagacctgggcaacactagcatccagctgctgcagggggaagtgactgtggagcttgtggcagaacagaagaaccagactcttcgagagggagaaaaaatgcagttgcctgctggtgagtaccataaggtgtatacgacatcacctagcccttcttgctacatgtacgtctatgtcaacactacagagcttgcactggagcaagacctggcatatctgcaagaattaaaggaaaaggtggagaatggaagtgaaacagggcctctacccccagagctgcagcctctgttggaaggggaagtaaaagggggccctgagccaacacctctggttcagacctttcttagacgccaacaaaggctccaggagattgaacgccggcgaaatactcctttccatgagcgattcttccgcttcttgttgcgaaagctctatgtctttcgccgcagcttcctgatgacttgtatctcacttcgaaatctgatattaggccgtccttccctggagcagctggcccaggaggtgacttatgcaaacttgagaccctttgaggcagttggagaactgaatccctcaaacacggattcttcacattctaatcctcctgagtcaaatcctgatcctgtccactcagagttctgaagggggccagatgttgggtgcagatgtagaagcagccagtcacagacccattctatgcaatggacatttatttgaaaaaaattctcaaaagttttttttttttt

SEQ ID NO: 11837 - DNA, 1607 bp, Homo sapiens
tcccctctcgaggacctgggttggccagcccagctttgtacgggtgactgaagtccacatcgacgtaacagttgaaagggaaggacgcggagaccacccggtacccgccccaggcgtttccagagtctccgcttaggcggcccgtgggggtcggggtcgcggtcgcggtcgcggaccggggacagagcaatggggcgggcgcgcagcgccggctgcactcccagagcctcccaccgccgccccacggccgcctagcgcgcgccgggactgcatttcccataggcccacgctgcggagcaccgcccacccgagtctcacgcgagtgcgctgccgcgaggtgtccctgccgcagcccccgcccgcccgcagagcttttgaaaggcggcgggaggcggcgagcgccatggccagtccgggctgcctgctgtgcgtgctgggcctgctactctgcggggcggcgagcctcgagctgtctagaccccacggcgacaccgccaagaagcccatcatcggaatattaatgcaaaaatgccgtaataaagtcatgaaaaactatggaagatactatattgctgcgtcctatgtaaagtacttggagtctgcaggtgcgagagttgtaccagtaaggctggatcttacagagaaagactatgaaatacttttcaaatctattaatggaatccttttccctggaggaagtgttgacctcagacgctcagattatgctaaagtggccaaaatattttataacttgtccatacagagttttgatgatggagactattttcctgtgtggggcacatgccttggatttgaagagctttcactgctgattagtggagagtgcttattaactgccacagatactgttgacgtggcaatgccgctgaacttcactggaggtcaattgcacagcagaatgttccagaattttcctactgagttgttgctgtcattagcagtagaacctctgactgccaatttccataagtggagcctctccgtgaagaattttacaatgaatgaaaagttaaagaagtttttcaatgtcttaactacaaatacagatggcaagattgagtttatttcaacaatggaaggatataagtatccagtatatggtgtccagtggcatccagagaaagcaccttatgagtggaagaatttggatggcatttcccatgcacctaatgctgtgaaaaccgcattttatttagcagagttttttgttaatgaagctcggaaaaacaaccatcattttaaatctgaatctgaagaggagaaagcattgatttatcagttcagtccaatttatactggaaatatttcttcatttcagcaatgttacatatttgattgaaagtcttcaatttgttaacagagcaaatttgaataattccatgattaaactgttagaataacttgctactcatggcaagattaggaagtcacagattcttttctataatgtgcctggctctgattcttcattctgtatgtgactatttatataacattagataattaaatagtgagacataaatagagtgtttttcatggaaaagccttcttatatctgaagattgaaaaaaataaatttactgaaa

SEQ ID NO: 11838 - DNA, 993 bp, Homo sapiens
ggtcactgcgccggggtagtgggccccagtgttgcgctctctggccgttccttacactctgcttcaggctccagtgcaggggcgtagtgggatatggccaactcgggctgcaaggacgtcacgggtccagatgaggagagttttctgtactttgcctacggcagcaacctgctgacagagaggatccacctccgaaacccctcggcggcgttcttctgtgtggcccgcctgcaggattttaagcttgactttggcaattcccaaggcaaaacaagtcaaacttggcatggagggatagccaccatttttcagagtcctggcgatgaagtgtggggagtagtatggaaaatgaacaaaagcaatttaaattctctggatgaattatttgcatgggtgcaaaagaaaatggtttgccgctggagtatcaagagaagttaaaagcaatagaaccaaatgactatacaggaaaggtctcagaagaaattgaagacatcatcaaaaagggggaaacacaaactctttagaacataacagaatatatctaagggtattctatgtgctaatataaaatatttttaacacttgagaacagggatctgggggatctccacgtttgatccattttcagcagtgctctgaaggagtatcttacttgggtgattccttgtttttagactataaaaagaaactgggataggagttagacaatttaaaaggggtgtatgagggcctgaaatatgtgacaaatgaatgtgagtaccccttctgtgaacactgaaagctattctcttgaattgatcttaagtgtctccttgctctggtaaaagatagatttgtagctcacttgatgatggtgctggtgaattgctctgctctgtctgagatttttaaaaatcagcttaatgagagtaatctgcagacaattgataataacattttgaaaattggaaagatggtatactgtttttagaggaataaacgtatttgtggttt

SEQ ID NO: 11839 - DNA, 1173 bp, Homo sapiens
acgcttcccgccagtcccctaaccctgaggctgccgcgcggcggtcactgcgccggggtagtgggccccagtgttgcgctctctggccgttccttacactctgcttcaggctccagtgcaggggcgtagtgggatatggccaactcgggctgcaaggacgtcacgggtccagatgaggagagttttctgtactttgcctacggcagcaacctgctgacagagaggatccacctccgaaacccctcggcggcgttcttctgtgtggcccgcctgcaggattttaagcttgactttggcaattcccaaggcaaaacaagtcaaacttggcatggagggatagccaccatttttcagagtcctggcgatgaagtgtggggagtagtatggaaaatgaacaaaagcaatttaaattctctggatgagcaagaaggggttaaaagtggaatgtatgttgtaatagaagttaaagttgcaactcaagaaggaaaagaaataacctgtcgaagttatctgatgacaaattacgaaagtgctcccccatccccacagtataaaaagattatttgcatgggtgcaaaagaaaatggtttgccgctggagtatcaagagaagttaaaagcaatagaaccaaatgactatacaggaaaggtctcagaagaaattgaagacatcatcaaaaagggggaaacacaaactctttagaacataacagaatatatctaagggtattctatgtgctaatataaaatatttttaacacttgagaacagggatctgggggatctccacgtttgatccattttcagcagtgctctgaaggagtatcttacttgggtgattccttgtttttagactataaaaagaaactgggataggagttagacaatttaaaaggggtgtatgagggcctgaaatatgtgacaaatgaatgtgagtaccccttctgtgaacactgaaagctattctcttgaattgatcttaagtgtctccttgctctggtaaaagatagatttgtagctcacttgatgatggtgctggtgaattgctctgctctgtctgagatttttaaaaatcagcttaatgagagtaatctgcagacaattgataataacattttgaaaattggaaagatggtatactgtttttagaggaataaacgtatttgtggtttaa

SEQ ID NO: 11840 - DNA, 1645 bp, Homo sapiens
actttacctcacttgtgaaggagaaagagccatcctctctacctttgttctaggtggatattctcttgctgtcagaacaccatccatttttgtagcccaaagaacaatgtttccatagtataaagttgaaaaaaaaaacaaactatattgaagcctctttaaagacaagataaatacagagagttatgttaggagtataacaagtaatattatgtctcaggccttctaattgaaatgctaagctaagcttacttttttttttttgtaacggagtctcgctcttgttgcccaggctagagtgcaatggcgtgatctcggctcaccccaacctctgcctcccgggttccagtgattctcccgcctcagcctcccgagtagctgggattacaggcatgcaccaccatgtcggactaattttttgtgtgttttttttttagtagagacaaggtttctccatgttggtcaggctggcctcgaactcctgacctcagatgatccacccacctcggcctcccaaagtgctaggattacaggtgtgagccactgcacccggcctttttttttttctttttgagatggagtcttgctgtctcccagcctggattgccacagtgcaatctcggctcactgcaacctccacctcccgtgatccacctcagcctcccaaagtgctgggattacagatgtgagccaccgtacccagcctaaatgctaagcttacttttgatgtggtaaatttatatattctctatcccaaatacatagggagcaagtatgttcagatgtagttaaatgtttaatcccatacaccatcttgactattataaaaagaccttacccagtgagctaaattggctaggtcaaatgtggttaaaatttggctgttctggtttcaggcaagaaggggttaaaagtggaatgtatgttgtaatagaagttaaagttgcaactcaagaaggaaaagaaataacctgtcgaagttatctgatgacaaattacgaaagtgctcccccatccccacagtataaaaagattatttgcatgggtgcaaaagaaaatggtttgccgctggagtatcaagagaagttaaaagcaatagaaccaaatgactatacaggaaaggtctcagaagaaattgaagacatcatcaaaaagggggaaacacaaactctttagaacataacagaatatatctaagggtattctatgtgctaatataaaatatttttaacacttgagaacagggatctgggggatctccacgtttgatccattttcagcagtgctctgaaggagtatcttacttgggtgattccttgtttttagactataaaaagaaactgggataggagttagacaatttaaaaggggtgtatgagggcctgaaatatgtgacaaatgaatgtgagtaccccttctgtgaacactgaaagctattctcttgaattgatcttaagtgtctccttgctctggtaaaagatagatttgtagctcacttgatgatggtgctggtgaattgctctgctctgtctgagatttttaaaaatcagcttaatgagagtaatctgcagacaattgataataacattttgaaaattggaaagatggtatactgtttttagaggaataaacgtatttgtggttt

SEQ ID NO: 11841 - DNA, 836 bp, Homo sapiens
gtcactgcgccggggtagtgggccccagtgttgcgctctctggccgttccttacactctgcttcaggctccagtgcaggggcgtagtgggatatggccaactcgggctgcaaggacgtcacgggtccagatgaggagagttttctgtactttgcctacggcagcaacctgctgacagagaggatccacctccgaaacccctcggcggcgttcttctgtgtggcccgcctgcagattatttgcatgggtgcaaaagaaaatggtttgccgctggagtatcaagagaagttaaaagcaatagaaccaaatgactatacaggaaaggtctcagaagaaattgaagacatcatcaaaaagggggaaacacaaactctttagaacataacagaatatatctaagggtattctatgtgctaatataaaatatttttaacacttgagaacagggatctgggggatctccacgtttgatccattttcagcagtgctctgaaggagtatcttacttgggtgattccttgtttttagactataaaaagaaactgggataggagttagacaatttaaaaggggtgtatgagggcctgaaatatgtgacaaatgaatgtgagtaccccttctgtgaacactgaaagctattctcttgaattgatcttaagtgtctccttgctctggtaaaagatagatttgtagctcacttgatgatggtgctggtgaattgctctgctctgtctgagatttttaaaaatcagcttaatgagagtaatctgcagacaattgataataacattttgaaaattggaaagatggtatactgtttttagaggaataaacgta

SEQ ID NO: 11842 - DNA, 767 bp, Homo sapiens
cactgcgccggggtagtgggccccagtgttgcgctctctggccgttccttacactctgcttcaggctccagtgcaggggcgtagtgggatatggccaactcgggctgcaaggacgtcacgggtccagatgaggagagttttctgtactttgcctacggcagcaacctgctgacagagaggatccacctccgaaacccctcggcggcgttcttctgtgtggcccgcctgcaggattttaagcttgactttggcaattcccaaggcaaaacaagtcaaacttggcatggagggatagccaccatttttcagagtcctggcgatgaagtgtggggagtagtatggaaaatgaacaaaagcaatttaaattctctggatgagtggagaaagaaacgtcacactgcctttcagaatcagggaaatcacccttgcaagcacaagacaagaatgtgggatagagaccccaaaattcctgttcagaacctaagcttagctctctgttggcaggcccaatcaggtcatggcacctgtaatagattatttgcatgggtgcaaaagaaaatggtttgccgctggagtatcaagagaagttaaaagcaatagaaccaaatgactatacaggaaaggtctcagaagaaattgaagacatcatcaaaaagggggaaacacaaactctttagaacataacagaatatatctaagggtattctatgtgctaatataaaatatttttaacacttgagaacagggatctgggggatctccacgtt

SEQ ID NO: 11843 - DNA, 2326 bp, Homo sapiens
gcctggattctcccagagattgcctggaacaccagctcgggtcctcgcacaccatcctgcgggtgcagcccagaactgtcttctgaggaagaggtgctctcctgggcccccactgtccccaggcctcagcaaggcaagtgaggtgctgccgtcatccaggctggacagttcagtgatttgcctgaggccccacagcagagttcaactggagacagagaaaccagctagaggcagagggaggtaacacggagtcccccagaaaggtctgggctgcgcgtgcttcaggtaacctcccttgaccttcaggagaacgagaaggctgcctgatcagagagtccctgaagaagattctgtggctacaggcttcagcagagtgtgagggagaccccggttatttcctcagctatttccaccaaatcctcctgtctttcgtggccaacaccccaggcaaggcttggggcccccgtctgctgctggacgcagagccatgaagaagaagttagtggtgctgggcctgctggccgtggtcctggtgctggtcattgtcggcctctgtctctggctgccctcagcctccaaggaacctgacaaccatgtgtacaccagggctgccgtggccgcggatgccaagcagtgctcgaagattgggagggatgcactgcgggacggtggctctgcggtggatgcagccattgcagccctgttgtgtgtggggctcatgaatgcccacagcatgggcatcgggggtggcctcttcctcaccatctacaacagcaccacacgaaaagctgaggtcatcaacgcccgcgaggtggcccccaggctggcctttgccaccatgttcaacagctcggagcagtcccagaagggggggctgtcggtggcggtgcctggggagatccgaggctatgagctggcacaccagcggcatgggcggctgccctgggctcgcctcttccagcccagcatccagctggcccgccagggcttccccgtgggcaagggcttggcggcagccctggaaaacaagcggaccgtcatcgagcagcagcctgtcttgtgtgaggtgttctgccgggatagaaaggtgcttcgggagggggagagactgaccctgccgcagctggctgacacctacgagacgctggccatcgagggtgcccaggccttctacaacggcagcctcacggcccagattgtgaaggacatccaggcggccgggggcattgtgacagctgaggacctgaacaactaccgtgctgagctgatcgagcacccgctgaacatcagcctgggagacgtggtgctgtacatgcccagtgcgccgctcagcgggcccgtgctggccctcatcctcaacatcctcaaagggtacaacttctcccgggagagcgtggagagccccgagcagaagggcctgacgtaccaccgcatcgtagaggctttccggtttgcctacgccaagaggaccctgcttggggaccccaagtttgtggatgtgactgaggtggtccgcaacatgacctccgagttcttcgctgcccagctccgggcccagatctctgacgacaccactcacccgatctcctactacaagcccgagttctacacgccggatgacgggggcactgctcacctgtctgtcgtcgcagaggacggcagtgctgtgtccgccaccagcaccatcaacctctactttggctccaaggtccgctccccggtcagcgggatcctgttcaataatgaaatggacgacttcagctctcccagcatcaccaacgagtttggggtacccccctcacctgccaatttcatccagccagggaagcagccgctctcgtccatgtgcccgacgatcatggtgggccaggacggccaggtccggatggtggtgggagctgctgggggcacacagatcaccacggccactgcactggccatcatctacaacctctggttcggctatgacgtgaagcgggccgtggaggagccccggctgcacaaccagcttctgcccaacgtcacgacagtggagagaaacattgaccaggcagtgactgcagccctggagacccggcaccatcacacccagatcgcgtccaccttcatcgctgtggtgcaagccatcgtccgcacggctggtggctgggcagctgcctcggactccaggaaaggcggggagcctgccggctactgagtgctccaggaggacaaggctgacaagcaatccagggacaagatactcaccaggaccaggaaggggactctgggggaccggcttcccctgtgagcagcagagcagcacaataaatgaggccactgtgcc

SEQ ID NO: 11844 - DNA, 2540 bp, Homo sapiens
cagaccgggcgtcgggtgagcccagaagtgagagcagttggctgtgccccagtgctgtgtgacccagaggcgccgctcaccctctctgagctggtggacatcatagcgggtgcagcccagaactgtcttctgaggaagaggtgctctcctgggcccccactgtccccaggcctcagatgctgcatattgctggcccagctcctgaggctctttggacctccaggaatcggtgtctctatcaggaacccttaaccctgacccggactcccagctgggacccggggtgtcggagtggcaagagcgctgtcaggcctggtgaagggtgtgagctgtccaacggggcagggaggaggcagggcctgttctgcagttggacagacagagccctctagctgctttctggaagactgaagggcagcaaggcaagtgaggtgctgccgtcatccaggctggacagttcagtgatttgcctgaggccccacagcaggagaacgagaaggctgcctgatcagagagtccctgaagaagattctgtggctacaggcttcagcagagtgtgagggagaccccggttatttcctcagctatttccaccaaatcctcctgtctttcgtggccaacaccccaggcaaggcttggggcccccgtctgctgctggacgcagagccatgaagaagaagttagtggtgctgggcctgctggccgtggtcctggtgctggtcattgtcggcctctgtctctggctgccctcagcctccaaggaacctgacaaccatgtgtacaccagggctgccgtggccgcggatgccaagcagtgctcgaagattgggagggatgcactgcgggacggtggctctgcggtggatgcagccattgcagccctgttgtgtgtggggctcatgaatgcccacagcatgggcatcgggggtggcctcttcctcaccatctacaacagcaccacacgaaaagctgaggtcatcaacgcccgcgaggtggcccccaggctggcctttgccaccatgttcaacagctcggagcagtcccagaagggggggctgtcggtggcggtgcctggggagatccgaggctatgagctggcacaccagcggcatgggcggctgccctgggctcgcctcttccagcccagcatccagctggcccgccagggcttccccgtgggcaagggcttggcggcagccctggaaaacaagcggaccgtcatcgagcagcagcctgtcttgtgtgaggtgttctgccgggatagaaaggtgcttcgggagggggagagactgaccctgccgcagctggctgacacctacgagacgctggccatcgagggtgcccaggccttctacaacggcagcctcacggcccagattgtgaaggacatccaggcggccgggggcattgtgacagctgaggacctgaacaactaccgtgctgagctgatcgagcacccgctgaacatcagcctgggagacgtggtgctgtacatgcccagtgcgccgctcagcgggcccgtgctggccctcatcctcaacatcctcaaagggtacaacttctcccgggagagcgtggagagccccgagcagaagggcctgacgtaccaccgcatcgtagaggctttccggtttgcctacgccaagaggaccctgcttggggaccccaagtttgtggatgtgactgaggtggtccgcaacatgacctccgagttcttcgctgcccagctccgggcccagatctctgacgacaccactcacccgatctcctactacaagcccgagttctacacgccggatgacgggggcactgctcacctgtctgtcgtcgcagaggacggcagtgctgtgtccgccaccagcaccatcaacctctactttggctccaaggtccgctccccggtcagcgggatcctgttcaataatgaaatggacgacttcagctctcccagcatcaccaacgagtttggggtacccccctcacctgccaatttcatccagccagggaagcagccgctctcgtccatgtgcccgacgatcatggtgggccaggacggccaggtccggatggtggtgggagctgctgggggcacacagatcaccacggccactgcactggccatcatctacaacctctggttcggctatgacgtgaagcgggccgtggaggagccccggctgcacaaccagcttctgcccaacgtcacgacagtggagagaaacattgaccaggcagtgactgcagccctggagacccggcaccatcacacccagatcgcgtccaccttcatcgctgtggtgcaagccatcgtccgcacggctggtggctgggcagctgcctcggactccaggaaaggcggggagcctgccggctactgagtgctccaggaggacaaggctgacaagcaatccagggacaagatactcaccaggaccaggaaggggactctgggggaccggcttcccctgtgagcagcagagcagcacaataaatgaggccactgtgccaggctccaggtggcctccctggcctgtctcccc

SEQ ID NO: 11845 - DNA, 2628 bp, Homo sapiens
gtgctgctggatgaccagaccgggcgtcgggtgagcccagaagtgagagcagttggctgtgccccagtgctgtgtgacccagaggcgccgctcaccctctctgagctggtggacatcataggtggggaagctcaggtcagggcactcccatgagtgtctggaggcctgagtcccattctcagctctgccatatgcttgctgcgctctagaggagttcctcttcctctccaagcctcggtttatgtacccgtgcagtgggagtgagttgcacttcggggtgaagggggcaagacttgtgtgggcgcatcctgcagaaggatcccacagcgggtgcagcccagaactgtcttctgaggaagaggtgctctcctgggcccccactgtccccaggcctcagcaaggcaagtgaggtgctgccgtcatccaggctggacagttcagtgatttgcctgaggccccacagcagagttcaactggagacagagaaaccagctagaggcagagggaggtaacacggagtcccccagaaaggtctgggctgcgcgtgcttcaggtaacctcccttgaccttcaggagaacgagaaggctgcctgatcagagagtccctgaagaagattctgtggctacaggcttcagcagagtgtgagggagaccccggttatttcctcagctatttccaccaaatcctcctgtctttcgtggccaacaccccaggcaaggcttggggcccccgtctgctgctggacgcagagccatgaagaagaagttagtggtgctgggcctgctggccgtggtcctggtgctggtcattgtcggcctctgtctctggctgccctcagcctccaaggaacctgacaaccatgtgtacaccagggctgccgtggccgcggatgccaagcagtgctcgaagattgggagggatgcactgcgggacggtggctctgcggtggatgcagccattgcagccctgttgtgtgtggggctcatgaatgcccacagcatgggcatcgggggtggcctcttcctcaccatctacaacagcaccacacgaaaagctgaggtcatcaacgcccgcgaggtggcccccaggctggcctttgccaccatgttcaacagctcggagcagtcccagaagggggggctgtcggtggcggtgcctggggagatccgaggctatgagctggcacaccagcggcatgggcggctgccctgggctcgcctcttccagcccagcatccagctggcccgccagggcttccccgtgggcaagggcttggcggcagccctggaaaacaagcggaccgtcatcgagcagcagcctgtcttgtgtgaggtgttctgccgggatagaaaggtgcttcgggagggggagagactgaccctgccgcagctggctgacacctacgagacgctggccatcgagggtgcccaggccttctacaacggcagcctcacggcccagattgtgaaggacatccaggcggccgggggcattgtgacagctgaggacctgaacaactaccgtgctgagctgatcgagcacccgctgaacatcagcctgggagacgtggtgctgtacatgcccagtgcgccgctcagcgggcccgtgctggccctcatcctcaacatcctcaaagggtacaacttctcccgggagagcgtggagagccccgagcagaagggcctgacgtaccaccgcatcgtagaggctttccggtttgcctacgccaagaggaccctgcttggggaccccaagtttgtggatgtgactgaggtggtccgcaacatgacctccgagttcttcgctgcccagctccgggcccagatctctgacgacaccactcacccgatctcctactacaagcccgagttctacacgccggatgacgggggcactgctcacctgtctgtcgtcgcagaggacggcagtgctgtgtccgccaccagcaccatcaacctctactttggctccaaggtccgctccccggtcagcgggatcctgttcaataatgaaatggacgacttcagctctcccagcatcaccaacgagtttggggtacccccctcacctgccaatttcatccagccagggaagcagccgctctcgtccatgtgcccgacgatcatggtgggccaggacggccaggtccggatggtggtgggagctgctgggggcacacagatcaccacggccactgcactggccatcatctacaacctctggttcggctatgacgtgaagcgggccgtggaggagccccggctgcacaaccagcttctgcccaacgtcacgacagtggagagaaacattgaccaggcagtgactgcagccctggagacccggcaccatcacacccagatcgcgtccaccttcatcgctgtggtgcaagccatcgtccgcacggctggtggctgggcagctgcctcggactccaggaaaggcggggagcctgccggctactgagtgctccaggaggacaaggctgacaagcaatccagggacaagatactcaccaggaccaggaaggggactctgggggaccggcttcccctgtgagcagcagagcagcacaataaatgaggccactgtgccaggctccaggtggcctccctggcctgtctcccca

SEQ ID NO: 11846 - DNA, 2413 bp, Homo sapiens
gaccagaccgggcgtcgggtgagcccagaagtgagagcagttggctgtgccccagtgctgtgtgacccagaggcgccgctcaccctctctgagctggtggacatcatagcgggtgcagcccagaactgtcttctgaggaagaggtgctctcctgggcccccactgtccccaggcctcagcaaggcaagtgaggtgctgccgtcatccaggctggacagttcagtgatttgcctgaggccccacagcagagttcaactggagacagagaaaccagctagaggcagagggaggtaacacggagtcccccagaaaggtctgggctgcgcgtgcttcaggtaacctcccttgaccttcaggagaacgagaaggctgcctgatcagagagtccctgaagaagattctgtggctacaggcttcagcagagtgtgagggagaccccggttatttcctcagctatttccaccaaatcctcctgtctttcgtggccaacaccccaggcaaggcttggggcccccgtctgctgctggacgcagagccatgaagaagaagttagtggtgctgggcctgctggccgtggtcctggtgctggtcattgtcggcctctgtctctggctgccctcagcctccaaggaacctgacaaccatgtgtacaccagggctgccgtggccgcggatgccaagcagtgctcgaagattgggagggatgcactgcgggacggtggctctgcggtggatgcagccattgcagccctgttgtgtgtggggctcatgaatgcccacagcatgggcatcgggggtggcctcttcctcaccatctacaacagcaccacacgaaaagctgaggtcatcaacgcccgcgaggtggcccccaggctggcctttgccaccatgttcaacagctcggagcagtcccagaagggggggctgtcggtggcggtgcctggggagatccgaggctatgagctggcacaccagcggcatgggcggctgccctgggctcgcctcttccagcccagcatccagctggcccgccagggcttccccgtgggcaagggcttggcggcagccctggaaaacaagcggaccgtcatcgagcagcagcctgtcttgtgtgaggtgttctgccgggatagaaaggtgcttcgggagggggagagactgaccctgccgcagctggctgacacctacgagacgctggccatcgagggtgcccaggccttctacaacggcagcctcacggcccagattgtgaaggacatccaggcggccgggggcattgtgacagctgaggacctgaacaactaccgtgctgagctgatcgagcacccgctgaacatcagcctgggagacgtggtgctgtacatgcccagtgcgccgctcagcgggcccgtgctggccctcatcctcaacatcctcaaagggtacaacttctcccgggagagcgtggagagccccgagcagaagggcctgacgtaccaccgcatcgtagaggctttccggtttgcctacgccaagaggaccctgcttggggaccccaagtttgtggatgtgactgaggtggtccgcaacatgacctccgagttcttcgctgcccagctccgggcccagatctctgacgacaccactcacccgatctcctactacaagcccgagttctacacgccggatgacgggggcactgctcacctgtctgtcgtcgcagaggacggcagtgctgtgtccgccaccagcaccatcaacctctactttggctccaaggtccgctccccggtcagcgggatcctgttcaataatgaaatggacgacttcagctctcccagcatcaccaacgagtttggggtacccccctcacctgccaatttcatccagccagggaagcagccgctctcgtccatgtgcccgacgatcatggtgggccaggacggccaggtccggatggtggtgggagctgctgggggcacacagatcaccacggccactgcactggccatcatctacaacctctggttcggctatgacgtgaagcgggccgtggaggagccccggctgcacaaccagcttctgcccaacgtcacgacagtggagagaaacattgaccaggcagtgactgcagccctggagacccggcaccatcacacccagatcgcgtccaccttcatcgctgtggtgcaagccatcgtccgcacggctggtggctgggcagctgcctcggactccaggaaaggcggggagcctgccggctactgagtgctccaggaggacaaggctgacaagcaatccagggacaagatactcaccaggaccaggaaggggactctgggggaccggcttcccctgtgagcagcagagcagcacaataaatgaggccactgtgccaggctccaggtggcctccctggcctgtctccccactc

SEQ ID NO: 11847 - DNA, 968 bp, Homo sapiens
attgaatgcagcaagggtctggaggctgaggaccaggcagacagacattcagagttgctggaacgcgacagagacagggagtcagactggtcatgcaaggccagctctggggtctcggcaggtggtccgcaacatgacctccgagttcttcgctgcccagctccgggcccagatctctgacgacaccactcacccgatctcctactacaagcccgagttctacacgccggatgacgggggcactgctcacctgtctgtcgtcgcagaggacggcagtgctgtgtccgccaccagcaccatcaacctctactttggctccaaggtccgctccccggtcagcgggatcctgttcaataatgaaatggacgacttcagctctcccagcatcaccaacgagtttggggtacccccctcacctgccaatttcatccagccagggaagcagccgctctcgtccatgtgcccgacgatcatggtgggccaggacggccaggtccggatggtggtgggagctgctgggggcacacagatcaccacggccactgcactggccatcatctacaacctctggttcggctatgacgtgaagcgggccgtggaggagccccggctgcacaaccagcttctgcccaacgtcacgacagtggagagaaacattgaccaggcagtgactgcagccctggagacccggcaccatcacacccagatcgcgtccaccttcatcgctgtggtgcaagccatcgtccgcacggctggtggctgggcagctgcctcggactccaggaaaggcggggagcctgccggctactgagtgctccaggaggacaaggctgacaagcaatccagggacaagatactcaccaggaccaggaaggggactctgggggaccggcttcccctgtgagcagcagagcagcacaataaatgaggccactgtgccaggctccaggtggcctccctggcctgtc

SEQ ID NO: 11848 - DNA, 1033 bp, Homo sapiens
agggagtcagactggtcatgcaaggtcctgggcctgcccttgggtcctggggagccacggaaggttgtgggtgccagagggttgcggtcagagtcacagtcaagggccttctgagacctgtgccccctccccaccctccctccccacctcctcaggccagctctggggtctcggcaggtggtccgcaacatgacctccgagttcttcgctgcccagctccgggcccagatctctgacgacaccactcacccgatctcctactacaagcccgagttctacacgccggatgacgggggcactgctcacctgtctgtcgtcgcagaggacggcagtgctgtgtccgccaccagcaccatcaacctctactttggctccaaggtccgctccccggtcagcgggatcctgttcaataatgaaatggacgacttcagctctcccagcatcaccaacgagtttggggtacccccctcacctgccaatttcatccagccagggaagcagccgctctcgtccatgtgcccgacgatcatggtgggccaggacggccaggtccggatggtggtgggagctgctgggggcacacagatcaccacggccactgcactggccatcatctacaacctctggttcggctatgacgtgaagcgggccgtggaggagccccggctgcacaaccagcttctgcccaacgtcacgacagtggagagaaacattgaccaggcagtgactgcagccctggagacccggcaccatcacacccagatcgcgtccaccttcatcgctgtggtgcaagccatcgtccgcacggctggtggctgggcagctgcctcggactccaggaaaggcggggagcctgccggctactgagtgctccaggaggacaaggctgacaagcaatccagggacaagatactcaccaggaccaggaaggggactctgggggaccggcttcccctgtgagcagcagagcagcacaataaatgaggccactgtgccaggctccaggtggcctccctggcctgtctccccactc

SEQ ID NO: 11849 - DNA, 853 bp, Homo sapiens
gacagggagtcagactggtcatgcaaggtggtccgcaacatgacctccgagttcttcgctgcccagctccgggcccagatctctgacgacaccactcacccgatctcctactacaagcccgagttctacacgccggatgacgggggcactgctcacctgtctgtcgtcgcagaggacggcagtgctgtgtccgccaccagcaccatcaacctctactttggctccaaggtccgctccccggtcagcgggatcctgttcaataatgaaatggacgacttcagctctcccagcatcaccaacgagtttggggtacccccctcacctgccaatttcatccagccagggaagcagccgctctcgtccatgtgcccgacgatcatggtgggccaggacggccaggtccggatggtggtgggagctgctgggggcacacagatcaccacggccactgcactggccatcatctacaacctctggttcggctatgacgtgaagcgggccgtggaggagccccggctgcacaaccagcttctgcccaacgtcacgacagtggagagaaacattgaccaggcagtgactgcagccctggagacccggcaccatcacacccagatcgcgtccaccttcatcgctgtggtgcaagccatcgtccgcacggctggtggctgggcagctgcctcggactccaggaaaggcggggagcctgccggctactgagtgctccaggaggacaaggctgacaagcaatccagggacaagatactcaccaggaccaggaaggggactctgggggaccggcttcccctgtgagcagcagagcagcacaataaatgaggccactgtgccaggctcc

SEQ ID NO: 11850 - DNA, 2375 bp, Homo sapiens
cctgcaccctgtgcagatgcctcccactgtccgccggggctgctgggcacgccctggctggtctcttggactagcgggtgcagcccagaactgtcttctgaggaagaggtgctctcctgggcccccactgtccccaggcctcagcaaggcaagtgaggtgctgccgtcatccaggctggacagttcagtgatttgcctgaggccccacagcagagttcaactggagacagagaaaccagctagaggcagagggaggtaacacggagtcccccagaaaggtctgggctgcgcgtgcttcaggtaacctcccttgaccttcaggagaacgagaaggctgcctgatcagagagtccctgaagaagattctgtggctacaggcttcagcagagtgtgagggagaccccggttatttcctcagctatttccaccaaatcctcctgtctttcgtggccaacaccccaggcaaggcttggggcccccgtctgctgctggacgagccatgaagaagaagttagtggtgctgggcctgctggccgtggtcctggtgctggtcattgtcggcctctgtctctggctgccctcagcctccaaggaacctgacaaccatgtgtacaccagggctgccgtggccgcggatgccaagcagtgctcgaagattgggagggatgcactgcgggacggtggctctgcggtggatgcagccattgcagccctgttgtgtgtggggctcatgaatgcccacagcatgggcatcgggggtggcctcttcctcaccatctacaacagcaccacacgaaaagctgaggtcatcaacgcccgcgaggtggcccccaggctggcctttgccaccatgttcaacagctcggagcagtcccagaagggggggctgtcggtggcggtgcctggggagatccgaggctatgagctggcacaccagcggcatgggcggctgccctgggctcgcctcttccagcccagcatccagctggcccgccagggcttccccgtgggcaagggcttggcggcagccctggaaaacaagcggaccgtcatcgagcagcagcctgtcttgtgtgaggtgttctgccgggatagaaaggtgcttcgggagggggagagactgaccctgccgcagctggctgacacctacgagacgctggccatcgagggtgcccaggccttctacaacggcagcctcacggcccagattgtgaaggacatccaggcggccgggggcattgtgacagctgaggacctgaacaactaccgtgctgagctgatcgagcacccgctgaacatcagcctgggagacgtggtgctgtacatgcccagtgcgccgctcagcgggcccgtgctggccctcatcctcaacatcctcaaagggtacaacttctcccgggagagcgtggagagccccgagcagaagggcctgacgtaccaccgcatcgtagaggctttccggtttgcctacgccaagaggaccctgcttggggaccccaagtttgtggatgtgactgaggtggtccgcaacatgacctccgagttcttcgctgcccagctccgggcccagatctctgacgacaccactcacccgatctcctactacaagcccgagttctacacgccggatgacgggggcactgctcacctgtctgtcgtcgcagaggacggcagtgctgtgtccgccaccagcaccatcaacctctactttggctccaaggtccgctccccggtcagcgggatcctgttcaataatgaaatggacgacttcagctctcccagcatcaccaacgagtttggggtacccccctcacctgccaatttcatccagccagggaagcagccgctctcgtccatgtgcccgacgatcatggtgggccaggacggccaggtccggatggtggtgggagctgctgggggcacacagatcaccacggccactgcactggccatcatctacaacctctggttcggctatgacgtgaagcgggccgtggaggagccccggctgcacaaccagcttctgcccaacgtcacgacagtggagagaaacattgaccaggcagtgactgcagccctggagacccggcaccatcacacccagatcgcgtccaccttcatcgctgtggtgcaagccatcgtccgcacggctggtggctgggcagctgcctcggactccaggaaaggcggggagcctgccggctactgagtgctccaggaggacaaggctgacaagcaatccagggacaagatactcaccaggaccaggaaggggactctgggggaccggcttcccctgtgagcagcagagcagcacaataaatgaggccactgtgccaggctccaggtggcctccctggcctgtctccccactc

SEQ ID NO: 11851 - DNA, 758 bp, Homo sapiens
ggtcagagctttaagctgcagctctgatgccccagggacctctcagacccccctgcccagagcaggcagcccgcgggtgcagcccagaactgtcttctgaggaagaggtgctctcctgggcccccactgtccccaggcctcagcagcaaggcaagtgaggtgctgccgtcatccaggctggacagttcagtgatttgcctgaggccccacagcaggagaacgagaaggctgcctgatcagagagtccctgaagaagattctgtggctacaggcttcagcagagtgtgagggagaccccggttatttcctcagctatttccaccaaatcctcctgtctttcgtggccaacaccccaggcaaggcttggggcccccgtctgctgctggacgcagagccatgaagaagaagttagtggtgctgggcctgctggccgtggtcctggtgctggtcattgtcggcctctgtctctggctgccctcagcctccaaggaacctgacaaccatgtgtacaccagggctgccgtggccgcggatgccaagcagtgctcgaagattgggagggatgcactgcgggacggtggctctgcggtggatgcagccattgcagccctgttgtgtgtggggctcatgaatgcccacagcatgggcatcgggggtggcctcttcctcaccatctacaacagcaccacacgaaaagctgaggtcatcaacgcccgcgaggtggcccccaggctggcctttgccaccatgttcaacag

SEQ ID NO: 11852 - DNA, 2091 bp, Homo sapiens
aggggagggaaggaggagctgggtcacagcagggaatcttagcttggttttggtgtgctgctggatgaccagaccgggcgtcgggtgagcccagaagtgagagcagttggctgtgccccagtgctgtgtgacccagaggcgccgctcaccctctctgagctggtggacatcataggtggggaagctcaggtcagggcactcccatgagtgtctggaggcctgagtcccattctcagctctgccatatgcttgctgcgctctagaggagttcctcttcctctccaagcctcggtttatgtacccgtgcagtgggagtgagttgcacttcggggtgaagggggcaagacttgtgtgggcgcatcctgcagaaggatcccacagcgggtgcagcccagaactgtcttctgaggaagaggtgctctcctgggcccccactgtccccaggcctcagcaaggcaagtgaggtgctgccgtcatccaggctggacagttcagtgatttgcctgaggccccacagcaggagaacgagaaggctgcctgatcagagagtccctgaagaagattctgtggctacaggcttcagcagagtgtgagggagaccccggttatttcctcagctatttccaccaaatcctcctgtctttcgtggccaacaccccaggcaaggcttggggcccccgtctgctgctggacgcagagccatgaagaagaagttagtggtgctgggcctgctggccgtggtcctggtgctggtcattgtcggcctctgtctctggctgccctcagcctccaaggaacctgacaaccatgtgtacaccagggctgccgtggccgcggatgccaagcagtgctcgaagattgggagggatgcactgcgggacggtggctctgcggtggatgcagccattgcagccctgttgtgtgtggggctcatgaatgcccacagcatgggcatcgggggtggcctcttcctcaccatctacaacagcaccacacgaaaagctgaggtcatcaacgcccgcgaggtggcccccaggctggcctttgccaccatgttcaacagctcggagcagtcccagaagggggggctgtcggtggcggtgcctggggagatccgaggctatgagctggcacaccagcggcatgggcggctgccctgggctcgcctcttccagcccagcatccagctggcccgccagggcttccccgtgggcaagggcttggcggcagccctggaaaacaagcggaccgtcatcgagcagcagcctgtcttgtgtgaggtgttctgccgggatagaaaggtgcttcgggagggggagagactgaccctgccgcagctggctgacacctacgagacgctggccatcgagggtgcccaggccttctacaacggcagcctcacggcccagattgtgaaggacatccaggcggccgggggcattgtgacagctgaggacctgaacaactaccgtgctgagctgatcgagcacccgctgaacatcagcctgggagacgtggtgctgtacatgcccagtgcgccgctcagcgggcccgtgctggccctcatcctcaacatcctcaaagggtacaacttctcccgggagagcgtggagagccccgagcagaagggcctgacgtaccaccgcatcgtagaggctttccggtttgcctacgccaagaggaccctgcttggggaccccaagtttgtggatgtgactgaggtggtccgcaacatgacctccgagttcttcgctgcccagctccgggcccagatctctgacgacaccactcacccgatctcctactacaagcccgagttctacacgccggatgacgggggcactgctcacctgtctgtcgtcgcagaggacggcagtgctgtgtccgccaccagcaccatcaacctctactttggctccaaggtccgctccccggtcagcgggatcctgttcaataatgaaatggacgacttcagctctcccagcatcaccaacgagtttggggtacccccctcacctgccaatttcatccagccagggaagcagccgctctcgtccatgtgcccgacgatcatggtgggccaggacggcc

SEQ ID NO: 11853 - DNA, 831 bp, Homo sapiens
ccagaccgggcgtcgggtgagcccagaagtgagagcagttggctgtgccccagtgctgtgtgacccagaggcgccgctcaccctctctgagctggtggacatcataggtggggaagctcaggtcagggcactcccatgagtgtctggaggcctgagtcccattctcagctctgccatatgcttgctgcgctctagaggagttcctcttcctctccaagcctcggtttatgtacccgtgcagtgggagtgagttgcacttcggggtgaagggggcaagacttgtgtgggcgcatcctgcagaaggatcccacagcaaggcaagtgaggtgctgccgtcatccaggctggacagttcagtgatttgcctgaggccccacagcagagttcaactggagacagagaaaccagctagaggcagagggaggtaacacggagtcccccagaaaggtctgggctgcgcgtgcttcaggcttcagcagagtgtgagggagaccccggttatttcctcagctatttccaccaaatcctcctgtctttcgtggccaacaccccaggcaaggcttggggcccccgtctgctgctggacgagccatgaagaagaagttagtggtgctgggcctgctggccgtggtcctggtgctggtcattgtcggcctctgtctctggctgccctcagcctccaaggaacctgacaaccatgtgtacaccagggctgccgtggccgcggatgccaagcagtgctcgaagattgggagggatgcactgcgggacggtggctctgcggtggatgcagccattgcagccctgttgtgtgtggggctcatgaatgcc

SEQ ID NO: 11854 - DNA, 1078 bp, Homo sapiens
ggtgtgctgctggatgaccagaccgggcgtcgggtgagcccagaagtgagagcagttggctgtgccccagtgctgtgtgacccagaggcgccgctcaccctctctgagctggtggacatcatagcgggtgcagcccagaactgtcttctgaggaagaggtgctctcctgggcccccactgtccccaggcctcagcagcaaggcaagtgaggtgctgccgtcatccaggctggacagttcagtgatttgcctgaggccccacagcagagttcaactggagacagagaaaccagctagaggcagagggaggtaacacggagtcccccagaaaggtctgggctgcgcgtgcttcaggtaacctcccttgaccttcaggagaacgagaaggctgcctgatcagagagtccctgaagaagattctgtggctacaggcttcagcagagtgtgagggagaccccggttatttcctcagctatttccaccaaatcctcctgtctttcgtggccaacaccccaggcaaggcttggggcccccgtctgctgctggacgcagagccatgaagaagaagttagtggtgctgggcctgctggccgtggtcctggtgctggtcattgtcggcctctgtctctggctgccctcagcctccaaggaacctgacaaccatgtgtacaccagggctgccgtggccgcggatgccaagcagtgctcgaagattgggagggatgcactgcgggacggtggctctgcggtggatgcagccattgcagccctgttgtgtgtggggctcatgaatgcccacagcatgggcatcgggggtggcctcttcctcaccatctacaacagcaccacacgaaaagctgaggtcatcaacgcccgcgaggtggcccccaggctggcctttgccaccatgttcaacagctcggagcagtcccagaagggggggctgtcggtggcggtgcctggggagatccgaggctatgagctggcacaccagcggcatgggcggctgccctgggctcgcctcttccagcccagcatccagctggcccgccagggcttccccgtgggcaagggcttgg

SEQ ID NO: 11855 - DNA, 874 bp, Homo sapiens
accctgtgcagatgcctcccactgtccgccggggctgctgggcacgccctggctggtctcttggactagcgggtgcagcccagaactgtcttctgaggaagaggtgctctcctgggcccccactgtccccaggcctcagcaaggcaagtgaggtgctgccgtcatccaggctggacagttcagtgatttgcctgaggccccacagcagagttcaactggagacagagaaaccagctagaggcagagggaggtaacacggagtcccccagaaaggtctgggctgcgcgtgcttcaggtaacctcccttgaccttcaggagaacgagaaggctgcctgatcagagagtccctgaagaagattctgtggctacaggcttcagcagagtgtgagggagaccccggttatttcctcagctatttccaccaaatcctcctgtctttcgtggccaacaccccaggcaaggcttggggcccccgtctgctgctggacgagccatgaagaagaagttagtggtgctgggcctgctggccgtggtcctggtgctggtcattgtcggcctctgtctctggctgccctcagcctccaaggaacctgacaaccatgtgtacaccagggctgccgtggccgcggatgccaagcagtgctcgaagattgggagggatgcactgcgggacggtggctctgcggtggatgcagccattgcagccctgttgtgtgtggggctcatgaatgcccacagcatgggcatcgggggtggcctcttcctcaccatctacaacagcaccacacgaaaagctgaggtcatcaacgcccgcgaggtggcccccaggctggcctttgccaccatgttcaacagctcggagcagtcccagaa

SEQ ID NO: 11856 - DNA, 929 bp, Homo sapiens
gcccagaagtgagagcagttggctgtgccccagtgctgtgtgacccagaggcgccgctcaccctctctgagctggtggacatcataggtggggaagctcaggtcagggcactcccatgagtgtctggaggcctgagtcccattctcagctctgccatatgcttgctgcgctctagaggagttcctcttcctctccaagcctcggtttatgtacccgtgcagtgggagtgagttgcacttcggggtgaagggggcaagacttgtgtgggcgcatcctgcagaaggatcccacagcgggtgcagcccagaactgtcttctgaggaagaggtgctctcctgggcccccactgtccccaggcctcagcaaggcaagtgaggtgctgccgtcatccaggctggacagttcagtgatttgcctgaggccccacagcagagttcaactggagacagagaaaccagctagaggcagagggaggtaacacggagtcccccagaaaggtctgggctgcgcgtgcttcagctatttccaccaaatcctcctgtctttcgtggccaacaccccaggcaaggcttggggcccccgtctgctgctggacgcagagccatgaagaagaagttagtggtgctgggcctgctggccgtggtcctggtgctggtcattgtcggcctctgtctctggctgccctcagcctccaaggaacctgacaaccatgtgtacaccagggctgccgtggccgcggatgccaagcagtgctcgaagattgggagggatgcactgcgggacggtggctctgcggtggatgcagccattgcagccctgttgtgtgtggggctcatgaatgcccacagcatgggcatcgggggtggcctcttcctcaccatctacaacagcaccacacgaaaagctgaggtcatcaacgcccgcgaggt

SEQ ID NO: 11857 - DNA, 747 bp, Homo sapiens
tccgtgagaggcctgcctgtcctgcaccctgtgcagatgcctcccactgtccgccggggctgctgggcacgccctggctggtctcttggactagcgggtgcagcccagaactgtcttctgaggaagaggtgctctcctgggcccccactgtccccaggcctcagcaaggcaagtgaggtgctgccgtcatccaggctggacagttcagtgatttgcctgaggccccacagcaggagaacgagaaggctgcctgatcagagagtccctgaagaagattctgtggctacaggcttcagcagagtgtgagggagaccccggttatttcctcagctatttccaccaaatcctcctgtctttcgtggccaacaccccaggcaaggcttggggcccccgtctgctgctggacgcagagccatgaagaagaagttagtggtgctgggcctgctggccgtggtcctggtgctggtcattgtcggcctctgtctctggctgccctcagcctccaaggaacctgacaaccatgtgtacaccagggctgccgtggccgcggatgccaagcagtgctcgaagattgggagggatgcactgcgggacggtggctctgcggtggatgcagccattgcagccctgttgtgtgtggggctcatgaatgcccacagcatgggcatcgggggtggcctcttcctcaccatctacaacagcaccacacgaaaagctgaggtcatcaacgcccgcgaggtggccccc

SEQ ID NO: 11858 - DNA, 537 bp, Homo sapiens
gaccagaccgggcgtcgggtgagcccagaagtgagagcagttggctgtgccccagtgctgtgtgacccagaggcgccgctcaccctctctgagctggtggacatcatagcgggtgcagcccagaactgtcttctgaggaagaggtgctctcctgggcccccactgtccccaggcctcagcaaggcaagtgaggtgctgccgtcatccaggctggacagttcagtgatttgcctgaggccccacagcaggagaacgagaaggctgcctgatcagagagtccctgaagaagattctgtggctacaggcttcagcagagtgtgagggagaccccggttatttcctcagctatttccaccaaatcctcctgtctttcgtggccaacaccccaggcaaggcttggggcccccgtctgctgctggacgagccatgaagaagaagttagtggtgctgggcctgctggccgtggtcctggtgctggtcattgtcggcctctgtctctggctgccctcagcctccaaggaacctgacaaccatgtg

SEQ ID NO: 11859 - DNA, 606 bp, Homo sapiens
cttagcttggttttggtgtgctgctggatgaccagaccgggcgtcgggtgagcccagaagtgagagcagttggctgtgccccagtgctgtgtgacccagaggcgccgctcaccctctctgagctggtggacatcataggtggggaagctcagcgggtgcagcccagaactgtcttctgaggaagaggtgctctcctgggcccccactgtccccaggcctcaggagaacgagaaggctgcctgatcagagagtccctgaagaagattctgtggctacaggcttcagcagagtgtgagggagaccccggttatttcctcagctatttccaccaaatcctcctgtctttcgtggccaacaccccaggcaaggcttggggcccccgtctgctgctggacgcagagccatgaagaagaagttagtggtgctgggcctgctggccgtggtcctggtgctggtcattgtcggcctctgtctctggctgccctcagcctccaaggaacctgacaaccatgtgtacaccagggctgccgtggccgcggatgccaagcagtgctcgaagattgggagggatgcactgcgggacggtggctctgcggtggatgcagc

SEQ ID NO: 11860 - DNA, 743 bp, Homo sapiens
tcccagccaggctggacctccgtgagaggcctgcctgtcctgcaccctgtgcagatgcctcccactgtccgccggggctgctgggcacgccctggctggtctcttggactagcgggtgcagcccagaactgtcttctgaggaagaggtgctctcctgggcccccactgtccccaggcctcaggagaacgagaaggctgcctgatcagagagtccctgaagaagattctgtggctacaggcttcagcagagtgtgagggagaccccggttatttcctcagctatttccaccaaatcctcctgtctttcgtggccaacaccccaggcaaggcttggggcccccgtctgctgctggacgcagagccatgaagaagaagttagtggtgctgggcctgctggccgtggtcctggtgctggtcattgtcggcctctgtctctggctgccctcagcctccaaggaacctgacaaccatgtgtacaccagggctgccgtggccgcggatgccaagcagtgctcgaagattgggagggatgcactgcgggacggtggctctgcggtggatgcagccattgcagccctgttgtgtgtggggctcatgaatgcccacagcatgggcatcgggggtggcctcttcctcaccatctacaacagcaccacacgaaaagctgaggtcatcaacgcccgcgaggtggcccccaggctggcctttgccaccatgttcaacagctcggagcagtcccagaa

SEQ ID NO: 11861 - DNA, 853 bp, Homo sapiens
cctgcaccctgtgcagatgcctcccactgtccgccggggctgctgggcacgccctggctggtctcttggactagcgggtgcagcccagaactgtcttctgaggaagaggtgctctcctgggcccccactgtccccaggcctcagcagcaaggcaagtgaggtgctgccgtcatccaggctggacagttcagtgatttgcctgaggccccacagcagagttcaactggagacagagaaaccagctagaggcagagggaggtaacacggagtcccccagaaaggtctgggctgcgcgtgcttcaggtaacctcccttgaccttcaggagaacgagaaggctgcctgatcagagagtccctgaagaagattctgtggctacaggcttcagcagagtgtgagggagaccccggttatttcctcagctatttccaccaaatcctcctgtctttcgtggccaacaccccaggcaaggcttggggcccccgtctgctgctggacgcagagccatgaagaagaagttagtggtgctgggcctgctggccgtggtcctggtgctggtcattgtcggcctctgtctctggctgccctcagcctccaaggaacctgacaaccatgtgtacaccagggctgccgtggccgcggatgccaagcagtgctcgaagattgggagggatgcactgcgggacggtggctctgcggtggatgcagccattgcagccctgttgtgtgtggggctcatgaatgcccacagcatgggcatcgggggtggcctcttcctcaccatctacaacagcaccacacgaaaagctgaggtcatcaacgcccgcgaggtggcccccaggctggcctttgcc

SEQ ID NO: 11862 - DNA, 811 bp, Homo sapiens
gaccagaccgggcgtcgggtgagcccagaagtgagagcagttggctgtgccccagtgctgtgtgacccagaggcgccgctcaccctctctgagctggtggacatcatagcgggtgcagcccagaactgtcttctgaggaagaggtgctctcctgggcccccactgtccccaggcctcagcaaggcaagtgaggtgctgccgtcatccaggctggacagttcagtgatttgcctgaggccccacagcaggagaacgagaaggctgcctgatcagagagtccctgaagaagattctgtggctacaggcttcagcagagtgtgagggagaccccggttatttcctcagctatttccaccaaatcctcctgtctttcgtggccaacaccccaggcaaggcttggggcccccgtctgctgctggacgcagagccatgaagaagaagttagtggtgctgggcctgctggccgtggtcctggtgctggtcattgtcggcctctgtctctggctgccctcagcctccaaggaacctgacaaccatgtgtacaccagggctgccgtggccgcggatgccaagcagtgctcgaagattgggagggatgcactgcgggacggtggctctgcggtggatgcagccattgcagccctgttgtgtgtggggctcatgaatgcccacagcatgggcatcgggggtggcctcttcctcaccatctacaacagcaccacacgaaaagctgaggtcatcaacgcccgcgaggtggcccccaggctggcctttgccaccatgttcaacagctcggagcagtcccagaagg

SEQ ID NO: 11863 - DNA, 579 bp, Homo sapiens
agaccgggcgtcgggtgagcccagaagtgagagcagttggctgtgccccagtgctgtgtgacccagaggcgccgctcaccctctctgagctggtggacatcataggagaacgagaaggctgcctgatcagagagtccctgaagaagattctgtggctacaggcttcagcagagtgtgagggagaccccggttatttcctcagctatttccaccaaatcctcctgtctttcgtggccaacaccccaggcaaggcttggggcccccgtctgctgctggacgcagagccatgaagaagaagttagtggtgctgggcctgctggccgtggtcctggtgctggtcattgtcggcctctgtctctggctgccctcagcctccaaggaacctgacaaccatgtgtacaccagggctgccgtggccgcggatgccaagcagtgctcgaagattgggagggatgcactgcgggacggtggctctgcggtggatgcagccattgcagccctgttgtgtgtggggctcatgaatgcccacagcatgggcatcgggggtggcctcttcctcaccatctacaacagcaccac

SEQ ID NO: 11864 - DNA, 597 bp, Homo sapiens
cccggtcagagctttaagctgcagctctgatgccccagggacctctcagacccccctgcccagagcaggcagcccgcgggtgcagcccagaactgtcttctgaggaagaggtgctctcctgggcccccactgtccccaggcctcagcagcaaggcaagtgaggtgctgccgtcatccaggctggacagttcagtgatttgcctgaggccccacagcagagttcaactggagacagagaaaccagctagaggcagagggaggtaacacggagtcccccagaaaggtctgggctgcgcgtgcttcaggtaacctcccttgaccttcaggagaacgagaaggctgcctgatcagagagtccctgaagaagattctgtggctacaggcttcagcagagtgtgagggagaccccggttatttcctcagctatttccaccaaatcctcctgtctttcgtggccaacaccccaggcaaggcttggggcccccgtctgctgctggacgcagagccatgaagaagaagttagtggtgctgggcctgctggccgtggtcctggtgctggtcattgtcggcctctgtctctggctgccctcagcctcc

SEQ ID NO: 11865 - DNA, 2366 bp, Homo sapiens
atgctgcatattgctggcccagctcctgaggctctttggacctccaggaatcggtgtctctaccaggaacccttaaccctgacccggactcccggctgggacccggggtgttggagtggcaagagcgctgtcaggcctggtgaagggtgtgagctgtccaacagggcagggaggaggcagggcctgttctgcagttggacagacagagccctctagctgctttctggaagactgaagggcagcaaggcaagtgaggtgctgccgtcatccaggctggacagttcagtgatttgcctgaggccccacagcaggagaacgagaaggctgcctgatcagagagtctctgaagaagattctgtggctacaggcttcagcagagtgtgagggagaccccggttatttcctcagctgtttccaccaaatcctcctgtctttcgtggccaacaccccaggcaaggcttggggcccccgtctgctgctggacgcagagccatgaagaagaagttagtggtgctgggcctgctggccgtggtcctggtgctggtcattgtcggcctctgtctctggctgccctcggcctccaaggaacctgacaaccatgtgtacaccagggctgccatggccgcggatgccaagcagtgcttggagattgggagggacacactgcgggacggtggctctgcagtggatgcagccattgcagccctgttgtgtgtggggctcatgaatgcccacagcatgggcatcggggttggcctcttcctcaccatctacaacagcaccactcgaaaagctgaggtcatcaatgcccgcgaggtggcccccaggctggcctttgccagcatgttcaacagctcggagcagtcccagaagggagggctgtcggtggcggtgcctggggagatccgaggctatgagctggcacaccagcggcatgggcggctgccctgggctcgcctcttccagcccagcatccagctggcccgccagggcttccctgtgggcaagggcttggcggcagtcctggaaaacaagcggactgtcatcgagcagcagcctgtcttgtggtatgtgttctgccgggatagaaaggtgcttcgggagggggagagactgaccctgccgcggctggctgacacctatgagatgctggccatcgagggtgcccaggccttctacaacggcagcctcatggcccagattgtgaaggacatccaggcggctgggggcattgtgacagctgaggacctgaacaactaccgtgctgagctgatcgagcacccgctgaacatcagcctgggagacgcggtgctgtacatgcccagtgcgcggctcagcgggcccgtgctggccctcatcctcaacatcctcaaagggtacaacttctcccgggagagcgtggagacccccgagcagaagggcctgacgtaccaccgcatcgtagaggctttccggtttgcctacgccaagaggaccctgcttggggaccccaagtttgtggatgtgactgaggtggtccgcaacatgacctctgagttcttcgctgcccagctccggtcccagatctctgaccacaccactcacccgatctcctactacaagcccgagttctacacgccggatgacgggggcactgctcacctgtctgtcgtcgcagaggacggcagtgctgtgtccgccaccagcaccatcaacctctactttggctccaaggtctgctccccggtcagtgggatcctgttcaataatgaatggacgacttcagctctcccagcattcaccaatgagtttggggcacccccctcacctgccaatttcatccagccagggaagcagccgctcttgtccatgtgcctgacgatcatggtgggccaggacggccaggtccggatggtggtgggagctgctgggggcacgcagatcaccacagacactgcactggccatcatctacaacctctggttcggctatgacgtgaagagggccgtggaggagccccggctgcacaacaagcttctgcccaacgtcacgacagtggagagaaacattgaccaggcagtgactgcagccctggagacccggcaccatcacacccagatcgcgtccaccttcatcgctgtggtgcaagccatcgtccgcacggctggtggctgggcagctgcctcggactccaggaaaggcggggaacctgctggctactgattgctccaggcagacaaggctgacaagcaatccagggacaagatactcaccaggatgaggaagaggactttgggggacgggcttcccctgtgagcagcagagcagcataataaatgaggccactgtgccaggctccaggtggcctccctggcctgtctccccac

SEQ ID NO: 11866 - DNA, 1845 bp, Homo sapiens
atgaagaagaagttagtggtgctgggcctgctggccgtggtcctggtgctggtcattgtcggcctctgtctctggctgccctcggcctccaaggaacctgacaaccatgtgtacaccagggctgccatggccgcggatgccaagcagtgcttggagattgggagggacacactgcgggacggtggctctgcagtggatgcagccattgcagccctgttgtgtgtggggctcatgaatgcccacagcatgggcatcggggttggcctcttcctcaccatctacaacagcaccactcgaaaagctgaggtcatcaatgcccgcgaggtggcccccaggctggcctttgccagcatgttcaacagctcggagcagtcccagaagggagggctgtcggtggcggtgcctggggagatccgaggctatgagctggcacaccagcggcatgggcggctgccctgggctcgcctcttccagcccagcatccagctggcccgccagggcttccctgtgggcaagggcttggcggcagtcctggaaaacaagcggactgtcatcgagcagcagcctgtcttgtggtatgtgttctgccgggatagaaaggtgcttcgggagggggagagactgaccctgccgcggctggctgacacctatgagatgctggccatcgagggtgcccaggccttctacaacggcagcctcatggcccagattgtgaaggacatccaggcggctgggggcattgtgacagctgaggacctgaacaactaccgtgctgagctgatcgagcacccgctgaacatcagcctgggagacgcggtgctgtacatgcccagtgcgcggctcagcgggcccgtgctggccctcatcctcaacatcctcaaagggtacaacttctcccgggagagcgtggagacccccgagcagaagggcctgacgtaccaccgcatcgtagaggctttccggtttgcctacgccaagaggaccctgcttggggaccccaagtttgtggatgtgactgaggtggtccgcaacatgacctctgagttcttcgctgcccagctccggtcccagatctctgaccacaccactcacccgatctcctactacaagcccgagttctacacgccggatgacgggggcactgctcacctgtctgtcgtcgcagaggacggcagtgctgtgtccgccaccagcaccatcaacctctatgggatcctgttcaataatgaatggacgacttcagctctcccagcattcaccaatgagtttggggcacccccctcacctgccaatttcatccagccagggaagcagccgctcttgtccatgtgcctgacgatcatggtgggccaggacggccaggtccggatggtggtgggagctgctgggggcacgcagatcaccacagacactgcactggccatcatctacaacctctggttcggctatgacgtgaagagggccgtggaggagccccggctgcacaacaagcttctgcccaacgtcacgacagtggagagaaacattgaccaggcagtgactgcagccctggagacccggcaccatcacacccagatcgcgtccaccttcatcgctgtggtgcaagccatcgtccgcacggctggtggctgggcagctgcctcggactccaggaaaggcggggaacctgctggctactgattgctccaggcagacaaggctgacaagcaatccagggacaagatactcaccaggatgaggaagaggactttgggggacgggcttcccctgtgagcagcagagcagcataataaatgaggccactgtgccaggctccaggtggcctccctggcctgtctccccact

SEQ ID NO: 11867 - DNA, 2039 bp, Homo sapiens
tcccttgaccttcaggagaacgagaaggctgcctgatcagagagtctctgaagaagattctgtggctacaggcttcagcagagtgtgagggagaccccggttatttcctcagctgtttccaccaaatcctcctgtctttcgtggccaacaccccaggcaaggcttggggcccccgtctgctgctggacgcagagccatgaagaagaagttagtggtgctgggcctgctggccgtggtcctggtgctggtcattgtcggcctctgtctctggctgccctcggcctccaaggaacctgacaaccatgtgtacaccagggctgccatggccgcggatgccaagcagtgcttggagattgggagggacacactgcgggacggtggctctgcagtggatgcagccattgcagccctgttgtgtgtggggctcatgaatgcccacagcatgggcatcggggttggcctcttcctcaccatctacaacagcaccactcgaaaagctgaggtcatcaatgcccgcgaggtggcccccaggctggcctttgccagcatgttcaacagctcggagcagtcccagaagggagggctgtcggtggcggtgcctggggagatccgaggctatgagctggcacaccagcggcatgggcggctgccctgggctcgcctcttccagcccagcatccagctggcccgccagggcttccctgtgggcaagggcttggcggcagtcctggaaaacaagcggactgtcatcgagcagcagcctgtcttgtggtatgtgttctgccgggatagaaaggtgcttcgggagggggagagactgaccctgccgcggctggctgacacctatgagatgctggccatcgagggtgcccaggccttctacaacggcagcctcatggcccagattgtgaaggacatccaggcggctgggggcattgtgacagctgaggacctgaacaactaccgtgctgagctgatcgagcacccgctgaacatcagcctgggagacgcggtgctgtacatgcccagtgcgcggctcagcgggcccgtgctggccctcatcctcaacatcctcaaagggtacaacttctcccgggagagcgtggagacccccgagcagaagggcctgacgtaccaccgcatcgtagaggctttccggtttgcctacgccaagaggaccctgcttggggaccccaagtttgtggatgtgactgaggtggtccgcaacatgacctctgagttcttcgctgcccagctccggtcccagatctctgaccacaccactcacccgatctcctactacaagcccgagttctacacgccggatgacgggggcactgctcacctgtctgtcgtcgcagaggacggcagtgctgtgtccgccaccagcaccatcaacctctactttggctccaaggtctgctccccggtcagtgggatcctgttcaataatgaatggacgacttcagctctcccagcattcaccaatgagtttggggcacccccctcacctgccaatttcatccagccagggaagcagccgctcttgtccatgtgcctgacgatcatggtgggccaggacggccaggtccggatggtggtgggagctgctgggggcacgcagatcaccacagacactgcactggccatcatctacaacctctggttcggctatgacgtgaagagggccgtggaggagccccggctgcacaacaagcttctgcccaacgtcacgacagtggagagaaacattgaccaggcagtgactgcagccctggagacccggcaccatcacacccagatcgcgtccaccttcatcgctgtggtgcaagccatcgtccgcacggctggtggctgggcagctgcctcggactccaggaaaggcggggaacctgctggctactgattgctccaggcagacaaggctgacaagcaatccagggacaagatactcaccaggatgaggaagaggactttgggggacgggcttcccctgtgagcagcagagcagcataataaatgaggccactgtgccaggc

SEQ ID NO: 11868 - DNA, 2334 bp, Homo sapiens
actccgtagtgtgcacttggtgagggcagcagctcgccacagctgccagccatctgtccattcacccatctgtccatctggcagcccgctgttcagacctgtctgtctgtccgcccatctgtaagcccatctctgtcccattgtctatctgaccatctttctcttactgtcctctttgtctagctatctggcctatctgtcgatccatcttcgtgtctgtcttcagcccccacctgtttgtccatctgtccaattacctgtgactctgtgcatcttcttgtccattcatctgcccacccatccgtccctccgtctgcccaccagccgcccctctcctcctgggctgcagagccatggcccggggctacggggccacggtcagcctagtcctgctgggtctggggctggcgctggctgtcattgtgctggctgtggtcctctctcgacaccaggccccatgtggcccccaggcctttgcccacgctgctgttgccgccgactccaaggtctgctcggatattggacgagccatcctccagcagcagggctcacccgtggatgccaccatcgcggctctggtctgcaccagcgtcgtcaaccctcagagcatgggcctgggcggaggggtcatcttcaccatctacaatgtgacaacaggggcccagtggatcggggtgcccggggagctccgtggctatgccgaggcccaccgccgccatggccgcctgccctgggcgcagctgttccagcccaccatcgcgctgctccgaggggggcatgtggtggcccctgtcctcagccgtttcctgcacaacagcatcctgcggccttccttgcaggcgtcaaccctgcgccagctcttcttcaacgggacagaacccctgaggcctcaggacccactcccatggcctgcactggccaccaccctggagaccgtggccacagagggcgtggaggtcttctacacggggaggctgggccagatgctggtggaggacattgccaaggaagggagccagctgacgctgcaggacctggccaagttccagcccgaggtggtggatgccctggaggtgcccctgggggactataccctgtactcaccaccgccgcctgcagggggtgccattctcagctttatcctcaacgtgctaagagggttcaacttctcaacagagtctatggccaggcctgaagggagggtgaacgtgtaccaccaccttgtagagacgctcaagtttgccaaggggcagaggtggaggctgggggaccctcgaagccacccgaagctccagaatgcctcccgggacctgctgggggagaccctggcccagctcatccgccaacagatcgatggccggggggaccaccagctcagccactacagcttggccgaggcctggggccacgggacaggcacgtcccatgtgtctgtgctgggggaggatggcagcgccgtggctgccaccagcaccatcaacacaccctttggagcgatggtgtattcaccacggacaggcatcatcctcaacaacgagctcctggacttatgcgagcgatgcccccggggttccggcaccaccccctcacctgtgagtggagacagggtgggtggagctcccggaaggtgctggcccccagttccaggcgagcgttccccatcctccatggtgccctccatcttgatcaacaaagcccaggggtcgaagctagtgattggcggggctggcggggagctcatcatctctgctgtggcccaggccatcatgagcaagctgtggcttggctttgacctgagagcggccattgcagcccccatcctgcatgtcaacagcaagggctgtgtggagtacgagcccaacttcagccaggaggtgcagaggggactccaagaccgtggccagaaccagacccagaggcccttcttcctgaacgtggtccaggctgtgtcccaggagggggcctgtgtgtacgccgtctcggacctgaggaagagtggggaggccgcaggctactaagacactgctctgcccagagctgaagtctggccccaccatgagtcctgtgtccaggccggacatggctgggggaccaactactctggcaggatctggacccctggcaggggagtccagctgagagtggaagaggtggcggggaccagctgggcagatgagaggctgagcctcatccctaaccccctttcccagagcccctggtggtcctgaaccggcccctctatccctccgcaggcctcttgcctggggccactctcccaccctctcgatctgtatatcctccagtccaagattaaagaggcggactgtggcctga

SEQ ID NO: 11869 - DNA, 2494 bp, Homo sapiens
tgcctggcctcctgccagcaacaagcaggagctgaaaaccagaagttgaggcgtgagtttggccactccgtagtgtgcacttggtgagggcagcagctcgccacagctgccagccatctgtccattcacccatctgtccatctggcagcccgctgttcagacctgtctgtctgtccgcccatctgtaagcccatctctgtcccattgtctatctgaccatctttctcttactgtcctctttgtctagctatctggcctatctgtcgatccatcttcgtgtctgtcttcagcccccacctgtttgtccatctgtccaattacctgtgactctgtgcatcttcttgtccattcatctgcccacccatccgtccctccgtctgcccaccagccgcccctctcctcctgggctgcagagccatggcccggggctacggggccacggtcagcctagtcctgctgggtctggggctggcgctggctgtcattgtgctggctgtggtcctctctcgacaccaggccccatgtggcccccaggcctttgcccacgctgctgttgccgccgactccaaggtctgctcggatattggacgagccatcctccagcagcagggctcacccgtggatgccaccatcgcggctctggtctgcaccagcgtcgtcaaccctcagagcatgggcctgggcggaggggtcatcttcaccatctacaatgtgacaacagggaaggtggaggtcatcaatgcccgggagacggtgccggccagccacgccccgagcctgctggaccagtgtgcacaggctctgccactgggcacaggggcccagtggatcggggtgcccggggagctccgtggctatgccgaggcccaccgccgccatggccgcctgccctgggcgcagctgttccagcccaccatcgcgctgctccgaggggggcatgtggtggcccctgtcctcagccgtttcctgcacaacagcatcctgcggccttccttgcaggcgtcaaccctgcgccagctcttcttcaacgggacagaacccctgaggcctcaggacccactcccatggcctgcactggccaccaccctggagaccgtggccacagagggcgtggaggtcttctacacggggaggctgggccagatgctggtggaggacattgccaaggaagggagccagctgacgctgcaggacctggccaagttccagcccgaggtggtggatgccctggaggtgcccctgggggactataccctgtactcaccaccgccgcctgcagggggtgccattctcagctttatcctcaacgtgctaagagggttcaacttctcaacagagtctatggccaggcctgaagggagggtgaacgtgtaccaccaccttgtagagacgctcaagtttgccaaggggcagaggtggaggctgggggaccctcgaagccacccgaagctccagaatgcctcccgggacctgctgggggagaccctggcccagctcatccgccaacagatcgatggccggggggaccaccagctcagccactacagcttggccgaggcctggggccacgggacaggcacgtcccatgtgtctgtgctgggggaggatggcagcgccgtggctgccaccagcaccatcaacacaccctttggagcgatggtgtattcaccacggacaggcatcatcctcaacaacgagctcctggacttatgcgagcgatgcccccggggttccggcaccaccccctcacctgtgagtggagacagggtgggtggagctcccggaaggtgctggcccccagttccaggcgagcgttccccatcctccatggtgccctccatcttgatcaacaaagcccaggggtcgaagctagtgattggcggggctggcggggagctcatcatctctgctgtggcccaggccatcatgagcaagctgtggcttggctttgacctgagagcggccattgcagcccccatcctgcatgtcaacagcaagggctgtgtggagtacgagcccaacttcagccaggaggtgcagaggggactccaagaccgtggccagaaccagacccagaggcccttcttcctgaacgtggtccaggctgtgtcccaggagggggcctgtgtgtacgccgtctcggacctgaggaagagtggggaggccgcaggctactaagacactgctctgcccagagctgaagtctggccccaccatgagtcctgtgtccaggccggacatggctgggggaccaactactctggcaggatctggacccctggcaggggagtccagctgagagtggaagaggtggcggggaccagctgggcagatgagaggctgagcctcatccctaaccccctttcccagagcccctggtggtcctgaaccggcccctctatccctccgcaggcctcttgcctggggccactctcccaccctctcgatctgtatatcctccagtccaagattaaagaggcggactgtggcctga

SEQ ID NO: 11870 - DNA, 2408 bp, Homo sapiens
gtgagggcagcagctcgccacagctgccagccatctgtccattcacccatctgtccatctggcagcccgctgttcagacctgtctgtctgtccgcccatctgtaagcccatctctgtcccattgtctatctgaccatctttctcttactgtcctctttgtctagctatctggcctatctgtcgatccatcttcgtgtctgtcttcagcccccacctgtttgtccatctgtccaattacctgtgactctgtgcatcttcttgtccattcatctgcccacccatccgtccctccgtctgcccaccagccgcccctctcctcctgggctgcagagccatggcccggggctacggggccacggtcagcctagtcctgctgggtctggggctggcgctggctgtcattgtgctggctgtggtcctctctcgacaccaggccccatgtggcccccaggcctttgcccacgctgctgttgccgccgactccaaggtctgctcggatattggacgagccatcctccagcagcagggctcacccgtggatgccaccatcgcggctctggtctgcaccagcgtcgtcaaccctcagagcatgggcctgggcggaggggtcatcttcaccatctacaatgtgacaacagggaaggtggaggtcatcaatgcccgggagacggtgccggccagccacgccccgagcctgctggaccagtgtgcacaggctctgccactgggcacaggggcccagtggatcggggtgcccggggagctccgtggctatgccgaggcccaccgccgccatggccgcctgccctgggcgcagctgttccagcccaccatcgcgctgctccgaggggggcatgtggtggcccctgtcctcagccgtttcctgcacaacagcatcctgcggccttccttgcaggcgtcaaccctgcgccagctcttcttcaacgggacagaacccctgaggcctcaggacccactcccatggcctgcactggccaccaccctggagaccgtggccacagagggcgtggaggtcttctacacggggaggctgggccagatgctggtggaggacattgccaaggaagggagccagctgacgctgcaggacctggccaagttccagcccgaggtggtggatgccctggaggtgcccctgggggactataccctgtactcaccaccgccgcctgcagggggtgccattctcagctttatcctcaacgtgctaagagggttcaacttctcaacagagtctatggccaggcctgaagggagggtgaacgtgtaccaccaccttgtagagacgctcaagtttgccaaggggcagaggtggaggctgggggaccctcgaagccacccgaagctccagaatgcctcccgggacctgctgggggagaccctggcccagctcatccgccaacagatcgatggccggggggaccaccagctcagccactacagcttggccgaggcctggggccacgggacaggcacgtcccatgtgtctgtgctgggggaggatggcagcgccgtggctgccaccagcaccatcaacacaccctttggagcgatggtgtattcaccacggacaggcatcatcctcaacaacgagctcctggacttatgcgagcgatgcccccggggttccggcaccaccccctcacctgcagtgagtggagacagggtgggtggagctcccggaaggtgctggcccccagttccaggcgagcgttccccatcctccatggtgccctccatcttgatcaacaaagcccaggggtcgaagctagtgattggcggggctggcggggagctcatcatctctgctgtggcccaggccatcatgagcaagctgtggcttggctttgacctgagagcggccattgcagcccccatcctgcatgtcaacagcaagggctgtgtggagtacgagcccaacttcagccaggaggtgcagaggggactccaagaccgtggccagaaccagacccagaggcccttcttcctgaacgtggtccaggctgtgtcccaggagggggcctgtgtgtacgccgtctcggacctgaggaagagtggggaggccgcaggctactaagacactgctctgcccagagctgaagtctggccccaccatgagtcctgtgtccaggccggacatggctgggggaccaactactctggcaggatctggacccctggcaggggagtccagctgagagtggaagaggtggcggggaccagctgggcagatgagaggctgagcctcatccctaaccccctttcccagagcccctggtggtcctgaaccggcccctctatccctccgcaggcctcttgcctggggccactctcccaccctctcgatctgtatatcctccagtccaagattaaagaggcggactgtg

SEQ ID NO: 11871 - DNA, 2120 bp, Homo sapiens
ggccactccgtagtgtgcacttggtgagggcagcagctcgccacagctgccagccatctgtccattcacccatctgtccatctggcagcccgctgttcagacctgtctgtctgtccgcccatctgtaagcccatctctgtcccattgtctatctgaccatctttctcttactgtcctctttgtctagctatctggcctatctgtcgatccatcttcgtgtctgtcttcagcccccacctgtttgtccatctgtccaattacctgtgactctgtgcatcttcttgtccattcatctgcccacccatccgtccctccgtctgcccaccagccgcccctctcctcctgggctgcagagccatggcccggggctacggggccacggtcagcctagtcctgctgggtctggggctggcgctggctgtcattgtgctggctgtggtcctctctcgacaccaggccccatgtggcccccaggcctttgcccacgctgctgttgccgccgactccaaggtctgctcggatattggacggggcccagtggatcggggtgcccggggagctccgtggctatgccgaggcccaccgccgccatggccgcctgccctgggcgcagctgttccagcccaccatcgcgctgctccgaggggggcatgtggtggcccctgtcctcagccgtttcctgcacaacagcatcctgcggccttccttgcaggcgtcaaccctgcgctcttcttcaacgggacagaacccctgaggcctcaggacccactcccatggcctgcactggccaccaccctggagaccgtggccacagagggcgtggaggtcttctacacggggaggctgggccagatgctggtggaggacattgccaaggaagggagccagctgacgctgcaggacctggccaagttccagcccgaggtggtggatgccctggaggtgcccctgggggactataccctgtactcaccaccgccgcctgcagggggtgccattctcagctttatcctcaacgtgctaagagggttcaacttctcaacagagtctatggccaggcctgaagggagggtgaacgtgtaccaccaccttgtagagacgctcaagtttgccaaggggcagaggtggaggctgggggaccctcgaagccacccgaagctccagaatgcctcccgggacctgctgggggagaccctggcccagctcatccgccaacagatcgatggccggggggaccaccagctcagccactacagcttggccgaggcctggggccacgggacaggcacgtcccatgtgtctgtgctgggggaggatggcagcgccgtggctgccaccagcaccatcaacacaccctttggagcgatggtgtattcaccacggacaggcatcatcctcaacaacgagctcctggacttatgcgagcgatgcccccggggttccggcaccaccccctcacctgcagtgagtggagacagggtgggtggagctcccggaaggtgctggcccccagttccaggcgagcgttccccatcctccatggtgccctccatcttgatcaacaaagcccaggggtcgaagctagtgattggcggggctggcggggagctcatcatctctgctgtggcccaggccatcatgagcaagctgtggcttggctttgacctgagagcggccattgcagcccccatcctgcatgtcaacagcaagggctgtgtggagtacgagcccaacttcagccaggaggtgcagaggggactccaagaccgtggccagaaccagacccagaggcccttcttcctgaacgtggtccaggctgtgtcccaggagggggcctgtgtgtacgccgtctcggacctgaggaagagtggggaggccgcaggctactaagacactgctctgcccagagctgaagtctggccccaccatgagtcctgtgtccaggccggacatggctgggggaccaactactctggcaggatctggacccctggcaggggagtccagctgagagtggaagaggtggcggggaccagctgggcagatgagaggctgagcctcatccctaaccccctttcccagagcccctggtggtcctgaaccggcccctctatccctcc

SEQ ID NO: 11872 - DNA, 2268 bp, Homo sapiens
actccgtagtgtgcacttggtgagggcagcagctcgccacagctgccagccatctgtccattcacccatctgtccatctggcagcccgctgttcagacctgtctgtctgtccgcccatctgtaagcccatctctgtcccattgtctatctgaccatctttctcttactgtcctctttgtctagctatctggcctatctgtcgatccatcttcgtgtctgtcttcagcccccacctgtttgtccatctgtccaattacctgtgactctgtgcatcttcttgtccattcatctgcccacccatccgtccctccgtctgcccacgctgctgttgccgccgactccaaggtctgctcggatattggacgagccatcctccagcagcagggctcacccgtggatgccaccatcgcggctctggtctgcaccagcgtcgtcaaccctcagagcatgggcctgggcggaggggtcatcttcaccatctacaatgtgacaacagggaaggtggaggtcatcaatgcccgggagacggtgccggccagccacgccccgagcctgctggaccagtgtgcacaggctctgccactgggcacaggggcccagtggatcggggtgcccggggagctccgtggctatgccgaggcccaccgccgccatggccgcctgccctgggcgcagctgttccagcccaccatcgcgctgctccgaggggggcatgtggtggcccctgtcctcagccgtttcctgcacaacagcatcctgcggccttccttgcaggcgtcaaccctgcgccagctcttcttcaacgggacagaacccctgaggcctcaggacccactcccatggcctgcactggccaccaccctggagaccgtggccacagagggcgtggaggtcttctacacggggaggctgggccagatgctggtggaggacattgccaaggaagggagccagctgacgctgcaggacctggccaagttccagcccgaggtggtggatgccctggaggtgcccctgggggactataccctgtactcaccaccgccgcctgcagggggtgccattctcagctttatcctcaacgtgctaagagggttcaacttctcaacagagtctatggccaggcctgaagggagggtgaacgtgtaccaccaccttgtagagacgctcaagtttgccaaggggcagaggtggaggctgggggaccctcgaagccacccgaagctccagaatgcctcccgggacctgctgggggagaccctggcccagctcatccgccaacagatcgatggccggggggaccaccagctcagccactacagcttggccgaggcctggggccacgggacaggcacgtcccatgtgtctgtgctgggggaggatggcagcgccgtggctgccaccagcaccatcaacacaccctttggagcgatggtgtattcaccacggacaggcatcatcctcaacaacgagctcctggacttatgcgagcgatgcccccggggttccggcaccaccccctcacctgtgagtggagacagggtgggtggagctcccggaaggtgctggcccccagttccaggcgagcgttccccatcctccatggtgccctccatcttgatcaacaaagcccaggggtcgaagctagtgattggcggggctggcggggagctcatcatctctgctgtggcccaggccatcatgagcaagctgtggcttggctttgacctgagagcggccattgcagcccccatcctgcatgtcaacagcaagggctgtgtggagtacgagcccaacttcagccaggaggtgcagaggggactccaagaccgtggccagaaccagacccagaggcccttcttcctgaacgtggtccaggctgtgtcccaggagggggcctgtgtgtacgccgtctcggacctgaggaagagtggggaggccgcaggctactaagacactgctctgcccagagctgaagtctggccccaccatgagtcctgtgtccaggccggacatggctgggggaccaactactctggcaggatctggacccctggcaggggagtccagctgagagtggaagaggtggcggggaccagctgggcagatgagaggctgagcctcatccctaaccccctttcccagagcccctggtggtcctgaaccggcccctctatccctccgcaggcctcttgcctggggccactctcccaccctctcgatctgtatatcctccagtccaagattaaagaggcggactgtggcctg

SEQ ID NO: 11873 - DNA, 2532 bp, Homo sapiens
ctctgagacacagccggaaaggctggcaggcaggagggctggggcgagcactggggggccatggagcgggcagaagagcccgtggtctatcagaagctgctgccctgggagccaagcttggagtcggaggaggaagtggaggaggaggagacatcagaggcgctggttctaaacccccggaggcaccaggactcttccaggaacaaggctggcgggctgcccggaacctgggcccgtgtagtggcagccctgctgctgctggctgttggctgctccctggctgtgaggcagctccagaatcagggcaggtcgacaggaagcttgggctctgtggcccctccacccggcggacactcccacggccctggcgtataccaccacggtgccatcatcagccctgcaggtgccatgttttggggcctcttccacgatagctcctcaggcaattccacggccctgacatcaggcccagcacagaccctggcccccggcctggggctgcccgcggctctgcccaccctgcacctgctgcatgcacgcttcggccgcctgccctggccacgcctgctagtgggccccaccacgctggctcaggagggcttcctggtggacacacccctggcaagggctctggtggctcggggcacagaaggcctctgtccactactttgccatgctgatgggacacccctgggcgctggggcccgagccaccaacccacaactggcagctgtgcttcgcagcgcagccctcgctcccacctcagaccttgctggggatgctctactgagtctactggcgggagacctgggggtggaggtgccctcggctgtgcccaggcccactttggaaccagcagagcagctacctgtgccccagggcatcctgttcaccacccccagtccctcagctggcccagaactgctggcactgttggaggcagccctgcgctccggggcgcccatccctgacccctgcccaccgttcctgcagactgctgtgagccccgagagcagtgccctggccgccgtggacagcagcggctctgtgctccttctcacctcctcgctcaactgctcctttggctctgcacacctgtccccaagcactggggttctgctcagcaacctggtggccaagtctaccactagtgcctgggcctgccccctcatcctccgtggcagcctggatgacacagaggctgatgtgttggggcttgtggcttcagggacccctgatgtggccagggccatgactcacaccctactcaggcatctggcagcaaggccccctacccaggcccagcaccagcatcagggtcagcaagaaccaacagagcatcccagcacttgtggccaagggaccctgctccaggtggcagcccacacagagcacgcccatgtctccagtgtcccccatgcctgctgccccttccaggggttctaacaggatgggggtgggtctggcagaaggcagagttatctgaagcatgggggcaggagcagagcagacacagcagcaatggagtgtgcacccgcagggtgtggtgcctcacacctgtaatctcagcactttgggtggtcaaggcaggaagatacctcgaggccaggagtttgaaactagcctagacaacaaagcaagatctcatctgtactaaaaatttaaaaatttgccaggggcggtggcacatgcctgttgtcccagctgcttgggaggctgaggcaggaagctcgcttgagctcaggagttcaaggctgcagagagctaggatcacaccactgcactccagcctggacaacagagtgagaacctgtctttaaaataataataataataataaaaaaatagctgggtgcggtggctcatgcctgtaatcccagcactttgggaggccaaggcaggtggatcacctgaggctaggagttcgagaccagcttgggcaacatggcgaaaccccgtctctactaaaaatacaaaaaattagctgggcatggtggcgggcacctgtaatcccagctacttgggaggctgaggcaggagaatcacttgaacccgagaggtggaggttgcagtgaaccaagatcgcaccattgcaaccccacctgggcaacaagagggaaaccctgtctaaaaaaaaaaaaaaaaaaaaggatttattatgtgctcactgctggctcaggccccaacctctggccttttaagttacctagacttgagttctggcatccagagctaacaatcattcttcagatcacccacaccggatggaatctctagctattttatcagctaagaaaatcagggtaataacgaaaaagcagtagggcctggggctagcactgagttcagatccagctttcaggaggacagtggaaagagtgcagagcctctgcctaggccctgggccccacgaagcaggacaggcagagcccagggtactgttggcatctctgtccttcccttcaggacaccccttacctatctgcctcaaccagactgggtacaaaataaagatcaagtctcccggaaacc

SEQ ID NO: 11874 - DNA, 2628 bp, Homo sapiens
ctctgagacacagccggaaaggctggcaggcaggagggctggggcgagcactggggggccatggagcgggcagaagagcccgtggtctatcagaagctgctgccctgggagccaagcttggagtcggaggaggaagtggaggaggaggagacatcagaggcgctggttctaaacccccggaggcaccaggactcttccaggaacaaggctggcgggctgcccggaacctgggcccgtgtagtggcagccctgctgctgctggctgttggctgctccctggctgtgaggcagctccagaatcagggcaggtcgacaggaagcttgggctctgtggcccctccacccggcggacactcccacggccctggcgtataccaccacggtgccatcatcagccctgcaggccgagagctgcttgttgccgggggcaacgtcgtggatgctggagttggagctgcattgtgcctggcagtggtgcatcctcatgccacggggctaggtgccatgttttggggcctcttccacgatagctcctcaggcaattccacggccctgacatcaggcccagcacagaccctggcccccggcctggggctgcccgcggctctgcccaccctgcacctgctgcatgcacgcttcggccgcctgccctggccacgcctgctagtgggccccaccacgctggctcaggagggcttcctggtggacacacccctggcaagggctctggtggctcggggcacagaaggcctctgtccactactttgccatgctgatgggacacccctgggcgctggggcccgagccaccaacccacaactggcagctgtgcttcgcagcgcagccctcgctcccacctcagaccttgctggggatgctctactgagtctactggcgggagacctgggggtggaggtgccctcggctgtgcccaggcccactttggaaccagcagagcagctacctgtgccccagggcatcctgttcaccacccccagtccctcagctggcccagaactgctggcactgttggaggcagccctgcgctccggggcgcccatccctgacccctgcccaccgttcctgcagactgctgtgagccccgagagcagtgccctggccgccgtggacagcagcggctctgtgctccttctcacctcctcgctcaactgctcctttggctctgcacacctgtccccaagcactggggttctgctcagcaacctggtggccaagtctaccactagtgcctgggcctgccccctcatcctccgtggcagcctggatgacacagaggctgatgtgttggggcttgtggcttcagggacccctgatgtggccagggccatgactcacaccctactcaggcatctggcagcaaggccccctacccaggcccagcaccagcatcagggtcagcaagaaccaacagagcatcccagcacttgtggccaagggaccctgctccaggtggcagcccacacagagcacgcccatgtctccagtgtcccccatgcctgctgccccttccaggggttctaacaggatgggggtgggtctggcagaaggcagagttatctgaagcatgggggcaggagcagagcagacacagcagcaatggagtgtgcacccgcagggtgtggtgcctcacacctgtaatctcagcactttgggtggtcaaggcaggaagatacctcgaggccaggagtttgaaactagcctagacaacaaagcaagatctcatctgtactaaaaatttaaaaatttgccaggggcggtggcacatgcctgttgtcccagctgcttgggaggctgaggcaggaagctcgcttgagctcaggagttcaaggctgcagagagctaggatcacaccactgcactccagcctggacaacagagtgagaacctgtctttaaaataataataataataataaaaaaatagctgggtgcggtggctcatgcctgtaatcccagcactttgggaggccaaggcaggtggatcacctgaggctaggagttcgagaccagcttgggcaacatggcgaaaccccgtctctactaaaaatacaaaaaattagctgggcatggtggcgggcacctgtaatcccagctacttgggaggctgaggcaggagaatcacttgaacccgagaggtggaggttgcagtgaaccaagatcgcaccattgcaaccccacctgggcaacaagagggaaaccctgtctaaaaaaaaaaaaaaaaaaaaggatttattatgtgctcactgctggctcaggccccaacctctggccttttaagttacctagacttgagttctggcatccagagctaacaatcattcttcagatcacccacaccggatggaatctctagctattttatcagctaagaaaatcagggtaataacgaaaaagcagtagggcctggggctagcactgagttcagatccagctttcaggaggacagtggaaagagtgcagagcctctgcctaggccctgggccccacgaagcaggacaggcagagcccagggtactgttggcatctctgtccttcccttcaggacaccccttacctatctgcctcaaccagactgggtacaaaataaagatcaagtctcccggaaacc

SEQ ID NO: 11875 - DNA, 1808 bp, Homo sapiens
cccatccccatgtctgcccaagatgcacccgctgccaagaagccctttctccttggctgacttgtgctcctcttgctaaatcaaaccttttgggaaatattccctggggtctcttggggtccttgggcatccctctgtcccagccgtggctcaggacaccccccctctgcaggaacaaggctggcgggctgcccggaacctgggcccgtgtagtggcagccctgctgctgctggctgttggctgctccctggctgtgaggcagctccagaatcagggcaggtcgacaggaagcttgggctctgtggcccctccacccggcggacactcccacggccctggcgtataccaccacggtgccatcatcagccctgcagccacatgctcccacctaggccgagagctgcttgttgccgggggcaacgtcgtggatgctggagttggagctgcattgtgcctggcagtggtgcatcctcatgccacggggctaggtgccatgttttggggcctcttccacgatagctcctcaggcaattccacggccctgacatcaggcccagcacagaccctggcccccggcctggggctgcccgcggctctgcccaccctgcacctgctgcatgcacgcttcggccgcctgccctggccacgcctgctagtgggccccaccacgctggctcaggagggcttcctggtggacacacccctggcaagggctctggtggctcggggcacagaaggcctctgtccactactttgccatgctgatgggacacccctgggcgctggggcccgagccaccaacccacaactggcagctgtgcttcgcagcgcagccctcgctcccacctcagaccttgctggggatgctctactgagtctactggcgggagacctgggggtggaggtgccctcggctgtgcccaggcccactttggaaccagcagagcagctacctgtgccccagggcatcctgttcaccacccccagtccctcagctggcccagaactgctggcactgttggaggcagccctgcgctccggggcgcccatccctgacccctgcccaccgttcctgcagactgctgtgagccccgagagcagtgccctggccgccgtggacagcagcggctctgtgctccttctcacctcctcgctcaactgctcctttggctctgcacacctgtccccaagcactggggttctgctcagcaacctggtggccaagtctaccactagtgcctgggcctgccccctcatcctccgtggcagcctggatgacacagaggctgatgtgttggggcttgtggcttcagggacccctgatgtggccagggccatgactcacaccctactcaggcatctggcagcaaggccccctacccaggcccagcaccagcatcagggtcagcaagaaccaacagagcatcccagcacttgtggccaagggaccctgctccaggtggcagcccacacagagcacgcccatgtctccagtgtcccccatgcctgctgccccttccaggggttctaacaggatgggggtgggtctggcagaaggcagagttatctgaagcatgggggcaggagcagagcagacacagcagcaatggagtgtgcacccgcagggtgtggtgcctcacacctgtaatctcagcactttgggtggtcaaggcaggaagatacctcgaggccaggagtttgaaactagcctagacaacaaagcaagatctctgtccttcccttcaggacaccccttacctatctgcctcaaccagactgggtacaaaataaagatcaagtctcccgg

SEQ ID NO: 11876 - DNA, 2482 bp, Homo sapiens
agtatcaaggttgtggcattaaggctgaactccttctcgacctcactgagctgtggccccttacaggcagtcaccccgggaaccctgtcgcgagagctcctcgggccttgtgtcctaatggggcaggctcacatgcagcctccttggccccgtgccctgcccagacctgttctggattccacccccacccttccccaaggtcgctgccacctcccacctgccaggcttgggcagggcctctgagacacagccggaaaggctggcaggcaggagggctggggcgagcactggggggccatggagcgggcagaagagcccgtggtctatcagaagctgctgccctgggagccaagcttggagtcggaggaggaagtggaggaggaggagacatcagaggcgctggttctaaacccccggaggcaccaggactcttccaggaacaaggctggcgggctgcccggaacctgggcccgtgtagtggcagccctgctgctgctggctgttggctgctccctggctgtgaggcagctccagaatcagggcaggtcgacaggaagcttgggctctgtggcccctccacccggcggacactcccacggccctggcgtataccaccacggtgccatcatcagccctgcaggccgagagctgcttgttgccgggggcaacgtcgtggatgctggagttggagctgcattgtgcctggcagtggtgcatcctcatgccacggggctaggtgccatgttttggggcctcttccacgatagctcctcaggcaattccacggccctgacatcaggcccagcacagaccctggcccccggcctggggctgcccgcggctctgcccaccctgcacctgctgcatgcacgcttcggccgcctgccctggccacgcctgctagtgggccccaccacgctggctcaggagggcttcctggtggacacacccctggcaagggctctggtggctcggggcacagaaggcctctgtccactactttgccatgctgatgggacacccctgggcgctggggcccgagccaccaacccacaactggcagctgtgcttcgcagcgcagccctcgctcccacctcagaccttgctggggatgctctactgagtctactggcgggagacctgggggtggaggtgccctcggctgtgcccaggcccactttggaaccagcagagcagctacctgtgccccagggcatcctgttcaccacccccagtccctcagctggcccagaactgctggcactgttggaggcagccctgcgctccggggcgcccatccctgacccctgcccaccgttcctgcagactgctgtgagccccgagagcagtgccctggccgccgtggacagcagcggctctgtgctccttctcacctcctcgctcaactgctcctttggctctgcacacctgtccccaagcactggggttctgctcagcaacctggtggccaagtctaccactagtgcctgggcctgccccctcatcctccgtggcagcctggatgacacagaggctgatgtgttggggcttgtggcttcagggacccctgatgtggccagggccatgactcacaccctactcaggcatctggcagcaaggccccctacccaggcccagcaccagcatcagggtcagcaagaaccaacagagcatcccagcacttgtggccaagggaccctgctccaggtggcagcccacacagagcacgcccatgtctccagtgtcccccatgcctgctgccccttccaggggttctaacaggatgggggtgggtctggcagaaggcagagttatctgaagcatgggggcaggagcagagcagacacagcagcaatggagtgtgcacccgcagggtgtggtgcctcacacctgtaatctcagcactttgggtggtcaaggcaggaagatacctcgaggccaggagtttgaaactagcctagacaacaaagcaagatctcatctgtactaaaaatttaaaaatttgccaggggcggtggcacatgcctgttgtcccagctgcttgggaggctgaggcaggaagctcgcttgagctcaggagttcaaggctgcagagagctaggatcacaccactgcactccagcctggacaacagagtgagaacctgtctttaaaataataataataataataaaaaaatagctgggtgcggtggctcatgcctgtaatcccagcactttgggaggccaaggcaggtggatcacctgaggctaggagttcgagaccagcttgggcaacatggcgaaaccccgtctctactaaaaatacaaaaaattagctgggcatggtggcgggcacctgtaatcccagctacttgggaggctgaggcaggagaatcacttgaacccgagaggtggaggttgcagtgaaccaagatcgcaccattgcaaccccacctgggcaacaagagggaaaccctgtctaaaaaaaaaaaaaaaaaaaa

SEQ ID NO: 11877 - DNA, 974 bp, Homo sapiens
attgaatgcagcaagggtctggaggctgaggaccaggcagacaaacattcagagttgctggaatgcgacagagacagggagtcagactggtcatgcaaggccagctctggggtctcggcaggtggtccgcgacatgacctccgagttcttctctgcccagctccgggcccagatctctgacgacaccactcacccgatctcctactacaagcccgagttctacatgccggatgacgggggcactgctcacctgtctgtggtcgcagaggacggcagtgctgtgtccgccaccagcaccatcaacctctactttggctccaaggtgcgctccccagtcagcgggatcctgctcaataatgaaatggatgacttcagctctaccagcatcaccaacgagtttggggtacccccctcacctgccaatttcatccagccagggaagcagccgctctcgtccatgtgcccgacgatcatggtgggccaggacggccaggtccggatggtggtgggagctgccgggggcacgcagatcaccatggccactgcactggccatcatctacaacctctggttcggctatgacgtgaagtgggccgtggaggagccccggctgcacaaccagcttctgcccaacgtcacgacagtggagagaaacattgaccaggaagtgactgcagccctggagacccggcaccatcacacccagatcacgtccaccttcattgctgtggtgcaagccatcgtccgcatggctggtggctgggcagctgcctcggactccaggaaaggtggggaacctgctggctactgattgctccaggcggacaaggctgacaagcaatccaggaacaaaatactcaccaggacgaggaagaggactttgggggacaggcttctcctgtgagcagcagagcagcacaataaatgaggccactgtgccaggctccaggtggcctccctggcctgtctcccca

SEQ ID NO: 11878 - DNA, 1025 bp, Homo sapiens
gtcagactggtcatgcaaggtcctgggcctgcccttgggtcctggggagccacggaaggttgtgggtgccagagggttgtggtcagagccacagtcaggggccttctgagacctgtgccccctccccaccctccctccccacctccctaggccagctctggggtctcggcaggtggtccgcgacatgacctccgagttcttctctgcccagctccgggcccagatctctgacgacaccactcacccgatctcctactacaagcccgagttctacatgccggatgacgggggcactgctcacctgtctgtggtcgcagaggacggcagtgctgtgtccgccaccagcaccatcaacctctactttggctccaaggtgcgctccccagtcagcgggatcctgctcaataatgaaatggatgacttcagctctaccagcatcaccaacgagtttggggtacccccctcacctgccaatttcatccagccagggaagcagccgctctcgtccatgtgcccgacgatcatggtgggccaggacggccaggtccggatggtggtgggagctgccgggggcacgcagatcaccatggccactgcactggccatcatctacaacctctggttcggctatgacgtgaagtgggccgtggaggagccccggctgcacaaccagcttctgcccaacgtcacgacagtggagagaaacattgaccaggaagtgactgcagccctggagacccggcaccatcacacccagatcacgtccaccttcattgctgtggtgcaagccatcgtccgcatggctggtggctgggcagctgcctcggactccaggaaaggtggggaacctgctggctactgattgctccaggcggacaaggctgacaagcaatccaggaacaaaatactcaccaggacgaggaagaggactttgggggacaggcttctcctgtgagcagcagagcagcacaataaatgaggccactgtgccaggctccaggtggcctccctggcctgtctcccca

SEQ ID NO: 11879 - DNA, 1046 bp, Homo sapiens
ctcgagagctgggctctgcgtcctcgtccagccgccaactcggccaaaggcgaagccagcagtttcttctgctgccgggcaacgcgccttttaaacctgagggagtgggcgcgtgagcacttaatggcgccggtgacagagtgagcttaacggattaataagcgcagccaggccagctctggggtctcggcaggtggtccgcgacatgacctccgagttcttctctgcccagctccgggcccagatctctgacgacaccactcacccgatctcctactacaagcccgagttctacatgccggatgacgggggcactgctcacctgtctgtggtcgcagaggacggcagtgctgtgtccgccaccagcaccatcaacctctactttggctccaaggtgcgctccccagtcagcgggatcctgctcaataatgaaatggatgacttcagctctaccagcatcaccaacgagtttggggtacccccctcacctgccaatttcatccagccagggaagcagccgctctcgtccatgtgcccgacgatcatggtgggccaggacggccaggtccggatggtggtgggagctgccgggggcacgcagatcaccatggccactgcactggccatcatctacaacctctggttcggctatgacgtgaagtgggccgtggaggagccccggctgcacaaccagcttctgcccaacgtcacgacagtggagagaaacattgaccaggaagtgactgcagccctggagacccggcaccatcacacccagatcacgtccaccttcattgctgtggtgcaagccatcgtccgcatggctggtggctgggcagctgcctcggactccaggaaaggtggggaacctgctggctactgattgctccaggcggacaaggctgacaagcaatccaggaacaaaatactcaccaggacgaggaagaggactttgggggacaggcttctcctgtgagcagcagagcagcacaataaatgaggccactgtgccaggctccaggtggcctccctggcctgtctcccca

SEQ ID NO: 11880 - DNA, 678 bp, Homo sapiens
atgacctctgagttcttcgctgcccagctccgggcccagatctctgacgacaccactcacccgatctcctactacaagcccgagttctacacgccggttgatgggggcactgctcacctgtctgtcgtcgcagaggacggcagtgctgtgtccgccaccagcaccatcaacctctactttggctccaaggtccgctccccggtcagcgagatcctgttcaatgatgaaatggatgacttcagctctcccaacatcaccaacgagtttggggtgcccccctcacctgccaatttcatccagccagggaagcagccgctctcgtcaatgtgcccgacgatcatggtgggccaggacggccaggtccggatggtggtgggagctgctgggggcacacagatcaccacagccactgcactggccatcatctacaacctctggttcggctatgacgtgaagcgggccgtggaggagccccggctgcacaaccagcttctgcccaacgtcacgacagtggagagaaacattgaccaggcagtgactgcagccctggagacccggcaccatcacacccagatcgcgtccaccttcatcgctgtggtgcaagccatcgtccgcacggctggtggctgggcagctgcctcggactccaggaaaggcggggagcctgccggctactga

SEQ ID NO: 11881 - DNA, 657 bp, Homo sapiens
atgacctctgagttcttcgctgcccagctccgggcccagatctctgacgacaccactcacccgatctcctactacaagcccgagttctacacgccggttgatgggggcactgctcacctgtctgtcgtcgcagaggacggcagtgctgtgtccgccaccagcaccatcaacctctactttggctccaaggtccgctccccggtcagcgagatcctgttcaatgatgaaatggatgacttcagctctcccaacatcaccaacgagtttggggtgcccccctcacctgccaatttcatccagccagggaagcagccgctctcgtcaatgtgcccgacgatcatggtgggccaggacggccagcccccaagccatgctgatcacactcccatgccccaggccatcatctacaacctctggttcggctatgacgtgaagcgggccgtggaggagccccggctgcacaaccagcttctgcccaacgtcacgacagtggagagaaacattgaccaggcagtgactgcagccctggagacccggcaccatcacacccagatcgcgtccaccttcatcgctgtggtgcaagccatcgtccgcacggctggtggctgggcagctgcctcggactccaggaaaggcggggagcctgccggctactga

SEQ ID NO: 11882 - DNA, 968 bp, Homo sapiens
attgaatgcggcaagggtctggaggctgaggaccaggcagacagacattcagagttgctggaacgcgacagagacagggagtcagactggtcatgcaaggccagctctggggtctcagcaggtggtccgcaacatgacctctgagttcttcgctgcccagctccggtcccagatctctgaccacaccactcacccgatctcctactacaagcccgagttctacacgccggatgacgggggcactgctcacctgtctgtcgtcgcagaggacggcagtgctgtgtccgccaccagcaccatcaacctctactttggctccaaggtctgctccccggtcagtgggatcctgttcaataatgaatggacgacttcagctctcccagcattcaccaatgagtttggggcacccccctcacctgccaatttcatccagccagggaagcagccgctcttgtccatgtgcccgacgatcatggtgggccaggacggccaggtccggatggtggtgggagctgctgggggcacgcagatcaccacagacactgcactggccatcatctacaacctctggttcggctatgacgtgaagagggccgtggaggagccccggctgcacaacaagcttctgcccaacgtcacgacagtggagagaaacattgaccaggcagtgactgcagccctggagacccggcaccatcacacccagatcgcatccaccttcatcgctgtggtgcaagccatcgtccgcacggctggtggctgggcagctgcctcggactccaggaaaggcggggaacctgctggctactgattgctccaggcagacaaggctgacaagcaatccagggacaagatactcaccaggatgaggaagaggactttgggggacgggcttcccctgtgagcagcagagcagcataataaatgaggccactgtgccaggctccaggtggcctccctggcctgtc

SEQ ID NO: 11883 - DNA, 873 bp, Homo sapiens
ccagctctggggtctcagcaggtggtccgcaacatgacctctgagttcttcgctgcccagctccggtcccagatctctgaccacaccactcacccgatctcctactacaagcccgagttctacacgccggatgacgggggcactgctcacctgtctgtcgtcgcagaggacggcagtgctgtgtccgccaccagcaccatcaacctctactttggctccaaggtctgctccccggtcagtgggatcctgttcaataatgaatggacgacttcagctctcccagcattcaccaatgagtttggggcacccccctcacctgccaatttcatccagccagggaagcagccgctcttgtccatgtgcccgacgatcatggtgggccaggacggccaggtccggatggtggtgggagctgctgggggcacgcagatcaccacagacactgcactggccatcatctacaacctctggttcggctatgacgtgaagagggccgtggaggagccccggctgcacaacaagcttctgcccaacgtcacgacagtggagagaaacattgaccaggcagtgactgcagccctggagacccggcaccatcacacccagatcgcatccaccttcatcgctgtggtgcaagccatcgtccgcacggctggtggctgggcagctgcctcggactccaggaaaggcggggaacctgctggctactgattgctccaggcagacaaggctgacaagcaatccagggacaagatactcaccaggatgaggaagaggactttgggggacgggcttcccctgtgagcagcagagcagcataataaatgaggccactgtgccaggctccaggtggcctccctggcctgtctcccc

SEQ ID NO: 11884 - DNA, 3666 bp, Homo sapiens
ggaaacgccttgcggggcagtgtgggagggagaagtccagggcggacaggctgggcgcacccgtgctcgcgcaccccaagatggctgagaggcaggaagagcagagagggagcccgcccttgagggcggaaggcaaggccgacgcggaggttaagctcattctgtaccattggacgcattcgttcagctctcaaaaggtgcgcttggtaattgctgaaaaggcattgaagtgcgaggaacatgatgtaagtctgcccttgagtgagcacaatgagccttggtttatgcgtttgaactcaactggagaagtgcctgtccttatccacggggaaaacataatttgtgaggccactcagatcattgattatcttgaacagactttcctggatgaaagaacacccaggttaatgcctgataaagaaagcatgtattacccacgggtacaacattaccgagagctgcttgactccttgccaatggatgcctatacacatggctgcattttacatcctgagttaactgtggactccatgatcccggcttatgcaactacaaggattcgtagccaaattggaaacacagagtctgagctgaagaaacttgctgaagaaaacccagatttacaagaagcatacattgcaaaacagaaacgacttaaatcaaagctgcttgatcatgacaatgtcaagtatttgaagaaaattcttgatgagttggagaaagtcttggatcaggttgaaactgaattgcaaagaagaaatgaagaaaccccagaagagggccagcaaccttggctctgcggtgaatccttcaccctggcagacgtctcactcgctgtcacattgcatcgactgaagttcctggggtttgcaaggagaaactggggaaacggaaagcgaccaaacttggaaacctattacgagcgtgtcttgaagagaaaaacatttaacaaggttttaggacatgtcaacaatatattaatctctgcagtgctgccaacagcattccgggtggccaagaaaagggccccaaaagttcttggcacgacccttgtggttggtttgcttgcaggagtgggatattttgcttttatgcttttcagaaagaggcttggcagcatgatattagcatttagacccagaccaaattatttctaggtttgttgggatcttgtcgtggcagctcatccaagcatttagctagaccctgtgattgcccgtggctctctgagtctgtcttattgagtagttagcagtattttttcctaaaattcagaagtcatctttgttacacaacacaggggttcaggtagcaataggacacaaaattgctttattctacaactgccagctccaggcagaaataggaaggcaaagagataagagaaggaaaaatgagagaatgaagtctgtatagggtagagcaatagaaagtaagcttcgggtgcctccaacgttcatggctgcctgtctcattggtaaacctcacatttagttacttgtggctactgcccacacatacacttctgtaattgagaactcttaggagaggactagggaatcactggggatagtgggctggagagaaccccaggctttatatgtatactttgacctcagtgttaattttaaatgcttatgaatcacacacattgctttagtaagattaagtgcttatatactagaaatttgatgctcattggaacacatctgcctagcatttctgtaaaagtcttaagtgatattaagatgattccttaccatttcagatggtccgcaatttgaattaccaagtggtaatggttccttactgttttagatggtgcctgtgagataccattcctctggatggtcatgtccagtcagtgggaggtagaaagggtggcatctgtagccctcttcatacacataagtggcatttaggtgaatgtcccagctaatcactagcatgtctaggtattggctgggtagtgggtattttgatgatctgggagcaccaaatatgttcattcttcgtttggggaggctggtctgtaaacacaaaaattgttgtccagatctttcatctgtttatgatcatcaacaaagacttgttagaaaggtctagtcttagcacttggcagttaatctagggaagatgaattaaatgggtagatagtgatgcatacctgtattcactgatgtatgtttaagggatttgggggggatacctcagttcatgtggaagggacagtctcggtgtgtcccatgaataaccttggaactgcaacaaatggtttgtgctcagaaaaagtctttcatggtgacaggaagacagtttccctggagctggccatgaaggccttagaagccatttctggtgtctggtgggtagcaggcatagagatgatgtgccgaggtcccagtgaacaacagtagccaaagaatgtactaactttatcattaataggaaagtcatacctaggaaacaatgactttttgatggcaaaatgattttttaattctattttgatgctgtaattccatttcatgacctagttgtattagaaaaccttgatgaactatatgttcccgatttacaaaaaaattaataaaacctccagagtaaactcagtcaaacaataattgagtagcagcttttataacatttaaaatttgcacatgagtgtgttgtcatatggagtgtctgaatctgttgctgggacataccaatccatgtattcattagagccatagaagttattattcattagttcatagtgtttgagttctttatgtcactctgttagaaacaagaactgagtcgtgaagaaataagaattggatttttataaaaacctctgaaggatatttacctatgaaaaagttgttaagaataaaaattagaagtccatggttaacttttccttcaatttatattattcctgaatcatagggaatctttctagaatgtgtttataatttccttgtacagtttctttggaaatacgttaaagatagtggcaatttcatatatttcatggatacttgagtttgtgcttttaaggtgtttgtttagggatacaatgaccactagatgtcgctgtttatccagtagactaagattgagtgttctttttgttcagcaactcttctaaaatgtttcaagcaaagatagtaatgacctcagtttctgaaataagggcatcttcatcagattattcttctgttttaaaaaaaagcttgaggcaaatgtgagtgatttccagtgctttgaaagggattacagtatcacacaatgtcaagctagagttaaacacagtattagctaaataggcacttatgtgtattttctttttcatgattatcggtgactggtcagtgtactcatcaatttccaaaatttgtataaatatcacaattagaaaaatgcctgaggtactaaagttatgttggctttttgtgtcttaacacacataaatactattgttattgcagcagatgccttttgaatccattttccataattgcggatagtcataaattgcttgctcaatttttagtaattattgctgttgacaccagcgttgtagatttttggtgttgttgaatgcagtagagagaccaagacactattctgtaagatcaataaaagtaattggaaaataaatatgaaccctaaaacaaa

SEQ ID NO: 11885 - DNA, 1228 bp, Homo sapiens
ccagggcggacaggctgggcgcacccgtgctcgcgcaccccaagatggctgagaggcattgaagtgcgaggaacatgatgtaagtctgcccttgagtgagcacaatgagccttggtttatgcgtttgaactcaactggagaagtgcctgtccttatccacggggaaaacataatttgtgaggccactcagatcattgattatcttgaacagactttcctggatgaaagaacacccaggttaatgcctgataaagaaagcatgtattacccacgggtacaacattaccgagagctgcttgactccttgccaatggatgcctatacacatggctgcattttacatcctgagttaactgtggactccatgatcccggcttatgcaactacaaggattcgtagccaaattggaaacacagagtctgagctgaagaaacttgctgaagaaaacccagatttacaagaagcatacattgcaaaacagaaacgacttaaatcaaagctgcttgatcatgacaatgtcaagtatttgaagaaaattcttgatgagttggagaaagtcttggatcaggttgaaactgaattgcaaagaagaaatgaagaaaccccagaagagggccagcaaccttggctctgcggtgaatccttcaccctggcagacgtctcactcgctgtcacattgcatcgactgaagttcctggggtttgcaaggagaaactggggaaacggaaagcgaccaaacttggaaacctattacgagcgtgtcttgaagagaaaaacatttaacaaggttttaggacatgtcaacaatatattaatctctgcagtgctgccaacagcattccgggtggccaagaaaagggccccaaaagttcttggcacgacccttgtggttggtttgcttgcaggagtgggatattttgcttttatgcttttcagaaagaggcttggcagcatgatattagcatttagacccagaccaaattatttctaggtttgttgggatcttgtcgtggcagctcatccaagcatttagctagaccctgtgattgcccgtggctctctgagtctgtcttattgagtagttagcagtattttttcctaaaattcagaagtcatctttgttacacaacacaggggttcaggtagcaataggacacaaaattgctttattctacaactgccagctccaggcagaaataggaaggcaaagagataagagaaggaaaaa

SEQ ID NO: 11886 - DNA, 1652 bp, Homo sapiens
atgggggactggaacttattgggtggcatcctagaggaagttcactcccactcaaccatagtggggaaaatctggctgaccatcctcttcatcttccgaatgctggtacttcgtgtggctgctgaggatgtctgggatgatgaacagtcagcatttgcctgcaacacccggcagccaggttgcaacaatatctgttatgatgatgcattccctatctctttgatcaggttctgggttttacagatcatctttgtgtcttctccttctttggtctatatgggccatgcactttataggctcagggcctttgagaaagacaggcagaggaaaaagtcacaccttagagcccagatggagaatccagatcttgacttggaggagcagcaaagaatagatagggaactgaggaggttagaggagcagaagaggatccataaagtccctctgaaaggatgtctgctgcgtacttatgtcttacacatcttgaccagatctgtgctggaagtaggattcatgataggccaatatattctctatgggtttcaaatgcaccccctttacaaatgcactcaacctccttgccccaatgcggtggattgctttgtatccaggcccactgagaagacaattttcatgctttttatgcacagcattgcagccatttccttgttactcaatatactggaaatatttcatctaggcatcagaaaaattatgaggacactttataagaaatccagcagtgagggcattgaggatgaaacaggccctccattccatttgaagaaatattctgtggcccagcagtgtatgatttgctcttcattgcctgaaagaatctctccacttcaagctaacaatcaacagcaagtcattcgagttaatgtgccaaagtctaaaaccatgtggcaaatcccacagccaaggcaacttgaagtagacccttccaatgggaaaaaggactggtctgagaaggatcagcatagcggacagctccatgttcacagcccgtgtccctgggctggcagtgctggaaatcagcacctgggacagcaatcagaccattcctcatttggcctgcagaatacaatgtctcagtcctggctaggtacaactacggctcctagaaactgtccatcctttgcagtaggaacctgggagcagtcccaggacccagaaccctcaggtgagcctctcacagatcttcatagtcactgcagagacagtgaaggcagcatgagagagagtggggtctggatagacagatctcgcccaggcagtcgcaaggccagctttctgtccagattgttgtctgaaaagcgacatctgcacagtgactcaggaagctctggttctcggaatagctcctgcttggattttcctcactgggaaaacagcccctcacctctgccttcagtcactgggcacagaacatcaatggtaagacaggcagccctaccgatcatggaactatcacaagagctgttccattctggatgctttctttttcctttctttcttcctggggtgtgtatgtatgtttgtgttgacagagaggcagatggagggggagattatttatggagagataaaattattcattcgatacattcagttaaattcaattcataaaatagacttagaaaaatctt

SEQ ID NO: 11887 - DNA, 5211 bp, Homo sapiens
cactggggctgcagggatggcgatcagggcggggaggtcgggccctggcgcggggcgcacgcgtgaagcagcaccgcacgtgtgaaaggaattcttttcagagcggccgggagccctgctccggaggaacgcacccgggtcgccgccgcggcagagcggggttaggaatctgaagcaatgggcgactggagctttctgggaagactcttagaaaatgcacaggagcactccacggtcatcggcaaggtttggctgaccgtgctgttcatcttccgcatcttggtgctgggggccgcggcggaggacgtgtggggcgatgagcagtcagacttcacctgcaacacccagcagccgggctgcgagaacgtctgctacgacagggccttccccatctcccacatccgcttctgggcgctgcagatcatcttcgtgtccacgcccaccctcatctacctgggccacgtgctgcacatcgtgcgcatggaagagaagaagaaagagagggaggaggaggagcagctgaagagagagagccccagccccaaggagccaccgcaggacaatccctcgtcgcgggacgaccgcggcagggtgcgcatggccggggcgctgctgcggacctacgtcttcaacatcatcttcaagacgctgttcgaggtgggcttcatcgccggccagtactttctgtacggcttcgagctgaagccgctctaccgctgcgaccgctggccctgccccaacacggtggactgcttcatctccaggcccacggagaagaccatcttcatcatcttcatgctggcggtggcctgcgcgtccctgctgctcaacatgctggagatctaccacctgggctggaagaagctcaagcagggcgtgaccagccgcctcggcccggacgcctccgaggccccgctggggacagccgatcccccgcccctgccccccagctcccggccgcccgccgttgccatcgggttcccaccctactatgcgcacaccgctgcgcccctgggacaggcccgcgccgtgggctaccccggggccccgccaccagccgcggacttcaaactgctagccctgaccgaggcgcgcggaaagggccagtccgccaagctctacaacggccaccaccacctgctgatgactgagcagaactgggccaaccaggcggccgagcggcagcccccggcgctcaaggcttacccggcagcgtccacgcctgcagcccccagccccgtcggcagcagctccccgccactcgcgcacgaggctgaggcgggcgcggcgcccctgctgctggatgggagcggcagcagtctggaggggagcgccctggcagggacccccgaggaggaggagcaggccgtgaccaccgcggcccagatgcaccagccgcccttgcccctcggagacccaggtcgggccagcaaggccagcagggccagcagcgggcgggccagaccggaggacttggccatctagtgcccgggtgcctgcctccagacagctgtgtagtgatctttttcttagaaaccaaaaccaaagtgcacttcccaccagcagatagaacctgaaagtcccaggaggtgggagcgactggagtcccaggaggtggacgatggaggagagatcaggtttccgtgttcaatgcttgctgttcttagcactgtgagttacagtggggataactcccactttctgagtttgggggtggcggggacaagggttgtgggcctttaagatcttcacagcagcccagaaatctggtcgctgagggctgtctctgggggtaactgttctgtagtggtaaagcaacaggtatcctgcagtccctttagctcctgggcaattgggtttgctattcctaagctctccagagcctctgggcggcccagagggtcttagctctgggccagagcacttagctctatctctttgatacttttaacttagagttgaatttcatttgggatatttgccaaactgcactaaaaaaagatttacagcaagtctatgtagtgtcatttgagtttccgaaattgcatgtgaagcccaggatatcaagcttcaggcctcatgacaagtgacaaagagcagttgccctccagaggcaggctcagtgggcaagggccccagaggttgctggcagaaggcaggtggaaacgcagccacgcctgaggccatttttaaacagttgaggaaattgacataaaagtgtgtcgggtatgccgtaggtatttattttctaaatgattattttgtgctttgaatggtgcagctatgcctattttctcccactttctttcaggaaaaatgaaagaaaaatagtgtttttctttctttaaatactgttagaatgattgctgaccaagacagtgctaatttgccctaatgcatgctactagcatctttactaaagattttgaactttcttgtaaaagaaattctttaatttcatgagtcacctaattataatgagaatgtattatataaaacaaaagcaggggaaagttttaagtgcattcaaatagaagttctgaagattttgaatgggaagtgaaaagtgaactactgttgccaggaaaattatttatacagatgaatctatgacaatctacacttttaaaaagtacagaataaaacacttcaagcttcctaatcattctttgtgggcagcctgtttgctttctccagtgtaaataatataagtgtctggggatccctgcctgggggagggcgcgtgctcatgcaggctgtatgccccattctgcctccacaccagagctgtcctgacagggaaggctatttatgtgtgtgggcatggctggaagacggcagaattttctgtcctgcacacacagctgtagtatcttggtcaccatttgtttataaaatgaacgatggtcatgttgagcctgtttctactcacacttttcacctccaacttctactgagtatcattagcccttgttcagcgagaccaatgtaatacatttctttttataaattaacttctcgatgatgcatttgggaccacactccaaacatactttctgttttctatcataaagggtgctccactaacaatctgatgaaaggaatgcaatttccaagtctcagattcttgcatgcaactagtttttcatgtcagtcaaacacaaagaatttgttagtacattctgcttgctgtaggatgcactggacaggctcctaggcttgaaaaatgctaacttttccatacgtctcctcagagactttctcaaccagattgacaagagagaaattagccctttggaaaactgtgagtgactttctcactcctctccaggctggtgcataactacagccattctagatgcataacttctctccgaagttcactcattacatgcagtgtatgccataggcctagggcagcaggacttagttcttgtgagtgataagggctgctagaagatcctagtgtgagaagcattccgataaaaagctttggccattttagaaaatgcaatagcaatcatccaagagcacaagtacagctcaagtacaagtggatgtcaatacttggttctttaagttctaccataataaatgttcataacagtaacaagcttcttatttacccacaatttgattttgagtggggttggagatgagcatgagaactcaaattgtatctagtttttacattttaaaattgaatttagtcacaatatgtttatggaaatgccagtattgtaccattgaccatagtctagtgggtccatttagagtggataggagtgtagaattagattcacctacttgaaaatcactaatctataaagaagtgaggttttgcaatagaacagtgcctgtggtgttttttcaggttagcatactgatttcagttcatgtaagaaatgaacgcatgtttcacatccttttgctctttgaggtatccatgattctaaaggctgggtccttctctctcaggcagtgtggaattgttctctactcaactagtcctttaagacattgaaacatgcaataaaaatagaaattgcctctctctgtgggcaagattccagacctatttttttctagcctggaaatttcactgaaactattttgttcttgattcattagaaagttttaaaaaatctctaagcctattttaaaactcaaatgctatacctatagcatttgagtattatatttacatacatggtttttaagctgctgtatacaattacttcttatatccctgtttttataaaatgttaaacatcactatagttacagtaccaaaaatcattttttaaattctaaaactattacttatattatcactcactttctcctttttaaacttttaatggttattcttgtattttttaataaaattgacacgaataaatccttaaatttacaaaagaaaaatagcaagccagcatctttctcatttatcctggatttcttcggctctggacaagtaagtggataggtcatagaattcctacacaagaatacctggactaataactatgaatataatttaaacatcactttacaaaaaattaatccaatagggtttaggtctcctttcacgttaggctttttaaaaagtattattaacactttctttattttgtattactgaataaactccttttttctgaattttttgaacttctgatatttgtaacactaattcatgaatctccaccaaaataaatacttatagagagtattgcatgatttaagagagtaaatgtgttttccaaagatgaatagagtcctgccaccatcaccacccgccacccctacaaattgaggatatcctaaataacctttaatatagcatatggacattgtacatttaaggtcagggaaggcacttttcttcctaattttatattacagtgcaaatcttgggttgactcactttaaggtttctgactgcccaaaatattttttcccctttacgttacagaacattataataaggcaaacaagttagggatttgaataacactcaaagcaacaaactgtttccagaaagtaccatatttgaagctgtttggtgtgtaaatgttcatttagctcatgtatttacaaaactcttactaaaacttaatttttgtgccataacagtgtctttcctggattacattgtaactggaagtaagcattttctaaaataataaaagtgcccttaagtttaaa

SEQ ID NO: 11888 - DNA, 1622 bp, Homo sapiens
cagcagggctcccgcgggcgtcactccggccatcgtccccacctccacctgggccgcccggcaggcaggcgacggaggcccgggagccatgggtgactggggcttcctggagaagttgctggaccaggtccaggagcactcgaccgtggtgggtaagatctggctgacggtgctcttcatcttccgcatcctcatcctgggcctggccggcgagtcagtgtggggtgacgagcaatcagatttcgagtgtaacacggcccagccaggctgcaccaacgtctgctatgaccaggccttccccatctcccacatccgctactgggtgctgcagttcctcttcgtcagcacacccaccctggtctacctgggccatgtcatttacctgtctcggcgagaagagcggctgcggcagaaggagggggagctgcgggcactgccggccaaggacccacaggtggagcgggcgctggcggccgtagagcgtcagatggccaagatctcggtggcagaagatggtcgcctgcgcatccgcggagcactgatgggcacctatgtcgccagtgtgctctgcaagagtgtgctagaggcaggcttcctctatggccagtggcgcctgtacggctggaccatggagcccgtgtttgtgtgccagcgagcaccctgcccctacctcgtggactgctttgtctctcgccccacggagaagaccatcttcatcatcttcatgttggtggttggactcatctccctggtgcttaacctgctggagttggtgcacctgctgtgtcgctgcctcagccgggggatgagggcacggcaaggccaagacgcacccccgacccagggcacctcctcagacccttacacggaccaggtcttcttctacctccccgtgggccaggggccctcatccccaccatgccccacctacaatgggctctcatccagtgagcagaactgggccaacctgaccacagaggagaggctggcgtcttccaggccccctctcttcctggacccaccccctcagaatggccaaaaacccccaagtcgtcccagcagctctgcttctaagaagcagtatgtatagaggcctgtggcttatgtcacccaacagaggggtcctgagaagtctggctgcctgggatgccccctgccccctcctggaaggctctgcagagatgactgggctggggaagcaggtgcttgctggccatggagcctcattgcaagttgttcttgaacacctgaggccttcctggtgcccaccaggcactacggcttcctctccagaatgtggctttgcctgagcacagacagagtcagcatggaatgctcttggccaagggtactgggggccctctggccttttgcagctgatccagaggaacccagagccaacttaccccaacctcaccctatggaacagtcacctgtgcgcaggttgtcctcaaaccctctcctcacaggaaaaggcggattgaggctgctgggtcagccttgatcgcacagacagagcttgtgccggatttggccctgtcaaggggactggtgccttgttttcatcactccttcctagttctactgttcaagcttctgaaataaacaggacttgatcacaa

SEQ ID NO: 11889 - DNA, 1059 bp, Homo sapiens
agcagggctcccgcgggcgtcactccggccatcgtccccacctccacctgggccgcccggcaggcaggcggtagaacgggcgtggcagacctccctgcaggcttgttgctgggcgaacgagaaggatgccatgctgacacactgacgtgctctgtctccttgcagacggaggcccgggagccatgggtgactggggcttcctggagaagttgctggaccaggtccaggagcactcgaccgtggtgggtaagatctggctgacggtgctcttcatcttccgcatcctcatcctgggcctggccggcgagtcagtgtggggtgacgagcaatcagatttcgagtgtaacacggcccagccaggctgcaccaacgtctgctatgaccaggccttccccatctcccacatccgctactgggtgctgcagttcctcttcgtcagcacacccaccctggtctacctgggccatgtcatttacctgtctcggcgagaagagcggctgcggcagaaggagggggagctgcgggcactgccggccaaggacccacaggtggagcgggcgctggcggccgtagagcgtcagatggccaagatctcggtggcagaagatggtcgcctgcgcatccgcggagcactgatgggcacctatgtcgccagtgtgctctgcaagagtgtgctagaggcaggcttcctctatggccagtggcgcctgtacggctggaccatggagcccgtgtttgtgtgccagcgagcaccctgcccctacctcgtggactgctttgtctctcgccccacggagaagaccatcttcatcatcttcatgttggtggttggactcatctccctggtgcttaacctgctggagttggtgcacctgctgtgtcgctgcctcagccgggggatgagggcacggcaaggccaagacgcacccccgacccagggcacctcctcagacccttacacggaccaggtcttcttctacctccccgtgggccaggggccctcatccccaccatgccccacctacaatgggctctcatccagtgagcagaactgggcca

SEQ ID NO: 11890 - DNA, 1029 bp, Homo sapiens
atgggtgactggggcttcctggagaagttgctggaccaggtccaggagcactcgaccgtggtgggtaagatctggctgacggtgctcttcatcttccgcatcctcatcctgggcctggccggcgagtcagtgtggggtgacgagcaatcagatttcgagtgtaacacggcccagccaggctgcaccaacgtctgctatgaccaggccttccccatctcccacatccgctactgggtgctgcagttcctcttcgtcagcacacccaccctggtctacctgggccatgtcatttacctgtctcggcgagaagagcggctgcggcagaaggagggggagctgcgggcactgccggccaaggacccacaggtggagcgggcgctggcggccgtagagcgtcagatggccaagatctcggtggcagaagatggtcgcctgcgcatccgcggagcactgatgggcacctatgtcgccagtgtgctctgcaagagtgtgctagaggcaggcttcctctatggccagtggcgcctgtacggctggaccatggagcccgtgtttgtgtgccagcgagcaccctgcccctacctcgtggactgctttgtctctcgccccacggagaagaccatcttcatcatcttcatgttggtggttggactcatctccctggtgcttaacctgctggagttggtgcacctgctgtgtcgctgcctcagccgggggatgagggcacggcaaggccaagacgcacccccgacccagggcacccctcagacccttacacggaccaggtcttcttctacctccccgtgggccaggggccctcatccccaccatgccccacctacaatgggctctcatccagtgagcagaactgggccaacctgaccacagaggagaggctggcgtcttccaggccccctctcttcctggacccaccccctcagaatggccaaaaacccccaagtcgtcccagcagctctgcttctaagaagcagtatgtatagaggcctgtggcttatgtcacccaacaga

SEQ ID NO: 11891 - DNA, 3177 bp, Homo sapiens
attaaaaagacggtggaagaggaacaactgacaggctcaagagcaaaaagcgtgggcagttggagaagaagcagccagagtgtgaagaagcccacggaaggaaagtccagggaggaggaaaagaagcagaagttttggcatctgttccctggctgtgccaagatgggcgattggagcttcctgggaaatttcctggaggaagtacacaagcactcgaccgtggtaggcaaggtctggctcactgtcctcttcatattccgtatgctcgtgctgggcacagctgctgagtcttcctggggggatgagcaggctgatttccggtgtgatacgattcagcctggctgccagaatgtctgctacgaccaggctttccccatctcccacattcgctactgggtgctgcagatcatcttcgtctccacgccctctctggtgtacatgggccacgccatgcacactgtgcgcatgcaggagaagcgcaagctacgggaggccgagagggccaaagaggtccggggctctggctcttacgagtacccggtggcagagaaggcagaactgtcctgctgggaggaagggaatggaaggattgccctccagggcactctgctcaacacctatgtgtgcagcatcctgatccgcaccaccatggaggtgggcttcattgtgggccagtacttcatctacggaatcttcctgaccaccctgcatgtctgccgcaggagtccctgtccccacccggtcaactgttacgtatcccggcccacagagaagaatgtcttcattgtctttatgctggctgtggctgcactgtccctcctccttagcctggctgaactctaccacctgggctggaagaagatcagacagcgatttgtcaaaccgcggcagcacatggctaagtgccagctttctggcccctctgtgggcatagtccagagctgcacaccaccccccgactttaatcagtgcctggagaatggccctgggggaaaattcttcaatcccttcagcaataatatggcctcccaacaaaacacagacaacctggtcaccgagcaagtacgaggtcaggagcagactcctggggaaggtttcatccaggttcgttatggccagaagcctgaggtgcccaatggagtctcaccaggtcaccgccttccccatggctatcatagtgacaagcgacgtcttagtaaggccagcagcaaggcaaggtcagatgacctatcagtgtgaccctcctttatgggaggatcaggaccaggtgggaacaaaggaggctcagagaagaaagacgtgtcccttctgaactgatgctttctcactgtcatcactgcttggctcctttgagccccgggtctcaatgacgttgctcattaattctagaaactataaccagggctctgggatagtaagagaggtgacaacccacccagactgcagttccctccccaccctctacccagtatacgaagcctttcagattactcatgaaacagggtagagggaaagaagggaagcatggcaaaagctggcctggaagggatagccagagggatagaatgactctctctctacataccagcagcataccaaatgcgttctctaagttcctacctccttgacctgatcaccctccctcctccaaggaagagctcaaagttcccagccaatagacagcatgaatcaaggaacttgcattatatgtgctcttgaatctgttgtctccatggaccattcctcggagtagtggtgagatggccttgggttgcccttggcttctcctccctctactcagccttaaaaagggcttcttggaactttaccagcagcctcagctttacaaatgccttggtatgtacctctggcaaatgccccaccttggtgatgttgcaacctttccttctgctagggtgtacacctagcctgtgcaggtgtcagccctgctagggagtcactgtacacacaaactctactggaattcctgccaacatctgtcaccctgcagctcctttacagttcaatccaatgatagaaaccatcccttccctttctcccttggctgttcacccagccattccctgaaggccttaccaacaggaatatccaagaagctgttgtcccctctcgaaccctgaccagatcatcagccactgaggccagtggaatttccccaggccttgttaaaacaaagaaagcattgtacctctcagattccccttgtggaaaaaaaaattctgctgtgaagatgaaaataaaaatggagagaaaacactggaaaactattttcccctcctatttacttcctttgctgactgccaacttagtgccaagaggaggtgtgatgacagctatggaggcccccagatctctctctcctggaggctttagcaggggcaaggaaatagtaggggaatctccagctctcttggcagggcctttatttaaagagcgcagagattcctatgtctccctagtgcccctaatgagactgccaagtgggggctgtagaaaagccttgccttccccagggattggcctggtctctgtattcactggatccataatgggttgctgttgttttggatgaaggtaaacgatgcttggaattggaaactgagacttatagagggattattacattattaaaatgcacgtgtgtgtgtgtgtgggtgctgatgggatgggtaaaggcttggggagtcctgaaataaggaaaggaaaccacagagaaacttgtgtcttcctgctctcctctccggctgcctggcagttattaacctaaacagatagccacaagaggttgggacagaggagggtaaaggctcagaaggaggttcaacctctgactcacctgcccatctctgggccctctgctgacacttggatgctattgttgggtggaaagataaatgagagtggagaggtggaggaaagtgactaggatgccatttaggaaggaatgtctgatcatcccgggtccctggaggggacaccttttaatctattgcctagcattaatattttctctccttctatctctgaaatgttttatgaaatgagtgttcttgaattagaaattctgtgggatcaatctttgatggtgagggttttagaaaggaaaaatatagtaaaatgtgtaatttgtcttaataaaatctatctctacatcta

SEQ ID NO: 11892 - DNA, 2153 bp, Homo sapiens
ccattttcaaacagtccctcctgggagaacacagacaggcagaggattacaacacaaggcagcaagcactgggagacgaaagttttggcatctgttccctggctgtgccaagatgggcgattggagcttcctgggaaatttcctggaggaagtacacaagcactcgaccgtggtaggcaaggtctggctcactgtcctcttcatattccgtatgctcgtgctgggcacagctgctgagtcttcctggggggatgagcaggctgatttccggtgtgatacgattcagcctggctgccagaatgtctgctacgaccaggctttccccatctcccacattcgctactgggtgctgcagatcatcttcgtctccacgccctctctggtgtacatgggccacgccatgcacactgtgcgcatgcaggagaagcgcaagctacgggaggccgagagggccaaagaggtccggggctctggctcttacgagtacccggtggcagagaaggcagaactgtcctgctgggaggaagggaatggaaggattgccctccagggcactctgctcaacacctatgtgtgcagcatcctgatccgcaccaccatggaggtgggcttcattgtgggccagtacttcatctacggaatcttcctgaccaccctgcatgtctgccgcaggagtccctgtccccacccggtcaactgttacgtatcccggcccacagagaagaatgtcttcattgtctttatgctggctgtggctgcactgtccctcctccttagcctggctgaactctaccacctgggctggaagaagatcagacagcgatttgtcaaaccgcggcagcacatggctaagtgccagctttctggcccctctgtgggcatagtccagagctgcacaccaccccccgactttaatcagtgcctggagaatggccctgggggaaaattcttcaatcccttcagcaataatatggcctcccaacaaaacacagacaacctggtcaccgagcaagtacgaggtcaggagcagactcctggggaaggtttcatccaggttcgttatggccagaagcctgaggtgcccaatggagtctcaccaggtcaccgccttccccatggctatcatagtgacaagcgacgtcttagtaaggccagcagcaaggcaaggtcagatgacctatcagtgtgaccctcctttatgggaggatcaggaccaggtgggaacaaaggaggctcagagaagaaagacgtgtcccttctgaactgatgctttctcactgtcatcactgcttggctcctttgagccccgggtctcaatgacgttgctcattaattctagaaactataaccagggctctgggatagtaagagaggtgacaacccacccagactgcagttccctccccaccctctacccagtatacgaagcctttcagattactcatgaaacagggtagagggaaagaagggaagcatggcaaaagctggcctggaagggatagccagagggatagaatgactctctctctacataccagcagcataccaaatgcgttctctaagttcctacctccttgacctgatcaccctccctcctccaaggaagagctcaaagttcccagccaatagacagcatgaatcaaggaacttgcattatatgtgctcttgaatctgttgtctccatggaccattcctcggagtagtggtgagatggccttgggttgcccttggcttctcctccctctactcagccttaaaaagggcttcttggaactttaccagcagcctcagctttacaaatgccttggtatgtacctctggcaaatgccccaccttggtgatgttgcaacctttccttctgctagggtgtacacctagcctgtgcaggtgtcagccctgctagggagtcactgtacacacaaactctactggaattcctgccaacatctgtcaccctgcagctcctttacagttcaatccaatgatagaaaccatcccttccctttctcccttggctgttcacccagccattccctgaaggccttaccaacaggaatatccaagaagctgttgtcccctctcgaaccctgaccagatcatcagccactgaggccagtggaatttccccaggccttgttaaaacaaagaaagca

SEQ ID NO: 11893 - DNA, 891 bp, Homo sapiens
actgacaggctcaagagcaaaaagcgtgggcagttggagaagaagcagccagagtgtgaagaagcccacggaaggaaagtccagggaggaggaaaagaagcagaagttttggcatctgttccctggctgtgccaagatgggcgattggagcttcctgggaaatttcctggaggaagtacacaagcactcgaccgtggtaggcaaggtctggctcactgtcctcttcatattccgtatgctcgtgctgggcacagctgctgagtcttcctggggggatgagcaggctgatttccggtgtgatacgattcagcctggctgccagaatgtctgctacgaccaggctttccccatctcccacattcgctactgggtgctgcagatcatcttcgtctccacgccctctctggtgtacatgggccacgccatgcacactgtgcgcatgcaggagaagcgcaagctacgggaggccgagagggccaaagaggtccggggctctggctcttacgagtacccggtggcagagaaggcagaactgtcctgctgggaggaagggaatggaaggattgccctccagggcactctgctcaacacctatgtgtgcagcatcctgatccgcaccaccatggaggtgggcttcattgtgggccagtacttcatctacggaatcttcctgaccaccctgcatgtctgccgcaggagtccctgtccccacccggtcaactgttacgtatcccggcccacagagaagaatgtcttcattgtctttatgctggctgtggctgcactgtccctcctccttagcctggctgaactctaccacctgggctggaagaagatcagacagcgatttgtcaaaccgcggcagcacatggctaagtgccagctttctgg

SEQ ID NO: 11894 - DNA, 1364 bp, Homo sapiens
gagaaagagcacatatttctccgtgggacactccttgtattggtgggtgagaaatgggcgactggagtttcctggggaacatcttggaggaggtgaatgagcactccaccgtcatcggcagagtctggctcaccgtgcttttcatcttccggatcctcatccttggcacggccgcagagttcgtgtggggggatgagcaatccgacttcgtgtgcaacacccagcagcctggctgcgagaacgtctgctacgacgaggcctttcccatctcccacattcgcctctgggtgctgcagatcatcttcgtctccaccccgtccctgatgtacgtggggcacgcggtgcactacgtccgcatggaggagaagcgcaaaagccgcgaggcggaggagctgggccagcaggcggggactaacggcggcccggaccagggcagcgtcaagaagagcagcggcagcaaaggcactaagaagttccggctggaggggaccctgctgaggacctacatctgccacatcatcttcaagaccctctttgaagtgggcttcatcgtgggccactacttcctgtacgggttccggatcctgcctctgtaccgctgcagccggtggccctgccccaatgtggtggactgcttcgtgtcccggcccacggagaaaaccatcttcatcctgttcatgttgtctgtggcctctgtgtccctattcctcaacgtgatggagttgggccacctgggcctgaaggggatccggtctgccttgaagaggcctgtagagcagcccctgggggagattcctgagaaatccctccactccattgctgtctcctccatccagaaagccaagggctatcagctcctagaagaagagaaaatcgtttcccactatttccccttgaccgaggttgggatggtggagaccagcccactgcctgccaagcctttcaatcagttcgaggagaagatcagcacaggacccctgggggacttgtcccggggctaccaagagacactgccttcctacgctcaggtgggggcacaagaagtggagggcgaggggccgcctgcagaggagggagccgaacccgaggtgggagagaagaaggaggaagcagagaggctgaccacggaggagcaggagaaggtggccgtgccagagggggagaaagtagagacccccggagtggataaggagggtgaaaaagaagagccgcagtcggagaaggtgtcaaagcaagggctgccagctgagaagacaccttcactctgtccagagctgacaacagatgatgccagacccctgagcaggctaagcaaagccagcagccgagccaggtcagacgatctaaccgtatgaagtgacgcc

SEQ ID NO: 11895 - DNA, 1302 bp, Homo sapiens
atgggcgactggagtttcctggggaacatcttggaggaggtgaatgagcactccaccgtcatcggcagagtctggctcaccgtgcttttcatcttccggatcctcatccttggcacggccgcagagttcgtgtggggggatgagcaatccgacttcgtgtgcaacacccagcagcctggctgcgagaacgtctgctacgacgaggcctttcccatctcccacattcgcctctgggtgctgcagatcatcttcgtctccaccccgtccctgatgtacgtggggcacgcggtgcactacgtccgcatggaggagaagcgcaaaagccgcgaggcggaggagctgggccagcaggcggggactaacggcggcccggaccagggcagcgtcaagaagagcagcggcagcaaaggcactaagaagttccggctggaggggaccctgctgaggacctacatctgccacatcatcttcaagaccctctttgaagtgggcttcatcgtgggccactacttcctgtacgggttccggatcctgcctctgtaccgctgcagccggtggccctgccccaatgtggtggactgcttcgtgtcccggcccacggagaaaaccatcttcatcctgttcatgttgtctgtggcctctgtgtccctattcctcaacgtgatggagttgggccacctgggcctgaaggggatccggtctgccttgaagaggcctgtagagcagcccctgggggagattcctgagaaatccctccactccattgctgtctcctccatccagaaagccaagggctatcagctcctagaagaagagaaaatcgtttcccactatttccccttgaccgaggttgggatggtggagaccagcccactgcctgccaagcctttcaatcagttcgaggagaagatcagcacaggacccctgggggacttgtcccggggctaccaagagacactgccttcctacgctcaggtgggggcacaagaagtggagggcgaggggccgcctgcagaggagggagccgaacccgaggtgggagagaagaaggaggaagcagagaggctgaccacggaggagcaggagaaggtggccgtgccagagggggagaaagtagagacccccggagtggataaggagggtgaaaaagaagagccgcagtcggagaaggtgtcaaagcaagggctgccagctgagaagacaccttcactctgtccagagctgacaacagatgatgccagacccctgagcaggctaagcaaagccagcagccgagccaggtcagacgatctaaccgtatga

SEQ ID NO: 11896 - DNA, 2313 bp, Homo sapiens
ttttaaaagcaaggataagcagaaagggacatggattttagttgatggatgactcactcactacattcaactgaactgaatctgctctataccagcaaagggacaaattcagaaaataaattgaagatggccatgctgtaacttctaaacatggtttgcttctcagatttacctaaactaagaaaggtttgctttaagaaatagtgctcccttcagaatggaagaatttatctgcctcttatttgatgtggatcagagctaagatggctgactaaataaacatgggggactggaatctccttggagatactctggaggaagttcacatccactccaccatgattggaaagatctggctcaccatcctgttcatatttcgaatgcttgttctgggtgtagcagctgaagatgtctggaatgatgagcagtctggcttcatctgcaatacagaacaaccaggctgcagaaatgtatgctacgaccaggcctttcctatctccctcattagatactgggttctgcaggtgatatttgtgtcttcaccatccctggtctacatgggccatgcattgtaccgactgagagttcttgaggaagagaggcaaaggatgaaagctcagttaagagtagaactggaggaggtagagtttgaaatgcctagggatcggaggagattggagcaagagctttgtcagctggagaaaaggaaactaaataaagctccactcagaggaaccttgctttgcacttatgtgatacacattttcactcgctctgtggttgaagttggattcatgattggacagtaccttttatatggatttcacttagagccgctatttaagtgccatggccacccgtgtccaaatataatcgactgttttgtctcaagaccaacagaaaagacaatattcctattatttatgcaatctatagccactatttcacttttcttaaacattcttgaaattttccacctaggttttaaaaagattaaaagagggctttggggaaaatacaagttgaagaaggaacataatgaattccatgcaaacaaggcaaaacaaaatgtagccaaataccagagcacatctgcaaattcactgaagcgactcccttctgcccctgattataatctgttagtggaaaagcaaacacacactgcagtgtaccctagtttaaattcatcttctgtattccagccaaatcctgacaatcatagtgtaaatgatgagaaatgcattttggatgaacaggaaactgtactttctaatgagatttccacacttagtactagttgtagtcattttcaacacatcagttcaaacaataacaaagacactcataaaatatttggaaaagaacttaatggtaaccagttaatggaaaaaagagaaactgaaggcaaagacagcaaaaggaactactactctagaggtcaccgttctattccaggtgttgctatagatggagagaacaacatgaggcagtcaccccaaacagttttctccttgccagctaactgcgattggaaaccgcggtggcttagagctacatggggttcctctacagaacatgaaaaccgggggtcacctcctaaaggtaacctcaagggccagttcagaaagggcacagtcagaacccttcctccttcacaaggagattctcaatcacttgacattccaaacactgctgattctttgggagggctgtcctttgagccagggttggtcagaacctgtaataatcctgtttgtcctccaaatcacgtagtgtccctaacgaacaatctcattggtaggcgggttcccacagatcttcagatctaaacagcggttggcttttagacattatatatattatcagagaagtagcctagtggtcgtggggcacagaaaaaatagataggggcagctctaaagaccagctgttaagacagacaactgcaaactcatttaagcaagagaaaaacagctctaattcgagattgtgaagcaacacttctaaattcaaagacatagagttgtcaaatcaggatttttttttttttaaatgatatcctttcgaatgtaactgattttgggaaaatcacatgttcagaattgaggctaaatggtttgatcaggttttctctttgaagagaccacagccttaggaaatggttcttgatctatacaattccaccttggacactgggttaattctgtttgcccctggaacacaatcacgtaagtttccttctagactggcatcctgatgtgtcttgagtataatcacatgttgctacctagtaaataaaatcttaagaagatc

SEQ ID NO: 11897 - DNA, 1901 bp, Homo sapiens
cagggagttgtggttgcaacactgtactccagcctgggcaacagagggagactctgtctcaacaaacaaacaaacaaagaaaaaaccccacagctatctagggaaaaagtaaagcaaccagcatatagaagtgacatattgttatattttcaccataggtttgctttaagaaatagtgctcccttcagaatggaagaatttatctgcctcttatttgatgtggatcagagctaagatggctgactaaataaacatgggggactggaatctccttggagatactctggaggaagttcacatccactccaccatgattggaaagatctggctcaccatcctgttcatatttcgaatgcttgttctgggtgtagcagctgaagatgtctggaatgatgagcagtctggcttcatctgcaatacagaacaaccaggctgcagaaatgtatgctacgaccaggcctttcctatctccctcattagatactgggttctgcaggtgatatttgtgtcttcaccatccctggtctacatgggccatgcattgtaccgactgagagttcttgaggaagagaggcaaaggatgaaagctcagttaagagtagaactggaggaggtagagtttgaaatgcctagggatcggaggagattggagcaagagctttgtcagctggagaaaaggaaactaaataaagctccactcagaggaaccttgctttgcacttatgtgatacacattttcactcgctctgtggttgaagttggattcatgattggacagtaccttttatatggatttcacttagagccgctatttaagtgccatggccacccgtgtccaaatataatcgactgttttgtctcaagaccaacagaaaagacaatattcctattatttatgcaatctatagccactatttcacttttcttaaacattcttgaaattttccacctaggttttaaaaagattaaaagagggctttggggaaaatacaagttgaagaaggaacataatgaattccatgcaaacaaggcaaaacaaaatgtagccaaataccagagcacatctgcaaattcactgaagcgactcccttctgcccctgattataatctgttagtggaaaagcaaacacacactgcagtgtaccctagtttaaattcatcttctgtattccagccaaatcctgacaatcatagtgtaaatgatgagaaatgcattttggatgaacaggaaactgtactttctaatgagatttccacacttagtactagttgtagtcattttcaacacatcagttcaaacaataacaaagacactcataaaatatttggaaaagaacttaatggtaaccagttaatggaaaaaagagaaactgaaggcaaagacagcaaaaggaactactactctagaggtcaccgttctattccaggtgttgctatagatggagagaacaacatgaggcagtcaccccaaacagttttctccttgccagctaactgcgattggaaaccgcggtggcttagagctacatggggttcctctacagaacatgaaaaccgggggtcacctcctaaaggtaacctcaagggccagttcagaaagggcacagtcagaacccttcctccttcacaaggagattctcaatcacttgacattccaaacactgctgattctttgggagggctgtcctttgagccagggttggtcagaacctgtaataatcctgtttgtcctccaaatcacgtagtgtccctaacgaacaatctcattggtaggcgggttcccacagatcttcagatctaaacagcggttggcttttagacattatatatattatcagagaagtagcctagtggtcgtggggcacagaaaaaatagataggggcagctctaaagaccagct

SEQ ID NO: 11898 - DNA, 2377 bp, Homo sapiens
aaaagcaaggataagcagaaagggacatggattttagttgatggatgactcactcactacattcaactgaactgaatctgctctataccagcaaagggacaaattcagaaaataaattgaagatggccatgctgtaacttctaaacatggtttgcttctcagatttacctaaactaagaaaggtttgctttaagaaatagtgctcccttcagaatggaagaatttatctgcctcttatttgatgtggatcagagctaagatggctgactaaataaacatgggggactggaatctccttggagatactctggaggaagttcacatccactccaccatgattggaaagatctggctcaccatcctgttcatatttcgaatgcttgttctgggtgtagcagctgaagatgtctggaatgatgagcagtctggcttcatctgcaatacagaacaaccaggctgcagaaatgtatgctacgaccaggcctttcctatctccctcattagatactgggttctgcaggtgatatttgtgtcttcaccatccctggtctacatgggccatgcattgtaccgactgagagttcttgaggaagagaggcaaaggatgaaagctcagttaagagtagaactggaggaggtagagtttgaaatgcctagggatcggaggagattggagcaagagctttgtcagctggagaaaaggaaactaaataaagctccactcagaggaaccttgctttgcacttatgtgatacacattttcactcgctctgtggttgaagttggattcatgattggacagtaccttttatatggatttcacttagagccgctatttaagtgccatggccacccgtgtccaaatataatcgactgttttgtctcaagaccaacagaaaagacaatattcctattatttatgcaatctatagccactatttcacttttcttaaacattcttgaaattttccacctaggttttaaaaagattaaaagagggctttggggaaaatacaagttgaagaaggaacataatgaattccatgcaaacaaggcaaaacaaaatgtagccaaataccagagcacatctgcaaattcactgaagcgactcccttctgcccctgattataatctgttagtggaaaagcaaacacacactgcagtgtaccctagtttaaattcatcttctgtattccagccaaatcctgacaatcatagtgtaaatgatgagaaatgcattttggatgaacaggaaactgtactttctaatgagatttccacacttagtactagttgtagtcattttcaacacatcagttcaaacaataacaaagacactcataaaatatttggaaaagaacttaatggtaaccagttaatggaaaaaagagaaactgaaggcaaagacagcaaaaggaactactactctagaggtcaccgttctattccaggtgttgctatagatggagagaacaacatgaggcagtcaccccaaacagttttctccttgccagctaactgcgattggaaaccgcggtggcttagagctacatggggttcctctacagaacatgaaaaccgggggtcacctcctaaagtgcctggctcaaaagctactgcaagctcgttactgctcatcctccagaggcccacatcaagtcagccacgactcaaggagactccaaagataaaagctgaagccaaaatatatgattctaaacaccctcctcggctactgcaaagcactgtgagcactttctcaggacgagagccaagaagcccagcacctatgggtcaccacagtttccgaggtcccagatgaaaaagatgcgctcgctaccaccgtgcggcggtcctttctctcgcaatagtctcaatgctcccgggccctgcctccggacgccaggacagaggccgccgactcgaagcgtgagcagttccggaggtacttggagaagtcgggggtgctggacacgctgaccaaggtgttggtagccttatatgaagaaccagagaaacctaacagtgctttggattttttaaagcatcacttaggagctgctactccagaaaatccagaaatagagctgcttcgcctagaactggccgaaatgaaagagaagtatgaagctattgtagaagaaaataaaaaactgaaagcaaagcttgctcagtatgaaccacctcaggaggagaagcgtgctgaataggattcttctcagtttgaaagacaatgaaaaatggttttgtatgacttgaatagtttgtatagtatataatcttttctgaacagatgctatagaactcttttaatatgtttaattcacctatcacactctgttaaaaacacatagaatcatcaataaaaactcaatat

SEQ ID NO: 11899 - DNA, 1637 bp, Homo sapiens
atatgactccccagcaccgggcggtgatgaattgggacgcaggcgcggagcccagggaccactccccctgcacagacatgagaccataggggacctgtctgggtggcctcagggataggcgctccccaaggtgtgaatgaggcaggatgaactggacaggtttgtacaccttgctcagtggcgtgaaccggcattctactgccattggccgagtatggctctcggtcatcttcatcttcagaatcatggtgctggtggtggctgcagagagtgtgtggggtgatgagaaatcttccttcatctgcaacacactccagcctggctgcaacagcgtttgctatgaccaattcttccccatctcccatgtgcggctgtggtccctgcagctcatcctagtttccaccccagctctcctcgtggccatgcacgtggctcaccagcaacacatagagaagaaaatgctacggcttgagggccatggggaccccctacacctggaggaggtgaagaggcacaaggtccacatctcagggacactgtggtggacctatgtcatcagcgtggtgttccggctgttgtttgaggccgtcttcatgtatgtcttttatctgctctaccctggctatgccatggtgcggctggtcaagtgcgacgtctacccctgccccaacacagtggactgcttcgtgtcccgccccaccgagaaaaccgtcttcaccgtcttcatgctagctgcctctggcatctgcatcatcctcaatgtggccgaggtggtgtacctcatcatccgggcctgtgcccgccgagcccagcgccgctccaatccaccttcccgcaagggctcgggcttcggccaccgcctctcacctgaatacaagcagaatgagatcaacaagctgctgagtgagcaggatggctccctgaaagacatactgcgccgcagccctggcaccggggctgggctggctgaaaagagcgaccgctgctcggcctgctgatgccacataccaggcaacctcccatcccacccccgaccctgccctgggcgagcccctccttctcccctgccggtgcacaggcctctgcctgctggggattactcgatcaaaaccttccttccctggctacttcccttcctcccggggccttccttttgaggagctggaggggtggggagctagaggccacctatgccagtgctcaaggttactgggagtgtgggctgcccttgttgcctgcacccttccctcttccctctccctctctctgggaccactgggtacaagagatgggatgctccgacagcgtctccaattatgaaactaatcttaaccctgtgctgtcagataccctgtttctggagtcacatcagtgaggagggatgtgggtaagaggagcagagggcaggggtgctgtggacatgtgggtggagaagggagggtggccagcactagtaaaggaggaatagtgcttgctggccacaaggaaaaggaggaggtgtctggggtgagggagttagggagagagaagcaggcagataagttggagcaggggttggtcaaggccacctctgcctctagtccccaaggcctctctctgcctgaaatgttacacattaaacaggattttacagtaaa

SEQ ID NO: 11900 - DNA, 1904 bp, Homo sapiens
ctggtggcatagggcagacacgcctgcagacattctctgggaaagggcagcagcagccaggtgtggcagtgacagggaggtgtgaatgaggcaggatgaactggacaggtttgtacaccttgctcagtggcgtgaaccggcattctactgccattggccgagtatggctctcggtcatcttcatcttcagaatcatggtgctggtggtggctgcagagagtgtgtggggtgatgagaaatcttccttcatctgcaacacactccagcctggctgcaacagcgtttgctatgaccaattcttccccatctcccatgtgcggctgtggtccctgcagctcatcctagtttccaccccagctctcctcgtggccatgcacgtggctcaccagcaacacatagagaagaaaatgctacggcttgagggccatggggaccccctacacctggaggaggtgaagaggcacaaggtccacatctcagggacactgtggtggacctatgtcatcagcgtggtgttccggctgttgtttgaggccgtcttcatgtatgtcttttatctgctctaccctggctatgccatggtgcggctggtcaagtgcgacgtctacccctgccccaacacagtggactgcttcgtgtcccgccccaccgagaaaaccgtcttcaccgtcttcatgctagctgcctctggcatctgcatcatcctcaatgtggccgaggtggtgtacctcatcatccgggcctgtgcccgccgagcccagcgccgctccaatccaccttcccgcaagggctcgggcttcggccaccgcctctcacctgaatacaagcagaatgagatcaacaagctgctgagtgagcaggatggctccctgaaagacatactgcgccgcagccctggcaccggggctgggctggctgaaaagagcgaccgctgctcggcctgctgatgccacataccaggcaacctcccatcccacccccgaccctgccctgggcgagcccctccttctcccctgccggtgcacaggcctctgcctgctggggattactcgatcaaaaccttccttccctggctacttcccttcctcccggggccttccttttgaggagctggaggggtggggagctagaggccacctatgccagtgctcaaggttactgggagtgtgggctgcccttgttgcctgcacccttccctcttccctctccctctctctgggaccactgggtacaagagatgggatgctccgacagcgtctccaattatgaaactaatcttaaccctgtgctgtcagataccctgtttctggagtcacatcagtgaggagggatgtgggtaagaggagcagagggcaggggtgctgtggacatgtgggtggagaagggagggtggccagcactagtaaaggaggaatagtgcttgctggccacaaggaaaaggaggaggtgtctggggtgagggagttagggagagagaagcaggcagataagttggagcaggggttggtcaaggccacctctgcctctagtccccaaggcctctctctgcctgaaatgttacacattaaacaggattttacagtaaatgaagaggtggcttgtgtgtttgtcaagttctttctcctgcaacctctgacctcccccaggatgagctggccttggttttttactgattaagaaaggaacagggcaaaagaagtagttacttgagtagctgaagctgcaaatgaggaaatcactgtacttctgggccgcagagccagccccggagccattcctccctgttgcttttgttgttgtggttcttgtctttttcattgtctaataacagctttattgggatttagtttacatacctccttcctctgattttgaaaagattaaaaatgacaactccctctgaa

SEQ ID NO: 11901 - DNA, 1587 bp, Homo sapiens
gggctgggctgacagtacctggtggcatagggcagacacgcctgcagacattctctgggaaagggcagcagcagccaggtgtgaatgaggcaggatgaactggacaggtttgtacaccttgctcagtggcgtgaaccggcattctactgccattggccgagtatggctctcggtcatcttcatcttcagaatcatggtgctggtggtggctgcagagagtgtgtggggtgatgagaaatcttccttcatctgcaacacactccagcctggctgcaacagcgtttgctatgaccaattcttccccatctcccatgtgcggctgtggtccctgcagctcatcctagtttccaccccagctctcctcgtggccatgcacgtggctcaccagcaacacatagagaagaaaatgctacggcttgagggccatggggaccccctacacctggaggaggtgaagaggcacaaggtccacatctcagggacactgtggtggacctatgtcatcagcgtggtgttccggctgttgtttgaggccgtcttcatgtatgtcttttatctgctctaccctggctatgccatggtgcggctggtcaagtgcgacgtctacccctgccccaacacagtggactgcttcgtgtcccgccccaccgagaaaaccgtcttcaccgtcttcatgctagctgcctctggcatctgcatcatcctcaatgtggccgaggtggtgtacctcatcatccgggcctgtgcccgccgagcccagcgccgctccaatccaccttcccgcaagggctcgggcttcggccaccgcctctcacctgaatacaagcagaatgagatcaacaagctgctgagtgagcaggatggctccctgaaagacatactgcgccgcagccctggcaccggggctgggctggctgaaaagagcgaccgctgctcggcctgctgatgccacataccaggcaacctcccatcccacccccgaccctgccctgggcgagcccctccttctcccctgccggtgcacaggcctctgcctgctggggattactcgatcaaaaccttccttccctggctacttcccttcctcccggggccttccttttgaggagctggaggggtggggagctagaggccacctatgccagtgctcaaggttactgggagtgtgggctgcccttgttgcctgcacccttccctcttccctctccctctctctgggaccactgggtacaagagatgggatgctccgacagcgtctccaattatgaaactaatcttaaccctgtgctgtcagataccctgtttctggagtcacatcagtgaggagggatgtgggtaagaggagcagagggcaggggtgctgtggacatgtgggtggagaagggagggtggccagcactagtaaaggaggaatagtgcttgctggccacaaggaaaaggaggaggtgtctggggtgagggagttagggagagagaagcaggcagataagttggagcaggggttggtcaaggccacctctgcctctagtccccaaggcctctctctgcctgaaatgttacacattaaacaggattttacagtaaatg

SEQ ID NO: 11902 - DNA, 484 bp, Homo sapiens
cagcagcagccaggtgtggcagtgacagggagacactatctgcagaagcacagggagcctgctgtagaaagacttctgtctcagatacattgtttcatcctacctatcctaccgctttggaacggtgtgaccttgaggagttacttatctgagcttcagcttcttcatctggaaaatgggataacaggcttcctaaatgggtcgaaagaaaaaatgtgtgaatgaggcaggatgaactggacaggtttgtacaccttgctcagtggcgtgaaccggcattctactgccattggccgagtatggctctcggtcatcttcatcttcagaatcatggtgctggtggtggctgcagagagtgtgtggggtgatgagaaatcttccttcatctgcaacacactccagcctggctgcaacagcgtttgctatgaccaattcttccccatctcccatgtgcggctgtggtccctgcagctcatcctagttt

SEQ ID NO: 11903 - DNA, 2309 bp, Homo sapiens
atttaatcctatgacaaactaagttggttctgtcttcacctgttttggtgaggttgtgtaagagttggtgtttgctcaggaagagatttaagcatgcttgcttacccagactcagagaagtctccctgttctgtcctagctagtgattcctgtgttgtgtgcattcgtcttttccagagcaaaccgcccagagtagaagatggattggggcacgctgcagacgatcctggggggtgtgaacaaacactccaccagcattggaaagatctggctcaccgtcctcttcatttttcgcattatgatcctcgttgtggctgcaaaggaggtgtggggagatgagcaggccgactttgtctgcaacaccctgcagccaggctgcaagaacgtgtgctacgatcactacttccccatctcccacatccggctatgggccctgcagctgatcttcgtgtccacgccagcgctcctagtggccatgcacgtggcctaccggagacatgagaagaagaggaagttcatcaagggggagataaagagtgaatttaaggacatcgaggagatcaaaacccagaaggtccgcatcgaaggctccctgtggtggacctacacaagcagcatcttcttccgggtcatcttcgaagccgccttcatgtacgtcttctatgtcatgtacgacggcttctccatgcagcggctggtgaagtgcaacgcctggccttgtcccaacactgtggactgctttgtgtcccggcccacggagaagactgtcttcacagtgttcatgattgcagtgtctggaatttgcatcctgctgaatgtcactgaattgtgttatttgctaattagatattgttctgggaagtcaaaaaagccagtttaacgcattgcccagttgttagattaagaaatagacagcatgagagggatgaggcaacccgtgctcagctgtcaaggctcagtcgctagcatttcccaacacaaagattctgaccttaaatgcaaccatttgaaacccctgtaggcctcaggtgaaactccagatgccacaatggagctctgctcccctaaagcctcaaaacaaaggcctaattctatgcctgtcttaattttctttcacttaagttagttccactgagaccccaggctgttaggggttattggtgtaaggtactttcatattttaaacagaggatatcggcatttgtttctttctctgaggacaagagaaaaaagccaggttccacagaggacacagagaaggtttgggtgtcctcctggggttctttttgccaactttccccacgttaaaggtgaacattggttctttcatttgctttggaagttttaatctctaacagtggacaaagttaccagtgccttaaactctgttacactttttggaagtgaaaactttgtagtatgataggttattttgatgtaaagatgttctggataccattatatgttccccctgtttcagaggctcagattgtaatatgtaaatggtatgtcattcgctactatgatttaatttgaaatatggtcttttggttatgaatactttgcagcacagctgagaggctgtctgttgtattcattgtggtcatagcacctaacaacattgtagcctcaatcgagtgagacagactagaagttcctagtgatggcttatgatagcaaatggcctcatgtcaaatatttagatgtaattttgtgtaagaaatacagactggatgtaccaccaactactacctgtaatgacaggcctgtccaacacatctcccttttccatgactgtggtagccagcatcggaaagaacgctgatttaaagaggtcgcttgggaattttattgacacagtaccatttaatggggaggacaaaatggggcaggggagggagaagtttctgtcgttaaaaacagatttggaaagactggactctaaagtctgttgattaaagatgagctttgtctacttcaaaagtttgtttgcttaccccttcagcctccaattttttaagtgaaaatatagctaataacatgtgaaaagaatagaagctaaggtttagataaatattgagcagatctataggaagattgaacctgaatattgccattatgcttgacatggtttccaaaaaatggtactccacatatttcagtgagggtaagtattttcctgttgtcaagaatagcattgtaaaagcattttgtaataataaagaatagctttaatgatatgcttgtaactaaaataattttgtaatgtatcaaatacatttaaaacattaaaatataatctctataat

SEQ ID NO: 11904 - DNA, 2250 bp, Homo sapiens
cggagcccctcggcggcgcccggcccaggacccgcctaggagcgcaggagccccagcgcagagaccccaacgccgagacccccgccccggccccgccgcgcttcctcccgacgcagagcaaaccgcccagagtagaagatggattggggcacgctgcagacgatcctggggggtgtgaacaaacactccaccagcattggaaagatctggctcaccgtcctcttcatttttcgcattatgatcctcgttgtggctgcaaaggaggtgtggggagatgagcaggccgactttgtctgcaacaccctgcagccaggctgcaagaacgtgtgctacgatcactacttccccatctcccacatccggctatgggccctgcagctgatcttcgtgtccacgccagcgctcctagtggccatgcacgtggcctaccggagacatgagaagaagaggaagttcatcaagggggagataaagagtgaatttaaggacatcgaggagatcaaaacccagaaggtccgcatcgaaggctccctgtggtggacctacacaagcagcatcttcttccgggtcatcttcgaagccgccttcatgtacgtcttctatgtcatgtacgacggcttctccatgcagcggctggtgaagtgcaacgcctggccttgtcccaacactgtggactgctttgtgtcccggcccacggagaagactgtcttcacagtgttcatgattgcagtgtctggaatttgcatcctgctgaatgtcactgaattgtgttatttgctaattagatattgttctgggaagtcaaaaaagccagtttaacgcattgcccagttgttagattaagaaatagacagcatgagagggatgaggcaacccgtgctcagctgtcaaggctcagtcgctagcatttcccaacacaaagattctgaccttaaatgcaaccatttgaaacccctgtaggcctcaggtgaaactccagatgccacaatggagctctgctcccctaaagcctcaaaacaaaggcctaattctatgcctgtcttaattttctttcacttaagttagttccactgagaccccaggctgttaggggttattggtgtaaggtactttcatattttaaacagaggatatcggcatttgtttctttctctgaggacaagagaaaaaagccaggttccacagaggacacagagaaggtttgggtgtcctcctggggttctttttgccaactttccccacgttaaaggtgaacattggttctttcatttgctttggaagttttaatctctaacagtggacaaagttaccagtgccttaaactctgttacactttttggaagtgaaaactttgtagtatgataggttattttgatgtaaagatgttctggataccattatatgttccccctgtttcagaggctcagattgtaatatgtaaatggtatgtcattcgctactatgatttaatttgaaatatggtcttttggttatgaatactttgcagcacagctgagaggctgtctgttgtattcattgtggtcatagcacctaacaacattgtagcctcaatcgagtgagacagactagaagttcctagtgatggcttatgatagcaaatggcctcatgtcaaatatttagatgtaattttgtgtaagaaatacagactggatgtaccaccaactactacctgtaatgacaggcctgtccaacacatctcccttttccatgactgtggtagccagcatcggaaagaacgctgatttaaagaggtcgcttgggaattttattgacacagtaccatttaatggggaggacaaaatggggcaggggagggagaagtttctgtcgttaaaaacagatttggaaagactggactctaaagtctgttgattaaagatgagctttgtctacttcaaaagtttgtttgcttaccccttcagcctccaattttttaagtgaaaatatagctaataacatgtgaaaagaatagaagctaaggtttagataaatattgagcagatctataggaagattgaacctgaatattgccattatgcttgacatggtttccaaaaaatggtactccacatatttcagtgagggtaagtattttcctgttgtcaagaatagcattgtaaaagcattttgtaataataaagaatagctttaatgatatgcttgtaactaaaataattttgtaatgtatcaaatacatttaaaacattaaaatataatctctataataa

SEQ ID NO: 11905 - DNA, 1797 bp, Homo sapiens
agacagcacccaagggtagaagatgggggcccaggagggagctgcaccctggtgggcagccatgggagtgtgtcaggtggaagcagccgtcagggtccctctctgctctctgtccggacagacagggctccaaccttcacttcagttcttgtgaactcccaccaggtaggcacggcccccaccaggcgccatggactggaagacactccaggccctactgagcggtgtgaacaagtactccacagcgttcgggcgcatctggctgtccgtggtgttcgtcttccgggtgctggtatacgtggtggctgcagagcgcgtgtggggggatgagcagaaggactttgactgcaacaccaagcagcccggctgcaccaacgtctgctacgacaactacttccccatctccaacatccgcctctgggccctgcagctcatcttcgtcacatgcccctcgctgctggtcatcctgcacgtggcctaccgtgaggagcgggagcgccggcaccgccagaaacacggggaccagtgcgccaagctgtacgacaacgcaggcaagaagcacggaggcctgtggtggacctacctgttcagcctcatcttcaagctcatcattgagttcctcttcctctacctgctgcacactctctggcatggcttcaatatgccgcgcctggtgcagtgtgccaacgtggccccctgccccaacatcgtggactgctacattgcccgacctaccgagaagaaaatcttcacctacttcatggtgggcgcctccgccgtctgcatcgtactcaccatctgtgagctctgctacctcatctgccacagggtcctgcgaggcctgcacaaggacaagcctcgagggggttgcagcccctcgtcctccgccagccgagcttccacctgccgctgccaccacaagctggtggaggctggggaggtggatccagacccaggcaataacaagctgcaggcttcagcacccaacctgacccccatctgaccacagggcaggggtggggcaacatgcgggctgccaatgggacatgcagggcggtgtggcaggtggagaggtcctacaggggctgagtgaccccactctgagttcactaagttatgcaactttcgttttggcagatattttttgacactgggaactgggctgtctagccgggtataggtaacccacaggcccagtgccagccctcaaaggacatagactttgaaacaagcgaattaactatctacgctgcctgcaaggggccacttagggcactgctagcagggcttcaaccaggaagggatcaacccaggaagggatgatcaggagaggcttccctgaggacataatgtgtaagagaggtgagaagtgctcccaagcagacacaacagcagcacagaggtctggaggccacacaaaaagtgatgctcgccctgggctagcctcagcagacctaaggcatctctactccctccagaggagccgcccagattcctgcagtggagaggaggtcttccagcagcagcaggtctggagggctgagaatgaacctgactagaggttctggagatacccagaggtcccccaggtcatcacttggctcagtggaagccctctttccccaaatcctactccctcagcctcaggcagtggtgctcccatcttcctccccacaactgtgctcaggctggtgccagcctttcagaccctgctcccagggacttgggtggatgcgctgatagaacatcctcaagacagtttccttgaaatcaataaatactgtgttttatacaggt

SEQ ID NO: 11906 - DNA, 2217 bp, Homo sapiens
gaacttctttcctggcacaggactcactgtgccccttcccgctgtgggtacaaggtctgccccccaccccagctctccaaagcccaccggcctccctggaggccgaggtcgacggcccgtcgcaccgggagggggggctcccaggggtgccccacgcacggtcaaggtcccgcgccaagcggggaccgggctgggccggaagcgggcacggtactcgcggcaaactagcgtgggcgagtcctgattgcagtcggacctgccgccgcggcacttaacagtttgcagagtgcttcccgcccctgatctcattggagccttcggacagcccagcccatggccaccgatgcccccatttcacgcctgaggaagcggaggctcagacgggccaccagcccctccggaggctggcccgggagcgcctggcagcgtcgggtctaggagccggctccctcctgctccctcctccgcgccgcccggggtgtgcccgccgtctgtgtgcaccactgctgagcccagctccggcgccctcgcctctgctgtgggccccggggacgcggggtcaggccaccgcgttggccaggccgctgcaggtaggcacggcccccaccaggcgccatggactggaagacactccaggccctactgagcggtgtgaacaagtactccacagcgttcgggcgcatctggctgtccgtggtgttcgtcttccgggtgctggtatacgtggtggctgcagagcgcgtgtggggggatgagcagaaggactttgactgcaacaccaagcagcccggctgcaccaacgtctgctacgacaactacttccccatctccaacatccgcctctgggccctgcagctcatcttcgtcacatgcccctcgctgctggtcatcctgcacgtggcctaccgtgaggagcgggagcgccggcaccgccagaaacacggggaccagtgcgccaagctgtacgacaacgcaggcaagaagcacggaggcctgtggtggacctacctgttcagcctcatcttcaagctcatcattgagttcctcttcctctacctgctgcacactctctggcatggcttcaatatgccgcgcctggtgcagtgtgccaacgtggccccctgccccaacatcgtggactgctacattgcccgacctaccgagaagaaaatcttcacctacttcatggtgggcgcctccgccgtctgcatcgtactcaccatctgtgagctctgctacctcatctgccacagggtcctgcgaggcctgcacaaggacaagcctcgagggggttgcagcccctcgtcctccgccagccgagcttccacctgccgctgccaccacaagctggtggaggctggggaggtggatccagacccaggcaataacaagctgcaggcttcagcacccaacctgacccccatctgaccacagggcaggggtggggcaacatgcgggctgccaatgggacatgcagggcggtgtggcaggtggagaggtcctacaggggctgagtgaccccactctgagttcactaagttatgcaactttcgttttggcagatattttttgacactgggaactgggctgtctagccgggtataggtaacccacaggcccagtgccagccctcaaaggacatagactttgaaacaagcgaattaactatctacgctgcctgcaaggggccacttagggcactgctagcagggcttcaaccaggaagggatcaacccaggaagggatgatcaggagaggcttccctgaggacataatgtgtaagagaggtgagaagtgctcccaagcagacacaacagcagcacagaggtctggaggccacacaaaaagtgatgctcgccctgggctagcctcagcagacctaaggcatctctactccctccagaggagccgcccagattcctgcagtggagaggaggtcttccagcagcagcaggtctggagggctgagaatgaacctgactagaggttctggagatacccagaggtcccccaggtcatcacttggctcagtggaagccctctttccccaaatcctactccctcagcctcaggcagtggtgctcccatcttcctccccacaactgtgctcaggctggtgccagcctttcagaccctgctcccagggacttgggtggatgcgctgatagaacatcctcaagacagtttccttgaaatcaataaatactgtgttttata

SEQ ID NO: 11907 - DNA, 765 bp, Homo sapiens
atggactggaagacactccaggccctactgagcggtgtgaacaagtactccacagcgttcgggcgcatctggctgtccgtggtgttcgtcttccgggtgctggtatacgtggtggctgcagagcgcgtgtggggggatgagcagaaggactttgactgcaacaccaagcagcccggctgcaccaacgtctgctacgacaactacttccccatctccaacatccgcctctgggccctgcagctcatcttcgtcacatgcccctcgctgctggtcatcctgcacgtggcctaccgtgaggagcgggagcgccggcaccgccagaaacacggggaccagtgcgccaagctgtacgacaacgcaggcaagaagcacggaggcctgtggtggacctacctgctgcacactctctggcatggcttcaatatgccgcgcctggtgcagtgtgccaacgtggccccctgccccaacatcgtggactgctacattgcccgacctaccgagaagaaaatcttcacctacttcatggtgggcgcctccgccgtctgcatcgtactcaccatctgtgagctctgctacctcatctgccacagggtcctgcgaggcctgcacaaggacaagcctcgagggggttgcagcccctcgtcctccgccagccgagcttccacctgccgctgccaccacaagctggtggaggctggggaggtggatccagacccaggcaataacaagctgcaggcttcagcacccaacctgacccccatctga

SEQ ID NO: 11908 - DNA, 2840 bp, Homo sapiens
aaacagacaagcccaaggacaaggaagcagctactggacccaagaaggaataaggtagaccctgattttggaacctgaagaccaaagtgcaagattagctctgctacttccatctgtggaccattgggcaggtatctctgggccttcacttactctttgtgaaatgaggacaggggcaatccctaccctaccaagtcattgggagtgaagacatgatgacacggtgattgtgaaaagattttgtcaatcgcaccagcattaagggtgcccatctccaggttcccccaggcctcaaggctcccaaggcctgagtgggcaggtagcacccaggtatagaccttccacgtgcagcacccaggacacagccagcatgaactgggcatttctgcagggcctgctgagtggcgtgaacaagtactccacagtgctgagccgcatctggctgtctgtggtgttcatctttcgtgtgctggtgtacgtggtggcagcggaggaggtgtgggacgatgagcagaaggactttgtctgcaacaccaagcagcccggctgccccaacgtctgctatgacgagttcttccccgtgtcccacgtgcgcctctgggccctacagctcatcctggtcacgtgcccctcactgctcgtggtcatgcacgtggcctaccgcgaggaacgcgagcgcaagcaccacctgaaacacgggcccaatgccccgtccctgtacgacaacctgagcaagaagcggggcggactgtggtggacgtacttgctgagcctcatcttcaaggccgccgtggatgctggcttcctctatatcttccaccgcctctacaaggattatgacatgccccgcgtggtggcctgctccgtggagccttgcccccacactgtggactgttacatctcccggcccacggagaagaaggtcttcacctacttcatggtgaccacagctgccatctgcatcctgctcaacctcagtgaagtcttctacctggtgggcaagaggtgcatggagatcttcggccccaggcaccggcggcctcggtgccgggaatgcctacccgatacgtgcccaccatatgtcctctcccagggagggcaccctgaggatgggaactctgtcctaatgaaggctgggtcggccccagtggatgcaggtgggtatccataacctgcgagatcagcagataagatcaacaggtcccccccacatgaggccacccaggaaaaaaggcaggggcagtggcatccttgccgtagcagggtggtgaggagggtggctgtgggggctcaggaagctcgcccaggggccaatgtgggaggttgggggtagtttggtccctgggtcctgagcctcaggggagggaggttgatagctactggggattttgtatatggcaacagtatatgtcaaacctcttaataaatatgattttcccagtactttgcagaccaggtggggagtggccgataggaaaacggggggcaggggggattaggtggacctcagagaggatgccaagactactcagtgagcacctgagcactggaacctcagatccaggctcacccatcaccccccaacacacacagtgtgtgcccccagaacatgatgggctgtgcccaaaggcagaggctactccaggggcctctgggttgtgcaaccacctggccaaagcaggaggagaggaattccaggagaccctgtgcccagcaggagtcagttctcagtgatcgtccatcacaggaatgagcgtgggttgggcctccctagccctgcccagcacaggtcccggataggtgagtcccctctgacggtgggagggtcacggctgagagcaagccagggatgggaatctgtcaaggtgcccaagaggcacatcctacaggccagggcccactgagagtgtctgagctgaaaggtcccttgtggatcctggagtctatggaatttcatgttctttttcactgatacaacttccccatcccatactcccccaccccaccaccactcagactttggcaactcccagaaccacacctccaccctaacatgcctctgagtcccaccaaatgcccactagacaattccctgggaggcccccaggcatctcatacccgccactcccaagctgacctcatcagctcacccagacctgcccccttgaagatgccccaccccatctcatgcaggacacagctattcacccagctgcccaagccaggggacgagacaagcctgacatccttgtccctcacaccccacacccccactggcaccaaatcccactgattccagtccctaaatgccacctgaatctgctcttcctctccttacaacaacctaactacctcctggacctcccccatctgccctccgctacagggatggagtgatttatctgtctatgcaactgaccatgtcattccacctgctttaaaatttcttccaccatcaccagccccatgccctcagcatggcccccgctgacctccccacctcatcccagcttcctccccttttctacctgcaagtaataccaaagggctcctggttccccaggcagacacgtcatgtggtgtcattcctcgtgcctttgtcatgctatttcctctggctagaatgcccttcccaccccctctgtgatcctccctcgaacctctaggacagctttacccatctctctaagtgccagcctcgcttgtccctctgccactctccccaaatcggaattgtcacttcccctgagtgtctccctatcagtctgtgagcccttaatgggcaggtcactgagtcatccaggtccctgctgccttcaataaatgcttgttagatgagt

SEQ ID NO: 11909 - DNA, 1355 bp, Homo sapiens
agcacacccggcaggctctgtcctggaaacaggcttcaacgggcttccccgaaaaccttccccgcttctggatatgaaattcaagctgcttgctgagtcctattgccggctgctgggagccaggagagccctgaggagtagtcactcagtagcagctgacgcgtgggtccaccatgaactggagtatctttgagggactcctgagtggggtcaacaagtactccacagcctttgggcgcatctggctgtctctggtcttcatcttccgcgtgctggtgtacctggtgacggccgagcgtgtgtggagtgatgaccacaaggacttcgactgcaatactcgccagcccggctgctccaacgtctgctttgatgagttcttccctgtgtcccatgtgcgcctctgggccctgcagcttatcctggtgacatgcccctcactgctcgtggtcatgcacgtggcctaccgggaggttcaggagaagaggcaccgagaagcccatggggagaacagtgggcgcctctacctgaaccccggcaagaagcggggtgggctctggtggacatatgtctgcagcctagtgttcaaggcgagcgtggacatcgcctttctctatgtgttccactcattctaccccaaatatatcctccctcctgtggtcaagtgccacgcagatccatgtcccaatatagtggactgcttcatctccaagccctcagagaagaacattttcaccctcttcatggtggccacagctgccatctgcatcctgctcaacctcgtggagctcatctacctggtgagcaagagatgccacgagtgcctggcagcaaggaaagctcaagccatgtgcacaggtcatcacccccacggtaccacctcttcctgcaaacaagacgacctcctttcgggtgacctcatctttctgggctcagacagtcatcctcctctcttaccagaccgcccccgagaccatgtgaagaaaaccatcttgtgaggggctgcctggactggtctggcaggttgggcctggatggggaggctctagcatctctcataggtgcaacctgagagtgggggagctaagccatgaggtaggggcaggcaagagagaggattcagacgctctgggagccagttcctagtcctcaactccagccacctgccccagctcgacggcactgggccagttccccctctgctctgcagctcggtttccttttctagaatggaaatagtgagggccaatgcccagggttggagggaggagggcgttcatagaagaacacacatgcgggcaccttcatcgtgtgtggcccactgtcagaacttaataaaagtcaactcatttgctggt

SEQ ID NO: 11910 - DNA, 1808 bp, Homo sapiens
acataactgggggtgtggagagcgcctcattgccactgcagtgactaaagctgggaagacgctggtcagttcacctgccccactggttgttttttaaacaaattctgatacaggcgacatcctcactgaccgagcaaagattgacattcgtatcatcactgtgcaccattggcttctaggcactccagtggggtaggagaaggaggtctgaaaccctcgcagagggatcttgccctcattctttgggtctgaaacactggcagtcgttggaaacaggactcagggataaaccagcgcaatggattgggggacgctgcacactttcatcgggggtgtcaacaaacactccaccagcatcgggaaggtgtggatcacagtcatctttattttccgagtcatgatcctcgtggtggctgcccaggaagtgtggggtgacgagcaagaggacttcgtctgcaacacactgcaaccgggatgcaaaaatgtgtgctatgaccactttttcccggtgtcccacatccggctgtgggccctccagctgatcttcgtctccaccccagcgctgctggtggccatgcatgtggcctactacaggcacgaaaccactcgcaagttcaggcgaggagagaagaggaatgatttcaaagacatagaggacattaaaaagcagaaggttcggatagaggggtcgctgtggtggacgtacaccagcagcatctttttccgaatcatctttgaagcagcctttatgtatgtgttttacttcctttacaatgggtaccacctgccctgggtgttgaaatgtgggattgacccctgccccaaccttgttgactgctttatttctaggccaacagagaagaccgtgtttaccatttttatgatttctgcgtctgtgatttgcatgctgcttaacgtggcagagttgtgctacctgctgctgaaagtgtgttttaggagatcaaagagagcacagacgcaaaaaaatcaccccaatcatgccctaaaggagagtaagcagaatgaaatgaatgagctgatttcagatagtggtcaaaatgcaatcacaggtttcccaagctaaacatttcaaggtaaaatgtagctgcgtcataaggagacttctgtcttctccagaaggcaataccaacctgaaagttccttctgtagcctgaagagtttgtaaatgactttcataataaatagacacttgagttaactttttgtaggatacttgctccattcatacacaacgtaatcaaatatgtggtccatctctgaaaacaagagactgcttgacaaaggagcattgcagtcactttgacaggttccttttaagtggactctctgacaaagtgggtactttctgaaaatttatataactgttgttgataaggaacatttatccaggaattgatacgtttattaggaaaagatatttttataggcttggatgtttttagttctgactttgaatttatataaagtatttttataatgactggtcttccttacctggaaaaacatgcgatgttagttttagaattacaccacaagtatctaaatttggaacttacaaagggtctatcttgtaaatattgttttgcattgtctgttggcaaatttgtgaactgtcatgatacgcttaaggtggaaagtgttcattgcacaatatatttttactgctttctgaatgtagacggaacagtgtggaagcagaaggcttttttaactcatccgtttgccaatcattgcaaacaactgaaatgtggatgtgattgcctcaataaagctcgtccccattgctt

SEQ ID NO: 11911 - DNA, 2131 bp, Homo sapiens
ccgcagcccgcccgagccgcgtcagggcagaggcggggtggggcgcggttaaaaggcgcagcaggtgggagccggggccttcacccgaaacccgacgagagcccgacagccggcggcgcccgagcccgacctgcctgcccagccggagcgaagggcgccgccccgcgcagagcccgcgccagggccgccggccgcagagcagttaaaacgtgcaggcaccagaaggcacttcctgtcggtgaagaagacctgtctccggtgtcacgggcatcctgtgttttgcaaacggggctgacctcccttcctggggagcaggaagggtcagggaaggaaaagaagtacagaagatctggctaaacaatttctgtatggcgaaagaaaaattctaacttgtacgccctcttcatgcatctttaattcaatttgaatattccaggcgacatcctcactgaccgagcaaagattgacattcgtatcatcactgtgcaccattggcttctaggcactccagtggggtaggagaaggaggtctgaaaccctcgcagagggatcttgccctcattctttgggtctgaaacactggcagtcgttggaaacaggactcagggataaaccagcgcaatggattgggggacgctgcacactttcatcgggggtgtcaacaaacactccaccagcatcgggaaggtgtggatcacagtcatctttattttccgagtcatgatcctcgtggtggctgcccaggaagtgtggggtgacgagcaagaggacttcgtctgcaacacactgcaaccgggatgcaaaaatgtgtgctatgaccactttttcccggtgtcccacatccggctgtgggccctccagctgatcttcgtctccaccccagcgctgctggtggccatgcatgtggcctactacaggcacgaaaccactcgcaagttcaggcgaggagagaagaggaatgatttcaaagacatagaggacattaaaaagcagaaggttcggatagaggggtcgctgtggtggacgtacaccagcagcatctttttccgaatcatctttgaagcagcctttatgtatgtgttttacttcctttacaatgggtaccacctgccctgggtgttgaaatgtgggattgacccctgccccaaccttgttgactgctttatttctaggccaacagagaagaccgtgtttaccatttttatgatttctgcgtctgtgatttgcatgctgcttaacgtggcagagttgtgctacctgctgctgaaagtgtgttttaggagatcaaagagagcacagacgcaaaaaaatcaccccaatcatgccctaaaggagagtaagcagaatgaaatgaatgagctgatttcagatagtggtcaaaatgcaatcacaggtttcccaagctaaacatttcaaggtaaaatgtagctgcgtcataaggagacttctgtcttctccagaaggcaataccaacctgaaagttccttctgtagcctgaagagtttgtaaatgactttcataataaatagacacttgagttaactttttgtaggatacttgctccattcatacacaacgtaatcaaatatgtggtccatctctgaaaacaagagactgcttgacaaaggagcattgcagtcactttgacaggttccttttaagtggactctctgacaaagtgggtactttctgaaaatttatataactgttgttgataaggaacatttatccaggaattgatacgtttattaggaaaagatatttttataggcttggatgtttttagttctgactttgaatttatataaagtatttttataatgactggtcttccttacctggaaaaacatgcgatgttagttttagaattacaccacaagtatctaaatttggaacttacaaagggtctatcttgtaaatattgttttgcattgtctgttggcaaatttgtgaactgtcatgatacgcttaaggtggaaagtgttcattgcacaatatatttttactgctttctgaatgtagacggaacagtgtggaagcagaaggcttttttaactcatccgtttgccaatcattgcaaacaactgaaatgtggatgtgattgcctcaataaagctcgtccccattgctt

SEQ ID NO: 11912 - DNA, 1805 bp, Homo sapiens
cgacgagagcccgacagccggcggcgcccgagcccgacctgcctgcccagccggagcgaagggcgccgccccgcgcagagcccgcgccagggccgccggccgcagagcaggcgacatcctcactgaccgagcaaagattgacattcgtatcatcactgtgcaccattggcttctaggcactccagtggggtaggagaaggaggtctgaaaccctcgcagagggatcttgccctcattctttgggtctgaaacactggcagtcgttggaaacaggactcagggataaaccagcgcaatggattgggggacgctgcacactttcatcgggggtgtcaacaaacactccaccagcatcgggaaggtgtggatcacagtcatctttattttccgagtcatgatcctcgtggtggctgcccaggaagtgtggggtgacgagcaagaggacttcgtctgcaacacactgcaaccgggatgcaaaaatgtgtgctatgaccactttttcccggtgtcccacatccggctgtgggccctccagctgatcttcgtctccaccccagcgctgctggtggccatgcatgtggcctactacaggcacgaaaccactcgcaagttcaggcgaggagagaagaggaatgatttcaaagacatagaggacattaaaaagcagaaggttcggatagaggggtcgctgtggtggacgtacaccagcagcatctttttccgaatcatctttgaagcagcctttatgtatgtgttttacttcctttacaatgggtaccacctgccctgggtgttgaaatgtgggattgacccctgccccaaccttgttgactgctttatttctaggccaacagagaagaccgtgtttaccatttttatgatttctgcgtctgtgatttgcatgctgcttaacgtggcagagttgtgctacctgctgctgaaagtgtgttttaggagatcaaagagagcacagacgcaaaaaaatcaccccaatcatgccctaaaggagagtaagcagaatgaaatgaatgagctgatttcagatagtggtcaaaatgcaatcacaggtttcccaagctaaacatttcaaggtaaaatgtagctgcgtcataaggagacttctgtcttctccagaaggcaataccaacctgaaagttccttctgtagcctgaagagtttgtaaatgactttcataataaatagacacttgagttaactttttgtaggatacttgctccattcatacacaacgtaatcaaatatgtggtccatctctgaaaacaagagactgcttgacaaaggagcattgcagtcactttgacaggttccttttaagtggactctctgacaaagtgggtactttctgaaaatttatataactgttgttgataaggaacatttatccaggaattgatacgtttattaggaaaagatatttttataggcttggatgtttttagttctgactttgaatttatataaagtatttttataatgactggtcttccttacctggaaaaacatgcgatgttagttttagaattacaccacaagtatctaaatttggaacttacaaagggtctatcttgtaaatattgttttgcattgtctgttggcaaatttgtgaactgtcatgatacgcttaaggtggaaagtgttcattgcacaatatatttttactgctttctgaatgtagacggaacagtgtggaagcagaaggcttttttaactcatccgtttgccaatcattgcaaacaactgaaatgtggatgtgattgcctcaataaagctcgtccccattgctt

SEQ ID NO: 11913 - DNA, 1927 bp, Homo sapiens
acgagagcccgacagccggcggcgcccgagcccgacctgcctgcccagccggagcgaagggcgccgccccgcgcagagcccgcgccagggccgccggccgcagagcagttaaaacgtgcaggcaccagaaggcacttcctgtcggtgaagaagacctgtctccggtgtcacgggcatcctgtgttttgcaaacggggctgacctcccttcctggggagcaggaagggtcagggcgacatcctcactgaccgagcaaagattgacattcgtatcatcactgtgcaccattggcttctaggcactccagtggggtaggagaaggaggtctgaaaccctcgcagagggatcttgccctcattctttgggtctgaaacactggcagtcgttggaaacaggactcagggataaaccagcgcaatggattgggggacgctgcacactttcatcgggggtgtcaacaaacactccaccagcatcgggaaggtgtggatcacagtcatctttattttccgagtcatgatcctcgtggtggctgcccaggaagtgtggggtgacgagcaagaggacttcgtctgcaacacactgcaaccgggatgcaaaaatgtgtgctatgaccactttttcccggtgtcccacatccggctgtgggccctccagctgatcttcgtctccaccccagcgctgctggtggccatgcatgtggcctactacaggcacgaaaccactcgcaagttcaggcgaggagagaagaggaatgatttcaaagacatagaggacattaaaaagcagaaggttcggatagaggggtcgctgtggtggacgtacaccagcagcatctttttccgaatcatctttgaagcagcctttatgtatgtgttttacttcctttacaatgggtaccacctgccctgggtgttgaaatgtgggattgacccctgccccaaccttgttgactgctttatttctaggccaacagagaagaccgtgtttaccatttttatgatttctgcgtctgtgatttgcatgctgcttaacgtggcagagttgtgctacctgctgctgaaagtgtgttttaggagatcaaagagagcacagacgcaaaaaaatcaccccaatcatgccctaaaggagagtaagcagaatgaaatgaatgagctgatttcagatagtggtcaaaatgcaatcacaggtttcccaagctaaacatttcaaggtaaaatgtagctgcgtcataaggagacttctgtcttctccagaaggcaataccaacctgaaagttccttctgtagcctgaagagtttgtaaatgactttcataataaatagacacttgagttaactttttgtaggatacttgctccattcatacacaacgtaatcaaatatgtggtccatctctgaaaacaagagactgcttgacaaaggagcattgcagtcactttgacaggttccttttaagtggactctctgacaaagtgggtactttctgaaaatttatataactgttgttgataaggaacatttatccaggaattgatacgtttattaggaaaagatatttttataggcttggatgtttttagttctgactttgaatttatataaagtatttttataatgactggtcttccttacctggaaaaacatgcgatgttagttttagaattacaccacaagtatctaaatttggaacttacaaagggtctatcttgtaaatattgttttgcattgtctgttggcaaatttgtgaactgtcatgatacgcttaaggtggaaagtgttcattgcacaatatatttttactgctttctgaatgtagacggaacagtgtggaagcagaaggcttttttaactcatccgtttgccaatcattgcaaacaactgaaatgtggatgtgattgcctcaataaagctcgtccccattgctt

SEQ ID NO: 11914 - DNA, 2173 bp, Homo sapiens
ttcattccgttaagttctacacattgtgttgcagggctgaaaaagcacgagtgtccgcactatgacaaaagaaaagcggcgtctcctcaaaacaccaccatgttcccctatgagtctggtgagccaagacactaagaaactgcaggaaacgagagagttctcggggtgggggtgtccatggatgaagcaccgaacaaactggagcccgcaagagtcttgccttcttttgagcctaagtcatgagttggatgttcctcagagatctcctgagtggagtaaataaatactccactgggactggatggatttggctggctgtcgtgtttgtcttccgtttgctggtctacatggtggcagcagagcacgtgtggaaagatgagcagaaagagtttgagtgcaacagtagacagcccggttgcaaaaatgtgtgttttgatgacttcttccccatttcccaagtcagactttgggccttacaactgataatggtctccacaccttcacttctggtggttttacatgtagcctatcatgagggtagagagaaaaggcacagaaagaaactctatgtcagcccaggtacaatggatgggggcctatggtacgcttatcttatcagcctcattgttaaaactggttttgaaattggcttccttgttttattttataagctatatgatggctttagtgttccctaccttataaagtgtgatttgaagccttgtcccaacactgtggactgcttcatctccaaacccactgagaagacgatcttcatcctcttcttggtcatcacctcatgcttgtgtattgtgttgaatttcattgaactgagttttttggttctcaagtgctttattaagtgctgtctccaaaaatatttaaaaaaacctcaagtcctcagtgtgtgagtgccacagcctcagatatgttgaatgtggtaggagagggacccctcccctactccagaatcttcacacttggccataaacacactccctctacctgaagcaaagctactctgtgacacacaagagggttaaacaaagaaaacctgcatccctcctcagcaaggcctaagctgagttggaagacaaagcacatcagccttagtatcatttgggaggaatttttttacattgtcaatatgctttcagttatgagctctagacagaggtctcattgttttgttgtagggttctccagtatgtggataacattagttgttttagaataggtaattgcaaattagtctgaagaaatctaacaggattcttttaagagcttagatttttcagggaaaaaaaaaaaaaaagaaaccctgtgtcagttttctgttttttctaactatctcattacaattggtgcacaatgaactggaaaatataaaaagtgacactttaggcaaatgtgatggcctccgagctgaaatgaaggaactggcaatctttccaaagtggcagccaaggccccactccctgtcctactcaatctctgcagggaaaaactgtgggataggatagcagccagctggggacacacagaggaacattcaacaggaaggtcccgcctagggaaaaggccacagagcccaggcctcttgccgattcagggatccttggatataagtggattagaggagagggaggaaagctatcatttcagtggtctccaaatcaagtagaaatattactgggaggtatcccacttaagcctgaaccagcagacatccgaaagggtcactctagagtcagaaaggaaagcaggtcccccagaaggcaacacattgataggaagtggaggccacagaaaaagaatgtgcccacttgataattacttaagacttctatttaaccaaaagaacattgaaatactttgtaaatattcatattgttgaacctttcataatcaggaattcactatgtactatactgtaagtcatagttcgcctataatttactagtatatctccctctaggacagatagtaaaatgtgtactatgttgttacagtggtgcaaaaatgttttaaaagtttatcacttgttttgaagactagaactttctttacttttctatattttcttagcaattcacagatatgttctctttggatttagtactttaacatatgtacatttcttcagaataaaaataagggtatttcacaatgc

SEQ ID NO: 11915 - DNA, 571 bp, Homo sapiens
aaatcaaatgagtaactgactggatctcttattaatctccacatctgtgtaaagagagtcttgccttcttttgagcctaagtcatgagttggatgttcctcagagatctcctgagtggagtaaataaatactccactgggactggatggatttggctggctgtcgtgtttgtcttccgtttgctggtctacatggtggcagcagagcacgtgtggaaagatgagcagaaagagtttgagtgcaacagtagacagcccggttgcaaaaatgtgtgttttgatgacttcttccccatttcccaagtcagactttgggccttacaactgataatggtctccacaccttcacttctggtggttttacatgtagcctatcatgagggtagagagaaaaggcacagaaagaaactctatgtcagcccaggtacaatggatgggggcctatggtacgcttatcttatcagcctcattgttaaaactggttttgaaattggcttccttgttttattttataagctatatgatggctttagtgttccctaccttataaagtgtgatttgaagccttgtcc

SEQ ID NO: 11916 - DNA, 2281 bp, Homo sapiens
ggggaggagccaagatggctgaataggaacagctccggtctacagctcccagagtgagcaacgcagaagatgggtgatttctgcatttccagtcgaggtaccgggttcatctcactagggagtgccagacactgggcgcagggctgaaaaagcacgagtgtccgcactatgacaaaagaaaagcggcgtctcctcaaaacaccaccatgttcccctatgagtctggtgagccaagacactaagaaactgcaggaaacgagagagttctcggggtgggggtgtccatggatgaagcaccgaacaaactggagcccgcaagagtcttgccttcttttgagcctaagtcatgagttggatgttcctcagagatctcctgagtggagtaaataaatactccactgggactggatggatttggctggctgtcgtgtttgtcttccgtttgctggtctacatggtggcagcagagcacgtgtggaaagatgagcagaaagagtttgagtgcaacagtagacagcccggttgcaaaaatgtgtgttttgatgacttcttccccatttcccaagtcagactttgggccttacaactgataatggtctccacaccttcacttctggtggttttacatgtagcctatcatgagggtagagagaaaaggcacagaaagaaactctatgtcagcccaggtacaatggatgggggcctatggtacgcttatcttatcagcctcattgttaaaactggttttgaaattggcttccttgttttattttataagctatatgatggctttagtgttccctaccttataaagtgtgatttgaagccttgtcccaacactgtggactgcttcatctccaaacccactgagaagacgatcttcatcctcttcttggtcatcacctcatgcttgtgtattgtgttgaatttcattgaactgagttttttggttctcaagtgctttattaagtgctgtctccaaaaatatttaaaaaaacctcaagtcctcagtgtgtgagtgccacagcctcagatatgttgaatgtggtaggagagggacccctcccctactccagaatcttcacacttggccataaacacactccctctacctgaagcaaagctactctgtgacacacaagagggttaaacaaagaaaacctgcatccctcctcagcaaggcctaagctgagttggaagacaaagcacatcagccttagtatcatttgggaggaatttttttacattgtcaatatgctttcagttatgagctctagacagaggtctcattgttttgttgtagggttctccagtatgtggataacattagttgttttagaataggtaattgcaaattagtctgaagaaatctaacaggattcttttaagagcttagatttttcagggaaaaaaaaaaaaaaagaaaccctgtgtcagttttctgttttttctaactatctcattacaattggtgcacaatgaactggaaaatataaaaagtgacactttaggcaaatgtgatggcctccgagctgaaatgaaggaactggcaatctttccaaagtggcagccaaggccccactccctgtcctactcaatctctgcagggaaaaactgtgggataggatagcagccagctggggacacacagaggaacattcaacaggaaggtcccgcctagggaaaaggccacagagcccaggcctcttgccgattcagggatccttggatataagtggattagaggagagggaggaaagctatcatttcagtggtctccaaatcaagtagaaatattactgggaggtatcccacttaagcctgaaccagcagacatccgaaagggtcactctagagtcagaaaggaaagcaggtcccccagaaggcaacacattgataggaagtggaggccacagaaaaagaatgtgcccacttgataattacttaagacttctatttaaccaaaagaacattgaaatactttgtaaatattcatattgttgaacctttcataatcaggaattcactatgtactatactgtaagtcatagttcgcctataatttactagtatatctccctctaggacagatagtaaaatgtgtactatgttgttacagtggtgcaaaaatgttttaaaagtttatcacttgttttgaagactagaactttctttacttttctatattttcttagcaattcacagatatgttctctttggatttagtactttaacatatgtacatttcttcagaataaaaataagggtatttcacaatgct

SEQ ID NO: 11917 - DNA, 2889 bp, Homo sapiens
gctcggccctggcctcgcaggctgccgcgccggagcgccaggtgcccgctgaagtagcaggaacagagccggtgttcggaccctcccctggcccccaacctgcggcggagagcggcgctgagacttctcctgggcgggcgagcgctggaggacctgcaggctgccaccccgccccgcccctcgtcccggcgtccgcgggatccagacccgaaccccggacggcgcccgaggttcgtgccctctctctagaccgcgccaactgccccatcggtcgggacgcgcttggatttctttccccatttcttctcttttaagtacaataaaaggaaagggggattcgaggattttttaaaaaattgcttctttaattgggaggcaattcactcccattctggaagtgcggcccggggaggggccaggagcgggaacgtgcccggtgctgcccagtctttgtctgctgcctccggatgcacagcgatgggggaatggaccatcttggagaggctgctagaagccgcggtgcagcagcactccactatgatcgggaggatcctgttgactgtggtggtgatcttccggatcctcattgtggccattgtgggggagacggtgtacgatgatgagcagaccatgtttgtgtgcaacaccctgcagcccggctgtaaccaggcctgctatgaccgcgccttccccatctcccacatacgttactgggtcttccagatcataatggtgtgtacccccagtctttgcttcatcacctactctgtgcaccagtccgccaagcagcgagaacgccgctactctacagtcttcctagccctggacagagacccccctgagtccataggaggtcctggaggaactgggggtgggggcagtggtgggggcaaacgagaagataagaagttgcaaaatgctattgtgaatggggtgctgcagaacacagagaacaccagtaaggagacagagccagattgtttagaggttaaggagctgactccacacccatcaggtctacgcactgcatcaaaatccaagctcagaaggcaggaaggcatctcccgcttctacattatccaagtggtgttccgaaatgccctggaaattgggttcctggttggccaatattttctctatggctttagtgtcccagggttgtatgagtgtaaccgctacccctgcatcaaggaggtggaatgttatgtgtcccggccaactgagaagactgtctttctagtgttcatgtttgctgtaagtggcatctgtgttgtgctcaacctggctgaactcaaccacctgggatggcgcaagatcaagctggctgtgcgaggggctcaggccaagagaaagtcaatctatgagattcgtaacaaggacctgccaagggtcagtgttcccaattttggcaggactcagtccagtgactctgcctatgtgtgagagggcaggtttcatgaaggtctgggggatggcaaggagccccaaggcagatgactgctcagacgtggctgtatccaccctcatttatgtgaccctcaccattaagatgtaggataagactggataaaagaagattttgcaccaatgggaaaggaggaaaagtggacccattttcacatatcacctaattggttctacagagacgattgggtagagtgatgaaatggatcaattagacttctttggtccctttctgtttatggcctagcctgatcctgataacactgaacttgcacagctaccaagtaggacttagccctgctgagctctttattctggtgaatggtgtgagttgagtacttcattgatataaaatttgtgacctatctcaacccatccctttatcctgagccatgggacaaacatccttgaggcactcttcatgtatctcccccaccagcatgcccctttccctcaatccaaaatagcatgccagctttttttttttttttttttttttttccagaatctggccttacattagacctaatatgttttatttgcaaacttagagggaattacatggggtgcttattggagaacggccatggcagaggttttcattagagccccatctgactggcccttagtcgtgatgaaaaccttaggaatgtctcaatatttccagttttctaactcaaactgcactggtgctgtttactagggatgggggatgggtgggagggagggaattgcaatatgcaactacaacacttttgtgagattgttgttgcacagttaggcacacggttacgagcttcaggatatttctgccttccagcttgtggactttggttaacattaaaaagattttttttggctaatatcaagagtgtctagctgagccacagcatttgtaactggtgtatctcactcattttcttacatagttttgttgtgcaacacagctgcacggtcattttgccatgatttgaatttacctgtgtgcttacaccagagaccttaatcatcccatgtcaatcctgatttattattttttcagttactctttgaaacacacacacatatacagacacacatacaaaattactggcttaaaagacctgcaactaaacactattggctaacgtgtgtttacggtgacttatttgagacatataccaaaggttcaaaaacctattgcattggactgtcaatatgttttcttctttttgctcttatttatttaagtgccatactgtacctttcatatccactgtgtatttagttaaaatattggccaagagaaacatctgggtaatgtgcttttatgaagccctttgttccctttgaattatcattatcatttttgatttagatatggacatggtgtaacacacaactaaggatttgtttaaaataaagttcttgcctttttttgtaaaa

SEQ ID NO: 11918 - DNA, 891 bp, Homo sapiens
atgggggagtgggcgttcctgggctcgctgctggacgccgtgcagctgcagtcgccgctcgtgggccgcctctggctggtggtcatgctgatcttccgcatcctggtgctggccacggtgggcggcgccgtgttcgaggacgagcaagaggagttcgtgtgcaacacgctgcagccgggctgtcgccagacctgctacgaccgcgccttcccggtctcccactaccgcttctggctcttccacatcctgctgctctcggcgcccccggtgctgttcgtcgtctactccatgcaccgggcaggcaaggaggcgggcggcgctgaggcggcggcgcagtgcgcccccggactgcccgaggcccagtgcgcgccgtgcgccctgcgcgcccgccgcgcgcgccgctgctacctgctgagcgtggcgctgcgcctgctggccgagctgaccttcctgggcggccaggcgctgctctacggcttccgcgtggccccgcacttcgcgtgcgccggtccgccctgcccgcacacggtcgactgcttcgtgagccggcccaccgagaagaccgtcttcgtgctcttctatttcgcggtggggctgctgtcggcgctgctcagcgtagccgagctgggccacctgctctggaagggccgcccgcgcgccggggagcgtgacaaccgctgcaaccgtgcacacgaagaggcgcagaagctgctcccgccgccgccgccgccaccacctattgttgtcacttgggaagaaaacagacaccttcaaggagagggctcccctggtagcccccaccccaagacagagctggatgcccctcgcttccgtagggaaagcacttctcctgcaggatggcattgctctctccccttccatggcacgtag

SEQ ID NO: 11919 - DNA, 1580 bp, Homo sapiens
agaaaaacccacctcctactcctggctcagacctttgctttcttatctccagctcacacctttaagtcttatgtagttaaaggacatttatccgcctccttggagaacacagccctccagtgtctcctgcagcctggagcctgggacattctggaagcatggaaggcgtggacttgctagggtttctcatcatcacattaaactgcaacgtgaccatggtgggaaagctctggttcgtcctcacgatgctgctgcggatgctggtgattgtcttggcggggcgacccgtctaccaggacgagcaggagaggtttgtctgcaacacgctgcagccgggatgcgccaatgtttgctacgacgtcttctcccccgtgtctcacctgcggttctggctgatccagggcgtgtgcgtcctcctcccctccgccgtcttcagcgtctatgtcctgcaccgaggagccacgctcgccgcgctgggcccccgccgctgccccgacccccgggagccggcctccgggcagagacgctgcccgcggccattcggggagcgcggcggcctccaggtgcccgacttttcggccggctacatcatccacctcctcctccggaccctgctggaggcagccttcggggccttgcactactttctctttggattcctggccccgaagaagttcccttgcacgcgccctccgtgcacgggcgtggtggactgctacgtgtcgcggcccacagagaagtccctgctgatgctgttcctctgggcggtcagcgcgctgtcttttctgctgggcctcgccgacctggtctgcagcctgcggcggcggatgcgcaggaggccgggaccccccacaagcccctccatccggaagcagagcggagcctcaggccacgcggagggacgccggactgacgaggagggtgggcgggaggaagagggggcaccggcgcccccgggtgcacgcgccggaggggagggggctggcagccccaggcgtacatccagggtgtcagggcacacgaagattccggatgaggatgagagtgaggtgacatcctccgccagcgaaaagctgggcagacagccccggggcaggccccaccgagaggccgcccaggaccccaggggctcaggatccgaggagcagccctcagcagcccccagccgcctggccgcgcccccttcctgcagcagcctgcagccccctgacccgcctgccagctccagtggtgctccccacctgagagccaggaagtctgagtgggtgtgaaaaaaacagcacctggcggtgccccggggctcacgcctgtaatcccaacactttgggaggcccaggcaggaggatcgtttgagaatatatctccttgcccaagagtttgagaccagcctggacaacataatgagaccctcgtctctacaaaatatctaaaaattagctgggcacagtggctccctcctgtagtcccagctacttgggaggctgagatgggaggaccatttgagcctgggagatcgaggctgcagtgagccaagatcacggcactgcgctgcagcctgggcaacacagtgagaccctgtc

SEQ ID NO: 11920 - DNA, 7644 bp, Homo sapiens
ggcagcggcgggagcggcttctgcctcggctggagactgaggcgaaggcggcagcggcggaggaggtggaggagaggcgagggtgaaggcgatggcgacgcggggcacatgaggccgcgaccggcgggacgggccgaggcccggcggaggaggcggctccgggggaacccgccgccggagggaatctggaaaaattgcaatcaaaacatcatttctctaagaaaattttgggtaaccgaagttctggacaacagggcataccaattcaatcaccatgagttggagcttcctgactcgcctgctagaggagattcacaaccattccacatttgtggggaagatctggctcactgttctgattgtcttccggatcgtccttacagctgtaggaggagaatccatctattacgatgagcaaagcaaatttgtgtgcaacacagaacagccgggctgtgagaatgtctgttatgatgcgtttgcacctctctcccatgtacgcttctgggtgttccagatcatcctggtggcaactccctctgtgatgtacctgggctatgctatccacaagattgccaaaatggagcacggtgaagcagacaagaaggcagctcggagcaagccctatgcaatgcgctggaaacaacaccgggctctggaagaaacggaggaggacaacgaagaggatcctatgatgtatccagagatggagttagaaagtgataaggaaaataaagagcagagccaacccaaacctaagcatgatggccgacgacggattcgggaagatgggctcatgaaaatctatgtgctgcagttgctggcaaggaccgtgtttgaggtgggttttctgatagggcagtattttctgtatggcttccaagtccacccgttttatgtgtgcagcagacttccttgtcctcataagatagactgctttatttctagacccactgaaaagaccatcttccttctgataatgtatggtgttacaggcctttgcctcttgcttaacatttgggagatgcttcatttagggtttgggaccattcgagactcactaaacagtaaaaggagggaacttgaggatccgggtgcttataattatcctttcacttggaatacaccatctgctccccctggctataacattgctgtcaaaccagatcaaatccagtacaccgaactgtccaatgctaagatcgcctacaagcaaaacaaggccaacacagcccaggaacagcagtatggcagccatgaggagaacctcccagctgacctggaggctctgcagcgggagatcaggatggctcaggaacgcttggatctggcagttcaggcctacagtcaccaaaacaaccctcatggtccccgggagaagaaggccaaagtggggtccaaagctgggtccaacaaaagcactgccagtagcaaatcaggggatgggaagacctccgtctggatttaatcctggcgggcttaaaacctgtgcttttcatagtttatggtaagcagcagctcactgaataatgacttccattgagtaaacatttggctctggttatcttcagggatgctgttggctcatgatccaagctcaggggactctggaggcggggctgggctgagggagagaaagggaaacacagtgttcccaggcacatgttcttagcaataatacagttgcagaactttacatttgtgtcttccagatctggagaagaacagacatatttaaatcattcttgttgaacagtttttgtatgtacagtattatggtacttttttttttttagtatgagaactttttttgtatttgtacattgaactgctgtagttatacttttatattaaaggggaaaaagtccttataaataatgcctattaggctagtgctattactttgttcagcaaattctaccctggctttagagtttttaatagatgctacacctaataaaagtgcctctcatattgcaggaacgatttcagatgtgtaaggagactgaagaggagataccagtttttagtcttggaaagcaagttcacagtagaaggaggttgagatctttcttttatgtgagaaatctttgaatctcattcatgcgatcagagttgtagccaatttttgaaaaccttattttcaaaggaaataaatgattcactgtaggattcctttaaatatcaagcatcaccagtatatgctttgatggtatatgtatataacttaaagttctttcaaaagcctgatacagaaacgtgtccccagtttggtagcaatgtggaaaacctggctagagatgatatggagctgtccctcagaaagcaaagccatgcctggaatccctaataggctgcttagttgtgaacctgtttgatttgccttaagcctctatccagaaacctgcccgcttccgtctggttaagaagccagtggtggatattttctttgttaacattagaaatgcaaacattcccttgtcaaccaagaatactcaaagctacttgtattggaaatggcagaaggcctaaatccaaatttcttattttttataatttaccatagaagttttgtgattaaattcttacttctgccagtggaggtttatgcctgaaaggtcatggggtcctgtctgtaaatagacctaaagagaagtgcagtatttattctttgtaggcataatgtgtttgtcactgacaagcattcatgttcatcccactagtcttttattgcagtcttttattgtcattttcagccttatgttggagagctttgctttctcatcatgttcacattgtcttaagttttgtgagcttctgagaaagagcttggtaaaggtttaaaggggactttgttccaccagggagcattttatttgggcgtctcacccttttctaatgaaagctgttgtaagccacctctgacttggaaattctgaaagtatgaatattttttatatcttaattgtaaaatgccagttctccattatttagatgaatagtagaacactgcaccctttgtgcagtgtttttgtttctctactgcattcctacccccaccaaaaaaaagaaacttaaggaaatttttttttgagacagggtctccctctttcacccaggctggagtgcagcagcatgatctcagctcactgcagcctctgcctcccaggctcaagcaatcattccacctcagcctcttgattagctgggactacaggcatgtgccaccatactcggctaattctgttttaaaaattttttttgtagagatgaggtctcactatgttacccaggctggtctcgaacttttgggttcaagtgatcctcccgcctcagcctctcaaagtgttagtattataggtgtgagccaccatgcccagcctagaaaatttaaccttatcttttagccattcatttacttttatttgcttttttaaaaaaaaatctttaaattttagcctagagaagcacctcaggaactctaaacatcttaggcaaaaattaaactcaggtgagactgaaggagaaatttcagaaatacacatgtacctcatgggtaattaatagacatgcacagtttccttcaaatcaaatgtttaataaggaaattcatataattccaagaaaacaggcaaaatttggaatacataagcctagctaagataaagaactaccagttaattcttaacatcactggagcttccagcaggttttttaattgaaggacaaaaagtgtccatacatttgtgttatctcttcagagcctgagggagaagagagtggctttgcccagtggaaaggctggggatttgagaatgatacagggggaaggagtcaagcagaaatgccaggaagaaccaggcaaagacatttggcgccagaagcatccacttaatttctgtgaagagtgcccctggtgtttcatcttggcctgttttgatgagaatgttatcttttgtgtctggataacgcgtcagcttcttaaagtacatataaagatattctgtcacctccccacatgcacacacttttaaaatctatttttattctcttgctaaagttgtaattatgtcaagaattttccagctctaactgccttcttagtacatgtctttctgcctttgaagcatatgagtttgccaaagtcattctcccctaatgacatattgtggacttacattaagaaaatgggccaggcgcggtggctcacacctgtaatcccagcactttaggaggcccaggcgggtggattacctgaggtcaggagttcaagaccagactggtcaacatggtgaaactccatctctactaaaaatacagaaattagccaggagtgctgggtggacgcctgcaatcccagctacttgggaggttgaggcaggagaattgcttgaacccaggaggcagaggttgcagtgagctgagatcataccattgcactccagcctgcaagacagagtgaaactcttgtctcaaaaaaaaaaaaagaaaaaaagaaagtgagcctgttgatgtctagctaacccattggtggagtctgcattgaatctgtaagaatattgttctggatcatgcaggtgggatttgtataaaaagcctgtccaacatttagttctcactcgcatcagaatcatactgttttgaattgccatataagacatgctccatcatgacacttgcttctcctccaaatacaagttgagtgcttagtccttcacctgctagaatcaggatacaatcaacatgattatgttccttaacacacttggatttatgcagatgtggtgtgtcctttgctcttttttttcttaagacagagtcttgctcttgtcgctcaggctggagtgcagtggtgtgatttcggctcactgcaacctccgcctcctgggttcaagcgattctcctgcctcagcctcccgagtagctgggattacaggcaccaccaccataccaggctgattttttttgtatttttaatatagacagggcttcatcatgttggccaggctggcaggctggtctcgaactcctcacctcgtgatccgcccacctcagcttcccaaagtgctgtgattacaggcgtgagccaccgcgcctggcctgctcttaaaacccgttattcagaagatttgtaaaagaaataggctttttttttttttttggttaattcaaacgaggggaaaattagatagcattttcccctaaagaaatgttaatgttcattttgtggctttgttttcaagtttcaggagccatgtacatctcagaagtgttacgaagtgattagaaaaggcctctggtaaaagaccttcaaggaccaaccattattattggtcacttgtttgaacttggcgcttaaaaaaaaagttggactgtgatgctttggtgctctttatcacagacatcagtgatggtctgaaacactctctagcagtttatacgaagaatggacttacatgttatcagttacactcatgatttactcgttcagcttctacaagtccatactttatgctgtctcatttaagagacagtccacttctgaaaataaaatcgatagttgatgatacatttttggctagccagctttctgtaaaaggcaagtatgttagacatgcacagtttccttcaaatcaaatgtttaataaggtacttcaagaaacgcctttttaaaaatcaaaggttttggccaggcatggtggctcacgcctgtaatcccagcactttgggaggccaaggtgggcgaatcacaaggtcaggagtttgagaccagcctggccaacatggtgaaaccccgtctctactaaaaataccaaaaattagccgggcgtggtggtgggtacctgtaatcccagctactcaggaggctgagatgagaatcacttgatcccaggaggtagaggttgcagtgagccgagattgcgccattgcacttcagcctgggcaacgagtgaaactctcaaaaaaaaattcatagtaataataaagtccctgcatgcagtttggaaataaaatttaaactcatttatgtgtaataaatatgtaataattcacagtcaccatcaaatgttggaatcattgaattgcatacttgtactcattccggccacatcatgaagtgtttaaagatttgtatttgctgttgtccctatgtagttctattgatgtttggttttgttttttggggtttgttttgagcccaggctagagtgcaatggcacaatctcaactcactacagcctggacctccttggctcaagcagtcctcccacttcagcctcccaagtagctggtctgcaagtgctcaccaccacacctggctaatttttgtattttttgtagagacagagctctcactatgttgcctagactggtctcaaactcctgggcccaagcaatcctcccatcacagcctccgaaggtgctgggattacaggcataagccactgtgcccagcctgtttttaataatgatattaagtgggtttggttcatgtgttattaatcagtgttaataatcgtacttttttttttttttaaaagaaaccatggtattctaaaatcaggagtccaaataaaagaaagttctcggctgtgcatggtggctaacacctgtaatcccagcactttgggaggctgaggtgggtggatcactagaggtcaggagtttgaaacaagcctggccaacatggtaaaaccccctctctactaaaaatacaaaaattagccgggcatggtggtgcacacctgtaatcccagctactcgggatgttgaggcatgagatttccttgaacctggaaggcagaggttgctgtgagccgagatcgcgccactgcactccagcctgggtgacagagtaagactgtcgccaaaaaagaggaaaaaagttatccagtgcagtttctacagagataaaagaagtaatagttctggctgggtgtggtggcttatgcctgtaatcccaacactttgggaggccaaggcaggtggatcacatgaggtcaggagttcgagaccagcctggccaacatggcaaaactgtctctactaaaaatataaaaattaggtatggtggcacgtgcctgtacttacagctacttgggaggctgaggcatgagatgacaatctcttgaacccaggaggcggaggttgcagtgagctgagattgcaccactgcactccagcttgggtgatggagtgagactcaaataaaaaaggtactagttctgcatttcagagttggcttgttgaaccaggctatatgcttccaagatttaaatgtttttctgtattatactctcaattgtgttttaaaaaaatctcttacagaaatctctacctcaggcactaagtgttatgacatgggtagcatattgatattgaaaacttagctaggacttccagccttttaagataatttaaatgtaaaattaaatggttaaccagcaatctaatgtcatgtggtgtgcagtttggatattgcatgaacagctaaggaatcacctgttctagtgccaaagatcactcattgctaattttgttctgtacagcttatgtaatattttcatggtggagacggactctgtgtgctcagggccttgtctctaggaagattttgtcaattccaaatacagttttgaagattca

SEQ ID NO: 11921 - DNA, 7640 bp, Homo sapiens
actgctaagagccccgactctagctagatccacgcagggcccgccagatcctcgaggaattgtagagcagaacctgggaggagacattagcatcccgtgctacaatggaccaaggcctcggcggagcgcgcagaagacaactctgggcccgctaaaccaacccaggatacccagagggaatctggaaaaattgcaatcaaaacatcatttctctaagaaaattttgggtaaccgaagttctggacaacagggcataccaattcaatcaccatgagttggagcttcctgactcgcctgctagaggagattcacaaccattccacatttgtggggaagatctggctcactgttctgattgtcttccggatcgtccttacagctgtaggaggagaatccatctattacgatgagcaaagcaaatttgtgtgcaacacagaacagccgggctgtgagaatgtctgttatgatgcgtttgcacctctctcccatgtacgcttctgggtgttccagatcatcctggtggcaactccctctgtgatgtacctgggctatgctatccacaagattgccaaaatggagcacggtgaagcagacaagaaggcagctcggagcaagccctatgcaatgcgctggaaacaacaccgggctctggaagaaacggaggaggacaacgaagaggatcctatgatgtatccagagatggagttagaaagtgataaggaaaataaagagcagagccaacccaaacctaagcatgatggccgacgacggattcgggaagatgggctcatgaaaatctatgtgctgcagttgctggcaaggaccgtgtttgaggtgggttttctgatagggcagtattttctgtatggcttccaagtccacccgttttatgtgtgcagcagacttccttgtcctcataagatagactgctttatttctagacccactgaaaagaccatcttccttctgataatgtatggtgttacaggcctttgcctcttgcttaacatttgggagatgcttcatttagggtttgggaccattcgagactcactaaacagtaaaaggagggaacttgaggatccgggtgcttataattatcctttcacttggaatacaccatctgctccccctggctataacattgctgtcaaaccagatcaaatccagtacaccgaactgtccaatgctaagatcgcctacaagcaaaacaaggccaacacagcccaggaacagcagtatggcagccatgaggagaacctcccagctgacctggaggctctgcagcgggagatcaggatggctcaggaacgcttggatctggcagttcaggcctacagtcaccaaaacaaccctcatggtccccgggagaagaaggccaaagtggggtccaaagctgggtccaacaaaagcactgccagtagcaaatcaggggatgggaagacctccgtctggatttaatcctggcgggcttaaaacctgtgcttttcatagtttatggtaagcagcagctcactgaataatgacttccattgagtaaacatttggctctggttatcttcagggatgctgttggctcatgatccaagctcaggggactctggaggcggggctgggctgagggagagaaagggaaacacagtgttcccaggcacatgttcttagcaataatacagttgcagaactttacatttgtgtcttccagatctggagaagaacagacatatttaaatcattcttgttgaacagtttttgtatgtacagtattatggtacttttttttttttagtatgagaactttttttgtatttgtacattgaactgctgtagttatacttttatattaaaggggaaaaagtccttataaataatgcctattaggctagtgctattactttgttcagcaaattctaccctggctttagagtttttaatagatgctacacctaataaaagtgcctctcatattgcaggaacgatttcagatgtgtaaggagactgaagaggagataccagtttttagtcttggaaagcaagttcacagtagaaggaggttgagatctttcttttatgtgagaaatctttgaatctcattcatgcgatcagagttgtagccaatttttgaaaaccttattttcaaaggaaataaatgattcactgtaggattcctttaaatatcaagcatcaccagtatatgctttgatggtatatgtatataacttaaagttctttcaaaagcctgatacagaaacgtgtccccagtttggtagcaatgtggaaaacctggctagagatgatatggagctgtccctcagaaagcaaagccatgcctggaatccctaataggctgcttagttgtgaacctgtttgatttgccttaagcctctatccagaaacctgcccgcttccgtctggttaagaagccagtggtggatattttctttgttaacattagaaatgcaaacattcccttgtcaaccaagaatactcaaagctacttgtattggaaatggcagaaggcctaaatccaaatttcttattttttataatttaccatagaagttttgtgattaaattcttacttctgccagtggaggtttatgcctgaaaggtcatggggtcctgtctgtaaatagacctaaagagaagtgcagtatttattctttgtaggcataatgtgtttgtcactgacaagcattcatgttcatcccactagtcttttattgcagtcttttattgtcattttcagccttatgttggagagctttgctttctcatcatgttcacattgtcttaagttttgtgagcttctgagaaagagcttggtaaaggtttaaaggggactttgttccaccagggagcattttatttgggcgtctcacccttttctaatgaaagctgttgtaagccacctctgacttggaaattctgaaagtatgaatattttttatatcttaattgtaaaatgccagttctccattatttagatgaatagtagaacactgcaccctttgtgcagtgtttttgtttctctactgcattcctacccccaccaaaaaaaagaaacttaaggaaatttttttttgagacagggtctccctctttcacccaggctggagtgcagcagcatgatctcagctcactgcagcctctgcctcccaggctcaagcaatcattccacctcagcctcttgattagctgggactacaggcatgtgccaccatactcggctaattctgttttaaaaattttttttgtagagatgaggtctcactatgttacccaggctggtctcgaacttttgggttcaagtgatcctcccgcctcagcctctcaaagtgttagtattataggtgtgagccaccatgcccagcctagaaaatttaaccttatcttttagccattcatttacttttatttgcttttttaaaaaaaaatctttaaattttagcctagagaagcacctcaggaactctaaacatcttaggcaaaaattaaactcaggtgagactgaaggagaaatttcagaaatacacatgtacctcatgggtaattaatagacatgcacagtttccttcaaatcaaatgtttaataaggaaattcatataattccaagaaaacaggcaaaatttggaatacataagcctagctaagataaagaactaccagttaattcttaacatcactggagcttccagcaggttttttaattgaaggacaaaaagtgtccatacatttgtgttatctcttcagagcctgagggagaagagagtggctttgcccagtggaaaggctggggatttgagaatgatacagggggaaggagtcaagcagaaatgccaggaagaaccaggcaaagacatttggcgccagaagcatccacttaatttctgtgaagagtgcccctggtgtttcatcttggcctgttttgatgagaatgttatcttttgtgtctggataacgcgtcagcttcttaaagtacatataaagatattctgtcacctccccacatgcacacacttttaaaatctatttttattctcttgctaaagttgtaattatgtcaagaattttccagctctaactgccttcttagtacatgtctttctgcctttgaagcatatgagtttgccaaagtcattctcccctaatgacatattgtggacttacattaagaaaatgggccaggcgcggtggctcacacctgtaatcccagcactttaggaggcccaggcgggtggattacctgaggtcaggagttcaagaccagactggtcaacatggtgaaactccatctctactaaaaatacagaaattagccaggagtgctgggtggacgcctgcaatcccagctacttgggaggttgaggcaggagaattgcttgaacccaggaggcagaggttgcagtgagctgagatcataccattgcactccagcctgcaagacagagtgaaactcttgtctcaaaaaaaaaaaaagaaaaaaagaaagtgagcctgttgatgtctagctaacccattggtggagtctgcattgaatctgtaagaatattgttctggatcatgcaggtgggatttgtataaaaagcctgtccaacatttagttctcactcgcatcagaatcatactgttttgaattgccatataagacatgctccatcatgacacttgcttctcctccaaatacaagttgagtgcttagtccttcacctgctagaatcaggatacaatcaacatgattatgttccttaacacacttggatttatgcagatgtggtgtgtcctttgctcttttttttcttaagacagagtcttgctcttgtcgctcaggctggagtgcagtggtgtgatttcggctcactgcaacctccgcctcctgggttcaagcgattctcctgcctcagcctcccgagtagctgggattacaggcaccaccaccataccaggctgattttttttgtatttttaatatagacagggcttcatcatgttggccaggctggcaggctggtctcgaactcctcacctcgtgatccgcccacctcagcttcccaaagtgctgtgattacaggcgtgagccaccgcgcctggcctgctcttaaaacccgttattcagaagatttgtaaaagaaataggctttttttttttttttggttaattcaaacgaggggaaaattagatagcattttcccctaaagaaatgttaatgttcattttgtggctttgttttcaagtttcaggagccatgtacatctcagaagtgttacgaagtgattagaaaaggcctctggtaaaagaccttcaaggaccaaccattattattggtcacttgtttgaacttggcgcttaaaaaaaaagttggactgtgatgctttggtgctctttatcacagacatcagtgatggtctgaaacactctctagcagtttatacgaagaatggacttacatgttatcagttacactcatgatttactcgttcagcttctacaagtccatactttatgctgtctcatttaagagacagtccacttctgaaaataaaatcgatagttgatgatacatttttggctagccagctttctgtaaaaggcaagtatgttagacatgcacagtttccttcaaatcaaatgtttaataaggtacttcaagaaacgcctttttaaaaatcaaaggttttggccaggcatggtggctcacgcctgtaatcccagcactttgggaggccaaggtgggcgaatcacaaggtcaggagtttgagaccagcctggccaacatggtgaaaccccgtctctactaaaaataccaaaaattagccgggcgtggtggtgggtacctgtaatcccagctactcaggaggctgagatgagaatcacttgatcccaggaggtagaggttgcagtgagccgagattgcgccattgcacttcagcctgggcaacgagtgaaactctcaaaaaaaaattcatagtaataataaagtccctgcatgcagtttggaaataaaatttaaactcatttatgtgtaataaatatgtaataattcacagtcaccatcaaatgttggaatcattgaattgcatacttgtactcattccggccacatcatgaagtgtttaaagatttgtatttgctgttgtccctatgtagttctattgatgtttggttttgttttttggggtttgttttgagcccaggctagagtgcaatggcacaatctcaactcactacagcctggacctccttggctcaagcagtcctcccacttcagcctcccaagtagctggtctgcaagtgctcaccaccacacctggctaatttttgtattttttgtagagacagagctctcactatgttgcctagactggtctcaaactcctgggcccaagcaatcctcccatcacagcctccgaaggtgctgggattacaggcataagccactgtgcccagcctgtttttaataatgatattaagtgggtttggttcatgtgttattaatcagtgttaataatcgtacttttttttttttttaaaagaaaccatggtattctaaaatcaggagtccaaataaaagaaagttctcggctgtgcatggtggctaacacctgtaatcccagcactttgggaggctgaggtgggtggatcactagaggtcaggagtttgaaacaagcctggccaacatggtaaaaccccctctctactaaaaatacaaaaattagccgggcatggtggtgcacacctgtaatcccagctactcgggatgttgaggcatgagatttccttgaacctggaaggcagaggttgctgtgagccgagatcgcgccactgcactccagcctgggtgacagagtaagactgtcgccaaaaaagaggaaaaaagttatccagtgcagtttctacagagataaaagaagtaatagttctggctgggtgtggtggcttatgcctgtaatcccaacactttgggaggccaaggcaggtggatcacatgaggtcaggagttcgagaccagcctggccaacatggcaaaactgtctctactaaaaatataaaaattaggtatggtggcacgtgcctgtacttacagctacttgggaggctgaggcatgagatgacaatctcttgaacccaggaggcggaggttgcagtgagctgagattgcaccactgcactccagcttgggtgatggagtgagactcaaataaaaaaggtactagttctgcatttcagagttggcttgttgaaccaggctatatgcttccaagatttaaatgtttttctgtattatactctcaattgtgttttaaaaaaatctcttacagaaatctctacctcaggcactaagtgttatgacatgggtagcatattgatattgaaaacttagctaggacttccagccttttaagataatttaaatgtaaaattaaatggttaaccagcaatctaatgtcatgtggtgtgcagtttggatattgcatgaacagctaaggaatcacctgttctagtgccaaagatcactcattgctaattttgttctgtacagcttatgtaatattttcatggtggagacggactctgtgtgctcagggccttgtctctaggaagattttgtcaattccaaatacagttttgaagattca

SEQ ID NO: 11922 - DNA, 2243 bp, Homo sapiens
ggggaacaatggggcccttgagggcccctcctccagcccccattgtgcttggtggtgagaggtggccctggctcggccacacaccctcggggaggaccagcatccaagcaggtggaagggctctgagggagactggaattttctggcctggagaaggacccgcccgcccgcccctatgaccaacatgagctggagcttcctgacgcggctgctggaggagatccacaaccactccaccttcgtgggcaaggtgtggctcacggtgctggtggtcttccgcatcgtgctgacggctgtgggcggcgaggccatctactcggacgagcaggccaagttcacttgcaacacgcggcagccaggctgcgacaacgtctgctatgacgccttcgcgcccctgtcgcacgtgcgcttctgggtcttccagattgtggtcatctccacgccctcggtcatgtacctgggctacgccgtgcaccgcctggcccgtgcgtctgagcaggagcggcgccgcgccctccgccgccgcccggggccacgccgcgcgccccgagcgcacctgccgcccccgcacgccggctggcctgagcccgccgacctgggcgaggaggagcccatgctgggcctgggcgaggaggaggaggaggaggagacgggggcagccgagggcgccggcgaggaagcggaggaggcaggcgcggaggaggcgtgcactaaggcggtcggcgctgacggcaaggcggcagggaccccgggcccgaccgggcaacacgatgggcggaggcgcatccagcgggagggcctgatgcgcgtgtacgtggcccagctggtggccagggcagctttcgaggtggccttcctggtgggccagtacctgctgtacggcttcgaggtgcgaccgttctttccctgcagccgccagccctgcccgcacgtggtggactgcttcgtgtcgcgccctactgaaaagacggtcttcctgctggttatgtacgtggtcagctgcctgtgcctgctgctcaacctctgtgagatggcccacctgggcttgggcagcgcgcaggacgcggtgcgcggccgccgcggccccccggcctccgcccccgcccccgcgccgcggcccccgccctgcgccttccctgcggcggccgctggcttggcctgcccgcccgactacagcctggtggtgcgggcggccgagcgcgctcgggcgcatgaccagaacctggcaaacctggccctgcaggcgctgcgcgacggggcagcggctggggaccgcgaccgggacagttcgccgtgcgtcggcctccctgcggcctcccgggggccccccagagcaggcgcccccgcgtcccggacgggcagtgctacctctgcgggcactgtcggggagcagggccggcccggcacccacgagcggccaggagccaagcccagggctggctccgagaagggcagtgccagcagcagggacgggaagaccaccgtgtggatctgagggcgctggcttgcgagctgggccagggaggaggagggttggggggctccggtggaaacctgcgaccccttctcctcagccttctccttagccggtggcctcaggcagactctgcccagaggggcagccaggctgctcagggaaggggctgaaagcggcagaggagtgccctggcttggtcaccactggggccaaggtggggtggagagaggcctaggagccagaaagggccctctgctgtggtctgaaccccagggggagtggggcattgactccacccctgtcctgagctggaataggtcctctgggatgccagctctcccctttgtgcttccctgcagcaacccatggagggcccagggtgcctggtatgggcatcagttggtgggggtgcgggggtgcgtgtccccattccctgcaacagcaaatggggctccttcttcagccctccccttcccagccccaaactgagacagactgggagctgggagcctggggtggacaggaccataccctctttgagcttctgcgatgccggccttccgttcctctgggaggcttgaagttctgcaaagatgttgatatgccttgcagcttggacccaatgggtggtggtcagggcctgggggcttggccatgctgggggaatggggctctgggttcctgcctgtggcctgtctgtcctcctccctaattcagacccagcctcaagaggaaagggagtaaaataaaactaacttgtttataa

SEQ ID NO: 11923 - DNA, 1116 bp, Homo sapiens
atgtgtggcaggttcctgcggcggctgctggcggaggagagccggcgctccacccccgtggggcgcctcttgcttcccgtgctcctgggattccgccttgtgctgctggctgccagtgggcctggagtctatggtgatgagcagagtgaattcgtgtgtcacacccagcagccgggctgcaaggctgcctgcttcgatgccttccaccccctctccccgctgcgtttctgggtcttccaggtcatcttggtggctgtacccagcgccctctatatgggtttcactctgtatcacgtgatctggcactgggaattatcaggaaaggggaaggaggaggagaccctgatccagggacgggagggcaacacagatgtcccaggggctggaagcctcaggctgctctgggcttatgtggctcagctgggggctcggcttgtcctggagggggcagccctggggttgcagtaccacctgtatgggttccagatgcccagctcctttgcatgtcgccgagaaccttgccttggtagtataacctgcaatctgtcccgcccctctgagaagaccattttcctaaagaccatgtttggagtcagcggtttctgtctcttgtttacttttttggagcttgtgcttctgggtttggggagatggtggaggacctggaagcacaaatcttcctcttctaaatacttcctaacttcagagagcaccagaagacacaagaaagcaaccgatagcctcccagtggtggaaaccaaagagcaatttcaagaagcagttccaggaagaagcttagcccaggaaaaacaaagaccagttggacccagagatgcctgagttggagatgaactttggccaactttcctcatcaccatacttaaaatcctgtccaaggaggagcttattcaccattttctatacatgtgacatatgtagcagcataaccgacaactgggactgcgctgccttgactccacctctacatacaatgactcagctaaccagactaataaaagccatgtttgcaccattgctcagggaggcattgctttggggaattattcccagtgtcctccttacttatcgcaagtaataaaatccccctgggaaatc

SEQ ID NO: 11924 - DNA, 2164 bp, Homo sapiens
ataaagcagcctgtcctggcaagggatggtcatcctctcaacctacagacccagtgagccctaggccctcaccccagacccagctgctggataggacccagccccgctcccagagacaatgaccatgtttgaaaatgtcacccgggccctggccagacagctaaaccctcgaggggacctgacaccacttgacagcctcatcgacttcaagcgcttccatcccttctgcctggtgctgaggaagaggaagagcacgctcttctggggggcccggtacgtccgcaccgactacacgctgctggatgtgcttgagcccggcagctcaccttcagacccaacagacactgggaattttggctttaagaatatgctggacacccgagtggagggagatgtggatgtaccaaagacggtgaaggtgaagggaacggcagggctctcgcagaacagcactctggaggtccagacactcagtgtggctcccaaggccctggagaccgtgcaggagaggaagctggcagcagaccacccattcctgaaggagatgcaagatcaaggggagaacctgtatgtggtgatggaggtggtggagacggtgcaggaggtcacactggagcgagccggcaaggcagaggcctgcttctccctccccttcttcgccccattggggctacagggatccataaatcacaaggaggctgtaaccatccccaagggctgcgtcctggcctttcgagtgagacagctgatggtcaaaggcaaagatgagtgggatattccacatatctgcaatgataacatgcaaaccttccctcctggagaaaagtcaggagaggagaaggtcatccttatccaggcatctgatgttggggacgtacacgaaggcttcaggacactaaaagaagaagttcagagagagacccaacaagtggagaagctgagccgagtagggcaaagctccctgctcagctccctcagcaaacttctagggaagaaaaaggagctacaagaccttgagctcgcacttgaaggggctctagacaagggacatgaagtgaccctggaggcactcccaaaagatgtcctgctatcaaaggaggccgtgggcgccatcctctatttcgttggagccctaacagagctaagtgaagcccaacagaagctgctggtgaaatccatggagaaaaagatcctacccgtgcagctaaagctggtggagagcacgatggaacagaacttcctgctggataaagagggtgttttccccctgcaacctgagctgctctcctcccttggggacgaggagctgaccctcacggaggctctagtcgggctgagtggcctggaagtgcagagatcgggcccccaatatatgtgggacccagacaccctccctcgcctctgtgctctttatgcaggcctctctctccttcagcagcttaccaaggcctcctaatttgccttttacgtctgcttcatgactccctaatgccttcccaacctcgtggtgctgtgtccttaccacctaagggcatttcagagccatcagctgaagacatctgaaatctcagctggtcacccatgataaccaacttccacctgcccaaccatatatcaccccctacccctccagctccgcaacccactaagcccatctgctgatgcttaaattttctttacttttcttttctttttttttttttttttgagatggaggctcactctgtcacccaggctggagtgcagtggcttgatcttggctcactgcaacctccgcctcccaggttcaagcaattctcctgcctcagcctctcgagcagctggaattacaggcacgtgccacgacacccagctaatttttgtatttttagtagagacggggtttcaccatgttgcccaggttggtctcgaactcctggcctcaagtgatctgcccgcctcggcctcccaaagtgctgggattacaggcgtgagccaccgtgcccggcctgtgcttaaatattctaggagtagaagcactcagacttttaaaactatgagccgtttcagcaaaactgagaaaaaaagaagattaattaatttcctatcctaatccctcctacttatacttccccaaaaaacaagctttactggaattaatggaaaatattatgtcaatcttagg

SEQ ID NO: 11925 - DNA, 1500 bp, Homo sapiens
atctgtggggattctcacaacttccatttctggtgaacagctgaggtcagagaggagttggtccaggcgcaatgttcagcgtatttgaggaaatcacaagaattgtagttaaggagatggatgctggaggggatatgattgccgttagaagccttgttgatgctgatagattccgctgcttccatctggtgggggagaagagaactttctttggatgccggcactacacaacaggcctcaccctgatggacattctggacacagatggggacaagtggttagatgaactggattctgggctccaaggtcaaaaggctgagtttcaaattctggataatgtagactcaacgggagagttgatagtgagattacccaaagaaataacaatttcaggcagtttccagggcttccaccatcagaaaatcaagatatcggagaaccggatatcccagcagtatctggctacccttgaaaacaggaagctgaagagggaactacccttttcattccgatcaattaatacgagagaaaacctgtatctggtgacagaaactctggagacggtaaaggaggaaaccctgaaaagcgaccggcaatataaattttggagccagatctctcagggccatctcagctataaacacaagggccaaagggaagtgaccatccccccaaatcgggtcctgagctatcgagtaaagcagcttgtcttccccaacaaggagacgatgaagaaggatggtgcttcatcctgtttaggaaagtctttgggttcggaggattccagaaacatgaaggagaagttggaggacatggagagtgtcctcaaggacctgacagaggagaagagaaaagatgtgctaaactccctcgctaagtgcctcggcaaggaggatattcggcaggatctagagcaaagagtatctgaggtcctgatttccggggagctacacatggaggacccagacaagcctctcctaagcagcctttttaatgctgctggggtcttggtagaagcgcgtgcaaaagccattctggacttcctggatgccctgctagagctgtctgaagagcagcagtttgtggctgaggccctggagaaggggacccttcctctgttgaaggaccaggtgaaatctgtcatggagcagaactgggatgagctggccagcagtcctcctgacatggactatgaccctgaggcacgaattctctgtgcgctgtatgttgttgtctctatcctgctggagctggctgaggggcctacctctgtctcttcctaactacaaaagccctttctccccacaagcctctgggttttccctttaccagtctgtcctcactgccatcgccactaccatcctgtcaccagtgggacctctttaaaacaagcagccaaccattctttgatgtatcccattcgctccatgttaacatccaaaaccagcctggatttcatacatggacttctgattaaaagtggcaggttgtgcatgttaa

SEQ ID NO: 11926 - DNA, 1476 bp, Homo sapiens
gtttctgagttggtccaggcgcaatgttcagcgtatttgaggaaatcacaagaattgtagttaaggagatggatgctggaggggatatgattgccgttagaagccttgttgatgctgatagattccgctgcttccatctggtgggggagaagagaactttctttggatgccggcactacacaacaggcctcaccctgatggacattctggacacagatggggacaagtggttagatgaactggattctgggctccaaggtcaaaaggctgagtttcaaattctggataatgtagactcaacgggagagttgatagtgagattacccaaagaaataacaatttcaggcagtttccagggcttccaccatcagaaaatcaagatatcggagaaccggatatcccagcagtatctggctacccttgaaaacaggaagctgaagagggaactacccttttcattccgatcaattaatacgagagaaaacctgtatctggtgacagaaactctggagacggtaaaggaggaaaccctgaaaagcgaccggcaatataaattttggagccagatctctcagggccatctcagctataaacacaagggccaaagggaagtgaccatccccccaaatcgggtcctgagctatcgagtaaagcagcttgtcttccccaacaaggagacgatgagtgctggtttagatattcatttcaggggcaaaacaaaatcctttccagaaggaaagtctttgggttcggaggattccagaaacatgaaggagaagttggaggacatggagagtgtcctcaaggacctgacagaggagaagagaaaagatgtgctaaactccctcgctaagtgcctcggcaaggaggatattcggcaggatctagagcaaagagtatctgaggtcctgatttccggggagctacacatggaggacccagacaagcctctcctaagcagcctttttaatgctgctggggtcttggtagaagcgcgtgcaaaagccattctggacttcctggatgccctgctagagctgtctgaagagcagcagtttgtggctgaggccctggagaaggggacccttcctctgttgaaggaccaggtgaaatctgtcatggagcagaactgggatgagctggccagcagtcctcctgacatggactatgaccctgaggcacgaattctctgtgcgctgtatgttgttgtctctatcctgctggagctggctgaggggcctacctctgtctcttcctaactacaaaagccctttctccccacaagcctctgggttttccctttaccagtctgtcctcactgccatcgccactaccatcctgtcaccagtgggacctctttaaaacaagcagccaaccattctttgatgtatcccattcgctccatgttaacatccaaaaccagcctggatttcatacatggacttctgattaaaagtggcaggttgtgcatgttaa

SEQ ID NO: 11927 - DNA, 1626 bp, Homo sapiens
gtggaatgtcatcagttaaggctattttcatttcttttgtggatcttcagttgcttcaggccatctggatgtatacatgcaggtcacagggaatatgatggcttagcttgggttcagaggcctgacacctcaggctgccaaatgtggaagatttaaatacttgaaccaataccctcctcccaaaaactgaaattggcttctgtttctgagttggtccaggcgcaatgttcagcgtatttgaggaaatcacaagaattgtagttaaggagatggatgctggaggggatatgattgccgttagaagccttgttgatgctgatagattccgctgcttccatctggtgggggagaagagaactttctttggatgccggcactacacaacaggcctcaccctgatggacattctggacacagatggggacaagtggttagatgaactggattctgggctccaaggtcaaaaggctgagtttcaaattctggataatgtagactcaacgggagagttgatagtgagattacccaaagaaataacaatttcaggcagtttccagggcttccaccatcagaaaatcaagatatcggagaaccggatatcccagcagtatctggctacccttgaaaacaggaagctgaagagggaactacccttttcattccgatcaattaatacgagagaaaacctgtatctggtgacagaaactctggagacggtaaaggaggaaaccctgaaaagcgaccggcaatataaattttggagccagatctctcagggccatctcagctataaacacaagggccaaagggaagtgaccatccccccaaatcgggtcctgagctatcgagtaaagcagcttgtcttccccaacaaggagacgatgagaaagtctttgggttcggaggattccagaaacatgaaggagaagttggaggacatggagagtgtcctcaaggacctgacagaggagaagagaaaagatgtgctaaactccctcgctaagtgcctcggcaaggaggatattcggcaggatctagagcaaagagtatctgaggtcctgatttccggggagctacacatggaggacccagacaagcctctcctaagcagcctttttaatgctgctggggtcttggtagaagcgcgtgcaaaagccattctggacttcctggatgccctgctagagctgtctgaagagcagcagtttgtggctgaggccctggagaaggggacccttcctctgttgaaggaccaggtgaaatctgtcatggagcagaactgggatgagctggccagcagtcctcctgacatggactatgaccctgaggcacgaattctctgtgcgctgtatgttgttgtctctatcctgctggagctggctgaggggcctacctctgtctcttcctaactacaaaagccctttctccccacaagcctctgggttttccctttaccagtctgtcctcactgccatcgccactaccatcctgtcaccagtgggacctctttaaaacaagcagccaaccattctttgatgtatcccattcgctccatgttaacatccaaaaccagcctggatttcatacatggacttctgattaaaagtggcaggttgtgcatgttaa

SEQ ID NO: 11928 - DNA, 1582 bp, Homo sapiens
acaactttcagtttcattattttagcttcctgagattcagaggccaggaactgtgcagagatctgtggggattctcacaacttccatttctggtgaacagctgaggtcagagaggagttggtccaggcgcaatgttcagcgtatttgaggaaatcacaagaattgtagttaaggagatggatgctggaggggatatgattgccgttagaagccttgttgatgctgatagattccgctgcttccatctggtgggggagaagagaactttctttggatgccggcactacacaacaggcctcaccctgatggacattctggacacagatggggacaagtggttagatgaactggattctgggctccaaggtcaaaaggctgagtttcaaattctggataatgtagactcaacgggagagttgatagtgagattacccaaagaaataacaatttcaggcagtttccagggcttccaccatcagaaaatcaagatatcggagaaccggatatcccagcagtatctggctacccttgaaaacaggaagctgaagagggaactacccttttcattccgatcaattaatacgagagaaaacctgtatctggtgacagaaactctggagacggtaaaggaggaaaccctgaaaagcgaccggcaatataaattttggagccagatctctcagggccatctcagctataaacacaagggccaaagggaagtgaccatccccccaaatcgggtcctgagctatcgagtaaagcagcttgtcttccccaacaaggagacgatgagtgctggtttagatattcatttcaggggcaaaacaaaatcctttccagaaggaaagtctttgggttcggaggattccagaaacatgaaggagaagttggaggacatggagagtgtcctcaaggacctgacagaggagaagagaaaagatgtgctaaactccctcgctaagtgcctcggcaaggaggatattcggcaggatctagagcaaagagtatctgaggtcctgatttccggggagctacacatggaggacccagacaagcctctcctaagcagcctttttaatgctgctggggtcttggtagaagcgcgtgcaaaagccattctggacttcctggatgccctgctagagctgtctgaagagcagcagtttgtggctgaggccctggagaaggggacccttcctctgttgaaggaccaggtgaaatctgtcatggagcagaactgggatgagctggccagcagtcctcctgacatggactatgaccctgaggcacgaattctctgtgcgctgtatgttgttgtctctatcctgctggagctggctgaggggcctacctctgtctcttcctaactacaaaagccctttctccccacaagcctctgggttttccctttaccagtctgtcctcactgccatcgccactaccatcctgtcaccagtgggacctctttaaaacaagcagccaaccattctttgatgtatcccattcgctccatgttaacatccaaaaccagcctggatttcatacatggacttctgattaaaagtggcaggttgtgcatgtt

SEQ ID NO: 11929 - DNA, 1597 bp, Homo sapiens
acaactttcagtttcattattttagcttcctgagattcagaggccaggaactgtgcagagatctgtggggattctcacaacttccatttctggtgaacagctgaggtcagagaggagttggtccaggcgcaatgttcagcgtatttgaggaaatcacaagaattgtagttaaggagatggatgctggaggggatatgattgccgttagaagccttgttgatgctgatagattccgctgcttccatctggtgggggagaagagaactttctttggatgccggcactacacaacaggcctcaccctgatggacattctggacacagatggggacaagtggttagatgaactggattctgggctccaaggtcaaaaggctgagtttcaaattctggataatgtagactcaacgggagagttgatagtgagattacccaaagaaataacaatttcaggcagtttccagggcttccaccatcagaaaatcaagatatcggagaaccggatatcccagcagtatctggctacccttgaaaacaggaagctgaagagggaactacccttttcattccgatcaattaatacgagagaaaacctgtatctggtgacagaaactctggagacggtaaaggaggaaaccctgaaaagcgaccggcaatataaattttggagccagatctctcagggccatctcagctataaacacaagggccaaagggaagtgaccatccccccaaatcgggtcctgagctatcgagtaaagcagcttgtcttccccaacaaggagacgatgaatattcatttcaggggcaaaacaaaatcctttccagaagagaaggatggtgcttcatcctgtttaggaaagtctttgggttcggaggattccagaaacatgaaggagaagttggaggacatggagagtgtcctcaaggacctgacagaggagaagagaaaagatgtgctaaactccctcgctaagtgcctcggcaaggaggatattcggcaggatctagagcaaagagtatctgaggtcctgatttccggggagctacacatggaggacccagacaagcctctcctaagcagcctttttaatgctgctggggtcttggtagaagcgcgtgcaaaagccattctggacttcctggatgccctgctagagctgtctgaagagcagcagtttgtggctgaggccctggagaaggggacccttcctctgttgaaggaccaggtgaaatctgtcatggagcagaactgggatgagctggccagcagtcctcctgacatggactatgaccctgaggcacgaattctctgtgcgctgtatgttgttgtctctatcctgctggagctggctgaggggcctacctctgtctcttcctaactacaaaagccctttctccccacaagcctctgggttttccctttaccagtctgtcctcactgccatcgccactaccatcctgtcaccagtgggacctctttaaaacaagcagccaaccattctttgatgtatcccattcgctccatgttaacatccaaaaccagcctggatttcatacatggacttctgattaaaagtggcaggttgtgcatgtt

SEQ ID NO: 11930 - DNA, 1263 bp, Homo sapiens
ggttagatgaactggattctgggctccaaggtcaaaaggctgagtttcaaattctggataatgtagactcaacgggagagttgatagtgagattacccaaagaaataacaatttcaggcagtttccagggcttccaccatcagaaaatcaagatatcggagaaccggatatcccagcagtatctggctacccttgaaaacaggaagctgaagagggaactacccttttcattccgatcaattaatacgagagaaaacctgtatctggtgacagaaactctggagacggtaaaggaggaaaccctgaaaagcgaccggcaatataaattttggagccagatctctcagggccatctcagctataaacacaagggccaaagggaagtgaccatccccccaaatcgggtcctgagctatcgagtaaagcagcttgtcttccccaacaaggagacgatgaatattcatttcaggggcaaaacaaaatcctttccagaagagaaggatggtgcttcatcctgtttaggaaagtctttgggttcggaggattccagaaacatgaaggagaagttggaggacatggagagtgtcctcaaggacctgacagaggagaagagaaaagatgtgctaaactccctcgctaagtgcctcggcaaggaggatattcggcaggatctagagcaaagagtatctgaggtcctgatttccggggagctacacatggaggacccagacaagcctctcctaagcagcctttttaatgctgctggggtcttggtagaagcgcgtgcaaaagccattctggacttcctggatgccctgctagagctgtctgaagagcagcagtttgtggctgaggccctggagaaggggacccttcctctgttgaaggaccaggtgaaatctgtcatggagcagaactgggatgagctggccagcagtcctcctgacatggactatgaccctgaggcacgaattctctgtgcgctgtatgttgttgtctctatcctgctggagctggctgaggggcctacctctgtctcttcctaactacaaaagccctttctccccacaagcctctgggttttccctttaccagtctgtcctcactgccatcgccactaccatcctgtcaccagtgggacctctttaaaacaagcagccaaccattctttgatgtatcccattcgctccatgttaacatccaaaaccagcctggatttcatacatggacttctgattaaaagtggcaggttgtgcatgttaa

SEQ ID NO: 11931 - DNA, 1546 bp, Homo sapiens
attattttagcttcctgagattcagaggccaggaactgtgcagagatctgtggggattctcacaacttccatttctggtgaacagctgaggtcagagaggaggcgcaatgttcagcgtatttgaggaaatcacaagaattgtagttaaggagatggatgctggaggggatatgattgccgttagaagccttgttgatgctgatagattccgctgcttccatctggtgggggagaagagaactttctttggatgccggcactacacaacaggcctcaccctgatggacattctggacacagatggggacaagtggttagatgaactggattctgggctccaaggtcaaaaggctgagtttcaaattctggataatgtagactcaacgggagagttgatagtgagattacccaaagaaataacaatttcaggcagtttccagggcttccaccatcagaaaatcaagatatcggagaaccggatatcccagcagtatctggctacccttgaaaacaggaagctgaagagggaactacccttttcattccgatcaattaatacgagagaaaacctgtatctggtgacagaaactctggagacggtaaaggaggaaaccctgaaaagcgaccggcaatataaattttggagccagatctctcagggccatctcagctataaacacaagggccaaagggaagtgaccatccccccaaatcgggtcctgagctatcgagtaaagcagcttgtcttccccaacaaggagacgatgaatattcatttcaggggcaaaacaaaatcctttccagaaggaaagtctttgggttcggaggattccagaaacatgaaggagaagttggaggacatggagagtgtcctcaaggacctgacagaggagaagagaaaagatgtgctaaactccctcgctaagtgcctcggcaaggaggatattcggcaggatctagagcaaagagtatctgaggtcctgatttccggggagctacacatggaggacccagacaagcctctcctaagcagcctttttaatgctgctggggtcttggtagaagcgcgtgcaaaagccattctggacttcctggatgccctgctagagctgtctgaagagcagcagtttgtggctgaggccctggagaaggggacccttcctctgttgaaggaccaggtgaaatctgtcatggagcagaactgggatgagctggccagcagtcctcctgacatggactatgaccctgaggcacgaattctctgtgcgctgtatgttgttgtctctatcctgctggagctggctgaggggcctacctctgtctcttcctaactacaaaagccctttctccccacaagcctctgggttttccctttaccagtctgtcctcactgccatcgccactaccatcctgtcaccagtgggacctctttaaaacaagcagccaaccattctttgatgtatcccattcgctccatgttaacatccaaaaccagcctggatttcatacatggacttctgattaaaagtggcaggttgtgcatgtt

SEQ ID NO: 11932 - DNA, 2714 bp, Homo sapiens
ccacatgtaggcagttcagaggtgcttcccagggccctggcgctagtgcctgtccctcctgctgaagttgcctttcctggtgtccagtgattgaattctaaattcagcacatataccagaggaatacgagccaaagaagttgttccagctagagttgctgggaatccatgaatcaaagacttgctcagctagttctgtatgtgaaaggaaatgggtgtgactctgaggaagcctttttaattctgattcaggagatacataattagatgccacttgattttgttccacagactttttgctgaggacttgagagctaaggttctgtgatccagaactagttccagacttactcttctggaaatgaacagggccctcctgtgcttatttttccaggatactgcattggaaattgagtcagggacccattggtgagaagagaacagtgaacagaatcacattgatctggtcctggagtttgtctgacaatttctacttgaccgcaggaggtctgaagattggaaggggccctactcaattgtgctatttttctctcttttttttttttttgagacggagttgcccaggctggagtgcagcggcatggtctcagctcactgcaacctctgcctcccgggttcaagcagttctctgcctcagcctcccaagtagctgggattacaggtgcctgccaccattcctggctaatttttgtattttcagtagagacagggtttcaccatcttggcctggctgatcttgaactcctgacctcgtgatccaccggcctcagcctcccaaagtgctgggattacagacgtgagccaccgtgcccggccaatcctgctatttctctacaggacaaagggatatataatctgcaacatgccctccatgttggaacgcattagcaaaaatttggtcaaagagattggaagcaaagacctgacacctgtcaaatacctattgagtgccaccaaattacgtcagtttgttatattacgaaagaagaaggattctcgttcatcattttgggaacaatctgactatgttccagttgaattctccctcaatgacatcctggagccaagttcttcagtcctagaaactgttgtgacaggaccgttccacttcagtgacattatgatccagaagcataaggctgacatgggtgtgaatgttggtatagaagtgagtgtgtcaggggaggcctctgtggaccatggatgctccctcgagtttcaaattgttaccatcccatcaccaaacctggaagactttcaaaaaaggaaactgttggatccagagccatcatttctgaaggagtgccggaggagaggggacaacctgtacgtggtgacagaggctgttgaactgatcaacaatactgtgctgtacgatagcagtagtgtgaatattttagggaaaattgctctttggattacctatggcaagggtcaaggccaaggagagagtctcagagtgaagaagaaggcgctgactcttcagaaaggcatggtgatggcttataagagaaagcagctggttatcaaggagaaagccattctcatctcagatgatgatgaacagagaacctttcaagatgagtacgaaatttccgaaatggtaggctactgtgctgcgaggagtgaggggttgctaccatcatttcataccatctctccaaccctcttcaatgcctcatccaatgatatgaagttaaaaccagagctatttctgacacagcaatttttgagcgggcatttgccaaaatacgaacaagttcacatcctcccagtaggaagaatagaggaacccttctggcaaaatttcaagcatctacaagaggaggttttccagaaaataaagacactggctcagctctcaaaggatgttcaggatgtcatgttctacagtatcctggccatgctcagagacagaggggctctacaggacctgatgaacatgctggaattggacagctcaggtcatttggatggccctggtggtgccatcctaaagaaacttcaacaggattcaaaccatgcatggtttaacccaaaggaccccattctttatctccttgaagccataatggtgctgagtgacttccaacacgatttgctggcctgttccatggagaagaggatcctgcttcagcaacaggagctggtaaggagcatcctggagccaaacttcagatacccctggagcattcccttcaccctcaaacctgagctcctcgccccactccagagtgagggtttggccatcacctatggcctgctggaggagtgtggccttaggatggagctggataaccccaggtcaacctgggatgtagaagcaaagatgcccctgtctgccctctatgggactctctcgttgctgcagcagctggctgaggcctaagccctccctgatgggcagtcagtccagagatgctggccctcgcccagtctatgctgtgagtgtccttatgggtgcaagagatagggctgtgcctctctgcgtttccaggtggagtagagacagtaatgggtagagactttaggaaatgttttggggtggtggaatactctatatattgacaagagtttatatattgacaagagtttatatatttgtcaaaactcctcaaatagtatgttaaagacgtaagcgtttcactatgtataaattttacttcaaaataataaaaacaaatactgactcta

SEQ ID NO: 11933 - DNA, 716 bp, Homo sapiens
agcaggctcagaaggtccagaaatcaggggaaggagacccctatctgtccttcttctggaagagctggaaaggaagtctgctcaggaaataaccttggaagatggtggccacgaagacctttgctctgctgctgctgtccctgttcctggcagtgggactaggagagaagaaagagggtcacttcagcgctctcccctccctgcctgttggatctcatgctaaggtgagcagccctcaacctcgaggccccaggtacgcggaagggactttcatcagtgactacagtattgccatggacaagattcaccaacaagactttgtgaactggctgctggcccaaaaggggaagaagaatgactggaaacacaacatcacccagagggaggctcgggcgctggagctggccagtcaagctaataggaaggaggaggaggcagtggagccacagagctccccagccaagaaccccagcgatgaagatttgctgcgggacttgctgattcaagagctgttggcctgcttgctggatcagacaaacctctgcaggctcaggtctcggtgactctgaccacacccagctcaggactggattctgcccttcacttagcacctgcctcagccccactccagaatagccaagagaacccaaaccaataaagtttatgctaagtcgagcccattgtgaaaatttattaaaatgactactgagcactaa

SEQ ID NO: 11934 - DNA, 2011 bp, Homo sapiens
ggcagcggtggcaggggctgcaggagcaagtgaccaggagcaggactggggacaggcctgatcgcccctgcacgaaccagacccttcgccgccctcacgatgactacctctccgatcctgcagctgctgctgcggctctcactgtgcgggctgctgctccagagggcggagacaggctctaaggggcagacggcgggggagctgtaccagcgctgggaacggtaccgcagggagtgccaggagaccttggcagccgcggaaccgccttcaggcctcgcctgtaacgggtccttcgatatgtacgtctgctgggactatgctgcacccaatgccactgcccgtgcgtcctgcccctggtacctgccctggcaccaccatgtggctgcaggtttcgtcctccgccagtgtggcagtgatggccaatggggactttggagagaccatacacaatgtgagaacccagagaagaatgaggcctttctggaccaaaggctcatcttggagcggttgcaggtcatgtacactgtcggctactccctgtctctcgccacactgctgctagccctgctcatcttgagtttgttcaggcggctacattgcactagaaactatatccacatcaacctgttcacgtctttcatgctgcgagctgcggccattctcagccgagaccgtctgctacctcgacctggcccctaccttggggaccaggcccttgcgctgtggaaccaggccctcgctgcctgccgcacggcccagatcgtgacccagtactgcgtgggtgccaactacacgtggctgctggtggagggcgtctacctgcacagtctcctggtgctcgtgggaggctccgaggagggccacttccgctactacctgctcctcggctggggggcccccgcgcttttcgtcattccctgggtgatcgtcaggtacctgtacgagaacacgcagtgctgggagcgcaacgaagtcaaggccatttggtggattatacggacccccatcctcatgaccatcttgattaatttcctcatttttatccgcattcttggcattctcctgtccaagctgaggacacggcaaatgcgctgccgggattaccggctgaggctggctcgctccacgctgacgctggtgcccctgctgggtgtccacgaggtggtgtttgctcccgtgacagaggaacaggcccggggcgccctgcgcttcgccaagctcggctttgagatcttcctcagctccttccagggcttcctggtcagcgtcctctactgcttcatcaacaaggaggtgcagtcggagatccgccgtggctggcaccactgccgcctgcgccgcagcctgggcgaggagcaacgccagctcccggagcgcgccttccgggccctgccctccggctccggcccgggcgaggtccccaccagccgcggcttgtcctcggggaccctcccagggcctgggaatgaggccagccgggagttggaaagttactgctagggggcgggatccccgtgtctgttcagttagcatggatttattgagtgccaactgcgtgccaggcccagtacggaggacgctggggaaatggtgaaggaaacagaaaaaaggtccctgcccttctggagatgacaactgagtggggaaaacagaccgtgaacacaaaacatcaagttccacacacgctatggaatggttatgaagggaagcgagaagggggcctagggtggtctgggaggcgtctccaaggaggtgacacttaagccatccccgaaagaggtgaaagagatcactttggggagagctggagaacaggattctaggcggaagcgatagcataggcaaaggcccttgggcaggaaggcgctcagccttggctggagtagaattaagtcagagccaacaggtggggagagacagagaagtgggcaggggcacccaagttgggatttcatttcaggtgcattggagattcttaggagtgtctcttgggggtaatattttatttttt

SEQ ID NO: 11935 - DNA, 1432 bp, Homo sapiens
ggggctgcaggagcaagtgaccaggagcaggactggggacaggcctgatcgcccctgcacgaaccagacccttcgccgccctcacgatgactacctctccgatcctgcagctgctgctgcggctctcactgtgcgggctgctgctccagagggcggagacaggctctaaggggcagacggcgggggagctgtaccagcgctgggaacggtaccgcagggagtgccaggagaccttggcagccgcggaaccgccttcagtggctgcaggtttcgtcctccgccagtgtggcagtgatggccaatggggactttggagagaccatacacaatgtgagaacccagagaagaatgaggcctttctggaccaaaggctcatcttggagcggttgcaggtcatgtacactgtcggctactccctgtctctcgccacactgctgctagccctgctcatcttgagtttgttcaggcggctacattgcactagaaactatatccacatcaacctgttcacgtctttcatgctgcgagctgcggccattctcagccgagaccgtctgctacctcgacctggcccctaccttggggaccaggcccttgcgctgtggaaccaggccctcgctgcctgccgcacggcccagatcgtgacccagtactgcgtgggtgccaactacacgtggctgctggtggagggcgtctacctgcacagtctcctggtgctcgtgggaggctccgaggagggccacttccgctactacctgctcctcggctggggggcccccgcgcttttcgtcattccctgggtgatcgtcaggtacctgtacgagaacacgcagtgctgggagcgcaacgaagtcaaggccatttggtggattatacggacccccatcctcatgaccatcttgattaatttcctcatttttatccgcattcttggcattctcctgtccaagctgaggacacggcaaatgcgctgccgggattaccggctgaggctggctcgctccacgctgacgctggtgcccctgctgggtgtccacgaggtggtgtttgctcccgtgacagaggaacaggcccggggcgccctgcgcttcgccaagctcggctttgagatcttcctcagctccttccagggcttcctggtcagcgtcctctactgcttcatcaacaaggaggtgcagtcggagatccgccgtggctggcaccactgccgcctgcgccgcagcctgggcgaggagcaacgccagctcccggagcgcgccttccgggccctgccctccggctccggcccgggcgaggtccccaccagccgcggcttgtcctcggggaccctcccagggcctgggaatgaggccagccgggagttggaaagttactgctagggggcgggatccccgtgtctgttcagttagcatggatttattgagtgccaact

SEQ ID NO: 11936 - DNA, 3289 bp, Homo sapiens
ggcagcggtggcaggggctgcaggagcaagtgaccaggagcaggactggggacaggcctgatcgcccctgcacgaaccagacccttcgccgccctcacgatgactacctctccgatcctgcagctgctgctgcggctctcactgtgcgggctgctgctccagagggcggagacaggctctaaggggcagacggcgggggagctgtaccagcgctgggaacggtaccgcagggagtgccaggagaccttggcagccgcggaaccgccttcaggcctcgcctgtaacgggtccttcgatatgtacgtctgctgggactatgctgcacccaatgccactgcccgtgcgtcctgcccctggtacctgccctggcaccaccatgtggctgcaggtttcgtcctccgccagtgtggcagtgatggccaatggggactttggagagaccatacacaatgtgagaacccagagaagaatgaggcctttctggaccaaaggctcatcttggagcggttgcaggtcatgtacactgtcggctactccctgtctctcgccacactgctgctagccctgctcatcttgagtttgttcaggcggctacattgcactagaaactatatccacatcaacctgttcacgtctttcatgctgcgagctgcggccattctcagccgagaccgtctgctacctcgacctggcccctaccttggggaccaggcccttgcgctgtggaaccaggccctcgctgcctgccgcacggcccagatcgtgacccagtactgcgtgggtgccaactacacgtggctgctggtggagggcgtctacctgcacagtctcctggtgctcgtgggaggctccgaggagggccacttccgctactacctgctcctcggctggggggcccccgcgcttttcgtcattccctgggtgatcgtcaggtacctgtacgagaacacgcagtgctgggagcgcaacgaagtcaaggccatttggtggattatacggacccccatcctcatgaccatcttgattaatttcctcatttttatccgcattcttggcattctcctgtccaagctgaggacacggcaaatgcgctgccgggattaccggctgaggctggctcgctccacgctgacgctggtgcccctgctgggtgtccacgaggtggtgtttgctcccgtgacagaggaacaggcccggggcgccctgcgcttcgccaagctcggctttgagatcttcctcagctccttccagggcttcctggtcagcgtcctctactgcttcatcaacaaggaggtgcagtcggagatccgccgtggctggcaccactgccgcctgcgccgcagcctgggcgaggagcaacgccagctcccggagcgcgccttccgggccctgccctccggctccggcccgggcgaggtccccaccagccgcggcttgtcctcggggaccctcccagggcctgggaatgaggccagccgggagttggaaagttactgctagggggcgggatccccgtgtctgttcagttagcatggatttattgagtgccaactgcgtgccaggcccagtacggaggacgctggggaaatggtgaaggaaacagaaaaaaggtccctgcccttctggagatgacaactgagtggggaaaacagaccgtgaacacaaaacatcaagttccacacacgctatggaatggttatgaagggaagcgagaagggggcctagggtggtctgggaggcgtctccaaggaggtgacacttaagccatccccgaaagaggtgaaagagatcactttggggagagctggagaacaggattctaggcggaagcgatagcataggcaaaggcccttgggcaggaaggcgctcagccttggctggagtagaattaagtcagagccaacaggtggggagagacagagaagtgggcaggggcacccaagttgggatttcatttcaggtgcattggagattcttaggagtgtctcttgggggtaatattttattttttaaaaaatgaggatgtcactcttacccaggttggtcttgaactcctgggctcaagcaatcctcccaccacgggtctctcaaagtgctgggattacaggcgtgagccaccgcacccggcttttttttttttttttaaacggagtctcactctgtcacccaggctggagtgcagtggtgcaatttcagctcactgcaccctccacctcccgagttcaagcctcccgggtagctgggattacaggcaccgccaccatgcctggctaatttttgcattttcagtagagatagggtttctccatgttggccaggctggtctcgaactcctgacctcaagtgatccacccacctcagcctcccaaagtgctgggattacaggcataagccaccatgcccggcccaaatgggctaatgttttaaacagatccttcttgtctgccctgtaggaggacaaattatcaggggcaggggtggaagctggagcccagaaaggaggggactgcaggtgggaagtgatggtggctggaccaggatggaggccactgaggggtatgaagcagtcggatttgaagctgtttaaaaggtggaggtgagaggatttcatgaaggagcacatgaggacacagcagcagagaggactccttggctttggatggtggagagactaaagatagagagattgggttcgggtagggggagaaccacgtgtgctctttggaaaggttaggctggcagtgtttgtaggacatgacaggacactgagtgtaagggtctggagctctcaggagaggggcgagctggagatagtaatgtgagaggcactgggtcctgagagggtgatttggtgtggaccggagcacaggtgaggcaaggcaggcctcgcagctgaaactttatatccagagcagccagggccactgctggctgcggagtgaggacgcatatccccactgtccttagatgggtggcccctggaacctgggagaatgagggggcatgctgacagtctcattgtggctggaccacctgtacatacacccacaagaccctcacccctaaatcctccccctacacatatgcacacttaagttaccgtatgggtgttgtcgagcattttccctggggtctgtggctccctggaccgacatgccccaaagctgaactcagccttttcaagcttgcggccctgctgcccaattcccctacaccctgccttgtgggttctcgcggggtgggggccttagggcaaggctcttgtaaataaagtataagaaacagttgc

SEQ ID NO: 11937 - DNA, 1518 bp, Homo sapiens
ttgcaaatcgcggtacctgtggatgagagacatagacgagagagtgagatggcctggtttgccctctacctcctgagccttctctgggctacagctgggactagtacccagacccagagttcatgctccgttccctcagcacaggagcccttggtcaatggaatacaagtactcatggagaactcggtgacttcatcagcctacccaaaccccagcatcctgattgccatgaatctggccggagcctacaacttgaaggcccagaagctcctgacttaccagctcatgtccagcgacaacaacgatctaaccattgggcagctcggcctcaccatcatggccctcacctcctcctgccgagaccctggggataaagtatccattctacaaagacaaatggagaactgggcaccttccagccccaacgctgaagcatcagccttctatgggcccagtctagcgatcttggcactgtgccagaagaactctgaggcgaccttgccgatagccgtccgctttgccaagaccctgctggccaactcctctcccttcaatgtagacacaggagcaatggcaaccttggctctgacctgtatgtacaacaagatccctgtaggttcagaggaaggttacagatccctgtttggtcaggtactaaaggatattgtggagaaaatcagcatgaagatcaaagataatggcatcattggagacatctacagtactggcctcgccatgcaggctctctctgtaacacctgagccatctaaaaaggaatggaactgcaagaagactacggatatgatactcaatgagattaagcaggggaaattccacaaccccatgtccattgctcaaatcctcccttccctgaaaggcaagacatacctagatgtgccccaggtcacttgtagtcctgatcatgaggtacaaccaactctacccagcaaccctggccctggccccacctctgcatctaacatcactgtcatatacaccataaataaccagctgaggggggttgagctgctcttcaacgagaccatcaatgttagtgtgaaaagtgggtcagtgttacttgttgtcctagaggaagcacagcgcaaaaatcctatgttcaaatttgaaaccacaatgacatcttggggccttgtcgtctcttctatcaacaatatcgcggaaaatgttaatcacaagacatactggcagtttcttagtggtgtaacacctttgaatgaaggggttgctgactacatacccttcaaccacgagcacatcacagccaatttcacacagtactaacgaagaggtgggttcagcttctatcaaacatctccaaaggatgggtgaaattttttccacttcattttaaatctatgcaaaaaagcgaatgcctgtgatgctaccatattcctggtaaaaacatggagaaccactatgtagaataaaaatgcaaagttcactggagtctcaacatctatgactcatgaaaataaaattttcatcttctcaacacaa

SEQ ID NO: 11938 - DNA, 1623 bp, Homo sapiens
gcaaatcgcggtacctgtggatgagagacatagacgagagagtgagatggcctggtttgccctctacctcctgagccttctctgggctacagctgggactagtacccagacccagagttcatgctgtgagtatgatgtttttccaaggaggtcagggaagcagttgccctggggaaggggctgtgacctctgacactgagtggttgaaaatagcaatcactataggaattccaaaatggccgttccctcagcacaggagcccttggtcaatggaatacaagtactcatggagaactcggtgacttcatcagcctacccaaaccccagcatcctgattgccatgaatctggccggagcctacaacttgaaggcccagaagctcctgacttaccagctcatgtccagcgacaacaacgatctaaccattgggcagctcggcctcaccatcatggccctcacctcctcctgccgagaccctggggataaagtatccattctacaaagacaaatggagaactgggcaccttccagccccaacgctgaagcatcagccttctatgggcccagtctagcgatcttggcactgtgccagaagaactctgaggcgaccttgccgatagccgtccgctttgccaagaccctgctggccaactcctctcccttcaatgtagacacaggagcaatggcaaccttggctctgacctgtatgtacaacaagatccctgtaggttcagaggaaggttacagatccctgtttggtcaggtactaaaggatattgtggagaaaatcagcatgaagatcaaagataatggcatcattggagacatctacagtactggcctcgccatgcaggctctctctgtaacacctgagccatctaaaaaggaatggaactgcaagaagactacggatatgatactcaatgagattaagcaggggaaattccacaaccccatgtccattgctcaaatcctcccttccctgaaaggcaagacatacctagatgtgccccaggtcacttgtagtcctgatcatgaggtacaaccaactctacccagcaaccctggccctggccccacctctgcatctaacatcactgtcatatacaccataaataaccagctgaggggggttgagctgctcttcaacgagaccatcaatgttagtgtgaaaagtgggtcagtgttacttgttgtcctagaggaagcacagcgcaaaaatcctatgttcaaatttgaaaccacaatgacatcttggggccttgtcgtctcttctatcaacaatatcgcggaaaatgttaatcacaagacatactggcagtttcttagtggtgtaacacctttgaatgaaggggttgctgactacatacccttcaaccacgagcacatcacagccaatttcacacagtactaacgaagaggtgggttcagcttctatcaaacatctccaaaggatgggtgaaattttttccacttcattttaaatctatgcaaaaaagcgaatgcctgtgatgctaccatattcctggtaaaaacatggagaaccactatgtagaataaaaatgcaaagttcactggagtctcaacatctatgactcatgaaaataaaattttcatcttctc

SEQ ID NO: 11939 - DNA, 470 bp, Homo sapiens
agagcagagacctgagaggcaccaggcccagccgtggcaccacacacctcccagctctgcagacgagatgcagcgactgtgtgtgtatgtgctgatctttgcactggctctggccgccttctctgaagcttcttggaagccccgctcccagcagccagatgcacccttaggtacaggggccaacagggacctggagctaccctggctggagcagcagggcccagcctctcatcatcgaaggcagctgggaccccagggtcccccacacctcgtggcagacccgtccaagaagcagggaccatggctggaggaagaagaagaagcctatggatggatggacttcggccgccgcagtgctgaggatgagaactaacaatcctagaaccaagcttcagagcctagccacctcccaccccactccagccctgtcccctgaaaaactgatcaaaaataaactagtttccagtgga

SEQ ID NO: 11940 - DNA, 848 bp, Homo sapiens
ccagcggctgcggcggcggagctcctccgaggtccgggtcaccagtctctgctcttcccagcctctccggcgcgctccaagggcttcccgtcgggaccatgcgcggccgtgagctcccgctggtcctgctggcgctggtcctctgcctggcgccccgggggcgagcggtcccgctgcctgcgggcggagggaccgtgctgaccaagatgtacccgcgcggcaaccactgggcggtggggcacttaatggggaaaaagagcacaggggagtcttcttctgtttctgagagagggagcctgaagcagcagctgagagagtacatcaggtgggaagaagctgcaaggaatttgctgggtctcatagaagcaaaggagaacagaaaccaccagccacctcaacccaaggccctgggcaatcagcagccttcgtgggattcagaggatagcagcaacttcaaagatgtaggttcaaaaggcaaagttggtagactctctgctccaggttctcaacgtgaaggaaggaacccccagctgaaccagcaatgataatgatggcctctctcaaaagagaaaaacaaaacccctaagagactgcgttctgcaagcatcagttctacggatcatcaacaagatttccttgtgcaaaatatttgactattctgtatctttcatccttgactaaattcgtgattttcaagcagcatcttctggtttaaacttgtttgctgtgaacaattgtcgaaaagagtcttccaattaatgcttttttatatctaggctacctgttggttagattcaaggccccgagctgttaccattcacaataaaagcttaaacacattgtccaaa

SEQ ID NO: 11941 - DNA, 579 bp, Homo sapiens
atgcgcggccgtgagctcccgctggtcctgctggcgctggtcctctgcctggcgccccgggggcgagcggtcccgctgcctgcgggcggagggaccgtgctgaccaagatgtacccgcgcggcaaccactgggcggtggggcacttaatggggaaaaagagcacaggggagtcttcttctgtttctgagagagggagcctgaagcagcagctgagagagtacatcaggtgggaagaagctgcaaggaatttgctgggtctcatagaagcaaaggagaacagaaaccaccagccacctcaacccaaggccctgggcaatcagcagccttcgtgggattcagaggatagcagcaacttcaaagatgtaggttcaaaaggcaaaggttctcaacgtgaaggaaggaacccccagctgaaccagcaatgataatgatggcctctctcaaaagagaaaaacaaaacccctaagagactgcgttctgcaagcatcagttctacggatcatcaacaagatttccttgtgcaaaatatttgactattctgtatctttcatccttgactaaattcgtgattttcaagc

SEQ ID NO: 11942 - DNA, 417 bp, Homo sapiens
atgcgcggccgtgagctcccgctggtcctgctggcgctggtcctctgcctggcgccccgggggcgagcggtcccgctgcctgcgggcggagggaccgtgctgaccaagatgtacccgcgcggcaaccactgggcggtggggcacttaatggggaaaaagagcacaggggagtcttcttctgtttctgagagagggagcctgaagcagcagctgagagagtacatcaggtgggaagaagctgcaaggaatttgctgggtctcatagaagcaaaggagaacagaaaccaccagccacctcaacccaaggccctgggcaatcagcagccttcgtgggattcagaggatagcagcaacttcaaagatttggtagactctctgctccaggttctcaacgtgaaggaaggaacccccagctga

SEQ ID NO: 11943 - DNA, 1929 bp, Homo sapiens
ccagattctaaatatcaggaaagacgctgtgggaaaatagcaggccaaaagttcttagtaaactgcagccagggagactcagactagaatggaggtagaaagaactgatgcagagtgggtttaattctaagcctttttgtggctaagttttgttgttgttaacttattgaatttagagttgtattgcactggtcatgtgaaagccagagcagcaccagtgtcaaaatagtgacagagagttttgaataccatagttagtatatatgtactcagagtatttttattaaagaaggcaaagagcccggcatagatcttatcttcatcttcactcggttgcaaaatcaatagttaagaaatagcatctaagggaacttttaggtgggaaaaaaaatctagagatggctctaaatgactgtttccttctgaacttggaggtggaccatttcatgcactgcaacatctccagtcacagtgcggatctccccgtgaacgatgactggtcccacccggggatcctctatgtcatccctgcagtttatggggttatcattctgataggcctcattggcaacatcactttgatcaagatcttctgtacagtcaagtccatgcgaaacgttccaaacctgttcatttccagtctggctttgggagacctgctcctcctaataacgtgtgctccagtggatgccagcaggtacctggctgacagatggctatttggcaggattggctgcaaactgatcccctttatacagcttacctctgttggggtgtctgtcttcacactcacggcgctctcggcagacagatacaaagccattgtccggccaatggatatccaggcctctcatgccctgatgaagatctgcctcaaagccgcctttatctggatcatctccatgctgctggccattccagaggccgtgttttctgacctccatcccttccatgaggaaagcaccaaccagaccttcattagctgtgccccatacccacactctaatgagcttcaccccaaaatccattctatggcttcctttctggtcttctacgtcattccactgtcgatcatctctgtttactactacttcattgctaaaaatctgatccagagtgcttacaatcttcccgtggaagggaatatacatgtcaagaagcagattgaatcccggaagcgacttgccaagacagtgctggtgtttgtgggcctgttcgccttctgctggctccccaatcatgtcatctacctgtaccgctcctaccactactctgaggtggacacctccatgctccactttgtcaccagcatctgtgcccgcctcctggccttcaccaactcctgcgtgaacccctttgccctctacctgctgagcaagagtttcaggaaacagttcaacactcagctgctctgttgccagcctggcctgatcatccggtctcacagcactggaaggagtacaacctgcatgacctccctcaagagtaccaacccctccgtggccacctttagcctcatcaatggaaacatctgtcacgagcggtatgtctagattgacccttgattttgccccctgagggacggttttgctttatggctagacaggaacccttgcatccattgttgtgtctgtgccctccaaagagccttcagaatgctcctgagtggtgtaggtgggggtggggaggcccaaatgatggatcaccattatattttgaaagaagccatcaagtcttaagtttttcatttcaacttgtgaacgtttcttctgatgtgaagcaaaccttcccttttcagaaaagggaacaagtagaaaattattttttaagcctcaagccctgttaaatggtcgtggccaattatgtcatagaaactgtatgaacaaccagatttacatagcagagaaatcatacattgaatgcttactt

SEQ ID NO: 11944 - DNA, 1225 bp, Homo sapiens
gggaacttttaggtgggaaaaaaaatctagagatggctctaaatgactgtttccttctgaacttggaggtggaccatttcatgcactgcaacatctccagtcacagtgcggatctccccgtgaacgatgactggtcccacccggggatcctctatgtcatccctgcagtttatggggttatcattctgataggcctcattggcaacatcactttgatcaagatcttctgtacagtcaagtccatgcgaaacgttccaaacctgttcatttccagtctggctttgggagacctgctcctcctaataacgtgtgctccagtggatgccagcaggtacctggctgacagatggctatttggcaggattggctgcaaactgatcccctttatacagcttacctctgttggggtgtctgtcttcacactcacggcgctctcggcagacagatacaaagccattgtccggccaatggatatccaggcctctcatgccctgatgaagatctgcctcaaagccgcctttatctggatcatctccatgctgctggccattccagaggccgtgttttctgacctccatcccttccatgaggaaagcaccaaccagaccttcattagctgtgccccatacccacactctaatgagcttcaccccaaaatccattctatggcttcctttctggtcttctacgtcattccactgtcgatcatctctgtttactactacttcattgctaaaaatctgatccagagtgcttacaatcttcccgtggaagggaatatacatgtcaagaagcagattgaatcccggaagcgacttgccaagacagtgctggtgtttgtgggcctgttcgccttctgctggctccccaatcatgtcatctacctgtaccgctcctaccactactctgaggtggacacctccatgctccactttgtcaccagcatctgtgcccgcctcctggccttcaccaactcctgcgtgaacccctttgccctctacctgctgagcgagtttcaggaaacagttcaacactcagctgctctgttgccagcctggcctgatcatccggtctcacagcactggaaggagtacaacctgcatgacctccctcaagagtaccaacccctccgtggccacctttagcctcatcaatggaaacatctgtcacgagcggtatgtctagattgacccttgattttgccccctgagggacggttttgctt

SEQ ID NO: 11945 - DNA, 814 bp, Homo sapiens
ataacacctagtttgagtcaacctggttaagtacaaatatgagaaggcttctcattcaggtccatgcttgcctactcctctgtccactgctttcgtgaagacaagatgaagttcacaattgtctttgctggacttcttggagtctttctagctcctgccctagctaactataatatcaacgtcaatgatgacaacaacaatgctggaagtgggcagcagtcagtgagtgtcaacaatgaacacaatgtggccaatgttgacaataacaacggatgggactcctggaattccatctgggattatggaaatggctttgctgcaaccagactctttcaaaagaagacatgcattgtgcacaaaatgaacaaggaagtcatgccctccattcaatcccttgatgcactggtcaaggaaaagaagcttcagggtaagggaccaggaggaccacctcccaagggcctgatgtactcagtcaacccaaacaaagtcgatgacctgagcaagttcggaaaaaacattgcaaacatgtgtcgtgggattccaacatacatggctgaggagatgcaagaggcaagcctgtttttttactcaggaacgtgctacacgaccagtgtactatggattgtggacatttccttctgtggagacacggtggagaactaaacaattttttaaagccactatggatttagtcatctgaatatgctgtgcagaaaaaatatgggctccagtggtttttaccatgtcattctgaaatttttctctactagttatgtttgatttctttaagtttcaataaaatcatttagcattg

SEQ ID NO: 11946 - DNA, 1092 bp, Homo sapiens
atgcagcgggccggaggcggtagcgcccctgggggcaacggcgggggcggcggcgggggcccgggcactgccttctccatcgactccctaatcgggccgccgccgccgcgctccggccacttgctgtacaccggctaccccatgttcatgccctaccggccgctcgtgctgccgcaggcgctggcccctgcgccgctgcccgctggcctcccgcccctcgccccgctagcctctttcgccggccgccttaccaacaccttctgcgcggggctgggtcaggctgtgccctcgatggtggcgctgaccaccgcgctgcccagcttcgcggagccgcccgacgctttctacgggccccaggagctcgccgccgccgctgccgccgccgccgccactgccgcccgaaacaaccccgagccaggcggccgacgcccagagggtgggctggaagctgatgagctgctgccggcccgggagaaagtggcagagcccccaccacctccgcctccgcacttctcagagacttttccaagtctgcccgcagaggggaaggtgtacagctcagatgaggagaagctggaggcatcagcaggagacccagcaggcagcgaacaggaggaagagggctcaggcggtgacagcgaggatgacggtttcctggacagttctgcagggggcccaggggctcttctgggacctaaaccgaagctaaagggaagcctggggactggagctgaggagggggcaccggtgacagcaggggtcacagctcctggggggaaaagccgacggcgccgcacagcatttaccagcgagcagcttttggaattggagaaggaatttcattgcaagaaatacctgagcttgacagagcgctctcagatcgcccacgccctcaagctcagtgaggtgcaggtcaagatctggtttcagaatcgacgggccaagtggaagcgcatcaaagctggcaatgtgagcagccgttctggggagcccgtaagaaaccccaagattgttgtccccatacctgtgcatgtcaacaggtttgctgtgcggagccagcaccaacaaatggagcagggggcccggccctga

SEQ ID NO: 11947 - DNA, 2123 bp, Homo sapiens
ccgccggagataagtacgccggcttcgcgcgctccccagcggcccgcgggaggcgacggacggcgggacggacggacggacggcagcttaccggggccgagggccaaacccgcgaagcgcgcgggctccgacgggcaagcggcggacgggggctccggcgagccctcggggcccgggcgccctctccactccggggcgcacggcctcaccccgcacaccccctgcacccgcccggcatgcagcgggcccaggactgaggggcggaggcgtctgctctccgggtcccgctcggcccctgcccggcgctcccggcggtgctcccggcgtccggcgggcttcccggcggcggcgcggcgcggggacttttcgcctctcgctggcctctaccgagcgcgtctatgagcgcagcgttcccgccgtcgctgatgatgatgcagcgcccgctggggagtagcaccgccttcagcatagactcgctgatcggcagcccgccgcagcccagccccggccatttcgtctacaccggctaccccatgttcatgccctaccggccggtagtgctgccgccgccgccgccgccgccgcccgcgctgccccaggccgcgctgcagccagcgctgccgcccgcacaccctcaccaccagatccccagcctgcccacaggcttctgctccagcctggcgcagggcatggcgctcacctctacgctcatggccacgctccccggcggcttctccgcgtcgccccagcaccaggaggcggcagcggcccgcaagttcgcgccgcagccgctgcccggcggcggtaacttcgacaaggcggaggcgctgcaggctgacgcggaggacggcaaaggcttcctggccaaagagggctcgctgctcgccttctccgcggccgagacggtgcaggcttcgctcgtcggggctgtccgagggcaagggaaagacgagtcaaaggtggaagacgacccgaagggcaaggaggagagcttctcgctggagagcgatgtggactacagctcggatgacaatctgactggccaggcagctcacaaggaggaagacccgggccacgcgctggaggagaccccgccgagcagcggcgccgcgggcagcaccacgtctacgggcaagaaccggcggcggcggactgccttcaccagcgagcagctgctggagctagagaaggagttccactgcaaaaagtacctctccttgaccgagcgctcgcagatcgcccacgccctcaaactcagcgaggtgcaggtgaaaatctggttccagaaccgacgggccaagtggaaacgggtgaaggcaggcaatgccaattccaagacaggggagccctcccggaaccctaagatcgtcgtccccatccctgtccacgtcagcaggttcgctatcagaagtcagcatcagcagctagaacaggcccggccctgagggtccagaagggccagggcctggcacccacctggagaagcccccgcacccgagggaacccatggtggactccactgtgtttgaagcaacaaagtcacagcccagctgtggccatcccaagcaaattgagaatatattcactaaatgggcttaaaagactgcttttgaaggggcttacagccacaccagaagacacgctaaatatttattatactatcctactttgtacataaatatctctatagactggatctcagctgcagtattttgaaagttataggacttaattacccagtaatttctccactcattccagaagaaaacaaaacctctgctgtaatctgcgcggttagcagccacctttccatacttttccaaaggtaaacgtgaaacccaagaacaagcactggggtttaaactgattttggtttgcgttctggctttttgagttgactgaaaagcagacattgttaggcagcctggaaattcgctttgctttgctttgcttttgcctggctttggtttcccctggggttgcctatcctatctgagccatgtgaagcacgtctccgttgtgttaatttatttcaatgtagcttattttcttataagttatgacatttaaacaatttcagtcttgtgaataataaaaaggagagagggggggaaaaagaccaa

SEQ ID NO: 11948 - DNA, 3367 bp, Homo sapiens
gagcgccaggaaggtagcgaggccagcgtcgccccgggactcgctgctcaagtctgtctattgcctgccgccacatccatcctagcagggccccgtcgcccaccaggcggacaaaagcggtccgctgaacaccatgcggccgctcggcgtgccgcccaggctctgctggtgagcgccgccaccccgcgcccaggtcccgcgagcccgcctgccgcgcacctcgccctgctcccagctctactccaggccccgtccgcccgggggcgccgcccaccgcgcctcgctcgggccgttgccgtctgcacccagaccctgagccgccgccgccggccatggaggtggcgcccgagcagccgcgctggatggcgcacccggccgtgctgaatgcgcagcaccccgactcacaccacccgggcctggcgcacaactacatggaacccgcgcagctgctgcctccagacgaggtggacgtcttcttcaatcacctcgactcgcagggcaacccctactatgccaaccccgctcacgcgcgggcgcgcgtctcctacagccccgcgcacgcccgcctgaccggaggccagatgtgccgcccacacttgttgcacagcccgggtttgccctggctggacgggggcaaagcagccctctctgccgctgcggcccaccaccacaacccctggaccgtgagccccttctccaagacgccactgcacccctcagctgctggaggccctggaggcccactctctgtgtacccaggggctgggggtgggagcgggggaggcagcgggagctcagtggcctccctcacccctacagcagcccactctggctcccaccttttcggcttcccacccacgccacccaaagaagtgtctcctgaccctagcaccacgggggctgcgtctccagcctcatcttccgcggggggtagtgcagcccgaggagaggacaaggacggcgtcaagtaccaggtgtcactgacggagagcatgaagatggaaagtggcagtcccctgcgcccaggcctagctactatgggcacccagcctgctacacaccaccccatccccacctacccctcctatgtgccggcggctgcccacgactacagcagcggactcttccaccccggaggcttcctggggggaccggcctccagcttcacccctaagcagcgcagcaaggctcgttcctgttcagaaggccgggagtgtgtcaactgtggggccacagccacccctctctggcggcgggacggcaccggccactacctgtgcaatgcctgtggcctctaccacaagatgaatgggcagaaccgaccactcatcaagcccaagcgaagactgtcggccgccagaagagccggcacctgttgtgcaaattgtcagacgacaaccaccaccttatggcgccgaaacgccaacggggaccctgtctgcaacgcctgtggcctctactacaagctgcacaatgttaacaggccactgaccatgaagaaggaagggatccagactcggaaccggaagatgtccaacaagtccaagaagagcaagaaaggggcggagtgcttcgaggagctgtcaaagtgcatgcaggagaagtcatcccccttcagtgcagctgccctggctggacacatggcacctgtgggccacctcccgcccttcagccactccggacacatcctgcccactccgacgcccatccacccctcctccagcctctccttcggccacccccacccgtccagcatggtgaccgccatgggctagggaacagatggacgtcgaggaccgggcactcccgggatgggtggaccaaacccttagcagcccagcatttcccgaaggccgacaccactcctgccagcccggctcggcccagcaccccctctcctggagggcgcccagcagcctgccagcagttactgtgaatgttccccaccgctgagaggctgcctccgcacctgaccgctgcccaggtggggtttcctgcatggacagttgtttggagaacaacaaggacaactttatgtagagaaaaggaggggacgggacagacgaaggcaaccatttttagaaggaaaaaggattaggcaaaaataatttattttgctcttgtttctaacaaggacttggagacttggtggtctgagctgtcccaagtcctccggttcttcctcgggattggcgggtccacttgccagggctctgggggcagatttgtggggacctcagcctgcaccctcttctcctctggcttccctctctgaaatagccgaactccaggctgggctgagccaaagccagagtggccacggcccagggagggtgagctggtgcctgctttgacgggccaggccctggagggcagagacaatcacgggcggtcctgcacagattcccaggccagggctgggtcacaggaaggaaacaacattttcttgaaaggggaaacgtctcccagatcgctcccttggctttgaggccgaagctgctgtgactgtgtccccttactgagcgcaagccacagcctgtcttgtcaggtggaccctgtaaatacatcctttttctgctaacccttcaaccccctcgcctcctactctgagacaaaagaaaaaatattaaaaaaatgcataggcttaactcgctgatgagttaattgttttatttttaaactctttttgggtccagttgattgtacgtagccacaggagccctgctatgaaaggaataaaacctacacacaaggttggagctttgcaattctttttggaaaagagctgggatcccacagccctagtatgaaagctgggggtggggaggggcctttgctgcccttggtttctgggggctggttggcatttgctggcctggcagggggtgaaggcaggagttgggggcaggtcaggaccaggacccagggagaggctgtgtccctgctggggtctcaggtccagctttactgtggctgtctggatccttcccaaggtacagctgtatataaacgtgtcccgagcttagattctgtatgcggtgacggcggggtgtggtggcctgtgaggggcccctggcccaggaggaggattgtgctgatgtagtgaccaagtgcaatatgggcgggcagtcgctgcagggagcaccacggccagaagtaacttattttgtactagtgtccgcataagaaaaagaatcggcagtattttctgtttttatgttttatttggcttgttttattttggattagtgaactaagttattgttaattatgtacaacatttatatattgtctgtaaaaaatgtatgctatcctcttattcctttaaagtgagtactgttaagaataataaaatactttttgtgaa

SEQ ID NO: 11949 - DNA, 2525 bp, Homo sapiens
ggcagctggcgccagggcggccggaggatgccgaggggccggagccgggagggcccgaggccgaggcgcactctacccccagctcctaccctgtaagccccgccagcctccggacgtgctgtccctgggcccgtcgccctcggggctcccgccggaactccttcactctcagaggccgagtccctcccctccccacggctgcgtgtggccgttgccgtctgcacccagaccctgagccgccgccgccggccatggaggtggcgcccgagcagccgcgctggatggcgcacccggccgtgctgaatgcgcagcaccccgactcacaccacccgggcctggcgcacaactacatggaacccgcgcagctgctgcctccagacgaggtggacgtcttcttcaatcacctcgactcgcagggcaacccctactatgccaaccccgctcacgcgcgggcgcgcgtctcctacagccccgcgcacgcccgcctgaccggaggccagatgtgccgcccacacttgttgcacagcccgggtttgccctggctggacgggggcaaagcagccctctctgccgctgcggcccaccaccacaacccctggaccgtgagccccttctccaagacgccactgcacccctcagctgctggaggccctggaggcccactctctgtgtacccaggggctgggggtgggagcgggggaggcagcgggagctcagtggcctccctcacccctacagcagcccactctggctcccaccttttcggcttcccacccacgccacccaaagaagtgtctcctgaccctagcaccacgggggctgcgtctccagcctcatcttccgcggggggtagtgcagcccgaggagaggacaaggacggcgtcaagtaccaggtgtcactgacggagagcatgaagatggaaagtggcagtcccctgcgcccaggcctagctactatgggcacccagcctgctacacaccaccccatccccacctacccctcctatgtgccggcggctgcccacgactacagcagcggactcttccaccccggaggcttcctggggggaccggcctccagcttcacccctaagcagcgcagcaaggctcgttcctgttcagaaggccgggagtgtgtcaactgtggggccacagccacccctctctggcggcgggacggcaccggccactacctgtgcaatgcctgtggcctctaccacaagatgaatgggcagaaccgaccactcatcaagcccaagcgaagactgacgacaaccaccaccttatggcgccgaaacgccaacggggaccctgtctgcaacgcctgtggcctctactacaagctgcacaatgttaacaggccactgaccatgaagaaggaagggatccagactcggaaccggaagatgtccaacaagtccaagaagagcaagaaaggggcggagtgcttcgaggagctgtcaaagtgcatgcaggagaagtcatcccccttcagtgcagctgccctggctggacacatggcacctgtgggccacctcccgcccttcagccactccggacacatcctgcccactccgacgcccatccacccctcctccagcctctccttcggccacccccacccgtccagcatggtgaccgccatgggctagggaacagatggacgtcgaggaccgggcactcccgggatgggtggaccaaacccttagcagcccagcatttcccgaaggccgacaccactcctgccagcccggctcggcccagcaccccctctcctggagggcgcccagcagcctgccagcagttactgtgaatgttccccaccgctgagaggctgcctccgcacctgaccgctgcccaggtggggtttcctgcatggacagttgtttggagaacaacaaggacaactttatgtagagaaaaggaggggacgggacagacgaaggcaaccatttttagaaggaaaaaggattaggcaaaaataatttattttgctcttgtttctaacaaggacttggagacttggtggtctgagctgtcccaagtcctccggttcttcctcgggattggcgggtccacttgccagggctctgggggcagatttgtggggacctcagcctgcaccctcttctcctctggcttccctctctgaaatagccgaactccaggctgggctgagccaaagccagagtggccacggcccagggagggtgagctggtgcctgctttgacgggccaggccctggagggcagagacaatcacgggcggtcctgcacagattcccaggccagggctgggtcacaggaaggaaacaacattttcttgaaaggggaaacgtctcccagatcgctcccttggctttgaggccgaagctgctgtgactgtgtccccttactgagcgcaagccacagcctgtcttgtcaggtggaccctgtaaatacatcctttttctgctaacccttcaaccccctcgcctcctactctgagacaaaagaaaaaatattaaaaaaatgcataggcttaa

SEQ ID NO: 11950 - DNA, 1878 bp, Homo sapiens
actgggtcaagcacagccctgagcggccgcgtgtccgaggcccaggtgccctctagagccctgtagttcctgcccctctctgcccctctcggctcctgctgttccgccgctgtcgtccgaaccatcccaacccccagtccacccagacagcgcccgagctaggggagggaacggtctgggagtcggcagctggcgccagggcggccggaggatgccgaggggccggagccgggagggcccgaggccgaggcgcactctacccccagctcctaccctgtaagccccgccagcctccggacgtgctgtccctgggcccgtcgccctcggggctcccgccggaactccttcactctcagaggccgagtccctcccctccccacggctgcgtgtggccgttgccgtctgcacccagaccctgagccgccgccgccggccatggaggtggcgcccgagcagccgcgctggatggcgcacccggccgtgctgaatgcgcagcaccccgactcacaccacccgggcctggcgcacaactacatggaacccgcgcagctgctgcctccagacgaggtggacgtcttcttcaatcacctcgactcgcagggcaacccctactatgccaaccccgctcacgcgcgggcgcgcgtctcctacagccccgcgcacgcccgcctgaccggaggccagatgtgccgcccacacttgttgcacagcccgggtttgccctggctggacgggggcaaagcagccctctctgccgctgcggcccaccaccacaacccctggaccgtgagccccttctccaagacgccactgcacccctcagctgctggaggccctggaggcccactctctgtgtacccaggggctgggggtgggagcgggggaggcagcgggagctcagtggcctccctcacccctacagcagcccactctggctcccaccttttcggcttcccacccacgccacccaaagaagtgtctcctgaccctagcaccacgggggctgcgtctccagcctcatcttccgcggggggtagtgcagcccgaggagaggacaaggacggcgtcaagtaccaggtgtcactgacggagagcatgaagatggaaagtggcagtcccctgcgcccaggcctagctactatgggcacccagcctgctacacaccaccccatccccacctacccctcctatgtgccggcggctgcccacgactacagcagcggactcttccaccccggaggcttcctggggggaccggcctccagcttcacccctaagcagcgcagcaaggctcgttcctgttcagaaggccgggagtgtgtcaactgtggggccacagccacccctctctggcggcgggacggcaccggccactacctgtgcaatgcctgtggcctctaccacaagatgaatgggcagaaccgaccactcatcaagcccaagcgaagactgtcggccgccagaagagccggcacctgttgtgcaaattgtcagacgacaaccaccaccttatggcgccgaaacgccaacggggaccctgtctgcaacgcctgtggcctctactacaagctgcacaatgttaacaggccactgaccatgaagaaggaagggatccagactcggaaccggaagatgtccaacaagtccaagaagagcaagaaaggggcggagtgcttcgaggagctgtcaaagtgcatgcaggagaagtcatcccccttcagtgcagctgccctggctggacacatggcacctgtgggccacctcccgcccttcagccactccggacacatcctgcccactccgacgcccatccacccctcctccagcctctccttcggccacccccacccgtccagcatggtgaccgccatgggctag

SEQ ID NO: 11951 - DNA, 844 bp, Homo sapiens
gtcgagcgcgggtccctctttattggccagctgggcgccctgctacttggcgtcgcatttctctctcccaggcgggttcgtttccgccagagaatgcagcagtcccgcatcctacgcaggacctgcaaccgaggtggaggcttcggtcaagccggctcctgcctgcgttgtcgaggaaggcaaccccaaggcctgaaaggacctggcagaactcctgtttcctttttttcctctacaccggattgcgggcaaggaggctggttcgggtctcccgaggcccctgctcaagcactccttaaccgtcctgctaagcccctctgtgcggcgattttctgagctgccgagcgggggccgttgccgtctgcacccagaccctgagccgccgccgccggccatggaggtggcgcccgagcagccgcgctggatggcgcacccggccgtgctgaatgcgcagcaccccgactcacaccacccgggcctggcgcacaactacatggaacccgcgcagctgctgcctccagacgaggtggacgtcttcttcaatcacctcgactcgcagggcaacccctactatgccaaccccgctcacgcgcgggcgcgcgtctcctacagccccgcgcacgcccgcctgaccggaggccagatgtgccgcccacacttgttgcacagcccgggtttgccctggctggacgggggcaaagcagccctctctgccgctgcggcccaccaccacaacccctggaccgtgagccccttctccaagacgccactgcacccctcagctgctggaggccctggaggcccactctctgtgtacccaggggctgggggtgggagcggggga

SEQ ID NO: 11952 - DNA, 563 bp, Homo sapiens
ggtagcgaggccagcgtcgccccgggactcgctgctcaagtctgtctattgcctgccgccacatccatcctagcagggccccgtcgcccaccaggcggacaaaagcggtccgctgaacaccatgcggccgctcggcgtgccgcccaggctctgctggtgagcgccgccaccccgcgcccaggtcccgcgagcccgcctgccgcgcacctcgccctgctcccagctctactccaggccccgtccgcccgggggcgccgcccaccgcgcctcgctcggcttgaactccgcgttgctccaaccacgaggggaaaggccccgcgttcagggaccccgtgtgtggcgaacgctcctttaccggaaaacaaggaaggaaattcgttgttttggaaaaagcctcctctcccgaggtcgggaacatctggtggtgagctccaggtctacgcaggcaccccgtgctaggattcgtttatgagcaggcaggattcgagaaccagggccgttgccgtctgcacccagaccctgagccgccgccgccggccatggaggtggcgcccgagcagccg

SEQ ID NO: 11953 - DNA, 1865 bp, Homo sapiens
ggaccttcaggccctggggtgaattcagctgctcctacatcagcttccggaaccaccaaaaattcaaattgggattttccggagtaaacaagagcctagagccctttgctcaatgctggatttaatacgtatatatttttaagcgagttggttttttcccctttgatttttgatcttcgcgacagttcctcccacgcatattatcgttgttgccgtcgttttctctccccgcgtggctccttgacctgcgagggagagagaggacaccgaagccgggagctcgcagggaccatgtatcagagcttgccatggccgccaaccacgggccgccccccggtgcctacgaggcgggcggccccggcgccttcatgcacggcgcgggcgccgcgtcctcgccagtctacgtgcccacaccgcggtgccctcctccgtgctgggcctgtcctacctccagggcggaggcgcgggctctgcgtccggagggcctcgggcggcagctccggtggggccgcgtctggtgcggggcccgggacccagcagggcagcccgggatggagccaggcgggagccgacggagccgcttacaccccgccgccggtgtcgccgcgcttctccttcccggggaccaccgggtccctggcggccgccgccgccgctgccgcggcccgggaagctgcggcctacagcagtggcggcggagcggcgggtgcgggcctggcgggccgcgagcagtacgggcgcgccggcttcgcgggctcctactccagcccctacccggcttacatggccgacgtgggcgcgtcctgggccgcagccgccgccgcctccgccggccccttcgacagcccggtcctgcacagcctgcccggccgggccaacccggccgcccgacaccccaatctcgatatgtttgacgacttctcagaaggcagagagtgtgtcaactgtggggctatgtccaccccgctctggaggcgagatgggacgggtcactatctgtgcaacgcctgcggcctctaccacaagatgaacggcatcaaccggccgctcatcaagcctcagcgccggctgtccgcctcccgccgagtgggcctctcctgtgccaactgccagaccaccaccaccacgctgtggcgccgcaatgcggagggcgagcctgtgtgcaatgcctgcggcctctacatgaagctccacggggtccccaggcctcttgcaatgcggaaagaggggatccaaaccagaaaacggaagcccaagaacctgaataaatctaagacaccagcagctccttcaggcagtgagagccttcctcccgccagcggtgcttccagcaactccagcaacgccaccaccagcagcagcgaggagatgcgtcccatcaagacggagcctggcctgtcatctcactacgggcacagcagctccgtgtcccagacgttctcagtcagtgcgatgtctggccatgggccctccatccaccctgtcctctcggccctgaagctctccccacaaggctatgcgtctcccgtcagccagtctccacagaccagctccaagcaggactcttggaacagcctggtcttggccgacagtcacggggacataatcactgcgtaatcttccctcttccctcctcaaattcctgcacggacctgggacttggaggatagcaaagaaggaggccctgggctcccaggggccggcctcctctgcctggtaatgactccagaacaacaactgggaagaaacttgaagtcgacaatctggttaggggaagcgggtgttggattttctcagatgcctttacacgctgatgggactggagggagcccacccttcagcacgagcacactgcatctctcctg

SEQ ID NO: 11954 - DNA, 3414 bp, Homo sapiens
ggacttggaggcggccggcgcaggggccgcgagaggcttcgtcgccgctgcagctccgggggctcccaggggagcgtgcgcggaacctccaggcccagcaggaccccggctgcggcgaggaggaaggagccagcctagcagcttctgcgcctgtggccgcgggtgtcctggaggcctctcggtgtgacgagtgggggacccgaaggctcgtgcgccacctccaggcctggacgctgccctccgtcttctgcccccaataggtgcgccggaccttcaggccctggggtgaattcagctgctcctacatcagcttccggaaccaccaaaaattcaaattgggattttccggagtaaacaagagcctagagccctttgctcaatgctggatttaatacgtatatatttttaagcgagttggttttttcccctttgatttttgatcttcgcgacagttcctcccacgcatattatcgttgttgccgtcgttttctctccccgcgtggctccttgacctgcgagggagagagaggacaccgaagccgggagctcgcagggaccatgtatcagagcttggccatggccgccaaccacgggccgccccccggtgcctacgaggcgggcggccccggcgccttcatgcacggcgcgggcgccgcgtcctcgccagtctacgtgcccacaccgcgggtgccctcctccgtgctgggcctgtcctacctccagggcggaggcgcgggctctgcgtccggaggcgcctcgggcggcagctccggtggggccgcgtctggtgcggggcccgggacccagcagggcagcccgggatggagccaggcgggagccgacggagccgcttacaccccgccgccggtgtcgccgcgcttctccttcccggggaccaccgggtccctggcggccgccgccgccgctgccgcggcccgggaagctgcggcctacagcagtggcggcggagcggcgggtgcgggcctggcgggccgcgagcagtacgggcgcgccggcttcgcgggctcctactccagcccctacccggcttacatggccgacgtgggcgcgtcctgggccgcagccgccgccgcctccgccggccccttcgacagcccggtcctgcacagcctgcccggccgggccaacccggccgcccgacaccccaatctcgatatgtttgacgacttctcagaaggcagagagtgtgtcaactgtggggctatgtccaccccgctctggaggcgagatgggacgggtcactatctgtgcaacgcctgcggcctctaccacaagatgaacggcatcaaccggccgctcatcaagcctcagcgccggctgtccgcctcccgccgagtgggcctctcctgtgccaactgccagaccaccaccaccacgctgtggcgccgcaatgcggagggcgagcctgtgtgcaatgcctgcggcctctacatgaagctccacggggtccccaggcctcttgcaatgcggaaagaggggatccaaaccagaaaacggaagcccaagaacctgaataaatctaagacaccagcagctccttcaggcagtgagagccttcctcccgccagcggtgcttccagcaactccagcaacgccaccaccagcagcagcgaggagatgcgtcccatcaagacggagcctggcctgtcatctcactacgggcacagcagctccgtgtcccagacgttctcagtcagtgcgatgtctggccatgggccctccatccaccctgtcctctcggccctgaagctctccccacaaggctatgcgtctcccgtcagccagtctccacagaccagctccaagcaggactcttggaacagcctggtcttggccgacagtcacggggacataatcactgcgtaatcttccctcttccctcctcaaattcctgcacggacctgggacttggaggatagcaaagaaggaggccctgggctcccaggggccggcctcctctgcctggtaatgactccagaacaacaactgggaagaaacttgaagtcgacaatctggttaggggaagcgggtgttggattttctcagatgcctttacacgctgatgggactggagggagcccacccttcagcacgagcacactgcatctctcctgtgagttggagacttctttcccaagatgtccttgtcccctgcgttccccactgtggcctagaccgtgggttttgcattgtgtttctagcaccgaggatctgagaacaagcggagggccgggccctgggacccctgctccagcccgaatgacggcatctgtttgccatgtacctggatgcgacgggcccctggggacaggcccttgccccatccatccgcttgaggcatggcaccgccctgcatccctaataccaaatctgactccaaaattgtggggtgtgacatacaagtgactgaacacttcctggggagctacaggggcacttaacccaccacagcacagcctcatcaaaatgcagctggcaacttctcccccaggtgccttccccctgctgccggcctttgctccttcacttccaacatctctcaaaataaaaatccctcttcccgctctgagcgattcagctctgcccgcagcttgtacatgtctctcccctggcaaaacaagagctgggtagtttagccaaacggcaccccctcgagttcactgcagacccttcgttcaccgtgtcacacatagaggggttctgagtaagaacaaaacgttctgctgctcaagccagtctggcaagcactcagcccagcctcgaggtccttctggggagagtgtaagtggacagagtcctggtcagggggcaggagtgtcccaagggctggcccacctgctgtctgtctgctcctcctagcccttggtcagatggcagccagagtccctcaggacctgcagcctcgccccggcagaagtcttttgtccaggaggcaaaaagccagagattctgcaacacgaattcgaagcaaacaaacacaacacaacagaattcctggaaagaagacgactgctaagacacggcaggggggcctggagggagcctccgactctgagctgctccgggatctgccgcgttctcctctgcacattgctgtttctgcccctgatgctggagctcaaggagactccttcctctttctcagcagagctgtagctgactgtggcattactacgcctccccacacgcccagacccctcactccaaaatcctactggctgtagcagagaatacctttgaaccaagattctgttttaatcatcatttacattgttttcttccaaaggccccctcgtataccctccctaacccacaaacctgttaacattgtcttaaggtgaaatggctggaaaatcagtatttaactaataaatttatctgtattcctctttc

SEQ ID NO: 11955 - DNA, 686 bp, Homo sapiens
agtcagcgccctagggccgagttgctgggccggggacccgagccgcgagctggggacttggaggcggccggcgcaggggccgcgagaggcttcgtcgccgctgcagctccgggggctcccaggggagcgtgcgcggaacctccaggcccagcagtagatatgtttgacgacttctcagaaggcagagagtgtgtcaactgtggggctatgtccaccccgctctggaggcgagatgggacgggtcactatctgtgcaacgcctgcggcctctaccacaagatgaacggcatcaaccggccgctcatcaagcctcagcgccggctgtccgcctcccgccgagtgggcctctcctgtgccaactgccagaccaccaccaccacgctgtggcgccgcaatgcggagggcgagcctgtgtgcaatgcctgcggcctctacatgaagctccacggggtccccaggcctcttgcaatgcggaaagaggggatccaaaccagaaaacggaagcccaagaacctgaataaatctaagacaccagcagctccttcaggcagtgagagccttcctcccgccagcggtgcttccagcaactccagcaacgccaccaccagcagcagcgaggagatgcgtcccatcaagacggagcctggcctgtcatctcactacgggcacagcagctccgtgtccca

SEQ ID NO: 11956 - DNA, 1010 bp, Homo sapiens
cgcaggggccgcgagaggcttcgtcgccgctgcagctccgggggctcccaggggagcgtgcgcggaacctccaggcccagcagttatgaaagaaaaaaaattacattatcttgaagaactgcaggagttgagtattccagaaaatgcaatgaaataggtcagctacttgattttaaaagtcaaatactggatcttttattaaggaccccggctgcggcgaggaggaaggagccagcctagcagcttctgcgcctgtggccgcgggtgtcctggaggcctctcggtgtgacgagtgggggacccgaaggctcgtgcgccacctccaggcctggacgctgccctccgtcttctgcccccaataggtgcgccggaccttcaggccctggggtgaattcagctgctcctacatcagcttccggaaccaccaaaaattcaaattgggattttccggagtaaacaagagcctagagccctttgctcaatgctggatttaatacgtatatatttttaagcgagttggttttttcccctttgatttttgatcttcgcgacagttcctcccacgcatattatcgttgttgccgtcgttttctctccccgcgtggctccttgacctgcgagggagagagaggacaccgaagccgggagctcgcagggaccatgtatcagagcttggccatggccgccaaccacgggccgccccccggtgcctacgaggcgggcggccccggcgccttcatgcacggcgcgggcgccgcgtcctcgccagtctacgtgcccacaccgcgggtgccctcctccgtgctgggcctgtcctacctccagggcggaggcgcgggctctgcgtccggaggcgcctcgggcggcagctccggtggggccgcgtctggtgcggggcccgggacccagcagggcagcccgggatggagccaggcgggagccgacggagccgcttacaccccgccgccggtgtcgccgcgcttctccttcccggggaccaccgggtccct

SEQ ID NO: 11957 - DNA, 2614 bp, Homo sapiens
acaacgtctccctcccacccggctgagaacagcctggaatccctgtgcagagtttgcctcacaccaggccttgagcagccgcagggacgccgctccccaccgcggggacgcatcctgctctgcaccctggttctcggcgctgcgcccgcggaggctcgtgcagggcaggctgcccgtgcgggtgaggactgagtgccgcgcagggaaggagtatcgcagaccggcgcccaggcccagcgggggaatccaagggccgtgttgcaggactcggcattcgttctgcgcgggtcaccttgaatgtctgtccggatccctcgcggcagggccgcagaggcgcgtccatatcttggaggaattcgttccatagaatgagtagatatgtttgacgacttctcagaaggcagagagtgtgtcaactgtggggctatgtccaccccgctctggaggcgagatgggacgggtcactatctgtgcaacgcctgcggcctctaccacaagatgaacggcatcaaccggccgctcatcaagcctcagcgccggctgtccgcctcccgccgagtgggcctctcctgtgccaactgccagaccaccaccaccacgctgtggcgccgcaatgcggagggcgagcctgtgtgcaatgcctgcggcctctacatgaagctccacggggtccccaggcctcttgcaatgcggaaagaggggatccaaaccagaaaacggaagcccaagaacctgaataaatctaagacaccagcagctccttcaggcagtgagagccttcctcccgccagcggtgcttccagcaactccagcaacgccaccaccagcagcagcgaggagatgcgtcccatcaagacggagcctggcctgtcatctcactacgggcacagcagctccgtgtcccagacgttctcagtcagtgcgatgtctggccatgggccctccatccaccctgtcctctcggccctgaagctctccccacaaggctatgcgtctcccgtcagccagtctccacagaccagctccaagcaggactcttggaacagcctggtcttggccgacagtcacggggacataatcactgcgtaatcttccctcttccctcctcaaattcctgcacggacctgggacttggaggatagcaaagaaggaggccctgggctcccaggggccggcctcctctgcctggtaatgactccagaacaacaactgggaagaaacttgaagtcgacaatctggttaggggaagcgggtgttggattttctcagatgcctttacacgctgatgggactggagggagcccacccttcagcacgagcacactgcatctctcctgtgagttggagacttctttcccaagatgtccttgtcccctgcgttccccactgtggcctagaccgtgggttttgcattgtgtttctagcaccgaggatctgagaacaagcggagggccgggccctgggacccctgctccagcccgaatgacggcatctgtttgccatgtacctggatgcgacgggcccctggggacaggcccttgccccatccatccgcttgaggcatggcaccgccctgcatccctaataccaaatctgactccaaaattgtggggtgtgacatacaagtgactgaacacttcctggggagctacaggggcacttaacccaccacagcacagcctcatcaaaatgcagctggcaacttctcccccaggtgccttccccctgctgccggcctttgctccttcacttccaacatctctcaaaataaaaatccctcttcccgctctgagcgattcagctctgcccgcagcttgtacatgtctctcccctggcaaaacaagagctgggtagtttagccaaacggcaccccctcgagttcactgcagacccttcgttcaccgtgtcacacatagaggggttctgagtaagaacaaaacgttctgctgctcaagccagtctggcaagcactcagcccagcctcgaggtccttctggggagagtgtaagtggacagagtcctggtcagggggcaggagtgtcccaagggctggcccacctgctgtctgtctgctcctcctagcccttggtcagatggcagccagagtccctcaggacctgcagcctcgccccggcagaagtcttttgtccaggaggcaaaaagccagagattctgcaacacgaattcgaagcaaacaaacacaacacaacagaattcctggaaagaagacgactgctaagacacggcaggggggcctggagggagcctccgactctgagctgctccgggatctgccgcgttctcctctgcacattgctgtttctgcccctgatgctggagctcaaggagactccttcctctttctcagcagagctgtagctgactgtggcattactacgcctccccacacgcccagacccctcactccaaaatcctactggctgtagcagagaatacctttgaaccaagattctgttttaatcatcatttacattgttttcttccaaaggccccctcgtataccctccctaacccacaaacctgttaacattgtcttaaggtgaaatggctggaaaatcagtatttaactaataaatttatctgtattcctctt

SEQ ID NO: 11958 - DNA, 1459 bp, Homo sapiens
gccgtcgttttctctccccgcgtggctccttgacctgcgagggagagagaggacaccgaagccgggagctcgcagggaccatgtatcagagcttggccatggccgccaaccacgggccgccccccggtgcctacgaggcgggcggccccggcgccttcatgcacggcgcgggcgccgcgtcctcgccagtctacgtgcccacaccgcgggtgccctcctccgtgctgggcctgtcctacctccagggcggaggcgcgggctctgcgtccggaggcgcctcgggcggcagctccggtggggccgcgtctggtgcggggcccgggacccagcagggcagcccgggatggagccaggcgggagccgacggagccgcttacaccccgccgccggtgtcgccgcgcttctccttcccggggaccaccgggtccctggcggccgccgccgccgctgccgcggcccgggaagctgcggcctacagcagtggcggcggagcggcgggtgcgggcctggcgggccgcgagcagtacgggcgcgccggcttcgcgggctcctactccagcccctacccggcttacatggccgacgtgggcgcgtcctgggccgcagccgccgccgcctccgccggccccttcgacagcccggtcctgcacagcctgcccggccgggccaacccggccgcccgacaccccaatctcgtagatatgtttgacgacttctcagaaggcagagagtgtgtcaactgtggggctatgtccaccccgctctggaggcgagatgggacgggtcactatctgtgcaacgcctgcggcctctaccacaagatgaacggcatcaaccggccgctcatcaagcctcagcgccggctgtccgcctcccgccgagtgggcctctcctgtgccaactgccagaccaccaccaccacgctgtggcgccgcaatgcggagggcgagcctgtgtgcaatgcctgcggcctctacatgaagctccacggggtccccaggcctcttgcaatgcggaaagaggggatccaaaccagaaaacggaagcccaagaacctgaataaatctaagacaccagcagctccttcaggcagtgagagccttcctcccgccagcggtgcttccagcaactccagcaacgccaccaccagcagcagcgaggagatgcgtcccatcaagacggagcctggcctgtcatctcactacgggcacagcagctccgtgtcccagacgttctcagtcagtgcgatgtctggccatgggccctccatccaccctgtcctctcggccctgaagctctccccacaaggctatgcgtctcccgtcagccagtctccacagaccagctccaagcaggactcttggaacagcctggtcttggccgacagtcacggggacataatcactgcgtaatcttccctcttccctcctcaaattcctgcacggacctgggacttgga

SEQ ID NO: 11959 - DNA, 2595 bp, Homo sapiens
ccaccgccaccgccgtgccctgccgccctccctgcccgctggtcaagaccacgcctgggaggatgtaccagagcctggcgctggccgcgagcccccgccaggccgcctacgccgactcgggctccttcctgcacgctccgggcgccggctctccgatgtttgtgccgccggcgcgcgtcccctcgatgctgtcctacctgtccgggtgtgagccgagcccgcagccccccgagctcgctgcgcgccccggctgggcgcagacagccaccgcggattcgtcggccttcggcccgggcagtccgcaccccccagccgcgcacccgcccggggccaccgccttccctttcgcgcacagcccctcggggcccggcagcggcggcagcgcggggggccgagacggcagtgcctaccagggcgcgctgttgcctcgagaacagttcgcggccccgcttgggcggccggtggggacctcgtactccgccacctacccggcctacgtgagccccgacgtggcccagtcctggactgccgggcccttcgatggcagcgtcctgcacggcctcccaggccgcaggcccaccttcgtgtccgacttcttggaggagttcccgggtgagggtcgtgagtgtgtcaactgcggggccctgtccacaccgctgtggcgccgagacggcaccggccactacctgtgcaatgcctgcggcctctaccacaagatgaatggcgtcaaccggccgctcgttcggcctcagaagcgcctgtcctcgtcccgccgcgccggcctctgctgcaccaactgccacacgaccaacaccacgctgtggcggcggaactcggagggggagcccgtgtgcaatgcctgcggcctctacatgaagctgcacggggtgccgcggcctctggctatgaagaaggaaagcatccagacacggaagcggaagccaaagaccatcgccaaggccaggggctcctcaggatccacaaggaatgcctcggcctccccatctgctgtcgccagcactgacagctcagcagccacttcgaaagccaagcccagcctggcgtccccagtgtgccctgggcccagcatggccccccaggcctctggccaggaggatgactctcttgcccccggccacttggagttcaagttcgagcctgaggactttgccttcccctccacggccccaagcccccaggctggcctcaggggggctctgcgccaagaggcctggtgtgcgctggccttggcctaggtccccaggccagcccatgtcaggggaacagcctggaacagaccacccactgagtcacctccgtgcctgctttgctccagcacagcagagaccagcaggccccccaacccagagactgggtctgctggagtctccacacagtggtggggaggccttctggacagacggcagtcgggccccagagcaagaaggctggtgagggaagggctcagcttcccaccccacgtacagcaagggactccccaggtgcggcccaaggctccggaccacactggccccctgcggcggaggccaacgcagggcaccaccaccaccaacttgaattccgtcatcaatgctcaccgtcaatatgtttacaagttgtagcagttgggggaaaacagtcaacctcccagtgtaaaaccaagattcccagtgaagcacctgaggccaagcaggggagaggaatgaggggagcagctggacatgggcctcctgaggcctcggggctgtccttcattgcccacatggatagacggagctgtggtgcagagaacttttcccgcaacaggtgcaggactgccagggatcggagtgcgggccgcgcacggtgccaggattccgccgaggggaagccgctcacattgcagtcatcacagacttacgcacttgtttggacagtttttccagaggggatgggaaagggccttgttctagctgaatctgtgtatcatgaccatttctgacaggcagaatgaattgtctggtagccctgtcctgacccatccaagcgctgttggggctggtggtgacgtggtcacatgtcctggcatatctggggccacgcagtttagtctcttgtcccaggagaattgttagtgacccctctttctcttgcaagccccctccacactgggttggatgataccttaatgagtgacgctggcgagaggcaccctacccgacgcagctgtgaatggccggtgatgtatgtcaggaggccacagggagcagaggagcggggcaggcagccacagggccctgcggggagcacatcctcgcctccgtccggctgctgcccttcaacaacaagccctgatttttccagcaatgccagaaacctggattttaagtcttccaatttgattcaaaaatatttttaacattgtgagccagctagacccccagtgcaccaccccatattgaaaaacagttgtctggcatcagcttcaggagcgggtccggtcattctgaaactgtccctccagaggttcttccagccccacttctatgcgatgtcatcttttctaaaagagacaaatgaagccacagggaaagtgaaataaagccttgaacctca

SEQ ID NO: 11960 - DNA, 2533 bp, Homo sapiens
atgtaccagagcctggcgctggccgcgagcccccgccaggccgcctacgccgactcgggctccttcctgcacgctccgggcgccggctctccgatgtttgtgccgccggcgcgcgtcccctcgatgctgtcctacctgtccgggtgtgagccgagcccgcagccccccgagctcgctgcgcgccccggctgggcgcagacagccaccgcggattcgtcggccttcggcccgggcagtccgcaccccccagccgcgcacccgcccggggccaccgccttccctttcgcgcacagcccctcggggcccggcagcggcggcagcgcggggggccgagacggcagtgcctaccagggcgcgctgttgcctcgagaacagttcgcggccccgcttgggcggccggtggggacctcgtactccgccacctacccggcctacgtgagccccgacgtggcccagtcctggactgccgggcccttcgatggcagcgtcctgcacggcctcccaggccgcaggcccaccttcgtgtccgacttcttggaggagttcccgggtgagggtcgtgagtgtgtcaactgcggggccctgtccacaccgctgtggcgccgagacggcaccggccactacctgtgcaatgcctgcggcctctaccacaagatgaatggcgtcaaccggccgctcgttcggcctcagaagcgcctgtcctcgtcccgccgcgccggcctctgctgcaccaactgccacacgaccaacaccacgctgtggcggcggaactcggagggggagcccgtgtgcaatgcctgcggcctctacatgaagctgcacggggtgccgcggcctctggctatgaagaaggaaagcatccagacacggaagcggaagccaaagaccatcgccaaggccaggggctcctcaggatccacaaggaatgcctcggcctccccatctgctgtcgccagcactgacagctcagcagccacttcgaaagccaagcccagcctggcgtccccagtgtgccctgggcccagcatggccccccaggcctctggccaggaggatgactctcttgcccccggccacttggagttcaagttcgagcctgaggactttgccttcccctccacggccccaagcccccaggctggcctcaggggggctctgcgccaagaggcctggtgtgcgctggccttggcctaggtccccaggccagcccatgtcaggggaacagcctggaacagaccacccactgagtcacctccgtgcctgctttgctccagcacagcagagaccagcaggccccccaacccagagactgggtctgctggagtctccacacagtggtggggaggccttctggacagacggcagtcgggccccagagcaagaaggctggtgagggaagggctcagcttcccaccccacgtacagcaagggactccccaggtgcggcccaaggctccggaccacactggccccctgcggcggaggccaacgcagggcaccaccaccaccaacttgaattccgtcatcaatgctcaccgtcaatatgtttacaagttgtagcagttgggggaaaacagtcaacctcccagtgtaaaaccaagattcccagtgaagcacctgaggccaagcaggggagaggaatgaggggagcagctggacatgggcctcctgaggcctcggggctgtccttcattgcccacatggatagacggagctgtggtgcagagaacttttcccgcaacaggtgcaggactgccagggatcggagtgcgggccgcgcacggtgccaggattccgccgaggggaagccgctcacattgcagtcatcacagacttacgcacttgtttggacagtttttccagaggggatgggaaagggccttgttctagctgaatctgtgtatcatgaccatttctgacaggcagaatgaattgtctggtagccctgtcctgacccatccaagcgctgttggggctggtggtgacgtggtcacatgtcctggcatatctggggccacgcagtttagtctcttgtcccaggagaattgttagtgacccctctttctcttgcaagccccctccacactgggttggatgataccttaatgagtgacgctggcgagaggcaccctacccgacgcagctgtgaatggccggtgatgtatgtcaggaggccacagggagcagaggagcggggcaggcagccacagggccctgcggggagcacatcctcgcctccgtccggctgctgcccttcaacaacaagccctgatttttccagcaatgccagaaacctggattttaagtcttccaatttgattcaaaaatatttttaacattgtgagccagctagacccccagtgcaccaccccatattgaaaaacagttgtctggcatcagcttcaggagcgggtccggtcattctgaaactgtccctccagaggttcttccagccccacttctatgcgatgtcatcttttctaaaagagacaaatgaagccacagggaaagtgaaataaagccttgaacctca

SEQ ID NO: 11961 - DNA, 2595 bp, Homo sapiens; identical to SEQ ID NO: 11959

SEQ ID NO: 11962 - DNA, 3770 bp, Homo sapiens
gacccacagcctggcacccttcggcgagcgctgtttgtttagggctcggtgagtccaatcaggagcccaggctgcagttttccggcagagcagtaagaggcgcctcctctctcctttttattcaccagcagcgcggcgcagaccccggactcgcgctcgcccgctggcgccctcggcttctctccgcgcctgggagcaccctccgccgcggccgttctccatgcgcagcgcccgcccgaggagctagacgtcagcttggagcggcgccggaccgtggatggccttgactgacggcggctggtgcttgccgaagcgcttcggggccgcgggtgcggacgccagcgactccagagcctttccagcgcgggagccctccacgccgccttcccccatctcttcctcgtcctcctcctgctcccggggcggagagcggggccccggcggcgccagcaactgcgggacgcctcagctcgacacggaggcggcggccggacccccggcccgctcgctgctgctcagttcctacgcttcgcatcccttcggggctccccacggaccttcggcgcctggggtcgcgggccccgggggcaacctgtcgagctgggaggacttgctgctgttcactgacctcgaccaagccgcgaccgccagcaagctgctgtggtccagccgcggcgccaagctgagccccttcgcacccgagcagccggaggagatgtaccagaccctcgccgctctctccagccagggtccggccgcctacgacggcgcgcccggcggcttcgtgcactctgcggccgcggcggcagcagccgcggcggcggccagctccccggtctacgtgcccaccacccgcgtgggttccatgctgcccggcctaccgtaccacctgcaggggtcgggcagtgggccagccaaccacgcgggcggcgcgggcgcgcaccccggctggcctcaggcctcggccgacagccctccatacggcagcggaggcggcgcggctggcggcggggccgcggggcctggcggcgctggctcagccgcggcgcacgtctcggcgcgcttcccctactctcccagcccgcccatggccaacggcgccgcgcgggagccgggaggctacgcggcggcgggcagtgggggcgcgggaggcgtgagcggcggcggcagtagcctggcggccatgggcggccgcgagccccagtacagctcgctgtcggccgcgcggccgctgaacgggacgtaccaccaccaccaccaccaccaccaccaccatccgagcccctactcgccctacgtgggggcgccactgacgcctgcctggcccgccggacccttcgagaccccggtgctgcacagcctgcagagccgcgccggagccccgctcccggtgccccggggtcccagtgcagacctgctggaggacctgtccgagagccgcgagtgcgtgaactgcggctccatccagacgccgctgtggcggcgggacggcaccggccactacctgtgcaacgcctgcgggctctacagcaagatgaacggcctcagccggcccctcatcaagccgcagaagcgcgtgccttcatcacggcggcttggattgtcctgtgccaactgtcacaccacaactaccaccttatggcgcagaaacgccgagggtgaacccgtgtgcaatgcttgtggactctacatgaaactccatggggtgcccagaccacttgctatgaaaaaagagggaattcaaaccaggaaacgaaaacctaagaacataaataaatcaaagacttgctctggtaatagcaataattccattcccatgactccaacttccacctcttctaactcagatgattgcagcaaaaatacttcccccacaacacaacctacagcctcaggggcgggtgccccggtgatgactggtgcgggagagagcaccaatcccgagaacagcgagctcaagtattcgggtcaagatgggctctacataggcgtcagtctcgcctcgccggccgaagtcacgtcctccgtgcgaccggattcctggtgcgccctggccctggcctgagcccacgccgccaggaggcagggagggctccgccgcgggcctcactccactcgtgtctgcttttgtgcagcggtccagacagtggcgactgcgctgacagaacgtgattctcgtgcctttattttgaaagagatgtttttcccaagaggcttgctgaaagagtgagagaagatggaagggaagggccagtgcaactgggcgcttgggccactccagccagcccgcctccggggcggaccctgctccacttccagaagccaggactaggacctgggccttgcctgctatggaatattgagagagattttttaaaaaagattttgcattttgtccaaaatcatgtgcttcttctgatcaattttggttgttccagaatttcttcataccttttccacatccagatttcatgtgcgttcatggagaagatcacttgaggccatttggtacacatctctggaggctgagtcggttcatgaggtctcttatcaaaaatattactcagtttgcaagactgcattgtaactttaacatacactgtgactgacgtttctcaaagttcatattgtgtggctgatctgaagtcagtcggaatttgtaaacagggtagcaaacaagatatttttcttccatgtatacaataatttttttaaaaagtgcaatttgcgttgcagcaatcagtgttaaatcatttgcataagatttaacagcattttttataatgaatgtaaacattttaacttaatggtacttaaaataatttaaaagaaaaatgttaacttagacattcttatgcttcttttacaactacatcccattttatatttccaattgttaaagaaaaatatttcaagaacaaatcttctctcaggaaaattgcctttctctatttgttaagaatttttatacaagaacaccaatataccccctttattttactgtggaatatgtgctggaaaaattgcaacaacactttactacctaacggatagcatttgtaaatactctaggtatctgtaaacactctgatgaagtctgtatagtgtgactaacccacaggcaggttggtttacattaatttttttttttgaatgggatgtcctatggaaacctatttcaccagagttttaaaaataaaaagggtattgttttgtcttctgtacagtgagttccttcccttttcaaagctttctttttatgctgtatgtgactatagatattcatataaaacaagtgcacgtgaagtttgcaaaatgctttaaggccttcctttcaaagcatagtccttttggagccgttttgtaccttttataccttggcttatttgaagttgacacatggggttagttactactctccatgtgcattggggacagtttttataagtgggaaggactcagtattattatatttgagatgataagcattttgtttgggaacaatgcttaaaaatattccagaaagttcagattttttttctttgtgaatgaaatatattctggcccacgaacagggcgatttcctttcagttttttccttttgcaacgtgccttgaagtctcaaagctcacctgaggttgcagacgttacccccaacagaagataggtagaaatgattccagtggcctctttgtattttcttcattgttgagtagatttcaggaaatcaggaggtgtttcacaatacagaatgatggcctttaactgtg

SEQ ID NO: 11963 - DNA, 8675 bp, Homo sapiens
cagccccggcaggatggcggcggacacgcaggtttccgagacactaaagcgttttgcagggaaggtgacaacagccagtgtaaaggaacggagagaaatcctcagtgaacttgggaagtgtgttgctggaaaagatcttccagagggagcagtgaaggggctctgcaaattgttctgcttgactctgcatcgatatagagatgcagcctcccgcagggccttgcaggcagccatccagcagttggctgaggcccagccagaagccactgctaagaaccttctacactctctgcagtcttctggtataggctccaaagcaggtgttcccagtaagagcagtggctctgccgccttgctggccttgacctggacctgcctcctggtgcgcattgtctttccatcgagagccaagcgacaaggagacatctggaacaaactggtggaagtgcagtgcctgctcttgctggaggtgctgggtggctcccacaagcacgccgtggatggtgctgtgaagaaactcacgaagctgtggaaagagaaccccgggctggtggaacagtacttgtcagccattctcagcctagagcccaaccagaactatgctggcatgctggggctgctggtgcagttctgcacgagtcacaaggagatggacgtggtcagtcagcacaagagcgccctactggacttttacatgaagaacatcctgatgagcaaagtcaagcctccgaagtacctgttggatagctgtgcccctctgctccgatacctgtcccactcagaatttaaggatctgatactgcccaccatacagaagtccttactgaggagtccagagaatgttattgaaactatttctagtctgctggcatcagtgacgcttgacctcagccagtatgccatggacatcgtgaaaggactggctggtcacctgaaatccaacagtccccgcctgatggatgaagctgtgctggcactgcggaacctggcacgccagtgcagtgactcttcggccatggaatccctgaccaagcacctatttgctatcctcggaggctcggaaggaaaactaactgttgtagcccagaagatgagcgtcctctcagggattgggagcgtcagtcatcacgtggtgtctggaccttccagtcaggtcctgaatgggatcgtggctgagctgttcatcccgttccttcagcaggaagttcatgaagggaccttggtacacgctgtctcagtcctggctctctggtgtaaccgattcactatggaagtgcccaagaagctcactgaatggttcaaaaaagctttcagccttaaaacctccacatctgcggtgaggcatgcctacctgcagtgcatgttggcctcttaccggggtgacacgctgttgcaggccctggacttactgcccttgctcatccagacagtggagaaggcagcctcccaaagcactcaggttcccaccatcactgaaggggttgccgcagccttgttgctcttaaagttgtcagtggctgactcacaggctgaggccaaactgagcagtttctggcagttgattgtggatgagaaaaagcaggttttcacttctgagaaattcctggtcatggcttcagaggatgccctgtgtactgtgttgcatctgacagagagacttttccttgaccacccgcatagactcactggcaacaaagttcagcagtaccaccgggctctggtggcggtgctcctgagccgcacctggcacgtccgcaggcaggctcagcagacagttcggaagctgctgtcctctcttgggggctttaagctggcgcacggactcttggaggagctgaagactgtcctcagttctcacaaggtgctgcccttagaggctttggtgactgatgctggagaggtgactgaggcaggcaaggcctacgtgcctccacgggtcctgcaggaggctctgtgtgtcatctccggtgtgccagggctcaagggtgatgtcaccgacactgaacaactggcccaggaaatgctgatcatctcccaccacccatccttagttgccgtgcagtctggactttggccagcacttcttgccaggatgaagatcgatcctgaagcctttatcaccaggcacctggatcagatcattcccaggatgaccacacagagtcccctaaaccagtcctccatgaatgccatgggctccctttccgtcctgtcgccggaccgggtcctcccacagctcatcagcaccatcactgcctccgtgcagaaccctgcactgcgcctggtgacgcgggaggagtttgccattatgcagacccctgctggggagctgtatgacaaatccatcattcagagtgcccagcaggacagcataaaaaaggccaacatgaagcgagagaacaaagcttattccttcaaagagcagatcatcgagctggagctgaaggaggagataaagaagaagaaaggcatcaaagaggaggtgcagctgaccagcaagcagaaggagatgctgcaggcccagctagacagggaggcgcaggtccggaggcggctgcaggagctggatggggagctggaggcggcgcttggactgctggacatcatcctggccaagaacccgtccggcctgacccagtacatccctgttttggtcgactcttttctgcccttgctgaagtctcccctggctgctcccaggatcaagaaccccttcttgtccttggctgcctgtgtcatgccctctaggctcaaggctttgggcactttggtgagccacgtgaccctgcgcctgctgaagccagagtgtgtcctggataagtcctggtgccaggaagagctgtcggtggctgtgaagagggcggtgatgctgctgcacacccacaccatcaccagcagggtgggcaagggggagccaggtgctgcgcccttgtccgcgccagccttctccttagtcttcccgtttctgaagatggtgctgacggagatgccccaccacagtgaggaggaggaggagtggatggcccagattcttcagatcctcactgtccaagcccagctgagggcctcccccaacaccccacccgggcgggtggacgagaatggcccggagttgctgcctcgcgtggccatgctgcgtcttctgacttgggtgatcgggacgggctcgcctcgcttacaggttctggcttcagacaccctgaccaccctgtgtgccagcagcagtggtgatgatggctgtgcctttgcagagcaggaggaggtggacgtgctgctctgtgccttgcagtccccgtgtgccagcgtgcgggaaaccgtgctccgggggctgatggaactccacatggtattgccagcacctgatactgatgagaagaatggcctgaaccttctgcggagactctgggtggtcaagtttgacaaggaggaggagatccggaagctggctgagaggctctggtcaatgatgggcctagacctgcagccagacctctgctccttgctgattgacgacgtgatctatcatgaggcggctgtaaggcaggcaggggccgaagccctctcccaagcagtggcacgttaccagcggcaggcggcggaggttatgggcaggctcatggagatttaccaggaaaagctctaccggccgcccccagtgctggatgctttgggacgagttatttcagaatctcctccagatcagtgggaagccaggtgtggcttggcgttggccctcaacaagctctcccagtatttggacagctctcaggtgaagccactctttcagttttttgtccctgatgccctcaatgaccgacacccagatgtccggaagtgcatgttggatgcagccctcgcaacgctcaacactcatgggaaggagaacgtcaactcgctgttgccagtattcgaggagttcctgaagaacgcgcccaatgatgccagctatgatgctgtgcgacagagtgtggtggtcctgatgggctctctggccaagcacctggacaagagtgaccccaaagtgaagcccattgttgccaagctcatcgctgccctctccaccccctcccagcaggtccaggagtccgtagccagctgcttgccaccccttgtgccagccatcaaggaggatgctggagggatgatccagaggcttatgcagcagctgctggagtcagacaagtacgcagagcgcaaaggggccgcctatggcctggcgggcctggtgaagggcctgggcatcctctcgctgaagcaacaggagatgatggcggcactgactgatgccatccaagataagaagaacttccgccggcgagagggagccctctttgccttcgagatgctctgcaccatgctggggaaactttttgagccgtatgtggttcacgtgctgccccatctgctcctgtgctttggggatggaaaccagtatgtgcgtgaggctgcagatgactgtgccaaggctgtgatgagcaacttgagtgctcacggggtgaagctggtgctcccctccttactggctgccctggaggaggaatcgtggcggaccaaagctgggtcagtggagcttcttggggcaatggcgtactgtgctcctaagcagctgtcatcctgtctacccaacattgtgcccaagcttacggaggtgctgaccgactcccatgtcaaagtccagaaggctggacagcaggcgctcaggcagatcggctccgttatcaggaacccggagatcctggccattgctccagtcctcctggatgccctgacggatccctccaggaagacccagaagtgcttgcagaccctgctggacaccaagtttgtccacttcattgatgccccatccctggccctcatcatgcccattgtccagagagccttccaggaccgttccacggacacgcggaagatggcagcccagattattggcaacatgtactccctgacagaccagaaggacttggctccgtacctgcccagcgtgacgcctggcctgaaagcatcgcttttggaccctgtgcctgaggtgcggaccgtatctgcaaaggcccttggggccatggtgaagggcatgggggagtcgtgctttgaggacttgctgccgtggctgatggagacactgacctatgagcagagctctgtggatcgctcaggcgctgcacaggggttggctgaggtcatggccggtttgggggtggagaagttggagaagttgatgccagaaatcgtggctacagccagcaaagtggacattgcaccccatgtccgagatggctacattatgatgtttaactacctgcccatcacctttggagacaagtttactccttatgtggggcccatcatcccctgtatcctcaaagctcttgctgatgagaatgagtttgtgcgtgacaccgccctgcgcgcgggccagcgggttatctccatgtacgctgagacagccatcgccctgctgctgccccagctagagcaaggcctctttgatgacctttggagaatcaggttcagctctgttcagctccttggggatctcctgtttcacatctcaggagtcactgggaagatgaccacagaaactgcctctgaggatgataactttggaactgcccagtccaacaaggcgatcatcactgccctgggggtagagcggcggaaccgggtgttggcagggctgtacatgggccgctcagacacccagctggtggtgcggcaggcgtccctgcatgtctggaagattgttgtctccaataccccccgcaccttgcgtgagatcctacccactctctttgggctcctgctgggtttcctggccagcacgtgtgcagataagagaacgattgcagcgagaacattgggagatcttgtgcggaagttaggggagaaaatcctccccgagatcatccccatccttgaggaaggcctgaggtctcagaagagcgatgagaggcagggtgtgtgcattggcctaagtgagatcatgaagtccaccagccgggatgccgtgctgtatttctctgaatccctcgtgcccacggcaaggaaggctttgtgtgacccactggaggaggtcagagaggcggcagccaagactttcgagcagctgcattccaccatcggccaccaggctctggaggacattctcccatttttactaaagcagctggatgacgaggaggtgtcagagtttgccttggatggtctgaagcaagtcatggctattaagagtcgtgtggtgctgccctaccttgtgcccaagctgacaacgccacctgtcaacacccgggtgctggctttcctttcgtcagtggctggtgatgccctcacccgtcatcttggcgtgatcctcccagcggtcatgctggccctgaaggaaaagcttgggaccccagatgagcagctggagatggccaattgtcaggctgtgatcctctccgtagaggatgacacagggcaccggatcatcatcgagtatctgctggaggccacccgcagccctgaggtgggcatgaggcaagctgctgccatcatcctcaacatctactgttcccgctcaaaggctgactacaccagccacctgcggagcctggtctcgggcctgatccgcctcttcaatgactccagccctgtggttctggaggagagctgggatgccctaaatgccatcactaagaagctggatgctggcaaccagttggcactcattgaagagctgcacaaggaaatccggctcatagggaacgagagcaaaggcgagcatgtgccaggattctgcctcccgaagaagggagtgacctccatccttccagtgttgcgggaaggagtcctgactggcagccctgagcagaaggaggaggcagccaaagccttaggcttggtaatccgcctgacctcggctgacgccctgaggccctccgtggtcagcatcactggccctctgatccgcatcctgggggacaggttcagctggaatgtgaaggcggctctgctcgagacactcagcctcttgttggctaaggttgggattgccctgaagcccttcctgccccagctgcagaccactttcaccaaagccctgcaggactccaaccggggggtgcgcctgaaggccgcagatgctctggggaagctcatttccatccacattaaggtggaccccctcttcacagagctgctcaatggcatccgcgccatggaggacccaggtgtcagggacaccatgctgcaggccctgaggtttgtgattcagggagcaggggccaaagtggatgccgtcatccggaaaaacatcgtctcactcctgctgagcatgctgggacacgatgaggacaacactcgcatctcctcagccgggtgcctaggggaactgtgtgcctttttgactgaagaggagcttagtgccgttctacagcagtgcttgctggcggacgtgtccggcattgactggatggttcggcacgggcggagcctggcactttccgtggctgtgaatgtggctcctggcagactttgtgccggcagatatagcagtgatgttcaggaaatgatcctgagcagtgccacggcggacaggatccccattgcggtgagcggggtccggggcatgggctttctcatgagacaccacatcgagacaggcggagggcagttgccggccaaactttccagcctgttcgttaagtgtctgcagaacccatccagcgacatcaggctggtggctgagaagatgatctggtgggcaaataaggacccactgcctcccctggacccccaggccatcaagcccatcctgaaggctcttcttgacaacaccaaggataagaacaccgtggtcagggcctacagcgaccaggcaattgtcaacctcctcaagatgcggcagggtgaagaggtgtttcagtccctctccaagatcctggatgtggccagtttggaggtgctgaacgaggttaaccgaaggtccctgaagaagctggccagccaggccgactccacggagcaggtggacgacaccatcctgacatgagaggcctgggccagcagcagcattgccgctccacatctttgctcaatgttttcatttttgaaaatacatttgttccaatggggagcttggaagatggcgttcccagaaagtattttaatatcaatagaccacagccaaagccttaaatcaaacccacacacaactgaaaattgcctcctccatctctcaccttttcctgtggagaagagaaggaaaagcacacgcatgcgcctcagcaaatggcagcccaggagctgtttgtccagtttagcatggctaggtctggaactataatagcagggtcagactgtgggttcctcttctcctgtgcttgagctctggtttgagagctggcgctaccaacctttttcctatatcccgagtggggcacagacggtggatctctgcccagtgtggtgtgtctggcttggcttttcaatattgtgaggtctgaatggatctgacccctgtcagatgaaaatgattcacagctctggcagttcccaagtctggggaggggtataggtttgaaaggctgtttgaaagaggaatgtttaataaaggctttgatttaatcttgatataaacagatttttaaaaatctccacccattaaacatgaagcttcctgcatcaggaataaggaa

SEQ ID NO: 11964 - DNA, 1786 bp, Homo sapiens
ctggacctaaatggcgcagcatgactttgctccagcctggcttaatttccctactccaccatcatcaacaaaggtcctgaccagcagtttgaaatcgtcattgaattttgagaagcattctgaaaactttgcatggacagagaatcgttatgatgtgaaccgtcgacgacacaactcttcagatggctttgattctgctattgggcgtcctaatggaggtaactttggaaggaaagaaaaaaatggatggcgtacacatggaagaaatggtacagaaaacataaatcatcgaggtggataccatggtggaagttcccgttctcgtagcagtattttccatgcaggaaaaagccaaggactacatgaaaacaacatacctgacaatgaaaccgggaggaaagaagacaagagagaacgcaaacagtttgaagctgaggattttccgtctttaaatcctgagtatgagagagaaccaaatcacaataagtctttagctgcaggtgtgtgggaatatcctccgaatcctaaatctagagctccaaggatgctggtcattaagaaaggtaatacaaaagacttacagctatctggattcccagtagtaggaaatcttccgtcacagccagttaagaatggaactggtccaagtgtttataaaggtttagtccctaaacctgctgctccacctacaaaacctacacaatggaaaagccaaacaaaagaaaataaagttggaacttctttccctcatgagtccacatttggcgttggcaactttaatgcttttaaatcaactgccaagaactttagtccatctacaaattcagtgaaagagtgtaatcgctcaaattcctcttctcctgttgacaaacttaatcagcagcctcgtctaaccaaactgacacgaatgcgcactgataagaagagtgaatttttgaaagcattgaaaagagacagagtagaagaggaacatgaagatgaaagccgtgctggctcagagaaggatgacgactcatttaatttacataacagcaatagtactcaccaagaaagggatataaaccgaaacttcgatgaaaatgaaattcctcaagagaatggcaatgcctcagtgatttcccagcagatcattcggtcttcaaccttcccacaaactgatgttctttcaagttcacttgaggcagaacacagattgttaaaggaaatgggctggcaggaagacagtgaaaatgatgaaacatgtgctcccttaactgaggatgaaatgagagaattccaagttattagtgaacagttacagaagaatggtctgagaaaaaatggtattttgaaaaatggcttgatctgtgacttcaagtttggaccgtggaagaacagcactttcaaacccacaactgagaatgatgacacagagacaagtagcagtgatacatcagatgacgacgatgtgtgaaggatttcctaacagctttagaaatcttagtgtgatacatctctcatacagtttggggtgaattgtaaaaatgaagaactataatttatgtagtgaaataccccattagaagaggattttttgggggacttcaatatgaagaaaaccaagaatgttttgttgggctgtgttgaacattatttctttgtaaatgaatgttgtaggaatgaggacttgggttggtccaacattgactttcttcatcactgcaacatttctctgactagcaatgtgacgatgtaacaaatgagattttctcatttaataataaaaaattgtgtaatgttttgcaaa

SEQ ID NO: 11965 - DNA, 3136 bp, Homo sapiens
cacactctttctccctccttctcctcgccccgccttccctccctcctcaatccctctagttccttccccgcctcgccactgtgcacgatctcgcgagacttggcccagaacattgcggatcgggtcggcgccattttgggactgagactggttgtgggggagggaaaagcggcaaaaggggattattcaaagtaccgaaaaccttctcccgggatcaggcgcggcggcacccccaggccaggggcacctctggtggggcagaaggtgattgaattactcagatatgaagatcatcatctaggttttgtgtaaaaggccctggatattttaagtggccattttggatttacagtgtttttggataattttgccccagaagtttattaaaattggcaagaatcgtctgtgaagtgaattgatagtagtgaacaattcagcaagctacttaaaaagagacccaggcagcatttcttcagtattttggttcaaacggattatataactggttacagtatttcagctggtggtaatttttgcctccccttcccccaccccgttgttggggttcttcagccgaaactgagagacgttgatttgtgtactgagtagtttcagcagtttcaaatgactgagtattgctgaagtttcatggcagtttatttttacctttattgaaagttttaggaatttttgacttcagctctttcatgtcacaatgggacactttttctgaatgaagagattgaaagaatacagagtttttttccttttatcttttatttacgtggaaatttaagatgttgcagttttccggcagcatggtagtattgagatagctatgtgtgtctctgtatatgctgatgtttaggaatgctcttcagatgtgaaattttctttttgtttttgctttttggctcgtaaattggatatttcatctggagtggacaagtacaacagtggcaagtacatggaataataaagaagactttgatcttaaatctaaagaacttggctaattcgggagatagccatatgaaaactttaaaacagaagtatgggtagctgacttgaagtaactctatgtcaaatagtcgtaggttaagtatcttcaaagaacttcgatattatttcagaggatacaaaataaaaatacaaactggaaaataaagattacagagaaaaaaccaacaccttcctgtgcagtcctgttggaatttggacttgccatgaggtgttgaagccttgtttcactgagttggagagactggacctaaatggcgcagcatgactttgctccagcctggcttaatttccctactccaccatcatcaacaaagtcgtcattgaattttgagaagcattctgaaaactttgcatggacagagaatcgttatgatgtgaaccgtcgacgacacaactcttcagatggctttgattctgctattgggcgtcctaatggaggtaactttggaaggaaagaaaaaaatggatggcgtacacatggaagaaatggtacagaaaacataaatcatcgaggtggataccatggtggaagttcccgttctcgtagcagtattttccatgcaggaaaaagccaaggactacatgaaaacaacatacctgacaatgaaaccgggaggaaagaagacaagagagaacgcaaacagtttgaagctgaggattttccgtctttaaatcctgagtatgagagagaaccaaatcacaataagtctttagctgcaggtgtgtggggcctacacgcccagacacacacatacccaaccaaaaaaatctcccaagctcctctcttagaatatcctccgaatcctaaatctagagctccaaggatgctggtcattaagaaaggtaatacaaaagacttacagctatctggattcccagtagtaggaaatcttccgtcacagccagttaagaatggaactggtccaagtgtttataaaggtttagtccctaaacctgctgctccacctacaaaacctacacaatggaaaagccaaacaaaagaaaataaagttggaacttctttccctcatgagtccacatttggcgttggcaactttaatgcttttaaatcaactgccaagaactttagtccatctacaaattcagtgaaagagtgtaatcgctcaaattcctcttctcctgttgacaaacttaatcagcagcctcgtctaaccaaactgacacgaatgcgcactgataagaagagtgaatttttgaaagcattgaaaagagacagagtagaagaggaacatgaagatgaaagccgtgctggctcagagaaggatgacgactcatttaatttacataacagcaatagtactcaccaagaaagggatataaaccgaaacttcgatgaaaatgaaattcctcaagagaatggcaatgcctcagtgatttcccagcagatcattcggtcttcaaccttcccacaaactgatgttctttcaagttcacttgaggcagaacacagattgttaaaggaaatgggctggcaggaagacagtgaaaatgatgaaacatgtgctcccttaactgaggatgaaatgagagaattccaagttattagtgaacagttacagaagaatggtctgagaaaaaatggtattttgaaaaatggcttgatctgtgacttcaagtttggaccgtggaagaacagcactttcaaacccacaactgagaatgatgacacagagacaagtagcagtgatacatcagatgacgacgatgtgtgaaggatttcctaacagctttagaaatcttagtgtgatacatctctcatacagtttggggtgaattgtaaaaatgaagaactataatttatgtagtgaaataccccattagaagaggattttttgggggacttcaatatgaagaaaaccaagaatgttttgttgggctgtgttgaacattatttctttgtaaatgaatgttgtaggaatgaggacttgggttggtccaacattgactttcttcatcactgcaacatttctctgactagcaatgtgacgatgtaacaaatgagattttctcatttaataataaaaaattgtgtaatgttttgcaaagcttctgtcttaaaatgtccaggtcttaagaaaaaaggcagcttaca

SEQ ID NO: 11966 - DNA, 4418 bp, Homo sapiens
gtgattgaattactcagatatgaagatcatcatctaggttttgtgtaaaaggccctggatattttaagtggccattttggatttacagtgtttttggataattttgccccagaagtttattaaaattggcaagaatcgtctgtgaagtgaattgatagtagtgaacaattcagcaagctacttaaaaagagacccaggcagcatttcttcagtattttggttcaaacggattatataactggttacagtatttcagctggtggtaatttttgcctccccttcccccaccccgttgttggggttcttcagccgaaactgagagacgttgatttgtgtactgagtagtttcagcagtttcaaatgactgagtattgctgaagtttcatggcagtttatttttacctttattgaaagttttaggaatttttgacttcagctctttcatgtcacaatgggacactttttctgaatgaagagattgaaagaatacagagtttttttccttttatcttttatttacgtggaaatttaagatgttgcagttttccggcagcatggtagtattgagatagctatgtgtgtctctgtatatgctgatgtttaggaatgctcttcagatgtgaaattttctttttgtttttgctttttggctcgtaaattggatatttcatctggagtggacaagtacaacagtggcaagtacatggaataataaagaagactttgatcttaaatctaaagaacttggctaattcgggagatagccatatgaaaactttaaaacagaagtatgggtagctgacttgaagtaactctatgtcaaatagtcgtaggttaagtatcttcaaagaacttcgatattatttcagaggatacaaaataaaaatacaaactggaaaataaagattacagagaaaaaaccaacaccttcctgtgcagtcctgttggaatttggacttgccatgaggtgttgaagccttgtttcactgagttggagagactggacctaaatggcgcagcatgactttgctccagcctggcttaatttccctactccaccatcatcaacaaagtcgtcattgaattttgagaagcattctgaaaactttgcatggacagagaatcgttatgatgtgaaccgtcgacgacacaactcttcagatggctttgattctgctattgggcgtcctaatggaggtaactttggaaggaaagaaaaaaatggatggcgtacacatggaagaaatggtacagaaaacataaatcatcgaggtggataccatggtggaagttcccgttctcgtagcagtattttccatgcaggaaaaagccaaggactacatgaaaacaacatacctgacaatgaaaccgggaggaaagaagacaagagagaacgcaaacagtttgaagctgaggattttccgtctttaaatcctgagtatgagagagaaccaaatcacaataagtctttagctgcaggtgtgtggggcctacacgcccagacacacacatacccaaccaaaaaaatctcccaagctcctctcttagaatatcctccgaatcctaaatctagagctccaaggatgctggtcattaagaaaggtaatacaaaagacttacagctatctggattcccagtagtaggaaatcttccgtcacagccagttaagaatggaactggtccaagtgtttataaaggtttagtccctaaacctgctgctccacctacaaaacctacacaatggaaaagccaaacaaaagaaaataaagttggaacttctttccctcatgagtccacatttggcgttggcaactttaatgcttttaaatcaactgccaagaactttagtccatctacaaattcagtgaaagagtgtaatcgctcaaattcctcttctcctgttgacaaacttaatcagcagcctcgtctaaccaaactgacacgaatgcgcactgataagaagagtgaatttttgaaagcattgaaaagagacagagtagaagaggaacatgaagatgaaagccgtgctggctcagagaaggatgacgactcatttaatttacataacagcaatagtactcaccaagaaagggatataaaccgaaacttcgatgaaaatgaaattcctcaagagaatggcaatgcctcagtgatttcccagcagatcattcggtcttcaaccttcccacaaactgatgttctttcaagttcacttgaggcagaacacagattgttaaaggaaatgggctggcaggaagacagtgaaaatgatgaaacatgtgctcccttaactgaggatgaaatgagagaattccaagttattagtgaacagttacagaagaatggtctgagaaaaaatggtattttgaaaaatggcttgatctgtgacttcaagtttggaccgtggaagaacagcactttcaaacccacaactgagaatgatgacacagagacaagtagcagtgatacatcagatgacgacgatgtgtgaaggatttcctaacagctttagaaatcttagtgtgatacatctctcatacagtttggggtgaattgtaaaaatgaagaactataatttatgtagtgaaataccccattagaagaggattttttgggggacttcaatatgaagaaaaccaagaatgttttgttgggctgtgttgaacattatttctttgtaaatgaatgttgtaggaatgaggacttgggttggtccaacattgactttcttcatcactgcaacatttctctgactagcaatgtgacgatgtaacaaatgagattttctcatttaataataaaaaattgtgtaatgttttgcaaagcttctgtcttaaaatgtccaggtcttaagaaaaaaggcagcttacactgttttgcttgcagagtcatatctttttcgtacaatggaaatcctcaagtccactttgtgcggtctccctctccttcccccaaaaaacaacaacaacaaaacaaaaaccaaaaaggaaaatgtagcatgttggctaaaactggagcaaagtgcactaaaacaatttcctgaactcacctgttgtactattcaccttttaaaccataaattgctctttagccatttgtagtgcagtaaatgttacaggaaaagacttggcacattttcttccaaattttaagaggtgattttcaaaagctttattggggtatgttgtcagaccagggttttcagagttgatggaaaagagtcttgtgagaaaacttattttgataaattattacacacgcagaaaaactgatcacactgactggatctgtccacgacatggaaaataaactggattttcagaatattgttgttttctgtagtgttcaaggtattgtttctaaacataaacatactctaaacatgctttattcacttgttaaagtcatacttttaaaagtaataccttactaaagatggtgattacttttccgaggtcagaaaaggaaagctaagcgttttcattatcaaatacacaagcttattaaatgaatgactgttaactactttattttcatttgcacattaattttggaattgtttctgttttgctgctgacggaaatactattttggctctgtgtatatttgtattttgatttttctggtttgtttacccccatttgcttttagctcccccttatgtttaaatatattctaacttatgtaaagagcataatcttagagcaaaaatacttgaggttttatgtcagatctaatcttaagtgtttgttgttttttaaaaagtgttttctcagatggctgcagtgtttttgctatttctgcataaataccctacctggactccccagttttcaccagaaactgttatttttttttgttgttgttcccactgagactgatggtgatggggaaattaaaaacaacacactagcacactcccacaaaacttgaggaagagttagaatggtaataaaatattaaatagaccttatacttaaaataaggtttcactatataatttgtcacaattcaatctaatcagctaaagttaaatgtagttagaattagccacaggagaatgtaaagcatgctttgacgaagctatcggtaacacatattgaatgtctttgagactcttagattgtactatttgcttaatagattaatgaaatttatcagatacaacctgtatttccaaaaacaagctagaaggaacctgaggaatgtggtttacatttgagatccaccttactgtgttttctactttcagaaaagattctgtagttttggtttttggcatctttcttatactcagttttttctgccttaattcccatttaccagcagttaactcatgtttattgtgctttcatgcattgtgatatggaatgtgtttagtaatttactccttataaatatggtaaagtacagtggt

SEQ ID NO: 11967 - DNA, 2857 bp, Homo sapiens
cggcaaaaggggattattcaaagtaccgaaaaccttctcccgggatcaggcgcggcggcacccccaggccaggggcacctctggtggggcagaaggtgattgaattactcagatatgaagatcatcatctaggttttgtgtaaaaggccctggatattttaagtggccattttggatttacagtgtttttggataattttgccccagaagtttattaaaattggcaagaatcgtctgtgaagtgaattgatagtagtgaacaattcagcaagctacttaaaaagagacccaggcagcatttcttcagtattttggttcaaacggattatataactggttacagtatttcagctggtggtaatttttgcctccccttcccccaccccgttgttggggttcttcagccgaaactgagagacgttgatttgtgtactgagtagtttcagcagtttcaaatgactgagtattgctgaagtttcatggcagtttatttttacctttattgaaagttttaggaatttttgacttcagctctttcatgtcacaatgggacactttttctgaatgaagagattgaaagaatacagagtttttttccttttatcttttatttacgtggaaatttaagatgttgcagttttccggcagcatggtagtattgagatagctatgtgtgtctctgtatatgctgatgtttaggaatgctcttcagatgtgaaattttctttttgtttttgctttttggctcgtaaattggatatttcatctggagtggacaagtacaacagtggcaagtacatggaataataaagaagactttgatcttaaatctaaagaacttggctaattcgggagatagccatatgaaaactttaaaacagaagtatgggtagctgacttgaagtaactctatgtcaaatagtcgtaggttaagtatcttcaaagaacttcgatattatttcagaggatacaaaataaaaatacaaactggaaaataaagattacagagaaaaaaccaacaccttcctgtgcagtcctgttggaatttggacttgccatgaggtgttgaagccttgtttcactgagttggagagactggacctaaatggcgcagcatgactttgctccagcctggcttaatttccctactccaccatcatcaacaaagtcgtcattgaattttgagaagcattctgaaaactttgcatggacagagaatcgttatgatgtgaaccgtcgacgacacaactcttcagatggctttgattctgctattgggcgtcctaatggaggtaactttggaaggaaagaaaaaaatggatggcgtacacatggaagaaatggtacagaaaacataaatcatcgaggtggataccatggtggaagttcccgttctcgtagcagtattttccatgcaggaaaaagccaaggactacatgaaaacaacatacctgacaatgaaaccgggaggaaagaagacaagagagaacgcaaacagtttgaagctgaggattttccgtctttaaatcctgagtatgagagagaaccaaatcacaataagtctttagctgcaggtgtgtgggaatatcctccgaatcctaaatctagagctccaaggatgctggtcattaagaaaggtaatacaaaagacttacagctatctggattcccagtagtaggaaatcttccgtcacagccagttaagaatggaactggtccaagtgtttataaaggtttagtccctaaacctgctgctccacctacaaaacctacacaatggaaaagccaaacaaaagaaaataaagttggaacttctttccctcatgagtccacatttggcgttggcaactttaatgcttttaaatcaactgccaagaactttagtccatctacaaattcagtgaaagagtgtaatcgctcaaattcctcttctcctgttgacaaacttaatcagcagcctcgtctaaccaaactgacacgaatgcgcactgataagaagagtgaatttttgaaagcattgaaaagagacagagtagaagaggaacatgaagatgaaagccgtgctggctcagagaaggatgacgactcatttaatttacataacagcaatagtactcaccaagaaagggatataaaccgaaacttcgatgaaaatgaaattcctcaagagaatggcaatgcctcagtgatttcccagcagatcattcggtcttcaaccttcccacaaactgatgttctttcaagttcacttgaggcagaacacagattgttaaaggaaatgggctggcaggaagacagtgaaaatgatgaaacatgtgctcccttaactgaggatgaaatgagagaattccaagttattagtgaacagttacagaagaatggtctgagaaaaaatggtattttgaaaaatggcttgatctgtgacttcaagtttggaccgtggaagaacagcactttcaaacccacaactgagaatgatgacacagagacaagtagcagtgatacatcagatgacgacgatgtgtgaaggatttcctaacagctttagaaatcttagtgtgatacatctctcatacagtttggggtgaattgtaaaaatgaagaactataatttatgtagtgaaataccccattagaagaggattttttgggggacttcaatatgaagaaaaccaagaatgttttgttgggctgtgttgaacattatttctttgtaaatgaatgttgtaggaatgaggacttgggttggtccaacattgactttcttcatcactgcaacatttctctgactagcaatgtgacgatgtaacaaatgagattttctcatttaataataaaaaattgtgtaatgttttgc

SEQ ID NO: 11968 - DNA, 2243 bp, Homo sapiens
tttccttttatcttttatttacgtggaaatttaagatgttgcagttttccggcagcatggtagtattgagatagctatgtgtgtctctgtatatgctgatgtttaggaatgctcttcagatgtgaaattttctttttgtttttgctttttggctcgtaaattggatatttcatctggagtggacaagtacaacagtggcaagtacatggaataataaagaagactttgatcttaaatctaaagaacttggctaattcgggagatagccatatgaaaactttaaaacagaagtatgggtagctgacttgaagtaactctatgtcaaatagtcgtaggttaagtatcttcaaagaacttcgatattatttcagaggatacaaaataaaaatacaaactggaaaataaagattacagagaaaaaaccaacaccttcctgtgcagtcctgttggaatttggacttgccatgaggtgttgaagccttgtttcactgagttggagagactggacctaaatggcgcagcatgactttgctccagcctggcttaatttccctactccaccatcatcaacaaaggtcctgaccagcagtttgaaatcgtcattgaattttgagaagcattctgaaaactttgcatggacagagaatcgttatgatgtgaaccgtcgacgacacaactcttcagatggctttgattctgctattgggcgtcctaatggaggtaactttggaaggaaagaaaaaaatggatggcgtacacatggaagaaatggtacagaaaacataaatcatcgaggtggataccatggtggaagttcccgttctcgtagcagtattttccatgcaggaaaaagccaaggactacatgaaaacaacatacctgacaatgaaaccgggaggaaagaagacaagagagaacgcaaacagtttgaagctgaggattttccgtctttaaatcctgagtatgagagagaaccaaatcacaataagtctttagctgcaggtgtgtgggaatatcctccgaatcctaaatctagagctccaaggatgctggtcattaagaaaggtaatacaaaagacttacagctatctggattcccagtagtaggaaatcttccgtcacagccagttaagaatggaactggtccaagtgtttataaaggtttagtccctaaacctgctgctccacctacaaaacctacacaatggaaaagccaaacaaaagaaaataaagttggaacttctttccctcatgagtccacatttggcgttggcaactttaatgcttttaaatcaactgccaagaactttagtccatctacaaattcagtgaaagagcagcctcgtctaaccaaactgacacgaatgcgcactgataagaagagtgaatttttgaaagcattgaaaagagacagagtagaagaggaacatgaagatgaaagccgtgctggctcagagaaggatgacgactcatttaatttacataacagcaatagtactcaccaagaaagggatataaaccgaaacttcgatgaaaatgaaattcctcaagagaatggcaatgcctcagtgatttcccagcagatcattcggtcttcaaccttcccacaaactgatgttctttcaagttcacttgaggcagaacacagattgttaaaggaaatgggctggcaggaagacagtgaaaatgatgaaacatgtgctcccttaactgaggatgaaatgagagaattccaagttattagtgaacagttacagaagaatggtctgagaaaaaatggtattttgaaaaatggcttgatctgtgacttcaagtttggaccgtggaagaacagcactttcaaacccacaactgagaatgatgacacagagacaagtagcagtgatacatcagatgacgacgatgtgtgaaggatttcctaacagctttagaaatcttagtgtgatacatctctcatacagtttggggtgaattgtaaaaatgaagaactataatttatgtagtgaaataccccattagaagaggattttttgggggacttcaatatgaagaaaaccaagaatgttttgttgggctgtgttgaacattatttctttgtaaatgaatgttgtaggaatgaggacttgggttggtccaacattgactttcttcatcactgcaacatttctctgactagcaatgtgacgatgtaacaaatgagattttctcatttaataataaaaaattgtgtaatgttttgcaaa

SEQ ID NO: 11969 - DNA, 3310 bp, Homo sapiens
ggcccagaacattgcggatcgggtcggcgccattttgggactgagactggttgtgggggagggaaaagcggcaaaaggggattattcaaagtaccgaaaaccttctcccgggatcaggcgcggcggcacccccaggccaggggcacctctggtggggcagaaggtgattgaattactcagatatgaagatcatcatctaggttttgtgtaaaaggccctggatattttaagtggccattttggatttacagtgtttttggataattttgccccagaagtttattaaaattggcaagaatcgtctgtgaagtgaattgatagtagtgaacaattcagcaagctacttaaaaagagacccaggcagcatttcttcagtattttggttcaaacggattatataactggttacagtatttcagctggtggtaatttttgcctccccttcccccaccccgttgttggggttcttcagccgaaactgagagacgttgatttgtgtactgagtagtttcagcagtttcaaatgactgagtattgctgaagtttcatggcagtttatttttacctttattgaaagttttaggaatttttgacttcagctctttcatgtcacaatgggacactttttctgaatgaagagattgaaagaatacagagtttttttccttttatcttttatttacgtggaaatttaagatgttgcagttttccggcagcatggtagtattgagatagctatgtgtgtctctgtatatgctgatgtttaggaatgctcttcagatgtgaaattttctttttgtttttgctttttggctcgtaaattggatatttcatctggagtggacaagtacaacagtggcaagtacatggaataataaagaagactttgatcttaaatctaaagaacttggctaattcgggagatagccatatgaaaactttaaaacagaagtatgggtagctgacttgaagtaactctatgtcaaatagtcgtaggttaagtatcttcaaagaacttcgatattatttcagaggatacaaaataaaaatacaaactggaaaataaagattacagagaaaaaaccaacaccttcctgtgcagtcctgttggaattttcgtcattgaattttgagaagcattctgaaaactttgcatggacagagaatcgttatgatgtgaaccgtcgacgacacaactcttcagatggctttgattctgctattgggcgtcctaatggaggtaactttggaaggaaagaaaaaaatggatggcgtacacatggaagaaatggtacagaaaacataaatcatcgaggtggataccatggtggaagttcccgttctcgtagcagtattttccatgcaggaaaaagccaaggactacatgaaaacaacatacctgacaatgaaaccgggaggaaagaagacaagagagaacgcaaacagtttgaagctgaggattttccgtctttaaatcctgagtatgagagagaaccaaatcacaataagtctttagctgcaggtgtgtgggaatatcctccgaatcctaaatctagagctccaaggatgctggtcattaagaaaggtaatacaaaagacttacagctatctggattcccagtagtaggaaatcttccgtcacagccagttaagaatggaactggtccaagtgtttataaaggtttagtccctaaacctgctgctccacctacaaaacctacacaatggaaaagccaaacaaaagaaaataaagttggaacttctttccctcatgagtccacatttggcgttggcaactttaatgcttttaaatcaactgccaagaactttagtccatctacaaattcagtgaaagagtgtaatcgctcaaattcctcttctcctgttgacaaacttaatcagcagcctcgtctaaccaaactgacacgaatgcgcactgataagaagagtgaatttttgaaagcattgaaaagagacagagtagaagaggaacatgaagatgaaagccgtgctggctcagagaaggatgacgactcatttaatttacataacagcaatagtactcaccaagaaagggatataaaccgaaacttcgatgaaaatgaaattcctcaagagaatggcaatgcctcagtgatttcccagcagatcattcggtcttcaaccttcccacaaactgatgttctttcaagttcacttgaggcagaacacagattgttaaaggaaatgggctggcaggaagacagtgaaaatgatgaaacatgtgctcccttaactgaggatgaaatgagagaattccaagttattagtgaacagttacagaagaatggtctgagaaaaaatggtattttgaaaaatggcttgatctgtgacttcaagtttggaccgtggaagaacagcactttcaaacccacaactgagaatgatgacacagagacaagtagcagtgatacatcagatgacgacgatgtgtgaaggatttcctaacagctttagaaatcttagtgtgatacatctctcatacagtttggggtgaattgtaaaaatgaagaactataatttatgtagtgaaataccccattagaagaggattttttgggggacttcaatatgaagaaaaccaagaatgttttgttgggctgtgttgaacattatttctttgtaaatgaatgttgtaggaatgaggacttgggttggtccaacattgactttcttcatcactgcaacatttctctgactagcaatgtgacgatgtaacaaatgagattttctcatttaataataaaaaattgtgtaatgttttgcaaagcttctgtcttaaaatgtccaggtcttaagaaaaaaggcagcttacactgttttgcttgcagagtcatatctttttcgtacaatggaaatcctcaagtccactttgtgcggtctccctctccttcccccaaaaaacaacaacaacaaaacaaaaaccaaaaaggaaaatgtagcatgttggctaaaactggagcaaagtgcactaaaacaatttcctgaactcacctgttgtactattcaccttttaaaccataaattgctctttagccatttgtagtgcagtaaatgttacaggaaaagacttggcacattttcttccaaattttaagaggtgattttcaaaagctttattggggtatgttgtcagaccagggttttcagagttgatggaaaagagtcttgtgagaaaacttattttgataaattattacacacgcagaaaaactgatcacactgactggatctgtccacgacatggaaaataaactggattttcagaata

SEQ ID NO: 11970 - DNA, 3369 bp, Homo sapiens
atggcgcagcatgactttgctccagcctggcttaatttccctactccaccatcatcaacaaaggtattatcaaataccttgaaatcgtcattgaattttgagaagcattctgaaaactttgcatggacagagaatcgttatgatgtgaaccgtcgacgacacaactcttcagatggctttgattctgctattgggcgtcctaatggaggtaactttggaaggaaagaaaaaaatggatggcgtacacatggaagaaatggtacagaaaacataaatcatcgaggtggataccatggtggaagttcccgttctcgtagcagtattttccatgcaggaaaaagccaaggactacatgaaaacaacatacctgacaatgaaaccgggaggaaagaagacaagagagaacgcaaacagtttgaagctgaggattttccgtctttaaatcctgagtatgagagagaaccaaatcacaataagtctttagctgcaggtgtgtgggaatatcctccgaatcctaaatctagagctccaaggatgctggtcattaagaaaggtaatacaaaagacttacagctatctggattcccagtagtaggaaatcttccgtcacagccagttaagaatggaactggtccaagtgtttataaaggtttagtccctaaacctgctgctccacctacaaaacctacacaatggaaaagccaaacaaaagaaaataaagttggaacttctttccctcatgagtccacatttggcgttggcaactttaatgcttttaaatcaactgccaagaactttagtccatctacaaattcagtgaaagagtgtaatcgctcaaattcctcttctcctgttgacaaacttaatcagcagcctcgtctaaccaaactgacacgaatgcgcactgataagaagagtgaatttttgaaagcattgaaaagagacagagtagaagaggaacatgaagatgaaagccgtgctggctcagagaaggatgacgactcatttaatttacataacagcaatagtactcaccaagaaagggatataaaccgaaacttcgatgaaaatgaaattcctcaagagaatggcaatgcctcagtgatttcccagcagatcattcggtcttcaaccttcccacaaactgatgttctttcaagttcacttgaggcagaacacagattgttaaaggaaatgggctggcaggaagacagtgaaaatgatgaaacatgtgctcccttaactgaggatgaaatgagagaattccaagttattagtgaacagttacagaagaatggtctgagaaaaaatggtattttgaaaaatggcttgatctgtgacttcaagtttggaccgtggaagaacagcactttcaaacccacaactgagaatgatgacacagagacaagtagcagtgatacatcagatgacgacgatgtgtgaaggatttcctaacagctttagaaatcttagtgtgatacatctctcatacagtttggggtgaattgtaaaaatgaagaactataatttatgtagtgaaataccccattagaagaggattttttgggggacttcaatatgaagaaaaccaagaatgttttgttgggctgtgttgaacattatttctttgtaaatgaatgttgtaggaatgaggacttgggttggtccaacattgactttcttcatcactgcaacatttctctgactagcaatgtgacgatgtaacaaatgagattttctcatttaataataaaaaattgtgtaatgttttgcaaagcttctgtcttaaaatgtccaggtcttaagaaaaaaggcagcttacactgttttgcttgcagagtcatatctttttcgtacaatggaaatcctcaagtccactttgtgcggtctccctctccttcccccaaaaaacaacaacaacaaaacaaaaaccaaaaaggaaaatgtagcatgttggctaaaactggagcaaagtgcactaaaacaatttcctgaactcacctgttgtactattcaccttttaaaccataaattgctctttagccatttgtagtgcagtaaatgttacaggaaaagacttggcacattttcttccaaattttaagaggtgattttcaaaagctttattggggtatgttgtcagaccagggttttcagagttgatggaaaagagtcttgtgagaaaacttattttgataaattattacacacgcagaaaaactgatcacactgactggatctgtccacgacatggaaaataaactggattttcagaatattgttgttttctgtagtgttcaaggtattgtttctaaacataaacatactctaaacatgctttattcacttgttaaagtcatacttttaaaagtaataccttactaaagatggtgattacttttccgaggtcagaaaaggaaagctaagcgttttcattatcaaatacacaagcttattaaatgaatgactgttaactactttattttcatttgcacattaattttggaattgtttctgttttgctgctgacggaaatactattttggctctgtgtatatttgtattttgatttttctggtttgtttacccccatttgcttttagctcccccttatgtttaaatatattctaacttatgtaaagagcataatcttagagcaaaaatacttgaggttttatgtcagatctaatcttaagtgtttgttgttttttaaaaagtgttttctcagatggctgcagtgtttttgctatttctgcataaataccctacctggactccccagttttcaccagaaactgttatttttttttgttgttgttcccactgagactgatggtgatggggaaattaaaaacaacacactagcacactcccacaaaacttgaggaagagttagaatggtaataaaatattaaatagaccttatacttaaaataaggtttcactatataatttgtcacaattcaatctaatcagctaaagttaaatgtagttagaattagccacaggagaatgtaaagcatgctttgacgaagctatcggtaacacatattgaatgtctttgagactcttagattgtactatttgcttaatagattaatgaaatttatcagatacaacctgtatttccaaaaacaagctagaaggaacctgaggaatgtggtttacatttgagatccaccttactgtgttttctactttcagaaaagattctgtagttttggtttttggcatctttcttatactcagttttttctgccttaattcccatttaccagcagttaactcatgtttattgtgctttcatgcattgtgatatggaatgtgtttagtaatttactccttataaatatggtaaagtacagtggt

SEQ ID NO: 11971 - DNA, 2568 bp, Homo sapiens
tctggccagaagaaatctggcctcggaacacgccattctccgcgccgcttccaataaccactaacatccctaacgagcatccgagccgagggctctgctcggaaatcgtcctggcccaactcggcccttcgagctctcgaagattaccgcatctatttttttttcttttttttcttttcctagcgcagataaagtgagcccggaaagggaaggagggggcggggacaccattgccctgaaagaataaataagtaaataaacaaactggctcctcgccgcagctggacgcggtcggttgagtccaggttgggtcggacctgaacccctaaaagcggaaccgcctcccgccctcgccatcccggagctgagtcgccggcggcggtggctgctgccagacccggagtttcctctttcactggatggagctgaactttgggcggccagagcagcacagctgtccggggatcgctgcacgctgagctccctcggcaagacccagcggcggctcgggatttttttgggggggcggggaccagccccgcgccggcaccatgttcctggcgaccctgtacttcgcgctgccgctcttggacttgctcctgtcggccgaagtgagcggcggagaccgcctggattgcgtgaaagccagtgatcagtgcctgaaggagcagagctgcagcaccaagtaccgcacgctaaggcagtgcgtggcgggcaaggagaccaacttcagcctggcatccggcctggaggccaaggatgagtgccgcagcgccatggaggccctgaagcagaagtcgctctacaactgccgctgcaagcggggtatgaagaaggagaagaactgcctgcgcatttactggagcatgtaccagagcctgcagggaaatgatctgctggaggattccccatatgaaccagttaacagcagattgtcagatatattccgggtggtcccattcatatcagtggagcacattcccaaagggaacaactgcctggatgcagcgaaggcctgcaacctcgacgacatttgcaagaagtacaggtcggcgtacatcaccccgtgcaccaccagcgtgtccaacgatgtctgcaaccgccgcaagtgccacaaggccctccggcagttctttgacaaggtcccggccaagcacagctacggaatgctcttctgctcctgccgggacatcgcctgcacagagcggaggcgacagaccatcgtgcctgtgtgctcctatgaagagagggagaagcccaactgtttgaatttgcaggactcctgcaagacgaattacatctgcagatctcgccttgcggatttttttaccaactgccagccagagtcaaggtctgtcagcagctgtctaaaggaaaactacgctgactgcctcctcgcctactcggggcttattggcacagtcatgacccccaactacatagactccagtagcctcagtgtggccccatggtgtgactgcagcaacagtgggaacgacctagaagagtgcttgaaatttttgaatttcttcaaggacaatacatgtcttaaaaatgcaattcaagcctttggcaatggctccgatgtgaccgtgtggcagccagccttcccagtacagaccaccactgccactaccaccactgccctccgggttaagaacaagcccctggggccagcagggtctgagaatgaaattcccactcatgttttgccaccgtgtgcaaatttacaggcacagaagctgaaatccaatgtgtcgggcaatacacacctctgtatttccaatggtaattatgaaaaagaaggtctcggtgcttccagccacataaccacaaaatcaatggctgctcctccaagctgtggtctgagcccactgctggtcctggtggtaaccgctctgtccaccctattatctttaacagaaacatcatagctgcattaaaaaaatacaatatggacatgtaaaaagacaaaaaccaagttatctgtttcctgttctcttgtatagctgaaattccagtttaggagctcagttgagaaacagttccattcaactggaacattttttttttttccttttaagaaagcttcttgtgatcctttggggcttctgtgaaaaacctgatgcagtgctccatccaaactcagaaggctttgggatatgctgtattttaaagggacagtttgtaacttgggctgtaaagcaaactggggctgtgttttcgatgatgatgatgatcatgatgatgatcatcatgatcatgatgatgatcatcatgatcatgatgatgattttaacagttttacttctggcctttcctagctagagaaggagttaatatttctaaggtaactcccatatctcctttaatgacattgatttctaatgatataaatttcagcctacattgatgccaagcttttttgccacaaagaagattcttaccaagagtgggctttgtggaaacagctggtactgatgttcacctttatatatgtactagcattttccacgctgatgtttatgtactgtaaacagttctgcactcttgtacaaaagaaaaaac

SEQ ID NO: 11972 - DNA, 1748 bp, Homo sapiens
cgccgggactgcgggccggcgcgctcgccctgggctggggtgcggaagcgcccgagtcctgggcaccgggcgagagtgtgagaggagcggacgcccaggagggagccgaggacgcgcggcgggttgggtcggacctgaacccctaaaagcggaaccgcctcccgccctcgccatcccggagctgagtcgccggcggcggtggctgctgccagacccggagtttcctctttcactggatggagctgaactttgggcggccagagcagcacagctgtccggggatcgctgcacgctgagctccctcggcaagacccagcggcggctcgggatttttttgggggggcggggaccagccccgcgccggcaccatgttcctggcgaccctgtacttcgcgctgccgctcttggacttgctcctgtcggccgaagtgagcggcggagaccgcctggattgcgtgaaagccagtgatcagtgcctgaaggagcagagctgcagcaccaagtaccgcacgctaaggcagtgcgtggcgggcaaggagaccaacttcagcctggcatccggcctggaggccaaggatgagtgccgcagcgccatggaggccctgaagcagaagtcgctctacaactgccgctgcaagcggggtatgaagaaggagaagaactgcctgcgcatttactggagcatgtaccagagcctgcagggaaatgatctgctggaggattccccatatgaaccagttaacagcagattgtcagatatattccgggtggtcccattcatatcagtggagcacattcccaaagggaacaactgcctggatgcagcgaaggcctgcaacctcgacgacatttgcaagaagtacaggtcggcgtacatcaccccgtgcaccaccagcgtgtccaacgatgtctgcaaccgccgcaagtgccacaaggccctccggcagttctttgacaaggtcccggccaagcacagctacggaatgctcttctgctcctgccgggacatcgcctgcacagagcggaggcgacagaccatcgtgcctgtgtgctcctatgaagagagggagaagcccaactgtttgaatttgcaggactcctgcaagacgaattacatctgcagatctcgccttgcggatttttttaccaactgccagccagagtcaaggtctgtcagcagctgtctaaaggaaaactacgctgactgcctcctcgcctactcggggcttattggcacagtcatgacccccaactacatagactccagtagcctcagtgtggccccatggtgtgactgcagcaacagtgggaacgacctagaagagtgcttgaaatttttgaatttcttcaaggacaatacatgtcttaaaaatgcaattcaagcctttggcaatggctccgatgtgaccgtgtggcagccagccttcccagtacagaccaccactgccactaccaccactgccctccgggttaagaacaagcccctggggccagcagggtctgagaatgaaattcccactcatgttttgccaccgtgtgcaaatttacaggcacagaagctgaaatccaatgtgtcgggcaatacacacctctgtatttccaatggtaattatgaaaaagaaggtctcggtgcttccagccacataaccacaaaatcaatggctgctcctccaagctgtggtctgagcccactgctggtcctggtggtaaccgctctgtccaccctattatctttaacagaaacatca

SEQ ID NO: 11973 - DNA, 2592 bp, Homo sapiens
cttccaggttgggtcggacctgaacccctaaaagcggaaccgcctcccgccctcgccatcccggagctgagtcgccggcggcggtggctgctgccagacccggagtttcctctttcactggatggagctgaactttgggcggccagagcagcacagctgtccggggatcgctgcacgctgagctccctcggcaagacccagcggcggctcgggatttttttgggggggcggggaccagccccgcgccggcaccatgttcctggcgaccctgtacttcgcgctgccgctcttggacttgctcctgtcggccgaagtgagcggcggagaccgcctggattgcgtgaaagccagtgatcagtgcctgaaggagcagagctgcagcaccaagtaccgcacgctaaggcagtgcgtggcgggcaaggagaccaacttcagcctggcatccggcctggaggccaaggatgagtgccgcagcgccatggaggccctgaagcagaagtcgctctacaactgccgctgcaagcggggtatgaagaaggagaagaactgcctgcgcatttactggagcatgtaccagagcctgcagggaaatgatctgctggaggattccccatatgaaccagttaacagcagattgtcagatatattccgggtggtcccattcatatcagtggagcacattcccaaagggaacaactgcctggatgcagcgaaggcctgcaacctcgacgacatttgcaagaagtacaggtcggcgtacatcaccccgtgcaccaccagcgtgtccaacgatgtctgcaaccgccgcaagtgccacaaggccctccggcagttctttgacaaggtcccggccaagcacagctacggaatgctcttctgctcctgccgggacatcgcctgcacagagcggaggcgacagaccatcgtgcctgtgtgctcctatgaagagagggagaagcccaactgtttgaatttgcaggactcctgcaagacgaattacatctgcagatctcgccttgcggatttttttaccaactgccagccagagtcaaggtctgtcagcagctgtctaaaggaaaactacgctgactgcctcctcgcctactcggggcttattggcacagtcatgacccccaactacatagactccagtagcctcagtgtggccccatggtgtgactgcagcaacagtgggaacgacctagaagagtgcttgaaatttttgaatttcttcaaggacaatacatgtcttaaaaatgcaattcaagcctttggcaatggctccgatgtgaccgtgtggcagccagccttcccagtacagaccaccactgccactaccaccactgccctccgggttaagaacaagcccctggggccagcagggtctgagaatgaaattcccactcatgttttgccaccgtgtgcaaatttacaggcacagaagctgaaatccaatgtgtcgggcaatacacacctctgtatttccaatggtaattatgaaaaagaaggtctcggtgcttccagccacataaccacaaaatcaatggctgctcctccaagctgtggtctgagcccactgctggtcctggtggtaaccgctctgtccaccctattatctttaacagaaacatcatagctgcattaaaaaaatacaatatggacatgtaaaaagacaaaaaccaagttatctgtttcctgttctcttgtatagctgaaattccagtttaggagctcagttgagaaacagttccattcaactggaacattttttttttttccttttaagaaagcttcttgtgatcctttggggcttctgtgaaaaacctgatgcagtgctccatccaaactcagaaggctttgggatatgctgtattttaaagggacagtttgtaacttgggctgtaaagcaaactggggctgtgttttcgatgatgatgatgatcatgatgatgatcatcatgatcatgatgatgatcatcatgatcatgatgatgattttaacagttttacttctggcctttcctagctagagaaggagttaatatttctaaggtaactcccatatctcctttaatgacattgatttctaatgatataaatttcagcctacattgatgccaagcttttttgccacaaagaagattcttaccaagagtgggctttgtggaaacagctggtactgatgttcacctttatatatgtactagcattttccacgctgatgtttatgtactgtaaacagttctgcactcttgtacaaaagaaaaaacacctgtcacatccaaatatagtatctgtcttttcgtcaaaatagagagtggggaatgagtgtgccgattcaatacctcaatccctgaacgacactctcctaatcctaagccttacctgagtgagaagccctttacctaacaaaagtccaatatagctgaaatgtcgctctaatactctttacacatatgaggttatatgtagaaaaaaattttactactaaatgatttcaactattggctttctatattttgaaagtaatgatattgtctcatttttttactgatggtttaatacaaaatacacagagcttctttcccctca

SEQ ID NO: 11974 - DNA, 9561 bp, Homo sapiens
cagaacactgcgtgtcctgtgcgcgagtacgggtccggccgcgggtcccaccgcaagcgggcgtgtgcagctgcggctgcctggcgggcgagcttaggagggagctggagctgcggagcggcgggaacaggagcaggccgagggtcctctggccagaagaaatctggcctcggaacacgccattctccgcgccgcttccaataaccactaacatccctaacgagcatccgagccgagggctctgctcggaaatcgtcctggcccaactcggcccttcgagctctcgaagattaccgcatctatttttttttcttttttttcttttcctagcgcagataaagtgagcccggaaagggaaggagggggcggggacaccattgccctgaaagaataaataagtaaataaacaaactggctcctcgccgcagctggacgcggtcggttgagtccaggttgggtcggacctgaacccctaaaagcggaaccgcctcccgccctcgccatcccggagctgagtcgccggcggcggtggctgctgccagacccggagtttcctctttcactggatggagctgaactttgggcggccagagcagcacagctgtccggggatcgctgcacgctgagctccctcggcaagacccagcggcggctcgggatttttttgggggggcggggaccagccccgcgccggcaccatgttcctggcgaccctgtacttcgcgctgccgctcttggacttgctcctgtcggccgaagtgagcggcggagaccgcctggattgcgtgaaagccagtgatcagtgcctgaaggagcagagctgcagcaccaagtaccgcacgctaaggcagtgcgtggcgggcaaggagaccaacttcagcctggcatccggcctggaggccaaggatgagtgccgcagcgccatggaggccctgaagcagaagtcgctctacaactgccgctgcaagcggggtatgaagaaggagaagaactgcctgcgcatttactggagcatgtaccagagcctgcagggaaatgatctgctggaggattccccatatgaaccagttaacagcagattgtcagatatattccgggtggtcccattcatatcagatgtttttcagcaagtggagcacattcccaaagggaacaactgcctggatgcagcgaaggcctgcaacctcgacgacatttgcaagaagtacaggtcggcgtacatcaccccgtgcaccaccagcgtgtccaacgatgtctgcaaccgccgcaagtgccacaaggccctccggcagttctttgacaaggtcccggccaagcacagctacggaatgctcttctgctcctgccgggacatcgcctgcacagagcggaggcgacagaccatcgtgcctgtgtgctcctatgaagagagggagaagcccaactgtttgaatttgcaggactcctgcaagacgaattacatctgcagatctcgccttgcggatttttttaccaactgccagccagagtcaaggtctgtcagcagctgtctaaaggaaaactacgctgactgcctcctcgcctactcggggcttattggcacagtcatgacccccaactacatagactccagtagcctcagtgtggccccatggtgtgactgcagcaacagtgggaacgacctagaagagtgcttgaaatttttgaatttcttcaaggacaatacatgtcttaaaaatgcaattcaagcctttggcaatggctccgatgtgaccgtgtggcagccagccttcccagtacagaccaccactgccactaccaccactgccctccgggttaagaacaagcccctggggccagcagggtctgagaatgaaattcccactcatgttttgccaccgtgtgcaaatttacaggcacagaagctgaaatccaatgtgtcgggcaatacacacctctgtatttccaatggtaattatgaaaaagaaggtctcggtgcttccagccacataaccacaaaatcaatggctgctcctccaagctgtggtctgagcccactgctggtcctggtggtaaccgctctgtccaccctattatctttaacagaaacatcatagctgcattaaaaaaatacaatatggacatgtaaaaagacaaaaaccaagttatctgtttcctgttctcttgtatagctgaaattccagtttaggagctcagttgagaaacagttccattcaactggaacattttttttttttccttttaagaaagcttcttgtgatcctttggggcttctgtgaaaaacctgatgcagtgctccatccaaactcagaaggctttgggatatgctgtattttaaagggacagtttgtaacttgggctgtaaagcaaactggggctgtgttttcgatgatgatgatgatcatgatgatgatcatcatgatcatgatgatgatcatcatgatcatgatgatgattttaacagttttacttctggcctttcctagctagagaaggagttaatatttctaaggtaactcccatatctcctttaatgacattgatttctaatgatataaatttcagcctacattgatgccaagcttttttgccacaaagaagattcttaccaagagtgggctttgtggaaacagctggtactgatgttcacctttatatatgtactagcattttccacgctgatgtttatgtactgtaaacagttctgcactcttgtacaaaagaaaaaacacctgtcacatccaaatatagtatctgtcttttcgtcaaaatagagagtggggaatgagtgtgccgattcaatacctcaatccctgaacgacactctcctaatcctaagccttacctgagtgagaagccctttacctaacaaaagtccaatatagctgaaatgtcgctctaatactctttacacatatgaggttatatgtagaaaaaaattttactactaaatgatttcaactattggctttctatattttgaaagtaatgatattgtctcatttttttactgatggtttaatacaaaatacacagagcttctttcccctcataagtagtgttcgctctgatatgaacttcacaaatacagctcatcaaaagcagactctgagaagcctcgtgctgtagcagaaagttctgcatcatgtgactgtggacaggcaggaggaaacagaacagacaagcattgtcttttgtcattgctcgaagtgcaagcgtgcatacctgtggagggaactggtggctgcttgtaaatgttctgcagcatctcttgacacacttgtcatgacacaatccagtaccttggttttcaggttatctgacaaaggcagctttgattgggacatggaggcatgggcaggttctcctttctttggaaacacatccatgctgggatgcacagttcttttcctaaggattgtgtttactcctgactgcaacgtcttggccactgtttggagcagtttggtctgaaggtcattaaggatctgcttgcatcttgtttcatgtcctccgtgacagactgcagaccatgttagaagagaaggaaggtttgtggatcaagagggttgacattaggtttggtgagatgagttgcttggcacagatcagcagaacaggaccctggtgataaggcatctggctttgctaaccacttatcatcttccattattctctttcttaactaagtagacccgaaagtgcacttttgaagtctggtttagatggcgagattccgaatctacaatgatcgagtactggtggccacttttctccaacattaagtaaagaggaggagattccaccttcagaaagtgctgggaagcattggctttcttcccacattggtagaagagatggaggaggaaaccagggtgcacatttctacagatcccctttgcctgctggtgtttgccttgtaagataagtcactggggggaaggggaaatctatgaaatccaagataaaggcatagtctttcagctctattggtgttaaaagtatatttgtgtccaaatgttaatcaacacaaatgtacagtactcagtactgacttttttcacttcaaaatgttttcaagggaaattcagcagacacccaactgtatttaattagtgaaaagatctataaagactcttactttgaataaacacattaagtaagtgtgtcaaaatatttggaatgccagttatctatgagcgcatatctcttacagagtgtattttgttttcattaaggtatctctgtgtatctacactggactaatttcatagggatctgattctatgtgatccactgtagaaagctactgattacttctgcagtaacagcagctctaattagcatcagatgaccaaagcggaaatgggagtttcagcgctaacaagggcagccttcattgaagaatgcatgggtaggcaatatataaattacattttgaaaagcctcatctgtcaccaacaaatatctcatttttcttcagtgataaaagcatattcaagttaccagctcctcaatttgaaaatcagttgctgattaaataaatagggggaagcatcttgttcagggacaacacgttagagagattcttatcaaagcaagccaagcaaggtttccgccattcagtgtgatcttagtttgacacggtgaccctaaaacaccatcatttgccccagaactggagcacaataagttaaatcatttacctgtctcacttcttcttggcgtgcttaaaagcaaaaatgattcgctacttcctgtccttcagtccgggcatttggggtgccactgaagacaggggttatctgctgaggtttgggtgtcttgcaggaagtatctcattgcagttgattttgatgaaaccaaacagtaactagggtccatgcagaccgtgactccctgattacatctagccatgccctacttatttcagagagaaagagagggggaataaaggcagtattgccacactgattagaagcacattcattccactttgatgttgaatatttttgaccgatacatgcttgagtatctttttaatagagcacatgaaggaagaagcacacaatatagagaaggaattgagaatgccaattacatatttatttttccatacctgatttttttcaagtctgtaataaaaaaagtataagttgagattaacataggttatttttcatgaagtatagcaaacgatctagaatgtgataggagtgtggtttccatttctttttttttttttttaacagacttttgtgctgtagtaagaatgtcttagaagttgtgtcttcgagttcctcaaacaccggacagggctcccccagagctgcctcagcctttgatttggtccatattcagacacttcctgtcttgcatacactctgaggatgggccgcttctagctgccgcccgtctccctcttgccttcttgtctctaaatcagacactcccaagcactccatctgctatactaggagagtgggagagccaaagcattttggagtccatgtaaagtgcctgggaaaagagatgtaagagcagtgggagtttatataattagcgaattcttttctcagaattcagcggaaatgtatttctgttgttattatttacaaaattgtggcctcagaggagctgtcttttggaaaataagttttcattcatgcagttagttagacatgcacgatgtacttgaatcaataaactgtggaccagaaaagggctgcttaaatgaattcacgtgttctaattctctttcgaggctgttgatgacctcctggattcatacccccatgatctgtcttgctcttgcctctgttctttgataaagcacatcagactatgtgacacccatcttttcaagaacgacctaaaagcaatgacaacaggcaggagagaattaccactggcctgggcacagtgacagcagaaggcccacctgagcttggagagttggcgagataaggcaaaatcaaggtgcaacagtgggccatgttccaagggtgaatggatctgagagtccgctgatgttccttactgatcagaacagggaccttctaacgaaacagccagagttccttgaatcaggcagaagttctttagagacaggaagccagagctattgataatatccgaacgacagaggaaggaatttcttattagaaattctaaaataaaacaagtggggatttggttggatacccttagaagctacatttttctctcatccctaagatagatatctcaagtgtatatctgacacctcttggctttgacacggctctgcttctcaagtgaccatttgttttaagtctgttgtctagaattctttgtgggggctggacctctgaaaaagattctcactgcagaggctttaaatctgtgtttttttccactccctccgtcctgggatgtattcggtaggacatttcatttatatcaggatattggctgattcagctctctttcatcgttattattcaggcctccctccaccaccttgttctttattgcctaagtattgccctccccaattcttcatcgtaatagctctaaatttagtttgacccaaattaatttttgttccaacagatatattttaagacagagaagcctctctcaggagccagatgatctgaagatgatgctaatccccaaatacgaagttcctccagctaactctcctctgagctccctcttcttagctttgggattggggatggtctcatccttgccaggaatccctttgttgctcccagtgtctctgatgagcttctcctccctcccagagacaatgcaggggtggttttcagcagaatgtgccacctgcacttctgattgttctgagacccagcccagaggggtggagaaggcgcacaaaccctattccaataaactgcctgcagagaaccacagcctgctaatagtcgttgaggtctcagccccctaaggtctccaagctcatttgaccagcgcagctgcgacttcggctgtctgcctctggcaggtgccaatatcagcatcttgtcccactgccatggggagttaatttttgctccagggcagctgccaagcccagcaccggcatcaatagaaggttttctctgattttcttctcttcctctcaggctaggctttcttaccaatccccaattttcttctgtagggcgccaggagactggccagagatctttagactcttacttagtttgaacatctcttgctgctcacacccaggcttcttcagcagaaagcatgacccatagtaggtactcagaaactggttgaatgaaaagccttgacatttaagggctttattctgtcatacggtagcaagaactggcctattggcatcgtattcctggcattgagctgtattgaccctgaatgtgtcctcctgaggtttttgagggtgacctaggagaaagggtctgaaaaagcactgggatccaagtgactttaaatctgcccgtggcatttcctgctgagaggcgagaaactagcatctctcccaacaggctcacatccgccaggaaggacagagcccaaaacgggggtagactttgtgggaaattcgccagttagtccgctgagattttaatctgcctcaagcacaggatgctgacaagaaaggtagaccactcccccgatcccagacaaaccccaggggtgacaacttctccatcagtatcctgagaagcaacatcaaatgcttaccaagtcagcacgtttactgagtgagtactctgacggaataaaccagcatttggagctgaacttgagaacacagggccctctgacagcagcttagggaaacacccatcccttccagattggcagaatccttccatttcatgtccttcggagacgctgtattctctttacaaatcattcatgaaactgagactcagtctcccaggggtaagtcctgggccacgtgcaaacaatggcaaatccagctcttccatgatagagaaggcaaacacacccaccttcatcctgagcctaaaaggccacctctgagcacttgggcagccactcctctgggcctcagagggccatgagcttggccaggtaggcacagcggcggggaagtcacagctgtcaggtaccggccatggtgcaggtgggaataggagatgccagagctgctttagctgaggaaagcaaacagtcagcagtgctcaaaggagcaaaacttcgaatgtgcacattgacccctgacacctgcaagcataacacagatcctaagactagagtgaagtaggaagaagaattagaaaatccagtggatgtcctgagtatagggaaccagggccgttgaaaatcagtaaaggttgattacctggggcgagaccgggtgactgtggcagtgcaggtgaaggtaccctggaccttctcagttcgctggcacataaggctccgccaataaagcgtggttctctctgtcacacacacacacacacacacacacacacacacacacacacacacacacacaatgattggagggctatatgatccagcattagcttcctggtgtgccaagcatgcttgatcgggaatttttttttattattattattttttagctgtagctgaaggcatttctcggatgtggagaggagaatggaaatcgcagaaccaaatcagtttgccctgccatatttggctgtggtctgtcattgggcatttctgatgtgcttttctggattcaggaagagctgattgtcctccgagggttgaaaaaaaaaaaacagtttcagaaacctgaatccagggccttatagttctcctcattatctatcttcttctcccttccctcgcccaagggagtgggggaaacacttttcactgcagagtttgctttaaagttttcccatcttgcgtgcattatcccttgatattaaaattattttctcagtttaatccaactcctgctgagaagctgtgtgagatttaggctgtggggtttttttcttgtactcttttggatggtgttgcatttttcactcttaacccgagggtgtgtttcagcttatgttcgttctgtttcatgcaggtttatagcacggtagagtagaaggcggcttctgatttttagggtatttttagaattcattcctgagtgaggggttcagacacccagtctcctcggaacaggggtgaggggtcgactgagctttgttgagaagcctccagttaggcttcgggcgggtctccatgttatattgtgtgtttactgagcttcccactggtagaagatgacacatttgtccatcgtcctgtgtatctgctttccagaggacaccggagcattctcctggggtcactcccacatggctgcctcacatagctgttttgcaacagcctttattgccaacacccttggaagaacatctcctgtagaagtacaagttttgcaatatggactttggaagtggttttgtgatgttcgaattttctgttagcctattgctcaagcactacagaatgtacatagtccctttggccatcctctcaccccagaatatcctaataaacattgttttctttttt

SEQ ID NO: 11975 - DNA, 1309 bp, Homo sapiens
gtgctagctgctggggagatggtggtgggccagaaagtgcagagtgcaatgccatgtaaagaaggggagaaggagagaggaagagaactaggatgcaggaaggaaagttctggaaggggatggcagagaccggaatgtggggatgtggggagtggattccagtggagcacattcccaaagggaacaactgcctggatgcagcgaaggcctgcaacctcgacgacatttgcaagaagtacaggtcggcgtacatcaccccgtgcaccaccagcgtgtccaacgatgtctgcaaccgccgcaagtgccacaaggccctccggcagttctttgacaaggtcccggccaagcacagctacggaatgctcttctgctcctgccgggacatcgcctgcacagagcggaggcgacagaccatcgtgcctgtgtgctcctatgaagagagggagaagcccaactgtttgaatttgcaggactcctgcaagacgaattacatctgcagatctcgccttgcggatttttttaccaactgccagccagagtcaaggtctgtcagcagctgtctaaaggaaaactacgctgactgcctcctcgcctactcggggcttattggcacagtcatgacccccaactacatagactccagtagcctcagtgtggccccatggtgtgactgcagcaacagtgggaacgacctagaagagtgcttgaaatttttgaatttcttcaaggacaatacatgtcttaaaaatgcaattcaagcctttggcaatggctccgatgtgaccgtgtggcagccagccttcccagtacagaccaccactgccactaccaccactgccctccgggttaagaacaagcccctggggccagcagggtctgagaatgaaattcccactcatgttttgccaccgtgtgcaaatttacaggcacagaagctgaaatccaatgtgtcgggcaatacacacctctgtatttccaatggtaattatgaaaaagaaggtctcggtgcttccagccacataaccacaaaatcaatggctgctcctccaagctgtggtctgagcccactgctggtcctggtggtaaccgctctgtccaccctattatctttaacagaaacatcatagctgcattaaaaaaatacaatatggacatgtaaaaagacaaaaaccaagttatctgtttcctgttctcttgtatagctgaaattccagtttaggagctcagttgagaaacagttccattcaactggaacattttttttttttccttttaagaaagcttcttgtgatcctttggggcttctgtg

SEQ ID NO: 11976 - DNA, 3013 bp, Homo sapiens
ggagagagagagagaggagagagaaagacacacgcacgcagagacacacggtcactggaattccattagaaaaaagtgagccgagcaagggttagcgggagaagatttttttgaatcttgtcttcgtcttggtgcgaaagaagcgactccagtctctcgtcctcgaagctccgactggattgttcttgggcgctgacacccgtctgtggatttcttttctatttgcattttattccgaccccctccctcgccgcttccttccagcccttcactcgcaaatcgcctctctccccacctccccaggcccctcctgggaagcgcaggggaattggacccgcggggactcacgccttcccggacgattggaggggagggctgaccccaggactgggctgttggcttagaaagccgatacacagatacgcgtatatttgattgtagcgggcaaggggggcgtcgagaggcagcagcccatcgcccgcctctcaccccaccccctccagccagaggcgagaatcgcaggactcgggatcttcatcgggtggactagctgggatctccgcattggatttggggctgattaccactgcttgcctattattattgttgttgttactactattatttttttttacccaagggagaaagacaaaaaaacggtgggatttatttaacatgatcttggcaaacgtcttctgcctcttcttctttctaggtgaggagttctacgaagcctccccctatgagccggtgacctcccgcctctcggacatcttcaggcttgcttcaatcttctcagggacaggggcagacccggtggtcagcgccaagagcaaccattgcctggatgctgccaaggcctgcaacctgaatgacaactgcaagaagctgcgctcctcctacatctccatctgcaaccgcgagatctcgcccaccgagcgctgcaaccgccgcaagtgccacaaggccctgcgccagttcttcgaccgggtgcccagcgagtacacctaccgcatgctcttctgctcctgccaagaccaggcgtgcgctgagcgccgccggcaaaccatcctgcccagctgctcctatgaggacaaggagaagcccaactgcctggacctgcgtggcgtgtgccggactgaccacctgtgtcggtcccggctggccgacttccatgccaattgtcgagcctcctaccagacggtcaccagctgccctgcggacaattaccaggcgtgtctgggctcttatgctggcatgattgggtttgacatgacacctaactatgtggactccagccccactggcatcgtggtgtccccctggtgcagctgtcgtggcagcgggaacatggaggaggagtgtgagaagttcctcagggacttcaccgagaacccatgcctccggaacgccatccaggcctttggcaacggcacggacgtgaacgtgtccccaaaaggcccctcgttccaggccacccaggcccctcgggtggagaagacgccttctttgccagatgacctcagtgacagtaccagcttggggaccagtgtcatcaccacctgcacgtctgtccaggagcaggggctgaaggccaacaactccaaagagttaagcatgtgcttcacagagctcacgacaaatatcatcccagggagtaacaaggtgatcaaacctaactcaggccccagcagagccagaccgtcggctgccttgaccgtgctgtctgtcctgatgctgaaactggccttgtaggctgtgggaaccgagtcagaatatttttgaaagctacgcagacaagaacagccgcctgacgaaatggaaacacacacagacacacacacaccttgcaaaaaaaaaattgtttttcccaccttgtcgctgaacctgtctcctcccaggtttcttctctggagaagtttttgtaaaccaaacagacaagcaggcaggcagcctgagagctggcccaggggtcccctggcaggggaaactctggtgccggggagggcacgaggctctagaaatgcccttcactttctcctggtgtttttctctctggacccttctgaagcagagaccggacaagagcctgcagcggaagggactctgggctgtgcctgaggctggctgggggcaggacaacacagctgcttccccaggctgcccactctggggacccgctgggggctggcagagggcatcggtcagcggggcagcggggctggccatgagggtccaccttcagccctttggcttcaaggatggagatggttttgccctccctctctgccctcgggtggggctggtgggtctgcagctggtgtgggaacttccccacggatggcggtggagggggttcgcaccgtgctgggctccccctgactgtagcacggagtgttggggctgggggccagctccaggagggcttgagagctcagcctgcctgggagagcccttgtggcgaggcattaaaacttgggcaccagcttctttctcggtggcagaaattttgaagtcagagagaaacggtcctttgttggcttctttgctttctcgtgggtcctttggcaggcctccctttggggagagggaggggagagaccacagccgggtgtgtgtctgcagcaccgtgggccctcaagctttcctgctgtcttctccctcctcctcctttcccctttctctttcctcatttcctagacgtacgtcaactgtatgtacataccggggctcctctcctaacatatatgtatatacacatccatatacatatattgtgtggtttcccctttctttcctttttttaagcaacaaaactatggaaataataccccaacagatgagcgaaaatgtattattgtaaagtttattttttttaatactgttgtctataatggggaaaaaggacattggccccgcagtgccctgccccagtcagcctggctgggctctggtgggggctcctgatccgcatccaagcttaaccaaggctccaataaacgtgctaggaagc

SEQ ID NO: 11977 - DNA, 2104 bp, Homo sapiens
gggagtggagccagcagctgagaccccggcaagggcaaccatggatctggagttggaacgggacaatgcgccatcaggccggcagaagctggcagatgagggccgagttgcggcacacaggtgccagatctccaaatagaggaaattggaaagaaaaagataaagctaatctgtaatttcatcacccggagacaactgctgttgacattgcattgtgtgtctaaggaggactttgacagggagaaagacaaaaaaacggtgggatttatttaacatgatcttggcaaacgtcttctgcctcttcttctttctagacgagaccctccgctctttggccagcccttcctccctgcagggccccgagctccacggctggcgccccccagtggactgtgtccgggccaatgagctgtgtgccgccgaatccaactgcagctctcgctaccgcactctgcggcagtgcctggcaggccgcgaccgcaacaccatgctggccaacaaggagtgccaggcggccttggaggtcttgcaggagagcccgctgtacgactgccgctgcaagcggggcatgaagaaggagctgcagtgtctgcagatctactggagcatccacctggggctgaccgagggtgaggagttctacgaagcctccccctatgagccggtgacctcccgcctctcggacatcttcaggcttgcttcaatcttctcagggacaggggcagacccggtggtcagcgccaagagcaaccattgcctggatgctgccaaggcctgcaacctgaatgacaactgcaagaagctgcgctcctcctacatctccatctgcaaccgcgagatctcgcccaccgagcgctgcaaccgccgcaagtgccacaaggccctgcgccagttcttcgaccgggtgcccagcgagtacacctaccgcatgctcttctgctcctgccaagaccaggcgtgcgctgagcgccgccggcaaaccatcctgcccagctgctcctatgaggacaaggagaagcccaactgcctggacctgcgtggcgtgtgccggactgaccacctgtgtcggtcccggctggccgacttccatgccaattgtcgagcctcctaccagacggtcaccagctgccctgcggacaattaccaggcgtgtctgggctcttatgctggcatgattgggtttgacatgacacctaactatgtggactccagccccactggcatcgtggtgtccccctggtgcagctgtcgtggcagcgggaacatggaggaggagtgtgagaagttcctcagggacttcaccgagaacccatgcctccggaacgccatccaggcctttggcaacggcacggacgtgaacgtgtccccaaaaggcccctcgttccaggccacccaggcccctcgggtggagaagacgccttctttgccagatgacctcagtgacagtaccagcttggggaccagtgtcatcaccacctgcacgtctgtccaggagcaggggctgaaggccaacaactccaaagagttaagcatgtgcttcacagagctcacgacaaatatcatcccagggagtaacaaggtgatcaaacctaactcaggccccagcagagccagaccgtcggctgccttgaccgtgctgtctgtcctgatgctgaaactggccttgtaggctgtgggaaccgagtcagaatatttttgaaagctacgcagacaagaacagccgcctgacgaaatggaaacacacacagacacacacacaccttgcaaaaaaaaaattgtttttcccaccttgtcgctgaacctgtctcctcccaggtttcttctctggagaagtttttgtaaaccaaacagacaagcaggcaggcagcctgagagctggcccaggggtcccctggcaggggaaactctggtgccggggagggcacgaggctctagaaatgcccttcactttctcctggtgtttttctctctggacccttctgaagcagagaccggacaagagcctgcagcggaagggactctgggctgtgcctgaggctggctgggggcaggacaacacagctgcttccccaggctgcccactctggggacccgctgggggctg

SEQ ID NO: 11978 - DNA, 1503 bp, Homo sapiens
gagaatcgcaggactcgggatcttcatcgggtggactagctgggatctccgcattggatttggggctgattaccactgcttgcctattattattgttgttgttactactattatttttttttacccaagggagaaagacaaaaaaacggtgggatttatttaacatgatcttggcaaacgtcttctgcctcttcttctttctagggacaggggcagacccggtggtcagcgccaagagcaaccattgcctggatgctgccaaggcctgcaacctgaatgacaactgcaagaagctgcgctcctcctacatctccatctgcaaccgcgagatctcgcccaccgagcgctgcaaccgccgcaagtgccacaaggccctgcgccagttcttcgaccgggtgcccagcgagtacacctaccgcatgctcttctgctcctgccaagaccaggcgtgcgctgagcgccgccggcaaaccatcctgcccagctgctcctatgaggacaaggagaagcccaactgcctggacctgcgtggcgtgtgccggactgaccacctgtgtcggtcccggctggccgacttccatgccaattgtcgagcctcctaccagacggtcaccagctgccctgcggacaattaccaggcgtgtctgggctcttatgctggcatgattgggtttgacatgacacctaactatgtggactccagccccactggcatcgtggtgtccccctggtgcagctgtcgtggcagcgggaacatggaggaggagtgtgagaagttcctcagggacttcaccgagaacccatgcctccggaacgccatccaggcctttggcaacggcacggacgtgaacgtgtccccaaaaggcccctcgttccaggccacccaggcccctcgggtggagaagacgccttctttgccagatgacctcagtgacagtaccagcttggggaccagtgtcatcaccacctgcacgtctgtccaggagcaggggctgaaggccaacaactccaaagagttaagcatgtgcttcacagagctcacgacaaatatcatcccagggagtaacaaggtgatcaaacctaactcaggccccagcagagccagaccgtcggctgccttgaccgtgctgtctgtcctgatgctgaaactggccttgtaggctgtgggaaccgagtcagaatatttttgaaagctacgcagacaagaacagccgcctgacgaaatggaaacacacacagacacacacacaccttgcaaaaaaaaaattgtttttcccaccttgtcgctgaacctgtctcctcccaggtttcttctctggagaagtttttgtaaaccaaacagacaagcaggcaggcagcctgagagctggcccaggggtcccctggcaggggaaactctggtgccggggagggcacgaggctctagaaatgcccttcactttctcctggtgtttttctctctggacccttctgaagcagagaccggacaagagcctgcagcgg

SEQ ID NO: 11979 - DNA, 874 bp, Homo sapiens
gccgtagccgggggagccagtcagtttccggccaaggcagcagggagaaagacaaaaaaacggtgggatttatttaacatgatcttggcaaacgtcttctgcctcttcttctttctagacgagaccctccgctctttggccagcccttcctccctgcagggccccgagctccacggctggcgccccccagtggactgtgtccgggccaatgagctgtgtgccgccgaatccaactgcagctctcgctaccgcactctgcggcagtgcctggcaggccgcgaccgcaacaccatgctggccaacaaggagtgccaggcggccttggaggtcttgcaggagagcccgctgtacgactgccgctgcaagcggggcatgaagaaggagctgcagtgtctgcagatctactggagcatccacctggggctgaccgagggtgaggagttctacgaagcctccccctatgagccggtgacctcccgcctctcggacatcttcaggcttgcttcaatcttctcagggacaggggcagacccggtggtcagcgccaagagcaaccattgcctggatgctgccaaggcctgcaacctgaatgacaactgcaagaagctgcgctcctcctacatctccatctgcaaccgcgagatctcgcccaccgagcgctgcaaccgccgcaagtgccacaaggccctgcgccagttcttcgaccgggtgcccagcgagtacacctaccgcatgctcttctgctcctgccaagaccaggcgtgcgctgagcgccgccggcaaaccatcctgcccagctgctcctatgaggacaaggagaagcccaactgcctggacctgcgtggcgtgtgccggactgaccacctgtgtcggt

SEQ ID NO: 11980 - DNA, 4921 bp, Homo sapiens
aagacacacgcacgcagagacacacggtcactggaattccattagaaaaaagtgagccgagcaagggttagcgggagaagatttttttgaatcttgtcttcgtcttggtgcgaaagaagcgactccagtctctcgtcctcgaagctccgactggattgttcttgggcgctgacacccgtctgtggatttcttttctatttgcattttattccgaccccctccctcgccgcttccttccagcccttcactcgcaaatcgcctctctccccacctccccaggcccctcctgggaagcgcaggggaattggacccgcggggactcacgccttcccggacgattggaggggagggctgaccccaggactgggctgttggcttagaaagccgatacacagatacgcgtatatttgattgtagcgggcaaggggggcgtcgagaggcagcagcccatcgcccgcctctcaccccaccccctccagccagaggcgagaatcgcaggactcgggatcttcatcgggtggactagctgggatctccgcattggatttggggctgattaccactgcttgcctattattattgttgttgttactactattatttttttttacccaagggagaaagacaaaaaaacggtgggatttatttaacatgatcttggcaaacgtcttctgcctcttcttctttctagacgagaccctccgctctttggccagcccttcctccctgcagggccccgagctccacggctggcgccccccagtggactgtgtccgggccaatgagctgtgtgccgccgaatccaactgcagctctcgctaccgcactctgcggcagtgcctggcaggccgcgaccgcaacaccatgctggccaacaaggagtgccaggcggccttggaggtcttgcaggagagcccgctgtacgactgccgctgcaagcggggcatgaagaaggagctgcagtgtctgcagatctactggagcatccacctggggctgaccgagggtgaggagttctacgaagcctccccctatgagccggtgacctcccgcctctcggacatcttcaggcttgcttcaatcttctcagggacaggggcagacccggtggtcagcgccaagagcaaccattgcctggatgctgccaaggcctgcaacctgaatgacaactgcaagaagctgcgctcctcctacatctccatctgcaaccgcgagatctcgcccaccgagcgctgcaaccgccgcaagtgccacaaggccctgcgccagttcttcgaccgggtgcccagcgagtacacctaccgcatgctcttctgctcctgccaagaccaggcgtgcgctgagcgccgccggcaaaccatcctgcccagctgctcctatgaggacaaggagaagcccaactgcctggacctgcgtggcgtgtgccggactgaccacctgtgtcggtcccggctggccgacttccatgccaattgtcgagcctcctaccagacggtcaccagctgccctgcggacaattaccaggcgtgtctgggctcttatgctggcatgattgggtttgacatgacacctaactatgtggactccagccccactggcatcgtggtgtccccctggtgcagctgtcgtggcagcgggaacatggaggaggagtgtgagaagttcctcagggacttcaccgagaacccatgcctccggaacgccatccaggcctttggcaacggcacggacgtgaacgtgtccccaaaaggcccctcgttccaggccacccaggcccctcgggtggagaagacgccttctttgccagatgacctcagtgacagtaccagcttggggaccagtgtcatcaccacctgcacgtctgtccaggagcaggggctgaaggccaacaactccaaagagttaagcatgtgcttcacagagctcacgacaaatatcatcccagggagtaacaaggtgatcaaacctaactcaggccccagcagagccagaccgtcggctgccttgaccgtgctgtctgtcctgatgctgaaactggccttgtaggctgtgggaaccgagtcagaatatttttgaaagctacgcagacaagaacagccgcctgacgaaatggaaacacacacagacacacacacaccttgcaaaaaaaaaattgtttttcccaccttgtcgctgaacctgtctcctcccaggtttcttctctggagaagtttttgtaaaccaaacagacaagcaggcaggcagcctgagagctggcccaggggtcccctggcaggggaaactctggtgccggggagggcacgaggctctagaaatgcccttcactttctcctggtgtttttctctctggacccttctgaagcagagaccggacaagagcctgcagcggaagggactctgggctgtgcctgaggctggctgggggcaggacaacacagctgcttccccaggctgcccactctggggacccgctgggggctggcagagggcatcggtcagcggggcagcggggctggccatgagggtccaccttcagccctttggcttcaaggatggagatggttttgccctccctctctgccctcgggtggggctggtgggtctgcagctggtgtgggaacttccccacggatggcggtggagggggttcgcaccgtgctgggctccccctgactgtagcacggagtgttggggctgggggccagctccaggagggcttgagagctcagcctgcctgggagagcccttgtggcgaggcattaaaacttgggcaccagcttctttctcggtggcagaaattttgaagtcagagagaaacggtcctttgttggcttctttgctttctcgtgggtcctttggcaggcctccctttggggagagggaggggagagaccacagccgggtgtgtgtctgcagcaccgtgggccctcaagctttcctgctgtcttctccctcctcctcctttcccctttctctttcctcatttcctagacgtacgtcaactgtatgtacataccggggctcctctcctaacatatatgtatatacacatccatatacatatattgtgtggtttcccctttctttcctttttttaagcaacaaaactatggaaataataccccaacagatgagcgaaaatgtattattgtaaagtttattttttttaatactgttgtctataatggggaaaaaggacattggccccgcagtgccctgccccagtcagcctggctgggctctggtgggggctcctgatccgcatccaagcttaaccaaggctccaataaacgtgctaggaagcaagctgcctctgcctcggtcccgtggggttttgcccccattttgttcttggtccagtgttacctgcgtaagtggagctcccagtgggctggggaaatgtgtgtccgtgtgtgtgcctgtgtgcatgtgtgtgcatccatgtgtctcacccatgtgtccacattgtgtgtagatggagctctcttaggagctggtttgacactgggggcgggatctgagggtccacgctgtgctgagcctggtgggctgttctgttccctctttgctcacttctccagttggcgcaaatgcctgtggctcccaggctggaagagaatgcagtggacgtggacgtggtggggagccacagcttggcatcacacgttgggaatgttttattgtcaggctgtctgggtggccctgttagtcttacatagagcaaagtggtatgtccctctgggactcctggcttatttgagatgtgtgattgtgagtgcagtgacctggccttttgggtcccaccagagaagaaggacatgactgtgcatgttctggggtcatggtctgaaagcataagtattttttgggtctccctctattccttcctttcctgtttctccatttgctacccaggccccacttggacactaggcctgccatagtctccaagagagattctccccagagaggaccaggagaatgcctgctggccaagtgtgtgtgtgtccatgtatgtgagcatgtgtacatgtgtgtgcggtcgtgtgcaggctcgcacatgttcacgtgcacgtgtgaatatatacccatggcaggagggagaatggaagactggtaggcgagaagatgtttctactgtcagcctggccttcagggctgcatgtgagcccatcccatttcaactggacaataggatgcagttttcccatctcccaatcgcaggtcccctcaatggcttttgcttctggttgtatatgtgtgagcagcatccgttcacagcgtttatcactgtggtgtattgccttccagcctctgcatggaaggggtacagtgagccagccaggtctctgtccagccattgcgggtagacgtggtcatggcatccacttaggaatccgtgttctttgcaaacagcaaagaccatttaacttaaaaagtactttactggaaggctatgggagaaggtggctcacggaatttgtgggaggtggggggaccaggggaggcgagggcagggactggagggcatctgaggggctggaaggcaggatgtacagggtcagcattctgctgccaaccattgcccatctggctgaactgggccttgtgcctgccctctgccatacttgagtgtgagagagaggatatatatgtcatgtctggtatccctaataggaggtaagcccttaggctacatcatgggggagagaaaatttcccaagaggaaactgaggtgccattatgaaggaggagtggatactagctagctttactctgccctcaaatgtctccctatccaagtatcacatggctgaaattttaccattaggtattcattcctttggttgagatgattcctatttgtgattctctcaaaatatgcaaatcgaactagaagaataaattgttgctatcttaa

SEQ ID NO: 11981 - DNA, 2039 bp, Homo sapiens
gcggctcccggggcgccggccctcccccgcccccacccccgcggtccctcggaccagcgctggaggcgcgtggtgtggacgcgcgcttcggagttggagggcggcgcccaggaccctggtgggagagtgtgtgcgtcgcgctggagggcgggaggcgggggcgggaggtgccggtcgagggagccccgctctcagagctccaggggaggagcgaggggagcgcggagcccggcgcctacagctcgccatggtgcgccccctgaacccgcgaccgctgccgcccgtagtcctgatgttgctgctgctgctgccgccgtcgccgctgcctctcgcagccggagacccccttcccacagaaagccgactcatgaacagctgtctccaggccaggaggaagtgccaggctgatcccacctgcagtgctgcctaccaccacctggattcctgcacctctagcataagcaccccactgccctcagaggagccttcggtccctgctgactgcctggaggcagcacagcaactcaggaacagctctctgataggctgcatgtgccaccggcgcatgaagaaccaggttgcctgcttggacatctattggaccgttcaccgtgcccgcagccttggtaactatgagctggatgtctccccctatgaagacacagtgaccagcaaaccctggaaaatgaatctcagcaaactgaacatgctcaaaccagactcagacctctgcctcaagtttgccatgctgtgtactctcaatgacaagtgtgaccggctgcgcaaggcctacggggaggcgtgctccgggccccactgccagcgccacgtctgcctcaggcagctgctcactttcttcgagaaggccgccgagccccacgcgcagggcctgctactgtgcccatgtgcccccaacgaccggggctgcggggagcgccggcgcaacaccatcgcccccaactgcgcgctgccgcctgtggcccccaactgcctggagctgcggcgcctctgcttctccgacccgctttgcagatcacgcctggtggatttccagacccactgccatcccatggacatcctaggaacttgtgcaacagagcagtccagatgtctacgagcatacctggggctgattgggactgccatgacccccaactttgtcagcaatgtcaacaccagtgttgccttaagctgcacctgccgaggcagtggcaacctgcaggaggagtgtgaaatgctggaagggttcttctcccacaacccctgcctcacggaggccattgcagctaagatgcgttttcacagccaactcttctcccaggactggccacaccctacctttgctgtgatggcacaccagaatgaaaaccctgctgtgaggccacagccctgggtgccctctcttttctcctgcacgcttcccttgattctgctcctgagcctatggtagctggacttccccagggccctcttcccctccaccacacccaggtggacttgcagcccacaaggggtgaggaaaggacagcagcaggaaggaggtgcagtgcgcagatgagggcacaggagaagctaagggttatgacctccagatccttactggtccagtcctcattccctccaccccatctccacttctgattcatgctgcccctccttggtggccacaatttagccatgtcatctggtggtgaccagctccaccaagcccctttctgagcccttcctcttgactaccaggatcaccagaatctaataagttagccattctctattgcattccagattagggttagggtagggaggactgggtgttctgaggcagcctagaaagtcattctcctttgtgaagaaggctcctgccccctcgtctcctcctctgagtggaggatggaaaactactgcctgcactgccctgtccccggatcctgccgaacatctgggcatcaggagctggagcctgtgggccttgctttattcctattattgtcctaaagtctctctgggctcttggatcatgattaaacctttgacttaag

SEQ ID NO: 11982 - DNA, 1837 bp, Homo sapiens
cccaggaccctggtgggagagtgtgtgcgtcgcgctggagggcgggaggcgggggcgggaggtgccggtcgagggagccccgctctcagagctccaggggaggagcgaggggagcgcggagcccggcgcctacagctcgccatggtgcgccccctgaacccgcgaccgctgccgcccgtagtcctgatgttgctgctgctgctgccgccgtcgccgctgcctctcgcagccggagacccccttcccacagaaagccgactcatgaacagctgtctccaggccaggaggaagtgccaggctgatcccacctgcagtgctgcctaccaccacctggattcctgcacctctagcataagcaccccactgccctcagaggagccttcggtccctgctgactgcctggaggcagcacagcaactcaggaacagctctctgataggctgcatgtgccaccggcgcatgaagaaccaggttgcctgcttggacatctattggaccgttcaccgtgcccgcagccttgactcagacctctgcctcaagtttgccatgctgtgtactctcaatgacaagtgtgaccggctgcgcaaggcctacggggaggcgtgctccgggccccactgccagcgccacgtctgcctcaggcagctgctcactttcttcgagaaggccgccgagccccacgcgcagggcctgctactgtgcccatgtgcccccaacgaccggggctgcggggagcgccggcgcaacaccatcgcccccaactgcgcgctgccgcctgtggcccccaactgcctggagctgcggcgcctctgcttctccgacccgctttgcagatcacgcctggtggatttccagacccactgccatcccatggacatcctaggaacttgtgcaacagagcagtccagatgtctacgagcatacctggggctgattgggactgccatgacccccaactttgtcagcaatgtcaacaccagtgttgccttaagctgcacctgccgaggcagtggcaacctgcaggaggagtgtgaaatgctggaagggttcttctcccacaacccctgcctcacggaggccattgcagctaagatgcgttttcacagccaactcttctcccaggactggccacaccctacctttgctgtgatggcacaccagaatgaaaaccctgctgtgaggccacagccctgggtgccctctcttttctcctgcacgcttcccttgattctgctcctgagcctatggtagctggacttccccagggccctcttcccctccaccacacccaggtggacttgcagcccacaaggggtgaggaaaggacagcagcaggaaggaggtgcagtgcgcagatgagggcacaggagaagctaagggttatgacctccagatccttactggtccagtcctcattccctccaccccatctccacttctgattcatgctgcccctccttggtggccacaatttagccatgtcatctggtggtgaccagctccaccaagcccctttctgagcccttcctcttgactaccaggatcaccagaatctaataagttagccattctctattgcattccagattagggttagggtagggaggactgggtgttctgaggcagcctagaaagtcattctcctttgtgaagaaggctcctgccccctcgtctcctcctctgagtggaggatggaaaactactgcctgcactgccctgtccccggatcctgccgaacatctgggcatcaggagctggagcctgtgggccttgctttattcctattattgtcctaaagtctctctgggctcttggatcatgattaaacctttgactt

SEQ ID NO: 11983 - DNA, 4835 bp, Homo sapiens
gttcctaccggcctggtccagcggacagcggctgcagcgggggcgccggctgggagctgtttttggaaggaagaaagatggaaagcggtgcagttctgctggaatccaaatcctccccatttaacctactgcatgagatgcatgagcttcgcctcctgggtcacctgtgtgacgtgacagtcagcgtggagtatcagggtgtccgcaaagacttcatggcccacaaggcagtgctggctgccaccagcaagttttttaaggaagtgttccttaatgagaagagtgtggatggtactaggactaatgtctacttaaatgaagtgcaggttgctgactttgcttcatttcttgagtttgtctacactgcaaaggtacaggtggaagaagatcgggtgcagcgaatgctggaagtggctgaaaagctgaaatgtttggatttatcagaaacttgttttcaattaaagaaacagatgttagagtcagtacttttggagttgcaaaatttctcagagtctcaggaggtggaggtgagcagtggctcccaagttagtgctgctcctgcccccagggcaagtgtggccaccgatggccctcaccccagtggtctcacggattccttggactacccaggagagagagccagcaatggcatgtcttcagatttgccaccgaagaagtccaaggacaaactagacaagaagaaagaggtagttaaacctccctaccctaaaatcaggagagctagtggaaggctggctgggaggaaggtctttgtggagatccctaaaaagaaatatacgagaagactccgagagcagcagaaaactgctgagggtgatgtgggggactacaggtgtccccaggaccaaagcccggacagggtgggcacggagatggagcaggtttccaaaaatgagggttgccaggcaggtgctgagttggaggaattgtcaaagaaagcagggccggaggaggaagaggaggaggaggaggaggacgaagaaggggagaagaagaagagcaactttaagtgcagcatttgcgagaaggcgtttctgtatgagaagagcttcctgaagcacagcaagcaccgccacggcgtggccaccgaggtggtgtaccgctgcgacacctgcggccagaccttcgccaaccgctgcaacctgaagagccaccagcgccacgtgcacagcagcgagcgccatttcccatgcgagctgtgcgggaagaagttcaagcgcaagaaggacgtgaagcggcacgtgctgcaggtgcatgagggcggcggcgagcggcaccgctgcggccagtgcggcaagggcctgagttccaagacagcgctgcggctgcacgagcgcacacacacgggagaccggccctacggctgcaccgagtgcggcgccaggttctcgcagccgtccgcgctcaagacgcacatgagaattcatacaggggaaaaaccttttgtctgtgatgaatgtggtgcaagattcactcagaaccacatgctgatttatcataaaaggtgtcacacaggtgaaagaccttttatgtgtgaaacatgtggcaagagttttgcttctaaggagtacttaaaacaccacaatagaatccatactggatccaaaccctttaaatgtgaagtatgtttcaggacttttgcccagcggaattcactgtaccagcatattaaagtccacacaggggagcgtccctactgctgtgaccagtgcggcaagcagttcacccagctcaacgccctccagcgccaccgccgcatccacacaggggagaggccattcatgtgcaatgcgtgcggacggacattcaccgacaagtccactcttcggcggcacacctcaatacacgataagaatactccatggaagtctttccttgtcattgtagatggctcgcccaagaacgatgacggacacaagactgaacagcctgacgaagagtatgtgtcatccaagctttcggataaattgctgtcttttgcagaaaatggccatttccacaacctggctgcagtccaagacactgtacctaccatgcaggagaacagttctgctgacacagcctgcaaggcagatgactccgtggtgtcccaggacaccctcctggccaccaccatcagtgagcttagcgagctgaccccacagacagactcgatgcccacacagcttcactctttgagcaacatggaataagagcttcaagcagttcccatcctgttagtctgcgtgtgtggtagctgaactcaagatgatgtggggctaagaaaaataattgtccatgtgcaaagatgtgggcaagaatggcctctgcagattttcctgaacttctgctaacttgcacggctttatcacagcatttttaaagctttccctcaaaaatcctgatctgcatgatctcagctactttattgacaaaaaggcagtgaacataacctcacttaattctggtgtagggtgtatgtgctaatcgttctaattcttgattacctagtttatagataactgctggtcttaattgcagagtacagagaactgaaccagctcctgatattgtagttagcagtcttcctggcttctcactctgccttatatttccatgtgggtttacttctctcataactactttcaaggtatttttcttccaagctgaaataaaactggggccacatattttcagtcatttcttccctgttgaattgaagcaaatcagattttctgtggggaccctcaaatgcaactgaagaaatagattgttgcattcattcctccccaccccccatttgtaggcagtaaacaaagtatgactgacagattgaacacctgcaaaactgctagcgtaatctcagcacatacgcagctaggaagtttgtcataaaatcaacttagaaatgagatgaggctgttcagtttgtcttaaaaaaatcagattaggtaaaagctgtcctaccaaagagtctagcaaaacaatatagtatttttttgcagaggcatgaaaaattaagacgctttagagtacttgaaagttgtgtagtcattttatttgcaaaatgaggtgactgtggcaaattatagaacacagagtattattacttttgccaggtttttctgacttgatttctgtaatttccagaaacccagacttctcatttccacacctagagatggaaacaggcaagtaactgacatgtctatttccttgggagcatgtgagaacatagcagtagggaccaaaagtctcagcacacttacctccgattatgccttaaagagttgattgtgaagaaccagtaactttgtcccaaatgcttctttggctgtttcatgcaggacttaattattgcttttaaaaattcacaatgaaaagacgattctgctgtatttgttaaacgttgacatttggttctagggccttgagtatgtgccacgtgcttgtgaaatgctatgattcacatgtaacatttaaacattaatttaaaaagggaaccttggagaattcttttgttcactagttccttttttctctacatttttaatttattaaacttgctgtgaaaacactttgattttctaagaggaaggtactttaagttccagaatgaacatgtagctgcactatgccagaaattaatgagggaagactttcttcctaagtgcttatgttttaacttatgttagtgaaaccactacaaggtgtttcaggcgctgataacatgcttcacacctgcccttggaggtcacagtactaatttacttcaaatttagttatgacagtgtcactgtatcctagttatgtttacagcacaaataaataatgactgtcatacatccagaggagaccgaacctgcccagctgatgtactgttttatggaataaagtcacttgatcagaaggaattgaaacaatagatcattttgttacctactggagggatttttgtcttgaatttgtttccttagaaattctacaaaaaaatgttgttaataaatgtctgctttgtaaaagcagttttgcaattttttaaagatctatttctgttataatttaggttctgcagaaatatgattcttaattgaaacatataatttgcttaattacgtgaataatgaaatgtaaaatccgggtccataagcctttatttcatacagtcctaggattaagctgtttaactgcttggatcccagttggtctctggcagtgggatcctggagaggagaaatcctggcctctgctcatgcgcaggccacaaccgggctggaagtgcggttgagctctctgccactttcttcaatgtaaaaagtaggcatcaaagatacgacttctactatatacatttctctgtccctgagaacagagaaacgtaaccctgtaggggactggttacagaggacctcctggagcatctgccccattcctccaagtccaagcacagccatgctgagtggaagcgaggccaccatctgagtggattggtcccaagtgtgtaatgaggaaagtggccaggtgccggcacagtgcctctcccagagcctcaagaagggccatttaggagcttgcttcaaccattttccaaccattttctgtgaaatgctgtcagcccaaactccaaagggatgtgcagcctttcgttttaccaaattctttgctgtcgtttggaaaaaatgggccatgtggtggagacctttatttaaggtgatttttacagaaatgtgattttgctgtaggtgattatccaaacaagtaaatttgagtgtataatttaatttttaacctgttaaataaaccttgtccctccaaggagttcatttttgggaaac

SEQ ID NO: 11984 - DNA, 4740 bp, Homo sapiens
atggaaagcggtgcagttctgctggaatccaaatcctccccatttaacctactgcatgagatgcatgagcttcgcctcctgggtcacctgtgtgacgtgacagtcagcgtggagtatcagggtgtccgcaaagacttcatggcccacaaggcagtgctggctgccaccagcaagttttttaaggaagtgttccttaatgagaagagtgtggatggtactaggactaatgtctacttaaatgaagtgcaggttgctgactttgcttcatttcttgagtttgtctacactgcaaaggtacaggtggaagaagatcgggtgcagcgaatgctggaagtggctgaaaagctgaaatgtttggatttatcagaaacttgttttcaattaaagaaacagatgttagagtcagtacttttggagttgcaaaatttctcagagtctcaggaggtggaggtgagcagtggctcccaagttagtgctgctcctgcccccagggcaagtgtggccaccgatggccctcaccccagtggtctcacggattccttggactacccaggagagagagccagcaatggcatgtcttcagatttgccaccgaagaagtccaaggacaaactagacaagaagaaagaggtagttaaacctccctaccctaaaatcaggagagctagtggaaggctggctgggaggaaggtctttgtggagatccctaaaaagaaatatacgagaagactccgagagcagcagaaaactgctgagggtgatgtgggggactacaggtgtccccaggaccaaagcccggacagggtgggcacggagatggagcaggtttccaaaaatgagggttgccaggcaggtgctgagttggaggaattgtcaaagaaagcagggccggaggaggaagaggaggaggaggaggaggacgaagaaggggagaagaagaagagcaactttaagtgcagcatttgcgagaaggcgtttctgtatgagaagagcttcctgaagcacagcaagcaccgccacggcgtggccaccgaggtggtgtaccgctgcgacacctgcggccagaccttcgccaaccgctgcaacctgaagagccaccagcgccacgtgcacagcagcgagcgccatttcccatgcgagctgtgcgggaagaagttcaagcgcaagaaggacgtgaagcggcacgtgctgcaggtgcatgagggcggcggcgagcggcaccgctgcggccagtgcggcaagggcctgagttccaagacagcgctgcggctgcacgagcgcacacacacgggagaccggccctacggctgcaccgagtgcggcgccaggttctcgcagccgtccgcgctcaagacgcacatgagaattcatacaggggaaaaaccttttgtctgtgatgaatgtggtgcaagattcactcagaaccacatgctgatttatcataaaaggtgtcacacaggtgaaagaccttttatgtgtgaaacatgtggcaagagttttgcttctaaggagtacttaaaacaccacaatagaatccatactggatccaaaccctttaaatgtgaagtatgtttcaggacttttgcccagcggaattcactgtaccagcatattaaagtccacacaggggagcgtccctactgctgtgaccagtgcggcaagcagttcacccagctcaacgccctccagcgccaccgccgcatccacacaggggagaggccattcatgtgcaatgcgtgcggacggacattcaccgacaagtccactcttcggcggcacacctcaatacacgataagaatactccatggaagtctttccttgtcattgtagatggctcgcccaagaacgatgacggacacaagactgaacagcctgacgaagagtatgtgtcatccaagctttcggataaattgctgtcttttgcagaaaatggccatttccacaacctggctgcagtccaagacactgtacctaccatgcaggagaacagttctgctgacacagcctgcaaggcagatgactccgtggtgtcccaggacaccctcctggccaccaccatcagtgagcttagcgagctgaccccacagacagactcgatgcccacacagcttcactctttgagcaacatggaataagagcttcaagcagttcccatcctgttagtctgcgtgtgtggtagctgaactcaagatgatgtggggctaagaaaaataattgtccatgtgcaaagatgtgggcaagaatggcctctgcagattttcctgaacttctgctaacttgcacggctttatcacagcatttttaaagctttccctcaaaaatcctgatctgcatgatctcagctactttattgacaaaaaggcagtgaacataacctcacttaattctggtgtagggtgtatgtgctaatcgttctaattcttgattacctagtttatagataactgctggtcttaattgcagagtacagagaactgaaccagctcctgatattgtagttagcagtcttcctggcttctcactctgccttatatttccatgtgggtttacttctctcataactactttcaaggtatttttcttccaagctgaaataaaactggggccacatattttcagtcatttcttccctgttgaattgaagcaaatcagattttctgtggggaccctcaaatgcaactgaagaaatagattgttgcattcattcctccccaccccccatttgtaggcagtaaacaaagtatgactgacagattgaacacctgcaaaactgctagcgtaatctcagcacatacgcagctaggaagtttgtcataaaatcaacttagaaatgagatgaggctgttcagtttgtcttaaaaaaatcagattaggtaaaagctgtcctaccaaagagtctagcaaaacaatatagtatttttttgcagaggcatgaaaaattaagacgctttagagtacttgaaagttgtgtagtcattttatttgcaaaatgaggtgactgtggcaaattatagaacacagagtattattacttttgccaggtttttctgacttgatttctgtaatttccagaaacccagacttctcatttccacacctagagatggaaacaggcaagtaactgacatgtctatttccttgggagcatgtgagaacatagcagtagggaccaaaagtctcagcacacttacctccgattatgccttaaagagttgattgtgaagaaccagtaactttgtcccaaatgcttctttggctgtttcatgcaggacttaattattgcttttaaaaattcacaatgaaaagacgattctgctgtatttgttaaacgttgacatttggttctagggccttgagtatgtgccacgtgcttgtgaaatgctatgattcacatgtaacatttaaacattaatttaaaaagggaaccttggagaattcttttgttcactagttccttttttctctacatttttaatttattaaacttgctgtgaaaacactttgattttctaagaggaaggtactttaagttccagaatgaacatgtagctgcactatgccagaaattaatgagggaagactttcttcctaagtgcttatgttttaacttatgttagtgaaaccactacaaggtgtttcaggcgctgataacatgcttcacacctgcccttggaggtcacagtactaatttacttcaaatttagttatgacagtgtcactgtatcctagttatgtttacagcacaaataaataatgactgtcatacatccagaggagaccgaacctgcccagctgatgtactgttttatggaataaagtcacttgatcagaaggaattgaaacaatagatcattttgttacctactggagggatttttgtcttgaatttgtttccttagaaattctacaaaaaaatgttgttaataaatgtctgctttgtaaaagcagttttgcaattttttaaagatctatttctgttataatttaggttctgcagaaatatgattcttaattgaaacatataatttgcttaattacgtgaataatgaaatgtaaaatccgggtccataagcctttatttcatacagtcctaggattaagctgtttaactgcttggatcccagttggtctctggcagtgggatcctggagaggagaaatcctggcctctgctcatgcgcaggccacaaccgggctggaagtgcggttgagctctctgccactttcttcaatgtaaaaagtaggcatcaaagatacgacttctactatatacatttctctgtccctgagaacagagaaacgtaaccctgtaggggactggttacagaggacctcctggagcatctgccccattcctccaagtccaagcacagccatgctgagtggaagcgaggccaccatctgagtggattggtcccaagtgtgtaatgaggaaagtggccaggtgccggcacagtgcctctcccagagcctcaagaagggccatttaggagcttgcttcaaccattttccaaccattttctgtgaaatgctgtcagcccaaactccaaagggatgtgcagcctttcgttttaccaaattctttgctgtcgtttggaaaaaatgggccatgtggtggagacctttatttaaggtgatttttacagaaatgtgattttgctgtaggtgattatccaaacaagtaaatttgagtgtataatttaatttttaacctgttaaataaaccttgtccctccaagg

SEQ ID NO: 11985 - DNA, 795 bp, Homo sapiens
ggacctgcgcgtctcggggatgcgggagcgggggcagggggcggcccgagggcctgatccacgcggccccggatgcccgcgtcgggaggcggcgcgtcgggccgaggaggggcttctctgtggctgcagtagtttgttctctgggtcgtctttggagtggccgagcggcgtccgggcgctggggcggccaagtggcgcgggaagggtgggaggtgccgtgagggcggcgaggacagcggcggatttaagccccactggaaaccccggcccttgtggccgtggactgggctgcgggtagcagcgtctcctggaagggctctggccccgtgagcctcggggattcaggggccgccgacgttggtgcagatgccgggcgcactgggaggcggccggaatgccaatgagattcggcggatacgcagctgtcaccggccgcagactgccctgtcgccacctccagtgcctgcactccagtagccaagcaacataggaaatcgcgctcagaacccactttgttgattgagaaatcagacacgttgaatccgaggtgacatctgtggtctggccgaaggaggctagaaggaaggcatgtgctttggatggatggaaacaggaatcaaagaggaagctgtttttggaaggaagaaagatggaaagcggtgcagttctgctggaatccaaatcctccccatttaacctactgcatgagatgcatgagcttcgcctcctgggtcacctgtgtgacgtgacagtcagcgtggagtatcagggtgtccgcaaagacttcatggccca

SEQ ID NO: 11986 - DNA, 951 bp, Homo sapiens
gttcctaccggcctggtccagcggacagcggctgcagcgggggcgccggctgggaggtgaaagaccttttatgtgtgaaacatgtggcaagagttttgcttctaaggagtacttaaaacaccacaatagaatccatactggatccaaaccctttaaatgtgaagtatgtttcaggacttttgcccagcggaattcactgtaccagcatattaaagtccacacaggggagcgtccctactgctgtgaccagtgcggcaagcagttcacccagctcaacgccctccagcgccaccgccgcatccacacaggggagaggccattcatgtgcaatgcgtgcggacggacattcaccgacaagtccactcttcggcggcacacctcaatacacgataagaatactccatggaagtctttccttgtcattgtagatggctcgcccaagaacgatgacggacacaagactgaacagcctgacgaagagtatgtgtcatccaagctttcggataaattgctgtcttttgcagaaaatggccatttccacaacctggctgcagtccaagacactgtacctaccatgcaggagaacagttctgctgacacagcctgcaaggcagatgactccgtggtgtcccaggacaccctcctggccaccaccatcagtgagcttagcgagctgaccccacagacagactcgatgcccacacagcttcactctttgagcaacatggaataagagcttcaagcagttcccatcctgttagtctgcgtgtgtggtagctgaactcaagatgatgtggggctaagaaaaataattgtccatgtgcaaagatgtgggcaagaatggcctctgcagattttcctgaacttctgctaacttgcacggctttatcacagcatttttaaagctttccctcaaaaatcctgatctgcatgatctcagctactttattg

SEQ ID NO: 11987 - DNA, 989 bp, Homo sapiens
agggtgctacgccacgcccagccgggccggccgttcctaccggcctggtccagcggacagcggctgcagcgggggcgccggctgggagaattcatacaggggaaaaaccttttgtctgtgatgaatgtggtgcaagattcactcagaaccacatgctgatttatcataaaaggtgtcacacaggtgaaagaccttttatgtgtgaaacatgtggcaagagttttgcttctaaggagtacttaaaacaccacaatagaatccatactggatccaaaccctttaaatgtgaagtatgtttcaggacttttgcccagcggaattcactgtaccagcatattaaagtccacacaggggagcgtccctactgctgtgaccagtgcggcaagcagttcacccagctcaacgccctccagcgccaccgccgcatccacacaggggagaggccattcatgtgcaatgcgtgcggacggacattcaccgacaagtccactcttcggcggcacacctcaatacacgataagaatactccatggaagtctttccttgtcattgtagatggctcgcccaagaacgatgacggacacaagactgaacagcctgacgaagagtatgtgtcatccaagctttcggataaattgctgtcttttgcagaaaatggccatttccacaacctggctgcagtccaagacactgtacctaccatgcaggagaacagttctgctgacacagcctgcaaggcagatgactccgtggtgtcccaggacaccctcctggccaccaccatcagtgagcttagcgagctgaccccacagacagactcgatgcccacacagcttcactctttgagcaacatggaataagagcttcaagcagttcccatcctgttagtctgcgtgtgtggtagctgaactcaagatgatgtggggctaagaaaaataattgtccatgtgcaaagatgtgggcaagaatggcctctgcagattttcctg

SEQ ID NO: 11988 - DNA, 1495 bp, Homo sapiens
atctttggtccagtgcggtggcggcggcggcggtggcggcggcgactgctgcggtgaaggaggaggaggagccgagcgggcgctggcaccgaggcctgaccatggacgaggaatacgatgtgatcgtgctggggaccggtctcaccgaatgcatcctgtcgggcatcatgtctgtgaacgggaagaaggtgctgcacatggaccggaacccctactacgggggcgagagctcctccatcacacccctggaggagctgtataagcgttttcagttgctggaggggccccctgagtcgatgggccgaggccgagactggaatgttgacctgattcccaaattcctcatggctaacgggcagctggtaaagatgctactgtatacagaggtgactcgctacctggacttcaaggtggtggagggcagctttgtctacaaggggggcaagatctacaaagtgccgtccactgagactgaggccttggcttccaatctgatgggcatgtttgagaatgaccccaagacctttgagggcgttgacccccagactaccagcatgcgtgacgtctaccggaagtttgatctgggccaggatgtcatcgatttcactggccatgccctggcgctctaccgcactgatgactacctggaccagccctgccttgagaccgtcaaccgcatcaagttgtacagtgagtccctggcccggtatggcaagagcccatatttatacccgctctacggcttgggcgagctgccccagggttttgcaagattgagtgccatctatggggggacatatatgctgaacaaacctgtggatgacatcatcatggagaacggcaaggtggtgggcgtgaagtctgagggagaggtggcccgctgcaagcagctgatctgtgaccccagctacatcccggaccgtgtgcggaaggctggccaggttatccgcatcatctgtatccttagccaccccatcaagaacaccaacgacgccaactcctgccaaataatcatcccccagaaccaggtcaacaggaagtcagacatctacgtgtgcatgatctcctatgcacacaacgtggcggcccagggcaagtacatagctattgccagcactactgtggagaccacggaccctgaaaaggaggtggagccggctctggagctgttggagcccattgatgatggttgtgagagccaggtgttctgttcctgctcctacgatgccaccacacactttgagacaacctgcaacgacatcaaagacatctacaaacgcatggctggcacggcctttgactttgagaacatgaagcgcaaacagaacgacgtctttggagaagctgagcagtgattgtggccgcccccagcccctgctgccccagcctgtgtctgttctcctcgagggctccagcatcctctgcttcccccaccacgttcccatcacccacctcattgatccactgaccaaatccttaaccctagcgatggctt

SEQ ID NO: 11989 - DNA, 2474 bp, Homo sapiens
ctgggccgcagcaccggccgccggcccgccccgcccgccccgccccgcgcctctctagactctcggcgagcagcgtcgcccgcggagccgcgctggtgctgtggcccgggccctggcagccctcccgggaggcgagccggggaggcggtggcccctgccggttgcggcggggcgcgggaagaggcgggactctttgacgcggcggaggggtcgggcgacggccgacgcgccgccatctttggtccagtgcggtggcggcggcggcggtggcggcggcgactgctgcggtgaaggaggaggaggagccgagcgggcgctggcaccgaggcctgaccatggacgaggaatacgatgtgatcgtgctggggaccggtctcaccgaatgcatcctgtcgggcatcatgtctgtgaacgggaagaaggtgctgcacatggaccggaacccctactacgggggcgagagctcctccatcacacccctggaggagctgtataagcgttttcagttgctggaggggccccctgagtcgatgggccgaggccgagactggaatgttgacctgattcccaaattcctcatggctaacgggcagctggtaaagatgctactgtatacagaggtgactcgctacctggacttcaaggtggtggagggcagctttgtctacaaggggggcaagatctacaaagtgccgtccactgagactgaggccttggcttccaatctgatgggcatgtttgagaaacggcgcttccgcaagttcctggtgtttgtggcaaacttcgatgagaatgaccccaagacctttgagggcgttgacccccagactaccagcatgcgtgacgtctaccggaagtttgatctgggccaggatgtcatcgatttcactggccatgccctggcgctctaccgcactgatgactacctggaccagccctgccttgagaccgtcaaccgcatcaagttgtacagtgagtccctggcccggtatggcaagagcccatatttatacccgctctacggcttgggcgagctgccccagggttttgcaagattgagtgccatctatggggggacatatatgctgaacaaacctgtggatgacatcatcatggagaacggcaaggtggtgggcgtgaagtctgagggagaggtggcccgctgcaagcagctgatctgtgaccccagctacatcccggaccgtgtgcggaaggctggccaggttatccgcatcatctgtatccttagccaccccatcaagaacaccaacgacgccaactcctgccaaataatcatcccccagaaccaggtcaacaggaagtcagacatctacgtgtgcatgatctcctatgcacacaacgtggcggcccagggcaagtacatagctattgccagcactactgtggagaccacggaccctgaaaaggaggtggagccggctctggagctgttggagcccattgaccagaagtttgtggctatcagtgacttgtatgagcccattgatgatggttgtgagagccaggtgttctgttcctgctcctacgatgccaccacacactttgagacaacctgcaacgacatcaaagacatctacaaacgcatggctggcacggcctttgactttgagaacatgaagcgcaaacagaacgacgtctttggagaagctgagcagtgattgtggccgcccccagcccctgctgccccagcctgtgtctgttctcctcgagggctccagcatcctctgcttcccccaccacgttcccatcacccacctcattgatccactgaccaaatccttaaccctagcgatggcttgggagatggggggttggatagcatcctctttcttggcccttccttatcctaggaaaagagggttcctctccttgtgtgtgtctcttccccccacccctaattcttctgctctgtttgggaagacgtggaggaaaaggtgacttctgcccccaccgctcttacccccactgtagtggcctttggagatgcccccacctcccccccaccaactctcgcgtgttggagagaaggggccctcccagcacaaagttgcattcctcccccctaatttattctaatttattaactttgacccaccctttctgagcctgcagccttcccgtgtggcctgagggctgtcgagtgagctgccccagcccctcccagcccttgcccagcctgggggagtggggaaggcttgggcatggccccgttggaggttgatttgctgttttgtttcttgtctttgtgttctgtggtacttgctgagagaaaagaaaagtgagccaagcagaaggaggtgggaaaacggacccaaaccccagtgtgccctgccccatgcctttcctttagtggtgggaaacccttatcttgcaaagtgaatgtgtccccttccccaccctctagtgtatttcacagaaaacaaaacctcccaataaaacggttgaaacctgaa

SEQ ID NO: 11990 - DNA, 584 bp, Homo sapiens
gaagcccccggaagcctccccagaagctgttgccggtgctatgcgacctgtacagcctgcagaaccaaagatccatggtccaatataacatatcttcttcaagtatttatggggtaacatcccaaaataacacttttagatgtctctaggcaagagaaaaccttcgaacttttatttggctaattttttaggaaaggaatgtatcctgtcaggtataatgtcagtgaatggcaagaaagttcttcatatggatcgaaacccttactacggaggagagagtgcatctataacaccattggaagatttatacaaaagatttaaaataccaggatcaccacccgagtcaatggggagaggaagagactggaatgttgacttgattcccaagttccttatggctaatggtcagctggttaagatgctgctttatacagaggtaactcgctatctggattttaaagtgactgaagggagctttgtctataagggtggaaaaatctacaaggttccttccactgaagcagaagccctggcatctagcctaatgggattgtttgaaaaacgtcgcttcaggaaattcctag

SEQ ID NO: 11991 - DNA, 1680 bp, Homo sapiens
ttcttctcttcccgtctgaggtggcggtcggtctcgccttgtcgccagctccattttcctctctttctcttcccctttccttcgcgcccaagagcgcctcccagcctcgtagggtggtcacggagcccctgcgccttttccttgctcgggtcctgcgtccgcgcctgccccgccatgaatgaggagtacgacgtgatcgtgctgggcaccggcctgacggtaacatcccaaaataacacttttagatgtctctaggcaagagaaaaccttcgaacttttatttggctaattttttaggaaaggaatgtatcctgtcaggtataatgtcagtgaatggcaagaaagttcttcatatggatcgaaacccttactacggaggagagagtgcatctataacaccattggaagatttatacaaaagatttaaaataccaggatcaccacccgagtcaatggggagaggaagagactggaatgttgacttgattcccaagttccttatggctaatggtcagctggttaagatgctgctttatacagaggtaactcgctatctggattttaaagtgactgaagggagctttgtctataagggtggaaaaatctacaaggttccttccactgaagcagaagccctggcatctagcctaatgggattgtttgaaaaacgtcgcttcaggaaattcctagtgtatgttgccaacttcgatgaaaaagatccaagaacttttgaaggcattgatcctaagaagaccacaatgcgagatgtgtataagaaatttgatttgggtcaagacgttatagattttactggtcatgctcttgcactttacagaactgatgattacttagatcaaccgtgttatgaaaccattaatagaattaaactttacagtgaatctttggcaagatatggcaaaagcccatacctttatccactctatggccttggagaactgccccaaggatttgcaaggctaagtgctatttatggaggtacctatatgctgaataaacccattgaagaaatcattgtacagaatggaaaagtaattggtgtaaaatctgaaggagaaattgctcgctgtaagcagctcatctgtgaccccagctacgtaaaagatcgggtagaaaaagtgggccaggtgatcagagttatttgcatcctcagccaccccatcaagaacaccaatgatgccaactcctgccagatcattattccacagaaccaagtcaatcgaaagtcagatatctacgtctgcatgatctcctttgcgcacaatgtagcagcacaagggaagtacattgctatagttagtacaactgtggaaaccaaggagcctgagaaggaaatcagaccagctttggagctcttggaaccaattgaacagaaatttgttagcatcagtgacctcctggtaccaaaagacttgggaacagaaagccagatctttatttcccgcacatatgatgccaccactcattttgagacaacgtgtgatgacattaaaaacatctataagaggatgacaggatcagagtttgactttgaggaaatgaagcgcaagaagaatgacatctatggggaagactaacagcagtacatgttattatgtaattaggacacatttaaaatttggcaaataatgcatataatgaaatcaatattgtaaggcctgc

SEQ ID NO: 11992 - DNA, 2266 bp, Homo sapiens
agagtgccgggagcgcctgattggcggccctcccggcgcctgcaggccccgccccggctgcggaggctcagtcacagccctcccctcctcgctccctcccctcctctccccgcccagttcttctcttcccgtctgaggtggcggtcggtctcgccttgtcgccagctccattttcctctctttctcttcccctttccttcgcgcccaagagcgcctcccagcctcgtagggtggtcacggagcccctgcgccttttccttgctcgggtcctgcgtccgcgcctgccccgccatgaatgaggagtacgacgtgatcgtgctgggcaccggcctgacggaatgtatcctgtcaggtataatgtcagtgaatggcaagaaagttcttcatatggatcgaaacccttactacggaggagagagtgcatctataacaccattggaagatttatacaaaagatttaaaataccaggatcaccacccgagtcaatggggagaggaagagactggaatgttgacttgattcccaagttccttatggctaatggtcagctggttaagatgctgctttatacagaggtaactcgctatctggattttaaagtgactgaagggagctttgtctataagggtggaaaaatctacaaggttccttccactgaagcagaagccctggcatctagcctaatgggattgtttgaaaaacgtcgcttcaggaaattcctagtgtatgttgccaacttcgatgaaaaagatccaagaacttttgaaggcattgatcctaagaagaccacaatgcgagatgtgtataagaaatttgatttgggtcaagacgttatagattttactggtcatgctcttgcactttacagaactgatgattacttagatcaaccgtgttatgaaaccattaatagaattaaactttacagtgaatctttggcaagatatggcaaaagcccatacctttatccactctatggccttggagaactgccccaaggatttgcaaggctaagtgctatttatggaggtacctatatgctgaataaacccattgaagaaatcattgtacagaatggaaaagtaattggtgtaaaatctgaaggagaaattgctcgctgtaagcagctcatctgtgaccccagctacgtaaaagatcgggtagaaaaagtgggccaggtgatcagagttatttgcatcctcagccaccccatcaagaacaccaatgatgccaactcctgccagatcattattccacagaaccaagtcaatcgaaagtcagatttgttagcatcagtgacctcctggtaccaaaagacttgggaacagaaagccagatctttatttcccgcacatatgatgccaccactcattttgagacaacgtgtgatgacattaaaaacatctataagaggatgacaggatcagagtttgactttgaggaaatgaagcgcaagaagaatgacatctatggggaagactaacagcagtacatgttattatgtaattaggacacatttaaaatttggcaaataatgcatataatgaaatcaatattgtaaggcctgcttttgtaatgaaaatggagagaatgaagagcgctgtgccagtaaatactccccttcacctttctaattattaacttgttttcatggagtggctattcagcattggcagttaccacattctgttcaatttaaccaaactggctttttttttttctagtgaagttaaacaaacattgggataccgacacagacaacttgagacagtttttttaatcttttaatcagtgtagctatgtgctgctgctgctcaagagctggatccatacaggttgtgtgtcatctgtcctcttgaggttcaggagattctaaattgaatattccacggtttgggacagcatccggaagttttccctatgactttatattttgtattatgtcaaatgttatggcagggcccaaatagcatagccacaagtttggtttatgtgggcataaaattctaaccaaaccccagacatagggagtcatttggagaaagcctgtatgtggtgttttaacctaataaagttgatgagagagaaggggagaggaagcgaacataaagcgggtcaagtgtagtgcatcttttgtatctcaggcgtggcttcttcagtggaccaagctgcaatgcagtattgacttgacagagcctctacttctgtctcaaaatggctccaaatgatttctgtactgcaaaataaagccaaattctggaaact

SEQ ID NO: 11993 - DNA, 1408 bp, Homo sapiens
tggcggtcggtctcgccttgtcgccagctccattttcctctctttctcttcccctttccttcgcgcccaagagcgcctcccagcctcgtagggtggtcacggagcccctgcgccttttccttgctcgggtcctgcgtccgcgcctgccccgccatgaatgaggagtacgacgtgatcgtgctgggcaccggcctgacggaatgtatcctgtcaggtataatgtcagtgaatggcaagaaagttcttcatatggatcgaaacccttactacggaggagagagtgcatctataacaccattggaagatttatacaaaagatttaaaataccaggatcaccacccgagtcaatggggagaggaagagactggaatgttgacttgattcccaagttccttatggctaatggcctaatgggattgtttgaaaaacgtcgcttcaggaaattcctagtgtatgttgccaacttcgatgaaaaagatccaagaacttttgaaggcattgatcctaagaagaccacaatgcgagatgtgtataagaaatttgatttgggtcaagacgttatagattttactggtcatgctcttgcactttacagaactgatgattacttagatcaaccgtgttatgaaaccattaatagaattaaactttacagtgaatctttggcaagatatggcaaaagcccatacctttatccactctatggccttggagaactgccccaaggatttgcaaggctaagtgctatttatggaggtacctatatgctgaataaacccattgaagaaatcattgtacagaatggaaaagtaattggtgtaaaatctgaaggagaaattgctcgctgtaagcagctcatctgtgaccccagctacgtaaaagatcgggtagaaaaagtgggccaggtgatcagagttatttgcatcctcagccaccccatcaagaacaccaatgatgccaactcctgccagatcattattccacagaaccaagtcaatcgaaagtcagatatctacgtctgcatgatctcctttgcgcacaatgtagcagcacaagggaagtacattgctatagttagtacaactgtggaaaccaaggagcctgagaaggaaatcagaccagctttggagctcttggaaccaattgaacagaaatttgttagcatcagtgacctcctggtaccaaaagacttgggaacagaaagccagatctttatttcccgcacatatgatgccaccactcattttgagacaacgtgtgatgacattaaaaacatctataagaggatgacaggatcagagtttgactttgaggaaatgaagcgcaagaagaatgacatctatggggaagactaacagcagtacatgttattatgtaattaggacacatttaaaatttggcaaataa

SEQ ID NO: 11994 - DNA, 2412 bp, Homo sapiens
agagtgccgggagcgcctgattggcggccctcccggcgcctgcaggccccgccccggctgcggaggctcagtcacagccctcccctcctcgctccctcccctcctctccccgcccagttcttctcttcccgtctgaggtggcggtcggtctcgccttgtcgccagctccattttcctctctttctcttcccctttccttcgcgcccaagagcgcctcccagcctcgtagggtggtcacggagcccctgcgccttttccttgctcgggtcctgcgtccgcgcctgccccgccatgaatgaggagtacgacgtgatcgtgctgggcaccggcctgacggaatgtatcctgtcaggtataatgtcagtgaatggcaagaaagttcttcatatggatcgaaacccttactacggaggagagagtgcatctataacaccattggaagatttatacaaaagatttaaaataccaggatcaccacccgagtcaatggggagaggaagagactggaatgttgacttgattcccaagttccttatggctaatggtcagctggttaagatgctgctttatacagaggtaactcgctatctggattttaaagtgactgaagggagctttgtctataagggtggaaaaatctacaaggttccttccactgaagcagaagccctggcatctagcctaatgggattgtttgaaaaacgtcgcttcaggaaattcctagtgtatgttgccaacttcgatgaaaaagatccaagaacttttgaaggcattgatcctaagaagaccacaatgcgagatgtgtataagaaatttgatttgggtcaagacgttatagattttactggtcatgctcttgcactttacagaactgatgattacttagatcaaccgtgttatgaaaccattaatagaattaaactttacagtgaatctttggcaagatatggcaaaagcccatacctttatccactctatggccttggagaactgccccaaggatttgcaaggctaagtgctatttatggaggtacctatatgctgaataaacccattgaagaaatcattgtacagaatggaaaagtaattggtgtaaaatctgaaggagaaattgctcgctgtaagcagctcatctgtgaccccagctacgtaaaagatcgggtagaaaaagtgggccaggtgatcagagttatttgcatcctcagccaccccatcaagaacaccaatgatgccaactcctgccagatcattattccacagaaccaagtcaatcgaaagtcagatatctacgtctgcatgatctcctttgcgcacaatgtagcagcacaagggaagtacattgctatagttagtacaactgtggaaaccaaggagcctgagaaggaaatcagaccagctttggagctcttggaaccaattgaacagaaatttgttagcatcagtgacctcctggtaccaaaagacttgggaacagaaagccagatctttatttcccgcacatatgatgccaccactcattttgagacaacgtgtgatgacattaaaaacatctataagaggatgacaggatcagagtttgactttgaggaaatgaagcgcaagaagaatgacatctatggggaagactaacagcagtacatgttattatgtaattaggacacatttaaaatttggcaaataatgcatataatgaaatcaatattgtaaggcctgcttttgtaatgaaaatggagagaatgaagagcgctgtgccagtaaatactccccttcacctttctaattattaacttgttttcatggagtggctattcagcattggcagttaccacattctgttcaatttaaccaaactggctttttttttttctagtgaagttaaacaaacattgggataccgacacagacaacttgagacagtttttttaatcttttaatcagtgtagctatgtgctgctgctgctcaagagctggatccatacaggttgtgtgtcatctgtcctcttgaggttcaggagattctaaattgaatattccacggtttgggacagcatccggaagttttccctatgactttatattttgtattatgtcaaatgttatggcagggcccaaatagcatagccacaagtttggtttatgtgggcataaaattctaaccaaaccccagacatagggagtcatttggagaaagcctgtatgtggtgttttaacctaataaagttgatgagagagaaggggagaggaagcgaacataaagcgggtcaagtgtagtgcatcttttgtatctcaggcgtggcttcttcagtggaccaagctgcaatgcagtattgacttgacagagcctctacttctgtctcaaaatggctccaaatgatttctgtactgcaaaataaagccaaattctggaaacta

SEQ ID NO: 11995 - DNA, 636 bp, Homo sapiens
ttctcttcccgtctgaggtggcggtcggtctcgccttgtcgccagctccattttcctctctttctcttcccctttccttcgcgcccaagagcgcctcccagcctcgtagggtggtcacggagcccctgcgccttttccttgctcgggtcctgcgtccgcgcctgccccgccatgaatgaggagtacgacgtgatcgtgctgggcaccggcctgacgttatacaaaagatttaaaataccaggatcaccacccgagtcaatggggagaggaagagactggaatgttgacttgattcccaagttccttatggctaatggtcagctggttaagatgctgctttatacagaggtaactcgctatctggattttaaagtgactgaagggagctttgtctataagggtggaaaaatctacaaggttccttccactgaagcagaagccctggcatctagcctaatgggattgtttgaaaaacgtcgcttcaggaaattcctagtgtatgttgccaacttcgatgaaaaagatccaagaacttttgaaggcattgatcctaagaagaccacaatgcgagatgtgtataagaaatttgatttgggtcaagacgttatagattttactggtcatgctcttgcactt

SEQ ID NO: 11996 - DNA, 834 bp, Homo sapiens
aagaaatttgatttgggtcaagacgttatagattttactggtcatgctcttgcactttacagaactgatgattacttagatcaaccgtgttatgaaaccattaatagaattaaactttacagtgaatctttggcaagatatggcaaaagcccatacctttatccactctatggccttggagaactgccccaaggatttgcaaggctaagtgctatttatggaggtacctatatgctgaataaacccattgaagaaatcattgtacagaatggaaaagtaattggtgtaaaatctgaaggagaaattgctcgctgtaagcagctcatctgtgaccccagctacgtaaaagatcgggtagaaaaagtgggccaggtgatcagagttatttgcatcctcagccaccccatcaagaacaccaatgatgccaactcctgccagatcattattccacagaaccaagtcaatcgaaagtcagatttgttagcatcagtgacctcctggtaccaaaagacttgggaacagaaagccagatctttatttcccgcacatatgatgccaccactcattttgagacaacgtgtgatgacattaaaaacatctataagaggatgacaggatcagagtttgactttgaggaaatgaagcgcaagaagaatgacatctatggggaagactaacagcagtacatgttattatgtaattaggacacatttaaaatttggcaaataatgcatataatgaaatcaatattgtaaggcctgcttttgtaatgaaaatggagagaatgaagagcgctgtgccagtaaatactccccttcacctttctaattatta

SEQ ID NO: 11997 - DNA, 918 bp, Homo sapiens
cagctccattttcctctctttctcttcccctttccttcgcgcccaagagcgcctcccagcctcgtagggtggtcacggagcccctgcgccttttccttgctcgggtcctgcgtccgcgcctgccccgccatgaatgaggagtacgacgtgatcgtgctgggcaccggcctgacggaatgtatcctgtcaggtataatgtcagtgaatggcaagaaagttcttcatatggatcgaaacccttactacggaggagagagtgcatctataacaccattggaagatttatacaaaagatttaaaataccaggatcaccacccgagtcaatggggagaggaagagactggaatgttgacttgattcccaagttccttatggctaatgaggtaactcgctatctggattttaaagtgactgaagggagctttgtctataagggtggaaaaatctacaaggttccttccactgaagcagaagccctggcatctagcctaatgggattgtttgaaaaacgtcgcttcaggaaattcctagtgtatgttgccaacttcgatgaaaaagatccaagaacttttgaaggcattgatcctaagaagaccacaatgcgagatgtgtataagaaatttgatttgggtcaagacgttatagattttactggtcatgctcttgcactttacagaactgatgattacttagatcaaccgtgttatgaaaccattaatagaattaaactttacagtgaatctttggcaagatatggcaaaagcccatacctttatccactctatggccttggagaactgccccaaggatttgcaaggctaagtgctatttatggaggtacctatatgctgaataaacccattgaagaaatcattgtacagaatggaaaagtaattggtgtaaaatctgaaggagaa

SEQ ID NO: 11998 - DNA, 1752 bp, Homo sapiens
gacgcgaatgacgctgcgccagtcaggccgcagccccgctgcttggcccgtcgggcccgccttggccggctcggcccgcccccggccctccctgcacggcctcccgtgcgcccctgtcagactgtggcggccggtcgcgcggtgcgctctccctccctgcccgcagcctggagaggcgcttcgtgctgcacacccccgcgttcctgccggcaccgcgcctgccctctgccgcgctccgccctgccgccgaccgcacgcccgccgcgggacatggcacacgcaccggcacgctgccccagcgcccggggctccggggacggcgagatgggcaagcccaggaacgtggcgctcatcaccggtatcacaggccaggatggttcctacctggctgagttcctgctggagaaaggctatgaggtccatggaattgtacggcggtccagttcatttaatacgggtcgaattgagcatctgtataagaatccccaggctcacattgaaggaaacatgaagttgcactatggcgatctcactgacagtacctgccttgtgaagatcattaatgaagtaaagcccacagagatctacaaccttggagcccagagccacgtcaaaatttcctttgacctcgctgagtacactgcggacgttgacggagttggcactctacgacttctagatgcagttaagacttgtggccttatcaactctgtgaagttctaccaagcctcaacaagtgaactttatgggaaagtgcaggaaataccccagaaggagaccacccctttctatccccggtcaccctatggggcagcaaaactctatgcctattggattgtggtgaacttccgtgaggcgtataatctctttgcagtgaacggcattctcttcaatcatgagagtcccagaagaggagctaatttcgttactcgaaaaattagccggtcagtagctaagatttaccttggacaactggaatgtttcagtttgggaaatctggatgccaaacgagattggggccatgccaaggactatgtggaggctatgtggttgatgttgcagaatgatgagccggaggacttcgttatagctactggggaggtccatagtgtccgggaatttgtcgagaaatcattcttgcacattggaaaaaccattgtgtgggaaggaaagaatgaaaatgaagtgggcagatgtaaagagaccggcaaagttcacgtgactgtggatctcaagtactaccggccaactgaagtggactttctgcagggcgactgcaccaaagcgaaacagaagctgaactggaagccccgggtcgctttcgatgagctggtgagggagatggtgcacgccgacgtggagctcatgaggacaaaccccaatgcctgagcagcgcctcggagcccggcccgccctccggctacaatccccgcagagtctccggtgcagacgcgctgcggggatggggagcggcgtgccaatctgcgggtcccctgcggcccctgctgccgctgcgctgtcccggccgcaagagcggggccgccccgccgaggtttgtagcagccgggatgtgaccctccagggtttgggtcgctttgcgtttgtcgaagcctcctctgaatggctttgtgaaatcaagatgttttaatcacattcactttacttgaaattatgttgttacacaacaaattgtggggccttcaaattgtttttctcttttcatattaaaaatggtctttctgtgaactagca

SEQ ID NO: 11999 - DNA, 1440 bp, Homo sapiens
tgtacacaggcagtttgttgggagcgttaccattgcctctggttcctcatgtgtaaaatggatggttcctacctggctgagttcctgctggagaaaggctatgaggtccatggaattgtacggcggtccagttcatttaatacgggtcgaattgagcatctgtataagaatccccaggctcacattgaaggaaacatgaagttgcactatggcgatctcactgacagtacctgccttgtgaagatcattaatgaagtaaagcccacagagatctacaaccttggagcccagagccacgtcaaaatttcctttgacctcgctgagtacactgcggacgttgacggagttggcactctacgacttctagatgcagttaagacttgtggccttatcaactctgtgaagttctaccaagcctcaacaagtgaactttatgggaaagtgcaggaaataccccagaaggagaccacccctttctatccccggtcaccctatggggcagcaaaactctatgcctattggattgtggtgaacttccgtgaggcgtataatctctttgcagtgaacggcattctcttcaatcatgagagtcccagaagaggagctaatttcgttactcgaaaaattagccggtcagtagctaagatttaccttggacaactggaatgtttcagtttgggaaatctggatgccaaacgagattggggccatgccaaggactatgtggaggctatgtggttgatgttgcagaatgatgagccggaggacttcgttatagctactggggaggtccatagtgtccgggaatttgtcgagaaatcattcttgcacattggaaaaaccattgtgtgggaaggaaagaatgaaaatgaagtgggcagatgtaaagagaccggcaaagttcacgtgactgtggatctcaagtactaccggccaactgaagtggactttctgcagggcgactgcaccaaagcgaaacagaagctgaactggaagccccgggtcgctttcgatgagctggtgagggagatggtgcacgccgacgtggagctcatgaggacaaaccccaatgcctgagcagcgcctcggagcccggcccgccctccggctacaatccccgcagagtctccggtgcagacgcgctgcggggatggggagcggcgtgccaatctgcgggtcccctgcggcccctgctgccgctgcgctgtcccggccgcaagagcggggccgccccgccgaggtttgtagcagccgggatgtgaccctccagggtttgggtcgctttgcgtttgtcgaagcctcctctgaatggctttgtgaaatcaagatgttttaatcacattcactttacttgaaattatgttgttacacaacaaattgtggggccttcaaattgtttttctcttttcatattaaaaatggtctttctgtgaactagca

SEQ ID NO: 12000 - DNA, 2655 bp, Homo sapiens
tcccgcccgcgccctgcccaccccggccgcgcgcaccacaacgcccccgccccgccgcccggaaccagctgagcgcagctggacccagcagccgctgtctccagtgccgcagcagcaggtagtgctcatagctctctttgtccagtgcttcggccttggtcccagcgccttcccacggagcagcactcttcaccctgcacagccttgttagcccaacagcatggtggtggaacaccccgagttcctcaaggcagggaaggagcctggcctgcagatctggcgtgtggagaagttcgatctggtgcccgtgcccaccaacctttatggagacttcttcacgggcgacgcctacgtcatcctgaagacagtgcagctgaggaacggaaatctgcagtatgacctccactactggctgggcaatgagtgcagccaggatgagagcggggcggccgccatctttaccgtgcagctggatgactacctgaacggccgggccgtgcagcaccgtgaggtccagggcttcgagtcggccaccttcctaggctacttcaagtctggcctgaagtacaagaaaggaggtgtggcatcaggattcaagcacgtggtacccaacgaggtggtggtgcagagactcttccaggtcaaagggcggcgtgtggtccgtgccaccgaggtacctgtgtcctgggagagcttcaacaatggcgactgcttcatcctggacctgggcaacaacatccaccagtggtgtggttccaacagcaatcggtatgaaagactgaaggccacacaggtgtccaagggcatccgggacaacgagcggagtggccgggcccgagtgcacgtgtctgaggagggcactgagcccgaggcgatgctccaggtgctgggccccaagccggctctgcctgcaggtaccgaggacaccgccaaggaggatgcggccaaccgcaagctggccaagctctacaaggtctccaatggtgcagggaccatgtccgtctccctcgtggctgatgagaaccccttcgcccagggggccctgaagtcagaggactgcttcatcctggaccacggcaaagatgggaaaatctttgtctggaaaggcaagcaggcaaacacggaggagaggaaggctgccctcaaaacagcctctgacttcatcaccaagatggactaccccaagcagactcaggtctcggtccttcctgagggcggtgagaccccactgttcaagcagttcttcaagaactggcgggacccagaccagacagatggcctgggcttgtcctacctttccagccatatcgccaacgtggagcgggtgcccttcgacgccgccaccctgcacacctccactgccatggccgcccagcacggcatggatgacgatggcacaggccagaaacagatctggagaatcgaaggttccaacaaggtgcccgtggaccctgccacatatggacagttctatggaggcgacagctacatcattctgtacaactaccgccatggtggccgccaggggcagataatctataactggcagggtgcccagtctacccaggatgaggtcgctgcatctgccatcctgactgctcagctggatgaggagctgggaggtacccctgtccagagccgtgtggtccaaggcaaggagcccgcccacctcatgagcctgtttggtgggaagcccatgatcatctacaagggcggcacctcccgcgagggcgggcagacagcccctgccagcacccgcctcttccaggtccgcgccaacagcgctggagccacccgggctgttgaggtattgcctaaggctggtgcactgaactccaacgatgcctttgttctgaaaaccccctcagccgcctacctgtgggtgggtacaggagccagcgaggcagagaagacgggggcccaggagctgctcagggtgctgcgggcccaacctgtgcaggtggcagaaggcagcgagccagatggcttctgggaggccctgggcgggaaggctgcctaccgcacatccccacggctgaaggacaagaagatggatgcccatcctcctcgcctctttgcctgctccaacaagattggacgttttgtgatcgaagaggttcctggtgagctcatgcaggaagacctggcaacggatgacgtcatgcttctggacacctgggaccaggtctttgtctgggttggaaaggattctcaagaagaagaaaagacagaagccttgacttctgctaagcggtacatcgagacggacccagccaatcgggatcggcggacgcccatcaccgtggtgaagcaaggctttgagcctccctcctttgtgggctggttccttggctgggatgatgattactggtctgtggaccccttggacagggccatggctgagctggctgcctgaggaggggcagggcccacccatgtcaccggtcagtgccttttggaactgtccttccctcaaagaggccttagagcgagcagagcagctctgctatgagtgtgtgtgtgtgtgtgtgttgtttcttttttttttttttacagtatccaaaaatagccctgcaaaaattcagagtccttgcaaaattgtctaaaatgtcagtgtttgggaaattaaatccaataaaaacattttgaagtgtg

SEQ ID NO: 12001 - DNA, 2562 bp, Homo sapiens
tcccgcccgcgccctgcccaccccggccgcgcgcaccacaacgcccccgccccgccgcccggaaccagctgagcgcagctggacccagcagccgctgtctccagtgccgcagcagcagcccaacagcatggtggtggaacaccccgagttcctcaaggcagggaaggagcctggcctgcagatctggcgtgtggagaagttcgatctggtgcccgtgcccaccaacctttatggagacttcttcacgggcgacgcctacgtcatcctgaagacagtgcagctgaggaacggaaatctgcagtatgacctccactactggctgggcaatgagtgcagccaggatgagagcggggcggccgccatctttaccgtgcagctggatgactacctgaacggccgggccgtgcagcaccgtgaggtccagggcttcgagtcggccaccttcctaggctacttcaagtctggcctgaagtacaagaaaggaggtgtggcatcaggattcaagcacgtggtacccaacgaggtggtggtgcagagactcttccaggtcaaagggcggcgtgtggtccgtgccaccgaggtacctgtgtcctgggagagcttcaacaatggcgactgcttcatcctggacctgggcaacaacatccaccagtggtgtggttccaacagcaatcggtatgaaagactgaaggccacacaggtgtccaagggcatccgggacaacgagcggagtggccgggcccgagtgcacgtgtctgaggagggcactgagcccgaggcgatgctccaggtgctgggccccaagccggctctgcctgcaggtaccgaggacaccgccaaggaggatgcggccaaccgcaagctggccaagctctacaaggtctccaatggtgcagggaccatgtccgtctccctcgtggctgatgagaaccccttcgcccagggggccctgaagtcagaggactgcttcatcctggaccacggcaaagatgggaaaatctttgtctggaaaggcaagcaggcaaacacggaggagaggaaggctgccctcaaaacagcctctgacttcatcaccaagatggactaccccaagcagactcaggtctcggtccttcctgagggcggtgagaccccactgttcaagcagttcttcaagaactggcgggacccagaccagacagatggcctgggcttgtcctacctttccagccatatcgccaacgtggagcgggtgcccttcgacgccgccaccctgcacacctccactgccatggccgcccagcacggcatggatgacgatggcacaggccagaaacagatctggagaatcgaaggttccaacaaggtgcccgtggaccctgccacatatggacagttctatggaggcgacagctacatcattctgtacaactaccgccatggtggccgccaggggcagataatctataactggcagggtgcccagtctacccaggatgaggtcgctgcatctgccatcctgactgctcagctggatgaggagctgggaggtacccctgtccagagccgtgtggtccaaggcaaggagcccgcccacctcatgagcctgtttggtgggaagcccatgatcatctacaagggcggcacctcccgcgagggcgggcagacagcccctgccagcacccgcctcttccaggtccgcgccaacagcgctggagccacccgggctgttgaggtattgcctaaggctggtgcactgaactccaacgatgcctttgttctgaaaaccccctcagccgcctacctgtgggtgggtacaggagccagcgaggcagagaagacgggggcccaggagctgctcagggtgctgcgggcccaacctgtgcaggtggcagaaggcagcgagccagatggcttctgggaggccctgggcgggaaggctgcctaccgcacatccccacggctgaaggacaagaagatggatgcccatcctcctcgcctctttgcctgctccaacaagattggacgttttgtgatcgaagaggttcctggtgagctcatgcaggaagacctggcaacggatgacgtcatgcttctggacacctgggaccaggtctttgtctgggttggaaaggattctcaagaagaagaaaagacagaagccttgacttctgctaagcggtacatcgagacggacccagccaatcgggatcggcggacgcccatcaccgtggtgaagcaaggctttgagcctccctcctttgtgggctggttccttggctgggatgatgattactggtctgtggaccccttggacagggccatggctgagctggctgcctgaggaggggcagggcccacccatgtcaccggtcagtgccttttggaactgtccttccctcaaagaggccttagagcgagcagagcagctctgctatgagtgtgtgtgtgtgtgtgtgttgtttcttttttttttttttacagtatccaaaaatagccctgcaaaaattcagagtccttgcaaaattgtctaaaatgtcagtgtttgggaaattaaatccaataaaaacattttgaagtgtg

SEQ ID NO: 12002 - DNA, 2657 bp, Homo sapiens
gggcggctacttaaggtcggcgacccgaggccgcggctgccgactgggtcccctgccgctgtcgccaccatggctccgcaccgccccgcgcccgcgctgctttgcgcgctgtccctggcgctgtgcgcgctgtcgctgcccgtccgcgcggccactgcgtcgcggggggcgtcccaggcgggggcgccccaggggcgggtgcccgaggcgcggcccaacagcatggtggtggaacaccccgagttcctcaaggcagggaaggagcctggcctgcagatctggcgtgtggagaagttcgatctggtgcccgtgcccaccaacctttatggagacttcttcacgggcgacgcctacgtcatcctgaagacagtgcagctgaggaacggaaatctgcagtatgacctccactactggctgggcaatgagtgcagccaggatgagagcggggcggccgccatctttaccgtgcagctggatgactacctgaacggccgggccgtgcagcaccgtgaggtccagggcttcgagtcggccaccttcctaggctacttcaagtctggcctgaagtacaagaaaggaggtgtggcatcaggattcaagcacgtggtacccaacgaggtggtggtgcagagactcttccaggtcaaagggcggcgtgtggtccgtgccaccgaggtacctgtgtcctgggagagcttcaacaatggcgactgcttcatcctggacctgggcaacaacatccaccagtggtgtggttccaacagcaatcggtatgaaagactgaaggccacacaggtgtccaagggcatccgggacaacgagcggagtggccgggcccgagtgcacgtgtctgaggagggcactgagcccgaggcgatgctccaggtgctgggccccaagccggctctgcctgcaggtaccgaggacaccgccaaggaggatgcggccaaccgcaagctggccaagctctacaaggtctccaatggtgcagggaccatgtccgtctccctcgtggctgatgagaaccccttcgcccagggggccctgaagtcagaggactgcttcatcctggaccacggcaaagatgggaaaatctttgtctggaaaggcaagcaggcaaacacggaggagaggaaggctgccctcaaaacagcctctgacttcatcaccaagatggactaccccaagcagactcaggtctcggtccttcctgagggcggtgagaccccactgttcaagcagttcttcaagaactggcgggacccagaccagacagatggcctgggcttgtcctacctttccagccatatcgccaacgtggagcgggtgcccttcgacgccgccaccctgcacacctccactgccatggccgcccagcacggcatggatgacgatggcacaggccagaaacagatctggagaatcgaaggttccaacaaggtgcccgtggaccctgccacatatggacagttctatggaggcgacagctacatcattctgtacaactaccgccatggtggccgccaggggcagataatctataactggcagggtgcccagtctacccaggatgaggtcgctgcatctgccatcctgactgctcagctggatgaggagctgggaggtacccctgtccagagccgtgtggtccaaggcaaggagcccgcccacctcatgagcctgtttggtgggaagcccatgatcatctacaagggcggcacctcccgcgagggcgggcagacagcccctgccagcacccgcctcttccaggtccgcgccaacagcgctggagccacccgggctgttgaggtattgcctaaggctggtgcactgaactccaacgatgcctttgttctgaaaaccccctcagccgcctacctgtgggtgggtacaggagccagcgaggcagagaagacgggggcccaggagctgctcagggtgctgcgggcccaacctgtgcaggtggcagaaggcagcgagccagatggcttctgggaggccctgggcgggaaggctgcctaccgcacatccccacggctgaaggacaagaagatggatgcccatcctcctcgcctctttgcctgctccaacaagattggacgttttgtgatcgaagaggttcctggtgagctcatgcaggaagacctggcaacggatgacgtcatgcttctggacacctgggaccaggtctttgtctgggttggaaaggattctcaagaagaagaaaagacagaagccttgacttctgctaagcggtacatcgagacggacccagccaatcgggatcggcggacgcccatcaccgtggtgaagcaaggctttgagcctccctcctttgtgggctggttccttggctgggatgatgattactggtctgtggaccccttggacagggccatggctgagctggctgcctgaggaggggcagggcccacccatgtcaccggtcagtgccttttggaactgtccttccctcaaagaggccttagagcgagcagagcagctctgctatgagtgtgtgtgtgtgtgtgtgttgtttcttttttttttttttacagtatccaaaaatagccctgcaaaaattcagagtccttgcaaaattgtctaaaatgtcagtgtttgggaaattaaatccaataaaaacattttgaagtgtg

SEQ ID NO: 12003 - DNA, 3018 bp, Homo sapiens
caggctggagtgcaatggcacgatatcagctcactgaagcctccacctcctgggctcaagcactcctcccacctcagccccccaggtagctgagactacaggtagaatggataaagcacggagaggaaccaagaatgtgctcagaaaaaaatccttcctcactgaaaccaggactaaggaaaggagattcccttctaccatccatggactcaggctgacggagcacgctgcctgtctgtgtctctccgtttctctctctggaacgttgtcagatgtcacggcggagggaaaagagacctggaatgacttgccgaatttttagcccataaccaggcactgtgtaaaccgctttacctcattcagtctttgcaattataccacaaggtcacactgtttagaaggagaaagaagagctcgctgtgaaaaacgctccacaatgctgcagagccttgtgaaggtggaagagtactctcatcagcaaacggcattccttccatggaaaatgtcattgggaggaaagcaggttcaagtgattctcctgcctcagcctcctgagtagctgggattacagagcccaacagcatggtggtggaacaccccgagttcctcaaggcagggaaggagcctggcctgcagatctggcgtgtggagaagttcgatctggtgcccgtgcccaccaacctttatggagacttcttcacgggcgacgcctacgtcatcctgaagacagtgcagctgaggaacggaaatctgcagtatgacctccactactggctgggcaatgagtgcagccaggatgagagcggggcggccgccatctttaccgtgcagctggatgactacctgaacggccgggccgtgcagcaccgtgaggtccagggcttcgagtcggccaccttcctaggctacttcaagtctggcctgaagtacaagaaaggaggtgtggcatcaggattcaagcacgtggtacccaacgaggtggtggtgcagagactcttccaggtcaaagggcggcgtgtggtccgtgccaccgaggtacctgtgtcctgggagagcttcaacaatggcgactgcttcatcctggacctgggcaacaacatccaccagtggtgtggttccaacagcaatcggtatgaaagactgaaggccacacaggtgtccaagggcatccgggacaacgagcggagtggccgggcccgagtgcacgtgtctgaggagggcactgagcccgaggcgatgctccaggtgctgggccccaagccggctctgcctgcaggtaccgaggacaccgccaaggaggatgcggccaaccgcaagctggccaagctctacaaggtctccaatggtgcagggaccatgtccgtctccctcgtggctgatgagaaccccttcgcccagggggccctgaagtcagaggactgcttcatcctggaccacggcaaagatgggaaaatctttgtctggaaaggcaagcaggcaaacacggaggagaggaaggctgccctcaaaacagcctctgacttcatcaccaagatggactaccccaagcagactcaggtctcggtccttcctgagggcggtgagaccccactgttcaagcagttcttcaagaactggcgggacccagaccagacagatggcctgggcttgtcctacctttccagccatatcgccaacgtggagcgggtgcccttcgacgccgccaccctgcacacctccactgccatggccgcccagcacggcatggatgacgatggcacaggccagaaacagatctggagaatcgaaggttccaacaaggtgcccgtggaccctgccacatatggacagttctatggaggcgacagctacatcattctgtacaactaccgccatggtggccgccaggggcagataatctataactggcagggtgcccagtctacccaggatgaggtcgctgcatctgccatcctgactgctcagctggatgaggagctgggaggtacccctgtccagagccgtgtggtccaaggcaaggagcccgcccacctcatgagcctgtttggtgggaagcccatgatcatctacaagggcggcacctcccgcgagggcgggcagacagcccctgccagcacccgcctcttccaggtccgcgccaacagcgctggagccacccgggctgttgaggtattgcctaaggctggtgcactgaactccaacgatgcctttgttctgaaaaccccctcagccgcctacctgtgggtgggtacaggagccagcgaggcagagaagacgggggcccaggagctgctcagggtgctgcgggcccaacctgtgcaggtggcagaaggcagcgagccagatggcttctgggaggccctgggcgggaaggctgcctaccgcacatccccacggctgaaggacaagaagatggatgcccatcctcctcgcctctttgcctgctccaacaagattggacgttttgtgatcgaagaggttcctggtgagctcatgcaggaagacctggcaacggatgacgtcatgcttctggacacctgggaccaggtctttgtctgggttggaaaggattctcaagaagaagaaaagacagaagccttgacttctgctaagcggtacatcgagacggacccagccaatcgggatcggcggacgcccatcaccgtggtgaagcaaggctttgagcctccctcctttgtgggctggttccttggctgggatgatgattactggtctgtggaccccttggacagggccatggctgagctggctgcctgaggaggggcagggcccacccatgtcaccggtcagtgccttttggaactgtccttccctcaaagaggccttagagcgagcagagcagctctgctatgagtgtgtgtgtgtgtgtgtgttgtttcttttttttttttttacagtatccaaaaatagccctgcaaaaattcagagtccttgcaaaattgtctaaaatgtcagtgtttgggaaattaaatccaataaaaacattttgaagtgtgt

SEQ ID NO: 12004 - DNA, 2570 bp, Homo sapiens
acaacgcccccgccccgccgcccggaaccagctgagcgcagctggacccagcagccgctgtctccagtgccgcagcagcaggtagtgctcatagctctctttgtccagtgcttcggccttggtcccagcgccttcccacggagcagcactcttcaccctgcacagccttgttagcccaacagcatggtggtggaacaccccgagttcctcaaggcagggaaggagcctggcctgcagatctggcgtgtggagaagttcgacgcctacgtcatcctgaagacagtgcagctgaggaacggaaatctgcagtatgacctccactactggctgggcaatgagtgcagccaggatgagagcggggcggccgccatctttaccgtgcagctggatgactacctgaacggccgggccgtgcagcaccgtgaggtccagggcttcgagtcggccaccttcctaggctacttcaagtctggcctgaagtacaagaaaggaggtgtggcatcaggattcaagcacgtggtacccaacgaggtggtggtgcagagactcttccaggtcaaagggcggcgtgtggtccgtgccaccgaggtacctgtgtcctgggagagcttcaacaatggcgactgcttcatcctggacctgggcaacaacatccaccagtggtgtggttccaacagcaatcggtatgaaagactgaaggccacacaggtgtccaagggcatccgggacaacgagcggagtggccgggcccgagtgcacgtgtctgaggagggcactgagcccgaggcgatgctccaggtgctgggccccaagccggctctgcctgcaggtaccgaggacaccgccaaggaggatgcggccaaccgcaagctggccaagctctacaaggtctccaatggtgcagggaccatgtccgtctccctcgtggctgatgagaaccccttcgcccagggggccctgaagtcagaggactgcttcatcctggaccacggcaaagatgggaaaatctttgtctggaaaggcaagcaggcaaacacggaggagaggaaggctgccctcaaaacagcctctgacttcatcaccaagatggactaccccaagcagactcaggtctcggtccttcctgagggcggtgagaccccactgttcaagcagttcttcaagaactggcgggacccagaccagacagatggcctgggcttgtcctacctttccagccatatcgccaacgtggagcgggtgcccttcgacgccgccaccctgcacacctccactgccatggccgcccagcacggcatggatgacgatggcacaggccagaaacagatctggagaatcgaaggttccaacaaggtgcccgtggaccctgccacatatggacagttctatggaggcgacagctacatcattctgtacaactaccgccatggtggccgccaggggcagataatctataactggcagggtgcccagtctacccaggatgaggtcgctgcatctgccatcctgactgctcagctggatgaggagctgggaggtacccctgtccagagccgtgtggtccaaggcaaggagcccgcccacctcatgagcctgtttggtgggaagcccatgatcatctacaagggcggcacctcccgcgagggcgggcagacagcccctgccagcacccgcctcttccaggtccgcgccaacagcgctggagccacccgggctgttgaggtattgcctaaggctggtgcactgaactccaacgatgcctttgttctgaaaaccccctcagccgcctacctgtgggtgggtacaggagccagcgaggcagagaagacgggggcccaggagctgctcagggtgctgcgggcccaacctgtgcaggtggcagaaggcagcgagccagatggcttctgggaggccctgggcgggaaggctgcctaccgcacatccccacggctgaaggacaagaagatggatgcccatcctcctcgcctctttgcctgctccaacaagattggacgttttgtgatcgaagaggttcctggtgagctcatgcaggaagacctggcaacggatgacgtcatgcttctggacacctgggaccaggtctttgtctgggttggaaaggattctcaagaagaagaaaagacagaagccttgacttctgctaagcggtacatcgagacggacccagccaatcgggatcggcggacgcccatcaccgtggtgaagcaaggctttgagcctccctcctttgtgggctggttccttggctgggatgatgattactggtctgtggaccccttggacagggccatggctgagctggctgcctgaggaggggcagggcccacccatgtcaccggtcagtgccttttggaactgtccttccctcaaagaggccttagagcgagcagagcagctctgctatgagtgtgtgtgtgtgtgtgtgttgtttcttttttttttttttacagtatccaaaaatagccctgcaaaaattcagagtccttgcaaaattgtctaaaatgtcagtgtttgggaaattaaatccaataaaaacattttgaagtgtg

SEQ ID NO: 12005 - DNA, 2717 bp, Homo sapiens
tcccgcccgcgccctgcccaccccggccgcgcgcaccacaacgcccccgccccgccgcccggaaccagctgagcgcagctggacccagcagccgctgtctccagtgccgcagcagcaggtagtgctcatagctctctttgtccagtgcttcggccttggtcccagcgccttcccacggagcagcactcttcaccctgcacagccttgttagatacagcgctaggaaaaggggagtaattcaggtctagaatggaaaaactgttttgttgctttcccaacagcatggtggtggaacaccccgagttcctcaaggcagggaaggagcctggcctgcagatctggcgtgtggagaagttcgatctggtgcccgtgcccaccaacctttatggagacttcttcacgggcgacgcctacgtcatcctgaagacagtgcagctgaggaacggaaatctgcagtatgacctccactactggctgggcaatgagtgcagccaggatgagagcggggcggccgccatctttaccgtgcagctggatgactacctgaacggccgggccgtgcagcaccgtgaggtccagggcttcgagtcggccaccttcctaggctacttcaagtctggcctgaagtacaagaaaggaggtgtggcatcaggattcaagcacgtggtacccaacgaggtggtggtgcagagactcttccaggtcaaagggcggcgtgtggtccgtgccaccgaggtacctgtgtcctgggagagcttcaacaatggcgactgcttcatcctggacctgggcaacaacatccaccagtggtgtggttccaacagcaatcggtatgaaagactgaaggccacacaggtgtccaagggcatccgggacaacgagcggagtggccgggcccgagtgcacgtgtctgaggagggcactgagcccgaggcgatgctccaggtgctgggccccaagccggctctgcctgcaggtaccgaggacaccgccaaggaggatgcggccaaccgcaagctggccaagctctacaaggtctccaatggtgcagggaccatgtccgtctccctcgtggctgatgagaaccccttcgcccagggggccctgaagtcagaggactgcttcatcctggaccacggcaaagatgggaaaatctttgtctggaaaggcaagcaggcaaacacggaggagaggaaggctgccctcaaaacagcctctgacttcatcaccaagatggactaccccaagcagactcaggtctcggtccttcctgagggcggtgagaccccactgttcaagcagttcttcaagaactggcgggacccagaccagacagatggcctgggcttgtcctacctttccagccatatcgccaacgtggagcgggtgcccttcgacgccgccaccctgcacacctccactgccatggccgcccagcacggcatggatgacgatggcacaggccagaaacagatctggagaatcgaaggttccaacaaggtgcccgtggaccctgccacatatggacagttctatggaggcgacagctacatcattctgtacaactaccgccatggtggccgccaggggcagataatctataactggcagggtgcccagtctacccaggatgaggtcgctgcatctgccatcctgactgctcagctggatgaggagctgggaggtacccctgtccagagccgtgtggtccaaggcaaggagcccgcccacctcatgagcctgtttggtgggaagcccatgatcatctacaagggcggcacctcccgcgagggcgggcagacagcccctgccagcacccgcctcttccaggtccgcgccaacagcgctggagccacccgggctgttgaggtattgcctaaggctggtgcactgaactccaacgatgcctttgttctgaaaaccccctcagccgcctacctgtgggtgggtacaggagccagcgaggcagagaagacgggggcccaggagctgctcagggtgctgcgggcccaacctgtgcaggtggcagaaggcagcgagccagatggcttctgggaggccctgggcgggaaggctgcctaccgcacatccccacggctgaaggacaagaagatggatgcccatcctcctcgcctctttgcctgctccaacaagattggacgttttgtgatcgaagaggttcctggtgagctcatgcaggaagacctggcaacggatgacgtcatgcttctggacacctgggaccaggtctttgtctgggttggaaaggattctcaagaagaagaaaagacagaagccttgacttctgctaagcggtacatcgagacggacccagccaatcgggatcggcggacgcccatcaccgtggtgaagcaaggctttgagcctccctcctttgtgggctggttccttggctgggatgatgattactggtctgtggaccccttggacagggccatggctgagctggctgcctgaggaggggcagggcccacccatgtcaccggtcagtgccttttggaactgtccttccctcaaagaggccttagagcgagcagagcagctctgctatgagtgtgtgtgtgtgtgtgtgttgtttcttttttttttttttacagtatccaaaaatagccctgcaaaaattcagagtccttgcaaaattgtctaaaatgtcagtgtttgggaaattaaatccaataaaaacattttgaagtgtg

SEQ ID NO: 12006 - DNA, 2734 bp, Homo sapiens
tcccgcccgcgccctgcccaccccggccgcgcgcaccacaacgcccccgccccgccgcccggaaccagctgagcgcagctggacccagcagccgctgtctccagtgccgcagcagcaggtagtgctcatagctctctttgtccagtgcttcggccttggtcccagcgccttcccacggagcagcactcttcaccctgcacagccttgttaggccttggttgctattctgtagaagagcagagtccccataaagaggaggtgcaggaattcttcccagaggctttggagagcccaacagcatggtggtggaacaccccgagttcctcaaggcagggaaggagcctggcctgcagatctggcgtgtggagaagttcgatctggtgcccgtgcccaccaacctttatggagacttcttcacgggcgacgcctacgtcatcctgaagacagtgcagctgaggaacggaaatctgcagtatgacctccactactggctgggcaatgagtgcagccaggatgagagcggggcggccgccatctttaccgtgcagctggatgactacctgaacggccgggccgtgcagcaccgtgaggtccagggcttcgagtcggccaccttcctaggctacttcaagtctggcctgaagtacaagaaaggaggtgtggcatcaggattcaagcacgtggtacccaacgaggtggtggtgcagagactcttccaggtcaaagggcggcgtgtggtccgtgccaccgaggtacctgtgtcctgggagagcttcaacaatggcgactgcttcatcctggacctgggcaacaacatccaccagtggtgtggttccaacagcaatcggtatgaaagactgaaggccacacaggtgtccaagggcatccgggacaacgagcggagtggccgggcccgagtgcacgtgtctgaggagggcactgagcccgaggcgatgctccaggtgctgggccccaagccggctctgcctgcaggtaccgaggacaccgccaaggaggatgcggccaaccgcaagctggccaagctctacaaggtctccaatggtgcagggaccatgtccgtctccctcgtggctgatgagaaccccttcgcccagggggccctgaagtcagaggactgcttcatcctggaccacggcaaagatgggaaaatctttgtctggaaaggcaagcaggcaaacacggaggagaggaaggctgccctcaaaacagcctctgacttcatcaccaagatggactaccccaagcagactcaggtctcggtccttcctgagggcggtgagaccccactgttcaagcagttcttcaagaactggcgggacccagaccagacagatggcctgggcttgtcctacctttccagccatatcgccaacgtggagcgggtgcccttcgacgccgccaccctgcacacctccactgccatggccgcccagcacggcatggatgacgatggcacaggccagaaacagatctggagaatcgaaggttccaacaaggtgcccgtggaccctgccacatatggacagttctatggaggcgacagctacatcattctgtacaactaccgccatggtggccgccaggggcagataatctataactggcagggtgcccagtctacccaggatgaggtcgctgcatctgccatcctgactgctcagctggatgaggagctgggaggtacccctgtccagagccgtgtggtccaaggcaaggagcccgcccacctcatgagcctgtttggtgggaagcccatgatcatctacaagggcggcacctcccgcgagggcgggcagacagcccctgccagcacccgcctcttccaggtccgcgccaacagcgctggagccacccgggctgttgaggtattgcctaaggctggtgcactgaactccaacgatgcctttgttctgaaaaccccctcagccgcctacctgtgggtgggtacaggagccagcgaggcagagaagacgggggcccaggagctgctcagggtgctgcgggcccaacctgtgcaggtggcagaaggcagcgagccagatggcttctgggaggccctgggcgggaaggctgcctaccgcacatccccacggctgaaggacaagaagatggatgcccatcctcctcgcctctttgcctgctccaacaagattggacgttttgtgatcgaagaggttcctggtgagctcatgcaggaagacctggcaacggatgacgtcatgcttctggacacctgggaccaggtctttgtctgggttggaaaggattctcaagaagaagaaaagacagaagccttgacttctgctaagcggtacatcgagacggacccagccaatcgggatcggcggacgcccatcaccgtggtgaagcaaggctttgagcctccctcctttgtgggctggttccttggctgggatgatgattactggtctgtggaccccttggacagggccatggctgagctggctgcctgaggaggggcagggcccacccatgtcaccggtcagtgccttttggaactgtccttccctcaaagaggccttagagcgagcagagcagctctgctatgagtgtgtgtgtgtgtgtgtgttgtttcttttttttttttttacagtatccaaaaatagccctgcaaaaattcagagtccttgcaaaattgtctaaaatgtcagtgtttgggaaattaaatccaataaaaacattttgaagtgtg

SEQ ID NO: 12007 - DNA, 1042 bp, Homo sapiens
ctcccccacccgcctgcccggccgccccgccccgagggcggctcccgcccgcgccctgcccaccccggccgcgcgcaccacaacgcccccgccccgccgcccggaaccagctgagcgcagctggacccagcagccgctgtctccagtgccgcagcagcaggtagtgctcatagctctctttgtccagtgcttcggccttggtcccagcgccttcccacggagcagcactcttcaccctgcacagccttgttagcccaacagcatggtggtggaacaccccgagttcctcaaggcagggaaggagcctggcctgcagatctggcgtgtggagaagttcgatctggtgcccgtgcccaccaacctttatggagacttcttcacgggcgacgcctacgtcatcctgaagacagtgcagctgaggaacggaaatctgcagtatgacctccactactggctgggcaatgagtgcagccaggatgagagcggggcggccgccatctttaccgtgcagctggatgactacctgaacggccgggccgtgcagcaccgtgaggtccagggcttcgagtcggccaccttcctaggctacttcaagtctggcctgaagtacaagaaaggaggtgtggcatcaggattcaagcacgtggtacccaacgaggtggtggtgcagagactcttccaggtcaaagggcggcgtgtggtccgtgccaccgaggtacctgtgtcctgggagagcttcaacaatggcgactgcttcatcctggacctgggcaacaacatccaccagtggtgtggttccaacagcaatcggtatgaaagactgaaggccacacaggtgtccaagggcatccgggacaacgagcggagtggccgggcccgagtgcacgtgtctgaggagggcactgagcccgaggcgatgctccaggtgctgggccccaagccggctctgcctgcaggtaccgaggacaccgccaaggaggatgcggccaaccgcaagctggccaagctctacaaggtctccaatggtgcagggaccatgtcc

SEQ ID NO: 12008 - DNA, 2726 bp, Homo sapiens
tcccgcccgcgccctgcccaccccggccgcgcgcaccacaacgcccccgccccgccgcccggaaccagctgagcgcagctggacccagcagccgctgtctccagtgccgcagcagcaggtagtgctcatagctctctttgtccagtgcttcggccttggtcccagcgccttcccacggagcagcactcttcaccctgcacagccttgttagttcttgcagatacagcgctaggaaaaggggagtaattcaggtctagaatggaaaaactgttttgttgctttcccaacagcatggtggtggaacaccccgagttcctcaaggcagggaaggagcctggcctgcagatctggcgtgtggagaagttcgatctggtgcccgtgcccaccaacctttatggagacttcttcacgggcgacgcctacgtcatcctgaagacagtgcagctgaggaacggaaatctgcagtatgacctccactactggctgggcaatgagtgcagccaggatgagagcggggcggccgccatctttaccgtgcagctggatgactacctgaacggccgggccgtgcagcaccgtgaggtccagggcttcgagtcggccaccttcctaggctacttcaagtctggcctgaagtacaagaaaggaggtgtggcatcaggattcaagcacgtggtacccaacgaggtggtggtgcagagactcttccaggtcaaagggcggcgtgtggtccgtgccaccgaggtacctgtgtcctgggagagcttcaacaatggcgactgcttcatcctggacctgggcaacaacatccaccagtggtgtggttccaacagcaatcggtatgaaagactgaaggccacacaggtgtccaagggcatccgggacaacgagcggagtggccgggcccgagtgcacgtgtctgaggagggcactgagcccgaggcgatgctccaggtgctgggccccaagccggctctgcctgcaggtaccgaggacaccgccaaggaggatgcggccaaccgcaagctggccaagctctacaaggtctccaatggtgcagggaccatgtccgtctccctcgtggctgatgagaaccccttcgcccagggggccctgaagtcagaggactgcttcatcctggaccacggcaaagatgggaaaatctttgtctggaaaggcaagcaggcaaacacggaggagaggaaggctgccctcaaaacagcctctgacttcatcaccaagatggactaccccaagcagactcaggtctcggtccttcctgagggcggtgagaccccactgttcaagcagttcttcaagaactggcgggacccagaccagacagatggcctgggcttgtcctacctttccagccatatcgccaacgtggagcgggtgcccttcgacgccgccaccctgcacacctccactgccatggccgcccagcacggcatggatgacgatggcacaggccagaaacagatctggagaatcgaaggttccaacaaggtgcccgtggaccctgccacatatggacagttctatggaggcgacagctacatcattctgtacaactaccgccatggtggccgccaggggcagataatctataactggcagggtgcccagtctacccaggatgaggtcgctgcatctgccatcctgactgctcagctggatgaggagctgggaggtacccctgtccagagccgtgtggtccaaggcaaggagcccgcccacctcatgagcctgtttggtgggaagcccatgatcatctacaagggcggcacctcccgcgagggcgggcagacagcccctgccagcacccgcctcttccaggtccgcgccaacagcgctggagccacccgggctgttgaggtattgcctaaggctggtgcactgaactccaacgatgcctttgttctgaaaaccccctcagccgcctacctgtgggtgggtacaggagccagcgaggcagagaagacgggggcccaggagctgctcagggtgctgcgggcccaacctgtgcaggtggcagaaggcagcgagccagatggcttctgggaggccctgggcgggaaggctgcctaccgcacatccccacggctgaaggacaagaagatggatgcccatcctcctcgcctctttgcctgctccaacaagattggacgttttgtgatcgaagaggttcctggtgagctcatgcaggaagacctggcaacggatgacgtcatgcttctggacacctgggaccaggtctttgtctgggttggaaaggattctcaagaagaagaaaagacagaagccttgacttctgctaagcggtacatcgagacggacccagccaatcgggatcggcggacgcccatcaccgtggtgaagcaaggctttgagcctccctcctttgtgggctggttccttggctgggatgatgattactggtctgtggaccccttggacagggccatggctgagctggctgcctgaggaggggcagggcccacccatgtcaccggtcagtgccttttggaactgtccttccctcaaagaggccttagagcgagcagagcagctctgctatgagtgtgtgtgtgtgtgtgtgttgtttcttttttttttttttacagtatccaaaaatagccctgcaaaaattcagagtccttgcaaaattgtctaaaatgtcagtgtttgggaaattaaatccaataaaaacattttgaagtgtg

SEQ ID NO: 12009 - DNA, 2767 bp, Homo sapiens
tcccgcccgcgccctgcccaccccggccgcgcgcaccacaacgcccccgccccgccgcccggaaccagctgagcgcagctggacccagcagccgctgtctccagtgccgcagcagcaggtagtgctcatagctctctttgtccagtgcttcggccttggtcccagcgccttcccacggagcagcactcttcaccctgcacagccttgttaggagaaggggatgaatgaatacaggacttacgcgtctgctgtggcccagctggcttccagatggtgacatgagccacccacagccggagctgttcctctttcccaaagctcagcccaacagcatggtggtggaacaccccgagttcctcaaggcagggaaggagcctggcctgcagatctggcgtgtggagaagttcgatctggtgcccgtgcccaccaacctttatggagacttcttcacgggcgacgcctacgtcatcctgaagacagtgcagctgaggaacggaaatctgcagtatgacctccactactggctgggcaatgagtgcagccaggatgagagcggggcggccgccatctttaccgtgcagctggatgactacctgaacggccgggccgtgcagcaccgtgaggtccagggcttcgagtcggccaccttcctaggctacttcaagtctggcctgaagtacaagaaaggaggtgtggcatcaggattcaagcacgtggtacccaacgaggtggtggtgcagagactcttccaggtcaaagggcggcgtgtggtccgtgccaccgaggtacctgtgtcctgggagagcttcaacaatggcgactgcttcatcctggacctgggcaacaacatccaccagtggtgtggttccaacagcaatcggtatgaaagactgaaggccacacaggtgtccaagggcatccgggacaacgagcggagtggccgggcccgagtgcacgtgtctgaggagggcactgagcccgaggcgatgctccaggtgctgggccccaagccggctctgcctgcaggtaccgaggacaccgccaaggaggatgcggccaaccgcaagctggccaagctctacaaggtctccaatggtgcagggaccatgtccgtctccctcgtggctgatgagaaccccttcgcccagggggccctgaagtcagaggactgcttcatcctggaccacggcaaagatgggaaaatctttgtctggaaaggcaagcaggcaaacacggaggagaggaaggctgccctcaaaacagcctctgacttcatcaccaagatggactaccccaagcagactcaggtctcggtccttcctgagggcggtgagaccccactgttcaagcagttcttcaagaactggcgggacccagaccagacagatggcctgggcttgtcctacctttccagccatatcgccaacgtggagcgggtgcccttcgacgccgccaccctgcacacctccactgccatggccgcccagcacggcatggatgacgatggcacaggccagaaacagatctggagaatcgaaggttccaacaaggtgcccgtggaccctgccacatatggacagttctatggaggcgacagctacatcattctgtacaactaccgccatggtggccgccaggggcagataatctataactggcagggtgcccagtctacccaggatgaggtcgctgcatctgccatcctgactgctcagctggatgaggagctgggaggtacccctgtccagagccgtgtggtccaaggcaaggagcccgcccacctcatgagcctgtttggtgggaagcccatgatcatctacaagggcggcacctcccgcgagggcgggcagacagcccctgccagcacccgcctcttccaggtccgcgccaacagcgctggagccacccgggctgttgaggtattgcctaaggctggtgcactgaactccaacgatgcctttgttctgaaaaccccctcagccgcctacctgtgggtgggtacaggagccagcgaggcagagaagacgggggcccaggagctgctcagggtgctgcgggcccaacctgtgcaggtggcagaaggcagcgagccagatggcttctgggaggccctgggcgggaaggctgcctaccgcacatccccacggctgaaggacaagaagatggatgcccatcctcctcgcctctttgcctgctccaacaagattggacgttttgtgatcgaagaggttcctggtgagctcatgcaggaagacctggcaacggatgacgtcatgcttctggacacctgggaccaggtctttgtctgggttggaaaggattctcaagaagaagaaaagacagaagccttgacttctgctaagcggtacatcgagacggacccagccaatcgggatcggcggacgcccatcaccgtggtgaagcaaggctttgagcctccctcctttgtgggctggttccttggctgggatgatgattactggtctgtggaccccttggacagggccatggctgagctggctgcctgaggaggggcagggcccacccatgtcaccggtcagtgccttttggaactgtccttccctcaaagaggccttagagcgagcagagcagctctgctatgagtgtgtgtgtgtgtgtgtgttgtttcttttttttttttttacagtatccaaaaatagccctgcaaaaattcagagtccttgcaaaattgtctaaaatgtcagtgtttgggaaattaaatccaataaaaacattttgaagtgtg

SEQ ID NO: 12010 - DNA, 2453 bp, Homo sapiens
agctggacccagcagccgctgtctccagtgccgcagcagcaggtagtgctcatagctctctttgtccagtgcttcggccttggtcccagcgccttcccacggagcagcactcttcaccctgcacagccttgttagcatggtggtggaacaccccgagttcctcaaggcagggaaggagcctggcctgcagatctggcgtgtggagaagttcgatctggtgcccgtgcccaccaacctttatggagacttcttcacgggcgacgcctacgtcatcctgaagacagtgcagctgaggaacggaaatctgcagtatgacctccactactggctgggcaatgagtgcagccaggatgagagcggggcggccgccatctttaccgtgcagctggatgactacctgaagtacaagaaaggaggtgtggcatcaggattcaagcacgtggtacccaacgaggtggtggtgcagagactcttccaggtcaaagggcggcgtgtggtccgtgccaccgaggtacctgtgtcctgggagagcttcaacaatggcgactgcttcatcctggacctgggcaacaacatccaccagtggtgtggttccaacagcaatcggtatgaaagactgaaggccacacaggtgtccaagggcatccgggacaacgagcggagtggccgggcccgagtgcacgtgtctgaggagggcactgagcccgaggcgatgctccaggtgctgggccccaagccggctctgcctgcaggtaccgaggacaccgccaaggaggatgcggccaaccgcaagctggccaagctctacaaggtctccaatggtgcagggaccatgtccgtctccctcgtggctgatgagaaccccttcgcccagggggccctgaagtcagaggactgcttcatcctggaccacggcaaagatgggaaaatctttgtctggaaaggcaagcaggcaaacacggaggagaggaaggctgccctcaaaacagcctctgacttcatcaccaagatggactaccccaagcagactcaggtctcggtccttcctgagggcggtgagaccccactgttcaagcagttcttcaagaactggcgggacccagaccagacagatggcctgggcttgtcctacctttccagccatatcgccaacgtggagcgggtgcccttcgacgccgccaccctgcacacctccactgccatggccgcccagcacggcatggatgacgatggcacaggccagaaacagatctggagaatcgaaggttccaacaaggtgcccgtggaccctgccacatatggacagttctatggaggcgacagctacatcattctgtacaactaccgccatggtggccgccaggggcagataatctataactggcagggtgcccagtctacccaggatgaggtcgctgcatctgccatcctgactgctcagctggatgaggagctgggaggtacccctgtccagagccgtgtggtccaaggcaaggagcccgcccacctcatgagcctgtttggtgggaagcccatgatcatctacaagggcggcacctcccgcgagggcgggcagacagcccctgccagcacccgcctcttccaggtccgcgccaacagcgctggagccacccgggctgttgaggtattgcctaaggctggtgcactgaactccaacgatgcctttgttctgaaaaccccctcagccgcctacctgtgggtgggtacaggagccagcgaggcagagaagacgggggcccaggagctgctcagggtgctgcgggcccaacctgtgcaggtggcagaaggcagcgagccagatggcttctgggaggccctgggcgggaaggctgcctaccgcacatccccacggctgaaggacaagaagatggatgcccatcctcctcgcctctttgcctgctccaacaagattggacgttttgtgatcgaagaggttcctggtgagctcatgcaggaagacctggcaacggatgacgtcatgcttctggacacctgggaccaggtctttgtctgggttggaaaggattctcaagaagaagaaaagacagaagccttgacttctgctaagcggtacatcgagacggacccagccaatcgggatcggcggacgcccatcaccgtggtgaagcaaggctttgagcctccctcctttgtgggctggttccttggctgggatgatgattactggtctgtggaccccttggacagggccatggctgagctggctgcctgaggaggggcagggcccacccatgtcaccggtcagtgccttttggaactgtccttccctcaaagaggccttagagcgagcagagcagctctgctatgagtgtgtgtgtgtgtgtgtgttgtttcttttttttttttttacagtatccaaaaatagccctgcaaaaattcagagtccttgcaaaattgtctaaaatgtcagt

SEQ ID NO: 12011 - DNA, 2428 bp, Homo sapiens
gtgctcccagggcccacaactgcttgaatgactattggtgttcctgtttgtgtgccctctgggccgggaagtcagagaaagaaaggagacaatttgtgattgaacagccactgtggccatcattctccttacctgtctgatgagagctgatcttcatgccactgtgtacacccaacagcatggtggtggaacaccccgagttcctcaaggcagggaaggagcctggcctgcagatctggcgtgtggagaagttcgatctggtgcccgtgcccaccaacctttatggagacttcttcacgggcgacgcctacgtcatcctgaagacagtgcagctgaggaacggaaatctgcagtatgacctccactactggctgggcaatgagtgcagccaggatgagagcggggcggccgccatctttaccgtgcagctggatgactacctgaacggccgggccgtgcagcaccgtgaggtccagggcttcgagtcggccaccttcctaggctacttcaagtctggcctgaagtacaagaaaggaggtgtggcatcaggattcaagcacgtggtacccaacgaggtggtggtgcagagactcttccaggtcaaagggcggcgtgtggtccgtgccaccgaggtacctgtgtcctgggagagcttcaacaatggcgactgcttcatcctggacctgggcaacaacatccaccagtggtgtggttccaacagcaatcggtatgaaagactgaaggccacacaggtgtccaagggcatccgggacaacgagcggagtggccgggcccgagtgcacgtgtctgaggagggcactgagcccgaggcgatgctccaggtgctgggccccaagccggctctgcctgcaggtaccgaggacaccgccaaggaggatgcggccaaccgcaagctggccaagctctacaaggtctccaatggtgcagggaccatgtccgtctccctcgtggctgatgagaaccccttcgcccagggggccctgaagtcagaggactgcttcatcctggaccacggcaaagatgggaaaatctttgtctggaaaggcaagcaggcaaacacggaggagaggaaggctgccctcaaaacagcctctgacttcatcaccaagatggactaccccaagcagactcaggtctcggtccttcctgagggcggtgagaccccactgttcaagcagttcttcaagaactggcgggacccagaccagacagatggcctgggcttgtcctacctttccagccatatcgccaacgtggagcgggtgcccttcgacgccgccaccctgcacacctccactgccatggccgcccagcacggcatggatgacgatggcacaggccagaaacagatctggagaatcgaaggttccaacaaggtgcccgtggaccctgccacatatggacagttctatggaggcgacagctacatcattctgtacaactaccgccatggtggccgccaggggcagataatctataactggcagggtgcccagtctacccaggatgaggtcgctgcatctgccatcctgactgctcagctggatgaggagctgggaggtacccctgtccagagccgtgtggtccaaggcaaggagcccgcccacctcatgagcctgtttggtgggaagcccatgatcatctacaagggcggcacctcccgcgagggcgggcagacagcccctgccagcacccgcctcttccaggtccgcgccaacagcgctggagccacccgggctgttgaggtattgcctaaggctggtgcactgaactccaacgatgcctttgttctgaaaaccccctcagccgcctacctgtgggtgggtacaggagccagcgaggcagagaagacgggggcccaggagctgctcagggtgctgcgggcccaacctgtgcaggtggcagaaggcagcgagccagatggcttctgggaggccctgggcgggaaggctgcctaccgcacatccccacggctgaaggacaagaagatggatgcccatcctcctcgcctctttgcctgctccaacaagattggacgttttgtgatcgaagaggttcctggtgagctcatgcaggaagacctggcaacggatgacgtcatgcttctggacacctgggaccaggtctttgtctgggttggaaaggattctcaagaagaagaaaagacagaagccttgacttctgctaagcggtacatcgagacggacccagccaatcgggatcggcggacgcccatcaccgtggtgaagcaaggctttgagcctccctcctttgtgggctggttccttggctgggatgatgattactggtctgtggaccccttggacagggccatggctgagctggctgcctgaggaggggcagggcccacccatgtcaccggtcagtgccttttggaactgtcctt

SEQ ID NO: 12012 - DNA, 5397 bp, Homo sapiens
cccgctccctacctaaggcgtgaggctacgagcggtcggctgtggcagcttctcttgtctctgacggcttgtagttatggggcaggagccgcggacgctgccgccctcccccaactggtactgcgcccgctgcagcgatgccgtgcccgggggcctctttggcttcgccgcgcggacctccgtcttccttgtccgcgtgggcccgggcgcaggcgagagtccagggacacccccgtttcgagtcataggagagttggtgggacacaccgaaagggtctctggcttcacattttctcatcaccctggtcagtacaacctctgtgccaccagctccgacgatgggactgtgaaaatatgggatgtagagacaaaaacagttgtgacagaacatgcactccatcagcatacgatatcaacattacattggtctcctcgagtaaaggacttaatagtatctggggatgaaaaaggagtagttttctgttactggtttaacagaaatgacagccagcacctctttatagaacccaggacaattttctgtcttacttgttcacctcatcatgaagatttagtagccattggctacaaggatggcatagtggtgataattgacatcagtaagaaaggagaagttattcataggcttcgaggccatgatgatgaaatccactccatagcctggtgtcccctgcctggtgaagattgtttatctataaaccaagaggaaacttcagaagaagctgaaattaccaacgggaatgctgtagcacaagctccagtaacaaaaggttgctacttagccactggaagcaaagatcaaaccattcgaatctggagctgttctagaggccgaggggtgatgattttgaaattgccctttctgaagagaagaggagggggtatagacccaactgttaaagagcgcctttggttgacactccattggcccagcaatcaaccaacacagctggtatctagctgttttggaggtgaactgttgcaatgggatctcactcaatcttggagacggaaatacaccctcttcagtgcctcatcagaagggcaaaatcattcaagaattgtgtttaatttatgtcctttacaaacagaggatgacaaacagctattactttctacatcaatggatagagatgtaaaatgttgggacatagccaccttggagtgcagctggacccttccttcccttggtgggtttgcatacagcctggctttctcttctgtggacataggctctttggccataggtgttggggatggcatgatccgtgtatggaatacactctccataaagaacaactatgatgtgaaaaatttttggcaaggcgtgaagtccaaggttacagcgctgtgctggcacccaaccaaggaaggttgcttagcttttggaactgatgatggaaaagtgggattgtatgacacctactccaacaagcctccacagatttctagcacatatcataagaagactgtatatactttagcctgggggccaccagtaccccccatgtcacttggaggagaaggagacagaccttcccttgctttatacagctgtggaggagaagggattgtcttacagcataatccctggaagcttagtggagaagcctttgacatcaacaaactcatcagggacaccaattcaatcaaatacaaattgcctgtacacacagagataagttggaaagcagatggcaaaatcatggctcttggcaatgaagatggatcaatagaaatatttcagattcccaacctgaaactgatctgtactatccaacagcatcacaagcttgtgaataccattagctggcatcatgagcatggcagccagccagaattgagctatctgatggcctctggctccaacaatgcagtcatttacgtgcacaacctgaagactgtcatagagagcagccctgagtctccagtgaccattacagagccctaccggaccctctcagggcatacggccaagattaccagtgtggcgtggagcccacatcatgatggaaggctggtatctgcttcctatgatggtacagcccaggtgtgggatgctctccgggaagagcccctgtgcaatttccgaggacatcgaggtcgactgctttgtgtggcatggtctcctttggatccagactgcatctattcaggggcagatgacttttgtgtgcacaagtggctcacttccatgcaagatcattcccggcctcctcaaggcaaaaaaagtattgaattggagaaaaaacggctctctcaacctaaggcaaagcccaaaaagaagaaaaagcccaccttgagaactcctgtaaagctggaatcgattgatggaaatgaagaagaaagcatgaaggagaactcaggacctgttgagaatggtgtgtcagaccaagaaggggaggagcaagcacgggagccggaattaccctgtggccttgctccagcggtttctagagaaccagttatctgcactccagtttcctcaggctttgaaaagtcaaaagtcaccattaataacaaagtcattttactgaaaaaggagccaccaaaagagaagccagaaaccttaatcaagaagagaaaagctcgttccttgcttcccctgagtacaagcctggaccacagatccaaagaggagcttcatcaggactgtttggtactagcaactgcaaagcactccagagagctgaatgaagatgtgtctgctgatgttgaggaaagatttcatctggggcttttcacagacagggctaccctgtatagaatgattgatattgaaggaaaaggtcacttagaaaatggccaccctgagttatttcaccagcttatgctttggaaaggagatctcaaaggtgttctccagactgcagcagaaagaggggagctgacagacaaccttgtggctatggcaccagcagctggctaccatgtgtggctatgggctgtggaagcttttgccaaacagctgtgttttcaggatcagtatgtcaaggctgcttctcacctactttccatccacaaagtgtatgaagcggtggagctgctcaagtcaaaccatttttacagggaagctattgcgattgccaaggcccggctgcgcccggaggacccagtcctgaaggacttgtacctcagctggggaaccgtcctagaaagagatggccactatgctgtagctgccaaatgctatttaggggccacttgtgcttatgatgcagccaaagttttggccaaaaagggggatgcggcatcacttagaacggctgcagagttggctgccatcgtaggagaggatgagttgtctgcttccctggctctcagatgtgcccaagagctgcttctggccaacaactgggtgggagcccaggaagccctgcagctgcatgaaagtctacagggtcagagattggtgttttgccttctggagctactgtccaggcatctggaggaaaagcagctttcagagggcaaaagctcctcctcttaccacacttggaacacgggcaccgaagggcctttcgtggagagggtgactgcagtgtggaagagcatcttcagccttgacacccctgagcagtatcaggaagcctttcagaagctgcagaacatcaagtacccatctgctacaaataacacacctgccaaacagctcctgcttcacatttgccatgacttgaccctggcagtgctgagccaacagatggcctcctgggacgaggctgtgcaggcgctccttcgggcggtggtccggagctatgactcagggagcttcaccatcatgcaggaagtgtactcagcctttctccctgacggctgtgaccacctaagagacaagttgggggaccatcaatcccctgccacaccagctttcaaaagtttggaggccttttttctttatgggcgtctgtatgaattctggtggtctctctccagaccttgcccaaattccagtgtctgggtaagggctggtcacagaacactctctgttgagccaagccagcagttagacactgccagcactgaagaaacggaccctgaaacttctcagccagagccaaacaggccttcagaactagacttgagactcacagaagaaggtgagcgaatgctgagtacttttaaggagctcttttcagaaaagcatgccagtctccaaaactcacagagaactgttgctgaagtccaagagaccttggcagaaatgatccgacaacaccaaaagagtcaactctgtaaatccacagcaaatggtcctgataagaatgaaccggaagtagaagcagagcagcccctctgcagttctcagagccagtgtaaagaagaaaaaaatgagccactttctctgcctgagttaaccaaaaggcttaccgaggcaaatcagagaatggcgaaatttcctgagagcattaaggcctggcccttcccagatgtgctggagtgctgcctcgtcctgcttctcatcaggtcccactttcctggctgtctggcccaggaaatgcagcagcaggcccaagagctccttcagaaatacggcaacacgaaaacttacagaagacactgccagaccttctgtatgtgaattttcacacaccttgaagaaactgccaaattgaaaatgtttgacatctttcacctctgcagttatgcctcaccagacattcactctggtccctagatgtttttgcagtaatccaaaagaatacaaacaaggattaagtttgaatcaaccctgcctacccatagacaacggtggatctgactttagactcaattgtggtctcctactggagggaagatcatgaaaagcccacagtagttattcagaactaacacctgcagagtgttggtcatctctacagccttaggcaggtttcacccaaagaggagaaacttctgtcgtcacccaaagtgttacatgcttaaaacacaagctacctttgtaaatacttcatctgatcagaagtgtgtcatgcttgtttgagatggagttgctgcattttaggactattgatacctttttttaattgtttttataatatttaatttgaaagaggagacccttctctctctactctttcatagactgaagtttgaatatgaaataggccttaaccatcatgttgactctcctgtcagaattttaggttggaaatttggttttattctttcatgtaattgcttatttgaacagatcacttactaaagctttagaagaagtgattcaaatgtgtgttttcccttcagttttataacaaatggattgatggcagtcaaatagctcaggaataaattactgtttcaatggttcttaaactttcttggatcataggatccttttgagaatcagattaaagccaaagatactctttggag

SEQ ID NO: 12013 - DNA, 1647 bp, Homo sapiens
ggacctcggtgagtacaaggtggtggggggtcgccagcaggttccctctccccggccccagctctggacgctcaccccagtgcaacgccctgagtgacggaaagaggtctggcggcttctctgttgacaactcagctggttccacaccctggcaattgtgaagagttggccaaatgtttgtccactgagctgatctcctctctggagcaccggggccaccaggagggagccaagacaatgcaaactccagtgaacattcccgtgcctgtgctccggctgccccggggccctgatggcttcagccgtggctttgcccctgatggacgcagagcccccttgaggccagaggttcctgaaatccaggagtgtcccatagctcaagaatccctggaatcccaggagcagcgggcacgagccgcccttcgggagcgttacctccgcagcctgctggccatggtgggtcatcaggtgagcttcacgttgcacgagggtgtgcgtgtggccgcccactttggagccaccgacctggatgtggccaacttctacgtgtcacagctgcagactcccataggtgtgcaagcagaggcgctgctccgatgtagtgacattatttcatataccttcaagccataaagatattgtgttcacttttctgcttgaggctaaggcactgtatcccaggcctcccaatgttcccgagccaggaactctgggccccatggagttatgagctcccttggaattttgagccaagctttaagcaagtctggactcctgagacctcctgggtctagtcagtaaaattctgcaactctaggaattctaagatcccattggaaggaatgctctacctcacagaactctgaaccctacagaaatatgggcctgctgccatttcctgaagaccggggcatcggggtggggtgataaaggatacaacctgcacagggggaagttattaaagaggctgcaaagtccagccaccctgaagatactccccagtgctcccctcctgctaaagaaccagttaccccaggaaaattcgactcctgtttttctttaattaactataccgacggggatggagtcatctttaggggctggtagggtggttatccaagggctgaatccagtggagctgggccaagtacgacaggagtccagataaaggtgtaggggctgcacggccgcaagtctcctggaaaggctggagtgaccggcatgccgggattgggagattaggatttgatttcattttggggcgggcggtggctcgtgctgggtcacgtggtcgtgcccaagcgctcctcctgttgccccacctgtggttgctgtggactgcacacgacagcagattcgctgtcccctcgttggaggcgaatggtcggaccccgagtggcggcgcccctgataaaaggccgaggattcgcgatcagggtgcaacttcactccctcctcttttctctccagccttgcagcgtggccgttcacatcacgcgcttcactaagcctcctatcactagtaacctttcagcgcattgtttaaaaagaaagcagtttctgtccctttctgtagttcctttaagttcaggatgtaagcgaagccttccattaagtaaaggtgagtgtcgtttcgtctcagtcgcg

SEQ ID NO: 12014 - DNA, 1524 bp, Homo sapiens
ggacctcggtgagtacaaggtggtggggggtcgccagcaggttccctctccccggccccagctctggacgctcaccccagtgcaacgccctgagtgacggaaagagccaagacaatgcaaactccagtgaacattcccgtgcctgtgctccggctgccccggggccctgatggcttcagccgtggctttgcccctgatggacgcagagcccccttgaggccagaggttcctgaaatccaggagtgtcccatagctcaagaatccctggaatcccaggagcagcgggcacgagccgcccttcgggagcgttacctccgcagcctgctggccatggtgggtcatcaggtgagcttcacgttgcacgagggtgtgcgtgtggccgcccactttggagccaccgacctggatgtggccaacttctacgtgtcacagctgcagactcccataggtgtgcaagcagaggcgctgctccgatgtagtgacattatttcatataccttcaagccataaagatattgtgttcacttttctgcttgaggctaaggcactgtatcccaggcctcccaatgttcccgagccaggaactctgggccccatggagttatgagctcccttggaattttgagccaagctttaagcaagtctggactcctgagacctcctgggtctagtcagtaaaattctgcaactctaggaattctaagatcccattggaaggaatgctctacctcacagaactctgaaccctacagaaatatgggcctgctgccatttcctgaagaccggggcatcggggtggggtgataaaggatacaacctgcacagggggaagttattaaagaggctgcaaagtccagccaccctgaagatactccccagtgctcccctcctgctaaagaaccagttaccccaggaaaattcgactcctgtttttctttaattaactataccgacggggatggagtcatctttaggggctggtagggtggttatccaagggctgaatccagtggagctgggccaagtacgacaggagtccagataaaggtgtaggggctgcacggccgcaagtctcctggaaaggctggagtgaccggcatgccgggattgggagattaggatttgatttcattttggggcgggcggtggctcgtgctgggtcacgtggtcgtgcccaagcgctcctcctgttgccccacctgtggttgctgtggactgcacacgacagcagattcgctgtcccctcgttggaggcgaatggtcggaccccgagtggcggcgcccctgataaaaggccgaggattcgcgatcagggtgcaacttcactccctcctcttttctctccagccttgcagcgtggccgttcacatcacgcgcttcactaagcctcctatcactagtaacctttcagcgcattgtttaaaaagaaagcagtttctgtccctttctgtagttcctttaagttcaggatgtaagcgaagccttccattaagtaaaggtgagtgtcgtttcgtctcagtcgcg

SEQ ID NO: 12015 - DNA, 3514 bp, Homo sapiens
cgacgcggaaccgaggcggcggcggcggctgcggcggcaggaaatcggggctcggccccgccggcgcgcgaccccatccccatcccggtccctgcagagcgatccccgggcccagatatggacgcagcagagccgggactccccccaggtcctgagggcaggaagaggtacagtgacatcttccggagcctggacaacctcgaaatctcactggggaacgtgacccttgagatgctggctggagaccctctactctcagaagacccagaacctgacaagacccctacagccactgttaccaacgaagccagctgttggagcggcccctccccagagggtcctgtacccctcacaggggaggaactggacttgcggctcattcggacaaaggggggtgtggacgcagccctggaatatgccaagacctggagccgctatgccaaggaactgcttgcctggactgaaaagagagccagctatgagctggagtttgctaagagcaccatgaagatcgctgaagctggcaaggtgtccattcaacagcagagccacatgcctctgcagtacatctacaccctgtttctggagcacgatctcagcctgggaaccctggccatggagacagtggcccagcagaaaagagactactaccagcccctcgccgccaaacggactgagattgagaagtggcggaaggagttcaaggagcagtggatgaaggagcagaagcggatgaatgaggcggtgcaggcactgcggcgcgcccagctgcagtatgtgcaacgcagcgaggacctgcgggcacgctcccaggggtcccctgaggactcggccccccaggcctcgccgggacctagcaagcagcaggagcggcggcggcgctcgcgagaggaggcccaggccaaggcgcaggaggccgaggcgctgtaccaggcctgtgtccgcgaggccaacgcgcggcagcaggacctggagatcgccaagcagcgaatcgtgtcgcacgtgcgcaagctggtgtttcagggggatgaagtgctgaggcgggtgacgctgagtctcttcgggctgcggggggcgcaggcagagcgtggcccccgcgccttcgccgccctggccgagtgctgtgcgccctttgagccgggccagcgctaccaggagtttgtacgggcgctgcggcccgaggccccgccgcccccgccgcccgccttctccttccaggagttccttccctccttgaacagctcccctctggacatcagaaagaagctctctgggcctcttcctccaaggctggatgagaattcagctgagccaggcccttgggaggatccgggcacaggctggcgctggcaagggactccaggccccactccgggcagcgatgtggacagcgtgggtggcggcagcgagtctcggtccctggactcacccacttccagcccaggcgctggcacgaggcagctggtgaaggcttcgtccacaggcactgagtcctcagatgactttgaggagcgagaccctgacctgggagacgggctggagaatgggctgggcagccccttcgggaagtggacactgtccagcgcggctcagacccaccagctgcggcgactgcggggcccagccaagtgccgcgagtgcgaagccttcatggtcagcgggacggagtgtgaggagtgctttctgacctgccacaagcgctgcctggagactctcctgatcctctgtggacacaggcggctcccagcccggacacccctttttggggttgacttcctgcagctacccagggacttcccggaggaggtaccctttgtggtcacgaagtgcacggctgagatagaacaccgtgccctggatgtgcagggcatttaccgggtcagcgggtcccgggtccgtgtggagcggctgtgccaggctttcgagaatggccgagcgttggtggagctgtcggggaactcgcctcatgacgtctcgagtgtcctcaagcgatttcttcaggagctcaccgagcccgtgatccccttccacctctacgacgccttcatctctctggctaagaccttgcatgcagaccctggggacgaccctgggacccccagccccagccctgaggttatccgctcgctgaagaccctcttggtacagctgcctgactctaactacaacaccctgcggcacctggtggcccatctgttcagggtggctgcacgatttatggaaaacaagatgtctgccaacaacctgggcattgtgtttgggccgacactgctgcggccgccggacggcccgcgggcagccagcgccatccctgtcacctgcctgctggactctgggcatcaggcccagcttgtggagttcctcatcgtgcactacgagcagatctttgggatggatgagctcccccaggccactgagcccccgccccaagactccagcccagcccctgggcccctcacaaccagctcccaaccgccacccccgcaccttgacccagactcccagcccccagtcctagcctcagaccccggcccagacccccagcaccacagtaccctggagcagcatcccacggccacacctaccgagattccaactccacagagtgaccagagagaggacgtggctgaagacaccaaagatgggggaggggaagtgtccagccaaggcccagaggactcactcctggggacacagtctcgtggccacttcagccgccagccagtgaagtatccccggggcggtgtgaggcctgtaacccaccagctgtccagtctggccctggtggcttccaagctgtgcgaggagacccccatcacatcagtgcccagagggagtttgcgggggcgggggcccagccctgcagctgcctcccctgagggcagccccctgcgccgcaccccgctgcccaagcattttgagattacccaggagacagcccggctactctcgaaattggacagcgaggctgtgcccagggccacctgctgcccggacgtccagcctgaggaagccgaggaccatctctgaccaccctggcaccttaaataaggaagaggcccagattgtgaagacggacccatatatccctacctcccaccacctagtggccaaacaccccgccaggagttcaatgctgggagaggtccagagggttcctataaggaaaaactatttaatacatgacctaggggaggcctaaaacccttttggggataatgtcccagagtccccccactagacacaggtcactgccaagcatcagggccactcgggctcagaggtcactcagggtcaatactcagggtcagtgcaggttatgagatccttggggtccaccctagtctctgacacctgggacaggggtgcttttgctactttggttgtggtcactcccccacacctgcctgcctccttcacggactcgaagtgaccttcctggaggaggtgggcagctcagactccacatgctggtggtgcctgaggtctgatggcctctaataaactgtgtcct

SEQ ID NO: 12016 - DNA, 3034 bp, Homo sapiens
aaatcggggctcggccccgccggcgcgcgaccccatccccatcccggtccctgcagagcgatccccgggcccagatatggacgcagcagagccgggactccccccaggtcctgagggcaggaagaggtacagtgacatcttccggagcctggacaacctcgaaatctcactggggaacgtgacccttgagatgctggctggagaccctctactctcagaagacccagaacctgacaagacccctacagccactgttaccaacgaagccagctgttggagcggcccctccccagagggtcctgtacccctcacaggggaggaactggacttgcggctcattcggacaaaggggggtgtggacgcagccctggaatatgccaagacctggagccgctatgccaaggaactgcttgcctggactgaaaagagagccagctatgagctggagtttgctaagagcaccatgaagatcgctgaagctggcaaggtgtccattcaacagcagagccacatgcctctgcagtacatctacaccctgtttctggagcacgatctcagcctgggaaccctggccatggagacagtggcccagcagaaaagagactactaccagcccctcgccgccaaacggactgagattgagaagtggcggaaggagttcaaggagcagtggatgaaggagcagaagcggatgaatgaggcggtgcaggcactgcggcgcgcccagctgcagtatgtgcaacgcagcgaggacctgcgggcacgctcccaggggtcccctgaggactcggccccccaggcctcgccgggacctagcaagcagcaggagcggcggcggcgctcgcgagaggaggcccaggccaaggcgcaggaggccgaggcgctgtaccaggcctgtgtccgcgaggccaacgcgcggcagcaggacctggagatcgccaagcagcgaatcgtgtcgcacgtgcgcaagctggtgtttcagggggatgaagtgctgaggcgggtgacgctgagtctcttcgggctgcggggggcgcaggcagagcgtggcccccgcgccttcgccgccctggccgagtgctgtgcgccctttgagccgggccagcgctaccaggagtttgtacgggcgctgcggcccgaggccccgccgcccccgccgcccgccttctccttccaggagttccttccctccttgaacagctcccctctggacatcagaaagaagctctctgggcctcttcctccaaggctggatgagaattcagctgagccaggcccttgggaggatccgggcacaggctggcgctggcaaggccccactccgggcagcgatgtggacagcgtgggtggcggcagcgagtctcggtccctggactcacccacttccagcccagacctgggagacgggctggagaatgggctgggcagccccttcgggaagtggacactgtccagcgcggctcagacccaccagctgcggcgactgcggggcccagccaagtgccgcgagtgcgaagccttcatggtcagcgggacggagtgtgaggagtgctttctgacctgccacaagcgctgcctggagactctcctgatcctctgtggacacaggcggctcccagcccggacacccctttttggggttgacttcctgcagctacccagggacttcccggaggaggtaccctttgtggtcacgaagtgcacggctgagatagaacaccgtgccctggatgtgcagggcatttaccgggtcagcgggtcccgggtccgtgtggagcggctgtgccaggctttcgagaatggccgagcgttggtggagctgtcggggaactcgcctcatgacgtctcgagtgtcctcaagcgatttcttcaggagctcaccgagcccgtgatccccttccacctctacgacgccttcatctctctggctaagaccttgcatgcagaccctggggacgaccctgggacccccagccccagccctgaggttatccgctcgctgaagaccctcttggtacagctgcctgactctaactacaacaccctgcggcacctggtggcccatctgttcagggtggctgcacgatttatggaaaacaagatgtctgccaacaacctgggcattgtgtttgggccgacactgctgcggccgccggacggcccgcgggcagccagcgccatccctgtcacctgcctgctggactctgggcatcaggcccagcttgtggagttcctcatcgtgcactacgagcagatctttgggatggatgagctcccccaggccactgagcccccgccccaagactccagcccagcccctgggcccctcacaaccagctcccaaccgccacccccgcaccttgacccagactcccagcccccagtcctagcctcagaccccggcccagacccccagcaccacagtaccctggagcagcatcccacggccacacctaccgagattccaactccacagagtgaccagagagaggacgtggctgaagacaccaaagatgggggaggggaagtgtccagccaaggcccagaggactcactcctggggacacagtctcgtggccacttcagccgccagccagtgaagtatccccggggcggtgtgaggcctgtaacccaccagctgtccagtctggccctggtggcttccaagctgtgcgaggagacccccatcacatcagtgcccagagggagtttgcgggggcgggggcccagccctgcagctgcctcccctgagggcagccccctgcgccgcaccccgctgcccaagcattttgagattacccaggagacagcccggctactctcgaaattggacagcgaggctgtgcccagggccacctgctgcccggacgtccagcctgaggaagccgaggaccatctctgaccaccctggcaccttaaataaggaagaggcccagattgtgaagacggacccatatatccctacctcccaccacctagtggccaaacaccccgccaggagttcaatgctgggagaggtccagagggttcctat

SEQ ID NO: 12017 - DNA, 3422 bp, Homo sapiens
atgaacaccattctgccttgccaagaccagtactttgtaggaggccagagctataattgcccgtattccactacaacgtcagaatctagtgttgacgtttccacggagacttgggtctctttctgggctgctggtctcctggacaacagagagctccaacaagcaccacaggcacaggaatcattcagtgactcaaattttcctcttccggacttgtgctcatgggaagaggctcagctttcctctcagctctacagaaataagcagctgcaagataccctggtgcagaaggaagaagaactcgccaggttacacgaagagaataatcacctcagacaatacctgaattctgctttggttaaatgtcttgaagaaaaggccaagaaattgctctcatctgatgagttctccaaagcatatggaaaattcaggaaggggaagagaaaatccaaagagcaaagatactctcctgctgagattccccatcccaaaaatgccaaaagaaacctctctagtgaatttgctaactgtgaagaacaagctgggccccctgtggatccctgggtccttcaaacacttgggttaaaagaccttgacactatcgatgacacctcatcagctaactacagtgccctcgcatctcatcccagaagagtcgccagcacattttcccagtttccggatgatgcagttgattataaaaatatccccagagaggatatgccaattgactatagaggtgacagaacaacccccttgcacagcactgccactcatggagaagatttccacatcctttctcaactttcaaatcccccagtggggctgaaaactcttccttactatactgctcatgtgtcacccaacaagacagagatggcattttccacatccctgagccctcattgtaatgtgaaaactcattccttccaccagggacaagcctttgtgcgtcgagatgaggagggaggctggaagtttacctgggtccctaagcagtcttagtgacccctcttttatcacaaagcactgccacgaactctgtttacaaagacctctcttgcacttgaatttgactatgtggaacacagaagctgttgcttagactgtctcctgccactttaaatgtcactctcaattacccacttaaatctgcagggaatggcttccaagaatccataatgaaacgtgtccgcgcttcttttacctaaatttgacttgtttacacaccaatacctgctattgacatcctctctttgccctatacttgataaggtattttccactcacttctatattcctttaagacctagatacatttttccaattttaaccagtttaacagattttcctcttttaagtagttgaaatattcacagcccttttacttttctccctttgtcatttctgaaaactgtctttagaatgagccctatttttgcttcaagtacttgctactgcatgttcaaatagctgagggtggggttgaaacaagtgtctttgcccatcaccactactcctgaagacataatgtggatgtgtgtagcattatgttcatggcagttcaaaaagttcagtgccccatagtggcattgacaaagcctcttaaaacaactgtaactccactaataatcaatatcacagataaactttaaaattacaaagaatttaaattatttttaaatgcctcatgatgtatcagcttctatatgtacccagcatcatttctttaaccaacatgactccaagaagaacattttgagggactgtggtaacaaaactagtcatcatctgcaactacccagatgctgacaaactcctattgctgaaaatagactaacctagctcagccattgtctcattcattcattcattcgcgtattcattttttcattgatcagtccacccaagaaatctgtagaatacctaatgcctactttgtaccaggcactatgctatgtgatggtgataaaatacaagcaatttagacactgtggccaccatcatgagacttagacctactcatctgctatgactttgcgaaaacgacttcccttttgtgaaggttcagtttcccaactgtagaatacagaagttggactagataattactaatattctatgaattgaggctgggtcctatcagatttactccaacatggcagtttcaggtcactgaagaaactaaagagaagtctttagataggcactgcaagtattaggtagggtaaactttatgtacaattaataaaattcaaaaacataagtcatttgaagttaacattagaaatcattgctctgatcacagtactctttttctagagcccattttgcagttaactcggcgtaactgtgtaagaataatttgcctctaaaaatagatacatattaatttttaaataagtgcggatagattgcatataaatattgctatcaaggacttcatatttctaaatttgaaacaatatattttcagtgcttgtgctagttttcttctttcccatctctcaagacccctatcattcccagaataatttgcacatcctgcatgtgcacctatgttttttggacaaacttcaattaatgatgaaatctttcatgttgaaacctgttctcatttttctcttttccacatctcaataagtcatcttgcacaatcaatatctcgtaggtcaactgtgttggttaggattctttgtaacagagacatgcctttcattgttgtttctgtttggttgttgctttattttggtgatgtaagcaaagggtctgttttataaagttttgttgccacccacttttaaaaataatttatgaagaaaatccaatatagtaattaatattactctctggagtactttaagaagtagaacacattccattttctaaaaaataaaataaaataaataactgtgccttttacattctggtatctgggcccctggtcggtgaaatttgtcgctttttagaataagagatttaaggattcgaattattgtactttatgacactaggaattgagaaagtaatataactaattttgaaagtctaataatcaagctgtaaaaggaaatgtatgagttaacaaatatttattttgcattctttgtgtgccttatcatgtgttaagtaccatgagggtacacccaggcttagcacaatgcatttggtatacaaaaccatgtaaaatgtcatagcttttgatagcttttaaatgaaacttaattttggcccagtttaaagatattaccgaacatttgggataaaatgtgatggtttcctggcttctatcatggacgatgttatggaagacaattaccacgtttttgaaatcatgtctataaatatttaatatccatttaaattatgtatagaaaattattttgttcatgttttagaaattaaacatttctttcacctga

SEQ ID NO: 12018 - DNA, 5722 bp, Homo sapiens
gcagttgcggggtttcgcgccgccggagtctgagaggccggaagtgccccttagcgggtgggggaagctggtaggcacgggcggctccgcagtgaccggactcgggggagcagataatcaccagaatgggagtgaatgacttgtggcaaattttggagcctgttaagcaacacatccccttgcgtaatcttggtgggaaaaccattgcagttgatctgagtctctgggtgtgtgaggcacagacagtcaaaaaaatgatgggcagcgtcatgaagccccacctcaggaacttattttttcgtatctcatatttaacacaaatggatgtaaaactggtatttgttatggaaggggaaccaccaaagctgaaagctgatgtcataagcaagaggaatcagtctcggtatgggtcttctggaaaatcgtggtctcagaaaacagggagatcacattttaaatcagtcttaagagagtgcctccatatgctcgaatgcttaggaatcccctgggttcaggctgctggggaagctgaagccatgtgtgcttatctcaatgctggtggtcatgtcgatggctgcctcaccaatgatggagatactttcctttatggggcccagactgtttacaggaatttcactatgaatacaaaggacccacatgttgactgttacacaatgtcatctatcaagagtaaactaggtttggatagagatgctctggttggattagcaatacttcttggctgtgattatctcccaaagggagtccctggagttggaaaagagcaagcattaaaacttatacagattttgaaagggcaaagtttacttcagaggtttaatcggtggaatgaaacatcttgtaactctagtccacaactgctagtcactaaaaaactggctcattgttccgtatgttcccatccaggttcacctaaggatcatgaacgtaatggatgcagattatgtaaaagtgataaatattgtgagccacatgactatgaatactgctgtccttgtgagtggcaccgtacagaacatgataggcaactcagtgaagtagagaacaatattaagaagaaagcttgctgttgtgagggattcccattccatgaggttattcaagaattccttttaaacaaggataaattggtgaaggttatcaggtaccaaagacctgatttgttattgtttcagagatttactcttgaaaaaatggagtggcccaatcactatgcatgtgagaaattgctggtacttttgacccattatgacatgatagaaagaaagcttggtagcagaaactctaatcaactacagccaattcgaattgttaagactcgaatcagaaatggagttcattgttttgaaatagaatgggaaaagcctgaacattatgctatggaagataaacaacatggagaatttgctttattaacaattgaggaagaatcattgtttgaagcagcatatcctgagatcgttgctgtttaccaaaaacaaaagttagaaattaaagggaagaaacaaaaacgtattaagcctaaagaaaacaatttgccagaaccagatgaagtaatgagctttcagtcacacatgactttaaaacccacatgtgaaatctttcataagcagaattccaagttaaattcggggatttcccctgatcctacattaccacaggaatctatttctgcctcattgaatagcttgcttttacctaaaaatactccatgtttgaatgcacaagaacagttcatgtcttctctaagacctttggctatacagcaaattaaagctgtcagtaagtctctaatttcagaatctagtcaacccaatacctcatctcataatatatccgtgattgctgatctacacttgagcactattgactgggaaggtacttcttttagtaattctccagctattcaaaggaatactttttctcatgatttaaaatcagaagttgaatcagagctatcagccatccctgatggctttgaaaatatcccagaacaactgtcctgtgaatcagaaaggtacactgcaaacataaagaaagtgttggatgaggattctgatgggattagtcctgaagagcatctactttctggcattactgatttatgtcttcaggatttgcctttaaaggaacgaatatttacaaaattatcatatcctcaggataatctacaaccagatgtcaacctgaaaactttgtccatacttagtgtaaaagaatcttgtattgctaacagtggttctgattgtacatcacatctttcaaaggatcttccaggaattcccttgcaaaatgaatccagagactctaaaattctaaaaggagaccagctgcttcaagaagactataaagtcaatacttctgtcccttattctgtcagtaacacagtggtaaagacctgcaatgttagaccaccaaatactgctttagatcatagtagaaaagttgatatgcaaaccactcggaaaattttaatgaagaagagtgtttgccttgacagacattcctctgatgaacaaagtgccccagtgtttgggaaagctaagtacacaactcaaagaatgaagcacagttctcaaaagcataattcatcccatttcaaagaaagtggccataacaagttgagtagccctaagatacatattaaagaaactgaacagtgtgtcagatcttatgaaacagctgaaaatgaagaaagctgtttcccagattcaacaaaaagttctctgagttctctacaatgtcataagaaagaaaacaactctggtacttgtttggatagccctcttcctttacgccagagattaaaactaagattccaaagcacttgaaatttaaaacacttaggtataacttaactattttagtactatcagcaatagcagagacagagggaaggtatctagttcatgtgtggtaaaaattttaatgttctctgtgtcatgaaacacttgccattttaatcaaagttgtaatttttaaaaagtcacctaaaactctggttttaaaagatcctctgtattgaaaacttctgataatgtatgtcattatgtccttactattccttaattgtagttttaaaatattggtatagtacttgacagagtaaatacttcatctgattgttcatttttactttttcttccacaagcctctaaagtatttatattccagcttgttcccaagaggataattctttatacttctcttcattcttttaaggccttgcaaggtcttccgttataactcgctttcctaaaagctattttctccctcagtgtgaagatacctttagtgtgctcttccactttggaaggccatgcaaggtgttccattataactctttttcctaagagttatattctccctcagtttgaagatacctttagtgtgctcttccacttttggtgtcttagtctcttttgaggggcaaaaatagaaaaggagagaagatgtcagtatgtttagtaaaaatcatgctcgtaatggctgaataaactgagcaaagtaactccttatgtatccccagaagttcacaggtatatcgggtggaaaaagatttggaaaatcaaatgtataaccaaaaggattagaaactagcccaggatcacgtagctaactaataatcctgtgggaatcagttttcttgcctgctaatttttttatttttctattttttccttctatagcacttttcccccttttgttttgaatctatgcaatattgactttaataccaccaaatattaagtcatgcattaatttaggtcgcactcaaaaattctagagaggcatccagattgaaaaggaaaatggtgtctgcagatgacaagattgtatgcatcaaaaattctaagaaatccactagaaaactattaaaactgataaagcgagttcatccaggtcgtagaatacaagaccaatgtgcaatgatcattgcattttgtttttgtttgtttgtttttttttgagacagagtctcactcttgtcgagactggggtgtagtggcgccatcttggctcactgcaacctctgcctcccaggttcacgcaattcacatgcctcagccacctgagtagcagggattacaggtgtgtgccaccatgcctggctaatttttagtatttttagtagagatgggattttcccttgttggtcaggctagtcatgaactcctggcctcaagcgatccacccatcttggcctcccagagtgctgggattacaggtgtgaatcaccatactcagcctcaattgtatttctgtacacctctaaataaatggaaatacattccatgttcatgaatcagaagacataagatgaccatactccccaaactgatctacaggttaaatgtaattcccattaattccagctggtttctttgctgattctaaaattcatatggaaatttcaggaacacagaatattaggaagaatcttgaaagagtttgaatgacccacccttcctgattttaagtatacagaactacagtaatgaatgtgttgtactggtataaaggtagacatataggtcaatatagatcaatggcatagaattgagaattcagaaaaaaagccttcacgtttatggtcagttgattttaaaccagagtgccaagacaattcaatgggaaaaggaaacagtctttgaaccaactgtcttctggatctattggatatctatgtaaaaaagagtgacatttgattcctacttcacatgatatttaagaagtaacttaagatggatcaaatacctaaatgtaagctaaagctataaaactcttagaagaaaacatagacgtaaatctttgtgactttggattaggcaaggatttcttaaatatacccaaagcataggcaacaaaagagaatacacaaactggacttcatcaaaactaaaaactgttgtttgaaatgacaccatcaagaaagtgaaaagacagcttacagaatgggagaaaatatttgcaaatcataaatgtgataagggacttgtatcttggtggtatataaagaactcgtaactcaattataaaaagacaactttgaaatgggcaaaatagctcaacaggcttttctgcaaagaagaaatacaaatgaccaagaagcacatttaaaaattttcagtactattactcatcaggaaaatgcaaatcaaaaccacaagacacccaatgtctacaatcaaaaagataataactagtattgatgaggatgtggagaaattgaaattctcataacatgctggtaggaatgtaaaatggggcagccactttggaaaaagtctggtagttcttcaaatggttaaatgtagagttacgatatgatccagcaattcctctcccaggtatatacccaagataaatgaaaacttatatccacataaaaacctgtgcacaaatgtccatagcagcgttattcataatagcctaaaagtggaaacaatcccagttccagaatgaggaaggggagaaactaatgtgtattagctattgtgtgctaagcattcaactagattatttacaaaccttgtatcatctcaactctttaaggactgtattgcaatgttttgaatattcagagagaaaaaagtcgttgctaaaacattttccaaggttctgcttattctgatttgttcagtcgtggctgtgatagttcaggaccatctagaccaggtaaataaaatatctagaggca

SEQ ID NO: 12019 - DNA, 6367 bp, Homo sapiens
gaaacgcttcctggtgctcctgggcctggcggttgagcccggggagctagtctttgcttgggtaaagaaagaggactttcctttttttttttccttttgagaaaattcagaaatttggaggcacagtagttaggattcaggccaaactggtaaatgacgaaggggcttcttccagagccaaggaggaagggttgtccggcagataatcaccagaatgggagtgaatgacttgtggcaaattttggagcctgttaagcaacacatccccttgcgtaatcttggtgggaaaaccattgcagttgatctgagtctctgggtgtgtgaggcacagacagtcaaaaaaatgatgggcagcgtcatgaagccccacctcaggaacttattttttcgtatctcatatttaacacaaatggatgtaaaactggtatttgttatggaaggggaaccaccaaagctgaaagctgatgtcataagcaagaggaatcagtctcggtatgggtcttctggaaaatcgtggtctcagaaaacagggagatcacattttaaatcagtcttaagagagtgcctccatatgctcgaatgcttaggaatcccctgggttcaggctgctggggaagctgaagccatgtgtgcttatctcaatgctggtggtcatgtcgatggctgcctcaccaatgatggagatactttcctttatggggcccagactgtttacaggaatttcactatgaatacaaaggacccacatgttgactgttacacaatgtcatctatcaagagtaaactaggtttggatagagatgctctggttggattagcaatacttcttggctgtgattatctcccaaagggagtccctggagttggaaaagagcaagcattaaaacttatacagattttgaaagggcaaagtttacttcagaggtttaatcggtggaatgaaacatcttgtaactctagtccacaactgctagtcactaaaaaactggctcattgttccgtatgttcccatccaggttcacctaaggatcatgaacgtaatggatgcagattatgtaaaagtgataaatattgtgagccacatgactatgaatactgctgtccttgtgagtggcaccgtacagaacatgataggcaactcagtgaagtagagaacaatattaagaagaaagcttgctgttgtgagggattcccattccatgaggttattcaagaattccttttaaacaaggataaattggtgaaggttatcaggtaccaaagacctgatttgttattgtttcagagatttactcttgaaaaaatggagtggcccaatcactatgcatgtgagaaattgctggtacttttgacccattatgacatgatagaaagaaagcttggtagcagaaactctaatcaactacagccaattcgaattgttaagactcgaatcagaaatggagttcattgttttgaaatagaatgggaaaagcctgaacattatgctatggaagataaacaacatggagaatttgctttattaacaattgaggaagaatcattgtttgaagcagcatatcctgagatcgttgctgtttaccaaaaacaaaagttagaaattaaagggaagaaacaaaaacgtattaagcctaaagaaaacaatttgccagaaccagatgaagtaatgagctttcagtcacacatgactttaaaacccacatgtgaaatctttcataagcagaattccaagttaaattcggggatttcccctgatcctacattaccacaggaatctatttctgcctcattgaatagcttgcttttacctaaaaatactccatgtttgaatgcacaagaacagttcatgtcttctctaagacctttggctatacagcaaattaaagctgtcagtaagtctctaatttcagaatctagtcaacccaatacctcatctcataatatatccgtgattgctgatctacacttgagcactattgactgggaaggtacttcttttagtaattctccagctattcaaaggaatactttttctcatgatttaaaatcagaagttgaatcagagctatcagccatccctgatggctttgaaaatatcccagaacaactgtcctgtgaatcagaaaggtacactgcaaacataaagaaagtgttggatgaggattctgatgggattagtcctgaagagcatctactttctggcattactgatttatgtcttcaggatttgcctttaaaggaacgaatatttacaaaattatcatatcctcaggataatctacaaccagatgtcaacctgaaaactttgtccatacttagtgtaaaagaatcttgtattgctaacagtggttctgattgtacatcacatctttcaaaggatcttccaggaattcccttgcaaaatgaatccagagactctaaaattctaaaaggagaccagctgcttcaagaagactataaagtcaatacttctgtcccttattctgtcagtaacacagtggtaaagacctgcaatgttagaccaccaaatactgctttagatcatagtagaaaagttgatatgcaaaccactcggaaaattttaatgaagaagagtgtttgccttgacagacattcctctgatgaacaaagtgccccagtgtttgggaaagctaagtacacaactcaaagaatgaagcacagttctcaaaagcataattcatcccatttcaaagaaagtggccataacaagttgagtagccctaagatacatattaaagaaactgaacagtgtgtcagatcttatgaaacagctgaaaatgaagaaagctgtttcccagattcaacaaaaagttctctgagttctctacaatgtcataagaaagaaaacaactctggtacttgtttggatagccctcttcctttacgccagagattaaaactaagattccaaagcacttgaaatttaaaacacttaggtataacttaactattttagtactatcagcaatagcagagacagagggaaggtatctagttcatgtgtggtaaaaattttaatgttctctgtgtcatgaaacacttgccattttaatcaaagttgtaatttttaaaaagtcacctaaaactctggttttaaaagatcctctgtattgaaaacttctgataatgtatgtcattatgtccttactattccttaattgtagttttaaaatattggtatagtacttgacagagtaaatacttcatctgattgttcatttttactttttcttccacaagcctctaaagtatttatattccagcttgttcccaagaggataattctttatacttctcttcattcttttaaggccttgcaaggtcttccgttataactcgctttcctaaaagctattttctccctcagtgtgaagatacctttagtgtgctcttccactttggaaggccatgcaaggtgttccattataactctttttcctaagagttatattctccctcagtttgaagatacctttagtgtgctcttccacttttggtgtcttagtctcttttgaggggcaaaaatagaaaaggagagaagatgtcagtatgtttagtaaaaatcatgctcgtaatggctgaataaactgagcaaagtaactccttatgtatccccagaagttcacaggtatatcgggtggaaaaagatttggaaaatcaaatgtataaccaaaaggattagaaactagcccaggatcacgtagctaactaataatcctgtgggaatcagttttcttgcctgctaatttttttatttttctattttttccttctatagcacttttcccccttttgttttgaatctatgcaatattgactttaataccaccaaatattaagtcatgcattaatttaggtcgcactcaaaaattctagagaggcatccagattgaaaaggaaaatggtgtctgcagatgacaagattgtatgcatcaaaaattctaagaaatccactagaaaactattaaaactgataaagcgagttcatccaggtcgtagaatacaagaccaatgtgcaatgatcattgcattttgtttttgtttgtttgtttttttttgagacagagtctcactcttgtcgagactggggtgtagtggcgccatcttggctcactgcaacctctgcctcccaggttcacgcaattcacatgcctcagccacctgagtagcagggattacaggtgtgtgccaccatgcctggctaatttttagtatttttagtagagatgggattttcccttgttggtcaggctagtcatgaactcctggcctcaagcgatccacccatcttggcctcccagagtgctgggattacaggtgtgaatcaccatactcagcctcaattgtatttctgtacacctctaaataaatggaaatacattccatgttcatgaatcagaagacataagatgaccatactccccaaactgatctacaggttaaatgtaattcccattaattccagctggtttctttgctgattctaaaattcatatggaaatttcaggaacacagaatattaggaagaatcttgaaagagtttgaatgacccacccttcctgattttaagtatacagaactacagtaatgaatgtgttgtactggtataaaggtagacatataggtcaatatagatcaatggcatagaattgagaattcagaaaaaaagccttcacgtttatggtcagttgattttaaaccagagtgccaagacaattcaatgggaaaaggaaacagtctttgaaccaactgtcttctggatctattggatatctatgtaaaaaagagtgacatttgattcctacttcacatgatatttaagaagtaacttaagatggatcaaatacctaaatgtaagctaaagctataaaactcttagaagaaaacatagacgtaaatctttgtgactttggattaggcaaggatttcttaaatatacccaaagcataggcaacaaaagagaatacacaaactggacttcatcaaaactaaaaactgttgtttgaaatgacaccatcaagaaagtgaaaagacagcttacagaatgggagaaaatatttgcaaatcataaatgtgataagggacttgtatcttggtggtatataaagaactcgtaactcaattataaaaagacaactttgaaatgggcaaaatagctcaacaggcttttctgcaaagaagaaatacaaatgaccaagaagcacatttaaaaattttcagtactattactcatcaggaaaatgcaaatcaaaaccacaagacacccaatgtctacaatcaaaaagataataactagtattgatgaggatgtggagaaattgaaattctcataacatgctggtaggaatgtaaaatggggcagccactttggaaaaagtctggtagttcttcaaatggttaaatgtagagttacgatatgatccagcaattcctctcccaggtatatacccaagataaatgaaaacttatatccacataaaaacctgtgcacaaatgtccatagcagcgttattcataatagcctaaaagtggaaacaatcccagttccagaatgaggaaggggagaaactaatgtgtattagctattgtgtgctaagcattcaactagattatttacaaaccttgtatcatctcaactctttaaggactgtattgcaatgttttgaatattcagagagaaaaaagtcgttgctaaaacattttccaaggttctgcttattctgatttgttcagtcgtggctgtgatagttcaggaccatctagaccaggtaaataaaatatctagaggcattcttgagattgtatgagatgaaaataacaaaattagttgggagtggccagtctgagttcattttgctatatagctcaggagtccccaacccctgggctatggacaggtaccagtccatcacctgtcaggaaccggcctgcacagcaggtgttgagcggcatgcaagcgagaattaccgcctgagctctgcctcctgtcagatcagcggtggcattagagtctcataggagcatgaaccctattgtgaactacgcatgcgaggatctagtttgtgcactcctactgagaatctaatgcctgatgatataaggtggaacagcttcatcccacagccatctccccctcatcatccgtggaaaaactgttttccacgaaagtggtcctcggtgccagaaaggttggggactgctgatatacctaatataggcataagtgtaaaattatagttcctcctcctcaaggatttctctgttttcattgtccaggttataccaattctttttaaagcattccatgttcttgttccttgatgtggtcatgttatcacttgtaaat

SEQ ID NO: 12020 - DNA, 593 bp, Homo sapiens
gaaacgcttcctggtgctcctgggcctggcggttgagcccggggagctagtctttgcttgggtaaagaaagaggactttcctttttttttttccttttgagaaaattcagaaatttggaggcacagtagttaggattcaggccaaactggtaaatgacgaaggggcttcttccagagccaaggaggaagggttgtccggcagataatcaccagaatgggagtgaatgacttgtggcaaattttggagcctgttaagcaacacatccccttgcgtaatcttggtgggaaaaccattgcagttgatctgagtctctgggtgtgtgaggcacagacagtcaaaaaaatgatgggcagcgtcatgaagccccacctcaggaacttattttttcgtatctcatatttaacacaaatggatgtaaaactggtatttgttatggaaggggaaccaccaaagctgaaagctgatgtcataagcaagaggaatcagtctcggtatgggtcttctggaaaatcgtggtctcagaaaacagggagatcacattttaaatcagtcttaagagagtgcctccatatgctcgaatgcttaggaatcc

SEQ ID NO: 12021 - DNA, 498 bp, Homo sapiens
gtgctcctgggcctggcggttgagcccggggagctagtctttgcttgggtaaagaaagaggactttcctttttttttttccttttgagaaaattcagaaatttggaggcacagtagttaggattcaggccaaactggtaaatgacgaaggggcttcttccagagccaaggaggaagggttgtccggtgtgtttcacataacagcagataatcaccagaatgggagtgaatgacttgtggcaaattttggagcctgttaagcaacacatccccttgcgtaatcttggtgggaaaaccattgcagttgatctgagtctctgggtgtgtgaggcacagacagtcaaaaaaatgatgggcagcgtcatgaagccccacctcaggaacttattttttcgtatctcatatttaacacaaatggatgtaaaactggtatttgttatggaaggggaaccaccaaagctgaaagctgatgtcataagcaagaggaatcagtctcggt

SEQ ID NO: 12022 - DNA, 2158 bp, Homo sapiens
gataaatattgtgagccacatgactatgaatactgctgtccttgtgagtggcaccgtacagaacatgataggcaactcagtgaagtagagaacaatattaagaagaaagcttgctgttgtgagggattcccattccatgaggttattcaagaattccttttaaacaaggataaattggtgaaggttatcaggtaccaaagacctgatttgttattgtttcagagatttactcttgaaaaaatggagtggcccaatcactatgcatgtgagaaattgctggtacttttgacccattatgacatgatagaaagaaagcttggtagcagaaactctaatcaactacagccaattcgaattgttaagactcgaatcagaaatggagttcattgttttgaaatagaatgggaaaagcctgaacattatgctatggaagataaacaacatggagaatttgctttattaacaattgaggaagaatcattgtttgaagcagcatatcctgagatcgttgctgtttaccaaaaacaaaagttagaaattaaagggaagaaacaaaaacgtattaagcctaaagaaaacaatttgccagaaccagatgaagtaatgagctttcagtcacacatgactttaaaacccacatgtgaaatctttcataagcagaattccaagttaaattcggggatttcccctgatcctacattaccacaggaatctatttctgcctcattgaatagcttgcttttacctaaaaatactccatgtttgaatgcacaagaacagttcatgtcttctctaagacctttggctatacagcaaattaaagctgtcagtaagtctctaatttcagaatctagtcaacccaatacctcatctcataatatatccgtgattgctgatctacacttgagcactattgactgggaaggtacttcttttagtaattctccagctattcaaaggaatactttttctcatgatttaaaatcagaagttgaatcagagctatcagccatccctgatggctttgaaaatatcccagaacaactgtcctgtgaatcagaaaggtacactgcaaacataaagaaagtgttggatgaggattctgatgggattagtcctgaagagcatctactttctggcattactgatttatgtcttcaggatttgcctttaaaggaacgaatatttacaaaattatcatatcctcaggataatctacaaccagatgtcaacctgaaaactttgtccatacttagtgtaaaagaatcttgtattgctaacagtggttctgattgtacatcacatctttcaaaggatcttccaggaattcccttgcaaaatgaatccagagactctaaaattctaaaaggagaccagctgcttcaagaagactataaagtcaatacttctgtcccttattctgtcagtaacacagtggtaaagacctgcaatgttagaccaccaaatactgctttagatcatagtagaaaagttgatatgcaaaccactcggaaaattttaatgaagaagagtgtttgccttgacagacattcctctgatgaacaaagtgccccagtgtttgggaaagctaagtacacaactcaaagaatgaagcacagttctcaaaagcataattcatcccatttcaaagaaagtggccataacgagtagccctaagatacatattaaagaaactgaacagtgtgtcagatcttatgaaacagctgaaaatgaagaaagctgtttcccagattcaacaaaaagttctctgagttctctacaatgtcataagaaagaaaacaactctggtacttgtttggatagccctcttcctttacgccagagattaaaactaagattccaaagcacttgaaatttaaaacacttaggtataacttaactattttagtactatcagcaatagcagagacagagggaaggtatctagttcatgtgtggtaaaaattttaatgttctctgtgtcatgaaacacttgccattttaatcaaagttgtaatttttaaaaagtcacctaaaactctggttttaaaagatcctctgtattgaaaacttctgataatgtatgtcattatgtccttactattccttaattgtagttttaaaatattggtatagtacttgacagagtaaatacttc

SEQ ID NO: 12023 - DNA, 1639 bp, Homo sapiens
gcgcaggcgcaaagggccaggtgctggaggtgctgtcatggcctgcctcaacccggtgcctaaactctacagatctgtaattgaagatgtaattgaaggagttcggaatctatttgctgaagaaggtatagaggaacaagttttaaaagacttgaagcagctctgggaaaccaaggttttgcagtctaaagcaacagaagacttcttcagaaatagcatccaatcacctctgtttactcttcagttgccgcacagcttgcaccaaacattgcaatcgtcaacagcatcattagttattcctgctggtagaactcttccaagttttaccacagcagaactgggcacttcaaactccagtgcaaactttacttttcctggttatcccattcatgtaccagcaggtgtgacactacagactgtatctggtcacctttataaagtcaatgtaccaattatggtgacagagacttctggaagagcaggtattcttcagcatccaattcagcaagtatttcaacagcttggccagccttcagtaatacaaactagtgttccacaattgaatccatggtctcttcaagcaactactgaaaaatcacagagaattgaaaccgtgctacagcaacccgcaattctaccttctgggccagtagataggaaacacttagaaaatgccaccagtgatatacttgtatctcctggaaatgagcataaaatcgtgcctgaagctttgttgtgtcatcaggaaagttctcactatatcagtcttccaggtgttgtattttctccacaggtctctcaaacaaattctaatgtggagtcagtgctcagtggttcagctagcatggctcaaaatctgcatgatgagtccctctccacaagccctcatggggctctccaccagcacgtgactgatattcagcttcatattcttaaaaataggatgtatggatgtgattctgtaaagcaaccaagaaatatagaggaacccagcaacatacctgtatcagagaaggattctaattctcaggtggatttaagcattcgggttactgatgatgatattggtgaaataattcaagtagatggaagcggtgatacatcttccaatgaagaaataggaagtacaagagatgcagatgagaatgaatttctagggaatattgacgggggagatctgaaggtacctgaagaagaagctgacagtatttcaaatgaggattcagccacaaacagtagtgataatgaagaccctcaagtaaacattgtagaagaggaccctttaaattctggagatgatgttagtgaacaggatgtgccagacctgtttgacacggataatgttattgtctgtcagtatgataagattcatcgaagcaagaacaaatggaaattctatttgaaagatggtgttatgtgttttggagggagagactatgtatttgcaaaagccattggtgatgcagagtggtaaaccttgtgagctcagtacatctattttgtgaacatcagttggattatattgcatattgtgaattcatttttattttgaatatagtccagcacagagctgttcaaatttttagttcactgtatggaatttaataaaattataattcagatgcagatacaattacac

SEQ ID NO: 12024 - DNA, 1573 bp, Homo sapiens
aaaacgtgcccagtgtttccctccgagggcactgcgtgccgcgcaggcgcaaagggccaggtgctggaggtgctgtcatggcctgcctcaacccggtgctctgggaaaccaaggttttgcagtctaaagcaacagaagacttcttcagaaatagcatccaatcacctctgtttactcttcagttgccgcacagcttgcaccaaacattgcaatcgtcaacagcatcattagttattcctgctggtagaactcttccaagttttaccacagcagaactgggcacttcaaactccagtgcaaactttacttttcctggttatcccattcatgtaccagcaggtgtgacactacagactgtatctggtcacctttataaagtcaatgtaccaattatggtgacagagacttctggaagagcaggtattcttcagcatccaattcagcaagtatttcaacagcttggccagccttcagtaatacaaactagtgttccacaattgaatccatggtctcttcaagcaactactgaaaaatcacagagaattgaaaccgtgctacagcaacccgcaattctaccttctgggccagtagataggaaacacttagaaaatgccaccagtgatatacttgtatctcctggaaatgagcataaaatcgtgcctgaagctttgttgtgtcatcaggaaagttctcactatatcagtcttccaggtgttgtattttctccacaggtctctcaaacaaattctaatgtggagtcagtgctcagtggttcagctagcatggctcaaaatctgcatgatgagtccctctccacaagccctcatggggctctccaccagcacgtgactgatattcagcttcatattcttaaaaataggatgtatggatgtgattctgtaaagcaaccaagaaatatagaggaacccagcaacatacctgtatcagagaaggattctaattctcaggtggatttaagcattcgggttactgatgatgatattggtgaaataattcaagtagatggaagcggtgatacatcttccaatgaagaaataggaagtacaagagatgcagatgagaatgaatttctagggaatattgacgggggagatctgaaggtacctgaagaagaagctgacagtatttcaaatgaggattcagccacaaacagtagtgataatgaagaccctcaagtaaacattgtagaagaggaccctttaaattctggagatgatgttagtgaacaggatgtgccagacctgtttgacacggataatgttattgtctgtcagtatgataagattcatcgaagcaagaacaaatggaaattctatttgaaagatggtgttatgtgttttggagggagagactatgtatttgcaaaagccattggtgatgcagagtggtaaaccttgtgagctcagtacatctattttgtgaacatcagttggattatattgcatattgtgaattcatttttattttgaatatagtccagcacagagctgttcaaatttttagttcactgtatggaatttaataaaattataattcagatgcagatacaatt

SEQ ID NO: 12025 - DNA, 1351 bp, Homo sapiens
acgactgcgtgggtgagtcgtctataaaaactcatctctgcgcgtctcttcgccacattcgcttcctgctttcggtgtgtctgttgtgtcttgttgcgggcaccgcagtcgccgtgaagatggcgtctaccagccgtttggatgctcttccaagagtcacatgtccaaaccatccagatgcgattttagtggaggactacagagccggtgatatgatctgtcctgaatgtggcttggttgtaggtgaccgggttattgatgtgggatctgaatggcgaactttcagcaatgacaaagcaacaaaagatccatctcgagttggagattctcagaatcctcttctgagtgatggagatttgtctaccatgattggcaagggcacaggagctgcaagttttgacgaatttggcaattctaagtaccagaatcggagaacaatgagcagttctgatcgggcaatgatgaatgcattcaaagaaatcactaccatggcagacagaatcaatctacctcgaaatatagttgatcgaacaaataatttattcaagcaagtatatgaacagaagagcctgaagggaagagctaatgatgctatagcttctgcttgtctctatattgcctgtagacaagaaggggttcctaggacatttaaagaaatatgtgccgtatcacgaatttctaagaaagaaattggtcggtgttttaaacttattttgaaagcgctagaaaccagtgtggatttgattacaactggggacttcatgtccaggttctgttccaacctttgtcttcctaaacaagtacagatggcagctacacatatagcccgtaaagctgtggaactggacttggttcctgggaggagccccatctctgtggcagcggcagctatttacatggcctcacaggcatcagctgaaaagaggacccaaaaagaaattggagatattgctggtgttgctgatgttacaatcagacagtcctatagactgatctatcctcgagccccagatctgtttcctacagacttcaaatttgacaccccagtggacaaactaccacagctataaattgaggcagctaacgtcaaattcttgaatacaaaactttgcctgttgtacatagcctatacaaaatgctgggttgagcctttcatgaggaaaaacaaaagacatggtacgcattccagggctgaatactattgcttggcattctgtatgtatatactagtgaaacatatttaatgatttaaatttcttatcaaatttcttttgtagcaatctaggaaactgtattttggaagatatttgaaattatgtaattcttgaataaaacatttttcaaaactcaa

SEQ ID NO: 12026 - DNA, 783 bp, Homo sapiens
actcatctctgcgcgtctcttcgccacattcgcttcctgctttcggtgtgtctgttgtgtcttgttgcgggcaccgcagtcgccgtgaagatggcgtctaccagccgtttggatgctcttccaagagtcacatgtccaaaccatccagatgcgattttagtggaggactacagagccggtgatatgatctgtcctgaatgtgaccgggttattgatgtgggatctgaatggcgaactttcagcaatgacaaagcaacaaaagatccatctcgagttggagattctcagaatcctcttctgagtgatggagatttgtctaccatgattggcaagggcacaggagctgcaagttttgacgaatttggcaattctaagtaccagaatcggagaacaatgagcagttctgatcgggcaatgatgaatgcattcaaagaaatcactaccatggcagacagaatcaatctacctcgaaatatagttgatcgaacaaataatttattcaagcaagtatatgaacagaagagcctgaagggaagagctaatgatgctatagcttctgcttgtctctatattgcctgtagacaagaaggggttcctaggacatttaaagaaatatgtgccgtatcacgaatttctaagaaagaaattggtcggtgttttaaacttattttgaaagcgctagaaaccagtgtggatttgattacaactggggacttcatgtccaggttctgttccaacctttgtcttcctaaacaagtacagatggcagctacacatatagcc

SEQ ID NO: 12027 - DNA, 770 bp, Homo sapiens
gcgtctaccagccgtttggatgctcttccaagagtcacatgtccaaaccatccagatgcgattttagtggaggactacagagccggtgatatgatctgtcctgaatgtggcttggttgtaggtgaccgggttattgatgtgggatctgaatggcgaactttcagcaatgacaaagcaacaaaagatccatctcgagttggagattctcagaatcctcttctgagtgatggagatttgtctaccatgattggcaagggcacaggagctgcaagttttgacgaatttggcaattctaagtaccagaatcggagaacaatgagcagttctgatcgggcaatgatgaatgcattcaaagaaatcactaccatggcagacagaatcaatctacctcgaaatatagttgatcgaacaaataatttattcaagcaagtatatgaacagaagagcctgaagggaagagctaatgatgctatagcttctgcttgtctctatattgcctgtagacaagaaggggttcctaggacatttaaagaaatatgtgccgtatcacgaatttctaagaaagaaattggtcggtgttttaaacttattttgaaagcgctagaaaccagtgtggatttgattacaactggggacttcatgtccagaaattggagatattgctggtgttgctgatgttacaatcagacagtcctatagactgatctatcctcgagccccagatctgtttcctacagacttcaaatttgacaccccagtggacaaactac

SEQ ID NO: 12028 - DNA, 1762 bp, Homo sapiens
gcggtggctgccgggactgagctcctagcacccgatcgggaagtggcgggcggagtcccgggtccagtcgccgcctcagctaccgccgctgccgccgccgccgccgccaccgccagtggtgagaccccgacctggcgggtcagcgctgggcgtgcgtgcgggcaggcgggggcgctgacgagaagcaggaagagggtgcagtgccggcgtgggcggccggccgaggcggaggcgcaggaagggggcggcgagtcgtgcgaggctgcccttctcactcagcattatggatccaagcctgttgagagaaagggagctgttcaaaaaacgagctctttctactcctgtagtagaaaaacgttcagcatcttctgagtcatcatcatcatcgtcaaagaagaagaaaacaaaggtagaacatggaggatcgtcaggctctaaacaaaattctgatcatagcaatggatcatttaacttgaaagctttgtcaggaagctctggatataagtttggtgttcttgctaagattgtgaattacatgaagacacggcatcagcgaggagatacgcatcctctaaccttagatgaaattttggatgaaacacaacatttagatattggactcaagcagaaacaatggctaatgactgaggctttagtcaacaatcccaaaattgaagtaatagatgggaagtatgctttcaagcccaagtacaacgtgagagataagaaggccctacttaggctcttagatcagcatgaccagcgaggattaggaggaattcttttagaagacatagaagaagcactgcccaattcccagaaagctgtcaaggctttgggggaccagatactatttgtaaatcgtcccgataagaagaaaatacttttcttcaatgataagagctgtcagttttctgtggatgaagaatttcagaaactgtggaggagtgtcactgtagattccatggacgaggagaaaattgaagaatatctgaagcgacagggtatttcttccatgcaggaatctggaccaaagaaagtggcccctattcagagaaggaaaaagcctgcttcacagaaaaagcgacgctttaagactcataacgaacacttggctggagtgctgaaggattactctgacattacttccagcaaatagggaacagttttgccctggaacagagttacagatacacaatcaagagtgttcttgctgatgctcggggtctgaagactgtcttcctatctgcttcttgcggctgaggagaggagcagttcagtttacaaaacaagtgcaaattaccaaactcaaagcttatttgagtagaatgggctcatgggcaatgtgatgttccctgttaaccttctgttactccctgggagaaaggcgctgagcgtggcatgcaggtgtctttgctgtgtttttctccacttctaaatggttcctggttcctttcttcctcgtttgttactttagagcaagtttgcccatagtcttgaatgcaatatttgtttattccaaaagaacatatttataataaaatcactgtagaaggatttttaagatgttagtgaattctgtttcttttcattctcggaaatggcaggaagcagctccagtctctgatttccatgggtcacgtgctggggatgtgatgaagcctgcagtctgcactgtgttgctgagcacatggatttcaccactggaacacaggtgtgctgcttgttagcaagcagagcaataaagatgtgctggatgtca

SEQ ID NO: 12029 - DNA, 426 bp, Homo sapiens
tgctcatacgcggactgctttctaggctaccttttggagatttgcattatggatccaagcctgttgagagaaagggagctgttcaaaaaacgagctctttctactcctgtagtagaaaaacgttcagcatcttctgagtcatcatcatcatcgtcaaagaagaagaaaacaaaggtagaacatggaggatcgtcaggctctaaacaaaattctgatcatagcaatggatcatttaacttgaaagctttgtcaggaagctctggatataagtttggtgttcttgctaagattgtgaattacatgaagacacggcatcagcgaggagatacgcatcctctaaccttagatgaaattttggatgaaacacaacatttagatattggactcaagcagaaacaatggctaatgactgaggctttagtcaac

SEQ ID NO: 12030 - DNA, 737 bp, Homo sapiens
gtcaggaggtttggttcctggccctggctcttccatctgtgcgaccttaaccagacagcttcacttcagatttcacgtattaaaataggaataacactaatacctgtttgctcctagagttgcgagggtcaaatactcattatggatccaagcctgttgagagaaagggagctgttcaaaaaacgagctctttctactcctgtagtagaaaaacgttcagcatcttctgagtcatcatcatcatcgtcaaagaagaagaaaacaaaggtagaacatggaggatcgtcaggctctaaacaaaattctgatcatagcaatggatcatttaacttgaaagctttgtcaggaagctctggatataagtttggtgttcttgctaagattgtgaattacatgaagacacggcatcagcgaggagatacgcatcctctaaccttagatgaaattttggatgaaacacaacatttagatattggactcaagcagaaacaatggctaatgactgaggctttagtcaacaatcccaaaattgaagtaatagatgggaagtatgctttcaagcccaagtacaacgtgagagataagaaggccctacttaggctcttagatcagcatgaccagcgaggattaggaggaattcttttagaagacatagaagaagcactgcccaattcccagaaagctgtcaaggctttgggggaccagatactatttgtaaatcgtcccgataagaagaa

SEQ ID NO: 12031 - DNA, 2731 bp, Homo sapiens
gggtgctgacgtcacgagagagggcggtcccccatttgatgaagttaaccgcgttatatacaagagcgccagcgacagaggcccgttagtttatctcagactcggcctaggtttgctgagtctaaaaagggaccgcggtggaccttttgaggtgaccatagccgccgaggagcataagtgactgcgcactgaggtggccacagtcgctaagaaggttgccatcgcgacgcggctgctcgagggtttcgcttccgggttaggcggccgcagaagcgtagaccgagtagcttgagcgcctcttccggttaccttttcccagcgccagaggcgcctagggttggggtcctcgctcaggcacagagacccgacaccgagcggcggcttccccgggatcgagggacgcgcacgccagaggagacgaaaggaacccgggtcggaccagatcggaaccactgaccattgcccatggcggccctaggccctagcagccagaatgtcactgaatacgtcgttcgagttcctaagaatacaaccaaaaaatataacatcatggcttttaatgcagccgacaaagtcaactttgctacgtggaatcaggctcggctggagcgggacttgagcaacaagaaaatctaccaagaggaggagatgcccgaatcgggcgcgggcagtgagttcaaccgcaagcttcgggaggaggctcggaggaagaagtacggcatcgtcctcaaggagttccggcccgaggaccagccctggctgctccgggtcaacggcaaatcaggcaggaagttcaagggcatcaagaagggaggcgtaacagagaacacgtcctactacatcttcacccagtgccccgacggggccttcgaggccttccccgtgcacaactggtacaatttcacaccgctggcccggcatcgcacgctcactgccgaggaggccgaggaggagtgggagaggaggaacaaggtgctgaaccacttcagcatcatgcagcagcggcggctcaaggatcaggaccaggacgaggatgaggaggagaaggagaaacgtggccgcaggaaggcgagcgagctgcgcatccacgacctggaggacgacctggagatgtcgtccgatgccagtgatgccagtggtgaggaggggggcagagtccccaaggccaagaagaaggcgccgctggccaagggcggcaggaaaaagaagaagaagaagggttcagacgacgaggccttcgaggacagcgatgatggggacttcgagggccaagaggtggactacatgtcagacggctccagtagctcccaagaagagcctgagagcaaggccaaggcgccgcagcaggaggaggggcccaagggtgtcgatgagcagagcgacagtagtgaggagagtgaggaggagaagccgcctgaggaggacaaggaggaggaggaggagaagaaggcacccaccccgcaggagaagaagcgcaggaaagacagcagcgaggagtcggacagctcagaggagagcgacattgacagcgaggcctcctcagccctcttcatggcgaagaagaagacgccacccaagagagagcggaagccgtcgggagggagctcaaggggcaacagccgcccaggcacgcccagcgcagagggtggcagcacctcctccaccctgcgggcggctgccagcaaactcgagcaagggaagcgggtgagcgagatgcctgcagccaagcggttgcggctggacacgggaccccagagcctgtctgggaagtcgacaccccagccaccatcaggcaagacaacacccaacagcggcgacgtgcaggtgactgaggatgccgtgcgccgctacctgacacggaagcccatgaccactaaggacctgctgaaaaagttccagaccaagaagacagggctgagcagcgagcagacagtgaacgtgttggcccagatcctcaagcgactcaaccccgagcgcaagatgatcaacgacaaaatgcacttctccctcaaggagtgaggcttggtccaatacatggctctgccccccagaacttaaggctctcactgccccttcgccatcctagagtgaggctctgtccaatacatggctctgccctccagaacttcaggctctcagtgacccttcgacatcctgcttgctccctgactcccagggccccgtagttagcaattctggaaaagttaagccatctcctcctctggcccttccttctggaatcttcagatgcctgttaggccttcttattgtcctcctcctcctggctcggcctccctcacactgaccaagggcctgtgctgcccactgggtaacttctacagttctcccttccacttccctaagtctctcttcagctgtgacttatccaccacatagcccagtaagtcttcagttttggctgggcatgatggtgagcgcctgcagtcccagctacttgggaggctaagcccagttcaaggctgcagtgaactatgatggtgccactgcattccagcctgggtgacagaatgaaatcctggcacaaaaaaaaaaaaaaagtagccaggcatggtggcgggagcctgttgtcccagctgttccgtaggctgaggcacgagattcacttgaacctgggaggtggaggttgctgtgagctgacaccacgccactgcactccagcctgggtgacagtgagactctgtctcaataaataaaaaataataataaattg

SEQ ID NO: 12032 - DNA, 1705 bp, Homo sapiens
atcatggcttttaatgcagccgacaaagtcaactttgctacgtggaatcaggctcggctggagcgggacttgagcaacaagaaaatctaccaagaggaggagatgcccgaatcgggcgcgggcagtgagttcaaccgcaagcttcgggaggaggctcggaggaagaagtacggcatcgtcctcaaggagttccggcccgaggaccagccctggctgctccgggtcaacggcaaatcaggcaggaagaggaacaaggtgctgaaccacttcagcatcatgcagcagcggcggctcaaggatcaggaccaggacgaggatgaggaggagaaggagaaacgtggccgcaggaaggcgagcgagctgcgcatccacgacctggaggacgacctggagatgtcgtccgatgccagtgatgccagtggtgaggaggggggcagagtccccaaggccaagaagaaggcgccgctggccaagggcggcaggaaaaagaagaagaagaagggttcagacgacgaggccttcgaggacagcgatgatggggacttcgagggccaagaggtggactacatgtcagacggctccagtagctcccaagaagagcctgagagcaaggccaaggcgccgcagcaggaggaggggcccaagggtgtcgatgagcagagcgacagtagtgaggagagtgaggaggagaagccgcctgaggaggacaaggaggaggaggaggagaagaaggcacccaccccgcaggagaagaagcgcaggaaagacagcagcgaggagtcggacagctcagaggagagcgacattgacagcgaggcctcctcagccctcttcatggcgaagaagaagacgccacccaagagagagcggaagccgtcgggagggagctcaaggggcaacagccgcccaggcacgcccagcgcagagggtggcagcacctcctccaccctgcgggcggctgccagcaaactcgagcaagggaagcgggtgagcgagatgcctgcagccaagcggttgcggctggacacgggaccccagagcctgtctgggaagtcgacaccccagccaccatcaggcaagacaacacccaacagcggcgacgtgcaggtgactgaggatgccgtgcgccgctacctgacacggaagcccatgaccactaaggacctgctgaaaaagttccagaccaagaagacagggctgagcagcgagcagacagtgaacgtgttggcccagatcctcaagcgactcaaccccgagcgcaagatgatcaacgacaaaatgcacttctccctcaaggagtgaggcttggtccaatacatggctctgccccccagaacttaaggctctcactgccccttcgccatcctagagtgaggctctgtccaatacatggctctgccctccagaacttcaggctctcagtgacccttcgacatcctgcttgctccctgactcccagggccccgtagttagcaattctggaaaagttaagccatctcctcctctggcccttccttctggaatcttcagatgcctgttaggccttcttattgtcctcctcctcctggctcggcctccctcacactgaccaagggcctgtgctgcccactgggtaacttctacagttctcccttccacttccctaagtctctcttcagctgtgacttatccaccacatagcccagtaagtcttcagttttggctg

SEQ ID NO: 12033 - DNA, 568 bp, Homo sapiens
tactgccatgattcgggggatgtgtgcatgcctggaacgggcgccagaggcgcctagggttggggtcctcgctcaggcacagagacccgacaccgagcggcggcttccccgggatcgagggacgcgcacgccagaggagacgaaaggaacccgggtcggaccagatcggaaccactgaccattgcccatggcggccctaggccctagcagccagaatgtcactgaatacgtcgttcgagttcctaagaatacaaccaaaaaatataacatcatggcttttaatgcagccgacaaagtcaactttgctacgtggaatcaggctcggctggagcgggacttgagcaacaagaaaatctaccaagaggaggagatgcccgaatcgggcgcgggcagtgagttcaaccgcaagcttcgggaggaggctcggaggaagaagtacggcatcgtcctcaaggagttccggcccgaggaccagccctggctgctccgggtcaacggcaaatcaggcaggaagttcaagggcatcaagaagggaggcgtaacagagaacacgtcctactacatcttc

SEQ ID NO: 12034 - DNA, 2982 bp, Homo sapiens
gaccccctagtaacagaggcggtggctactgctgcggccactgggtttcggcctcttcccagcagcggctctaagaagcgcagcggaactcgaccggatccaacccagttagttacttcctgtctagagttgtagcttccacctgcaccttctagccaccatggcaacctcatctgaagaagttttgctgattgtaaagaaagtgcgtcaaaagaagcaggatggagctctgtacctcatggcagaaagaattgcttgggcacctgaaggcaaagatagatttacaatcagccatatgtatgcagatattaaatgccagaaaattagtccagaaggaaaagctaaaattcagcttcagctggtcctacatgcaggggacacaactaacttccatttttccaatgaaagcacagcagtgaaagagcgagatgcagtaaaagaccttcttcagcagctgctgcccaaattcaagaggaaagcaaataaagaactggaagagaagaacagaatgctgcaagaagatcctgttttgtttcagctttataaagaccttgttgtgagtcaagtgatcagtgctgaggaattctgggccaatcgtttaaatgtgaatgcaacagatagttcttccacatccaatcataagcaggatgttggcatttctgctgcatttctggctgatgtccggccccaaactgatggctgtaacggtctaagatataatttaacttctgatatcattgagtccatatttaggacctatccagcagtaaaaatgaaatatgcagaaaatgttccccacaacatgacagagaaggaattctggacacgttttttccagtcccattattttcacagggatcggctgaatacagggtcaaaggatctctttgcagaatgtgccaaaatagatgaaaaaggcctaaaaacaatggtttcattaggagtgaaaaacccactactagatttaacagctttggaagataaaccattagatgagggctatggcatttcctctgtgccatctgcttccaattctaaatccataaaagagaatagtaatgctgccatcatcaagagatttaaccatcacagtgccatggtcctggcagctggactcagaaaacaagaagcacaaaatgaacaaactagtgagcccagcaacatggatggaaattccggagatgcagactgctttcagccagcagtcaaaagggcgaaattacaagagtccattgaatatgaagacttggggaaaaataattctgtaaaaacgattgcactaaacctcaagaagtcagataggtattatcatggtccaactccaatccagtcactacagtatgcaacaagtcaggacattattaattcttttcaaagtattagacaagaaatggaagcttatacacccaagttaactcaggttctctcaagtagtgctgccagtagtaccatcacagcactgtcacctggaggggcacttatgcagggaggaacacagcaagccataaaccagatggtgccaaatgatattcaatctgaattgaaacacttatatgtagctgttggagaacttctacgacatttctggtcctgctttcctgttaatacgccattcctagaagaaaaggtagtgaaaatgaaaagtaatttggaacgattccaagttacgaagctctgtccattccaagaaaagattcggagacagtatttaagcacaaatttggtaagtcacatagaagagatgctccagacagcctacaacaagctccacacatggcagtcacggcgtctgatgaagaaaacgtgaggtggccatgatgcttacaggttttgtgagattgagagaactatgacctgcagcaactctggaaacctggcctgacagacaagcagatgacctcacaggagtgataagaaacatctgctccacgccaactcccagagctgatgctattgtacttgcacattggagactgaaaggaaagaagggactaaatgctggggaggtaaattaagacagaaccaaatgagctaagttgcaaatatatatatatacacacacacacatatatgtacatgtgtatgtacatatatattttaaaagactgtttactgcagttgctcaggaactgcttttgattcacattaagctgctttcagaaattaaaaaaacactttttaaagggtgcattgataaaatctgaggttttttggttgtcgtttttttctgtgtacatttttttcctaagtttatggcacagggtagaccttaagtattcctcctccatccttcattcttcaccctccattggatcctcaagttttaatgaattccaattataccttacatcagcaagttaaaaaaagtactttaaaataaagcaaagggagactgttgctcaaccatcaggaaacagttgtcagaagacatcattggttctgtgtttcctacggaaataagaaacgataaatattgcactgaatgtttgtggtttggagtccctgaataataaagagggaatatatttgcagaaagtcgcatagggttttttaatgcagaattttgtcagaagacaatggcgctgcatgtttttctttgagtgcaaatgtacattgctaagatttttttaagatggcatgtgctttgaaaagaagatattgcatttttaagagtttaaaaatcttatgagtgagaaatattaaaaaaatcttattttcacctctttagaagaaataaaagatgtttctcctatctccttttctctagtatttgactgttactgtccttggcgaatcgataatcattgcatagtgactgaaaagcctaagtgcaaaaaaaaaaaaaaaagatgttcttgtttctgaacttcgtgccatattttgttcctgatgggatcaacttaatgtttaagactttagatgtcttgtattaaaaattacacaaaaaaagtaaaactttttatacttacccttttaactcta

SEQ ID NO: 12035 - DNA, 2707 bp, Homo sapiens
aggccgcggtcgcgattacgctctctacggcctgcgaccgcagggccgttgcgggctggagacacggcgccgactggaaccggaggagctctaggccaaatggttgggccagccaggatcccaggacccttcgccgctcgagaccggagagaggaaacgaaacaggcgggaacccgtgggggagggagggaactagcggaaggtgtcatggcggccgcgctcttgagtcacgtgcccagggcccgccttgctacttccggtcacgtgccctcagactcctcgcagccagcgatggaggcgagaccccctagtaacagaggcggtggctactgctgcggccactgggtttcggcctcttcccagcagcggctctaagaagcgcagcggaactcgaccggatccaacccagttagttacttcctgtctagagttgtagcttccacctgagttctcctgggaagaagtgtttgccactcaaggaatacactcaagaaaaacctggaaatcacagaaggcattgtaagatagctacagtgattctgttaaacctcctgaaattggtccttgaacaattaagaggtgctacagatgaccaggaaaatttaccaggcaaattagctgtgagacaattgaccatttgtgcccaatgttcgcaccttctagccaccatggcaacctcatctgaagaagttttgctgattgtaaagaaagtgcgtcaaaagaagcaggatggagctctgtacctcatggcagaaagaattgcttgggcacctgaaggcaaagatagatttacaatcagccatatgtatgcagatattaaatgccagaaaattagtccagaaggaaaagctaaaattcagcttcagctggtcctacatgcaggggacacaactaacttccatttttccaatgaaagcacagcagtgaaagagcgagatgcagtaaaagaccttcttcagcagctgctgcccaaattcaagaggaaagcaaataaagaactggaagagaagaacagaatgctgcaagaagatcctgttttgtttcagctttataaagaccttgttgtgagtcaagtgatcagtgctgaggaattctgggccaatcgtttaaatgtgaatgcaacagatagttcttccacatccaatcataagcaggatgttggcatttctgctgcatttctggctgatgtccggccccaaactgatggctgtaacggtctaagatataatttaacttctgatatcattgagtccatatttaggacctatccagcagtaaaaatgaaatatgcagaaaatgttccccacaacatgacagagaaggaattctggacacgttttttccagtcccattattttcacagggatcggctgaatacagggtcaaaggatctctttgcagaatgtgccaaaatagatgaaaaaggcctaaaaacaatggtttcattaggagtgaaaaacccactactagatttaacagctttggaagataaaccattagatgagggctatggcatttcctctgtgccatctgcttccaattctaaatccataaaagagaatagtaatgctgccatcatcaagagatttaaccatcacagtgccatggtcctggcagctggactcagaaaacaagaagcacaaaatgaacaaactagtgagcccagcaacatggatggaaattccggagatgcagactgctttcagccagcagtcaaaagggcgaaattacaagagtccattgaatatgaagacttggggaaaaataattctgtaaaaacgattgcactaaacctcaagaagtcagataggtattatcatggtccaactccaatccagtcactacagtatgcaacaagtcaggacattattaattcttttcaaagtattagacaagaaatggaagcttatacacccaagttaactcaggttctctcaagtagtgctgccagtagtaccatcacagcactgtcacctggaggggcacttatgcagggaggaacacagcaagccataaaccagatggtgccaaatgatattcaatctgaattgaaacacttatatgtagctgttggagaacttctacgacatttctggtcctgctttcctgttaatacgccattcctagaagaaaaggtagtgaaaatgaaaagtaatttggaacgattccaagttacgaagctctgtccattccaagaaaagattcggagacagtatttaagcacaaatttggtaagtcacatagaagagatgctccagacagcctacaacaagctccacacatggcagtcacggcgtctgatgaagaaaacgtgaggtggccatgatgcttacaggttttgtgagattgagagaactatgacctgcagcaactctggaaacctggcctgacagacaagcagatgacctcacaggagtgataagaaacatctgctccacgccaactcccagagctgatgctattgtacttgcacattggagactgaaaggaaagaagggactaaatgctggggaggtaaattaagacagaaccaaatgagctaagttgcaaatatatatatatacacacacacacatatatgtacatgtgtatgtacatatatattttaaaagactgtttactgcagttgctcaggaactgcttttgattcacattaagctgctttcagaaattaaaaaaacactttttaaagggtgcattgataaaa

SEQ ID NO: 12036 - DNA, 545 bp, Homo sapiens
actcctcgcagccagcgatggaggcgagaccccctagtaacagaggcggtggctactgctgcggccactgggtttcggcctcttcccagcagcggctctaagaagcgcagcggaactcgaccggatccaacccagttagttacttcctgtctagagttgtagcttccacctgagttctcctgggaagaagtgtttgccactcaaggaatacactcaagaaaaacctggaaatcacagaaggcattcaccttctagccaccatggcaacctcatctgaagaagttttgctgattgtaaagaaagtgcgtcaaaagaagcaggatggagctctgtacctcatggcagaaagaattgcttgggcacctgaaggcaaagatagatttacaatcagccatatgtatgcagatattaaatgccagaaaattagtccagaaggaaaagctaaaattcagcttcagctggtcctacatgcaggggacacaactaacttccatttttccaatgaaagcacagcagtgaaagagcgagatgcagtaaaagacctt

SEQ ID NO: 12037 - DNA, 2587 bp, Homo sapiens
agactcctcgcagccagcgatggaggcgagaccccctagtaacagaggcggtggctactgctgcggccactgggtttcggcctcttcccagcagcggctctaagaagcgcagcggaactcgaccggatccaacccagttagttacttcctgtctagagttgtagcttccacctgcaccttctagccaccatggcaacctcatctgaagaagttttgctgattgtaaagaaagtgcgtcaaaagaagcaggatggagctctgtacctcatggcagaaagaattgcttgggcacctgaaggcaaagatagatttacaatcagccatatgtatgcagatattaaataatgctgcaagaagatcctgttttgtttcagctttataaagaccttgttgtgagtcaagtgatcagtgctgaggaattctgggccaatcgtttaaatgtgaatgcaacagatagttcttccacatccaatcataagcaggatgttggcatttctgctgcatttctggctgatgtccggccccaaactgatggctgtaacggtctaagatataatttaacttctgatatcattgagtccatatttaggacctatccagcagtaaaaatgaaatatgcagaaaatgttccccacaacatgacagagaaggaattctggacacgttttttccagtcccattattttcacagggatcggctgaatacagggtcaaaggatctctttgcagaatgtgccaaaatagatgaaaaaggcctaaaaacaatggtttcattaggagtgaaaaacccactactagatttaacagctttggaagataaaccattagatgagggctatggcatttcctctgtgccatctgcttccaattctaaatccataaaagagaatagtaatgctgccatcatcaagagatttaaccatcacagtgccatggtcctggcagctggactcagaaaacaagaagcacaaaatgaacaaactagtgagcccagcaacatggatggaaattccggagatgcagactgctttcagccagcagtcaaaagggcgaaattacaagagtccattgaatatgaagacttggggaaaaataattctgtaaaaacgattgcactaaacctcaagaagtcagataggtattatcatggtccaactccaatccagtcactacagtatgcaacaagtcaggacattattaattcttttcaaagtattagacaagaaatggaagcttatacacccaagttaactcaggttctctcaagtagtgctgccagtagtaccatcacagcactgtcacctggaggggcacttatgcagggaggaacacagcaagccataaaccagatggtgccaaatgatattcaatctgaattgaaacacttatatgtagctgttggagaacttctacgacatttctggtcctgctttcctgttaatacgccattcctagaagaaaaggtagtgaaaatgaaaagtaatttggaacgattccaagttacgaagctctgtccattccaagaaaagattcggagacagtatttaagcacaaatttggtaagtcacatagaagagatgctccagacagcctacaacaagctccacacatggcagtcacggcgtctgatgaagaaaacgtgaggtggccatgatgcttacaggttttgtgagattgagagaactatgacctgcagcaactctggaaacctggcctgacagacaagcagatgacctcacaggagtgataagaaacatctgctccacgccaactcccagagctgatgctattgtacttgcacattggagactgaaaggaaagaagggactaaatgctggggaggtaaattaagacagaaccaaatgagctaagttgcaaatatatatatatacacacacacacatatatgtacatgtgtatgtacatatatattttaaaagactgtttactgcagttgctcaggaactgcttttgattcacattaagctgctttcagaaattaaaaaaacactttttaaagggtgcattgataaaatctgaggttttttggttgtcgtttttttctgtgtacatttttttcctaagtttatggcacagggtagaccttaagtattcctcctccatccttcattcttcaccctccattggatcctcaagttttaatgaattccaattataccttacatcagcaagttaaaaaaagtactttaaaataaagcaaagggagactgttgctcaaccatcaggaaacagttgtcagaagacatcattggttctgtgtttcctacggaaataagaaacgataaatattgcactgaatgtttgtggtttggagtccctgaataataaagagggaatatatttgcagaaagtcgcatagggttttttaatgcagaattttgtcagaagacaatggcgctgcatgtttttctttgagtgcaaatgtacattgctaagatttttttaagatggcatgtgctttgaaaagaagatattgcatttttaagagtttaaaaatcttatgagtgagaaatattaaaaaaatcttattttcacctctttagaagaaataaaagatgtttctcct

SEQ ID NO: 12038 - DNA, 2049 bp, Homo sapiens
ctagctaggcggctgggagcgttttcgtggcggggaacggaggttgaattgccctgcctgggctcatagggaaggaggatgtgaaggagcttgtgaaggcagaggaagattattgaataataaaatacagttttgaaaaaaatggatgaagaacctgaaagaactaagcgatgggaaggaggctatgaaagaacatgggagattcttaaagaagatgaatctggatcacttaaagctacaatagaagacattctattcaaggcaaagagaaaaagagtatttgagcaccatggacaagttcgacttggaatgatgcgccacctttatgtggtagtagatggatcaagaacaatggaagaccaagatttaaagcctaatagactgacgtgtactttaaagttgttggaatactttgtagaggaatattttgatcaaaatcctattagtcagattggaataattgtaactaagagtaaaagagctgaaaaattgactgaactttcaggaaacccaagaaaacatataacgtctttgaagaaagctgtggatatgacctgccatggagagccatctctttataattccctaagcatagctatgcagactctaaaacacatgcctggacatacaagtcgagaagtactaatcatctttagcagccttacaacttgcgatccatctaatatttatgatctaatcaagaccctaaaggcagctaaaattagagtatctgttattggattgtctgcagaagttcgcgtttgcactgtacttgctcgtgaaactggtggcacgtaccatgttattttagatgaaagccattacaaagagttgctcacacatcatgttagtcctcctcctgctagctcaagttctgaatgctcacttattcgtatgggatttcctcagcacaccattgcttctttatctgaccaggatgcaaaaccctctttcagcatggcgcatttggatggcaatactgagccagggcttacattaggaggctatttctgcccacagtgtcgggcaaagtactgtgagctacctgttgagtgtaaaatctgtggtcttactttggtgtctgctccccacttggcacggtcttaccatcatttgtttcctttggatgcttttcaagaaattcccctagaagaatataatggagaaagattttgttatggatgtcagggggaattgaaagaccaacatgtttatgtttgtgctgtgtgccaaaatgttttctgtgtggactgtgatgtttttgttcatgattctctacactgttgccctggctgtattcataagattccagctccttcaggtgtttgattccagcatgtagtatacattgtatgtgttaaaaagaaatttgcaactgtgaataaaaggacttctttagaagaagcttcatttaaaacatgaaaggataatctgacttaagaaactttttgctaagaaaaggtaatattttattaaattttaaatttgtgttgtcacagaaatacctgaaattcagtagtacttcattcaattaattttgttttctattattttgagttatactgttttcaaagtcattatgcagtatgtataaacttataagaattaaattgatgtgataattttatgtttttataattaaatatagaatctttatgatttatgttaattcattaatttagtgtaagaagaaagttaagtctgaatgtaaattcagtgtaagatgaaaatttatcaatacttatgaaattaggctgggcgctgtggctcacacctgtaatcccaacactttgggaggctgaggtgggcagatcacctgaggtcaggagttcgagaccagcctggccaacatggtgaaaccccgtcactactaaaaatacaaaaaataattagccgggcatggtggttcacgcctggagtcccagctacttgggaggctgaggcaggagaatcgcttgaacccaggaggcggaggttgcagtgagccaagattgtgccactgcactccaccctagagtgagactccatctcaaaaaaaaaaaaagttat

SEQ ID NO: 12039 - DNA, 2174 bp, Homo sapiens
ggcgcagaggtggggcaggccgtctggctagctaggcggctgggagcgttttcgtggcggggaacggaggttgaattgccctgcctgggctcatagggaaggaggatgtgaaggagcttgtgaaggcagaggaaggctggagtgcagtggcacaaccttggctcgctccagtgtctacctgccaggttcaagtgattctcctgcctcagcctcccgagtagctgggattacagattattgaataataaaatacagttttgaaaaaaatggatgaagaacctgaaagaactaagcgatgggaaggaggctatgaaagaacatgggagattcttaaagaagatgaatctggatcacttaaagctacaatagaagacattctattcaaggcaaagagaaaaagagtatttgagcaccatggacaagttcgacttggaatgatgcgccacctttatgtggtagtagatggatcaagaacaatggaagaccaagatttaaagcctaatagactgacgtgtactttaaagttgttggaatactttgtagaggaatattttgatcaaaatcctattagtcagattggaataattgtaactaagagtaaaagagctgaaaaattgactgaactttcaggaaacccaagaaaacatataacgtctttgaagaaagctgtggatatgacctgccatggagagccatctctttataattccctaagcatagctatgcagactctaaaacacatgcctggacatacaagtcgagaagtactaatcatctttagcagccttacaacttgcgatccatctaatatttatgatctaatcaagaccctaaaggcagctaaaattagagtatctgttattggattgtctgcagaagttcgcgtttgcactgtacttgctcgtgaaactggtggcacgtaccatgttattttagatgaaagccattacaaagagttgctcacacatcatgttagtcctcctcctgctagctcaagttctgaatgctcacttattcgtatgggatttcctcagcacaccattgcttctttatctgaccaggatgcaaaaccctctttcagcatggcgcatttggatggcaatactgagccagggcttacattaggaggctatttctgcccacagtgtcgggcaaagtactgtgagctacctgttgagtgtaaaatctgtggtcttactttggtgtctgctccccacttggcacggtcttaccatcatttgtttcctttggatgcttttcaagaaattcccctagaagaatataatggagaaagattttgttatggatgtcagggggaattgaaagaccaacatgtttatgtttgtgctgtgtgccaaaatgttttctgtgtggactgtgatgtttttgttcatgattctctacactgttgccctggctgtattcataagattccagctccttcaggtgtttgattccagcatgtagtatacattgtatgtgttaaaaagaaatttgcaactgtgaataaaaggacttctttagaagaagcttcatttaaaacatgaaaggataatctgacttaagaaactttttgctaagaaaaggtaatattttattaaattttaaatttgtgttgtcacagaaatacctgaaattcagtagtacttcattcaattaattttgttttctattattttgagttatactgttttcaaagtcattatgcagtatgtataaacttataagaattaaattgatgtgataattttatgtttttataattaaatatagaatctttatgatttatgttaattcattaatttagtgtaagaagaaagttaagtctgaatgtaaattcagtgtaagatgaaaatttatcaatacttatgaaattaggctgggcgctgtggctcacacctgtaatcccaacactttgggaggctgaggtgggcagatcacctgaggtcaggagttcgagaccagcctggccaacatggtgaaaccccgtcactactaaaaatacaaaaaataattagccgggcatggtggttcacgcctggagtcccagctacttgggaggctgaggcaggagaatcgcttgaacccaggaggcggaggttgcagtgagccaagattgtgccactgcactccaccctagagtgagactccatctcaaaaaaaaaaaaagttat

SEQ ID NO: 12040 - DNA, 1956 bp, Homo sapiens
ggctagctaggcggctgggagcgttttcgtggcggggaacggaggttgaattgccctgcctgggctcatagggaaggaggatgtgaaggagcttgtgaaggcagaggaagattattgaataataaaatacagttttgaaaaaaatggatgaagaacctgaaagaactaagcgatgggaaggaggctatgaaagaacatgggagattcttaaagaagatgaatctggatcacttaaagctacaatagaagacattctattcaaggcaaagagaaaaagatgcgccacctttatgtggtagtagatggatcaagaacaatggaagaccaagatttaaagcctaatagactgacgtgtactttaaagttgttggaatactttgtagaggaatattttgatcaaaatcctattagtcagattggaataattgtaactaagagtaaaagagctgaaaaattgactgaactttcaggaaacccaagaaaacatataacgtctttgaagaaagctgtggatatgacctgccatggagagccatctctttataattccctaagcatagctatgcagactctaaaacacatgcctggacatacaagtcgagaagtactaatcatctttagcagccttacaacttgcgatccatctaatatttatgatctaatcaagaccctaaaggcagctaaaattagagtatctgttattggattgtctgcagaagttcgcgtttgcactgtacttgctcgtgaaactggtggcacgtaccatgttattttagatgaaagccattacaaagagttgctcacacatcatgttagtcctcctcctgctagctcaagttctgaatgctcacttattcgtatgggatttcctcagcacaccattgcttctttatctgaccaggatgcaaaaccctctttcagcatggcgcatttggatggcaatactgagccagggcttacattaggaggctatttctgcccacagtgtcgggcaaagtactgtgagctacctgttgagtgtaaaatctgtggtcttactttggtgtctgctccccacttggcacggtcttaccatcatttgtttcctttggatgcttttcaagaaattcccctagaagaatataatggagaaagattttgttatggatgtcagggggaattgaaagaccaacatgtttatgtttgtgctgtgtgccaaaatgttttctgtgtggactgtgatgtttttgttcatgattctctacactgttgccctggctgtattcataagattccagctccttcaggtgtttgattccagcatgtagtatacattgtatgtgttaaaaagaaatttgcaactgtgaataaaaggacttctttagaagaagcttcatttaaaacatgaaaggataatctgacttaagaaactttttgctaagaaaaggtaatattttattaaattttaaatttgtgttgtcacagaaatacctgaaattcagtagtacttcattcaattaattttgttttctattattttgagttatactgttttcaaagtcattatgcagtatgtataaacttataagaattaaattgatgtgataattttatgtttttataattaaatatagaatctttatgatttatgttaattcattaatttagtgtaagaagaaagttaagtctgaatgtaaattcagtgtaagatgaaaatttatcaatacttatgaaattaggctgggcgctgtggctcacacctgtaatcccaacactttgggaggctgaggtgggcagatcacctgaggtcaggagttcgagaccagcctggccaacatggtgaaaccccgtcactactaaaaatacaaaaaataattagccgggcatggtggttcacgcctggagtcccagctacttgggaggctgaggcaggagaatcgcttgaacccaggaggcggaggttgcagtgagccaaga

SEQ ID NO: 12041 - DNA, 1994 bp, Homo sapiens
gaacggaggttgaattgccctgcctgggctcatagggaaggaggatgtgaaggagcttgtgaaggcagaggaaggctggagcgcagcggcgcgatctcggctcactgcaacctccacctcccgggttcaagcgattctccttcctcagcctcccgagtagctggaactacagattattgaataataaaatacagttttgaaaaaaatggatgaagaacctgaaagaactaagcgatgggaaggaggctatgaaagaacatgggagattcttaaagaagatgaatctggatcacttaaagctacaatagaagacattctattcaaggcaaagagaaaaagagtatttgagcaccatggacaagttcgacttggaatgatgcgccacctttatgtggtagtagatggatcaagaacaatggaagaccaagatttaaagcctaatagactgacgtgtactttaaagttgttggaatactttgtagaggaatattttgatcaaaatcctattagtcagattggaataattgtaactaagagtaaaagagctgaaaaattgactgaactttcaggaaacccaagaaaacatataacgtctttgaagaaagctgtggatatgacctgccatggagagccatctctttataattccctaagcatagctatgcagactctaaaacacatgcctggacatacaagtcgagaagtactaatcatctttagcagccttacaacttgcgatccatctaatatttatgatctaatcaagaccctaaaggcagctaaaattagagtatctgttattggattgtctgcagaagttcgcgtttgcactgtacttgctcgtgaaactggtggcacgtaccatgttattttagatgaaagccattacaaagagttgctcacacatcatgttagtcctcctcctgctagctcaagttctgaatgctcacttattcgtatgggatttcctcagcacaccattgcttctttatctgaccaggatgcaaaaccctctttcagcatggcgcatttggatggcaatactgagccagggcttacattaggaggctatttctgcccacagtgtcgggcaaagtactgtgagctacctgttgagtgtaaaatctgtggtcttactttggtgtctgctccccacttggcacggtcttaccatcatttgtttcctttggatgcttttcaagaaattcccctagaagaatataatggagaaagattttgttatggatgtcagggggaattgaaagaccaacatgtttatgtttgtgctgtgtgccaaaatgttttctgtgtggactgtgatgtttttgttcatgattctctacactgttgccctggctgtattcataagattccagctccttcaggtgtttgattccagcatgtagtatacattgtatgtgttaaaaagaaatttgcaactgtgaataaaaggacttctttagaagaagcttcatttaaaacatgaaaggataatctgacttaagaaactttttgctaagaaaaggtaatattttattaaattttaaatttgtgttgtcacagaaatacctgaaattcagtagtacttcattcaattaattttgttttctattattttgagttatactgttttcaaagtcattatgcagtatgtataaacttataagaattaaattgatgtgataattttatgtttttataattaaatatagaatctttatgatttatgttaattcattaatttagtgtaagaagaaagttaagtctgaatgtaaattcagtgtaagatgaaaatttatcaatacttatgaaattaggctgggcgctgtggctcacacctgtaatcccaacactttgggaggctgaggtgggcagatcacctgaggtcaggagttcgagaccagcctggccaacatggtgaaaccccgtcactactaaaaatacaaaaaataattagccgggcatggtggttcacgcctggagtcccagctact

SEQ ID NO: 12042 - DNA, 1735 bp, Homo sapiens
attctcatcctcttcacttttccactcctccccttacctcccttctcttctgaattctccattctgggctcttgcctgtgaaatctttctttgctttccccatcttttcctcgcattttttcaccatctttccctcaatctccaggagccaatgcgagactttggctccgattaagcgacggcccgagactcggggtgcgcgaggaggatcgacagagtggtgatggagagcaccccttcaaggggactgaaccgagtacacctacaatgcaggaatctgcaggaattcttagggggcctgagccctggggtattggaccgattgtatgggcaccctgccacatgtctggctgtcttcagggagctcccatccttggctaagaactgggtgatgcggatgctctttctggagcagcctttgccacaggctgctgtagctctgtgggtaaagaaggaattcagcaaggctcaggaggaaagtacagggctgctgagcggcctccggatctggcacacacagctgctcccaggcgggctccagggcctcatcctcaaccccattttccgccagaacctccgcattgcccttctgggtggggggaaggcctggtctgatgacacaagtcagctgggaccagacaagcatgcccgggacgttccctcccttgacaagtacgccgaggagcgatgggaggtggtcttgcacttcatggtgggctcccccagtgcagctgtcagccaggacttggctcagctcctcagccaggctgggctcatgaagagtactgaacctggagagccgccctgcattacttccgctggcttccagttcctgttgctggacaccccggctcagctctggtactttatgttgcagtatttgcagacagcccagagccggggcatggacctggtagagattctctccttcctcttccagctcagcttctctactctgggcaaggattactctgtggaaggtatgagtgattctctgttgaacttcctgcaacatctgcgtgagtttgggcttgttttccagaggaagaggaaatctcggcgttactaccccacacgcctggccatcaatctctcatcaggtgtctctggagctgggggcactgtgcatcagccaggtttcattgtcgtggaaaccaattaccgactgtatgcctacacggagtcggagctgcagattgccctcattgccctcttctctgagatgctctatcggttccccaacatggtggtggcgcaggtgacccgggagagtgtgcagcaggcaatcgccagtggcatcacagcccagcagataatccatttcctaaggacaagagcccacccagtgatgctcaaacagacacctgtgctgccccccaccatcaccgaccagatccggctctgggagctggaaagggacagactccggttcactgagggtgtcctgtataaccagttcctgtcgcaagtggactttgagctgctgctggcccacgcgcgggagctgggcgtgctcgtgttcgagaactcggccaagcggctcatggtggtgaccccggccgggcacagcgacgtcaagcgcttttggaagcggcagaaacatagctcctgagagcgcgggacttggacacggacctcggcgggcgggactgggcggggcggggcatcagaactcaggtgttttttatttacgcgtcagggcttttcttgtttaataaagttatgatagctagca

SEQ ID NO: 12043 - DNA, 1673 bp, Homo sapiens
ctcccttctcttctgaattctccattctgggctcttgcctgtgaaatctttctttgctttccccatcttttcctcgcattttttcaccatctttccctcaatctccaggagccaatgcgagactttggctccgattaagcgacggcccgagactcggggtgatggagagcaccccttcaaggggactgaaccgagtacacctacaatgcaggaatctgcaggaattcttagggggcctgagccctggggtattggaccgattgtatgggcaccctgccacatgtctggctgtcttcagggagctcccatccttggctaagaactgggtgatgcggatgctctttctggagcagcctttgccacaggctgctgtagctctgtgggtaaagaaggaattcagcaaggctcaggaggaaagtacagggctgctgagcggcctccggatctggcacacacagctgctcccaggcgggctccagggcctcatcctcaaccccattttccgccagaacctccgcattgcccttctgggtggggggaaggcctggtctgatgacacaagtcagctgggaccagacaagcatgcccgggacgttccctcccttgacaagtacgccgaggagcgatgggaggtggtcttgcacttcatggtgggctcccccagtgcagctgtcagccaggacttggctcagctcctcagccaggctgggctcatgaagagtactgaacctggagagccgccctgcattacttccgctggcttccagttcctgttgctggacaccccggctcagctctggtactttatgttgcagtatttgcagacagcccagagccggggcatggacctggtagagattctctccttcctcttccagctcagcttctctactctgggcaaggattactctgtggaaggtatgagtgattctctgttgaacttcctgcaacatctgcgtgagtttgggcttgttttccagaggaagaggaaatctcggcgttactaccccacacgcctggccatcaatctctcatcaggtgtctctggagctgggggcactgtgcatcagccaggtttcattgtcgtggaaaccaattaccgactgtatgcctacacggagtcggagctgcagattgccctcattgccctcttctctgagatgctctatcggttccccaacatggtggtggcgcaggtgacccgggagagtgtgcagcaggcaatcgccagtggcatcacagcccagcagataatccatttcctaaggacaagagcccacccagtgatgctcaaacagacacctgtgctgccccccaccatcaccgaccagatccggctctgggagctggaaagggacagactccggttcactgagggtgtcctgtataaccagttcctgtcgcaagtggactttgagctgctgctggcccacgcgcgggagctgggcgtgctcgtgttcgagaactcggccaagcggctcatggtggtgaccccggccgggcacagcgacgtcaagcgcttttggaagcggcagaaacatagctcctgagagcgcgggacttggacacggacctcggcgggcgggactgggcggggcggggcatcagaactcaggtgttttttatttacgcgtcagggcttttcttgtttaataaagttatgatagctagca

SEQ ID NO: 12044 - DNA, 1735 bp, Homo sapiens; identical to SEQ ID NO: 12042

SEQ ID NO: 12045 - DNA, 1673 bp, Homo sapiens; identical to SEQ ID NO: 12043

SEQ ID NO: 12046 - DNA, 1735 bp, Homo sapiens; identical to SEQ ID NO: 12042

SEQ ID NO: 12047 - DNA, 598 bp, Homo sapiens
cccttctcttctgaattctccattctgggctcttgcctgtgaaatctttctttgctttccccatcttttcctcgcattttttcaccatctttccctcaatctccaggagccaatgcgagactttggctccgattaagcgacggcccgagactcggggtgcgcgaggaggatcgacagagtggtgatggagagcaccccttcaaggggactgaaccgagtacacctacaatgcaggaatctgcaggaattcttagggggcctgagccctggggtattggaccgattgtatgggcaccctgccacatgtctggctgtcttcagggagctcccatccttggctaagaactgggtgatgcggatgctctttctggagcagcctttgccacaggctgctgtagctctgtgggtaaagaaggaattcagcaaggctcaggaggaaagtacagggctgctgagcggcctccggatctggcacacacagctgctcccaggcgggctccagggcctcatcctcaaccccattttccgccagaacctccgcattgcccttctgggtggtacagggattacaggtgtgagccactgcgcctggccaggg

SEQ ID NO: 12048 - DNA, 1673 bp, Homo sapiens
ctcccttctcttctgaattttccattctgggctcttgcctgtgaaatctttctttgctttccccatcttttcctcgcattttttcaccatctttccctcaatctccaggagccaatgcgagactttggctccgattaagcgacggcccgagactcggggtgatggagagcaccccttcaaggggactgaaccgagtacacctacaatgcaggaatctgcaggaattcttagggggcctgagccctggggtattggaccgattgtatgggcaccctgccacatgtctggctgtcttcagggagctcccatccttggctaagaactgggtgatgcggatgctctttctggagcagcctttgccacaggctgctgtagctctgtgggtaaagaaggaattcagcaaggctcaggaggaaagtacagggctgctgagcggcctccggatctggcacacacagctgctcccaggcgggctccagggcctcatcctcaaccccattttccgccagaacctccgcattgcccttctgggtggggggaaggcctggtctgatgacacaagtcagctgggaccagacaagcatgcccgggacgttccctcccttgacaagtacgccgaggagcgatgggaggtggtcttgcacttcatggtgggctcccccagtgcagctgtcagccaggacttggctcagctcctcagccaggctgggctcatgaagagtactgaacctggagagccgccctgcattacttccgctggcttccagttcctgttgctggacaccccggctcagctctggtactttatgttgcagtatttgcagacagcccagagccggggcatggacctggtagagattctctccttcctcttccagctcagcttctctactctgggcaaggattactctgtggaaggtatgagtgattctctgttgaacttcctgcaacatctgcgtgagtttgggcttgttttccagaggaagaggaaatctcggcgttactaccccacacgcctggccatcaatctctcatcaggtgtctctggagctgggggcactgtgcatcagccaggtttcattgtcgtggaaaccaattaccgactgtatgcctacacggagtcggagctgcagattgccctcattgccctcttctctgagatgctctatcggttccccaacatggtggtggcgcaggtgacccgggagagtgtgcagcaggcaatcgccagtggcatcacagcccagcagataatccatttcctaaggacaagagcccacccagtgatgctcaaacagacacctgtgctgccccccaccatcaccgaccagatccggctctgggagctggaaagggacagactccggttcactgagggtgtcctgtataaccagttcctgtcgcaagtggactttgagctgctgctggcccacgcgcgggagctgggcgtgctcgtgttcgagaactcggccaagcggctcatggtggtgaccccggccgggcacagcgacgtcaagcgcttttggaagcggcagaaacatagctcctgagagcgcgggacttggacacggacctcggcgggcgggactgggcggggcggggcatcagaactcaggtgttttttatttacgcgtcagggcttttcttgtttaataaagttatgatagctagca

SEQ ID NO: 12049 - DNA, 598 bp, Homo sapiens; identical to SEQ ID NO: 12047

SEQ ID NO: 12050 - DNA, 1673 bp, Homo sapiens; identical to SEQ ID NO: 12043

SEQ ID NO: 12051 - DNA, 598 bp, Homo sapiens
cccttctcttctgaattctccattctgggctctttcctgtgaaatctttctttgctttccccatcttttcctcgcattttttcaccatctttccctcaatctccaggagccaatgcgagactttggctccgattaagcgacggcccgagacttggggtgcgcgaggaggatcgacagagtggtgatggagagcaccccttcaaggggactgaaccgagtacacctacaatgcaggaatctgcaggaattcttagggggcctgagccctggggtattggaccgattgtatgggcaccctgccacatgtctggctgtcttcagggagctcccatccttggctaagaactgggtgatgcggatgctctttctggagcagcctttgccacaggctgctgtagctctgtgggtaaagaaggaattcagcaaggctcaggaggaaagtacagggctgctgagcggcctccggatctggcacacccagctgctcccaggcgggctccagggcctcatcctcaaccccattttccgccagaacctccgcattgcccttctgggtggtacagggattacaggtgtgagccactgcgcctggccaggg

SEQ ID NO: 12052 - DNA, 1735 bp, Homo sapiens
attctcatcctcttcacttttccactcctccccttacctcccttctcttctgaattttccattctgggctcttgcctgtgaaatctttctttgctttccccatcttttcctcgcattttttcaccatctttccctcaatctccaggagccaatgcgagactttggctccgattaagcgacggcccgagactcggggtgcgcgaggaggatcgacagagtggtgatggagagcaccccttcaaggggactgaaccgagtacacctacaatgcaggaatctgcaggaattcttagggggcctgagccctggggtattggaccgattgtatgggcaccctgccacatgtctggctgtcttcagggagctcccatccttggctaagaactgggtgatgcggatgctctttctggagcagcctttgccacaggctgctgtagctctgtgggtaaagaaggaattcagcaaggctcaggaggaaagtacagggctgctgagcggcctccggatctggcacacacagctgctcccaggcgggctccagggcctcatcctcaaccccattttccgccagaacctccgcattgcccttctgggtggggggaaggcctggtctgatgacacaagtcagctgggaccagacaagcatgcccgggacgttccctcccttgacaagtacgccgaggagcgatgggaggtggtcttgcacttcatggtgggctcccccagtgcagctgtcagccaggacttggctcagctcctcagccaggctgggctcatgaagagtactgaacctggagagccgccctgcattacttccgctggcttccagttcctgttgctggacaccccggctcagctctggtactttatgttgcagtatttgcagacagcccagagccggggcatggacctggtagagattctctccttcctcttccagctcagcttctctactctgggcaaggattactctgtggaaggtatgagtgattctctgttgaacttcctgcaacatctgcgtgagtttgggcttgttttccagaggaagaggaaatctcggcgttactaccccacacgcctggccatcaatctctcatcaggtgtctctggagctgggggcactgtgcatcagccaggtttcattgtcgtggaaaccaattaccgactgtatgcctacacggagtcggagctgcagattgccctcattgccctcttctctgagatgctctatcggttccccaacatggtggtggcgcaggtgacccgggagagtgtgcagcaggcaatcgccagtggcatcacagcccagcagataatccatttcctaaggacaagagcccacccagtgatgctcaaacagacacctgtgctgccccccaccatcaccgaccagatccggctctgggagctggaaagggacagactccggttcactgagggtgtcctgtataaccagttcctgtcgcaagtggactttgagctgctgctggcccacgcgcgggagctgggcgtgctcgtgttcgagaactcggccaagcggctcatggtggtgaccccggccgggcacagcgacgtcaagcgcttttggaagcggcagaaacatagctcctgagagcgcgggacttggacacggacctcggcgggcgggactgggcggggcggggcatcagaactcaggtgttttttatttacgcgtcagggcttttcttgtttaataaagttatgatagctagca

SEQ ID NO: 12053 - DNA, 1673 bp, Homo sapiens; identical to SEQ ID NO: 12043

SEQ ID NO: 12054 - DNA, 1673 bp, Homo sapiens
ctcccttctcttctgaattctccattctgggctctttcctgtgaaatctttctttgctttccccatcttttcctcgcattttttcaccatctttccctcaatctccaggagccaatgcgagactttggctccgattaagcgacggcccgagacttggggtgatggagagcaccccttcaaggggactgaaccgagtacacctacaatgcaggaatctgcaggaattcttagggggcctgagccctggggtattggaccgattgtatgggcaccctgccacatgtctggctgtcttcagggagctcccatccttggctaagaactgggtgatgcggatgctctttctggagcagcctttgccacaggctgctgtagctctgtgggtaaagaaggaattcagcaaggctcaggaggaaagtacagggctgctgagcggcctccggatctggcacacccagctgctcccaggcgggctccagggcctcatcctcaaccccattttccgccagaacctccgcattgcccttctgggtggggggaaggcctggtctgatgacacaagtcagctgggaccagacaagcatgcccgggacgttccctcccttgacaagtacgccgaggagcgatgggaggtggtcttgcacttcatggtgggctcccccagtgcagctgtcagccaggacttggctcagctcctcagccaggctgggctcatgaagagtactgaacctggagagccgccctgcattacttccgctggcttccagttcctgttgctggacaccccggctcagctctggtactttatgttgcagtatttgcagacagcccagagccggggcatggacctggtagagattctctccttcctcttccagctcagcttctctactctgggcaaggattactctgtggaaggtatgagtgattctctgttgaacttcctgcaacatctgcgtgagtttgggcttgttttccagaggaagaggaaatctcggcgttactaccccacacgcctggccatcaatctctcatcaggtgtctctggagctgggggcactgtgcatcagccaggtttcattgtcgtggaaaccaattaccgactgtatgcctacacggagtcggagctgcagattgccctcattgccctcttctctgagatgctctatcggttccccaacatggtggtggcgcaggtgacccgggagagtgtgcagcaggcaatcgccagtggcatcacagcccagcagataatccatttcctaaggacaagagcccacccagtgatgctcaaacagacacctgtgctgccccccaccatcaccgaccagatccggctctgggagctggaaagggacagactccggttcactgagggtgtcctgtataaccagttcctgtcgcaagtggactttgagctgctgctggcccacgcgcgggagctgggcgtgctcgtgttcgagaactcggccaagcggctcatggtggtgaccccggccgggcacagcgacgtcaagcgcttttggaagcggcagaaacatagctcctgagagcgcgggacttggacacggacctcggcgggcgggactgggcggggcggggcatcagaactcaggtgttttttatttacgcgtcagggcttttcttgtttaataaagttatgatagctagca

SEQ ID NO: 12055 - DNA, 1735 bp, Homo sapiens
attctcatcctcttcacttttccactcctccccttacctcccttctcttctgaattctccattctgggctctttcctgtgaaatctttctttgctttccccatcttttcctcgcattttttcaccatctttccctcaatctccaggagccaatgcgagactttggctccgattaagcgacggcccgagacttggggtgcgcgaggaggatcgacagagtggtgatggagagcaccccttcaaggggactgaaccgagtacacctacaatgcaggaatctgcaggaattcttagggggcctgagccctggggtattggaccgattgtatgggcaccctgccacatgtctggctgtcttcagggagctcccatccttggctaagaactgggtgatgcggatgctctttctggagcagcctttgccacaggctgctgtagctctgtgggtaaagaaggaattcagcaaggctcaggaggaaagtacagggctgctgagcggcctccggatctggcacacccagctgctcccaggcgggctccagggcctcatcctcaaccccattttccgccagaacctccgcattgcccttctgggtggggggaaggcctggtctgatgacacaagtcagctgggaccagacaagcatgcccgggacgttccctcccttgacaagtacgccgaggagcgatgggaggtggtcttgcacttcatggtgggctcccccagtgcagctgtcagccaggacttggctcagctcctcagccaggctgggctcatgaagagtactgaacctggagagccgccctgcattacttccgctggcttccagttcctgttgctggacaccccggctcagctctggtactttatgttgcagtatttgcagacagcccagagccggggcatggacctggtagagattctctccttcctcttccagctcagcttctctactctgggcaaggattactctgtggaaggtatgagtgattctctgttgaacttcctgcaacatctgcgtgagtttgggcttgttttccagaggaagaggaaatctcggcgttactaccccacacgcctggccatcaatctctcatcaggtgtctctggagctgggggcactgtgcatcagccaggtttcattgtcgtggaaaccaattaccgactgtatgcctacacggagtcggagctgcagattgccctcattgccctcttctctgagatgctctatcggttccccaacatggtggtggcgcaggtgacccgggagagtgtgcagcaggcaatcgccagtggcatcacagcccagcagataatccatttcctaaggacaagagcccacccagtgatgctcaaacagacacctgtgctgccccccaccatcaccgaccagatccggctctgggagctggaaagggacagactccggttcactgagggtgtcctgtataaccagttcctgtcgcaagtggactttgagctgctgctggcccacgcgcgggagctgggcgtgctcgtgttcgagaactcggccaagcggctcatggtggtgaccccggccgggcacagcgacgtcaagcgcttttggaagcggcagaaacatagctcctgagagcgcgggacttggacacggacctcggcgggcgggactgggcggggcggggcatcagaactcaggtgttttttatttacgcgtcagggcttttcttgtttaataaagttatgatagctagca

SEQ ID NO: 12056 - DNA, 598 bp, Homo sapiens; identical to SEQ ID NO: 12047

SEQ ID NO: 12057 - DNA, 598 bp, Homo sapiens
cccttctcttctgaattttccattctgggctcttgcctgtgaaatctttctttgctttccccatcttttcctcgcattttttcaccatctttccctcaatctccaggagccaatgcgagactttggctccgattaagcgacggcccgagactcggggtgcgcgaggaggatcgacagagtggtgatggagagcaccccttcaaggggactgaaccgagtacacctacaatgcaggaatctgcaggaattcttagggggcctgagccctggggtattggaccgattgtatgggcaccctgccacatgtctggctgtcttcagggagctcccatccttggctaagaactgggtgatgcggatgctctttctggagcagcctttgccacaggctgctgtagctctgtgggtaaagaaggaattcagcaaggctcaggaggaaagtacagggctgctgagcggcctccggatctggcacacacagctgctcccaggcgggctccagggcctcatcctcaaccccattttccgccagaacctccgcattgcccttctgggtggtacagggattacaggtgtgagccactgcgcctggccaggg

SEQ ID NO: 12058 - DNA, 598 bp, Homo sapiens; identical to SEQ ID NO: 12047

SEQ ID NO: 12059 - DNA, 1735 bp, Homo sapiens; identical to SEQ ID NO: 12042

SEQ ID NO: 12060 - DNA, 1232 bp, Homo sapiens
actcctccccttacctcccttctcttctgaattctccattctgggctcttgcctgtgaaatctttctttgctttccccatcttttcctcgcattttttcaccatctttccctcaatctccaggagccaatgcgagactttggctccgattaagcgacggcccgagactcggggtgcgcgaggaggatcgacagagtgggagctcccatccttggctaagaactgggtgatgcggatgctctttctggagcagcctttgccacaggctgctgtagctctgtgggtaaagaaggaattcagcaaggctcaggaggaaagtacagggctgctgagcggcctccggatctggcacacacagctgctcccaggcgggctccagggcctcatcctcaaccccattttccgccagaacctccgcattgcccttctgggtggggggaaggcctggtctgatgacacaagtcagctgggaccagacaagcatgcccgggacgttccctcccttgacaagtacgccgaggagcgatgggaggtggtcttgcacttcatggtgggctcccccagtgcagctgtcagccaggacttggctcagctcctcagccaggctgggctcatgaagagtactgaacctggagagccgccctgcattacttccgctggcttccagttcctgttgctggacaccccggctcagctctggtactttatgttgcagtatttgcagacagcccagagccggggcatggacctggtagagattctctccttcctcttccagctcagcttctctactctgggcaaggattactctgtggaaggtatgagtgattctctgttgaacttcctgcaacatctgcgtgagtttgggcttgttttccagaggaaggtatgagcgcctagataagtggcttccagggaagaaacagggtggtgtgttgcctttgcctttaaaaaggagtggggtcttggggcagtagcaggaagcagttgccagaactgaatacttgggtctctcgggggagagaagttgggggttgaggttctgcatcttgggagggatctgatatttcaggcaggaagatgtaaggcagtgacttctgagacaaggcatctgcctttctattcttttcagaggaaatctcggcgttactaccccacacgcctggccatcaatctctcatcaggtgtctctggagctgggggcactgtgcatcagccaggtttcattgtcgt

SEQ ID NO: 12061 - DNA, 1232 bp, Homo sapiens; identical to SEQ ID NO: 12060

SEQ ID NO: 12062 - DNA, 1232 bp, Homo sapiens
actcctccccttacctcccttctcttctgaattttccattctgggctcttgcctgtgaaatctttctttgctttccccatcttttcctcgcattttttcaccatctttccctcaatctccaggagccaatgcgagactttggctccgattaagcgacggcccgagactcggggtgcgcgaggaggatcgacagagtgggagctcccatccttggctaagaactgggtgatgcggatgctctttctggagcagcctttgccacaggctgctgtagctctgtgggtaaagaaggaattcagcaaggctcaggaggaaagtacagggctgctgagcggcctccggatctggcacacacagctgctcccaggcgggctccagggcctcatcctcaaccccattttccgccagaacctccgcattgcccttctgggtggggggaaggcctggtctgatgacacaagtcagctgggaccagacaagcatgcccgggacgttccctcccttgacaagtacgccgaggagcgatgggaggtggtcttgcacttcatggtgggctcccccagtgcagctgtcagccaggacttggctcagctcctcagccaggctgggctcatgaagagtactgaacctggagagccgccctgcattacttccgctggcttccagttcctgttgctggacaccccggctcagctctggtactttatgttgcagtatttgcagacagcccagagccggggcatggacctggtagagattctctccttcctcttccagctcagcttctctactctgggcaaggattactctgtggaaggtatgagtgattctctgttgaacttcctgcaacatctgcgtgagtttgggcttgttttccagaggaaggtatgagcgcctagataagtggcttccagggaagaaacagggtggtgtgttgcctttgcctttaaaaaggagtggggtcttggggcagtagcaggaagcagttgccagaactgaatacttgggtctctcgggggagagaagttgggggttgaggttctgcatcttgggagggatctgatatttcaggcaggaagatgtaaggcagtgacttctgagacaaggcatctgcctttctattcttttcagaggaaatctcggcgttactaccccacacgcctggccatcaatctctcatcaggtgtctctggagctgggggcactgtgcatcagccaggtttcattgtcgt

SEQ ID NO: 12063 - DNA, 1232 bp, Homo sapiens; identical to SEQ ID NO: 12060

SEQ ID NO: 12064 - DNA, 1232 bp, Homo sapiens
actcctccccttacctcccttctcttctgaattctccattctgggctcttgcctgtgaaatctttctttgctttccccatcttttcctcgcattttttcaccatctttccctcaatctccaggagccaatgcgagactttggctccgattaagcgacggcccgagactcggggtgcgcgaggaggatcgacagagtgggagctcccatccttggctaagaactgggtgatgcggatgctctttctggagcagcctttgccacaggctgctgtagctctgtgggtaaagaaggaattcagcaaggctcaggaggaaagtacagggctgctgagcggcctccggatctggcacacacagctgctcccaggcgggctccagggcctcatcctcaaccccattttccgccagaacctccgcattgcccttctgggtggggggaaggcctggtctgatgacacaagtcagctgggaccagacaagcatgcccgggacgttccctcccttgacaagtacgccgaggagcgatgggaggtggtcttgcacttcatggtgggctcccccagtgcagctgtcagccaggacttggctcagctcctcagccaggctgggctcatgaagagtactgaacctggagagccgccctgcattacttccgctggcttccagttcctgttgctggacaccccggctcagctctggtactttatgttgcagtatttgcagacagcccagagccggggcatggacctggtagagattctctccttcctcttccagctcagcttctctactctgggcaaggattactctgtggaaggtatgagtgattctctgttgaacttcctgcaacatctgcgtgagtttgggcttgttttccagaggaaggtatgagcgcctagataagtggcttccagggaagaaacagggtggtgtgttgcctttgcctttaaaaaggagtggggtcttggggcagtagtaggaagcagttgccagaactgaatacttgggtctctcgggggagagaagttgggggttgaggttctgcatcttgggagggatctgatatttcaggcaggaagatgtaaggcagtgacttctgagacaaggcatctgcctttctattcttttcagaggaaatctcggcgttactaccccacacgcctggccatcaatctctcatcaggtgtctctggagctgggggcactgtgcatcagccaggtttcattgtcgt

SEQ ID NO: 12065 - DNA, 1232 bp, Homo sapiens
actcctccccttacctcccttctcttctgaattctccattctgggctctttcctgtgaaatctttctttgctttccccatcttttcctcgcattttttcaccatctttccctcaatctccaggagccaatgcgagactttggctccgattaagcgacggcccgagacttggggtgcgcgaggaggatcgacagagtgggagctcccatccttggctaagaactgggtgatgcggatgctctttctggagcagcctttgccacaggctgctgtagctctgtgggtaaagaaggaattcagcaaggctcaggaggaaagtacagggctgctgagcggcctccggatctggcacacccagctgctcccaggcgggctccagggcctcatcctcaaccccattttccgccagaacctccgcattgcccttctgggtggggggaaggcctggtctgatgacacaagtcagctgggaccagacaagcatgcccgggacgttccctcccttgacaagtacgccgaggagcgatgggaggtggtcttgcacttcatggtgggctcccccagtgcagctgtcagccaggacttggctcagctcctcagccaggctgggctcatgaagagtactgaacctggagagccgccctgcattacttccgctggcttccagttcctgttgctggacaccccggctcagctctggtactttatgttgcagtatttgcagacagcccagagccggggcatggacctggtagagattctctccttcctcttccagctcagcttctctactctgggcaaggattactctgtggaaggtatgagtgattctctgttgaacttcctgcaacatctgcgtgagtttgggcttgttttccagaggaaggtatgagcgcctagataagtggcttccagggaagaaacagggtggtgtgttgcctttgcctttaaaaaggagtggggtcttggggcagtagcaggaagcagttgccagaactgaatacttgggtctctcgggggagagaagttgggggttgaggttctgcatcttgggagggatctgatatttcaggcaggaagatgtaaggcagtgacttctgagacaaggcatctgcctttctattcttttcagaggaaatctcggcgttactaccccacacgcctggccatcaatctctcatcaggtgtctctggagctgggggcactgtgcatcagccaggtttcattgtcgt

SEQ ID NO: 12066 - DNA, 2125 bp, Homo sapiens
actctgccggcaacgccgaggcgcttctgcatctgtgggccgagcattcttcaggtcatctgaaccttctgagaaaacatggtcaacgtcttgaaaggagtgcttatagaatgtgatcctgccatgaagcagtttctgctgtacttggatgagtccaatgccctggggaagaagttcatcattcaagacattgatgacactcacgtctttgtaatagcagaattggttaatgtcctccaggagcgagtgggtgaattaatggaccaaaatgctttttcccttacccagaaatgaaaatactcaatatggaccatttaggaattataagcagcaactgtgaaagacttgccactcaatatcttaggtgactgattagacatagagggttgttttaggagcatgccacgggaaagactgagggatcatgatcatttgttcagaaaaaaagcccctgaactgattttgttaccatagaatttaaaaaaaaaaaaagctttaacagttggctgtaatttggcttttattatcctttattaaaatacaaatgtcaatgcttttcctgcctttttaataccatgtcagtgtaacataggtatttattttgctcatccctgtgatctgtgcatttttgctgcgtggatgtgattgtttggtttcagttagaaacgtcatagatttgctgtttgaatatgccaaggtggggacttagacattatgtacgtctcacaaatcctacctgcataccagtcagctctattgaggaagacaatgtaaaactaatgtaaactacagtttgcatttccctgaaaacagaatattgtttttaagagggttagaaacaaccagtgggaaaggcacatgctgctttgtttagtttttccttgttcaaactttgttggtcacattttcccatctgtattcttttttattaagaaaacagcttagggaggctgaggtgggaggattgcttgagcccaggagtccgaggttgctacaaaaacaccattgcactctggcctggacaacagagagaccctgcctcaaaaaaaaaaaaaaaaaaaaaaaaaattctacttgtaccttattccctatgagaatacttatcaaacttatctaaaaaagaaaaataggaacagccatatgcaaagtcagcccaacaggaaaggacatattagattaaaatacattgcggcctgggcttagtggctcacacctgtaatcccagcactttgggaggctgaggcaggcagatcgcttgagtccaggagtcgaaaccctgtctctacaaaaaaaaaaatacaaaaatctgcctgttgtcccagccactggggaggctgaggtaggaggtcaaggctgcagtgaaccttgatcattgctactgccactccagcctaggtgacagagtgagaccctgtctccaaaaaaaaaagtgtatatgtatgtgtgtatatatagcaagagagagttctgtgatcaattgaaggcaaaaacagtaacactgagaggggctttgcttcccttcctgaagatcatgtcattggggtgggttcctgtaaagggaattttccaagagaaaagagaattttcatgacctgtagactcttacaaatccattttacctgcttccttatggtatgtttattcaaagcacctgtgtaccatatttattcacttacacagcattactgaatctggaaattttcagttaggtatattttacataattcccacccatataactcagtccatacagttcacagttttcattccctcatagcaatgcaaaaaattttgatgagttactactactaaaactagttaagtaaaagatgattcttaagaatttccaggctgggcacggtggctcacgcctgtaatcccagcactttgggaggctgaggcaggcagctcacgaggtcaggagatcgagaccatcctgctcggtgaaaccccatctctattaaaaatacaaaaaattagccgggcctggtggcgggtgcctgtagtcccatctactcaggaggctgaggcaggagaatggcgtgaacccgggaggcggagcttgcagtaagctgagattgtgccactgcactccagcctgggcgacagagggagactccatctc

SEQ ID NO: 12067 - DNA, 4548 bp, Homo sapiens
aaagaaaaaaaaaaggaggaggaggaggagggtgagagagaagctgggagagcagagaaaaggggccaccggtcgcccccccgcttccccgcacgcgctctccagccgcggccgcccgcctgccgcggtcaccccggcctctgcctctgtcccccagtgatcggatcaaggcgctgagcgaggccctgcctgcggggcggccatgcggcggtgacaggagcgcgaccgacacgcacgggcccctcgccccctctcgcctcccgtccgctcgccagctcccctcagccgaggctgctccgcggcggccgcagcccgcgcgcggcccacactcgcctcccctcggcacccccggccccggagctgcctggaggcggccgcactcggggatcatggcccaagttgcaatgtccaccctccccgttgaagatgaggagtcctcggagagcaggatggtggtgacattcctcatgtcagctctcgagtccatgtgtaaagaactggccaagtccaaagccgaagtggcctgcattgcagtgtatgaaacagacgtgtttgtcgtcggaactgaaagaggacgtgcttttgtcaataccagaaaggattttcaaaaagattttgtaaaatattgtgttgaagaagaagaaaaagctgcagagatgcataaaatgaaatctacaacccaggcaaatcggatgagtgtagatgctgtagaaattgaaacactcagaaaaacagttgaggactatttctgcttttgctatgggaaagctttaggcaaatccacagtggtacctgtaccatatgagaagatgctgcgagaccagtcggctgtggtagtgcaggggcttccggaaggtgttgcctttaaacaccccgagaactatgatcttgcaaccctgaaatggattttggagaacaaagcagggatttcattcatcattaagagaccttttttagagccaaagaagcatgtaggtggtcgtgtgatggtaacagatgctgacaggtcaatactatctccaggtggaagttgtggccccatcaaagtgaaaactgaacccacagaagattctggcatttccctggaaatggcagctgtgacagtaaaggaagaatcagaagatcctgattattatcaatataacattcaagcaggcccttctgaaactgatgatgttgatgaaaaacagcccctatcgaagcctttgcaaggaagccaccattcttcagagggcaatgaaggcacagaaatggaagtaccagcagaagattctactcaacatgtcccttcagaaacaagtgaggaccctgaagttgaggtgactattgaagatgatgattattctccaccgtctaagagaccaaaggccaatgagctaccgcagccaccagtcccggaacccgccaatgctgggaagcggaaagtgagggagttcaacttcgagaaatggaatgctcgcatcactgatctacgtaaacaagttgaagaattgtttgaaaggaaatatgctcaagccataaaagccaaaggtccggtgacgatcccgtaccctcttttccagtctcatgttgaagatctttatgtagaaggacttcctgaaggaattccttttagaaggccatctacttacggaattcctcgcctggagaggatattacttgcaaaggaaaggattcgttttgtgattaagaaacatgagcttctgaattcaacacgtgaagatttacagcttgataagccagcttcaggagtaaaggaagaatggtatgccagaatcactaaattaagaaagatggtggatcagcttttctgcaaaaaatttgcggaagccttggggagcactgaagccaaggctgtaccgtaccaaaaatttgaggcacacccgaatgatctgtacgtggaaggactgccagaaaacattcctttccgaagtccctcatggtatggaatcccaaggctggaaaaaatcattcaagtgggcaatcgaattaaatttgttattaaaagaccagaacttctgactcacagtaccactgaagttactcagccaagaacgaatacaccagtcaaagaagattggaatgtcagaattaccaagctacggaagcaagtggaagagatttttaatttgaaatttgctcaagctcttggactcaccgaggcagtaaaagtaccatatcctgtgtttgaatcaaacccggagttcttgtatgtggaaggcttgccagaggggattcccttccgaagccctacctggtttggaattccacgacttgaaaggatcgtccgcgggagtaataaaatcaagttcgttgttaaaaaacctgaactagttatttcctacttgcctcctgggatggctagtaaaataaacactaaagctttgcagtcccccaaaagaccacgaagtcctgggagtaattcaaaggttcctgaaattgaggtcaccgtggaaggccctaataacaacaatcctcaaacctcagctgttcgaaccccgacccagactaacggttctaacgttcccttcaagccacgagggagagagttttcctttgaggcctggaatgccaaaatcacggacctaaaacagaaagttgaaaatctcttcaatgagaaatgtggggaagctcttggccttaaacaagctgtgaaggtgccgttcgcgttatttgagtctttcccggaagacttttatgtggaaggcttacctgagggtgtgccattccgaagaccatcgacttttggcattccgaggctggagaagatactcagaaacaaagccaaaattaagttcatcattaaaaagcccgaaatgtttgagacggcgattaaggagagcacctcctctaagagccctcccagaaaaataaattcatcacccaatgttaatactactgcatcaggtgttgaagaccttaacatcattcaggtgacaattccagatgatgataatgaaagactctcgaaagttgaaaaagctagacagctaagagaacaagtgaatgacctctttagtcggaaatttggtgaagctattggtatgggttttcctgtgaaagttccctacaggaaaatcacaattaaccctggctgtgtggtggttgatggcatgcccccgggggtgtccttcaaagcccccagctacctggaaatcagctccatgagaaggatcttagactctgccgagtttatcaaattcacggtcattagaccatttccaggacttgtgattaataaccagctggttgatcagagtgagtcagaaggccccgtgatacaagaatcagctgaaccaagccagttggaagttccagccacagaagaaataaaagagactgatggaagctctcagatcaagcaagaaccagaccccacgtggtagacctcttccctcctaggcttaaagtatcagtggttgagaagagcttttcggacctgttactaccccaagctgtgtaatatacttgtataacagaaataccttctatacaaacctttttttctacttttagatagaaatgtctactttttcagcagttctgtgaattaaagagcagagtgactgtgggtctggaatggctggtgtacttgggaatgtactatcaggattttacagcaatgctgggaaatgacagggaaaatgacaggaatgaatctcaccagattttttatgtactcagcagagccttgagttacggtgtttattttccaatcaagtgaagatatctcctacttctcctactggaacatctcagcttctgcagtgaagaaaaattcctgtgatagttcagttctttagtttttctatttgaaaaaaaaaaatcatttaaatgatcctttgttcacggctctccttaatgactgagtgaacagttcctatctgtatatttgactaaaccttttcctaagctatctctcatggttcctatgtttttttatcataattaaaagcaaaaccatctggatcacctaacagtcagaggtcagtatctcagcgtgtgaattatagaggaaatacagagagaacctcttccacttttacttttcgtccaaataaaatgcatggtgtaccagaagttgaagatcgggttgaggattggggctagctcgatgacactaaggccccaacatcgcgggacctgctgtggcgcggattcttaggaacgctgttctagccggccccctctccaggggtcgccgtggccggcattatttcctagttcttcttgtaaccctgaggtgccagcgcggggagtgaggaggggtcagggggctaaggatgcaacctctgacgttctgcgccttcctaggagagtcttacatgtgttgagatttcacaagcaatgcgagttgtaaaataccagctctacaagaagctaggctctgtgacggcatagttttcagtagctttatcacaatattcacaatggagaattatatgacatggtagcagaaataggcccttttatgtgttgcttctattttacctcaaattgtagatatagggtaatcaataaaatccatccatgcctttcacacactaa

SEQ ID NO: 12068 - DNA, 4412 bp, Homo sapiens
cgcccccccgcttccccgcacgcgctctccagccgcggccgcccgcctgccgcggtcaccccggcctctgcctctgtcccccagtgatcggatcaaggcgctgagcgaggccctgcctgcggggcggccatgcggcggtgacaggagcgcgaccgacacgcacgggcccctcgccccctctcgcctcccgtccgctcgccagctcccctcagccgaggctgctccgcggcggccgcagcccgcgcgcggcccacactcgcctcccctcggcacccccggccccggagctgcctggaggcggccgcactcggggatcatggcccaagttgcaatgtccaccctccccgttgaagatgaggagtcctcggagagcaggatggtggtgacattcctcatgtcagctctcgagtccatgtgtaaagaactggccaagtccaaagccgaagtggcctgcattgcagtgtatgaaacagacgtgtttgtcgtcggaactgaaagaggacgtgcttttgtcaataccagaaaggattttcaaaaagattttgtaaaatattgtgttgaagaagaagaaaaagctgcagagatgcataaaatgaaatctacaacccaggcaaatcggatgagtgtagatgctgtagaaattgaaacactcagaaaaacagttgaggactatttctgcttttgctatgggaaagctttaggcaaatccacagtggtacctgtaccatatgagaagatgctgcgagaccagtcggctgtggtagtgcaggggcttccggaaggtgttgcctttaaacaccccgagaactatgatcttgcaaccctgaaatggattttggagaacaaagcagggatttcattcatcattaagagaccttttttagagccaaagaagcatgtaggtggtcgtgtgatggtaacagatgctgacaggtcaatactatctccaggtggaagttgtggccccatcaaagtgaaaactgaacccacagaagattctggcatttccctggaaatggcagctgtgacagtaaaggaagaatcagaagatcctgattattatcaatataacattcaagcaggcccttctgaaactgatgatgttgatgaaaaacagcccctatcgaagcctttgcaaggaagccaccattcttcagagggcaatgaaggcacagaaatggaagtaccagcagaagatgatgattattctccaccgtctaagagaccaaaggccaatgagctaccgcagccaccagtcccggaacccgccaatgctgggaagcggaaagtgagggagttcaacttcgagaaatggaatgctcgcatcactgatctacgtaaacaagttgaagaattgtttgaaaggaaatatgctcaagccataaaagccaaaggtccggtgacgatcccgtaccctcttttccagtctcatgttgaagatctttatgtagaaggacttcctgaaggaattccttttagaaggccatctacttacggaattcctcgcctggagaggatattacttgcaaaggaaaggattcgttttgtgattaagaaacatgagcttctgaattcaacacgtgaagatttacagcttgataagccagcttcaggagtaaaggaagaatggtatgccagaatcactaaattaagaaagatggtggatcagcttttctgcaaaaaatttgcggaagccttggggagcactgaagccaaggctgtaccgtaccaaaaatttgaggcacacccgaatgatctgtacgtggaaggactgccagaaaacattcctttccgaagtccctcatggtatggaatcccaaggctggaaaaaatcattcaagtgggcaatcgaattaaatttgttattaaaagaccagaacttctgactcacagtaccactgaagttactcagccaagaacgaatacaccagtcaaagaagattggaatgtcagaattaccaagctacggaagcaagtggaagagatttttaatttgaaatttgctcaagctcttggactcaccgaggcagtaaaagtaccatatcctgtgtttgaatcaaacccggagttcttgtatgtggaaggcttgccagaggggattcccttccgaagccctacctggtttggaattccacgacttgaaaggatcgtccgcgggagtaataaaatcaagttcgttgttaaaaaacctgaactagttatttcctacttgcctcctgggatggctagtaaaataaacactaaagctttgcagtcccccaaaagaccacgaagtcctgggagtaattcaaaggttcctgaaattgaggtcaccgtggaaggccctaataacaacaatcctcaaacctcagctgttcgaaccccgacccagactaacggttctaacgttcccttcaagccacgagggagagagttttcctttgaggcctggaatgccaaaatcacggacctaaaacagaaagttgaaaatctcttcaatgagaaatgtggggaagctcttggccttaaacaagctgtgaaggtgccgttcgcgttatttgagtctttcccggaagacttttatgtggaaggcttacctgagggtgtgccattccgaagaccatcgacttttggcattccgaggctggagaagatactcagaaacaaagccaaaattaagttcatcattaaaaagcccgaaatgtttgagacggcgattaaggagagcacctcctctaagagccctcccagaaaaataaattcatcacccaatgttaatactactgcatcaggtgttgaagaccttaacatcattcaggtgacaattccagatgatgataatgaaagactctcgaaagttgaaaaagctagacagctaagagaacaagtgaatgacctctttagtcggaaatttggtgaagctattggtatgggttttcctgtgaaagttccctacaggaaaatcacaattaaccctggctgtgtggtggttgatggcatgcccccgggggtgtccttcaaagcccccagctacctggaaatcagctccatgagaaggatcttagactctgccgagtttatcaaattcacggtcattagaccatttccaggacttgtgattaataaccagctggttgatcagagtgagtcagaaggccccgtgatacaagaatcagctgaaccaagccagttggaagttccagccacagaagaaataaaagagactgatggaagctctcagatcaagcaagaaccagaccccacgtggtagacctcttccctcctaggcttaaagtatcagtggttgagaagagcttttcggacctgttactaccccaagctgtgtaatatacttgtataacagaaataccttctatacaaacctttttttctacttttagatagaaatgtctactttttcagcagttctgtgaattaaagagcagagtgactgtgggtctggaatggctggtgtacttgggaatgtactatcaggattttacagcaatgctgggaaatgacagggaaaatgacaggaatgaatctcaccagattttttatgtactcagcagagccttgagttacggtgtttattttccaatcaagtgaagatatctcctacttctcctactggaacatctcagcttctgcagtgaagaaaaattcctgtgatagttcagttctttagtttttctatttgaaaaaaaaaaatcatttaaatgatcctttgttcacggctctccttaatgactgagtgaacagttcctatctgtatatttgactaaaccttttcctaagctatctctcatggttcctatgtttttttatcataattaaaagcaaaaccatctggatcacctaacagtcagaggtcagtatctcagcgtgtgaattatagaggaaatacagagagaacctcttccacttttacttttcgtccaaataaaatgcatggtgtaccagaagttgaagatcgggttgaggattggggctagctcgatgacactaaggccccaacatcgcgggacctgctgtggcgcggattcttaggaacgctgttctagccggccccctctccaggggtcgccgtggccggcattatttcctagttcttcttgtaaccctgaggtgccagcgcggggagtgaggaggggtcagggggctaaggatgcaacctctgacgttctgcgccttcctaggagagtcttacatgtgttgagatttcacaagcaatgcgagttgtaaaataccagctctacaagaagctaggctctgtgacggcatagttttcagtagctttatcacaatattcacaatggagaattatatgacatggtagcagaaataggcccttttatgtgttgcttctattttacctcaaattgtagatatagggtaatcaataaaatccatccatgcctttcacacactaa

SEQ ID NO: 12069 - DNA, 4415 bp, Homo sapiens
cgcccccccgcttccccgcacgcgctctccagccgcggccgcccgcctgccgcggtcaccccggcctctgcctctgtcccccagtgatcggatcaaggcgctgagcgaggccctgcctgcggggcggccatgcggcggtgacaggagcgcgaccgacacgcacgggcccctcgccccctctcgcctcccgtccgctcgccagctcccctcagccgaggctgctccgcggcggccgcagcccgcgcgcggcccacactcgcctcccctcggcacccccggccccggagctgcctggaggcggccgcactcggggatcatggcccaagttgcaatgtccaccctccccgttgaagatgaggagtcctcggagagcaggatggtggtgacattcctcatgtcagctctcgagtccatgtgtaaagaactggccaagtccaaagccgaagtggcctgcattgcagtgtatgaaacagacgtgtttgtcgtcggaactgaaagaggacgtgcttttgtcaataccagaaaggattttcaaaaagattttgtaaaatattgtgttgaagaagaagaaaaagctgcagagatgcataaaatgaaatctacaacccaggcaaatcggatgagtgtagatgctgtagaaattgaaacactcagaaaaacagttgaggactatttctgcttttgctatgggaaagctttaggcaaatccacagtggtacctgtaccatatgagaagatgctgcgagaccagtcggctgtggtagtgcaggggcttccggaaggtgttgcctttaaacaccccgagaactatgatcttgcaaccctgaaatggattttggagaacaaagcagggatttcattcatcattaagagaccttttttagagccaaagaagcatgtaggtggtcgtgtgatggtaacagatgctgacaggtcaatactatctccaggtggaagttgtggccccatcaaagtgaaaactgaacccacagaagattctggcatttccctggaaatggcagctgtgacagtaaaggaagaatcagaagatcctgattattatcaatataacattcaaggaagccaccattcttcagagggcaatgaaggcacagaaatggaagtaccagcagaagattctactcaacatgtcccttcagaaacaagtgaggaccctgaagttgaggtgactattgaagatgatgattattctccaccgtctaagagaccaaaggccaatgagctaccgcagccaccagtcccggaacccgccaatgctgggaagcggaaagtgagggagttcaacttcgagaaatggaatgctcgcatcactgatctacgtaaacaagttgaagaattgtttgaaaggaaatatgctcaagccataaaagccaaaggtccggtgacgatcccgtaccctcttttccagtctcatgttgaagatctttatgtagaaggacttcctgaaggaattccttttagaaggccatctacttacggaattcctcgcctggagaggatattacttgcaaaggaaaggattcgttttgtgattaagaaacatgagcttctgaattcaacacgtgaagatttacagcttgataagccagcttcaggagtaaaggaagaatggtatgccagaatcactaaattaagaaagatggtggatcagcttttctgcaaaaaatttgcggaagccttggggagcactgaagccaaggctgtaccgtaccaaaaatttgaggcacacccgaatgatctgtacgtggaaggactgccagaaaacattcctttccgaagtccctcatggtatggaatcccaaggctggaaaaaatcattcaagtgggcaatcgaattaaatttgttattaaaagaccagaacttctgactcacagtaccactgaagttactcagccaagaacgaatacaccagtcaaagaagattggaatgtcagaattaccaagctacggaagcaagtggaagagatttttaatttgaaatttgctcaagctcttggactcaccgaggcagtaaaagtaccatatcctgtgtttgaatcaaacccggagttcttgtatgtggaaggcttgccagaggggattcccttccgaagccctacctggtttggaattccacgacttgaaaggatcgtccgcgggagtaataaaatcaagttcgttgttaaaaaacctgaactagttatttcctacttgcctcctgggatggctagtaaaataaacactaaagctttgcagtcccccaaaagaccacgaagtcctgggagtaattcaaaggttcctgaaattgaggtcaccgtggaaggccctaataacaacaatcctcaaacctcagctgttcgaaccccgacccagactaacggttctaacgttcccttcaagccacgagggagagagttttcctttgaggcctggaatgccaaaatcacggacctaaaacagaaagttgaaaatctcttcaatgagaaatgtggggaagctcttggccttaaacaagctgtgaaggtgccgttcgcgttatttgagtctttcccggaagacttttatgtggaaggcttacctgagggtgtgccattccgaagaccatcgacttttggcattccgaggctggagaagatactcagaaacaaagccaaaattaagttcatcattaaaaagcccgaaatgtttgagacggcgattaaggagagcacctcctctaagagccctcccagaaaaataaattcatcacccaatgttaatactactgcatcaggtgttgaagaccttaacatcattcaggtgacaattccagatgatgataatgaaagactctcgaaagttgaaaaagctagacagctaagagaacaagtgaatgacctctttagtcggaaatttggtgaagctattggtatgggttttcctgtgaaagttccctacaggaaaatcacaattaaccctggctgtgtggtggttgatggcatgcccccgggggtgtccttcaaagcccccagctacctggaaatcagctccatgagaaggatcttagactctgccgagtttatcaaattcacggtcattagaccatttccaggacttgtgattaataaccagctggttgatcagagtgagtcagaaggccccgtgatacaagaatcagctgaaccaagccagttggaagttccagccacagaagaaataaaagagactgatggaagctctcagatcaagcaagaaccagaccccacgtggtagacctcttccctcctaggcttaaagtatcagtggttgagaagagcttttcggacctgttactaccccaagctgtgtaatatacttgtataacagaaataccttctatacaaacctttttttctacttttagatagaaatgtctactttttcagcagttctgtgaattaaagagcagagtgactgtgggtctggaatggctggtgtacttgggaatgtactatcaggattttacagcaatgctgggaaatgacagggaaaatgacaggaatgaatctcaccagattttttatgtactcagcagagccttgagttacggtgtttattttccaatcaagtgaagatatctcctacttctcctactggaacatctcagcttctgcagtgaagaaaaattcctgtgatagttcagttctttagtttttctatttgaaaaaaaaaaatcatttaaatgatcctttgttcacggctctccttaatgactgagtgaacagttcctatctgtatatttgactaaaccttttcctaagctatctctcatggttcctatgtttttttatcataattaaaagcaaaaccatctggatcacctaacagtcagaggtcagtatctcagcgtgtgaattatagaggaaatacagagagaacctcttccacttttacttttcgtccaaataaaatgcatggtgtaccagaagttgaagatcgggttgaggattggggctagctcgatgacactaaggccccaacatcgcgggacctgctgtggcgcggattcttaggaacgctgttctagccggccccctctccaggggtcgccgtggccggcattatttcctagttcttcttgtaaccctgaggtgccagcgcggggagtgaggaggggtcagggggctaaggatgcaacctctgacgttctgcgccttcctaggagagtcttacatgtgttgagatttcacaagcaatgcgagttgtaaaataccagctctacaagaagctaggctctgtgacggcatagttttcagtagctttatcacaatattcacaatggagaattatatgacatggtagcagaaataggcccttttatgtgttgcttctattttacctcaaattgtagatatagggtaatcaataaaatccatccatgcctttcacacactaa

SEQ ID NO: 12070 - DNA, 4356 bp, Homo sapiens
cgcccccccgcttccccgcacgcgctctccagccgcggccgcccgcctgccgcggtcaccccggcctctgcctctgtcccccagtgatcggatcaaggcgctgagcgaggccctgcctgcggggcggccatgcggcggtgacaggagcgcgaccgacacgcacgggcccctcgccccctctcgcctcccgtccgctcgccagctcccctcagccgaggctgctccgcggcggccgcagcccgcgcgcggcccacactcgcctcccctcggcacccccggccccggagctgcctggaggcggccgcactcggggatcatggcccaagttgcaatgtccaccctccccgttgaagatgaggagtcctcggagagcaggatggtggtgacattcctcatgtcagctctcgagtccatgtgtaaagaactggccaagtccaaagccgaagtggcctgcattgcagtgtatgaaacagacgtgtttgtcgtcggaactgaaagaggacgtgcttttgtcaataccagaaaggattttcaaaaagattttgtaaaatattgtgttgaagaagaagaaaaagctgcagagatgcataaaatgaaatctacaacccaggcaaatcggatgagtgtagatgctgtagaaattgaaacactcagaaaaacagttgaggactatttctgcttttgctatgggaaagctttaggcaaatccacagtggtacctgtaccatatgagaagatgctgcgagaccagtcggctgtggtagtgcaggggcttccggaaggtgttgcctttaaacaccccgagaactatgatcttgcaaccctgaaatggattttggagaacaaagcagggatttcattcatcattaagagaccttttttagagccaaagaagcatgtaggtggtcgtgtgatggtaacagatgctgacaggtcaatactatctccaggtggaagttgtggccccatcaaagtgaaaactgaacccacagaagattctggcatttccctggaaatggcagctgtgacagtaaaggaagaatcagaagatcctgattattatcaatataacattcaaggaagccaccattcttcagagggcaatgaaggcacagaaatggaagtaccagcagaagatgatgattattctccaccgtctaagagaccaaaggccaatgagctaccgcagccaccagtcccggaacccgccaatgctgggaagcggaaagtgagggagttcaacttcgagaaatggaatgctcgcatcactgatctacgtaaacaagttgaagaattgtttgaaaggaaatatgctcaagccataaaagccaaaggtccggtgacgatcccgtaccctcttttccagtctcatgttgaagatctttatgtagaaggacttcctgaaggaattccttttagaaggccatctacttacggaattcctcgcctggagaggatattacttgcaaaggaaaggattcgttttgtgattaagaaacatgagcttctgaattcaacacgtgaagatttacagcttgataagccagcttcaggagtaaaggaagaatggtatgccagaatcactaaattaagaaagatggtggatcagcttttctgcaaaaaatttgcggaagccttggggagcactgaagccaaggctgtaccgtaccaaaaatttgaggcacacccgaatgatctgtacgtggaaggactgccagaaaacattcctttccgaagtccctcatggtatggaatcccaaggctggaaaaaatcattcaagtgggcaatcgaattaaatttgttattaaaagaccagaacttctgactcacagtaccactgaagttactcagccaagaacgaatacaccagtcaaagaagattggaatgtcagaattaccaagctacggaagcaagtggaagagatttttaatttgaaatttgctcaagctcttggactcaccgaggcagtaaaagtaccatatcctgtgtttgaatcaaacccggagttcttgtatgtggaaggcttgccagaggggattcccttccgaagccctacctggtttggaattccacgacttgaaaggatcgtccgcgggagtaataaaatcaagttcgttgttaaaaaacctgaactagttatttcctacttgcctcctgggatggctagtaaaataaacactaaagctttgcagtcccccaaaagaccacgaagtcctgggagtaattcaaaggttcctgaaattgaggtcaccgtggaaggccctaataacaacaatcctcaaacctcagctgttcgaaccccgacccagactaacggttctaacgttcccttcaagccacgagggagagagttttcctttgaggcctggaatgccaaaatcacggacctaaaacagaaagttgaaaatctcttcaatgagaaatgtggggaagctcttggccttaaacaagctgtgaaggtgccgttcgcgttatttgagtctttcccggaagacttttatgtggaaggcttacctgagggtgtgccattccgaagaccatcgacttttggcattccgaggctggagaagatactcagaaacaaagccaaaattaagttcatcattaaaaagcccgaaatgtttgagacggcgattaaggagagcacctcctctaagagccctcccagaaaaataaattcatcacccaatgttaatactactgcatcaggtgttgaagaccttaacatcattcaggtgacaattccagatgatgataatgaaagactctcgaaagttgaaaaagctagacagctaagagaacaagtgaatgacctctttagtcggaaatttggtgaagctattggtatgggttttcctgtgaaagttccctacaggaaaatcacaattaaccctggctgtgtggtggttgatggcatgcccccgggggtgtccttcaaagcccccagctacctggaaatcagctccatgagaaggatcttagactctgccgagtttatcaaattcacggtcattagaccatttccaggacttgtgattaataaccagctggttgatcagagtgagtcagaaggccccgtgatacaagaatcagctgaaccaagccagttggaagttccagccacagaagaaataaaagagactgatggaagctctcagatcaagcaagaaccagaccccacgtggtagacctcttccctcctaggcttaaagtatcagtggttgagaagagcttttcggacctgttactaccccaagctgtgtaatatacttgtataacagaaataccttctatacaaacctttttttctacttttagatagaaatgtctactttttcagcagttctgtgaattaaagagcagagtgactgtgggtctggaatggctggtgtacttgggaatgtactatcaggattttacagcaatgctgggaaatgacagggaaaatgacaggaatgaatctcaccagattttttatgtactcagcagagccttgagttacggtgtttattttccaatcaagtgaagatatctcctacttctcctactggaacatctcagcttctgcagtgaagaaaaattcctgtgatagttcagttctttagtttttctatttgaaaaaaaaaaatcatttaaatgatcctttgttcacggctctccttaatgactgagtgaacagttcctatctgtatatttgactaaaccttttcctaagctatctctcatggttcctatgtttttttatcataattaaaagcaaaaccatctggatcacctaacagtcagaggtcagtatctcagcgtgtgaattatagaggaaatacagagagaacctcttccacttttacttttcgtccaaataaaatgcatggtgtaccagaagttgaagatcgggttgaggattggggctagctcgatgacactaaggccccaacatcgcgggacctgctgtggcgcggattcttaggaacgctgttctagccggccccctctccaggggtcgccgtggccggcattatttcctagttcttcttgtaaccctgaggtgccagcgcggggagtgaggaggggtcagggggctaaggatgcaacctctgacgttctgcgccttcctaggagagtcttacatgtgttgagatttcacaagcaatgcgagttgtaaaataccagctctacaagaagctaggctctgtgacggcatagttttcagtagctttatcacaatattcacaatggagaattatatgacatggtagcagaaataggcccttttatgtgttgcttctattttacctcaaattgtagatatagggtaatcaataaaatccatccatgcctttcacacactaagtca

SEQ ID NO: 12071 - DNA, 572 bp, Homo sapiens
atttccagagagcaggaagcacagagaaggcccgtgggtcgcccttggggtgctttccatcctgcagggctcgctgcctgccctgaaagttctgataaagacataggaccttcatcaccaggggcgccccgtgggctgttgctgtagcgtctgtcccccatttcttacacacattgagtgtgattgttaccagtggagggtgtccaatggaagaagcaccaaaagccgagatttattgaaagtggaagggatcatggcccaagttgcaatgtccaccctccccgttgaagatgaggagtcctcggagagcaggatggtggtgacattcctcatgtcagctctcgagtccatgtgtaaagaactggccaagtccaaagccgaagtggcctgcattgcagtgtatgaaacagacgtgtttgtcgtcggaactgaaagaggacgtgcttttgtcaataccagaaaggattttcaaaaagattttgtaaaatattgtgttgaagaagaagaaaaagctgcagagatgcataaaatgaaatctacaacccaggcaaatcggatgagtgtagatgctg

SEQ ID NO: 12072 - DNA, 979 bp, Homo sapiens
ccccggccccggagctgcctggaggcggccgcactcggggatcatggcccaagttgcaatgtccaccctccccgttgaagatgaggagtcctcggagagcaggatggtggtgacattcctcatgtcagctctcgagtccatgtgtaaagaactggccaagtccaaagccgaagtggcctgcattgcagtgtatgaaacagacgtgtttgtcgtcggaactgaaagaggacgtgcttttgtcaataccagaaaggattttcaaaaagattttgtaaaatattgtgttgaagaagaagaaaaagctgcagagatgcataaaatgaaatctacaacccaggcaaatcggatgagtgtagatgctgtagaaattgaaacactcagaaaaacagttgaggactatttctgcttttgctatgggaaagctttaggcaaatccacagtggtacctgtaccatatgagaagatgctgcgagaccagtcggctgtggtagtgcaggggcttccggaaggtgttgcctttaaacaccccgagaactatgatcttgcaaccctgaaatggattttggagaacaaagcagggatttcattcatcattaagagaccttttttagagccaaagaagcatgtaggtggtcgtgtgatggtaacagatgctgacaggtcaatactatctccaggtggaagttgtggccccatcaaagtgaaaactgaacccacagaagattctggcatttccctggaaatggcagctgtgacagtaaaggaagaatcagaagatcctgattattatcaatataacattcaaggaagccaccattcttcagagggcaatgaaggcacagaaatggaagtaccagcagaaggttaggagaaaaagagattgcatattttccactatttgttgtatgtttattctattttatagattctattatccttaaaacaccttatttggaaataaaaggtgattcccttggta

SEQ ID NO: 12073 - DNA, 3492 bp, Homo sapiens
agagaaaaggggccaccggtcgcccccccgcttccccgcacgcgctctccagccgcggccgcccgcctgccgcggtcaccccggcctctgcctctgtcccccagtgatcggatcaaggcgctgagcgaggccctgcctgcggggcggccatgcggcggtgacaggagcgcgaccgacacgcacgggcccctcgccccctctcgcctcccgtccgctcgccagctcccctcagcacccccggccccggcccaagttgcaatgtccaccctccccgttgaagatgaggagtcctcggagagcaggatggtggtgacattcctcatgtcagctctcgagtccatgtgtaaagaactggccaagtccaaagccgaagtggcctgcattgcagtgtatgaaacagacgtgtttgtcgtcggaactgaaagaggacgtgcttttgtcaataccagaaaggattttcaaaaagattttgtaaaatattgtgttgaagaagaagaaaaagctgcagagatgcataaaatgaaatctacaacccaggcaaatcggatgagtgtagatgctgtagaaattgaaacactcagaaaaacagttgaggactatttctgcttttgctatgggaaagctttaggcaaatccacagtggtacctgtaccatatgagaagatgctgcgagaccagtcggctgtggtagtgcaggggcttccggaaggtgttgcctttaaacaccccgagaactatgatcttgcaaccctgaaatggattttggagaacaaagcagggatttcattcatcattaagagaccttttttagagccaaagaagcatgtaggtggtcgtgtgatggtaacagatgctgacaggtcaatactatctccaggtggaagttgtggccccatcaaagtgaaaactgaacccacagaagattctggcatttccctggaaatggcagctgtgacagtaaaggaagaatcagaagatcctgattattatcaatataacattcaagcaggcccttctgaaactgatgatgttgatgaaaaacagcccctatcgaagcctttgcaaggaagccaccattcttcagagggcaatgaaggcacagaaatggaagtaccagcagaagattctactcaacatgtcccttcagaaacaagtgaggaccctgaagttgaggtgactattgaagatgatgattattctccaccgtctaagagaccaaaggccaatgagctaccgcagccaccagtcccggaacccgccaatgctgggaagcggaaagtgagggagttcaacttcgagaaatggaatgctcgcatcactgatctacgtaaacaagttgaagaattgtttgaaaggaaatatgctcaagccataaaagccaaaggtccggtgacgatcccgtaccctcttttccagtctcatgttgaagatctttatgtagaaggacttcctgaaggaattccttttagaaggccatctacttacggaattcctcgcctggagaggatattacttgcaaaggaaaggattcgttttgtgattaagaaacatgagcttctgaattcaacacgtgaagatttacagcttgataagccagcttcaggagtaaaggaagaatggtatgccagaatcactaaattaagaaagatggtggatcagcttttctgcaaaaaatttgcggaagccttggggagcactgaagccaaggctgtaccgtaccaaaaatttgaggcacacccgaatgatctgtacgtggaaggactgccagaaaacattcctttccgaagtccctcatggtatggaatcccaaggctggaaaaaatcattcaagtgggcaatcgaattaaatttgttattaaaagaccagaacttctgactcacagtaccactgaagttactcagccaagaacgaatacaccagtcaaagaagattggaatgtcagaattaccaagctacggaagcaagtggaagagatttttaatttgaaatttgctcaagctcttggactcaccgaggcagtaaaagtaccatatcctgtgtttgaatcaaacccggagttcttgtatgtggaaggcttgccagaggggattcccttccgaagccctacctggtttggaattccacgacttgaaaggatcgtccgcgggagtaataaaatcaagttcgttgttaaaaaacctgaactagttatttcctacttgcctcctgggatggctagtaaaataaacactaaagctttgcagtcccccaaaagaccacgaagtcctgggagtaattcaaaggttcctgaaattgaggtcaccgtggaaggccctaataacaacaatcctcaaacctcagctgttcgaaccccgacccagactaacggttctaacgttcccttcaagccacgagggagagagttttcctttgaggcctggaatgccaaaatcacggacctaaaacagaaagttgaaaatctcttcaatgagaaatgtggggaagctcttggccttaaacaagctgtgaaggtgccgttcgcgttatttgagtctttcccggaagacttttatgtggaaggcttacctgagggtgtgccattccgaagaccatcgacttttggcattccgaggctggagaagatactcagaaacaaagccaaaattaagttcatcattaaaaagcccgaaatgtttgagacggcgattaaggagagcacctcctctaagagccctcccagaaaaataaattcatcacccaatgttaatactactgcatcaggtgttgaagaccttaacatcattcaggtgacaattccagatgatgataatgaaagactctcgaaagttgaaaaagctagacagctaagagaacaagtgaatgacctctttagtcggaaatttggtgaagctattggtatgggttttcctgtgaaagttccctacaggaaaatcacaattaaccctggctgtgtggtggttgatggcatgcccccgggggtgtccttcaaagcccccagctacctggaaatcagctccatgagaaggatcttagactctgccgagtttatcaaattcacggtcattagaccatttccaggacttgtgattaataaccagctggttgatcagagtgagtcagaaggccccgtgatacaagaatcagctgaaccaagccagttggaagttccagccacagaagaaataaaagagactgatggaagctctcagatcaagcaagaaccagaccccacgtggtagacctcttccctcctaggcttaaagtatcagtggttgagaagagcttttcggacctgttactaccccaagctgtgtaatatacttgtataacagaaataccttctatacaaacctttttttctacttttagatagaaatgtctactttttcagcagttctgtgaattaaagagcagagtgactgtgggtctggaatggctggtgtacttgggaatgtactatcaggattttacagcaatgctgggaaatgaca

SEQ ID NO: 12074 - DNA, 952 bp, Homo sapiens
tctccacgtgggtaccggcgctctcggcgcccgtagccacccgcccgccggaagccgacatctcgagttctggcagaagcaatttgcgcggcgaggagcggagcggcaggaacccaataagctgcttcgcctcggagctgaagcccgtactcaagatggcggctccgggcgggcgtggccagtgactagaaggcgaggcgccgcgggaccatggcggcggcggcggacgagcggagtccagaggacggagaagacgaggaagaggaggagcagttggttctggtggaattatcaggaattattgattcagacttcctctcaaaatgtgaaaataaatgcaaggttttgggcattgacactgagaggcccattctgcaagtggacagctgtgtctttgctggggagtatgaagacactctagggacctgtgttatatttgaagaaaatgttgaacatgctgatacagaaggcaataataaaacagtgctaaaatataaatgccatacaatgaagaagctcagcatgacaagaactctcctgacagagaagaaggaaggagaagaaaacataggtggggtggaatggctgcaaataaaggataatgatttctcctatcgacccaacatgatttgtaactttctacatgaaaatgaagacgaagaagtggtagcttcagccccagataaatctttggaattggaagaggaagagattcaaatgaacgacagttcaaacctgagttgtgaacaggagaaaccaatgcacttggaaatagaagattctggtcctcttattgatataccttctgagacagaaggttctgtttttatggaaactcaaatgctgccttagaaatcactcctagatgaaatgtttctcataataacttgtcaagaactttttagagttgttacataaaaataattgctgtgtagctttcagtcttttaata

SEQ ID NO: 12075 - DNA, 2393 bp, Homo sapiens
actgcgctgggaaacatggcgaccgagggaatgatccttactaaccacgaccatcaaatccgtgtcggagtccttacagtgagtgatagttgcttcaggaatcttgcagaagaccgcagtgggataaatctcaaagatctcgtacaagatccttctttgttgggtgggactatatcagcatacaagatagtaccagatgaaatagaagaaatcaaggccacaaaagaagtaatagaacgggaagcaccagggatggccctggcaatgctgatgggatcacttaatgttacacctctgggcatgctctctaggcctgtatgtggaatcagagggaaaacgctcataattaacctgccaggtagcaagaaaggatctcaggaatgctttcaattcatactgccagctctacctcatgccattgaccttttacgtgatgccattgtaaaagtaaaggaggtgcatgatgaacttgaagatttgccttccccacctccccctctttcccctcctcctactaccagcccccataaacagacagaagacaaaggagttcaatgtgaggaagaggaagaagagaagaaagacagtggtgttgcttcaacagaagatagttcctcatcacatataactgcagcagccattgctgccaagattccagactccatcatttctcgtggtgttcaggtgctcccacgagacacagcctccctcagcactactccttcagaatcgcctcgtgctcaggctacatctcgcctctctacagcttcctgcccaacaccaaaagtccagtccaggtgcagcagcaaggagaacattctcagagccagtcacagtgctgtcgatatcaccaaggtggctagaagacatcgcatgtctccttttcctctgacatctatggacaaagcctttatcacagtcctggagatgactccggtgcttgggacagaaatcatcaattaccgagatggaatggggcgagtccttgctcaagatgtatatgcaaaagacaatttaccccccttcccagcatcagtaaaagatggctatgctgtccgagctgctgatggcccaggagatcgtttcatcattggggaatcccaagctggtgaacagccaactcagacagtaatgccaggacaagtcatgcgggttacaacaggtgctccaataccctgcggtgctgatgcagtagtacaagtggaagataccgaacttatcagggaatcagatgatggcactgaagaacttgaagtgcgaattctggtgcaagctcggccaggccaagatatcagacccatcggccatgacattaaaagaggggaatgtgttttggccaaaggaacccacatgggcccctcagagattggtcttctggcaactgtaggtgtcacagaggttgaagttaataagtttccagtggttgcagtcatgtcaacagggaatgagctgctaaatcctgaagatgacctcttaccagggaagattcgagacagcaatcgttcaactcttctagcaacaattcaggaacatggttaccccacgatcaacttgggtattgtaggagacaacccagatgacttactcaatgccttgaatgagggtatcagtcgtgctgatgtcatcatcacatcagggggtgtatccatgggggaaaaggactatctcaagcaggtgctggacattgatcttcatgctcagatccattttggcagggtttttatgaaaccaggcttgccaacaacatttgcaactttggatattgatggtgtaagaaaaataatctttgcactacctgggaatcctgtatcggctgtggtcacctgcaatctctttgttgtgcctgcactgaggaaaatgcagggcatcttggatcctcggccaaccatcatcaaagcaaggttatcatgtgatgtaaaacttgatcctcgtccagaataccatcggtgtatactaacttggcatcaccaagaaccactaccttgggcacagagtacaggtaatcaaatgagcagccgtctgatgagcatgcgcagtgccaatggattgttgatgctacctccaaagacagaacagtacgtggagctccacaaaggcgaggtggtggatgtcatggtcattggacggctatgatggtcaccagcaggagaaagctttgatgcatgtccacatatcattgactgtatcctgtaatatgcaacggcacagctagttttcccgatttggataaaagttgatctgtatagtcaacatcttgaactatatttcaaatgaatttaaatatcttttaaagaaaaaaacacctaaaaataaatcttaacagaaaattctgttctgattatatcaaggcaaatttttcctttcttgcaaattgctttgtgtgttcaatgcta

SEQ ID NO: 12076 - DNA, 4193 bp, Homo sapiens
agcagcgctcatggcgaagaggcttaaggccacaaaaccgtgggacagcaggaggaagagaagccaggtatctccactccagctgccctgcctcagactcctcagtttcgcacgtgaggatcgtcttgcaggcactgactggagatggaatcctaaagcataggtgaagcggaaatcctccttcagggagagcccactgaggaagccagcggctagcacgaggcaggacaggatacctccctcttcgcccacggcggcctctctgtcatagtagccaccgttctgccactcatgcagctttctaagacacctctcggttccccagcgctttcagtggggcggccggccattcccgagggttgcaagaggaggcccggggtgctgagccagcctcgctgcccccgcgtagaaagccggcccgccggcgagagccagcctaaggcgcggacaaccaacgaggtgtcaggctcggcaggggattgcttctgtctggggcccggccgaggttgcgttcgtgcctcgcgcgcacacgctccgcgttcactcagccaatccggtgctactcgcgcgcccaggagcgatccgcggtcctactcaggctgggccggctccttcccgctcccaatactcagcacccgagctctcactcctcccctcactctccacgagttccacgcctaggggtgtagctccgcccttgtccccgagtccgcccccgcaacctccagagcgtgtgctatcctttcctctcagtcctgccatctagctgccttgggtctcgcgctccgcagagcgttccgacactctccggcctcgttctgccgcctccgcgcgctctccccgtgcggccaccgcgccccccaagcttgcctccttcttgccggacttggggccgcgcgccctgactccttcccctcccgcggacccgcgcactcccggcgcggcctctcccccacgcaggccaccgtgcactctgtggcctccccctccttccccgctctcctcgcgcttctctggctccctagctgtcgcgctctcctcggcgagcgcgctcccggcccgcgcgctccgggctccggtttctcccggctcctgtcagtgcggtgactgcgctgggaaacatggcgaccgagggaatgatccttactaaccacgaccatcaaatccgtgtcggagtccttacagtgagtgatagttgcttcaggaatcttgcagaagaccgcagtgggataaatctcaaagatctcgtacaagatccttctttgttgggtgggactatatcagcatacaagatagtaccagatgaaatagaagaaatcaaggaaaccctgatagattggtgtgatgaaaaggaacttaatttgatattaacaactggaggaacaggatttgcaccacgagatgtcactccagaggccacaaaagaagtaatagaacgggaagcaccagggatggccctggcaatgctgatgggatcacttaatgttacacctctgggcatgctctctaggcctgtatgtggaatcagagggaaaacgctcataattaacctgccaggtagcaagaaaggatctcaggaatgctttcaattcatactgccagctctacctcatgccattgaccttttacgtgatgccattgtaaaagtaaaggaggtgcatgatgaacttgaagatttgccttccccacctccccctctttcccctcctcctactaccagcccccataaacagacagaagacaaaggagttcaatgtgaggaagaggaagaagagaagaaagacagtggtgttgcttcaacagaagatagttcctcatcacatataactgcagcagccattgctgccaagattccagactccatcatttctcgtggtgttcaggtgctcccacgagacacagcctccctcagcactactccttcagaatcgcctcgtgctcaggctacatctcgcctctctacagcttcctgcccaacaccaaaagtccagtccaggtgcagcagcaaggagaacattctcagagccagtcacagtgctgtcgatatcaccaaggtggctagaagacatcgcatgtctccttttcctctgacatctatggacaaagcctttatcacagtcctggagatgactccggtgcttgggacagaaatcatcaattaccgagatggaatggggcgagtccttgctcaagatgtatatgcaaaagacaatttaccccccttcccagcatcagtaaaagatggctatgctgtccgagctgctgatggcccaggagatcgtttcatcattggggaatcccaagctggtgaacagccaactcagacagtaatgccaggacaagtcatgcgggttacaacaggtgctccaataccctgcggtgctgatgcagtagtacaagtggaagataccgaacttatcagggaatcagatgatggcactgaagaacttgaagtgcgaattctggtgcaagctcggccaggccaagatatcagacccatcggccatgacattaaaagaggggaatgtgttttggccaaaggaacccacatgggcccctcagagattggtcttctggcaactgtaggtgtcacagaggttgaagttaataagtttccagtggttgcagtcatgtcaacagggaatgagctgctaaatcctgaagatgacctcttaccagggaagattcgagacagcaatcgttcaactcttctagcaacaattcaggaacatggttaccccacgatcaacttgggtattgtaggagacaacccagatgacttactcaatgccttgaatgagggtatcagtcgtgctgatgtcatcatcacatcagggggtgtatccatgggggaaaaggactatctcaagcaggtgctggacattgatcttcatgctcagatccattttggcagggtttttatgaaaccaggcttgccaacaacatttgcaactttggatattgatggtgtaagaaaaataatctttgcactacctgggaatcctgtatcggctgtggtcacctgcaatctctttgttgtgcctgcactgaggaaaatgcagggcatcttggatcctcggccaaccatcatcaaagcaaggttatcatgtgatgtaaaacttgatcctcgtccagaataccatcggtgtatactaacttggcatcaccaagaaccactaccttgggcacagagtacaggtaatcaaatgagcagccgtctgatgagcatgcgcagtgccaatggattgttgatgctacctccaaagacagaacagtacgtggagctccacaaaggcgaggtggtggatgtcatggtcattggacggctatgatggtcaccagcaggagaaagctttgatgcatgtccacatatcattgactgtatcctgtaatatgcaacggcacagctagttttcccgatttggataaaagttgatctgtatagtcaacatcttgaactatatttcaaatgaatttaaatatcttttaaagaaaaaaacacctaaaaataaatcttaacagaaaattctgttctgattatatcaaggcaaatttttcctttcttgcaaattgctttgtgtgttcaatgctaggtctgatagcgatagcttttagtagacagcggtaggtgcctgcagaacttgtgtttttctcatctttaaaatacaactacttatgctcttaaatcaaggctgtctgcttatttatactagcgtaggcaacacttggatttcccttcttagtatgcttcataactgctttacagagagcttttgcttgttctttctcatgtatctcgtgtttatgtgcacagtgccaaaagaagactgactgggtggaggctctgccttgcctcaagaaccatcccctgcagagcatccagggaggtttctcgccccaatagcctcacggcacagtactcttgggcagtaactggacaccttttatttgaagaaacaaactgaagaaaaaatgcttccttaagtgctgacagcctttttaaccaatacatttaaaattgtacagaacaaaaaaataaaatcaaagactgatcttgtacagatattagtgttaccagcattcatgtggaaatcaagagcaaagacaaaataatgttaaacaattctgtaccataacattttctgtaatgatactgaaacttaatgaataaaaaaattccttgatcattattt

SEQ ID NO: 12077 - DNA, 4297 bp, Homo sapiens
agcagcgctcatggcgaagaggcttaaggccacaaaaccgtgggacagcaggaggaagagaagccaggtatctccactccagctgccctgcctcagactcctcagtttcgcacgtgaggatcgtcttgcaggcactgactggagatggaatcctaaagcataggtgaagcggaaatcctccttcagggagagcccactgaggaagccagcggctagcacgaggcaggacaggatacctccctcttcgcccacggcggcctctctgtcatagtagccaccgttctgccactcatgcagctttctaagacacctctcggttccccagcgctttcagtggggcggccggccattcccgagggttgcaagaggaggcccggggtgctgagccagcctcgctgcccccgcgtagaaagccggcccgccggcgagagccagcctaaggcgcggacaaccaacgaggtgtcaggctcggcaggggattgcttctgtctggggcccggccgaggttgcgttcgtgcctcgcgcgcacacgctccgcgttcactcagccaatccggtgctactcgcgcgcccaggagcgatccgcggtcctactcaggctgggccggctccttcccgctcccaatactcagcacccgagctctcactcctcccctcactctccacgagttccacgcctaggggtgtagctccgcccttgtccccgagtccgcccccgcaacctccagagcgtgtgctatcctttcctctcagtcctgccatctagctgccttgggtctcgcgctccgcagagcgttccgacactctccggcctcgttctgccgcctccgcgcgctctccccgtgcggccaccgcgccccccaagcttgcctccttcttgccggacttggggccgcgcgccctgactccttcccctcccgcggacccgcgcactcccggcgcggcctctcccccacgcaggccaccgtgcactctgtggcctccccctccttccccgctctcctcgcgcttctctggctccctagctgtcgcgctctcctcggcgagcgcgctcccggcccgcgcgctccgggctccggtttctcccggctcctgtcagtgcggtgactgcgctgggaaacatggcgaccgagggaatgatccttactaaccacgaccatcaaatccgtgtcggagtccttacagtgagtgatagttgcttcaggaatcttgcagaagaccgcagtgggataaatctcaaagatctcgtacaagatccttctttgttgggtgggactatatcagcatacaagatagtaccagatgaaatagaagaaatcaaggaaaccctgatagattggtgtgatgaaaaggaacttaatttgatattaacaactggaggaacaggatttgcaccacgagatgtcactccagaggccacaaaagaagtaatagaacgggaagcaccagggatggccctggcaatgctgatgggatcacttaatgttacacctctgggcatgctctctaggcctgtatgtggaatcagagggaaaacgctcataattaacctgccaggtagcaagaaaggatctcaggaatgctttcaattcatactgccagctctacctcatgccattgaccttttacgtgatgccattgtaaaagtaaaggaggtgcatgatgaacttgaagatttgccttccccacctccccctctttcccctcctcctactaccagcccccataaacagacagaagacaaaggagttcaatgtgaggaagaggaagaagagaagaaagacagtggtgttgcttcaacagaagatagttcctcatcacatataactgcagcagccattgctgccaagaagcatccattctacaccagtcctgctgttgtcatggcacacggtgaacagcccatccctggtctcatcaattattcccatcattcaacagatgaacggattccagactccatcatttctcgtggtgttcaggtgctcccacgagacacagcctccctcagcactactccttcagaatcgcctcgtgctcaggctacatctcgcctctctacagcttcctgcccaacaccaaaagtccagtccaggtgcagcagcaaggagaacattctcagagccagtcacagtgctgtcgatatcaccaaggtggctagaagacatcgcatgtctccttttcctctgacatctatggacaaagcctttatcacagtcctggagatgactccggtgcttgggacagaaatcatcaattaccgagatggaatggggcgagtccttgctcaagatgtatatgcaaaagacaatttaccccccttcccagcatcagtaaaagatggctatgctgtccgagctgctgatggcccaggagatcgtttcatcattggggaatcccaagctggtgaacagccaactcagacagtaatgccaggacaagtcatgcgggttacaacaggtgctccaataccctgcggtgctgatgcagtagtacaagtggaagataccgaacttatcagggaatcagatgatggcactgaagaacttgaagtgcgaattctggtgcaagctcggccaggccaagatatcagacccatcggccatgacattaaaagaggggaatgtgttttggccaaaggaacccacatgggcccctcagagattggtcttctggcaactgtaggtgtcacagaggttgaagttaataagtttccagtggttgcagtcatgtcaacagggaatgagctgctaaatcctgaagatgacctcttaccagggaagattcgagacagcaatcgttcaactcttctagcaacaattcaggaacatggttaccccacgatcaacttgggtattgtaggagacaacccagatgacttactcaatgccttgaatgagggtatcagtcgtgctgatgtcatcatcacatcagggggtgtatccatgggggaaaaggactatctcaagcaggtgctggacattgatcttcatgctcagatccattttggcagggtttttatgaaaccaggcttgccaacaacatttgcaactttggatattgatggtgtaagaaaaataatctttgcactacctgggaatcctgtatcggctgtggtcacctgcaatctctttgttgtgcctgcactgaggaaaatgcagggcatcttggatcctcggccaaccatcatcaaagcaaggttatcatgtgatgtaaaacttgatcctcgtccagaataccatcggtgtatactaacttggcatcaccaagaaccactaccttgggcacagagtacaggtaatcaaatgagcagccgtctgatgagcatgcgcagtgccaatggattgttgatgctacctccaaagacagaacagtacgtggagctccacaaaggcgaggtggtggatgtcatggtcattggacggctatgatggtcaccagcaggagaaagctttgatgcatgtccacatatcattgactgtatcctgtaatatgcaacggcacagctagttttcccgatttggataaaagttgatctgtatagtcaacatcttgaactatatttcaaatgaatttaaatatcttttaaagaaaaaaacacctaaaaataaatcttaacagaaaattctgttctgattatatcaaggcaaatttttcctttcttgcaaattgctttgtgtgttcaatgctaggtctgatagcgatagcttttagtagacagcggtaggtgcctgcagaacttgtgtttttctcatctttaaaatacaactacttatgctcttaaatcaaggctgtctgcttatttatactagcgtaggcaacacttggatttcccttcttagtatgcttcataactgctttacagagagcttttgcttgttctttctcatgtatctcgtgtttatgtgcacagtgccaaaagaagactgactgggtggaggctctgccttgcctcaagaaccatcccctgcagagcatccagggaggtttctcgccccaatagcctcacggcacagtactcttgggcagtaactggacaccttttatttgaagaaacaaactgaagaaaaaatgcttccttaagtgctgacagcctttttaaccaatacatttaaaattgtacagaacaaaaaaataaaatcaaagactgatcttgtacagatattagtgttaccagcattcatgtggaaatcaagagcaaagacaaaataatgttaaacaattctgtaccataacattttctgtaatgatactgaaacttaatgaataaaaaaattccttgatcattatttaaaaa

SEQ ID NO: 12078 - DNA, 2895 bp, Homo sapiens
agtgtgaccgggatggcgcattttcttgcaccaactaatgcggtgtcgctggcggctgaggagggcggagagttctgtggtgaaatagtgggaaggattcatgtaggcatcgggaagagcctaagtccacattataaaataggaagttgatgcggggtacagttactcccggaccggcggcgtgaaagtcgtgatatcatcgttgaactattagctttgaagtttaaatccaatggagaagactcaagaaacagtccaaagaattcttctagaaccctataaatacttacttcagttaccaggtaaacaagtgagaaccaaactttcacaggcatttaatcattggctgaaagttccagaggacaagctacagattattattgaagtgacagaaatgttgcataatgccagtttactcatcgatgatattgaagacaactcaaaactccgacgtggctttccagtggcccacagcatctatggaatcccatctgtcatcaattctgccaattacgtgtatttccttggcttggagaaagtcttaacccttgatcacccagatgcagtgaagctttttacccgccagcttttggaactccatcagggacaaggcctagatatttactggagggataattacacttgtcccactgaagaagaatataaagctatggtgctgcagaaaacaggtggactgtttggattagcagtaggtctcatgcagttgttctctgattacaaagaagatttaaaaccgctacttaatacacttgggctctttttccaaattagggatgattatgctaatctacactccaaagaatatagtgaaaacaaaagtttttgtgaagatctgacagagggaaagttctcatttcctactattcatgctatttggtcaaggcctgaaagcacccaggtgcagaatatcttgcgccagagaacagaaaacatagatataaaaaaatactgtgtacattatcttgaggatgtaggttcttttgaatacactcgtaatacccttaaagagcttgaagctaaagcctataaacagattgatgcacgtggtgggaaccctgagctagtagccttagtaaaacacttaagtaagatgttcaaagaagaaaatgaataatgttaagccattcttgattggacctcatagcttattttagttaatcttttttttgtcttttagccttaccaccttttaaaaaatttgttattctccagaaacagtaaataggtgagtaggggtggtgcaagtgaattcgttttcatttagaagcccctctgtacagataatcaaaattcaaagttgaaagaatcaaaagcagccacagttatgtaggtctgatttgaatgtcataattgcagtgacaggacattgccaccaactctatcctactaccatcaatgttgtgtttattccgtcaataaaaaagacttgcttccaggaatttttatccatacactttctaactgtactatctgggcagttccaagccagtttctattagctagctggaccaaagaccacaaatctctttttttcctaaacgctgctgtaaggaatatctcacttttccccccggaaacaccctcactgaagtcttctatgaaaaggctgataatgggctgggcgcggtggctcacgcctgtaatcccagcactttgggaggccgaggcgggcagatcacgaggtcaggagatcgagaccatcctgacacggtgaaaccctgtctctactaaaaatacaaaaaattagctgggcgtggtggtgggcgcctgtagtcccagctactcgggaggctgaggcaggagaatggtgtgaacccaggaggcggagcttgcagtgagccgagatagtgcctctgcactccagcctgggtgacagagcgagactccgtctcaaaaaaaagggctgataatgataaacagtgagcactccggtcctttttcttaggttttccttttttccttcctctccaccccacaagttttgctttttaaccaaggtgtctctgcttgatgaaattcacatgctagtctaaatctttttttctcccttgtaacatttatgtgccccaaactggttagtatatgggtacagcattccctttccaattgggaagcggaaaaagagagtatgggatattttagaagggagcctttgaaccttattatatttccccatcattgatagtgacaatcttaaaagggttgttttcttaccttaagtacaaaagcatggaaaaatgcgcttttccttcccgcccacatcaccaccccgacttgaagacagtaggtgcttgaatggaaagtgagtaggcatctttaatcgccctgattaaaggaaagtgttagcctgagagggcctgactgaaaagtaaccaaaggcttaatatcaaacactaattagctttttagtgccttaaccctgacctggttaccagttttctgtagtttctacacccaagccactgaagtcatctgtggcccaagaggtaggacaaaaaaaaaaaaaaaaaaagctgatttcaatatttgatttgttgacatcccaaaatgaaagttttatgtttcccttagaaacatgttttgcttggttctatagtatgttacttaggatctatttaccatatatttgtatgagaaatcctcacccaagcattcaacctaaatctttgaaaagttgggtgctgtctttagtaacttttaaaatagtttaaatctcccattttaatagtgataaggaaacctgttaaaatcatggctattgatgttatagtatggaaagttgaactttatgaacccatacttttaaaaagcatttttaaaaatctaacactgactatagaaacaaattaaaatgtctacctttaagtataaaaa

SEQ ID NO: 12079 - DNA, 2740 bp, Homo sapiens
cgcgcaaatcctcgtccgcgagaactgcaaggcccgcaatgccctgcgcctgcgtggaccgattagctttgaagtttaaatccaatggagaagactcaagaaacagtccaaagaattcttctagaaccctataaatacttacttcagttaccaggtaaacaagtgagaaccaaactttcacaggcatttaatcattggctgaaagttccagaggacaagctacagattattattgaagtgacagaaatgttgcataatgccagtttactcatcgatgatattgaagacaactcaaaactccgacgtggctttccagtggcccacagcatctatggaatcccatctgtcatcaattctgccaattacgtgtatttccttggcttggagaaagtcttaacccttgatcacccagatgcagtgaagctttttacccgccagcttttggaactccatcagggacaaggcctagatatttactggagggataattacacttgtcccactgaagaagaatataaagctatggtgctgcagaaaacaggtggactgtttggattagcagtaggtctcatgcagttgttctctgattacaaagaagatttaaaaccgctacttaatacacttgggctctttttccaaattagggatgattatgctaatctacactccaaagaatatagtgaaaacaaaagtttttgtgaagatctgacagagggaaagttctcatttcctactattcatgctatttggtcaaggcctgaaagcacccaggtgcagaatatcttgcgccagagaacagaaaacatagatataaaaaaatactgtgtacattatcttgaggatgtaggttcttttgaatacactcgtaatacccttaaagagcttgaagctaaagcctataaacagattgatgcacgtggtgggaaccctgagctagtagccttagtaaaacacttaagtaagatgttcaaagaagaaaatgaataatgttaagccattcttgattggacctcatagcttattttagttaatcttttttttgtcttttagccttaccaccttttaaaaaatttgttattctccagaaacagtaaataggtgagtaggggtggtgcaagtgaattcgttttcatttagaagcccctctgtacagataatcaaaattcaaagttgaaagaatcaaaagcagccacagttatgtaggtctgatttgaatgtcataattgcagtgacaggacattgccaccaactctatcctactaccatcaatgttgtgtttattccgtcaataaaaaagacttgcttccaggaatttttatccatacactttctaactgtactatctgggcagttccaagccagtttctattagctagctggaccaaagaccacaaatctctttttttcctaaacgctgctgtaaggaatatctcacttttccccccggaaacaccctcactgaagtcttctatgaaaaggctgataatgggctgggcgcggtggctcacgcctgtaatcccagcactttgggaggccgaggcgggcagatcacgaggtcaggagatcgagaccatcctgacacggtgaaaccctgtctctactaaaaatacaaaaaattagctgggcgtggtggtgggcgcctgtagtcccagctactcgggaggctgaggcaggagaatggtgtgaacccaggaggcggagcttgcagtgagccgagatagtgcctctgcactccagcctgggtgacagagcgagactccgtctcaaaaaaaagggctgataatgataaacagtgagcactccggtcctttttcttaggttttccttttttccttcctctccaccccacaagttttgctttttaaccaaggtgtctctgcttgatgaaattcacatgctagtctaaatctttttttctcccttgtaacatttatgtgccccaaactggttagtatatgggtacagcattccctttccaattgggaagcggaaaaagagagtatgggatattttagaagggagcctttgaaccttattatatttccccatcattgatagtgacaatcttaaaagggttgttttcttaccttaagtacaaaagcatggaaaaatgcgcttttccttcccgcccacatcaccaccccgacttgaagacagtaggtgcttgaatggaaagtgagtaggcatctttaatcgccctgattaaaggaaagtgttagcctgagagggcctgactgaaaagtaaccaaaggcttaatatcaaacactaattagctttttagtgccttaaccctgacctggttaccagttttctgtagtttctacacccaagccactgaagtcatctgtggcccaagaggtaggacaaaaaaaaaaaaaaaaaaagctgatttcaatatttgatttgttgacatcccaaaatgaaagttttatgtttcccttagaaacatgttttgcttggttctatagtatgttacttaggatctatttaccatatatttgtatgagaaatcctcacccaagcattcaacctaaatctttgaaaagttgggtgctgtctttagtaacttttaaaatagtttaaatctcccattttaatagtgataaggaaacctgttaaaatcatggctattgatgttatagtatggaaagttgaactttatgaacccatacttttaaaaagcatttttaaaaatctaacactgactatagaaacaaattaaaatgtctacctttaagt

SEQ ID NO: 12080 - DNA, 850 bp, Homo sapiens
aaggctttctgggaaataaagtccatactctggggccaacgcgcaaatcctcgtccgcgagaactgcaaggcccgcaatgccctgcgcctgcgtggaccgattagctttgaagtttaaatccaatggagaagactcaagaaacagtccaaagaattcttctagaaccctataaatacttacttcagttaccaggtaaacaagtgagaaccaaactttcacaggcatttaatcattggctgaaagttccagaggacaagctacagattattattgaagtgacagaaatgttgcataatgccagtttactcatcgatgatattgaagacaactcaaaactccgacgtggctttccagtggcccacagcatctatggaatcccatctgtcatcaattctgccaattacgtgtatttccttggcttggagaaagtcttaacccttgatcacccagatgcagtgaagctttttacccgccagcttttggaactccatcagggacaaggcctagatatttactggagggataattacacttgtcccactgaagaagaatataaagctatggtgctgcagaaaacaggtggactgtttggattagcagtaggtctcatgcagttgttctctgattacaaagaagatttaaaaccgctacttaatacacttgggctctttttccaaattagggatgattatgctaatctacactccaaagaatatagtgaaaacaaaagtttttgtgaagatctgacagagggaaagttctcatttcctactattcatgctatttggtcaaggcctgaaagcacccaggtgcagaatatcttgcgccagagaacagaaaacatagata

SEQ ID NO: 12081 - DNA, 2703 bp, Homo sapiens
ccggactctgtgctagcactgtatacgtttgcagttctctgcccagccgctgtggaaaatcggcctcgaagtgattgaaattccctgtttatatcaggcggcttctttcagatccatcgtctttctcccggagtatgaatggaaggattcagtatgcgcttcacatttgtatgtctctggccattctcaaaccaggcccttccctttgaaaagtcttttgcatgggatgttcacttcttagacgcaaggttgtgtgccctggtttcatcgtctaacgcgttagaaggcgctttcatttcttcatgggtgttgagcgccgaccactggggtggcctctgccttcgtagacctgcgcctggtgagacggacagatgctgaacaaaacgatgtgaaattaccgcagtggcagtgccccagaggagagttccacggtgataggagaatgagggaatttggcttctttagggagggaaaggaagggtttctgagcaagtgaggatcgagctgagagctgaagggctagcaggagttaactaaggaaagagaaaaggaaaagacattccagacaaaaagactaacttgtcagaaagccctgtggcggaagggagcttttccaatatgaagaactgagcctggagagatgggatgagggggagtgtcgaaccttttaggctttgtaaaggagttttggttttctcctaatagcaatgggatatcttccaaggaatctcaatcaaaagggagagatggctccgattggaatgtcatccctggctgaagagtagaggaagcgaaaaaaagaagagttaaagaggcaaatgcagggaacccgacgaggaggctattgccgtagtagttcacatggtgaaaagaatggagcgtttgtattaatgattatggattcactctttgaacaaatttctggcagctttttagttttgaaagtgagaagtttcagactctcactgaggtattctgtagttttttcactctaaaaggaaactagtagagttcatgtaacacacactaatgcctctttacatttaactttagtatgtgatagctgaaatttccagctgtgataaattgggaaatcctttgatttaaaagaaaaacaaaggcgggtgagggtgagagtatatgccacggtgtgtagaatcctttagactcttaagaagacacaaggcggctgggcgtggtggctcacgcttgtaatcccagcactttgggaggccgaggcgggcggatcacgaggtcaggagatcgagaccatcctggctaacacggtgaaagcccgtctctactaaaaatacaaaaaaattagccgggcaaggtggcgggcgcctgtagtcccagctactcgggaggctgaggcaggagaatggcgtgaacccgggaggcggagtttgcagtgagacgagatcacgccactgcactccagcctgggcgacagagtgagacgctgtttcagaagaaagacacaaggcaactttgaagtttaaatccaatggagaagactcaagaaacagtccaaagaattcttctagaaccctataaatacttacttcagttaccaggtaaacaagtgagaaccaaactttcacaggcatttaatcattggctgaaagttccagaggacaagctacagattattattgaagtgacagaaatgttgcataatgccagtttactcatcgatgatattgaagacaactcaaaactccgacgtggctttccagtggcccacagcatctatggaatcccatctgtcatcaattctgccaattacgtgtatttccttggcttggagaaagtcttaacccttgatcacccagatgcagtgaagctttttacccgccagcttttggaactccatcagggacaaggcctagatatttactggagggataattacacttgtcccactgaagaagaatataaagctatggtgctgcagaaaacaggtggactgtttggattagcagtaggtctcatgcagttgttctctgattacaaagaagatttaaaaccgctacttaatacacttgggctctttttccaaattagggatgattatgctaatctacactccaaagaatatagtgaaaacaaaagtttttgtgaagatctgacagagggaaagttctcatttcctactattcatgctatttggtcaaggcctgaaagcacccaggtgcagaatatcttgcgccagagaacagaaaacatagatataaaaaaatactgtgtacattatcttgaggatgtaggttcttttgaatacactcgtaatacccttaaagagcttgaagctaaagcctataaacagattgatgcacgtggtgggaaccctgagctagtagccttagtaaaacacttaagtaagatgttcaaagaagaaaatgaataatgttaagccattcttgattggacctcatagcttattttagttaatcttttttttgtcttttagccttaccaccttttaaaaaatttgttattctccagaaacagtaaataggtgagtaggggtggtgcaagtgaattcgttttcatttagaagcccctctgtacagataatcaaaattcaaagttgaaagaatcaaaagcagccacagttatgtaggtctgatttgaatgtcataattgcagtgacaggacattgccaccaactctatcctactaccatcaatgttgtgttta

SEQ ID NO: 12082 - DNA, 1396 bp, Homo sapiens
aggccggccgggggccaccgaggggccaggagggcctgtgggccgcgggcaggaccggcccgccacagagcccctgcccacgtcccgttccgggctcagacccgacaagtgggagcgagatcaacatctggccccgccgcggggacaacattagctttgaagtttaaatccaatggagaagactcaagaaacagtccaaagaattcttctagaaccctataaatacttacttcagttaccaggtaaacaagtgagaaccaaactttcacaggcatttaatcattggctgaaagttccagaggacaagctacagattattattgaagtgacagaaatgttgcataatgccagtttactcatcgatgatattgaagacaactcaaaactccgacgtggctttccagtggcccacagcatctatggaatcccatctgtcatcaattctgccaattacgtgtatttccttggcttggagaaagtcttaacccttgatcacccagatgcagtgaagctttttacccgccagcttttggaactccatcagggacaaggcctagatatttactggagggataattacacttgtcccactgaagaagaatataaagctatggtgctgcagaaaacaggtggactgtttggattagcagtaggtctcatgcagttgttctctgattacaaagaagatttaaaaccgctacttaatacacttgggctctttttccaaattagggatgattatgctaatctacactccaaagaatatagtgaaaacaaaagtttttgtgaagatctgacagagggaaagttctcatttcctactattcatgctatttggtcaaggcctgaaagcacccaggtgcagaatatcttgcgccagagaacagaaaacatagatataaaaaaatactgtgtacattatcttgaggatgtaggttcttttgaatacactcgtaatacccttaaagagcttgaagctaaagcctataaacagattgatgcacgtggtgggaaccctgagctagtagccttagtaaaacacttaagtaagatgttcaaagaagaaaatgaataatgttaagccattcttgattggacctcatagcttattttagttaatcttttttttgtcttttagccttaccaccttttaaaaaatttgttattctccagaaacagtaaataggtgagtaggggtggtgcaagtgaattcgttttcatttagaagcccctctgtacagataatcaaaattcaaagttgaaagaatcaaaagcagccacagttatgtaggtctgatttgaatgtcataattgcagtgacaggacattgccaccaactctatcctactaccatcaatgttgtgtttattccgtcaataaaaaagacttgcttcca

SEQ ID NO: 12083 - DNA, 868 bp, Homo sapiens
tagcactgtatacgtttgcagttctctgcccagccgctgtggaaaatcggcctcgaagtgattgaaattccctgtttatatcaggcggcttctttcagatccatcgtctttctcccggagtatgaatggaaggattcagtatgcgcttcacatttattagctttgaagtttaaatccaatggagaagactcaagaaacagtccaaagaattcttctagaaccctataaatacttacttcagttaccaggtaaacaagtgagaaccaaactttcacaggcatttaatcattggctgaaagttccagaggacaagctacagattattattgaagtgacagaaatgttgcataatgccagtttactcatcgatgatattgaagacaactcaaaactccgacgtggctttccagtggcccacagcatctatggaatcccatctgtcatcaattctgccaattacgtgtatttccttggcttggagaaagtcttaacccttgatcacccagatgcagtgaagctttttacccgccagcttttggaactccatcagggacaaggcctagatatttactggagggataattacacttgtcccactgaagaagaatataaagctatggtgctgcagaaaacaggtggactgtttggattagcagtaggtctcatgcagttgttctctgattacaaagaagatttaaaaccgctacttaatacacttgggctctttttccaaattagggatgattatgctaatctacactccaaagaatatagtgaaaacaaaagtttttgtgaagatctgacagagggaaagttctcatttcctactattcatgctatttggtcaaggcctgaaagcacccaggtg

SEQ ID NO: 12084 - DNA, 3336 bp, Homo sapiens
ctctaacactcctcccccagcctcttccttccctctgcagagacacccttctcctttctgctgtctctgcacgggtggccagagccacacagccctttctttaagtcaggagttgccctgtcagagcacaaggcaagaaggaagtggtaaagggacggaggggaagccctgagaggactgagaggatgggaaattctctgctgagagaaaacaggcggcagcagaacactcaagagatgccttggaatgtgagaatgcaaagccccaaacagagaacatccagatgctgggatcaccatatcgctgaagggtgtttctgccttccatggaaaaaaatactcatttttgaaaagaggcaagattcccaaaacgaaaatgaaagaatgtcatctactcccatccaggacaatgttgaccagacctactcagaggagctgtgctataccctcatcaatcatcgggttctctgtacaaggccatcagggaactctgctgaagagtactatgagaatgttccctgcaaagctgagagacccagagagtccttgggaggaactgagactgagtattcacttctacatatgccttctacagaccccaggcatgcccgatccccagaagatgaatatgaacttctcatgcctcacagaatctcctctcactttctgcaacagccacgtccacttatggccccttctgagactcagttttcccatttatagtgaagtggctggactagcatttgtttagcaccaacaaataaaaggtgggatgggggatctgcctgaagcagggatgggacacaaagtccctccagcttatctcccacaacaaccctttccctgcagagcatggtttgtataccacaagccctcttagcacgcaaaagccaaaatctaaagatcaaccatttatcctgaacaacaccatttgagaaagaggtaaccatctttggttctacatggtttggagagtatagtggtaggaggggctccctgattcccctaaagctatgcacaccacaaggggctctgctcttctgtctgggatcttcttataaagtgttcccatgatcattctctaaagtcacaaggaagctttactcatcatactaagtgtgcccaagggggagttcactcattactgtgaccttccagctcagtccccacccatgggagcctgtgttgctcctctcactccatgtgtctaagtcatgtcttttacatagtgtcctttgacctgttggcccccatggtctggttagttatgtgagttgaatcaagaggctctaggccagatgtttacataattttaacctatatgattttatttttaactttgtatttctccctagaaatcttaataagacaattatgccatcagacaatgttaagaagaacgatccttggagatcccgtaatcccactacccttctttggctcagagaggataatttgcctaatgatacattaaagttagtggcaaaacttaatttggagcctgatttcctactgacttccaatttagtgctcccccagtatgctaaatagaaagccctctgcaatatattaaatgtatactaaatgtatatatttaataatgtcatgtataaaatatgaataaaatgtccacataggaaattaacacatatataccttctctgataagcactcctctatgtgtcctgattatttactttctcttatcttttccttagtgttcctcaaattatatctatcctctaaaccagggatcagcaaactataacccccaggccaaatctagcccactccctgtttttatagataaagatttgttggaacacagccacactcatttgtttacctactatctatgattgttcaaccatgggagagttgagtaattgtgacatggaccataggccctaaagagccaaaataaatatactttggcactttttggaaaaaaagtttgcagacacctgccctaaatgattatagtttgagagaaacttaacagaaatgtgtttggttactgatgcataagagcaagcaccaataaaatggcataaaaatattaaatcacaaatggataagtgagaccaaggcaatttagcaaattctactatttctgtattcacacctgtgtcttccacttgctgttttatttaactcacggctactgtcctaattttagggatgctaaaatagtttgttttaaaagaggtttgtttaagaaagcagtaggtacattatgtttactagacaggcccttggaccagctaagcgacagggaacctggtacattatgtttagttactgttttcttctcaaagttaaccaaagctaaataactttcctatgtaaaatgtgctgactcccaaaagaggagaaatgcaatggcttgagcttgcatgtgtcacaggtttgtggagccttcagccaggtgatggtcttcagctaaagagccagctgcatcttggtatctcttcctctgctaacttcctacttttagcaaaattctttcacttggaactctagctgatccttggccaggatcagatcctcaaaaggaaatattcagttagcagtggatattgtacaagatgtaacatggcttagaggaaagagtgtagacccagcgacagatcatcagtcactcaaatcctggttctctctcttcctccatctgtgactttgaacatgctacttggaggctcagcttcttcaccatcaacaggaggattacatctaatgcaggcaatcatctattacagatgccgaataaatgatatcaaagagcatagagaaacaaaaatcttttatgatgtacggaaaaaaaccatgctgatacagctggctattcagggtcacccagcagtcctccagcaaggtagaaacaccaaatcaatgagtttatgctagaatttttcacatggccactggaccattgtggaagtagactggttgaaatattcttagtatgacatagtaagttatatttgtttgaaccttatcctgtgaaagcattatctgtcccaaacagtatatgccttttatcagggacacattaaatataaatgtttaaccaaagaaagttgttcttataatgtaattataacagggatttataagagggaattataagagggattatgaaagggaattacttttgagcaaggggagccatttgggagtgcttcaagatacccaatatgatatacacaattatgatttgtcagtcaaaaataatattaagaacaaaaaaagagttaaaaaattctgatatgagtgtaatatacttaatatgtaggatgtctcaaatttccagtaaataaattttaatgtcccaaaa

SEQ ID NO: 12085 - DNA, 623 bp, Homo sapiens
tttctgctgtctctgcacgggtggccagagccacacagccctttctttaagtcaggagttgccctgtcagagcacaaggcaagaaggaagtggtaaagggacggaggggaagccctgagaggactgagaggatgggaaattctctgctgagagaaaacaggcggcagcagaacactcaagagatgccttggaatgtgagaatgcaaagccccaaacagagaacatccaggaaaaaaatactcatttttgaaaagaggcaagattcccaaaacgaaaatgaaagaatgtcatctactcccatccaggacaatgttgaccagacctactcagaggagctgtgctataccctcatcaatcatcgggttctctgtacaaggccatcagggaactctgctgaagagtactatgagaatgttccctgcaaagctgagagacccagagagtccttgggaggaactgagactgagtattcacttctacatatgccttctacagaccccaggcatgcccgatccccagaagatgaatatgaacttctcatgcctcacagaatctcctctcactttctgcaacagccacgtccacttatggccccttctgagactcagttttcccatttatag

SEQ ID NO: 12086 - DNA, 1036 bp, Homo sapiens
tcctttctgctgtctctgcacgggtggccagagccacacagccctttctttaagtcaggagttgccctgtcagagcacaaggcaagaaggaagtggtaaagggacggaggggaagccctgagaggactgagaggatgggaaattctctgctgagagaaaacagtttcaggcggcagcagaacactcaagagatgccttggaatgtgagaatgcaaagccccaaacagagaacatccagatgctgggatcaccatatcgctgaagggtgtttctgccttccatggaaaaaaatactcatttttgaaaagaggcaagattcccaaaacgaaaatgaaagaatgtcatctactcccatccaggacaatgttgaccagacctactcagaggagctgtgctataccctcatcaatcatcgggttctctgtacaaggccatcagggaactctgctgaagagtactatgagaatgttccctgcaaagctgagagacccagagagtccttgggaggaactgagactgagtattcacttctacatatgccttctacagaccccaggcatgcccgatccccagaagatgaatatgaacttctcatgcctcacagaatctcctctcactttctgcaacagccacgtccacttatggccccttctgagactcagttttcccatttatagtgaagtggctggactagcatttgtttagcaccaacaaataaaaggtgggatgggggatctgcctgaagcagggatgggacacaaagtccctccagcttatctcccacaacaaccctttccctgcagagcatggtttgtataccacaagccctcttagcacgcaaaagccaaaatctaaagatcaaccatttatcctgaacaacaccatttgagaaagaggtaaccatctttggttctacatggtttggagagtatagtggtaggaggggctccctgattcccctaaagctatgcacaccacaaggggctctgctcttctgtctgggatcttcttataaagtgttcccatgatcattctc

SEQ ID NO: 12087 - DNA, 1313 bp, Homo sapiens
gtggatgtttacttgctggtggtcttatctaagatcaacattggcagctgtgcccggagaggcctccagggtccaggtccaatgcacttccctctcagaagaggcatccgctaaaatagggaccaaagctgctggagggaggcaaggcaagctgctatgtgaaaaaacgccaggccaggcagtcatgtcacacctggcagaaatgactgaagcatagccactggctgaagttatccccacacccactctctggagaggatgatcaggagcagtctgctcaaccgggaggtgggactcctcctcgggaaggtgtagaatcaccagcctggctccctgcggactcccggggctcacagaggccagagcagcaacagcacatgggaaacaacggggcgctggactggggaggtctcagagctctcctagtgatgacagcctcattttacccagggagaaagggcgagtaagctaaggtcacacagcaacaaagctgcacccagaccccagagccactctcctccctccctcctccaccagggccatgcccacttggggcaccccgccaccgtgttccagggacagctggagcacatgcttcttccctcgccaacccagcaattccgcagggcatctgacctccactgttgacttctacccagaggacaagaacatttttagttcccaaggaatgtacatcagccccacggaagctaggccacctctgggatggggttgctggtttagaacaaacgccagtcatcctatataaggacctgacagccaccaggcaccacctccgccaggaactgcaggcccacctgtctgcaacccagctgaggccatgccctccccagggaccgtctgcagcctcctgctcctcggcatgctctggctggacttggccatggcaggctccagcttcctgagccctgaacaccagagagtccagagaaaggagtcgaagaagccaccagccaagctgcagccccgagctctagcaggctggctccgcccggaagatggaggtcaagcagaaggggcagaggatgaactggaagtccggttcaacgccccctttgatgttggaatcaagctgtcaggggttcagtaccagcagcacagccaggccctggggaagtttcttcaggacatcctctgggaagaggccaaagaggccccagccgacaagtgatcgcccacaagccttactcacctctctctaagtttagaagcgctcatctggcttttcgcttgcttctgcagcaactcccacgactgttgtacaagctcaggaggcgaataaatgttcaaac

SEQ ID NO: 12088 - DNA, 1425 bp, Homo sapiens
agttccccaaagataacacagctttgcacagtggatgtttacttgctggtggtcttatctaagatcaacattggcagctgtgcccggagaggcctccagggtccaggtccaatgcacttccctctcagaagaggcatccgctaaaatagggaccaaagctgctggagggaggcaaggcaagctgctatgtgaaaaaacgccaggccaggcagtcatgtcacacctggcagaaatgactgaagcatagccactggctgaagttatccccacacccactctctggagaggatgatcaggagcagtctgctcaaccgggaggtgggactcctcctcgggaaggtgtagaatcaccagcctggctccctgcggactcccggggctcacagaggccagagcagcaacagcacatgggaaacaacggggcgctggactggggaggtctcagagctctcctagtgatgacagcctcattttacccagggagaaagggcgagtaagctaaggtcacacagcaacaaagctgcacccagaccccagagccactctcctccctccctcctccaccagggccatgcccacttggggcaccccgccaccgtgttccagggacagctggagcacatgcttcttccctcgccaacccagcaattccgcagggcatctgacctccactgttgacttctacccagaggacaagaacatttttagttcccaaggaatgtacatcagccccacggaagctaggccacctctgggatggggttgctggtttagaacaaacgccagtcatcctatataaggacctgacagccaccaggcaccacctccgccaggaactgcaggcccacctgtctgcaacccagctgaggccatgccctccccagggaccgtctgcagcctcctgctcctcggcatgctctggctggacttggccatggcaggctccagcttcctgagccctgaacaccagagagtccagcagagaaaggagtcgaagaagccaccagccaagctgcagccccgagctctagcaggctggctccgcccggaagatggaggtcaagcagaaggggcagaggatgaactggaagtccggttcaacgccccctttgatgttggaatcaagctgtcaggggttcagtaccagcagcacagccaggccctggggaagtttcttcaggacatcctctgggaagaggccaaagaggccccagccgacaagtgatcgcccacaagccttactcacctctctctaagtttagaagcgctcatctggcttttcgcttgcttctgcagcaactcccacgactgttgtacaagctcaggaggcgaataaatgttcaaactgtatgctgatgttccaaatgggaatttatttcaaagaggaaaagttaatattttactttaaaaaaatcaaaataatac

SEQ ID NO: 12089 - DNA, 401 bp, Homo sapiens
caggcccacctgtctgcaacccagctgaggccatgccctccccagggaccgtctgcagcctcctgctcctcggcatgctctggctggacttggccatggcaggctccagcttcctgagccctgaacaccagagagtccagcagagaaaggagtcgaagaagccaccagccaagctgcagccccgagctctagcaggctggctccgcccggaagatggaggtcaagcagaaggggcagaggatgaactggaagtccggaggccccagccgacaagtgatcgcccacaagccttactcacctctctctaagtttagaagcgctcatctggcttttcgcttgcttctgcagcaactcccacgactgttgtacaagctcaggaggcgaataaatgttcaaactgt

SEQ ID NO: 12090 - DNA, 227 bp, Homo sapiens
aagataacacagctttgcacagtggatgtttacttgctggtggtcttatctaagatcaacattggcagctgtgcccggagaggcctccagggtccaggcccacctgtctgcaacccagctgaggccatgccctccccagggaccgtctgcagcctcctgctcctcggcatgctctggctggacttggccatggcaggctccagcttcctgagccctgaacaccagag

SEQ ID NO: 12091 - DNA, 793 bp, Homo sapiens
aacacagctttgcacagtggatgtttacttgctggtggtcttatctaagatcaacattggcagctgtgcccggagaggcctccagggtccagcaattccgcagggcatctgacctccactgttgacttctacccagaggacaagaacatttttagttcccaaggaatgtacatcagccccacggaagctaggccacctctgggatggggttgctggtttagaacaaacgccagtcatcctatataaggacctgacagccaccaggcaccacctccgccaggaactgcaggcccacctgtctgcaacccagctgaggccatgccctccccagggaccgtctgcagcctcctgctcctcggcatgctctggctggacttggccatggcaggctccagcttcctgagccctgaacaccagagagtccagcagagaaaggagtcgaagaagccaccagccaagctgcagccccgagctctagcaggctggctccgcccggaagatggaggtcaagcagaaggggcagaggatgaactggaagtccggttcaacgccccctttgatgttggaatcaagctgtcaggggttcagtaccagcagcacagccaggccctggggaagtttcttcaggacatcctctgggaagaggccaaagaggccccagccgacaagtgatcgcccacaagccttactcacctctctctaagtttagaagcgctcatctggcttttcgcttgcttctgcagcaactcccacgactgttgtacaagctcaggaggcgaataaatgttcaaac

SEQ ID NO: 12092 - DNA, 856 bp, Homo sapiens
gtggatgtttacttgctggtggtcttatctaagatcaacattggcagctgtgcccggagaggcctccagggtccagggccatgcccacttggggcaccccgccaccgtgttccagggacagctggagcacatgcttcttccctcgccaacccagcaattccgcagggcatctgacctccactgttgacttctacccagaggacaagaacatttttagttcccaaggaatgtacatcagccccacggaagctaggccacctctgggatggggttgctggtttagaacaaacgccagtcatcctatataaggacctgacagccaccaggcaccacctccgccaggaactgcaggcccacctgtctgcaacccagctgaggccatgccctccccagggaccgtctgcagcctcctgctcctcggcatgctctggctggacttggccatggcaggctccagcttcctgagccctgaacaccagagagtccagagaaaggagtcgaagaagccaccagccaagctgcagccccgagctctagcaggctggctccgcccggaagatggaggtcaagcagaaggggcagaggatgaactggaagtccggttcaacgccccctttgatgttggaatcaagctgtcaggggttcagtaccagcagcacagccaggccctggggaagtttcttcaggacatcctctgggaagaggccaaagaggccccagccgacaagtgatcgcccacaagccttactcacctctctctaagtttagaagcgctcatctggcttttcgcttgcttctgcagcaactcccacgactgttgtacaagctcaggaggcgaataaatgttcaaactgta

SEQ ID NO: 12093 - DNA, 443 bp, Homo sapiens
gtggatgtttacttgctggtggtcttatctaagatcaacattggcagctgtgcccggagaggcctccagggtccagcagagaaaggagtcgaagaagccaccagccaagctgcagccccgagctctagcaggctggctccgcccggaagatggaggtcaagcagaaggggcagaggatgaactggaagtccggttcaacgccccctttgatgttggaatcaagctgtcaggggttcagtaccagcagcacagccaggccctggggaagtttcttcaggacatcctctgggaagaggccaaagaggccccagccgacaagtgatcgcccacaagccttactcacctctctctaagtttagaagcgctcatctggcttttcgcttgcttctgcagcaactcccacgactgttgtacaagctcaggaggcgaataaatgttcaaac

SEQ ID NO: 12094 - DNA, 326 bp, Homo sapiens
gtggatgtttacttgctggtggtcttatctaagatcaacattggcagctgtgcccggagaggcctccagggtccagttcaacgccccctttgatgttggaatcaagctgtcaggggttcagtaccagcagcacagccaggccctggggaagtttcttcaggacatcctctgggaagaggccaaagaggccccagccgacaagtgatcgcccacaagccttactcacctctctctaagtttagaagcgctcatctggcttttcgcttgcttctgcagcaactcccacgactgttgtacaagctcaggaggcgaataaatgttcaaac

SEQ ID NO: 12095 - DNA, 440 bp, Homo sapiens
gtggatgtttacttgctggtggtcttatctaagatcaacattggcagctgtgcccggagaggcctccagggtccagagaaaggagtcgaagaagccaccagccaagctgcagccccgagctctagcaggctggctccgcccggaagatggaggtcaagcagaaggggcagaggatgaactggaagtccggttcaacgccccctttgatgttggaatcaagctgtcaggggttcagtaccagcagcacagccaggccctggggaagtttcttcaggacatcctctgggaagaggccaaagaggccccagccgacaagtgatcgcccacaagccttactcacctctctctaagtttagaagcgctcatctggcttttcgcttgcttctgcagcaactcccacgactgttgtacaagctcaggaggcgaataaatgttcaaac

SEQ ID NO: 12096 - DNA, 524 bp, Homo sapiens
acctccgccaggaactgcaggcccacctgtctgcaacccagctgaggccatgccctccccagggaccgtctgcagcctcctgctcctcggcatgctctggctggacttggccatggcaggctccagcttcctgagccctgaacaccagagagtccagagaaaggagtcgaagaagccaccagccaagctgcagccccgagctctagcaggctggctccgcccggaagatggaggtcaagcagaaggggcagaggatgaactggaagtccggttcaacgccccctttgatgttggaatcaagctgtcaggggttcagtaccagcagcacagccaggccctggggaagtttcttcaggacatcctctgggaagaggccaaagaggccccagccgacaagtgatcgcccacaagccttactcacctctctctaagtttagaagcgctcatctggcttttcgcttgcttctgcagcaactcccacgactgttgtacaagctcaggaggcgaataaatgttcaaactgt

SEQ ID NO: 12097 - DNA, 527 bp, Homo sapiens
acctccgccaggaactgcaggcccacctgtctgcaacccagctgaggccatgccctccccagggaccgtctgcagcctcctgctcctcggcatgctctggctggacttggccatggcaggctccagcttcctgagccctgaacaccagagagtccagcagagaaaggagtcgaagaagccaccagccaagctgcagccccgagctctagcaggctggctccgcccggaagatggaggtcaagcagaaggggcagaggatgaactggaagtccggttcaacgccccctttgatgttggaatcaagctgtcaggggttcagtaccagcagcacagccaggccctggggaagtttcttcaggacatcctctgggaagaggccaaagaggccccagccgacaagtgatcgcccacaagccttactcacctctctctaagtttagaagcgctcatctggcttttcgcttgcttctgcagcaactcccacgactgttgtacaagctcaggaggcgaataaatgttcaaactgt

SEQ ID NO: 12098 - DNA, 855 bp, Homo sapiens
gtggatgtttacttgctggtggtcttatctaagatcaacattggcagctgtgcccggagaggcctccagggtccagggccatgcccacttggggcaccccgccaccgtgttccagggacagctggagcacatgcttcttccctcgccaacccagcaattccgcagggcatctgacctccactgttgacttctacccagaggacaagaacatttttagttcccaaggaatgtacatcagccccacggaagctaggccacctctgggatggggttgctggtttagaacaaacgccagtcatcctatataaggacctgacagccaccaggcaccacctccgccaggaactgcaggcccacctgtctgcaacccagctgaggccatgccctccccagggaccgtctgcagcctcctgctcctcggcatgctctggctggacttggccatggcaggctccagcttcctgagccctgaacaccagagagtccagcagagaaaggagtcgaagaagccaccagccaagctgcagccccgagctctagcaggctggctccgcccggaagatggaggtcaagcagaaggggcagaggatgaactggaagtccggttcaacgccccctttgatgttggaatcaagctgtcaggggttcagtaccagcagcacagccaggccctggggaagtttcttcaggacatcctctgggaagaggccaaagaggccccagccgacaagtgatcgcccacaagccttactcacctctctctaagtttagaagcgctcatctggcttttcgcttgcttctgcagcaactcccacgactgttgtacaagctcaggaggcgaataaatgttcaaac

SEQ ID NO: 12099 - DNA, 4677 bp, Homo sapiens
caggcacgtcccgggggctccagcttctgctcagagcgcggagagccgggccgggcgggcgcgcgcgcaggactcgggccgctcgaggggtccggccggacggtgtcgggagccggacccgtcggcagaggagcgggcgccgcgatggctgagggcagtgccgtgtctgaccctcagcacgccgcgcgtctgctgcgagcgctcagctctttccgcgaggagtctcgcttctgcgacgcgcacctggtcctcgacggggaggagatcccggtgcagaagaacatcctggcggcggccagcccgtacatcaggacaaagttaaactataatcctccaaaagatgatggatcaacttataagattgaacttgaagggatatcggtaatggttatgagagagatcctggattacatcttcagtgggcagatcaggctaaatgaagatacaatccaagatgttgttcaggcagctgacctgctgctactgacggaccttaaaaccctgtgctgtgagtttttggaaggctgcattgctgctgagaactgtattggtatccgtgactttgcactacattactgcctccatcacgttcattaccttgccacagaatacctggagactcatttccgagacgtcagcagcacggaagaattcttagagctgagtcctcaaaagcttaaagaagtgatttctcttgagaagttaaacgttggcaatgaaagatatgtctttgaagcagtaattcgatggatagcacatgatacagaaataagaaaggtccacatgaaggatgttatgtcagctctgtgggtttcagggttggactccagttatttacgggaacagatgctgaatgaaccattagtacgagaaattgtcaaagagtgtagcaatataccgctcagccagccgcagcaaggggaggcgatgctggccaacttcaaaccccggggctactctgagtgcatcgtgactgttggtggagaagagagagtttcacggaaacccacagcagcgatgcgatgcatgtgccctctctatgaccctaacaggcagctttggatcgaactggcccctttaagcatgccgagaattaaccatggagttctctcagcagaaggatttttgtttgtattcgggggccaagatgaaaataagcagactcttagctcaggagaaaagtatgatccagatgcaaatacatggacagcattgccacctatgaacgaggcaagacataacttcggaattgtggagatagatgggatgctgtacattttgggaggagaggatggtgaaaaggagctgatttccatggagtgttacgatatttattctaaaacctggacaaagcaacctgatttgaccatggtcagaaagatcggctgctatgcagctatgaaaaagaaaatctacgccatgggtggaggctcctacggaaagctttttgagtctgtagagtgttatgatcccaggacccagcagtggactgccatatgtccactaaaagagaggaggtttggagcggtggcctgtggagttgctatggagctgtatgtgtttgggggagtccgaagtcgtgaggacgcccagggtagcgagatggtaacttgcaagtccgagttctaccatgatgagtttaaaaggtggatctatcttaacgaccagaatttatgcatccccgccagttcctcttttgtttatggagctgtacctataggagccagtatttatgttattggagatcttgatacaggtaccaattacgactacgtgcgtgagtttaaaagaagcacaggaacctggcaccacactaaaccactccttccatccgaccttcgccgtacaggatgtgcagccttacgcattgcgaattgcaagcttttccgcctgcagcttcagcaaggcttattccgtattcgtgttcattccccttgaggaggaagcagagcagagtgcgagatcctgacccaagagcaccataacatagctccgaaagggagagcagagatggcagctgaaactcactctgtgctgggctttggtatggtaactctttggtggttttatgatgcttacaaacttgagctttagctcttgtttgggagaacacgtaactgttgaaaaactacctgggaggagtgagttcctccagttaaatgtggctgtagatgttggaggctagggaggctagtaaatatcaaaaggaaaagggagtgggaattgctatcatgtaaaatatcaaagttaaaatactaaggtgcattttccctgaagggaactcatgtctgactgctgtattcaaatacgtagctttggtaacaaacaaaatccgtatatgcaaatcaacatatccaaacatgccaagactgcttttccactgcacttggaaggatatattatgcctaaccctgcccaacaaattaaggtttgtgcctaaaatgttagattggactgtatgccagttagtctccatttattcctagtactctgtcctaagaatctttttaaaactatatcatgatgaattgaaatgaagataaaattgctcttttgtaactttatcttagtaatgtaaagattcagtaaattgatgagtcaggttgcagccctcatgtgaactgaaagaagttgctcgcttctgtgttgacttagatcaagacacgtcacgcatcctttctggggtagtacctgtggagccgggaagggtctcctgcagtgccattctgccttctcaatgagcaaaaccattttctaagtatgaggatattagtgagtaggagattttataaaagaaagacctgagtcagacaaataataaaggtctgctgtggctaaaaaagcaaaaacaaaaaagctatccagacaaaatacatagggatcagaaactttttcatataacctgtctgaaagcacacaaagtcttgtttactactgtttagggtttgaaaacttgtcttagaatgcgaatctgtgttaagaatctagtctttgtaatagaagtttcccagtggcattcactagtgagagttttagacaaattatgttacgagtaaagtttggctggtagaataaactacctcaacttaatttcattctgttcatagtagagcaaattaatcttttcctccttccctcctttcctatctctcattctcacctcaacccactttaccccacttctcattgggggaaaaatgtctttcgttcgtggaacgtatcttgtaagatattttgttttccacttgaattacaccaccctagtgtgaaatcggggacttcaaagtgcttgattccttcctaaattgaattttatgcaatgtcaaatttctaatcaatttaatatacagtacttcatttttaattgttttctaaaaaaaaggttttttttttccttttggaatatggctgtaagaagcagcattttgtcttattaacacatgtataaaggtatcctttggttttaagtcgagaacaggaatttcttctagaaacttcctgtatggaacgtttatatgcaattaacatgcatatgaaaaacatcacttacgttctcccacccatagacataaaaaagggtgacctgtgattttttttcttatacctgctggaagtcagtacaatgcgtcaaaagttgctgaaagatgctgtgcctatggggttctagagagtgttgagtgtggtacattaactctccattttagccagaagatacctgataagagaaggtgtaaggtttttatcttatatgccagaggcaccaggccagatgtgccgcacagtcatgtaattcaatcatgtttaatatgtcagtcaaaaccaaattcagaattgttttgtgtaccagtcagctgttgtctgcacattttcgtagtgacagtgtggagatctttttaatgaaagcaaactatgtggcctctgcaaagaaaggaagatttttctttttacaactagatattagttttagaggaaggaaatagctgaaaaactaaatttgctttggtgaaatgtcctgtacagaacagtaccttggcattcagcagctgtaattggggaacattaaaacagtaactgacatccagttaaagccacgatcgtcagcaattctccttttttaatttctgatatttaaagttttttttccagtctacaccaggcctctccaaggagacagttcattatttaggagtgaatgtgttcctcttgcaatattatcagtacctgcatgacttggtaaattcattttataaaaatagtgttttttttttttaatttcagttcattgactctataactgcagaaattagataatgttttataaaataaatttgccacataatatgggatgcaataaccaacaaagctgctaagtgccaaactgttattttactatatataaatattaaaatattgtgttgaagtatagggatgtatttaattttactatgctccaacattaatcatgactcttttgtaaattacagttatttcagtattgtaaaataaatgttgactcatttcatgcaggtttgtgttttaacattccacttatgccttgaaacatcatttcttgataactttttgatacttctttcttgataaggcacttttaccaggtgtgtgttggaattggtggctcaggataggtcttaaattttaaatacaaatatctttggg

SEQ ID NO: 12100 - DNA, 3249 bp, Homo sapiens
ctagaacgaaaggagtgaggcgccgagagcccagataccattttggcgtgagagctggtggttggcaaggccgcgggagtgggaagcgtccgccatgttctgcgaaaaagccatggaactgatccgcgagctgcatcgcgcgcccgaagggcaactgcctgccttcaacgaggatggactcagacaagttctggaggagatgaaagctttgtatgaacaaaaccagtctgatgtgaatgaagcaaagtcaggtggacgaagtgatttgataccaactatcaaatttcgacactgttctctgttaagaaatcgacgctgcactgtagcatacctgtatgaccgcttgcttcggatcagagcactcagatgggaatatggtagcgtcttgccaaatgcattacgatttcacatggctgctgaagaaatggagtggtttaataattataaaagatctcttgctacttatatgaggtcactgggaggagatgaaggtttggacattacacaggatatgaaaccaccaaaaagcctatatattgaagtccggtgtctaaaagactatggagaatttgaagttgatgatggcacttcagtcctattaaaaaaaaatagccagcactttttacctcgatggaaatgtgagcagctgatcagacaaggagtcctggagcacatcctgtcatgaccatgcgccgaggcacttccaggcttcactcaactcatggactcctctgtactcactctctccaccactcccttcacctccctctttgattttagaagctatagacattgtttaagataactaagaatacttggctaagaagtataatttgctaactattaaggactttctttttttaatgttgtacactattcttcctactcttttttggttttggttttgttttgtagagactgtctcactatgttgcccaagctggtctcaaactcctggcctcaagcagtcctcccaccttagcttctcaaagtgttgagatcacaggcgtgagccactgcacccggcccctactcctttttctaataagctgtatctgtaatcacagcattcctacagttgttacagtgtgttttttaaatgaaagtaaacatggttacatttgaatctcttaaataagcagtcacttggctggacaggaagaaggtagatcctgtgtgtcttgttttctggtcatgtgtattgtacaagctagagagctgaatttctgagatacacattttcaaatcacatgcaagtgaagatgatggtctgtagaaattttcagtatatataatgtttaatgacatactaatttatcatctggctatttgggaaggaaggacacacatggattttgcacatttccaccatggtggctggtgtggcttgtggctatggggtgatcaccagtatcaccactttggaaggggacagtgaaattggggctagagaaggaactttgtacagttttccctgagattcagattgactgaaaagtcacatgaagagttgattgtcttttaatggtatgttttaaacagctgacattttaaattttgatgaaatccagtttattcgtttgttcttttatgctttgggtgttgcatccgagaaatcttttcccatcccaagatcacaattttttttcctttttacttctagaagtgttataattttaagctttatactttggtctatgacccgtttttttttttgttttgttttgttttttcgtttgtttctttgttttgagatggagtcttgttctgtcacccaggctggggtgcagtggcgtgatcttggctcactgcaatctctatcccctgggttcaagtgattctcttgtctcagcctcccaagtagctgggattacaggcacaggccgccacgcctggctaatttttgtatttttagtagagacagagttttaccatgttggccaggctggtttcaaactcctgacctcaagtgacccaccttggcctcccaaagttttgggattacaagtgtgggccaccgcggccagcctatgatccattttgaatgaattttttatatggtgcaaggtgtcaatccaccttcactttttcttgggaatatagatatccagctgtttcactaccattttttgaaaggactgccctttgctctatcacctttgcatttttgttaaaaagtagttgtcaatgtatatgtgggtttatttcaggactctgttttgttccattgacctgtttttctctcctgaatgccaataccatatttgtatgtagtgtatgtaattttctaataattcttgaaacagatagtattaatgtgtcatatttttgctgttgtttgtattttttgtagagatggggtttcaccgtgttggccaggctgtgttgaactcctgagctaaagcaatacacttgcctcgtcctccccatgtgctgggattacaggcgtgagccttggtgctggcccagtgtaccacatttctttttgagatttgttttggctatgttaagtcctttgcttttgatgtgaaatttgggaacaggcagggtgtggtggcttatgcctgtaatcctagaactttgggaggcctagatgggtggatcacttgagctcaggagttccagaccagcccgggcctatggcaaaactccgtctctacaaaaaatagaaaaaattagccaggtgtggtggtgcatgcctgtagtcacagttacacggcaggctgaggtgggaggatcacttgaaccccagaggtcaagactgcagtgagctgagatcacaccactgtactccagcctgggtgacaaagtgagactctatctcaaaaagaaattaggatcaatttgtcaatttctacaacaacaacaacaaaaacccctgttgggcaccttgattgagattgcattgaatttatataaaactgttgggagaattgacatcttaataatattgagtcttctggcctataaacaaggtctgtcttcctaggtattaatgttttgtcttctatttctcttaataatcttttgtagttttcagtgtacaggtctaccatgtcagcatttcatagttttgatgctaaatggtattttaaaatttcaaattctaaccacttgttgctagtaaatagaaatacaattgatgttgaacttgtatccttcagccttgctaaactgtgagttctcatggtgtttttgtaaattacatcaacagtcatgtgttctatgaataaagagttttactccttc

SEQ ID NO: 12101 - DNA, 1156 bp, Homo sapiens
agaacgaaaggagtgaggcgccgagagcccagataccattttggcgtgagagctggtggttggcaaggccgcgggagtgggaagcgtccgccatgttctgcgaaaaagccatggaactgatccgcgagctgcatcgcgcgcccgaagggcaactgcctgccttcaacgaggatggactcagacaagttctggaggagatgaaagctttgtatgaacaaaaccagtctgatgtgaatgaagcaaagtcaggtggacgaagtgatttgataccaactatcaaatttcgacactgttctctgttaagaaatcgacgctgcactgtagcatacctgtatgaccgcttgcttcggatcagagcactcagatgggaatatggtagcgtcttgccaaatgcattacgatttcacatggctgctgaagaaatggaatctcgctctgttgcccaggctggagtacagtggtgcattctctgctcactgcaacttccgcctcctggcttcaagcaattctcctgcctcagcctgccaagtagctgtgattacagatggagtggtttaataattataaaagatctcttgctacttatatgaggtcactgggaggagatgaaggtttggacattacacaggatatgaaaccaccaaaaagcctatatattgaagtccggtgtctaaaagactatggagaatttgaagttgatgatggcacttcagtcctattaaaaaaaaatagccagcactttttacctcgatggaaatgtgagcagctgatcagacaaggagtcctggagcacatcctgtcatgaccatgcgccgaggcacttccaggcttcactcaactcatggactcctctgtactcactctctccaccactcccttcacctccctctttgattttagaagctatagacattgtttaagataactaagaatacttggctaagaagtataatttgctaactattaaggactttctttttttaatgttgtacactattcttcctactcttttttggttttggttttgttttgtagagactgtctcactatgttgcccaagctggtctcaaactcctggcctcaagcagtcctcccaccttagcttctcaaagtgttgagatcacaggcgtgagccactgcacccggcccctactcc

SEQ ID NO: 12102 - DNA, 2673 bp, Homo sapiens
gggctctcgccgtggcgggaaaacggcggccgcggcgtctcctccgggacgctgaggggcccgaggagaccgtgaggctctggcctgcagctcgcgccgccatggacgctgccgaggtcgaattcctcgccgagaaggagctggttaccattatccccaacttcagtctggacaagatctacctcatcgggggggacctggggccttttaaccctggtttacccgtggaagtgcccctgtggctggcgattaacctgaaacaaagacagaaatgtcgcctgctccctccagagtggatggatgtagaaaagttggagaagatgagggatcatgaacgaaaggaagaaacttttaccccaatgcccagcccttactacatggaacttacgaagctcctgttaaatcatgcttcagacaacatcccgaaggcagacgaaatccggaccctggtcaaggatatgtgggacactcgtatagccaaactccgagtgtctgctgacagctttgtgagacagcaggaggcacatgccaagctggataacttgaccttgatggagatcaacaccagcgggactttcctcacacaagcgctcaaccacatgtacaaactccgcacgaacctccagcctctggagagtactcagtctcaggacttctagagaaaggcctggtgcaggcggcttgctgggggatgtgagcgctcaggacgtgatgaggtactcgtggttctggagctctagaaacacttctgatgcatgaaaaatgtgtgatggtgcaaggaatggattcaggatgttgttggagaaacaagtttgtgattagtccttaaaacttagctccctgggacattcttcaattccacatctgtttctagaaaccagccctttttccccccacttttgagaaataaaaaagccttaggtaaataagtcattctccctagcagagccacttgggtctcctgcatggaagccatcacacttgggcaggtgttcagtgactggtaggtgtagatacagcaggagtggccatgtggtccacggctttttaccccttcttgatcctgatttcttgggctgaatttagactctctcacagaggtggctcacagagaaggatggcagatggtgcagccaacaatgctgaccggtgcttatcctctaagccctgatccacaataaaaatggacccaactcagctctgactctctaggtttttgtgctgcgtaactaccaagtaaaaggactgagcctgtggctgagatgactcagtcaacgaaactgaggcacacggcagttaagtggaaactgcagaccaacacctggggtgtctccttctcttggctacttctagctcaggtttaatgggttgcttatcaagaggagagtcaggaaaaaaacgaatccaatgtattgagcatgagtgacaatgtattgagcatgagtgacaatgctagaagaaaagtcactttcagtgctgctcttgatggatttggggaaggattctttgttgtaggtaacagtgggctcaggggaaattatttttttcctaagagaaaattactttattcgtagcattttggaaatgttaggacctttacagaaattacattaccttgagaggtgaaatgatcgtccagcatcatgcaatggatagaaggttctgtaatcagctttaaaaaaaactttaatttttggccgggcacattggcttggctcatgcatgtaatcccagcactttgggaggccaaggcaggtggatcacaaggccaggagattgagactatcctggctaacatggtgaaaccccgtctctattaaaaatacaaaaaaaaaaaaatttgccaggtgtggtggcacacgcctatagtcgcagctactcgggaggctgaggcaggagaatcgcttgaacccgagaggcggaggttgtagtgagccaagattgcaccactgtactcctgcctgggcaacgagagcaagactctgtctcaaacaaaaaaaattttaactttttttttagacagggtctcgttctgtcatccaggctgcagtagagtggcgtgattatagctcactgcagcctcgaactcctgggttcacacagttctcccaccacagcctcccaaagcactgggattgcaagcatgagccgccatgcctggccagcctatttttggctggacaccagtgggccaaaagcagtggggtgctgtctggggagctctgagaatgcgcatgtgtgacaggctgagcctaaagacttatcacccagcatctgccctccagtgtctagcatgctgcacactatcactccatgttgctgcccacgtgtccccgccaggcaggttttggtggttatttggacactgaagggtcagacctggaagactgggaccaaaagatgaggtctccataatttaaggtgctgttcagacttggttcagctcataggacttgttctttcatctcagccttccttggaatcctcctgctttcatctggggatcttttagaatgaaaccacttgttattgtggagggcaaggggtcctaatgccctcctcttagagcctgagccagtggaggcagctccgtctgcggagatgtatagttattgagcttttctttgtttggctttgttttatatcataaaaaagattttcctcttaacataa

SEQ ID NO: 12103 - DNA, 2247 bp, Homo sapiens
cggtaccgcccgaattgactgctcctgtctgatgcgtccccgggcgcgggaaacgagtttcaatccactttcctgaccccaaccatcctgcccagtctccgcttccccgtcttgtacacccctaactcctgaggctcctccgaatcacgcgagtggaagcggagaagctcaagtggccgccatgtcagaggcttatttccgagtggagtcgggtgcgctggggcctgaggagaactttctttctttggacgacatcctgatgtcccacgagaagctgccggtgcgcacggagaccgccatgcctcgccttggcgctttcttcctggagcggagcgcaggcgccgagactgacaacgcggtcccacagggttccaagcttgaactacccttgtggctggcaaaaggactttttgacaacaagcgacggatcctttctgtggaactccccaagatctaccaagagggttggaggactgtgttcagtgcagatcccaatgtggtggacctccacaaaatggggccccatttctacgggtttggctcccagctcctgcattttgacagtcccgagaatgcagacatttcccagtctctgctgcagacttttatcggacgttttcgccgcatcatggactcctcacagaatgcttacaacgaagacacttcagccctggtagccaggctagacgagatggagaggggcttatttcaaacagggcagaaaggactgaatgactttcagtgttgggagaaggggcaggcttctcagatcacagcttccaacctcgttcagaattacaagaagagaaaattcactgatatggaagactgaaagccggaagaacacagaatggctcctcacagacgtatccctccgtgtgtccttgataggagctggttgaccttgtacagaaccagaatcctgtcccatttcatggcttatttcctgtggccatagagaattatagggaactggacatgctggaggatgtgggtgtccctggctctgtgagtcttccaggaccgtcccaccctgctgacccacagcccaggccctttaacccaagaacccatggccaaggagaaatcaaagtccttcctaaataagaatcactgccatataatatatcacagtagagttgcaactgagattccttgtgtctgggagtttggacagcttcagatgtacagtttcactagccacaaagcacaggtacaaactgggtcatcgcctgttcacaaaatgctctcttgatcttatttgcctcatcttcctcatggttgtacagaggatagcaccccaccatgccagcctgacttggagatatctcctgctgcctgcctgcagggagttaccccagtttccaaaaacagtcgcccagataaaggaggaaaagggaaaggcagacgaatggcatggcttttactaaagaaaagatgttggcctcatactctatactcagggcttaatgaactggaatctgcataactcagcagtcaacccagaagggaaatggttaaactgagcttgttattgcctcggagagcctaagagcacccgcacacttaattctactccctgtctagaaaagctgtcagggagtcgtttggaattgcaatgtagttattaagggctgttaaccagcctgcattacatctggaagtcaggacttgggtgctgactatgaagggccctgttttcaaaatctaacattgcaagtgtaaatgggcaagaagcctccgttgtgctttttttttcctcttcagtaacttttgcaacattattgcatagaagatccctgaccatttactaggaacctggttaagcaagcactaatctcttttcctggagatcaaggatgcaacctcaggttgagaaagaaacagggttccctgggcccattagactgtttgcagggcatcactgcttccccctgacacctcacaactagcaaaaattgtctttgtctttggaaattatagagggatttgggtatccagattgtgcagatgcaaacttaggctgtcttgatgcaaacttagaaccacagaaatgcttttaaaatgcctgttttaagatggaattgttgtttttataatttgattttagtgctaaataaatgattggctttgtacatgaatatgttctgtacaagtgctctttcactagtactacagataatcaaagctatcagaattgtgtctttgatcatatttgacggtaatacacaaatccatgttttagca

SEQ ID NO: 12104 - DNA, 2039 bp, Homo sapiens
agacttgatcgattgcttctgcctgggcggtaccgcccgaattgactgctcctgtctgatgcgtccccgggcgcgggaaacgagtttcaatccactttcctgaccccaaccatcctgcccagtctccgcttccccgtcttgtacacccctaactcctgaggctcctccgaatcacgcgagtggaagcggagaagctcaagtggccgccatgtcagaggcttatttccgagtggagtcgggtgcgctggggcctgaggagaactttctttctttggacgacatcctgatgtcccacgagaagctgccggtgcgcacggagaccgccatgcctcgccttggcgctttcttcctggagcggagcgcaggcgccgagactgacaacgcggtcccacagacttttatcggacgttttcgccgcatcatggactcctcacagaatgcttacaacgaagacacttcagccctggtagccaggctagacgagatggagaggggcttatttcaaacagggcagaaaggactgaatgactttcagtgttgggagaaggggcaggcttctcagatcacagcttccaacctcgttcagaattacaagaagagaaaattcactgatatggaagactgaaagccggaagaacacagaatggctcctcacagacgtatccctccgtgtgtccttgataggagctggttgaccttgtacagaaccagaatcctgtcccatttcatggcttatttcctgtggccatagagaattatagggaactggacatgctggaggatgtgggtgtccctggctctgtgagtcttccaggaccgtcccaccctgctgacccacagcccaggccctttaacccaagaacccatggccaaggagaaatcaaagtccttcctaaataagaatcactgccatataatatatcacagtagagttgcaactgagattccttgtgtctgggagtttggacagcttcagatgtacagtttcactagccacaaagcacaggtacaaactgggtcatcgcctgttcacaaaatgctctcttgatcttatttgcctcatcttcctcatggttgtacagaggatagcaccccaccatgccagcctgacttggagatatctcctgctgcctgcctgcagggagttaccccagtttccaaaaacagtcgcccagataaaggaggaaaagggaaaggcagacgaatggcatggcttttactaaagaaaagatgttggcctcatactctatactcagggcttaatgaactggaatctgcataactcagcagtcaacccagaagggaaatggttaaactgagcttgttattgcctcggagagcctaagagcacccgcacacttaattctactccctgtctagaaaagctgtcagggagtcgtttggaattgcaatgtagttattaagggctgttaaccagcctgcattacatctggaagtcaggacttgggtgctgactatgaagggccctgttttcaaaatctaacattgcaagtgtaaatgggcaagaagcctccgttgtgctttttttttcctcttcagtaacttttgcaacattattgcatagaagatccctgaccatttactaggaacctggttaagcaagcactaatctcttttcctggagatcaaggatgcaacctcaggttgagaaagaaacagggttccctgggcccattagactgtttgcagggcatcactgcttccccctgacacctcacaactagcaaaaattgtctttgtctttggaaattatagagggatttgggtatccagattgtgcagatgcaaacttaggctgtcttgatgcaaacttagaaccacagaaatgcttttaaaatgcctgttttaagatggaattgttgtttttataatttgattttagtgctaaataaatgattggctttgtacatgaatatgttctgtacaagtgctctttcactagtactacagataatcaaagctatcagaattgtgtctttgatcatatttgacggtaatacacaaatccatgttttagc

SEQ ID NO: 12105 - DNA, 2390 bp, Homo sapiens
agacttgatcgattgcttctgcctgggcggtaccgcccgaattgactgctcctgtctgatgcgtccccgggcgcgggaaacgagtttcaatccactttcctgaccccaaccatcctgcccagtctccgcttccccgtcttgtacacccctaactcctgaggctcctccgaatcacgcgagtggaagcggagaagctcaagtggccgccatgtcagaggcttatttccgagtggagtcgggtgcgctggggcctgaggagaactttctttctttggacgacatcctgatgtcccacgagaagctgccggtgcgcacggagaccgccatgcctcgccttggcgctttcttcctggagcggagcgcaggcgccgagactgacaacgcggtcccacagggttttgctctgttgcccaggctggagtgcagtggtgtgatatggctcactgcagccttgacctcccaggctccagagatcctcccacctcagccacctatgtggctggtattgcagggttccaagcttgaactacccttgtggctggcaaaaggactttttgacaacaagcgacggatcctttctgtggaactccccaagatctaccaagagggttggaggactgtgttcagtgcagatcccaatgtggtggacctccacaaaatggggccccatttctacgggtttggctcccagctcctgcattttgacagtcccgagaatgcagacatttcccagtctctgctgcagacttttatcggacgttttcgccgcatcatggactcctcacagaatgcttacaacgaagacacttcagccctggtagccaggctagacgagatggagaggggcttatttcaaacagggcagaaaggactgaatgactttcagtgttgggagaaggggcaggcttctcagatcacagcttccaacctcgttcagaattacaagaagagaaaattcactgatatggaagactgaaagccggaagaacacagaatggctcctcacagacgtatccctccgtgtgtccttgataggagctggttgaccttgtacagaaccagaatcctgtcccatttcatggcttatttcctgtggccatagagaattatagggaactggacatgctggaggatgtgggtgtccctggctctgtgagtcttccaggaccgtcccaccctgctgacccacagcccaggccctttaacccaagaacccatggccaaggagaaatcaaagtccttcctaaataagaatcactgccatataatatatcacagtagagttgcaactgagattccttgtgtctgggagtttggacagcttcagatgtacagtttcactagccacaaagcacaggtacaaactgggtcatcgcctgttcacaaaatgctctcttgatcttatttgcctcatcttcctcatggttgtacagaggatagcaccccaccatgccagcctgacttggagatatctcctgctgcctgcctgcagggagttaccccagtttccaaaaacagtcgcccagataaaggaggaaaagggaaaggcagacgaatggcatggcttttactaaagaaaagatgttggcctcatactctatactcagggcttaatgaactggaatctgcataactcagcagtcaacccagaagggaaatggttaaactgagcttgttattgcctcggagagcctaagagcacccgcacacttaattctactccctgtctagaaaagctgtcagggagtcgtttggaattgcaatgtagttattaagggctgttaaccagcctgcattacatctggaagtcaggacttgggtgctgactatgaagggccctgttttcaaaatctaacattgcaagtgtaaatgggcaagaagcctccgttgtgctttttttttcctcttcagtaacttttgcaacattattgcatagaagatccctgaccatttactaggaacctggttaagcaagcactaatctcttttcctggagatcaaggatgcaacctcaggttgagaaagaaacagggttccctgggcccattagactgtttgcagggcatcactgcttccccctgacacctcacaactagcaaaaattgtctttgtctttggaaattatagagggatttgggtatccagattgtgcagatgcaaacttaggctgtcttgatgcaaacttagaaccacagaaatgcttttaaaatgcctgttttaagatggaattgttgtttttataatttgattttagtgctaaataaatgattggctttgtacatgaatatgttctgtacaagtgctctttcactagtactacagataatcaaagctatcagaattgtgtctttgatcatatttgacggtaatacacaaatccatgttttagc

SEQ ID NO: 12106 - DNA, 3841 bp, Homo sapiens
gtgcctgggcggaaactttgcgagagtagcgcgggagctgagaagttgcagggttgagttggtcccggcaagtccttgagcagtttgttcctctgtcttcccgcttcctggtgccccgactgcgtccccacgaacgccccgtccttaccgccggctgctgtggagtgcctcgctgtctcccaggtccccgagttcctggtttcagagaagatgaccgaagaagtggatttcctgggacaggactctgatgggggtagtgaggaagtggtcctaactcctgcagagctcattgaaagattggagcaggcctggatgaatgaaaagtttgcccctgagctgctggagagcaagcctgagattgtagaatgtgtcatggaacagctggagcacatggaagaaaatctcaggagagccaaaagggaggacctgaaggtcagcatccaccaaatggagatggagaggatccgctacgtcctcagcagctacttgcggtgtcgcctcatgaagatagagaagtttttccctcatgtccttgagaaggaaaaaacacgtcctgagggggagccttccagcctctcgccggaagagttggcctttgccagagagttcatggcgaacacagagtcctatctgaaaaatgtcgccttgaagcacatgccccctaacttacagaaggtggacctctttcgggcagttcccaaaccagatctagattcttacgtgtttctgagagtgagagaacgacaagaaaacatactggtagaaccagacacagatgagcagagggactacgtgattgacctggagaagggctcacagcacttgatccgatacaaaaccattgcacctctggttgcatctggagctgtccagctaatttaaaactaggcataaacagccaggcatggtgactcaagcctgtaatcccagcactttgggaggccgaggcgggcggatcatgaggtcaggagttcgagaccaaccgaccaacatggtgaaaccccatctttactaaaaatacaaaataattagccgggtgttggtggtgtgcacctgtaatcccagctactcaggaggccggggcaggagaatcgcttgaacctgggagcaggaggttgcagtgagccgaggtcgtgccattgcactccagcctgggtgacagtgagactttgtctcaaaaaaaaaaacaaaaaacaaaaaaaaaacaaactaggcataaactcatgaggtcaggagatcaagaccatcctggctactaaaccccatctctactaaacccatctctactaaaaatacaaaaaattagccaggcatggtggcgggcccatctactcaggaggctgaggcaggagaatggtgtgaacccgggaggtggagcttgcagtgagccaagatcgtgccattgcactctagcctgggcgacagagcgagactccatttccaaaaaaaacacactaggcgtaaacaagaatgaagacctggaaccgtagagaaaatactagaaacccctcgtatcacgttgtgcctgaggacaataataaagtagtttactaggcatcagacattcctcagcagtgctgtgggtcacgggcgtgaagcggagctcgaggcaggattgcttgtgttgctgcatgtcctgtctgctgttttagcccgtgtcagtagatggggccattgtactgtttgttctgcacacttggcggagcagcagaggctctcagcacgccttttccctttgtagtattttctgagctaaggaaagtcaggcagaagtagttcataagaaggcatcactgcctgtgatcggggctgcatttagccctgacctgataatggtaggagagttcatttagcctttctgctgcgaagattgtaaatagattaaagaaaacagctgtggccttctcccgtcatacatcattagactgtgtaaactaacattttagaacctctaatattggacttaaaaccaatttctgtcgtgcttaattgaaaatcacaactaaaccaataaaccattattaaatttccattctgcagcagaaggcacctctggacggctcccggcttgtagtttaatgaagtatgtgctccctgctgttaacccgcagccctccccaactctccagcagctttgccaagtcagcctccgggccatctggctgtccttggccaaggcactgttaacggagtgacgttaaccatcttgtattgtgacctgtggccgcttttctggtttaagtccttcactttttcaagaggaatggatgaaattaatgtgcatgcagagtctcacagtgatgccggaaggaaggatgtataggcagtgaatgaatgatctttccttgaaatgctataaaaagcaacctgcattccagtcttttcttcctggttgaagttggcagatttccatttgcagggtatgggctgcgagagtaatcagggtaacattgctgtcatttccaagagaaatcagtaggggaaagcaagggaggtcttttttttttttcttttttgagacggagtttccctcttgttacccaggctggagtggcagtggtgtgaacacggctcactgcagcctccacctcctgggttcaagagattctcctgccccagcctcccgagtagctggtattataggtgcacaccaccacacccaactaattttttgtatttttagtagagatggggtttcatgatgttggccaagctggtctcgagctcctgaccccaggtgatccacccacctcggcctcccaaagtgctggaattataggcgtgagccactgcgcacggcctggggaggttttatttcttgacaaaggtatttgatactcgtgcagtccctggagggtctcactggagagacaacatttaggctgagatctgattaacaggaggcagctgcagtgcagaggtcaaaagggagggtgttccaggcagagaaaacagcctgtgcaaaggccctgaggcagaaacaaactctacttgaggtcagcctggttagaaagcccaactcaaaatagaaagtattacatgataaggtctgaggcaggctggacccagatcttacaggaccttgttaataaggatcccatttggtcccccacagtcctgagaagcgggcagggctgtgggaaacagcagatatttagtggtaagcctgagatcagaacccaagtctgcacttcctagtcacgttctccctgtagtgctaagcccagagacctgagctgttaacctagaacagtgtgcttcctaagccttaatgtgcatacccatcgcctggagctcgccttaagatgtaggttctgcctgaagcccaagttcatttagtatgtcatggttaattcagagtaaaatcaagagttagtacttgatttatgcttgttatataaagaaagagacaacttcactgtatgatcattttgtcacttttcaaaagcatttaattcccattcaattgaaaatgtttcaagaacaaacctgtttggtcattttattgatattgcacatttgtatatgaataaatttttgcaaattaaaaaaaaaaaagatgtaggttctgaaacagggtgaggtccaggatcctgcctttctaaggagctcccatgttgtgcagttgctgctggcccggggaccacattgaatgacggctctacgtcctcatgcctccagctgctgccctgtacatgtccaactgcacggagcactttacatcctctaaaaccacagtaaattgctccatttcctaaattacctcttcaagagaagactggttttgatgtcatttttaaataaaggagaagttgaatttcaaaaccaagtggaacaggaa

SEQ ID NO: 12107 - DNA, 1158 bp, Homo sapiens
cgggagctgagaagttgcagggttgagttggtcccggcaagtccttgagcagtttgttcctctgtcttcccgcttcctggtgccccgactgcgtccccacgaacgccccgtccttaccgccggctgctgtggagtgcctcgctgtctcccaggttcctggtttcagagaagatgaccgaagaagtggatttcctgggacaggactctgatgggggtagtgaggaagtggtcctaactcctgcagagctcattgaaagattggagcaggcctggatgaatgaaaagtttgcccctgagctgctggagagcaagcctgagattgtagaatgtgtcatggaacagctggagcacatggaagaaaatctcaggagagccaaaagggaggacctgaaggtcagcatccaccaaatggagatggagaggatccgctacgtcctcagcagctacttgcggtgtcgcctcatgaagatagagaagtttttccctcatgtccttgagaaggaaaaaacacgtcctgagggggagccttccagcctctcgccggaagagttggcctttgccagagagttcatggcgaacacagagtcctatctgaaaaatgtcgccttgaagcacatgccccctaacttacagaaggtggacctctttcgggcagttcccaaaccagatctagattcttacgtgtttctgagagtgagagaacgacaagaaaacatactggtagaaccagacacagatgagcagagggactacgtgattgacctggagaagggctcacagcacttgatccgatacaaaaccattgcacctctggttgcatctggagctgtccagctaatttaaaactaggcataaacagccaggcatggtgactcaagcctgtaatcccagcactttgggaggccgaggcgggcggatcatgaggtcaggagttcgagaccaaccgaccaacatggtgaaaccccatctttactaaaaatacaaaataattagccgggtgttggtggtgtgcacctgtaatcccagctactcaggaggccggggcaggagaatcgcttgaacctgggagcaggaggttgcagtgagccgaggtcgtgccattgcactccagcctgggtgacagtgagactttgtctcaaaaaaaaaaacaaaaaacaa

SEQ ID NO: 12108 - DNA, 2022 bp, Homo sapiens
ctttgcgagagtagcgcgggagctgagaagttgcagggttgagttggtcccggcaagtccttgagcagtttgttcctctgtcttcccgcttcctggtgccccgactgcgtccccacgaacgccccgtccttaccgccggctgctgtggagtgcctcgctgtctcccaggtccccgagtgagcgtcgaatgggacctctgtggctagggcaggcctgtgtgggtggcactgagagggaggaggggagggggatgttcgcagtttccttgcgaccccagggactttctttgtccccgccatccacctccttaggcctttgggatcgccgactggtctaatgtcgccggcccttgtggctctgggaaattagcattgattaatcttcctaacaatttttgtttttatagagacaggatctccctatgttgcccaggctggtctcgaactcctgggctcaaggtatcttcctgcctcggcttcccaaagtgctgggattacaggcgtgagcccggccagctcctaataatgttaagtgcttgctaggagtcaagcgctgtgctgagcgcaggggcttcccacgtcattgcgtccccagtgcttagtgccaggcactgagcagaggcgcgattcgtatttgaactaaaacgaaccccgtccctgaggaacaagacctctactgggaagtcaaagaaatgaatagtgattgtatggtgtgatgggtgctcagctcttggtggacagaagtaagggggaggcttgtttgagaaacggatacctgacctaagccttggaggaagaggcagacactggaaaactagagtccctgcgttctctcaccacttgctaaagggcctctacaaccccaggaaacctcaataaacctttcctttctccagatagatgtctgttcttgcagataattagaaaacgcattgcagagtattggttctttccctctcattaggttcctggtttcagagaagatgaccgaagaagtggatttcctgggacaggactctgatgggggtagtgaggaagtggtcctaactcctgcagagctcattgaaagattggagcaggcctggatgaatgaaaagtttgcccctgagctgctggagagcaagcctgagattgtagaatgtgtcatggaacagctggagcacatggaagaaaatctcaggagagccaaaagggaggacctgaaggtcagcatccaccaaatggagatggagaggatccgctacgtcctcagcagctacttgcggtgtcgcctcatgaaggtttgacgtggagatacctggagggattgagacagcacagtctgtaatgcagactgaatgtcctggggaaaacttgggctggggcccaggagggtccaggacctgaagatgctgctaagagcccaatatccatgtagctaaactgtaaggagagcgagagattgctccacagaagcacagaggaacgtgtgtggcccactgcggggacaccgcacacatttttagtctgttcacctgccgagtgagtggttcccccttgcgttacagcatggcagtgctaaagggagagttgttggcattggtcaatagtgaatgctgactagaggagaacttgtttccaaaattattttgtctgtcagatggccaacgtcagtgtcaaatgaaccaggatgacttacattcacctacagctttgtggctatctaacttacaaaaatgaagttgcaggccaggcgtggtggctcacacctgtaatcccagcactttgggaggctaggcgggtggatcacctgaggtcaggagtttgagaccagcctgaccaacaaggtgaaaccccatttctactaaaaataaaaaaattagccaggcgtggcggcaggcgcctgtagtcccagctactcaggaggctgagacaggagaattgcttgaacccaggaggtggaggtttcagtgagccaagattgtaccactgcactccagcctgggcaacagagcgagactccgcctcaaaaaaaaaaaaaaaa

SEQ ID NO: 12109 - DNA, 4335 bp, Homo sapiens
gcggcggcggcgagggcccgggtgggtggccgaacttctcccgccatggagggagcagcggcccgggaggcccgggggaccgagaccccgcgcgcgtctgcgcccccgcccgcgccctcggagcccccggccgcgccccgcgcccgcccgcgcctcgtcttccgcacgcagctggcgcacgggagccccacgggcaagatcgagggcttcaccaacgtccgcgagctgtacgccaagatcgccgaagccttcgggatcgcgcccaccgagattttattctgcaccctcaacagccacaaagtggacatgcagaagctcctggggggtcagataggcctggaggacttcatctttgcccacgtgcgaggcgagaccaaggaggtggaggtcactaagacagaggatgctctggggctgaccatcacggacaacggggctggctacgccttcatcaagagaatcaaggaaggcagtatcatcaaccggatcgaggcagtgtgcgtgggtgacagcatcgaagccatcaacgaccactccattgtgggctgccgccactacgaggtggccaagatgctccgggagctgcccaagtcccagcccttcaccctgcgcctggtgcagcccaagagggccttcgatatgattggccagagaagtcggtccagcaaatgtccagtagaggcgaaagtgaccagcgggagggagaccctgcggcttcgttctgggggggctgccacagtggaggaagcgcccagtgagtttgaggaggaggcatctcggaaggttgatgacctgctggaaagctacatgggcattcgggaccccgagctggcgtccaccatggtggagacgtccaagaagacagcgagcgcccaggagtttgcacgctgtttagactccgtcttgggcgagttcgccttccccgacgagtttgtggtggaagtgtgggccgccatcggcgaggccagagaggcctgtggctagtttgccctgggggggcccagcacagccccagcccggagcccagccccctgccccggccctgctccagaacccagcccagatcggaggacaagttcctctctagaacccaatccaatttggagccccagcccaactccagaacccaacccttctctagaatccagcccagatctgaggccaagctatgtgctagagcccaggccagctctgagaccaagcccagcattgagaataagctctgttctaaaactcaggccagccctgagaccaagcccagctctagaactcagatgagctttgagaccatgcccagcactgagaccaagccctgttctagaactcaggcctgctctgaggccaagcccagctctagaacccagatgagctctgagaccatgcccagctctagaactcagatgggctctgagaccatgcccagctctagaactcagatgggctctgagaccgagcccagctctagaactcagatgggctctgagaccgagcccagctctaaaactcagatgggctctgagaccatgcccagctctagaactcagatgggctctgagaccgagcccagctctagaactcagatgggctctgagaccgagcccagctctagaactcagatgggctctgagaccatgcccagctctagaactcagatgggctccgagaccaagcccagctctagaacccagatgagctctgagaccatgcccagctctagaactcagatgagctctgagacagagcccagtattgagaccaagccctgttctagagtccaggccagctccgagaccaagcccagctctagaacccagataagctctgaaaccaagcccagcatagagaccaagccgtgttctagaattcaggccacatctgaagccaagcccagctctagaactcaggtcagccctgagaccaagcccagctctagaacccagataagctctgaaaccaatcccagcattgagaccaagccctgttctagaactcaggccacctctgaggccaaacccagctctagaacccagataagatctgagaccaagccctgctctgaagcccaggccagctctgagacgaagcacatctctagaatccagctgagccctgacaacaagccaaactctggaacccagacacattttaagacccagaccagcttggagaccaatcccagttccagaatccaggctagctcggagaccaagccctgctggaaaactcaagctgactctggaactctggacagctccacgatgcagccacacctggacactcggtctagctccggaaccccagttaattttggaacccatgtgagattcatgaagcagcccagctctggaaccccagtcagctcaggattcagagacagctcccaaatcaaatcctattcaagaactcagaccagctcagaaacccaggtccacacggctgcccagtccagatcccaaccccagttgcatccaagtgcccatccccatcctgcagcccagtccagctccagtgatgattccagctctgagactgagcccagctctagaacctcgcctagtgctacaaccaggcccaactccaggattcagaccagctctggaaccccatccatcttggaagcaagacccagctccagcacacagcttggtgccaagccccactctccttgcacaatgcagctcagctctagaatgcagtttacttccaggacccagaccaatttcaaggcctggccaagctccagagctcaatccagcccaagcaccgcacccagctctggaactcagctcagttctggagcacaggctggttctgaaatcccagccagctccaaaacacagacagcagctgagacccagccaagttccagaatccagctaagctctggagtccaatctagtcctgggacccaggccatcgcagcaatagaattaagctccacagccctgtctagttccgacagcaggtccagctccaggacccagcgctgcccaggagctcgaccagcctctgggactcaattcgcctctaaaaccctgccaggttctagataccagctccagaccacagccccagacagctctggtattcaactggactttgggaagcagagcagttctgaaagtcagcttagctttggaactcagcccagctctgggacccagataagctcaagaattcaagccagctctggaagtcagcttagttcgggaacccagctgatttccggagcccaacccagctccagaactcagactagttctggaaaccagctcagctccgggacccagaccactgcaagaattcagctcagccctggagctcatcttagctccagaacccagtccagtcctgagaccaggctcagctctgaggctcagtccagctctggaacccagttcagttctgggattcagtttggctctgaaacccagaccggctcaagaattcagcccgactctggagcccaacttagttccagaacccagtccagctctgagaccgggctcagctctgaaacccagaccggctcaagaattcagcccagccctggagcccaccttagttctggaacccagcctgtttctggaacccaatccagttccagaactcacaccagttcaagaatctggctgagccctggaaatggaatctgcccacagacccctggccttgaccctagaatccagcttgaggcccctgccccagcccaacctcagcccccaggcccatcccccagagaccccaccccagcccctagcaaagacccccagcctctgcctcagccccatgatcaggtatgtggcatccaggccagccttggccccatcccaggcttaccccaagcctcctacctggccccacagtcacaggtctcctcaaccccccagaagccagccgtctctcccaagccccgggtgggaccccagaagtccaccccacccaccatatctgtcactcctagtcctgcccctagggcagccctcctgagttcccagctgtctgagtccccagctttggcgccagccctttgccccactctgggggagccaggagcccgcccttaccgcggggggccgtagcttggctgtgacttagccctggttcatgtggttctcgtcctctcctgtcccttccagcctggggcccccagaagcagcaagtgaccttatttctccagcaggcggtggtagggagtgtgcggtggtgaaaacaggggcttcaccggtcctggctcagatccaggtccttggagggaaaaggagggcaggagacgggttgcaccgcatgtaccctgagggctcatggtgaataaaggcaccttccatctctgca

SEQ ID NO: 12110 - DNA, 3321 bp, Homo sapiens
gcgcgcgcgtcccggaagcagaagcctgtgtggccttcccggcggctgattcgagggcttgtttggtcagaaggggggcgtcagagaagctgccccttagccaaccatgccgtctgagggtcgctgctgggagaccttgaaggccctacgcagttccgacaaaggtcgcctttgctactaccgcgactggctgctgcggcgcgaggatgttttagaagaatgtatgtctcttcccaagctatcttcttattctggatgggtggtagagcacgtcctaccccatatgcaggagaaccaacctctgtctgagacttcgccatcctctacgtcagcttcagccctagatcaaccctcatttgttcccaaatctcctgacgcaagctctgccttttccccagcctcccctgcaacaccaaatggaaccaagggcaaagatgagtcccagcacacagaatctatggtacttcagtcctcacgggggatcaaagtggaaggctgcgtccgaatgtacgaactggtacacagaatgaaaggaacagagggcctgaggctatggcaggaggagcaggagaggaaggtgcaagccctctcggagatggcatctgaacaactgaagcggtttgatgaatggaaggaactgaagcagcataaagaattccaggacttgcgggaagtaatggagaagagctccagagaagccttgggacaccaagagaagctaaaagctgagcaccgtcacagagcaaagattctcaacctgaagctgcgggaagcagagcagcagcgcgtgaagcaagcagaacaggagcggcttcggaaggaagaaggccagatccgcctgcgggccctctatgctctgcaggaggagatgctgcagctcagccagcagctggatgcctctgagcagcacaaagccctgcttaaggtcgacctggctgccttccagacccgaggcaaccagctgtgcagcctcatctcagggatcatccgggcctcttcagagagcagctatcccacagcagagagtcaagctgaggctgagcgagctctgcgggaaatgcgggacctcctgatgaacttggggcaggagatcaccagagcctgcgaagacaagaggaggcaggatgaagaagaggcccaggtaaagctgcaagaggcacagatgcagcagggaccagaggcccacaaagagcccccagctcccagccagggcccaggagggaaacagaatgaagacctccaggtgaaggtacaagacattacaatgcagtggtaccagcagctgcaggatgcttccatgcagtgtgtgttgacctttgagggcctgaccaacagcaaggacagtcaggccaaaaagataaagatggacctccagaaggctgctaccatcccagtgagccaaatctctaccattgcaggctcaaaactgaaggagatctttgacaagatccacagcctgctctctggaaaacctgttcaatctggtgggcgctctgtgtctgtcacacttaacccacaggggctggactttgttcaatacaaactggcagagaaatttgtgaaacaaggcgaggaggaagtggcctctcaccatgaagcagcattccccattgcagttgtggcatccgggatctgggagctccaccccagagtgggggacctcattcttgctcatctacataagaagtgtccttactctgttcctttctatcccactttcaaggagggaatggctttggaagactatcagaggatgcttggttaccaagtaaaggattccaaagtggagcagcaagacaactttctaaaacgcatgtcagggatgatccgtctctacgctgctatcatccagctccggtggccatatggaaaccgacaggagattcaccctcatggcttaaatcatggatggcgctggttggcacagatcttaaacatggagcccttgtcagatgtgacagccaccctcctctttgacttcctggaggtgtgtgggaatgccctcatgaagcaataccaggttcagttctggaagatgctaattctcatcaaagaggactactttcccagaattgaagctatcacaagctcaggacagatgggctccttcatacgcctcaagcagttcttggagaaatgtttgcaacacaaggacattcctgtccccaagggctttctgacttcctccttctggcgctcctgatgtcactccatcacccaccatcaccgctgctgcaaagaggcaataataaaggaactgaagacagctgtatttgggagaagtcatgtcagattcagaaatttgccattatgtatttttatgtatttatgccttgtgactaggagaggagattttcatgggtcacaaaattcttggaggtcccttagtagatttggtagttccttaagagatccacgtgataaaataaatggagttggcctttcttgttttttgcaaaagtgataaaaggtctttagcacttggtctcctcccttgtctctagtgtctttcagaaagttggcaataccttaacaaatgcactctgagctggagggagcccaccatttgcacccacctacccaccctcacccctgttcagatgaatttccagaaagagctaaggctcataaggttcccttttaagtattatttaatagttgaggccagatacttacatgcaagtctgggttatggttgttttgcctttctcagcttgtgaagtcattctaaagctagaggaagtatgtgatatacacatggactaaggctcaggtgacactatggctagattaacatctgggattaggactggaaacacatgtcattttgaactaagggaaactctttgtcatcctaatttggaatttggtccctggatggctagggatccatgaaccaggcaggtaccttttttgtttttgttttgttttgtttcttttctgtttgaattaagatgggctaagatggggcttgcaacattaaacatgagctgagcatccataagcattgaattgggattaaataaagatgttgggcaggaactgaacactgctaatatgatgataaatatgcctgactaaagccactacagaaatccagagattggctgttaaaatttgttttgtggaaagactaattctctttgatactgcagaggcagtggccatggatctgttcctctgtgctaaatgtcttgtggcagggtgtgtttgtgggggagtgttcactggtactcttgagtggcctgaagtgacccattctatgaattgttaattaaggtgccaaaaaaaattaataataaagcttggttttttgaaaaa

SEQ ID NO: 12111 - DNA, 2218 bp, Homo sapiens
ggccttcccggcggctgattcgagggcttgtttggtcagaaggggggcgtcagagaagctgccccttagccaaccatgccgtctgagggtcgctgctgggagaccttgaaggccctacgcagttccgacaaaggtcgcctttgctactaccgcgactggctgctgcggcgcgaggatgttttagaagaatgtatgtctcttcccaagctatcttcttattctggatgggtggtagagcacgtcctaccccatatgcaggagaaccaacctctgtctgagacttcgccatcctctacgtcagcttcagccctagatcaaccctcatttgttcccaaatctcctgacgcaagctctgccttttccccagcctcccctgcaacaccaaatggaaccaagggcaaagatgagtcccagcacacagaatctatggtacttcagtcctcacgggggatcaaagtggaaggctgcgtccgaatgtacgaactggtacacagaatgaaaggaacagagggcctgaggctatggcaggaggagcaggagaggaaggtgcaagccctctcggagatggcatctgaacaactgaagcggtttgatgaatggaaggaactgaagcagcataaagaattccaggacttgcgggaagtaatggagaagagctccagagaagccttgggacaccaagagaagctaaaagctgagcaccgtcacagagcaaagattctcaacctgaagctgcgggaagcagagcagcagcgcgtgaagcaagcagaacaggagcggcttcggaaggaagaaggccagatccgcctgcgggccctctatgctctgcaggaggagatgctgcagctcagccagcagctggatgcctctgagcagcacaaagccctgcttaaggtcgacctggctgccttccagacccgaggcaaccagctgtgcagcctcatctcagggatcatccgggcctcttcagagagcagctatcccacagcagagagtcaagctgaggctgagcgagctctgcgggaaatgcgggacctcctgatgaacttggggcaggagatcaccagagcctgcgaagacaagaggaggcaggatgaagaagaggcccaggtaaagctgcaagaggcacagatgcagcagggaccagaggcccacaaagagcccccagctcccagccagggcccaggagggaaacagaatgaagacctccaggtgaaggtacaagacattacaatgcagtggtaccagcagctgcaggatgcttccatgcagtgtgtgttgacctttgagggcctgaccaacagcaaggacagtcaggccaaaaagataaagatggacctccagaaggctgctaccatcccagtgagccaaatctctaccattgcaggctcaaaactgaaggagatctttgacaagatccacagcctgctctctggaaaacctgttcaatctggtgggcgctctgtgtctgtcacacttaacccacaggggctggactttgttcaatacaaactggcagagaaatttgtgaaacaaggcgaggaggaagtggcctctcaccatgaagcagcattccccattgcagttgtggcatccgggatctgggagctccaccccagagtgggggacctcattcttgctcatctacataagaagtgtccttactctgttcctttctatcccactttcaaggagggaatggctttggaagactatcagaggatgcttggttaccaagtaaaggattccaaagtggagcagcaagacaactttctaaaacgcatgtcagggatgatccgtctctacgctgctatcatccagctccggtggccatatggaaaccgacaggagattcaccctcatggcttaaatcatggatggcgctggttggcacagatcttaaacatggagcccttgtcagatgtgacagccaccctcctctttgacttcctggaggtgtgtgggaatgccctcatgaagcaataccaggttcagttctggaagatgctaattctcatcaaagaggactactttcccaggtatcaggcttgttgagcagacagcaggggattaagtaactcataaccaggcctcagatacccaagggtgctattacctgctggttttgattcaagttaaaaacacctgtactaagtatgacatctttcctactccagtccctctcgttgatatttgaataaatgcttttgaaccttaa

SEQ ID NO: 12112 - DNA, 2242 bp, Homo sapiens
atgccgtctgagggtcgctgctgggagaccttgaaggccctacgcagttccgacaaaggtcgcctttgctactaccgcgactggctgctgcggcgcgaggatgttttagaagaatgtatgtctcttcccaagctatcttcttattctggatgggtggtagagcacgtcctaccccatatgcaggagaaccaacctctgtctgagacttcgccatcctctacgtcagcttcagccctagatcaaccctcatttgttcccaaatctcctgacgcaagctctgccttttccccagcctcccctgcaacaccaaatggaaccaagggcaaagatgagtcccagcacacagaatctatggtacttcagtcctcacgggggatcaaagtggaaggctgcgtccgaatgtacgaactggtacacagaatgaaaggaacactccagagaagccttgggacaccaagagaagctaaaagctgagcaccgtcacagagcaaagattctcaacctgaagctgcgggaagcagagcagcagcgcgtgaagcaagcagaacaggagcggcttcggaaggaagaaggccagatccgcctgcgggccctctatgctctgcaggaggagatgctgcagctcagccagcagctggatgcctctgagcagcacaaagccctgcttaaggtcgacctggctgccttccagacccgaggcaaccagctgtgcagcctcatctcagggatcatccgggcctcttcagagagcagctatcccacagcagagagtcaagctgaggctgagcgagctctgcgggaaatgcgggacctcctgatgaacttggggcaggagatcaccagagcctgcgaagacaagaggaggcaggatgaagaagaggcccaggtaaagctgcaagaggcacagatgcagcagggaccagaggcccacaaagagcccccagctcccagccagggcccaggagggaaacagaatgaagacctccaggtgaaggtacaagacattacaatgcagtggtaccagcagctgcaggatgcttccatgcagtgtgtgttgacctttgagggcctgaccaacagcaaggacagtcaggccaaaaagataaagatggacctccagaaggctgctaccatcccagtgagccaaatctctaccattgcaggctcaaaactgaaggagatctttgacaagatccacagcctgctctctggaaaacctgttcaatctggtgggcgctctgtgtctgtcacacttaacccacaggggctggactttgttcaatacaaactggcagagaaatttgtgaaacaaggcgaggaggaagtggcctctcaccatgaagcagcattccccattgcagttgtggcatccgggatctgggagctccaccccagagtgggggacctcattcttgctcatctacataagaagtgtccttactctgttcctttctatcccactttcaaggagggaatggctttggaagactatcagaggatgcttggttaccaagtaaaggattccaaagtggagcagcaagacaactttctaaaacgcatgtcagggatgatccgtctctacgctgctatcatccagctccggtggccatatggaaaccgacaggagattcaccctcatggcttaaatcatggatggcgctggttggcacagatcttaaacatggagcccttgtcagatgtgacagccaccctcctctttgacttcctggaggtgtgtgggaatgccctcatgaagcaataccaggttcagttctggaagatgctaattctcatcaaagaggactactttcccagaattgaagctatcacaagctcaggacagatgggctccttcatacgcctcaagcagttcttggagaaatgtttgcaacacaaggacattcctgtccccaagggctttctgacttcctccttctggcgctcctgatgtcactccatcacccaccatcaccgctgctgcaaagaggcaataataaaggaactgaagacagctgtatttgggagaagtcatgtcagattcagaaatttgccattatgtatttttatgtatttatgccttgtgactaggagaggagattttcatgggtcacaaaattcttggaggtcccttagtagatttggtagttccttaagagatccacgtgataaaataaatggagttggcctttcttgttttttgcaaaagtgataaaaggtctttagcacttggtctcctcccttg

SEQ ID NO: 12113 - DNA, 3504 bp, Homo sapiens
gattgccacccaggacgatgagcggctgagatggagacgtctgcctcagccactgcctccgagaagcaagaagccaaaagtgggatcctggaggccgctggcttccccgacccgggtaaaaaggcctctcctttggtggtggctgcagcggcagcagcagcggtagctgcccaaggagtgccgcagcatctcttgccaccattccatgcgcccctaccgattgacatgcgacaccaggaaggaaggtaccattacgagcctcattctgtccacggtgtgcacgggccccctgccctcagcggcagccctgtcatctctgacatctccttgatccggctttccccgcacccggctggccctggggagtcccccttcaacgccccccacccgtacgtgaacccccacatggagcactacctccgttctgtgcacagcagccccacgctctccatgatctctgcagccaggggcctcagccccgctgatgtggcccaggagcaccttaaggagaggggactgtttggccttcctgctccaggcaccaccccctcagactattaccaccagatgaccctcgtggcaggccaccccgcgccctacggggacctgctgatgcagagcgggggcgctgccagcgcaccccatctccacgactacctcaaccccgtggacgtgtcccgtttctccagcccgcgggtgacgccccgcctgagccgcaagcgggcgctgtccatctccccactctcagacgccagcctggacctgcagcggatgatccgcacctcacccaactcgctagtggcctacatcaacaactcccgaagcagctcggcggccagcggttcctacgggcatctgtcagcgggtgccctcagcccagccttcaccttcccccaccccatcaaccccgtggcctaccagcagattctgagccagcagaggggtctggggtcagcctttggacacacaccacccctgatccagccctcacccaccttcctggcccagcagcccatggccctcacctccatcaatgccacgcccacccagctcagcagcagcagcaactgtctgagtgacaccaaccagaacaagcagagcagtgagtcggccgtcagcagcaccgtcaaccctgtcgccattcacaagcgcagcaaggtcaagaccgagcctgagggcctgcggccggcctcccctctggcgctgacgcagggccaggtgtctggacacggctcatgtgggtgtgcccttcccctctcccaggagcagctggctgacctcaaggaagatctggacagggatgactgtaagcaggaggctgaggtggtcatctatgagaccaactgccactgggaagactgcaccaaggagtacgacacccaggagcagctggtgcatcacatcaacaacgagcacatccacggggagaagaaggagtttgtgtgccgctggcaggcctgcacgcgggagcagaagcccttcaaggcgcagtacatgctggtggtgcacatgcggcgacacacgggcgagaagccccacaagtgcacgttcgagggctgctcgaaggcctactcccgcctggagaacctgaagacacacctgcggtcccacaccggggagaagccatatgtgtgtgagcacgagggctgcaacaaagccttctccaacgcctcggaccgcgccaagcaccagaatcgcacccactccaacgagaaaccctacatctgcaagatcccaggctgcaccaagagatacacagaccccagctctctccggaagcatgtgaaaacggtccacggcccagatgcccacgtcaccaagaagcagcgcaatgacgtgcacctccgcacaccgctgctcaaagagaatggggacagtgaggccggcacggagcctggcggcccagagagcaccgaggccagcagcaccagccaggccgtggaggactgcctgcacgtcagagccatcaagaccgagagctccgggctgtgtcagtccagccccggggcccagtcgtcctgcagcagcgagccctctcctctgggcagtgcccccaacaatgacagtggcgtggagatgccggggacggggcccgggagcctgggagacctgacggcactggatgacacacccccaggggccgacacctcagccctggctgccccctccgctggtggcctccagctgcgcaaacacatgaccaccatgcaccggttcgagcagctcaagaaggagaagctcaagtcactcaaggattcctgctcatgggccgggccgactccacacacgcggaacaccaagctgcctcccctcccgggaagtggctccatcctggaaaacttcagtggcagtgggggcggcgggcccgcggggctgctgccgaacccgcggctgtcggagctgtccgcgagcgaggtgaccatgctgagccagctgcaggagcgccgcgacagctccaccagcacggtcagctcggcctacaccgtgagccgccgctcctccggcatctccccctacttctccagccgccgctccagcgaggcctcgcccctgggcgccggccgcccgcacaacgcgagctccgctgactcctacgaccccatctccacggacgcgtcgcggcgctcgagcgaggccagccagtgcagcggcggctccgggctgctcaacctcacgccggcgcagcagtacagcctgcgggccaagtacgcggcagccactggcggccccccgcccactccgctgccgggcctggagcgcatgagcctgcggaccaggctggcgctgctggacgcgcccgagcgcacgctgcccgccggctgcccacgcccactggggccgcggcgtggcagcgacgggccgacctatggccacggccacgcgggggctgcgcccgccttcccccacgaggctccaggcggcggagccaggcgggccagcgaccctgtgcggcggcccgatgccctgtccctgccgcgggtgcagcgcttccacagcacccacaacgtgaaccccggcccgctgccgccctgtgccgacaggcgaggcctccgcctgcagagccacccgagcaccgacggcggcctggcccgcggcgcctactcgccccggccgcctagcatcagcgagaacgtggcgatggaggccgtggcggcaggagtggacggcgcggggcccgaggccgacctggggctgccggaggacgacctggtgcttccagacgacgtggtgcagtacatcaaggcgcacgccagtggcgctctggacgagggcaccgggcaggtgtatcccacggaaagcactggcttctctgacaaccccagactacccagcccggggctgcacggccagcgcaggatggtggctgcggactccaacgtgggcccctccgcccctatgctgggaggatgccagttaggctttggggcgccctccagcctgaacaaaaataacatgcctgtgcagtggaatgaggcatcagcaacatggctgtcggggacatga

SEQ ID NO: 12114 - DNA, 6768 bp, Homo sapiens
gattgccacccaggacgatgagcggctgagatggagacgtctgcctcagccactgcctccgagaagcaagaagccaaaagtgggatcctggaggccgctggcttccccgacccgggtaaaaaggcctctcctttggtggtggctgcagcggcagcagcagcggtagctgcccaaggagtgccgcagcatctcttgccaccattccatgcgcccctaccgattgacatgcgacaccaggaaggaaggtaccattacgagcctcattctgtccacggtgtgcacgggccccctgccctcagcggcagccctgtcatctctgacatctccttgatccggctttccccgcacccggctggccctggggagtcccccttcaacgccccccacccgtacgtgaacccccacatggagcactacctccgttctgtgcacagcagccccacgctctccatgatctctgcagccaggggcctcagccccgctgatgtggcccaggagcaccttaaggagaggggactgtttggccttcctgctccaggcaccaccccctcagactattaccaccagatgaccctcgtggcaggccaccccgcgccctacggggacctgctgatgcagagcgggggcgctgccagcgcaccccatctccacgactacctcaaccccgtggacgtgtcccgtttctccagcccgcgggtgacgccccgcctgagccgcaagcgggcgctgtccatctccccactctcagacgccagcctggacctgcagcggatgatccgcacctcacccaactcgctagtggcctacatcaacaactcccgaagcagctcggcggccagcggttcctacgggcatctgtcagcgggtgccctcagcccagccttcaccttcccccaccccatcaaccccgtggcctaccagcagattctgagccagcagaggggtctggggtcagcctttggacacacaccacccctgatccagccctcacccaccttcctggcccagcagcccatggccctcacctccatcaatgccacgcccacccagctcagcagcagcagcaactgtctgagtgacaccaaccagaacaagcagagcagtgagtcggccgtcagcagcaccgtcaaccctgtcgccattcacaagcgcagcaaggtcaagaccgagcctgagggcctgcggccggcctcccctctggcgctgacgcagggccaggtgtctggacacggctcatgtgggtgtgcccttcccctctcccaggagcagctggctgacctcaaggaagatctggacagggatgactgtaagcaggaggctgaggtggtcatctatgagaccaactgccactgggaagactgcaccaaggagtacgacacccaggagcagctggtgcatcacatcaacaacgagcacatccacggggagaagaaggagtttgtgtgccgctggcaggcctgcacgcgggagcagaagcccttcaaggcgcagtacatgctggtggtgcacatgcggcgacacacgggcgagaagccccacaagtgcacgttcgagggctgctcgaaggcctactcccgcctggagaacctgaagacacacctgcggtcccacaccggggagaagccatatgtgtgtgagcacgagggctgcaacaaagccttctccaacgcctcggaccgcgccaagcaccagaatcgcacccactccaacgagaaaccctacatctgcaagatcccaggctgcaccaagagatacacagaccccagctctctccggaagcatgtgaaaacggtccacggcccagatgcccacgtcaccaagaagcagcgcaatgacgtgcacctccgcacaccgctgctcaaagagaatggggacagtgaggccggcacggagcctggcggcccagagagcaccgaggccagcagcaccagccaggccgtggaggactgcctgcacgtcagagccatcaagaccgagagctccgggctgtgtcagtccagccccggggcccagtcgtcctgcagcagcgagccctctcctctgggcagtgcccccaacaatgacagtggcgtggagatgccggggacggggcccgggagcctgggagacctgacggcactggatgacacacccccaggggccgacacctcagccctggctgccccctccgctggtggcctccagctgcgcaaacacatgaccaccatgcaccggttcgagcagctcaagaaggagaagctcaagtcactcaaggattcctgctcatgggccgggccgactccacacacgcggaacaccaagctgcctcccctcccgggaagtggctccatcctggaaaacttcagtggcagtgggggcggcgggcccgcggggctgctgccgaacccgcggctgtcggagctgtccgcgagcgaggtgaccatgctgagccagctgcaggagcgccgcgacagctccaccagcacggtcagctcggcctacaccgtgagccgccgctcctccggcatctccccctacttctccagccgccgctccagcgaggcctcgcccctgggcgccggccgcccgcacaacgcgagctccgctgactcctacgaccccatctccacggacgcgtcgcggcgctcgagcgaggccagccagtgcagcggcggctccgggctgctcaacctcacgccggcgcagcagtacagcctgcgggccaagtacgcggcagccactggcggccccccgcccactccgctgccgggcctggagcgcatgagcctgcggaccaggctggcgctgctggacgcgcccgagcgcacgctgcccgccggctgcccacgcccactggggccgcggcgtggcagcgacgggccgacctatggccacggccacgcgggggctgcgcccgccttcccccacgaggctccaggcggcggagccaggcgggccagcgaccctgtgcggcggcccgatgccctgtccctgccgcgggtgcagcgcttccacagcacccacaacgtgaaccccggcccgctgccgccctgtgccgacaggcgaggcctccgcctgcagagccacccgagcaccgacggcggcctggcccgcggcgcctactcgccccggccgcctagcatcagcgagaacgtggcgatggaggccgtggcggcaggagtggacggcgcggggcccgaggccgacctggggctgccggaggacgacctggtgcttccagacgacgtggtgcagtacatcaaggcgcacgccagtggcgctctggacgagggcaccgggcaggtgtatcccacggaaagcactggcttctctgacaaccccagactacccagcccggggctgcacggccagcgcaggatggtggctgcggactccaacgtgggcccctccgcccctatgctgggaggatgccagttaggctttggggcgccctccagcctgaacaaaaataacatgcctgtgcagtggaatgaggtgagctccggcaccgtagacgccctggccagccaggtgaagcctccaccctttcctcagggcaacctggcggtggtgcagcagaagcctgcctttggccagtacccgggctacagtccgcaaggcctacaggctagccctgggggcctggacagcacgcagccacacctgcagccccgcagcggagccccctcccagggcatccccagggtaaactacatgcagcagctgcgacagccagtggcaggcagccagtgtcctggcatgactaccactatgagcccccatgcctgctatggccaagtccacccccagctgagccccagcaccatcagtggggccctcaaccagttcccccaatcctgcagcaacatgccagccaagccagggcatctggggcaccctcagcagacagaagtggcacctgaccccaccacgatgggcaatcgccacagggaacttggggtccccgattcagccctggctggagtgccaccacctcacccagtccagagctacccacagcagagccatcacctggcagcctccatgagccaggagggctaccaccaggtccccagccttctgcctgcccgccagcctggcttcatggagccccaaacaggcccgatgggggtggctacagcaggctttggcctagtgcagccccggcctcccctcgagcccagccccactggccgccaccgtggggtacgtgctgtgcagcagcagctggcctacgccagggccacaggccatgccatggctgccatgccgtccagtcaggaaacagcagaggctgtgcccaagggagcgatgggcaacatggggtcggtgcctccccagccgcctccgcaggacgcaggtggggccccggaccacagcatgctctactactacggccagatccacatgtacgaacaggatggaggcctggagaacctcgggagctgccaggtcatgcggtcccagccaccacagccacaggcctgtcaggacagcatccagccccagcccttgccctcaccaggggtcaaccaggtgtccagcactgtggactcccagctcctggaggccccccagattgacttcgatgccatcatggatgatggcgatcactcgagtttgttctcgggtgctctgagccccagcctcctccacagcctctcccagaactcctcccgcctcaccaccccccgaaactccttgaccctgccctccatccccgcaggcatcagcaacatggctgtcggggacatgagctccatgctcaccagcctcgccgaggagagcaagttcctgaacatgatgacctagaggcccgagcgcctggtgctgagtgcacccggaggggtcatcgctgcccagagcctggggattccagctgtcttgtctttttccaaaaaagtgttaaataggcttgaggggttgttgcgcaatggccgcttcagatgacagatgttgtaagagaaggtttatgggcatcctctctggtcttttggattattcctcagaacaatgaaaaaagtctccataggacaggaaggaatgcaaaactcatttacacagtgctttccagcctttggtgcttacaggaccgcgctgttccggcttcttcacggctgacattcggctaacgagggattactttggccaaaacctttcaaaggatatgcagaaagatggtagggagcatttgggtttgaatctgaatgctatactggatactctgctccggaaagatgagctttttattctactacttggaaggaaaaggaattcctggtccacctgaattcctctatgaagcctaactcttgaggtctctaacataccttgtcatagaggaaaagcacagattatacctggatgattcaggagcacattctgattccaggtttggtagagctggctcttctactccgtaaagccgagtctgggactggcagcccatccaagtgtatatgaatgaataaagcatccaagtatatatgaatgaataaagtatgtaagtatcaccagaaaaaggaaagaaaaaatgtactccttggggcaagcccagaagctgccctggcctctccagaccgtgtttacagtgtttgcatgtagaatgtagcccttcctgaaaagaagacttgtttctaaatacctcggggctgctggagccgctgtgggttagggatggactgaggcctcgaggagtgagggtgcacccggggcccagcctcaggctgccctagggatctctcagtaggaagaggaagttgcgtgtttacccaatcctgtttctccaatgcaacgtccacccactttaccaccaaaaactccagggcctgacggcagcccggtcccccagcactcaccagcagcccagtgttctccaccaagccacagtgtgcatgcctggtatcctccggattcccttccttctgcccgctgagtcactgggcagagaatgatgacatgtgtaggtggtgtggttgggggtggaaaggggaaggggttgatcctcaggactctgagggagcatcgttgaattttcctgttcagtgtgaccaagacccacctggaaatggaatttggaactggcttcaggagacatcattcctgaacacactgtagggtgaattggtgcatcttccccaccatacacacacacacacacacacacacacacacacacacacacacaccccaaaccttttcatggggaatgtgtggcaaccttgccaaacagcaccactcagagtgtgactctgactgtgaccttggccttaatgaggaacttcttaggagagtttgaggacaaggccaacatcgtcatctgggctcgctgcgtcccagcacatcaaactctgtccagagacaaggccaactgcaaatgaaagccagggaacattgctaagggtctgtggctctgtggtggtgttcatcgccttcctgagataggatttcccttgccagtcccaacctgtatatattctgtacagaagacatccctgaatatactgtaggtgagtcgtccagccaaatttatatctccaaaacatttttagctttttctacatgctatgaattgagatgacatgctcaacttgtaaataagtctttttgtacattaaaaaagtaattttttcataatttatcttgtctatctgcttcccccttgacagtagttaatgagaacctgggcagtaaatttggtgcattcgagcagaaattaggctgtattttttcttaacagtgtcaaaattgactatcccgcctttgccaagaaatgtttaatgctgaggc

SEQ ID NO: 12115 - DNA, 315 bp, Homo sapiens
ggccacctgcgtgctagaggcaaacttttgtctctctcggattgccacccaggacgatgagcggctgagatggagacgtctgcctcagccactgcctccgagaagcaagaagccaaaagtgggatcctggaggccgctggcttccccgacccgggtaaaaaggcctctcctttggtggtggctgcagcggcagcagcagcggtagctgcccaaggagtgccgcagcatctcttgccaccattccatgcgcccctaccgattgacatgcgacaccaggaaggaaggtaccattacgagcctcattctgtccacggt

SEQ ID NO: 12116 - DNA, 2354 bp, Homo sapiens
ccacccaggacgatgagcggctgagatggagacgtctgcctcagccactgcctccgagaagcaagaagccaaaagtgggatcctggaggccgctggcttccccgacccgggtaaaaaggcctctcctttggtggtggctgcagcggcagcagcagcggtagctgcccaaggagtgccgcagcatctcttgccaccattccatgcgcccctaccgattgacatgcgacaccaggaaggaaggtaccattacgagcctcattctgtccacggtgtgcacggtgtcccgtttctccagcccgcgggtgacgccccgcctgagccgcaagcgggcgctgtccatctccccactctcagacgccagcctggacctgcagcggatgatccgcacctcacccaactcgctagtggcctacatcaacaactcccgaagcagctcggcggccagcggttcctacgggcatctgtcagcgggtgccctcagcccagccttcaccttcccccaccccatcaaccccgtggcctaccagcagattctgagccagcagaggggtctggggtcagcctttggacacacaccacccctgatccagccctcacccaccttcctggcccagcagcccatggccctcacctccatcaatgccacgcccacccagctcagcagcagcagcaactgtctgagtgacaccaaccagaacaagcagagcagtgagtcggccgtcagcagcaccgtcaaccctgtcgccattcacaagcgcagcaaggtcaagaccgagcctgagggcctgcggccggcctcccctctggcgctgacgcaggagcagctggctgacctcaaggaagatctggacagggatgactgtaagcaggaggctgaggtggtcatctatgagaccaactgccactgggaagactgcaccaaggagtacgacacccaggagcagctggtgcatcacatcaacaacgagcacatccacggggagaagaaggagtttgtgtgccgctggcaggcctgcacgcgggagcagaagcccttcaaggcgcagtacatgctggtggtgcacatgcggcgacacacgggcgagaagccccacaagtgcacgttcgagggctgctcgaaggcctactcccgcctggagaacctgaagacacacctgcggtcccacaccggggagaagccatatgtgtgtgagcacgagggctgcaacaaagccttctccaacgcctcggaccgcgccaagcaccagaatcgcacccactccaacgagaaaccctacatctgcaagatcccaggctgcaccaagagatacacagaccccagctctctccggaagcatgtgaaaacggtccacggcccagatgcccacgtcaccaagaagcagcgcaatgacgtgcacctccgcacaccgctgctcaaagagaatggggacagtgaggccggcacggagcctggcggcccagagagcaccgaggccagcagcaccagccaggccgtggaggactgcctgcacgtcagagccatcaagaccgagagctccgggctgtgtcagtccagccccggggcccagtcgtcctgcagcagcgagccctctcctctgggcagtgcccccaacaatgacagtggcgtggagatgccggggacggggcccgggagcctgggagacctgacggcactggatgacacacccccaggggccgacaccacagccacaggcctgtcaggacagcatccagccccagcccttgccctcaccaggggtcaaccaggtgtccagcactgtggactcccagctcctggaggccccccagattgacttcgatgccatcatggatgatggcgatcactcgagtttgttctcgggtgctctgagccccagcctcctccacagcctctcccagaactcctcccgcctcaccaccccccgaaactccttgaccctgccctccatccccgcaggcatcagcaacatggctgtcggggacatgagctccatgctcaccagcctcgccgaggagagcaagttcctgaacatgatgacctagaggcccgagcgcctggtgctgagtgcacccggaggggtcatcgctgcccagagcctggggattccagctgtcttgtctttttccaaaaaagtgttaaataggcttgaggggttgttgcgcaatggccgcttcagatgacagatgttgtaagagaaggtttatgggcatcctctctggtcttttggattattcctcagaacaatgaaaaaagtctccataggacaggaaggaatgcaaaactcatttacacagtgctttccagcctttggtgcttacaggaccgcgctgttccggcttcttcacggctgaca

SEQ ID NO: 12117 - DNA, 6799 bp, Homo sapiens
tgctgctttaccgacacatcaaagagcaaggattgccacccaggacgatgagcggctgagatggagacgtctgcctcagccactgcctccgagaagcaagaagccaaaagtgggatcctggaggccgctggcttccccgacccgggtaaaaaggcctctcctttggtggtggctgcagcggcagcagcagcggtagctgcccaaggagtgccgcagcatctcttgccaccattccatgcgcccctaccgattgacatgcgacaccaggaaggaaggtaccattacgagcctcattctgtccacggtgtgcacgggccccctgccctcagcggcagccctgtcatctctgacatctccttgatccggctttccccgcacccggctggccctggggagtcccccttcaacgccccccacccgtacgtgaacccccacatggagcactacctccgttctgtgcacagcagccccacgctctccatgatctctgcagccaggggcctcagccccgctgatgtggcccaggagcaccttaaggagaggggactgtttggccttcctgctccaggcaccaccccctcagactattaccaccagatgaccctcgtggcaggccaccccgcgccctacggggacctgctgatgcagagcgggggcgctgccagcgcaccccatctccacgactacctcaaccccgtggacgtgtcccgtttctccagcccgcgggtgacgccccgcctgagccgcaagcgggcgctgtccatctccccactctcagacgccagcctggacctgcagcggatgatccgcacctcacccaactcgctagtggcctacatcaacaactcccgaagcagctcggcggccagcggttcctacgggcatctgtcagcgggtgccctcagcccagccttcaccttcccccaccccatcaaccccgtggcctaccagcagattctgagccagcagaggggtctggggtcagcctttggacacacaccacccctgatccagccctcacccaccttcctggcccagcagcccatggccctcacctccatcaatgccacgcccacccagctcagcagcagcagcaactgtctgagtgacaccaaccagaacaagcagagcagtgagtcggccgtcagcagcaccgtcaaccctgtcgccattcacaagcgcagcaaggtcaagaccgagcctgagggcctgcggccggcctcccctctggcgctgacgcagggccaggtgtctggacacggctcatgtgggtgtgcccttcccctctcccaggagcagctggctgacctcaaggaagatctggacagggatgactgtaagcaggaggctgaggtggtcatctatgagaccaactgccactgggaagactgcaccaaggagtacgacacccaggagcagctggtgcatcacatcaacaacgagcacatccacggggagaagaaggagtttgtgtgccgctggcaggcctgcacgcgggagcagaagcccttcaaggcgcagtacatgctggtggtgcacatgcggcgacacacgggcgagaagccccacaagtgcacgttcgagggctgctcgaaggcctactcccgcctggagaacctgaagacacacctgcggtcccacaccggggagaagccatatgtgtgtgagcacgagggctgcaacaaagccttctccaacgcctcggaccgcgccaagcaccagaatcgcacccactccaacgagaaaccctacatctgcaagatcccaggctgcaccaagagatacacagaccccagctctctccggaagcatgtgaaaacggtccacggcccagatgcccacgtcaccaagaagcagcgcaatgacgtgcacctccgcacaccgctgctcaaagagaatggggacagtgaggccggcacggagcctggcggcccagagagcaccgaggccagcagcaccagccaggccgtggaggactgcctgcacgtcagagccatcaagaccgagagctccgggctgtgtcagtccagccccggggcccagtcgtcctgcagcagcgagccctctcctctgggcagtgcccccaacaatgacagtggcgtggagatgccggggacggggcccgggagcctgggagacctgacggcactggatgacacacccccaggggccgacacctcagccctggctgccccctccgctggtggcctccagctgcgcaaacacatgaccaccatgcaccggttcgagcagctcaagaaggagaagctcaagtcactcaaggattcctgctcatgggccgggccgactccacacacgcggaacaccaagctgcctcccctcccgggaagtggctccatcctggaaaacttcagtggcagtgggggcggcgggcccgcggggctgctgccgaacccgcggctgtcggagctgtccgcgagcgaggtgaccatgctgagccagctgcaggagcgccgcgacagctccaccagcacggtcagctcggcctacaccgtgagccgccgctcctccggcatctccccctacttctccagccgccgctccagcgaggcctcgcccctgggcgccggccgcccgcacaacgcgagctccgctgactcctacgaccccatctccacggacgcgtcgcggcgctcgagcgaggccagccagtgcagcggcggctccgggctgctcaacctcacgccggcgcagcagtacagcctgcgggccaagtacgcggcagccactggcggccccccgcccactccgctgccgggcctggagcgcatgagcctgcggaccaggctggcgctgctggacgcgcccgagcgcacgctgcccgccggctgcccacgcccactggggccgcggcgtggcagcgacgggccgacctatggccacggccacgcgggggctgcgcccgccttcccccacgaggctccaggcggcggagccaggcgggccagcgaccctgtgcggcggcccgatgccctgtccctgccgcgggtgcagcgcttccacagcacccacaacgtgaaccccggcccgctgccgccctgtgccgacaggcgaggcctccgcctgcagagccacccgagcaccgacggcggcctggcccgcggcgcctactcgccccggccgcctagcatcagcgagaacgtggcgatggaggccgtggcggcaggagtggacggcgcggggcccgaggccgacctggggctgccggaggacgacctggtgcttccagacgacgtggtgcagtacatcaaggcgcacgccagtggcgctctggacgagggcaccgggcaggtgtatcccacggaaagcactggcttctctgacaaccccagactacccagcccggggctgcacggccagcgcaggatggtggctgcggactccaacgtgggcccctccgcccctatgctgggaggatgccagttaggctttggggcgccctccagcctgaacaaaaataacatgcctgtgcagtggaatgaggtgagctccggcaccgtagacgccctggccagccaggtgaagcctccaccctttcctcagggcaacctggcggtggtgcagcagaagcctgcctttggccagtacccgggctacagtccgcaaggcctacaggctagccctgggggcctggacagcacgcagccacacctgcagccccgcagcggagccccctcccagggcatccccagggtaaactacatgcagcagctgcgacagccagtggcaggcagccagtgtcctggcatgactaccactatgagcccccatgcctgctatggccaagtccacccccagctgagccccagcaccatcagtggggccctcaaccagttcccccaatcctgcagcaacatgccagccaagccagggcatctggggcaccctcagcagacagaagtggcacctgaccccaccacgatgggcaatcgccacagggaacttggggtccccgattcagccctggctggagtgccaccacctcacccagtccagagctacccacagcagagccatcacctggcagcctccatgagccaggagggctaccaccaggtccccagccttctgcctgcccgccagcctggcttcatggagccccaaacaggcccgatgggggtggctacagcaggctttggcctagtgcagccccggcctcccctcgagcccagccccactggccgccaccgtggggtacgtgctgtgcagcagcagctggcctacgccagggccacaggccatgccatggctgccatgccgtccagtcaggaaacagcagaggctgtgcccaagggagcgatgggcaacatggggtcggtgcctccccagccgcctccgcaggacgcaggtggggccccggaccacagcatgctctactactacggccagatccacatgtacgaacaggatggaggcctggagaacctcgggagctgccaggtcatgcggtcccagccaccacagccacaggcctgtcaggacagcatccagccccagcccttgccctcaccaggggtcaaccaggtgtccagcactgtggactcccagctcctggaggccccccagattgacttcgatgccatcatggatgatggcgatcactcgagtttgttctcgggtgctctgagccccagcctcctccacagcctctcccagaactcctcccgcctcaccaccccccgaaactccttgaccctgccctccatccccgcaggcatcagcaacatggctgtcggggacatgagctccatgctcaccagcctcgccgaggagagcaagttcctgaacatgatgacctagaggcccgagcgcctggtgctgagtgcacccggaggggtcatcgctgcccagagcctggggattccagctgtcttgtctttttccaaaaaagtgttaaataggcttgaggggttgttgcgcaatggccgcttcagatgacagatgttgtaagagaaggtttatgggcatcctctctggtcttttggattattcctcagaacaatgaaaaaagtctccataggacaggaaggaatgcaaaactcatttacacagtgctttccagcctttggtgcttacaggaccgcgctgttccggcttcttcacggctgacattcggctaacgagggattactttggccaaaacctttcaaaggatatgcagaaagatggtagggagcatttgggtttgaatctgaatgctatactggatactctgctccggaaagatgagctttttattctactacttggaaggaaaaggaattcctggtccacctgaattcctctatgaagcctaactcttgaggtctctaacataccttgtcatagaggaaaagcacagattatacctggatgattcaggagcacattctgattccaggtttggtagagctggctcttctactccgtaaagccgagtctgggactggcagcccatccaagtgtatatgaatgaataaagcatccaagtatatatgaatgaataaagtatgtaagtatcaccagaaaaaggaaagaaaaaatgtactccttggggcaagcccagaagctgccctggcctctccagaccgtgtttacagtgtttgcatgtagaatgtagcccttcctgaaaagaagacttgtttctaaatacctcggggctgctggagccgctgtgggttagggatggactgaggcctcgaggagtgagggtgcacccggggcccagcctcaggctgccctagggatctctcagtaggaagaggaagttgcgtgtttacccaatcctgtttctccaatgcaacgtccacccactttaccaccaaaaactccagggcctgacggcagcccggtcccccagcactcaccagcagcccagtgttctccaccaagccacagtgtgcatgcctggtatcctccggattcccttccttctgcccgctgagtcactgggcagagaatgatgacatgtgtaggtggtgtggttgggggtggaaaggggaaggggttgatcctcaggactctgagggagcatcgttgaattttcctgttcagtgtgaccaagacccacctggaaatggaatttggaactggcttcaggagacatcattcctgaacacactgtagggtgaattggtgcatcttccccaccatacacacacacacacacacacacacacacacacacacacacacaccccaaaccttttcatggggaatgtgtggcaaccttgccaaacagcaccactcagagtgtgactctgactgtgaccttggccttaatgaggaacttcttaggagagtttgaggacaaggccaacatcgtcatctgggctcgctgcgtcccagcacatcaaactctgtccagagacaaggccaactgcaaatgaaagccagggaacattgctaagggtctgtggctctgtggtggtgttcatcgccttcctgagataggatttcccttgccagtcccaacctgtatatattctgtacagaagacatccctgaatatactgtaggtgagtcgtccagccaaatttatatctccaaaacatttttagctttttctacatgctatgaattgagatgacatgctcaacttgtaaataagtctttttgtacattaaaaaagtaattttttcataatttatcttgtctatctgcttcccccttgacagtagttaatgagaacctgggcagtaaatttggtgcattcgagcagaaattaggctgtattttttcttaacagtgtcaaaattgactatcccgcctttgccaagaaatgtttaatgctgaggca

SEQ ID NO: 12118 - DNA, 8208 bp, Homo sapiens
gtctatgggaagttcggggacttgacagccgctgccgccgcagggcatttttggtcgaagagagctgaagtaatgagaagacatcatggaggcccagtcccacagctccacgaccactgaaaagaaaaaagttgagaattccatagtgaagtgctccactcgaacagatgtgagcgagaaagccgttgcctccagcaccacttctaatgaggatgaaagtcctggacagacttatcacagagagagaagaaacgcaatcactatgcagccacagaatgtccaggggctcagcaaagtcagtgaggaaccttcaacatcgagtgacgagagggcctcattgatcaagaaagagatccatgggtccctgccacacgtggcggagccctctgtgccgtaccgcgggacggtgtttgccatggaccccaggaatggttacatggagccccactaccaccctcctcatcttttccctgccttccatcctcctgtaccaattgatgccagacatcatgagggccgttaccattacgatccatctccgattcctccattgcatatgacttccgccttatctagtagccctacgtatccggacctgcccttcattaggatctccccacaccggaaccccactgctgcttccgagtctcccttcagccctccacatccctacattaatccctacatggactatatccgctccttgcacagcagcccatcgctctccatgatctcagcaacccgtgggctgagccctacagatgcgccccatgcaggagtcagcccagcagaatactatcatcagatggccctgctaactggccagcgcagcccctatgcagacattattccctcagctgccaccgccggcacgggggccatccacatggaatatcttcatgctatggatagcaccagattctccagccccaggctgtcagccaggccgagccgaaaacgtacactgtccatatcaccactctccgatcatagctttgaccttcagaccatgataaggacgtctcccaactccttggtcacgattctcaataattcccgtagcagctcttcagcaagtggctcctatggtcacttatctgcaagtgcaatcagccctgccttgagcttcacctactcttccgcgcccgtctctctccacatgcatcagcagatcctaagccgacaacagagcttaggttcagcctttggacacagccctccactcatccaccctgccccaacttttccaacacagaggcctattccagggatccctacggttctgaaccccgtccaggtcagctccggcccttctgagtcctcacagaacaagcccacgagtgagtctgcagtgagcagcactggtgacccgatgcacaacaagaggtccaagatcaaacccgatgaagacctccccagcccaggggctcgggggcagcaggaacagcccgaaggaacaacccttgtcaaggaggaaggggacaaagatgaaagcaaacaggagcctgaagtcatctatgagacaaactgccactgggaaggctgcgcgagggagttcgacacccaagagcagcttgtgcaccatataaataacgaccatattcatggagagaagaaggagttcgtgtgcaggtggctggactgctcaagagagcagaaacccttcaaagcccagtatatgttggtagtgcatatgagaagacacacgggcgagaagcctcacaaatgcacttttgaaggttgcacaaaggcctactcgagactagaaaacttgaaaacacacttgagatctcacactggagagaaaccatacgtctgtgagcacgaaggttgcaacaaggctttctcaaatgcctctgatcgcgccaaacaccaaaacagaacgcattccaatgagaaaccatatgtgtgcaaaatcccaggctgcactaagcgttacacagacccaagctccctccggaaacatgtgaagacagtgcatggcccagaggctcatgtcaccaagaagcagcgaggggacatccatcctcggccgccacccccgagagattccggcagccattcacagtccaggtcgcctggccgaccgactcagggagcccttggtgagcagcaggacctcagcaacactacctcaaagcgggaagaatgcctccaggtgaaaaccgtcaaggcagagaagccaatgacatctcagccaagccctggtggtcagtcttcatgcagcagccaacagtcccccatcagcaactattccaacagtgggctcgagcttcctctgaccgatggaggtagtataggagacctcagtgccatcgatgaaaccccaatcatggactcaaccatttccactgcaaccacagcccttgctttgcaagccaggagaaacccggcagggaccaaatggatggagcacgtaaaactagaaaggctaaaacaagtgaatggaatgtttccgcgactgaaccccattctaccccctaaagcccctgcggtctctcctctcataggaaatggcacacagtccaacaacacctgcagcttgggtgggcccatgacgcttctcccgggcagaagcgacctctctggggtggacgtcactatgctgaacatgctcaacagaagggacagcagcgccagcaccatcagctcggcctacctgagcagccgccgctcctcagggatctcgccctgcttctccagccgccgctccagcgaggcgtcacaggccgagggccggccgcagaacgtgagcgtggccgactcctacgaccccatctccaccgacgcctcgcgccgctccagcgaagccagccagagcgacggcctgcccagcctgctcagcctcacgcccgcccagcagtaccgcctcaaggccaagtacgcggctgccacaggagggccgccgccgacgcccctgcccaacatggagaggatgagcctgaagacgcgcctggcgctgctcggggatgccctcgagcctggcgtggccctgcctccagttcatgccccgaggaggtgcagcgacgggggagcccacggctacgggcggcgccacctgcagccgcacgatgcgccgggccacggcgtgaggagggccagcgacccggtgcggacaggctccgagggcctggccctgcctcgtgtgccgcgcttcagcagcctcagcagctgcaaccccccggcgatggccacgtccgcggagaagcgcagtctcgtgcttcagaattacacgcggcccgagggcggccagtcccgaaacttccactcgtccccctgtcctcccagcatcaccgagaacgtcaccctggagtccctgaccatggacgctgatgccaacctgaacgatgaggatttcctgccggacgacgtggtgcagtatttaaattcccagaaccaagcagggtacgagcagcacttccccagcgccctcccggacgacagcaaagtgccccacgggcccggtgactttgacgcgcccgggctgccagacagccacgctggccagcagttccatgccctcgagcagccctgccccgagggcagcaaaaccgacctgcccattcagtggaacgaagtcagctccggaagcgccgacctgtcctcctccaagctcaagtgtgggccgcggcccgctgtgccgcagactcgcgcctttgggttctgcaacggcatggtcgtccacccgcagaaccccttgaggagcgggcctgctgggggctatcagaccctcggggagaacagcaacccctacggtggcccagagcacttgatgctccacaacagccccggaagtggcaccagtggaaacgccttccatgaacagccctgtaaggccccgcagtatgggaactgtctcaacaggcagccagtggcccctggtgcactcgacggtgcctgtggtgccgggattcaagcctcaaagctgaagagcacccccatgcaagggagcgggggccagctgaatttcggcctgccggtagcgccaaatgagtcagctggcagcatggtgaatggcatgcagaaccaggacccagtgggacaggggtacctggctcaccagctcctcggcgacagcatgcagcacccgggggcaggccgccccggtcagcagatgcttgggcagattagtgctacctcacacatcaacatctaccaagggccagagagctgcctgccaggggctcacggcatgggcagccagccgtcaagcttggcagttgtcaggggctaccagccatgtgccagctttgggggcagcaggcgccaggctatgccgagggacagccttgctctgcagtcaggacagctcagtgacacaagtcagacctgcagggtgaatggtatcaagatggagatgaaagggcagccccatccgctgtgctctaatctgcagaattactctggtcagttctatgaccaaaccgtgggcttcagtcagcaagacacgaaagctggttcattctctatttcagacgccagctgcctgctacaggggaccagcgccaaaaactctgagttactttccccaggtgctaatcaggtgacaagcacagtggacagcctcgacagccatgacctggaaggggtacagattgacttcgatgccatcatagacgatggggaccactccagcctgatgtcgggggccctgagcccaagtatcattcagaacctttcccatagctcctcccgcctcaccacgcctcgggcgtccctcccattcccagcgctgtccatgagcaccaccaacatggctatcggggacatgagttctttgctgacctccctagcggaagaaagcaaattccttgcagttatgcaataggctttaggaaaaaaagactgcaaccaacggaaatcaataggagttgaagagattaaactgactttgttttggctgtttttttagttctgtatgtattttagcaatctcatctcacctaactgagatgtgtttcaattatattccttttatggaaaaggactctgaaaaaccctaaagtattctagggagaaactgtcttccatttcagttttgaatcagtattgttacactcaaaccaccctctttttaaaaaaaaaaaaaaaaactgtaagccccgccccctttttagtaaaccgatgtaaatttgtgatgtgcatattcttctttcttttagaagagcagtcaaattaaaggatttgacatgttttgctgttgctcaaaggaaataggagttggtgtgcttgtgaccaaggggttacacttccagcttttaaaattctcctttacatgtgctcagtgttttgttttgtgttttggtttctgttttttattttaattcccacattgggcacaagaatcagaatatggatagctagtttaagaaacttttgtgggtgcactgtagcatagatgacagaatattgatgttccccccatctccaattcagttcagggcattccacagttaaacagaaatgggaacgtggggctcttataaatgaaatgggcgctcacagttttggttttcagctcttcatgtctgtaagtgtgctttgggggaggctatgtctgtatggtcgattctcagttatcacatttgcctctcctcccactaccttcatgaacattcagtgctgtttcgcactgcagttagagagaagggacggacagttggtgacactcagccacattgctacttttatctgttctggtaagaagttagatagatggtagattgaagcaattgggtagaattagttgggggaatatttatgagttgctgtgtttgttgattagttccatctctttcccattttaactgagaattgattatatatagctctaagtatataggtatttaaacaaccccacaagcggctgtatcagtaacatttattaattccactatagtgagggaggatttccattctaaataccttattttgagggatttataaaacttagttgtaaaagagaaagcccacatagtgggaataaattgcttcagccatttttagtatttgagagcactagggaagatgtttagtagctgtgtggatgccttttttcacaccctgtctattgaatgctgcatccattcacgaagttaaatgttacatgcagttagtccttaatgtggactggatctgtacttttgttttggattaaaacatttaaagatttttgaagtgcagctactccccacgtgcatttgatacacataaaagtcatactgtgtgtgcacaaagagtacatggattttccagcatattgctttaaaaaattatataaactgttaaaatattaacacctcaggctacctgctgtattctgtcccattgacccctggaattggatttactgcaagtgattgataattcaattatgtggcttttcccctttaatcttgccatttaaattacagtagaaagacaaaatcaagtaaaataaagtgttagataatagaaagagtgttaagaccagcccacttttctcatgtttatgttctttcatttggaccaagaatctccgcatggaggttgatttgccactggggactttggctaagactattaggtttgctttcaactagatgttcctgagacaagcagagggacactgcaattccccttccatgcctgctgttctcccccatgtaagtcttctttgaaattaacggatgtgtctcctttggaacagccccataacaaaagagaactactgatctgagcataggaaagtagaggctctaccacttttcagttgaaaaagcaagactttctctgtgtttctgaaacaaggcataatgttgtcacagaatcagagatccagtctcacttttccacaaatctccaaatctccagtcttatcttgtgtgctctaatggtttggttcaatccctttccaactcttgttttcaaagcatggggcctgagtgttctccactcctcctaagaaaggagcttgggtggaagggaccatgctgacctcctccatcagagggctcttccagtagtattctcggatgcaacctccatttctcagttaccattatttcctgtatcagctttgtccttcctggagggatgcacagtgatccggcccaccactgttgttgtcttgtgcttctgctctttcctatggtttcaggttattttctgggtttcccctattcttcttttatttctttttttttttatatttgctttcctttctactgcttttagatttgcaggagatgcaagtttcagctcaatgtttggcttctctcaatatggaaatttcagaaggacagaggagaggagggaggaagaagaaagtatactcctccagaatttcagtgatctgttgtggcagtccagtggaaggaaggtcttttgaggtcacttagaagcatctttttgggacatccttttgggatctctgtaggctaggcatctcatatcttgagactcacccccagcctccaagcctctctccatttctctaacctatgcattttagagcgagaggaccgcctcactagtgtcaccatcctgccttttctaaaacatgcaggctcacacattctactcctgcttaatgtctgtgttaaacgttttctaaccatttttgttttatttttctgaaaaagttaacccctcccaactcctcacacattggctcttcctcttgagccacaaagttttgattcttgcgatgtatgtgccttattttatgttaatcttgtcaatgagagggaccagttggtgttgcccaatcagcactccaaggctgtgtgtgcaccagccagagagcgcacggtggtagcagagtcgaggctgtcttgtatcctggtttcatgtgttgttttgaactgataggaggatgttctcttctgacaagttacccttgtgtatcctgcagacatgtaaaataaaatacaagttcatttttttcaccttttttagatttttttaaaaaataaaatgtgtaatcctttttttaaaagaaacacatgtaaatacatttaagtattgtaggcatagcgttcagatgtgactggcccaggcgttcctcggacaagcctgcattccccgtgatcacgcccacctcaagcccaggggctgcagcccagccacagatgaactctacctttgctttcagaaccacttagtccttttgtaacaaagaaaaaaaaatgtttcttacaatgtcaataaaaaattctttgtatggaa

SEQ ID NO: 12119 - DNA, 653 bp, Homo sapiens
tgcggttctcttgctcgctttctgttctcttgcttactttcaaatgcagacgtgcactacagcgtcaccagggcatttttggtcgaagagagctgaagtaatgagaagacatcatggaggcccagtcccacagctccacgaccactgaaaagaaaaaagttgagaattccatagtgaagtgctccactcgaacagatgtgagcgagaaagccgttgcctccagcaccacttctaatgaggatgaaagtcctggacagacttatcacagagagagaagaaacgcaatcactatgcagccacagaatgtccaggggctcagcaaagtcagtgaggaaccttcaacatcgagtgacgagagggcctcattgatcaagaaagagatccatgggtccctgccacacgtggcggagccctctgtgccgtaccgcgggacggtgtttgccatggaccccaggaatggttacatggagccccactaccaccctcctcatcttttccctgccttccatcctcctgtaccaattgatgccagacatcatgagggccgttaccattacgatccatctccgattcctccattgcatatgacttccgccttatctagtagccctacgtatccggacctgcccttcattaggatctccccacaccgg

SEQ ID NO: 12120 - DNA, 1341 bp, Homo sapiens
ggccggacacttccgtccggcgcgcggcgtcctcctcccgctcggaaggtcccaggtgtgacaccttcagcaggtctcagggaagatggcagccctaggggacattcaggagtccccttctgtcccgtcccctgtcagtctctcatcaccagggacacctggaacccagcaccacgagcctcagcttcacctccatgggcatcaacatggctcccctggctccagccctaaggtgctctcccagccgtccgacctggatctccaagacgtagaggaagtggagatcggcagagacaccttctggcccgactccgagcccaagccggagcaggctccacgctctcctggctctcaggcccctgacgagggggcgggcggggcgctgcgcagcctcctgaggagccttccccgcagggcccggtgcagcgccggcttcgggcctgaatccagcgcggagcggccggcgggccagccgcctggggccgtcccttgcgcccagccgcggggcgcctggcgcgtgacgctcgtgcagcaagcagcggccgggcccgagggtgcgcccgagcgggctgccgagctgggagtcaacttcggtcggagccggcagggcagcgcgcggggggccaagccgcacaggtgcgaggcctgcggcaagagtttcaagtataactcgctgctcctgaagcaccagcgcatccacacgggcgagaagccctacgcctgccacgagtgcggcaagcgcttccgcggctggtcgggcttcatccagcaccaccgcatccacacgggcgagaagccctacgagtgcggccagtgcggccgcgccttcagccacagctcgcacttcacgcagcacctgcgcatccacaacggcgagaagccctacaagtgcggcgagtgcggccaggccttcagccagagctccaacctggtgcgccaccagcggctgcacacgggtgagaagccctacgcctgcagccagtgcggcaaggccttcatctggagctccgtgctcatcgagcaccagcgcatccacactggcgagaagccctacgagtgctccgactgcggcaaagccttccgcggccgctcgcacttcttccggcacctgcggacccacacgggcgagaagcccttcgcgtgtggcgcctgcggcaaggccttcggccagagctcccagctcatccagcaccagcgggtgcactaccgcgagtagccgggcgggggctcggggctcggcctcctacctgcccccaacccaccctccaccccgtcccccacggtgggcactgcccagcaccgcatgccacgtgtccggaataaattctttttgattgttgg

SEQ ID NO: 12121 - DNA, 1297 bp, Homo sapiens
aggtcccaggtgtgacaccttcagcaggtctcagggaagatggcagccctaggggacattcaggagtccccttctgtcccgtcccctgtcagtctctcatcaccagggacacctggaacccagcaccacgagcctcagcttcacctccatgggcatcaacatggctcccctggctccagccctaaggtgctctcccagccgtccgacctggatctccaagacgtagaggaagtggagatcggcagagacaccttctggcccgactccgagcccaagccggagcaggctccacgctctcctggctctcaggcccctgacgagggggcgggcggggcgctgcgcagcctcctgaggagccttccccgcagggcccggtgcagcgccggcttcgggcctgaatccagcgcggagcggccggcgggccagccgcctggggccgtcccttgcgcccagccgcggggcgcctggcgcgtgacgctcgtgcagcaagcagcggccgggcccgagggtgcgcccgagcgggctgccgagctgggagtcaacttcggtcggagccggcagggcagcgcgcggggggccaagccgcacaggtgcgaggcctgcggcaagagtttcaagtataactcgctgctcctgaagcaccagcgcatccacacgggcgagaagccctacgcctgccacgagtgcggcaagcgcttccgcggctggtcgggcttcatccagcaccaccgcatccacacgggcgagaagccctacgagtgcggccagtgcggccgcgccttcagccacagctcgcacttcacgcagcacctgcgcatccacaacggcgagaagccctacaagtgcggcgagtgcggccaggccttcagccagagctccaacctggtgcgccaccagcggctgcacacgggtgagaagccctacgcctgcagccagtgcggcaaggccttcatctggagctccgtgctcatcgagcaccagcgcatccacactggcgagaagccctacgagtgctccgactgcggcaaagccttccgcggccgctcgcacttcttccggcacctgcggacccacacgggcgagaagcccttcgcgtgtggcgcctgcggcaaggccttcggccagagctcccagctcatccagcaccagcgggtgcactaccgcgagtagccgggcgggggctcggggctcggcctcctacctgcccccaacccaccctccaccccgtcccccacggtgggcactgcccagcaccgcatgccacgtgtccggaataaattctttttgattgttggaa

SEQ ID NO: 12122 - DNA, 5877 bp, Homo sapiens
agaacacaaagtgagctgcacaccatatatggagaaacccgtttcttaaaactagtgatgaactcatgctctgttctgttttctcaaagctgaagtcggctaggtttgcaaagctgtgggctgagcactcaggcaatcacactctcagaaactgcggcggctctggactgcagcctcccaaggctccatgccagacaaagcatgcgtgtcacacttgctacaatagcctggatggtttcttttgtctccaattattcacacacagcaaatattttgccagatatcgaaaatgaagatttcatcaaagactgcgttcgaatccataacaagttccgatcagaggtgaaaccaacagccagtgatatgctatacatgacttgggacccagcactagcccaaattgcaaaagcatgggccagcaattgccagttttcacataatacacggctgaagccaccccacaagctgcacccaaacttcacttcactgggagagaacatctggactgggtctgtgcccattttttctgtgtcttccgccatcacaaactggtatgacgaaatccaggactatgacttcaagactcggatatgcaaaaaagtctgtggccactacactcaggttgtttgggcagatagttacaaagttggctgcgcagttcaattttgccctaaagtttctggctttgacgctctttccaatggagcacattttatatgcaactacggaccaggagggaattacccaacttggccatataagagaggagccacctgcagtgcctgccccaataatgacaagtgtttggacaatctctgtgttaaccgacagcgagaccaagtcaaacgttactactctgttgtatatccaggctggcccatatatccacgtaacagatacacttctctctttctcattgttaattcagtaattctaatactgtctgttataattaccattttggtacagcacaagtaccctaatttagttcttttggactaatacaattcaggaaagaaaaaacccaaaaaccaacctcattcacatatggctttttttttaaccaataacaattaggtgtacttctattttaaaacatttcagaaaaaaatatatgttatagcaatactcttactcaaaagaagaaatttcctaactctatcagataaactcatctttagtataaataagcattatttgcaggttgccacaggtggacttttagtaagtaacctaacccatgtttcagcttctaaatctgcaaaatgagcaaggtacagtagcacatttttaggtgattcttagtaactccagtagccttcattagttaaaaacattattattttttgcatgctgcttcgactctaaatatctggttttccctgtctttttggtttactacttccccagattcagaacagaggagtaactaggggatctgattttagaggccttaattttctgttcatggactgttaaaagtaaaaccaaactttcaaaagggataaacctaaatatttacttgttatcattagagagggaacatcaaatgctgggacatcattactaaccaatagcatcagacactggatttaatggataatcacaatggtcgtaatgtatacaaagacttatataccactttctcgtataaatttttcaaaaaatacaataataatataatttataaagaacactcttctatgaacaaccaccaccaccaaaaaaaaaaaaagccctcagaaaatttctcacaaataaggcaactaatgcctgatatctcaaaatcctttacaaaaggagatagttctagtcaaggagttttgggtatgttacttttttttcttctttttcttttcatctgcctccatcttaagtgcaatttcttcagctgtaagagctcccagtttcttattctttgctttcttaaccttttccttgatgctggccacatcaattttagtttcagtagaagctagacaaattaaaagcacaacacatgtaatactttagattttaccaagtaaaacaaagaatatatgtttaacaaagaatatatgtttaaggcagttaacttcagagtattcttataattgaataattgaaaggtgatcacagtataaaatataaaaacacttgcctaaagcagttagaaatttcttcagattaagataaaacaaatcataaaatactttatatattagtacaagtatacataaaaatggcataaatggcataattgaaccaattactggattcaactatattaagactatttccttaaatcctacttcagactaaattattttacctacattcttttccatattttggaacttctgagtcattattttccatcttgcacattaaaataatttaaaattacatgtatcccttctcaataagtttaatcagctaaccctaagctagaggtcaaaatctacttcctctaatatcaaaacgaaaatttaaagttttccaaatattaattcaatattaattgaatattcaatgaattaattcatttaatgttagattaattcattgaatattaattcaatgaatgactaattaatagtattttaacaagattttggtatatttaacaacattttggtaataaagacaataatttgagagtgtgtggaagtccccctaatagaagccaactatctaatcaatgccaaaagtgtgaacaaaatagagaaaggaagcagtgaaaaagaatgcaactttttcttaccattcaaagtacaggatcacagcataaaagaatcataagataaaacatcaaactacccagcaacctgagaagcacagagtgttaaagcctccaccgtgtggagaaactaaattagggtaactagctattgagtatattgagtaccttcaaagcactcaactgacaggttttacagactggaaattataatacttatgacatttctaccttttatataaccaataatctaccatagaatgtagtatttttaaagctattaacaagcaatatattaaaataataatgtattatatctgtttctgacccagtctatgtacaatattgctggtgagccctctcccttcagtgtgtcactgttcactttggagggttactttaggaagaggataagtgttaccacaggggaaaaaaatgcagaagaggatgcatcagaagaaatggcatgacaatgttttctcttagtgtcttttaaatactaggttagtgcgaaagtgatttctgccatttaaaaaccacaatcactttcgcactaatagctcctgaataagacctgtcagcatcctttagtctaaggtgatgagaaatccatgttaccgatatagaagccaaactctaagccaagatcacataaagagaagaaaaagtacaacttctgataattcctctttgagaggcatgacagcagagctcagggatcttcttgcatttctacagaagatgcactggctgccctgggtttgtatctttcacaacaaagagtcttttccaagcacagaccagaggtcaggagaggactgtcaatccagtttgcactgaaataggcattagctgcctctaaattataaattatctcagccatcccttgtccttaggattagtaattaatgaaatgctaagagaactgatgaaaagatacaactgtttcttaaaaagattcagacaaatttattatgggtttacttttcctaattaataaagacttttacatcatagaaagcattaccttccttaggtttcacaattggtttttccttaggtggaataaatgctttgtttctttcctcttgtctcttactgatggcttctgcttgtttagcctacattaataaataaaaaatatatcagttaaatgtatttatagttaaataattcaagtatctatgaactttgctattcatgtgagccagacataaagtgccgtacctttattgcttccattttctgccgcttcttctgatttgccttcaaaaagtattcaccactagccaattctttatcgatctgttgaaaacggtatttacaattacatcagaaataatgtagaggagaagtcatgtcctaagcaagtcacaatatccttagggtaaaaacaatggggtcaaactgatttattaataaaaatggtagtgacataaaggaaacagagtctaagctgaggggaatacatacacaaaagtgtggaggtaggaaagcacctccatggaatacaacccagagtagttcagggatatggcatggaaggtcactgattcagaaaagtgtgagaagaaactggagagagagttttggggaaaatttgaagaagcttcaatggcagacaaagtaggagggataagatttagaaatgactgtaggtttctgagaagactgtaaagaccaaagaataattttaatggagaggaatgaagaatagatgagagcctggaataaaggtagtggcatgcagaataaaagccagaactatcaggaattggtgactaattagcaaaagcaacagcttgttcattcaatatacagccaacatgtaaaatgtgtataactgacctgtctcccacttacatagcattattatatctaaggcactgttctaagctctttataattactcatttaatcctcactaacaattctttaagataggtattaccattactcccactttaggtatggggaaacttaagtatggatgggataaataactcgcccagtcacataatgaattaagtgttaagaacaagtcaatcgagacatcactgtttcaagaagcttacacagctacagaagaaagataagtcaattactacaagaaagggccataagaaataaggcaggtgttatggaagcatggtttaatgactgcatcactccactttccccctaactactatcaatttcctccatgatccaaaacttccattgttttttcactatgatcatcattttccccgtcaatcacaaatcttccctgaaagactccaaccatggttgtggaaaaaagagatgtagaaagcaatgagttcacatgctgagcagaagtagaaagggaaggctttaggatatagccaaggaagggaataatgaagcaagaacccccaggagacaggtgaagatggaattcaaagaacacatagaagaggctgatgcaggtggaagaaaacccatacgtgagagaagaggaaacagaaaggggttcttatctggtggtctcaaatatttcaataaaatgcaatgtcatatgctaaacatgggagggcactgagagaattaagaggaaacatgaattttgaatgaaattaatccaaagataaaactttctctaacttaatttggtagccacgttgcaaggaagaagtcaagtttttagactgatccaagttttagagctttgctgagaaggtgggacagaagtaaaaaggggcatgaatcaaaacaatgatgtgcaagaacaaaatggaaactggtcatggtgggaaaggaaatgaagcagaagacacctgacaaaaggaatcataacttagaaaaacggtgggtgttacaatttacaatttaagatttcagaacaagaacaaccatagagcacacagtcacaataatgttgccaaatcagagaaaagagtattgcagactaaacgaacttttatccatggaacatttacagtggctacagggtcacaaacctcctggatgcagtttataatcaatgtgaacgccccactgcacacccccatgcactcagctcaaaatatgcctatttatatttaccctcagtttcttatagctctgcacacacacacacaatatatatatatacacatatcccacctgaaatactttcaataaagtttctgaccaaa

SEQ ID NO: 12123 - DNA, 758 bp, Homo sapiens
gagcgatttcctgacaggtcctggcagatgaggggaaggaaggagggggaggagccctctgtgacagttgtcccagaaagggcataaacaggatgtggtgttggatgaaaccttcctcctactgcacagcccgcccccctacagccccggtccccacgcctagaagacagcggaactaagaaaagaagaggcctgtggacagaacaatcatgtctgactccctggtggtgtgcgaggtagacccagagctaacagaaaagctgaggaaattccgcttccgaaaagagacagacaatgcagccatcataatgaaggtggacaaagaccggcagatggtggtgctggaggaagaatttcagaacatttccccagaggagctcaaaatggagttgccggagagacagcccaggttcgtggtttacagctacaagtacgtgcatgacgatggccgagtgtcctaccctttgtgtttcatcttctccagccctgtgggctgcaagccggaacaacagatgatgtatgcagggagtaaaaacaggctggtgcagacagcagagctcacaaaggtgttcgaaatccgcaccactgatgacctcactgaggcctggctccaagaaaagttgtctttctttcgttgatctctgggctggggactgaattcctgatgtctgagtcctcaaggtgactggggacttggaacccctaggacctgaacaaccaagactttaaataaattttaaaatgcaaaaactcggaga

SEQ ID NO: 12124 - DNA, 646 bp, Homo sapiens
gttggatgaaaccttcctcctactgcacagcccgcccccctacagccccggtccccacgcctagaagacagcggaactaagaaaagaagaggcctgtggacagaacaatcatgtctgactccctggtggtgtgcgaggtagacccagagctaacagaaaagctgaggaaattccgcttccgaaaagagacagacaatgcagccatcataatgaaggtggacaaagaccggcagatggtggtgctggaggaagaatttcagaacatttccccagaggagctcaaaatggagttgccggagagacagcccaggttcgtggtttacagctacaagtacgtgcatgacgatggccgagtgtcctaccctttgtgtttcatcttctccagccctgtgggctgcaagccggaacaacagatgatgtatgcagggagtaaaaacaggctggtgcagacagcagagctcacaaaggtgttcgaaatccgcaccactgatgacctcactgaggcctggctccaagaaaagttgtctttctttcgttgatctctgggctggggactgaattcctgatgtctgagtcctcaaggtgactggggacttggaacccctaggacctgaacaaccaagactttaaataaattttaaaatgc

SEQ ID NO: 12125 - DNA, 3081 bp, Homo sapiens
agtctagcccactccttcataaagccctcgcatcccaggagcgagcagagccagagcaggatggagaggagacgcatcacctccgctgctcgccgctcctacgtctcctcaggggagatgatggtggggggcctggctcctggccgccgtctgggtcctggcacccgcctctccctggctcgaatgccccctccactcccgacccgggtggatttctccctggctggggcactcaatgctggcttcaaggagacccgggccagtgagcgggcagagatgatggagctcaatgaccgctttgccagctacatcgagaaggttcgcttcctggaacagcaaaacaaggcgctggctgctgagctgaaccagctgcgggccaaggagcccaccaagctggcagacgtctaccaggctgagctgcgagagctgcggctgcggctcgatcaactcaccgccaacagcgcccggctggaggttgagagggacaatctggcacaggacctggccactgtgaggcagaagctccaggatgaaaccaacctgaggctggaagccgagaacaacctggctgcctatagacaggaagcagatgaagccaccctggcccgtctggatctggagaggaagattgagtcgctggaggaggagatccggttcttgaggaagatccacgaggaggaggttcgggaactccaggagcagctggcccgacagcaggtccatgtggagcttgacgtggccaagccagacctcaccgcagccctgaaagagatccgcacgcagtatgaggcaatggcgtccagcaacatgcatgaagccgaagagtggtaccgctccaagtttgcagacctgacagacgctgctgcccgcaacgcggagctgctccgccaggccaagcacgaagccaacgactaccggcgccagttgcagtccttgacctgcgacctggagtctctgcgcggcacgaacgagtccctggagaggcagatgcgcgagcaggaggagcggcacgtgcgggaggcggccagttatcaggaggcgctggcgcggctggaggaagaggggcagagcctcaaggacgagatggcccgccacttgcaggagtaccaggacctgctcaatgtcaagctggccctggacatcgagatcgccacctacaggaagctgctagagggcgaggagaaccggatcaccattcccgtgcagaccttctccaacctgcagattcgagaaaccagcctggacaccaagtctgtgtcagaaggccacctcaagaggaacatcgtggtgaagaccgtggagatgcgggatggagaggtcattaaggagtccaagcaggagcacaaggatgtgatgtgaggcaggacccacctggtggcctctgccccgtctcatgaggggcccgagcagaagcaggatagttgctccgcctctgctggcacatttccccagacctgagctccccaccaccccagctgctcccctccctcctctgtccctaggtcagcttgctgccctaggctccgtcagtatcaggcctgccagacggcacccacccagcacccagcaactccaactaacaagaaactcacccccaaggggcagtctggaggggcatggccagcagcttgcgttagaatgaggaggaaggagagaaggggaggagggcggggggcacctactacatcgccctccacatccctgattcctgttgttatggaaactgttgccagagatggaggttctctcggagtatctgggaactgtgcctttgagtttcctcaggctgctggaggaaaactgagactcagacaggaaagggaaggccccacagacaaggtagccctggccagaggcttgttttgtcttttggtttttatgaggtgggatatccctatgctgcctaggctgaccttgaactcctgggctcaagcagtctacccacctcagcctcctgtgtagctgggattatagattggagccaccatgcccagctcagagggttgttctcctagactgaccctgatcagtctaagatgggtggggacgtcctgccacctggggcagtcacctgcccagatcccagaaggacctcctgagcgatgactcaagtgtctcagtccacctgagctgccatccagggatgccatctgtgggcacgctgtgggcaggtgggagcttgattctcagcacttgggggatctgttgtgtacgtggagagggatgaggtgctgggagggatagaggggggctgcctggcccccagctgtgggtacagagaggtcaagcccaggaggactgccccgtgcagactggaggggacgctggtagagatggaggaggaggcaattgggatggcgctaggcatacaagtaggggttgtgggtgaccagttgcacttggcctctggattgtgggaattaaggaagtgactcatcctcttgaagatgctgaaacaggagagaaaggggatgtatccatgggggcagggcatgactttgtcccatttctaaaggcctcttccttgctgtgtcataccaggccgccccagcctctgagcccctgggactgctgcttcttaaccccagtaagccactgccacacgtctgaccctctccaccccatagtgaccggctgcttttccctaagccaagggcctcttgcggtcccttcttactcacacacaaaatgtacccagtattctaggtagtgccctattttacaattgtaaaactgaggcacgagcaaagtgaagacactggctcatattcctgcagcctggaggccgggtgctcagggctgacacgtccaccccagtgcacccactctgctttgactgagcagactggtgagcagactggtgggatctgtgcccagagatgggactgggagggcccacttcagggttctcctctcccctctaaggccgaagaagggtccttccctctccccaagacttggtgtcctttccctccactccttcctgccacctgctgctgctgctgctgctaatcttcagggcactgctgctgcctttagtcgctgaggaaaaataaagacaaatgctgcgcccttccccag

SEQ ID NO: 12126 - DNA, 1013 bp, Homo sapiens
agagccagagcaggatggagaggagacgcatcacctccgctgctcgccgctcctacgtctcctcaggggagatgatggtggggggcctggctcctggccgccgtctgggtcctggcacccgcctctccctggctcgaatgccccctccactcccgacccgggtggatttctccctggctggggcactcaatgctggcttcaaggagacccgggccagtgagcgggcagagatgatggagctcaatgaccgctttgccagctacatcgagaaggttcgcttcctggaacagcaaaacaaggcgctggctgctgagctgaaccagctgcgggccaaggagcccaccaagctggcagacgtctaccaggctgagctgcgagagctgcggctgcggctcgatcaactcaccgccaacagcgcccggctggaggttgagagggacaatctggcacaggacctggccactgtgaggcagaagaagcagatgaagccaccctggcccgtctggatctggagaggaagattgagtcgctggaggaggagatccggttcttgaggaagatccacgaggaggaggttcgggaactccaggagcagctggcccgacagcaggtccatgtggagcttgacgtggccaagccagacctcaccgcagccctgaaagagatccgcacgcagtatgaggcaatggcgtccagcaacatgcatgaagccgaagagtggtaccgctccaagtttgcagacctgacagacgctgctgcccgcaacgcggagctgctccgccaggccaagcacgaagccaacgactaccggcgccagttgcagtccttgacctgcgacctggagtctctgcgcggcacgaacgagtccctggagaggcagatgcgcgagcaggaggagcggcacgtgcgggaggcggccagttatcaggaggcgctggcgcggctggaggaagaggggcagagcctcaaggacgagatggcccgccacttgcaggagtaccaggacctgctca

SEQ ID NO: 12127 - DNA, 2946 bp, Homo sapiens
atggagaggagacgcatcacctccgctacccgcctctccctggctcgaatgccccctccactcccgacccgggtggatttctccctggctggggcactcaatgctggcttcaaggagacccgggccagtgagcgggcagagatgatggagctcaatgaccgctttgccagctacatcgagaaggttcgcttcctggaacagcaaaacaaggcgctggctgctgagctgaaccagctgcgggccaaggagcccaccaagctggcagacgtctaccaggctgagctgcgagagctgcggctgcggctcgatcaactcaccgccaacagcgcccggctggaggttgagagggacaatctggcacaggacctggccactgtgaggcagaagctccaggatgaaaccaacctgaggctggaagccgagaacaacctggctgcctatagacaggaagcagatgaagccaccctggcccgtctggatctggagaggaagattgagtcgctggaggaggagatccggttcttgaggaagatccacgaggaggaggttcgggaactccaggagcagctggcccgacagcaggtccatgtggagcttgacgtggccaagccagacctcaccgcagccctgaaagagatccgcacgcagtatgaggcaatggcgtccagcaacatgcatgaagccgaagagtggtaccgctccaagtttgcagacctgacagacgctgctgcccgcaacgcggagctgctccgccaggccaagcacgaagccaacgactaccggcgccagttgcagtccttgacctgcgacctggagtctctgcgcggcacgaacgagtccctggagaggcagatgcgcgagcaggaggagcggcacgtgcgggaggcggccagttatcaggaggcgctggcgcggctggaggaagaggggcagagcctcaaggacgagatggcccgccacttgcaggagtaccaggacctgctcaatgtcaagctggccctggacatcgagatcgccacctacaggaagctgctagagggcgaggagaaccggatcaccattcccgtgcagaccttctccaacctgcagattcgagaaaccagcctggacaccaagtctgtgtcagaaggccacctcaagaggaacatcgtggtgaagaccgtggagatgcgggatggagaggtcattaaggagtccaagcaggagcacaaggatgtgatgtgaggcaggacccacctggtggcctctgccccgtctcatgaggggcccgagcagaagcaggatagttgctccgcctctgctggcacatttccccagacctgagctccccaccaccccagctgctcccctccctcctctgtccctaggtcagcttgctgccctaggctccgtcagtatcaggcctgccagacggcacccacccagcacccagcaactccaactaacaagaaactcacccccaaggggcagtctggaggggcatggccagcagcttgcgttagaatgaggaggaaggagagaaggggaggagggcggggggcacctactacatcgccctccacatccctgattcctgttgttatggaaactgttgccagagatggaggttctctcggagtatctgggaactgtgcctttgagtttcctcaggctgctggaggaaaactgagactcagacaggaaagggaaggccccacagacaaggtagccctggccagaggcttgttttgtcttttggtttttatgaggtgggatatccctatgctgcctaggctgaccttgaactcctgggctcaagcagtctacccacctcagcctcctgtgtagctgggattatagattggagccaccatgcccagctcagagggttgttctcctagactgaccctgatcagtctaagatgggtggggacgtcctgccacctggggcagtcacctgcccagatcccagaaggacctcctgagcgatgactcaagtgtctcagtccacctgagctgccatccagggatgccatctgtgggcacgctgtgggcaggtgggagcttgattctcagcacttgggggatctgttgtgtacgtggagagggatgaggtgctgggagggatagaggggggctgcctggcccccagctgtgggtacagagaggtcaagcccaggaggactgccccgtgcagactggaggggacgctggtagagatggaggaggaggcaattgggatggcgctaggcatacaagtaggggttgtgggtgaccagttgcacttggcctctggattgtgggaattaaggaagtgactcatcctcttgaagatgctgaaacaggagagaaaggggatgtatccatgggggcagggcatgactttgtcccatttctaaaggcctcttccttgctgtgtcataccaggccgccccagcctctgagcccctgggactgctgcttcttaaccccagtaagccactgccacacgtctgaccctctccaccccatagtgaccggctgcttttccctaagccaagggcctcttgcggtcccttcttactcacacacaaaatgtacccagtattctaggtagtgccctattttacaattgtaaaactgaggcacgagcaaagtgaagacactggctcatattcctgcagcctggaggccgggtgctcagggctgacacgtccaccccagtgcacccactctgctttgactgagcagactggtgagcagactggtgggatctgtgcccagagatgggactgggagggcccacttcagggttctcctctcccctctaaggccgaagaagggtccttccctctccccaagacttggtgtcctttccctccactccttcctgccacctgctgctgctgctgctgctaatcttcagggcactgctgctgcctttagtcgctgaggaaaaataaagacaaatgctgcgcccttccccag

SEQ ID NO: 12128 - DNA, 1817 bp, Homo sapiens
agtctagcccactccttcataaagccctcgcatcccaggagcgagcagagccagagcaggatggagaggagacgcatcacctccgctgctcgccgctcctacgtctcctcaggggagatgatggtggggggcctggctcctggccgccgtctgggtcctggcacccgcctctccctggctcgaatgccccctccactcccgacccgggtggatttctccctggctggggcactcaatgctggcttcaaggagacccgggccagtgagcgggcagagatgatggagctcaatgaccgctttgccagctacatcgagaaggttcgcttcctggaacagcaaaacaaggcgctggctgctgagctgaaccagctgcgggccaaggagcccaccaagctggcagacgtctaccaggctgagctgcgagagctgcggctgcggctcgatcaactcaccgccaacagcgcccggctggaggttgagagggacaatctggcacaggacctggccactgtgaggcagaagctccaggatgaaaccaacctgaggctggaagccgagaacaacctggctgcctatagacaggaagcagatgaagccaccctggcccgtctggatctggagaggaagattgagtcgctggaggaggagatccggttcttgaggaagatccacgaggaggaggttcgggaactccaggagcagctggcccgacagcaggtccatgtggagcttgacgtggccaagccagacctcaccgcagccctgaaagagatccgcacgcagtatgaggcaatggcgtccagcaacatgcatgaagccgaagagtggtaccgctccaagtttgcagacctgacagacgctgctgcccgcaacgcggagctgctccgccaggccaagcacgaagccaacgactaccggcgccagttgcagtccttgacctgcgacctggagtctctgcgcggcacgaacgagtccctggagaggcagatgcgcgagcaggaggagcggcacgtgcgggaggcggccagttatcaggaggcgctggcgcggctggaggaagaggggcagagcctcaaggacgagatggcccgccacttgcaggagtaccaggacctgctcaatgtcaagctggccctggacatcgagatcgccacctacaggaagctgctagagggcgaggagaaccggatcaccattcccgtgcagaccttctccaacctgcagattcgagggggcaaaagcaccaaagacggggaaaatcacaaggtcacaagatatctcaaaagcctcacaatacgagttataccaatacaggctcaccagattgtaaatggaacgccgccggctcgcggttagctgcctgcctctcagacacggcgctttgcccagcttgacagggagtgagcctcacccaccccatcctcccaatccccctgagttccctcttcccaggcttcccctaaagggcctggactgcgtcattttcccaggaactgcagtgcccagcccaggacgtggtacagagtaactgtacattaaactggcagagcttgttagtggtaaaggtggtgagtccttgggtgcgcagtggagctgctctggggcctctgagcaagcagcagcctctgtctcacctcttcctgtcactgggagggccccttgggtctcgctgtgcctggacgccaggctctctgctttattctttcatccctgaggctccatcgctcagctcagtgctgactcagttcagaggattcttccctcaggaccgcagctcttgcagtgaataaagttttatgttccctgctcttaatgtt

SEQ ID NO: 12129 - DNA, 1445 bp, Homo sapiens
agagcaggatggagaggagacgcatcacctccgctgctcgccgctcctacgtctcctcaggggagatgatggtggggggcctggctcctggccgccgtctgggtcctggcacccgcctctccctggctcgaatgccccctccactcccgacccgggtggatttctccctggctggggcactcaatgctggcttcaaggagacccgggccagtgagcgggcagagatgatggagctcaatgaccgctttgccagctacatcgagaaggttcgcttcctggaacagcaaaacaaggcgctggctgctgagctgaaccagctgcgggccaaggagcccaccaagctggcagacgtctaccaggctgagctgcgagagctgcggctgcggctcgatcaactcaccgccaacagcgcccggctggaggttgagagggacaatctggcacaggacctggccactgtgaggcagaagctccaggatgaaaccaacctgaggctggaagccgagaacaacctggctgcctatagacaggaagcagatgaagccaccctggcccgtctggatctggagaggaagattgagtcgctggaggaggagatccggttcttgaggaagatccacgaggaggaggttcgggaactccaggagcagctggcccgacagcaggtccatgtggagcttgacgtggccaagccagacctcaccgcagccctgaaagagatccgcacgcagtatgaggcaatggcgtccagcaacatgcatgaagccgaagagtggtaccgctccaagtttgcagacctgacagacgctgctgcccgcaacgcggagctgctccgccaggccaagcacgaagccaacgactaccggcgccagttgcagtccttgacctgcgacctggagtctctgcgcggcacgaacgagtccctggagaggcagatgcgcgagcaggaggagcggcacgtgcgggaggcggccagttatcaggaggcgctggcgcggctggaggaagaggggcagagcctcaaggacgagatggcccgccacttgcaggagtaccaggacctgctcaatgtcaagctggccctggacatcgagatcgccacctacaggaagctgctagagggcgaggagaaccggatcaccattcccgtgcagaccttctccaacctgcagattcgaggtcagtacagcagggcctcgtgggaagggcactggagtcctgccccctcctccagggcctgtaggttgctccagactgggactgaggatcagggcaaagggatccagctctccctgggggccttcgtgacactgcagcgctcctagccagagcctatcataccagggtacttctaggtggggcttgcagctgcccctgtcctgctaggccctggtccctcttcccctccctgcaccccattcgacagcagaactgggtgagagctt

SEQ ID NO: 12130 - DNA, 1999 bp, Homo sapiens
gggcggtgggagccgaggcgccgagcaagatggcggcgcgagtgctgcgcgcccgcggagcggcctgggccggcggcctcctgcagcgggcggccccctgcagcctcctgcccaggctccggacatggacatcttccagcaacagatctcgagaagacagctggctaaaatccttatttgtccggaaagttgatccaagaaaagatgcccactccaatctcctagccaaaaaggaaacaagcaatctatacaaattacagtttcacaatgttaaaccggaatgcctagaagcatacaacaaaatttgtcaagaggtgttgccaaagattcacgaagataaacactacccttgtactttggtggggacttggaacacgtggtatggcgagcaggaccaagctgtccacctctggaggtatgaaggaggctatccagccctcacagaagtcatgaataaactcagagaaaataaggaatttttggaatttcgtaaggcaagaagtgacatgcttctctccaggaagaatcagctcctgttggagttcagtttctggaatgagcctgtgccaagatccggacctaatatatatgaactcaggtcttaccaactccgaccaggaaccatgattgaatggggcaattactgggctcgtgcaatccgcttcagacaggatggtaacgaagccgtcggaggattcttctctcagattgggcagctgtacatggtgcaccatctttgggcttacagggatcttcagaccagggaagacatacggaatgcagcatggcacaaacatggctgggaggaattggtatattacacagttccacttattcaggaaatggaatccagaatcatgatcccactgaagacctcgcccctccagtaaagctgtagagtttctatgtgcctacatacatttctgtgacaagtatttgtcgtaaattaattttaattgtgtatcaagtgaaaaagaaacactgaggttttaagctgctgtatatagcttgtgagaaacctcttttctttaaaatttacataatcacaagaaaggaaagaattacagttggactgattgtgacagtgccttgtcgtcctctttgaaacaccccgtgttgtccagtataccttataacactgagccacttctccccaccctccagaaggggtccacgttgaattctgaatcatcttgaaaataagattccaaccacaaaaaaaatttagccatttctttactaaaaaaaaccaaaaaacaaatctgttttataatcacagatttttagacaaatttcttgtatcaggaagaaatacaaattttgtcatgtttctcaagcagtttttctgagtagtttctgaggaggaacaaattacaagtgtacccaataactgaaaatgttttaactcactctcatttgtaagcagtccacatagtagacaatgggttttccaagctgggcaaggtacatttaatcagtaaatcagtttcacatcatgtattgtgatgtttcaatgtgagacacaaaaacaatggcttgaaacttgtgtatcatatgtgattttgaaatgaacaccttgaatagcactaatttttatttgtggtatttttctataacaaaacaagtagctctaggaaaagaggttttattttgtaaacgatcatttgtgacctcagacactctctggctaatattttaataagctcacagcagataattctgagatcatgggtgaggggtggtgcatgttgagatttaaattggcataaagctgcatactttttgtctagctgtttgatttcattttttaatatagtatgccaattttgtgactgttaccatgtgaaagtcctgttgaaatgaacaattgtctgccccacaatcaagaatgtatgtgtaaagtgtgaataaatctcatatcaaatgtcaaacttttacatgtgaatgattttctcaaagaacatagaaaagtcaataaaatcctcttaatttccacata

SEQ ID NO: 12131 - DNA, 1882 bp, Homo sapiens
gggcggtgggagccgaggcgccgagcaagatggcggcgcgagtgctgcgcgcccgcggagcggcctgggccggcggcctcctgcagcgggcggccccctgcagcctcctgcccaggctccggacatggacatcttccagcaacagatctcgagaagacagctggctaaaatccttatttgtccggaaagttgatccaagaaaagatgcccactccaatctcctagccaaaaaggaaacaagcaatctatacaaattacagttcaagaggtgttgccaaagattcacgaagataaacactacccttgtactttggtggggacttggaacacgtggtatggcgagcaggaccaagctggaatttttggaatttcgtaaggcaagaagtgacatgcttctctccaggaagaatcagctcctgttggagttcagtttctggaatgagcctgtgccaagatccggacctaatatatatgaactcaggtcttaccaactccgaccaggaaccatgattgaatggggcaattactgggctcgtgcaatccgcttcagacaggatggtaacgaagccgtcggaggattcttctctcagattgggcagctgtacatggtgcaccatctttgggcttacagggatcttcagaccagggaagacatacggaatgcagcatggcacaaacatggctgggaggaattggtatattacacagttccacttattcaggaaatggaatccagaatcatgatcccactgaagacctcgcccctccagtaaagctgtagagtttctatgtgcctacatacatttctgtgacaagtatttgtcgtaaattaattttaattgtgtatcaagtgaaaaagaaacactgaggttttaagctgctgtatatagcttgtgagaaacctcttttctttaaaatttacataatcacaagaaaggaaagaattacagttggactgattgtgacagtgccttgtcgtcctctttgaaacaccccgtgttgtccagtataccttataacactgagccacttctccccaccctccagaaggggtccacgttgaattctgaatcatcttgaaaataagattccaaccacaaaaaaaatttagccatttctttactaaaaaaaaccaaaaaacaaatctgttttataatcacagatttttagacaaatttcttgtatcaggaagaaatacaaattttgtcatgtttctcaagcagtttttctgagtagtttctgaggaggaacaaattacaagtgtacccaataactgaaaatgttttaactcactctcatttgtaagcagtccacatagtagacaatgggttttccaagctgggcaaggtacatttaatcagtaaatcagtttcacatcatgtattgtgatgtttcaatgtgagacacaaaaacaatggcttgaaacttgtgtatcatatgtgattttgaaatgaacaccttgaatagcactaatttttatttgtggtatttttctataacaaaacaagtagctctaggaaaagaggttttattttgtaaacgatcatttgtgacctcagacactctctggctaatattttaataagctcacagcagataattctgagatcatgggtgaggggtggtgcatgttgagatttaaattggcataaagctgcatactttttgtctagctgtttgatttcattttttaatatagtatgccaattttgtgactgttaccatgtgaaagtcctgttgaaatgaacaattgtctgccccacaatcaagaatgtatgtgtaaagtgtgaataaatctcatatcaaatgtcaaacttttacatgtgaatgattttctcaaagaacatagaaaagtcaataaaatcctcttaatttccacata

SEQ ID NO: 12132 - DNA, 5739 bp, Homo sapiens
gcgcggccagagcggccggggacaggctccgaggcaggcccgacccgcctccccggcgccgccgtggctcgacggagaccagctaggctggcccccaagaggaccctttccaagtccccagctgggggccctgtgtagacctggagtggacacgcccctccttcccttcatgattcgtttgtagcgcagtggcgatggatgatgaggatgggagatgcttactagacgtgatttgtgacccacaggccctcaatgacttcttgcatggatccgagaagcttgacagtgatgacctcctggataatcccggggaggcccaaagtgccttctatgaaggtcctgggctccatgtgcaagaagcttccggcaaccacctgaacccagagcccaaccagccggcccccagtgtggacctagacttcctggaagatgacatcctgggctctcctgcgacagggggcggcggcgggggcagtgggggcgctgaccagccctgtgacatcctccagcagagcctccaagaggccaacatcacggagcagacgctggaggccgaggctgagctggacctgggtcccttccagctgcccaccctgcagcctgcggatggcggggcaggcccgacgggcgctggaggggcagcggccgtggctgcggggccccaagccctcttcccaggcagcaccgacctgctggggctgcagggcccgcctaccgtgctgacccaccaggccctggtgccgccccaggacgtggtcaacaaggccctgagtgtgcagcccttcctgcagcctgtgggcctgggcaatgtgacactgcagcccatcccgggcctccaaggcctgcccaatggcagccctgggggtgccacggcggccacactgggcctggcgcccatccaggtggtgggccagcccgtcatggcgctcaacacgcccacctcccagctcctggccaagcaggtgcccgtcagcggctacctggcctcggcggctggcccctcggagcccgtgacgctggcgtcggccggtgtctcgccacagggggctggcctggtcatccagaagaacctctcggccgctgtggccaccacgctcaatgggaactctgtgttcggaggcgcgggggccgcctcggctcccaccgggacgccctcgggacagccgctggcggtggccccaggcctcggctcgtcgccactggtcccggcgcccaacgtgatcctgcatcgcacacccacgcccatccagcccaagcccgcgggggtgctgccgcccaagctctaccagctgacgcccaagccgtttgcgcccgcgggcgccacgctcaccatccagggcgagccgggggcgctcccgcagcagcccaaggccccgcagaacctgacgttcatggcggcggggaaggcgggccagaacgtggtgctgtcgggcttccccgcgcctgcgctgcaagcgaacgtcttcaagcagccaccggccaccaccaccggagcggccccgccgcagccccccggggccctgagcaaacccatgagcgtccacctcctgaaccaaggcagcagcatcgtcatccccgcccagcacatgctgccgggccagaaccagttcctactgcctggcgccccggcggtccagctcccgcagcagctctcagccctgccggccaacgtgggcgggcagatcctggcggccgctgccccccacacaggtggacagctcatcgcgaaccccatcctcacaaaccagaacctggcgggcccactgagcctgggccccgtgttggccccccactccggggcccacagcgcgcacatcctctccgccgctcccatccaggtgggccagcctgcgctcttccagatgcccgtgtcgctggcggcgggcagcctgcccacgcagagccagccagcgcccgccgggccggccgccaccactgtcctccagggggtcaccctgccccccagcgccgtggccatgctcaacacccccgacggcctggtgcagccggccacccctgccgctgccaccggggaggccgcgcctgtcctcacggtgcagcctgccccccaggcgccccccgcggtcagcacacccctgcccctgggcctccagcagccgcaggcgcagcagcccccgcaggcccccaccccacaggccgccgccccgcctcaggccaccaccccccagcccagccctggcctggcgtctagcccggagaagatcgtcctggggcagccgccctctgccacccccacggccatcctcactcaggactccctgcagatgttcctgccccaggagaggagccagcagcccctctccgcagagggcccccacctctccgtgcctgcctcggtcatagtcagcgccccgcctcccgcccaagacccagccccagccacccccgtcgccaaaggagctggcctcggccctcaggcccccgacagccaggcttccccggctccggccccccagatcccggcagcggctccgctgaagggcccaggcccctcttcgtccccgtcactacctcaccaggcccctctgggggacagcccccacctgccctccccacaccccacccggcccccttcccgcccaccctcccggccacagagtgtgtcccgccctccctcagagccacccttgcacccttgccccccaccccaggcccccccaactctgcctggcatctttgtcatccaaaaccagctaggcgttcccccgcctgccagcaacccggcccctactgccccaggcccgccgcagccgcctctccgcccccagtcccagccgcctgagggaccgctgcccccagccccccacctccctccatcctccacctcctctgctgtggcctcctcctctgagacgtcctccaggttgccagcccctacgccatccgacttccagctccagttcccacccagccaggggccccacaagtcccccactccccctccaaccctccacctggtccctgagccggcagcaccccccccaccgcctcctcggaccttccagatggtgaccacccccttcccagcgctgccccagccgaaggctcttctcgagagatttcaccaggtgccgtccggaatcatcctccagaacaaggctgggggggcccctgccgccccgcagacctccaccagcctggggcccctcaccagccccgctgcgtctgtgctggtcagtgggcaggccccatctgggacccccactgcccccagccacgcccccgccccggcacccatggccgccacaggcctccctcctctgcttccagccgagaacaaggcttttgccagcaacctcccgaccctgaatgtggccaaggccgcttcctccgggccagggaagccctccgggctgcagtatgagagcaaactgagtggcctgaagaagccccccacgcttcagcccagcaaggaagcctgtttcctggagcatttgcacaaacaccagggctccgtcctgcaccccgactacaagacggccttcccctcctttgaggacgccctgcatcgcctcctgccctaccatgtctaccagggcgccctcccctcccccagtgactaccacaaagtggacgaggagtttgagacggtctccacgcagctgctgaaacgcacccaggccatgctcaataaatatcggctcctgctcctggaggagtcccggagggtgagcccctcagcggagatggtaatgatcgaccgaatgttcattcaggaggagaagaccacccttgccttggataaacagctggccaaggagaagccggacgagtacgtgtcttcctcccgctcgctcggcctccccatcgcagcctcttccgagggtcatcggcttcccggccacggccccctgtcgtcttcagctcccggggcctccacccagccccctccacacctgcccaccaagcttgtgatccggcacggcggggcaggcggctccccttcggtcacctgggcccgggcgtcctcctccctgtcctcctcttcctcctcctcctctgccgcctcctccttggacgccgacgaggacggccccatgccctcccgcaaccgcccgcccatcaagacctacgaggcccggagccgcatcgggctcaagctcaagatcaagcaggaagccgggctcagcaaggtcgtgcacaacacggccctggaccccgtgcaccagcccccgccaccccccgctaccctcaaggtggccgagcccccgccacggccgccaccaccaccgccgcccacgggccagatgaacggcacggtggaccacccgccgcctgccgcccccgagcgcaagcccctgggcaccgccccgcactgcccgcgcctgccactgcgcaagacctaccgcgagaacgtggggggccctggcgcgccggaggggacgcccgcaggcagggcacggggaggcagcccggcgccgctgcccgccaaagtggacgaggccaccagcgggctcatccgcgagctggcggccgtggaggacgagctgtaccagcgtatgctgaagggccccccgccagagcccgcagccagcgccgcccaaggcaccggggaccccgactgggaggcgcccgggctgccccctgccaagcggcgcaagtccgagtcgcccgacgtggaccaggccagcttctccagcgacagcccgcaggatgacacgctcaccgagcacctgcagagcgccatcgacagcatcctgaacctgcagcaggcccccggccggacgcccgcgccctcgtacccccacgctgcctcggccggcacccccgcatccccgccgcccctgcacaggcccgaggcctacccaccctccagtcacaacggtggcctcggcgccaggacgttgaccagataacaccgggccgcctccccttccccgtcccctcctcccgaagacgccgggacagtcgggtgtccgccctcagcctcctggggactcgagccggggatcccctgacggtttttcttgcctaagttatttgagtcacaaaggcctccttccctgccgcctgcttcagctgggttgctggggggtgggcgtggatttagggagggggctgtgatgtaaaacgtctcccctgccaaaggaggggcaaagtgctgtgtcagttcctgtttcttcccatttcctggcacactctgcccctctgtccgggggacacgcgcatgtgtttgccagggatggggccaccgggttgatgccaacgctccgggtgcctgtcttgtctgtgtggcttctcagatggtggagggtgctgggagctggcagggtccttccagacagtctcagcctctccccgccgcccccaacaggctgtcaaacaaaaccggagagggggtgggggagccagcctcccagcgtgctgtgcccgcaggcacccgtgtgacatccgcacgtccagctccgtgacctgtgtgtgtgtgtgtgtgcacaagtgagtgagagatttcgaacgcccacccctcgactttgaaatctgagcaaaacaagaaactggggtcttcctctcccccgaacctctccccagctagtcttccctctgttcttcctgcctccagccgcccgcgccagattttgaaatctcggagacaaaactagtactgtaagataaatttttttgtactgtatttattgtgtataacgatttttttaaaggagaattctgtacatttagaactcttgtaaattaaaaaccgatcctttttttaaaactgta

SEQ ID NO: 12133 - DNA, 1522 bp, Homo sapiens
tggctgagttcttcctttgacaagatggcggcaggaggcagtggcgttggtgggaagcgcagctcgaaaagcgatgccgattctggtttcctggggctgcggcccacttcggtggacccagcgctgaggcggcggcggcgaggcccaagaaataagaagcggggctggcggcggcttgctcaggagccgctggggctggaggttgaccagttcctggaagacgtgcggctacaggagcgcacgagcggtggcttgttgtcagaggccccaaatgaaaaactcttcttcgtggacactggctccaaggaaaaagggctgacaaagaagagaaccaaagtccagaagaagtcactgcttctcaagaaaccccttcgggttgacctcatcctcgagaacacatccaaagtccctgcccccaaagacgtcctcgcccaccaggtccccaacgccaagaagctcaggcggaaggagcagctatgggagaagctggccaagcagggcgagctgccccgggaggtgcgcagggcccaggcccggctcctcaacccttctgcaacaagggccaagcccgggccccaggacaccgtagagcggcccttctacgacctctgggcctcagacaaccccctggacaggccgttggttggccaggatgagtttttcctggagcagaccaagaagaaaggagtgaagcggccagcacgcctgcacaccaagccgtcccaggcacccgccgtggaggtggcgcctgccggagcttcctacaatccatcctttgaagaccaccagaccctgctctcagcggcccacgaggtggagttgcagcggcagaaggaggcggagaagctggagcggcagctggccctgcccgccacggagcaggccgccacccaggagtccacattccaggagctgtgcgaggggctgctggaggagtcggatggtgagggggagccaggccagggcgaggggccggaggctggggatgccgaggtctgtcccacgcccgcccgcctggccaccacagagaagaagacggagcagcagcggcggcgggagaaggctgtgcacaggctgcgggtacagcaggccgcgttgcgggccgcccggctccggcaccaggagctgttccggctgcgcgggatcaaggcccaggtggccctgaggctggcggagctggcgcggcggcagaggcggcggcaggcgcggcgggaggctgaggctgacaagccccgaaggctggggcggctcaagtaccaggcacctgacatcgacgtgcagctgagctcggagctgacagactcgctcaggaccctgaagcccgagggcaacatccttcgagaccggttcaagagcttccagaggaggaatatgatcgagcctcgagagagagccaagttcaaacgcaagtacaaggtgaagctggtggagaagcgggcgttccgtgagatccagttgtagctgccatcagatgccggagactcgcccttcaataaaaaatctcttctagctgatcagtggg

SEQ ID NO: 12134 - DNA, 1478 bp, Homo sapiens
tgacaagatggcggcaggaggcagtggcgttggtgggaagcgcagctcgaaaagcgatgccgattctggtttcctggggctgcggcccacttcggtggacccagcgctgaggcggcggcggcgaggcccaagaaataagaagcggggctggcggcggcttgctcaggagccgctggggctggaggttgaccagttcctggaagacgtgcggctacaggagcgcacgagcggtggcttgttgtcagaggccccaaatgaaaaactcttcttcgtggacactggctccaaggaaaaagggctgacaaagaagagaaccaaagtccagaagaagtcactgcttctcaagaaaccccttcgggttgacctcatcctcgagaacacatccaaagtccctgcccccaaagacgtcctcgcccaccaggtccccaacgccaagaagctcaggcggaaggagcagctatgggagaagctggccaagcagggcgagctgccccgggaggtgcgcagggcccaggcccggctcctcaacccttctgcaacaagggccaagcccgggccccaggacaccgtagagcggcccttctacgacctctgggcctcagacaaccccctggacaggccgttggttggccaggatgagtttttcctggagcagaccaagaagaaaggagtgaagcggccagcacgcctgcacaccaagccgtcccaggcacccgccgtggaggtggcgcctgccggagcttcctacaatccatcctttgaagaccaccagaccctgctctcagcggcccacgaggtggagttgcagcggcagaaggaggcggagaagctggagcggcagctggccctgcccgccacggagcaggccgccacccaggagtccacattccaggagctgtgcgaggggctgctggaggagtcggatggtgagggggagccaggccagggcgaggggccggaggctggggatgccgaggtctgtcccacgcccgcccgccaccacagagaagaagacggagcagcagcggcgagaaggctgtgcacaggctgcgggtacagcaggccgcgttgcgggccgcccggctccggcaccaggagctgttccggctgcgcgggatcaccaggtggccctgaggctggcggagcgcggcggcagaggcggcggcaggcgcggcgggaggctgaggctgacaagccccgaaggctggggcggctcaagtaccaggcacctgacatcgacgtgcagctgagctcggagctgacagactcgctcaggaccctgaagcccgagggcaacatccttcgagaccggttcaagagcttccagaggaggaatatgatcgagcctcgagagagagccaagttcaaacgcaagtacaaggtgaagctggtggagaagcgggcgttccgtgagatccagttgtagctgccatcagatgccggagactcgcccttcaataaaaaatctcttctagctg

SEQ ID NO: 12135 - DNA, 850 bp, Homo sapiens
gacaagatggcggcaggaggcagtggcgttggtgggaagcgcagctcgaaaagcgatgccgattctggtttcctggggctgcggcccacttcggtggacccagcgctgaggcggcggcggcgaggcccaagaaataagaagcggggctggcggcggcttgctcaggagccgctggggctggaggttgaccagttcctggaagacgtgcggctacaggagcgcacgagcggtggcttgttgtcagaggccccaaatgaaaaactcttcttcgtggacactggctccaaggaaaaagggctgacaaagaagagaaccaaagtccagaagaagtcactgcttctcaagaaaccccttcgggttgacctcatcctcgagaacacatccaaagtccctgcccccaaagacgtcctcgcccaccaggtccccaacgccaagaagctcaggcggaaggagcagctatgggcctcagacaaccccctggacaggccgttggttggccaggatgagtttttcctggagcagaccaagaagaaaggagtgaagcggcgggaggctgaggctgacaagccccgaaggctggggcggctcaagtaccaggcacctgacatcgacgtgcagctgagctcggagctgacagactcgctcaggaccctgaagcccgagggcaacatccttcgagaccggttcaagagcttccagaggaggaatatgatcgagcctcgagagagagccaagttcaaacgcaagtacaaggtgaagctggtggagaagcgggcgttccgtgagatccagttgtagctgccatcagatgccggagactcgcccttcaataaaaaatctcttctagctg

SEQ ID NO: 12136 - DNA, 4971 bp, Homo sapiens
aaaggctgccagggccgcaggctgccaagccctgccctgcccaaggcgcatagagcatggcccgaggcgctgagggaggccgtggggacgcgggttggggcctgcgtggcgccctggcggccgtggcgctgctctcggcgctcaacgctgcgggcacggtgttcgcgctgtgccagtggcgcgggctgagctcggcgctgcgggctttggaggcgcagcggggccgggagcagcgcgaggacagtgccctgcgctccttcctggccgagttgagccgcgcgccgcgcggggcgtccgcaccaccccaagacccggccagctcagctcgcaacaagcgcagccacagcggcgagcccgcgccgcatatccgcgccgagagccatgacatgctgatgatgatgacctactccatggtgccgatccgagtgatggtggacctgtgcaacagcaccaagggcatctgcctcacaggaccttctggaccaccaggacctccgggagccggcgggttgccaggacacaacggattggatggacagcctggtcctcagggcccaaaaggagaaaaaggagcaaatggaaaaagaggaaaaatggggatacctggagctgcaggaaatccaggggaaaggggagaaaagggagaccatggtgaactgggcctgcagggaaatgagggcccaccagggcagaagggagaaaagggtgacaaaggagatgtgtccaacgacgtgctcctggcaggtgccaaaggtgaccaaggcccacccggtccacctgggcccccaggccctccaggtcctccagggccccctggaagcagaagagccaaaggccctcggcagccaagcatgttcaacggccagtgcccaggtgagacttgtgccataccaaatgatgataccttggttggaaaagctgatgagaaagccagtgaacaccattccccacaagcagaatccatgatcacttccattggaaacccagtgcaagtactgaaagtgacagagacatttgggacttggataagagagtctgctaacaagagtgatgaccggatttgggtgacagagcatttttcaggcatcatggttaaggaattcaaggatcagccctcacttctgaatggcagttacacgttcatccaccttccatactatttccatggctgtgggcacgttgtttacaacaactctctctactaccacaaagggggttctaataccctagtgagatttgaatttggccaggaaacatcccaaactctgaagcttgaaaatgccttgtattttgatcgaaaatacctttttgcaaattccaaaacttacttcaatctagctgtagatgaaaagggcctttggattatctatgcgtcaagtgtggacggctcgagcattcttgtagcacaactggatgagaggacattctcagtggtgcaacacgtcaataccacgtaccctaaatccaaggctggcaacgccttcattgcccgaggaatcctctatgtcacagacaccaaagatatgagggtcacatttgcctttgatttgttaggagggaaacagatcaatgcaaactttgatttaagaacttcccagtctgttcttgccatgttagcatacaacatgagagatcagcatttatattcatgggaagatggccatttaatgctttatcctgtgcagtttttgtcaactaccttaaatcagtgatgtgctgcattcggctcccttcagcaaatttcaggggttttctgggaccagttctcccccaacaggaaacttgtttttttaacgtcagccagatatttagaaaataacctcaaaagtgtttatatggtcagtgagccccgcttagtgaaatagcaacagattggaagttgaaatggctgagatttggtgatctccccacagctggctctgcaagttacctctttctccttgggccttagtttccccattggtaatctgaattggctaagatgattggggagattttctgtacctgtaggtaatttggtgattcttggtggctgctcttctcacaacttttatgtatctgcttctgtcgtttagcttttttagccacatgctgaccaaatttacctttgagttgataagtccagtggcttgagtagtgaatccctcagtgctgacttatatcttgttctttgaaaaaatgcattgactctttaagacatctaaagtatcacattatccataatttattgcttttctttgcatctgcacctgccaccacagaataaccattaccctcagctgctgattgggcagctctgagattagcaaaagccagggacagctacatgttcaggtttttttttttttttttttttcaataagctattttttttcttttcttattttaaatagagagagagtcttgctatgtttcccaggctggtcttgaactcctggggctcaagtgatcctcctgccttggcctcccaaaatgctggattacaggcatgtgtgcctggcccaggtttcttaataaaacagaatcatgatcttccaggttccccccagtttctgatcatgttgatttgtagctgtggatcatgaacactgaatcctcagatcactctgacttcttatgcttctcctgtggatccactatcaaagtactaaatgctgtgtaagtagacgttaatctggctggaaccatgggaagcactttgcagtgttcagaagagaggctccatttgtggctattatgtagaactgggccagagccagtccattgcctgtttttttaaataaggttttactgagcacagccacactcatttgtttatgcagtacggcctgacattgcttttgctctgcaacagcagagtcgagtcattgcaacaaagagcatatggccccacagtgcctaaaatattgaccagctacccctttatggaaaaagattgctgactcctgataaagaatataaagtgagcctgattcttgaaaaaatcagaaccagagcctgttttgttttgttctaaactaagaagccgcataggatgtgacttgcgttttgagtagaggggaaggctgataacggcgtaagatgaagtggccctccacaaaggctggttaggggacagttctttctctaacatagttttaaaggatgtgatctggtccccttggatgccaggagagaatccagttgaacttgctcctaaatgctcttaaatatgcatattttctgccaactcacttctttaaacatctttcagcccagcgctgcggccccgggaagggccactgcgaatagagaggaagctggaaaagttcctggggctctgcagccaggaaggggaaccagggcaaatcttatgtaaagatttttcagcaacttgtcccaatttgtgtgtattctgaaactttctctttgggaccaaattcattctcaatggccctgagttcaatatattattaacagcagtattttaaaacttagggttgaactgggcatggtggcacataactgcaatcccagctactttggaggcagggatgggaggatcacttgaggccaggatctcaggaccagcctagagagatcccatctctaaaaaataaaatataagaaaataaaacttaggggatatacagatttaaatattcaaatctccctgctcccctgaaagtccccaggcagctgtcaatgacttgtttgttgtgttctcaatatgatggctatttgaaacttcacctacttttcattagattggttgtaccatgtcaccttagcttttaaaaatactcttttcagattcacgttctctaacaaagagtctcatgttcaagatcaatatgtctaataagtgctggtgtccttttaaagtatttaaatatatatgttgctgttgctgaatacaggagaccaggttaggaatatagtttcataataatagtacatacaatactaattgtatataaggtagcaaccaaaagaggttgttaattagcacatattccttttagaaaaatgtttcagaaacctcagtcttgatatctgagctatctgggctcccttacttgtgagtaagggatcatgctcaccactggagaagcttacaccgggactttttttcttttttcttttttttttgctatgacagagtaatgctaacgtaaggacaactgagtttgatcagtgtttaatcgcagtgggtaatcttatctgattgtctttaaaagtgaaaaggattaagattttattctttcttgtaaacattacttgattttttaaagaagttttgggctcactgctaaaatagagtatacaactgaatgtttttaagtcaagatactgttttaggagtttaccctctcatttataaccaaagttgctctaaaacactttccaaatatctgcacttctgatgtcagaatcaaaccagataattctctaattcttctttaatctaaagtagatagcttcccactggaaagtaaacaaaaccatccctcccaacctcaaagctaggccacactctatttcaaggcattttctttcagctgataaggtgtcctcctgaagccaagtaggtggttctggtctccaagtatcgttaagcacaggtgctatgacagaaaaagttctggggtggaagttttaagatgaggagttctgatcttaggcatcttaacagtcacaaggtgaaaagtcaaatgaaacagtacaattcttgatgagtgaggtgtcatcttccaaccacacagaggacgttttggctatgatcatctgatggcaagtgaaggagaaatgagtgatagggctttgcgttttcatccagatgctgtggccctgtgtttcacagcattaagagccataatttccaacctgcacagatcctgaacaacaaatgaataacgatgaatgtctttttggttgtaatttaacaagtcaaataaaataatcattgctgagcacaatcacatgttgaaa

SEQ ID NO: 12137 - DNA, 4584 bp, Homo sapiens
accattgtgtatgattcgttgttgactgcagcatcactagatccgagtgatggtggacctgtgcaacagcaccaagggcatctgcctcacaggaccttctggaccaccaggacctccgggagccggcgggttgccaggacacaacggattggatggacagcctggtcctcagggcccaaaaggagaaaaaggagcaaatggaaaaagaggaaaaatggggatacctggagctgcaggaaatccaggggaaaggggagaaaagggagaccatggtgaactgggcctgcagggaaatgagggcccaccagggcagaagggagaaaagggtgacaaaggagatgtgtccaacgacgtgctcctggcaggtgccaaaggtgaccaaggcccacccggtccacctgggcccccaggccctccaggtcctccagggccccctggaagcagaagagccaaaggccctcggcagccaagcatgttcaacggccagtgcccaggtgagacttgtgccataccaaatgatgataccttggttggaaaagctgatgagaaagccagtgaacaccattccccacaagcagaatccatgatcacttccattggaaacccagtgcaagtactgaaagtgacagagacatttgggacttggataagagagtctgctaacaagagtgatgaccggatttgggtgacagagcatttttcaggcatcatggttaaggaattcaaggatcagccctcacttctgaatggcagttacacgttcatccaccttccatactatttccatggctgtgggcacgttgtttacaacaactctctctactaccacaaagggggttctaataccctagtgagatttgaatttggccaggaaacatcccaaactctgaagcttgaaaatgccttgtattttgatcgaaaatacctttttgcaaattccaaaacttacttcaatctagctgtagatgaaaagggcctttggattatctatgcgtcaagtgtggacggctcgagcattcttgtagcacaactggatgagaggacattctcagtggtgcaacacgtcaataccacgtaccctaaatccaaggctggcaacgccttcattgcccgaggaatcctctatgtcacagacaccaaagatatgagggtcacatttgcctttgatttgttaggagggaaacagatcaatgcaaactttgatttaagaacttcccagtctgttcttgccatgttagcatacaacatgagagatcagcatttatattcatgggaagatggccatttaatgctttatcctgtgcagtttttgtcaactaccttaaatcagtgatgtgctgcattcggctcccttcagcaaatttcaggggttttctgggaccagttctcccccaacaggaaacttgtttttttaacgtcagccagatatttagaaaataacctcaaaagtgtttatatggtcagtgagccccgcttagtgaaatagcaacagattggaagttgaaatggctgagatttggtgatctccccacagctggctctgcaagttacctctttctccttgggccttagtttccccattggtaatctgaattggctaagatgattggggagattttctgtacctgtaggtaatttggtgattcttggtggctgctcttctcacaacttttatgtatctgcttctgtcgtttagcttttttagccacatgctgaccaaatttacctttgagttgataagtccagtggcttgagtagtgaatccctcagtgctgacttatatcttgttctttgaaaaaatgcattgactctttaagacatctaaagtatcacattatccataatttattgcttttctttgcatctgcacctgccaccacagaataaccattaccctcagctgctgattgggcagctctgagattagcaaaagccagggacagctacatgttcaggtttttttttttttttttttttcaataagctattttttttcttttcttattttaaatagagagagagtcttgctatgtttcccaggctggtcttgaactcctggggctcaagtgatcctcctgccttggcctcccaaaatgctggattacaggcatgtgtgcctggcccaggtttcttaataaaacagaatcatgatcttccaggttccccccagtttctgatcatgttgatttgtagctgtggatcatgaacactgaatcctcagatcactctgacttcttatgcttctcctgtggatccactatcaaagtactaaatgctgtgtaagtagacgttaatctggctggaaccatgggaagcactttgcagtgttcagaagagaggctccatttgtggctattatgtagaactgggccagagccagtccattgcctgtttttttaaataaggttttactgagcacagccacactcatttgtttatgcagtacggcctgacattgcttttgctctgcaacagcagagtcgagtcattgcaacaaagagcatatggccccacagtgcctaaaatattgaccagctacccctttatggaaaaagattgctgactcctgataaagaatataaagtgagcctgattcttgaaaaaatcagaaccagagcctgttttgttttgttctaaactaagaagccgcataggatgtgacttgcgttttgagtagaggggaaggctgataacggcgtaagatgaagtggccctccacaaaggctggttaggggacagttctttctctaacatagttttaaaggatgtgatctggtccccttggatgccaggagagaatccagttgaacttgctcctaaatgctcttaaatatgcatattttctgccaactcacttctttaaacatctttcagcccagcgctgcggccccgggaagggccactgcgaatagagaggaagctggaaaagttcctggggctctgcagccaggaaggggaaccagggcaaatcttatgtaaagatttttcagcaacttgtcccaatttgtgtgtattctgaaactttctctttgggaccaaattcattctcaatggccctgagttcaatatattattaacagcagtattttaaaacttagggttgaactgggcatggtggcacataactgcaatcccagctactttggaggcagggatgggaggatcacttgaggccaggatctcaggaccagcctagagagatcccatctctaaaaaataaaatataagaaaataaaacttaggggatatacagatttaaatattcaaatctccctgctcccctgaaagtccccaggcagctgtcaatgacttgtttgttgtgttctcaatatgatggctatttgaaacttcacctacttttcattagattggttgtaccatgtcaccttagcttttaaaaatactcttttcagattcacgttctctaacaaagagtctcatgttcaagatcaatatgtctaataagtgctggtgtccttttaaagtatttaaatatatatgttgctgttgctgaatacaggagaccaggttaggaatatagtttcataataatagtacatacaatactaattgtatataaggtagcaaccaaaagaggttgttaattagcacatattccttttagaaaaatgtttcagaaacctcagtcttgatatctgagctatctgggctcccttacttgtgagtaagggatcatgctcaccactggagaagcttacaccgggactttttttcttttttcttttttttttgctatgacagagtaatgctaacgtaaggacaactgagtttgatcagtgtttaatcgcagtgggtaatcttatctgattgtctttaaaagtgaaaaggattaagattttattctttcttgtaaacattacttgattttttaaagaagttttgggctcactgctaaaatagagtatacaactgaatgtttttaagtcaagatactgttttaggagtttaccctctcatttataaccaaagttgctctaaaacactttccaaatatctgcacttctgatgtcagaatcaaaccagataattctctaattcttctttaatctaaagtagatagcttcccactggaaagtaaacaaaaccatccctcccaacctcaaagctaggccacactctatttcaaggcattttctttcagctgataaggtgtcctcctgaagccaagtaggtggttctggtctccaagtatcgttaagcacaggtgctatgacagaaaaagttctggggtggaagttttaagatgaggagttctgatcttaggcatcttaacagtcacaaggtgaaaagtcaaatgaaacagtacaattcttgatgagtgaggtgtcatcttccaaccacacagaggacgttttggctatgatcatctgatggcaagtgaaggagaaatgagtgatagggctttgcgttttcatccagatgctgtggccctgtgtttcacagcattaagagccataatttccaacctgcacagatcctgaacaacaaatgaataacgatgaatgtctttttggttgtaatttaacaagtcaaataaaataatcattgctgagcacaatcaca

SEQ ID NO: 12138 - DNA, 1676 bp, Homo sapiens
tgatggtggacctgtgcaacagcaccaagggcatctgcctcacaggaccttctggaccaccaggacctccgggagccggcgggttgccaggacacaacggattggatggacagcctggtcctcagggcccaaaaggagaaaaaggagcaaatggaaaaagaggaaaaatggggatacctggagctgcaggaaatccaggggaaaggggagaaaagggagaccatggtgaactgggcctgcagggaaatgagggcccaccagggcagaagggagaaaagggtgacaaaggagatgtgtccaacgacgtgctcctggcaggtgccaaaggtgaccaaggcccacccggtccacctgggcccccaggccctccaggtcctccagggccccctggaagcagaagagccaaaggccctcggcagccaagcatgttcaacggccagtgcccaggtgagacttgtgccataccaaatgatgataccttggttggaaaagctgatgagaaagccagtgaacaccattccccacaagcagaatccatgatcacttccattggaaacccagtgcaagtactgaaagtgacagagacatttgggacttggataagagagtctgctaacaagagtgatgaccggatttgggtgacagagcatttttcaggcatcatggttaaggaattcaaggatcagccctcacttctgaatggcagttacacgttcatccaccttccatactatttccatggctgtgggcacgttgtttacaacaactctctctactaccacaaagggggttctaataccctagtgagatttgaatttggccaggaaacatcccaaactctgaagcttgaaaatgccttgtattttgatcgaaaatacctttttgcaaattccaaaacttacttcaatctagctgtagatgaaaagggcctttggattatctatgcgtcaagtgtggacggctcgagcattcttgtagcacaactggatgagaggacattctcagtggtgcaacacgtcaataccacgtaccctaaatccaaggctggcaacgccttcattgcccgaggaatcctctatgtcacagacaccaaagatatgagggtcacatttgcctttgatttgttaggagggaaacagatcaatgcaaactttgatttaagaacttcccagtctgttcttgccatgttagcatacaacatgagagatcagcatttatattcatgggaagatggccatttaatgctttatcctgtgcagtttttgtcaactaccttaaatcagtgatgtgctgcattcggctcccttcagcaaatttcaggggttttctgggaccagttctcccccaacaggaaacttgtttttttaacgtcagccagatatttagaaaataacctcaaaagtgtttatatggtcagtgagccccgcttagtgaaatagcaacagattggaagttgaaatggctgagattttctgtacctgtaggtaatttggtgattcttggtggctgctcttctcacaacttttatgtatctgcttctgtcgtttagcttttttagccacatgctgaccaaatttacctttgagttgataagtccagtggcttgagtagtgaatccctcagtgctgacttatatcttgttctttgaaaaaatgcattgactctttaagacatct

SEQ ID NO: 12139 - DNA, 4469 bp, Homo sapiens
agatgcctcacctctaggggatgctgattctgggatgcctttttcgtctcctaggctcctcaaggccaactgcgctgggaagagggggtgtccaacagcaggagggctgtttttttgaactacaatttgccagcatacagcagagcagcaagaagataacagggcggggggcacgggattagcccaaacaaaacacactcaagaacgcgagtctgtggttcaacacgaggcagaaaacagctgggccgggtgcggggcttctccctcgcgtgtatccgctcactgcactcgctgccctggccgcgggcgccgcgcagggtgctgatgtccaggagggatctagacctcccgcggcgctcgggctagtggacgcaggtggtcccaaatgctgggaccaagctaggaaccaagcggaagctcggattgctcggcatcgggcctcgtcgttattctaccgtgagggaaactgagaccgagggcacggcagggagtcgcccgccgtctcaccagcgtgaggggttgcgccgggccccgaaaactggtttgcgccgcccggcatcgggatccgggacctctgcccgccgggcgctgcctgcgcgttcctggaactgggctgggcggagaaatcagggcccgcagagaggcattcctgccgccttccccgccgcccggggccgcaggggggcctggccaaggcttccagcacagaggagcttcggggaggctggattgcgcctgtgtctaaaaataaacaggttcctgcgtgaagaccagctgggagcccactgcctgctgccacctccaactccggccccctcaccatgcactccctggacgagccgctcgacctgaagctgagtatcaccaagctccgggcggcaagagagaagcgggagaggacgctgggtgtggtccggccccgtgctctgcacagggagctgggcctggtggatgacagccccacacctggctctccaggctccccgccctcaggcttcctgctgaactccaagttccccgagaaggtggagggacgcttttcagcagcccctctcgtggacctcagcctgtcaccaccatctgggctggactcccccaatggcagcagctcgctgtcccccgagcgccagggcaacggggacctgcctccagtgcccagtgcctcggacttccagccactgcgctatttggatggtgtccccagctccttccagttcttcctgcccctcggctccgggggggccctgcacctgcctgcctcctccttccttacccctcccaaggacaagtgcctctcgccagacctgcccctgcccaagcagctggtgtgtcgctgggccaagtgtaaccagctctttgagctcctgcaagacctggtggaccatgtcaacgattaccatgtcaagcccgagaaggatgcggggtactgctgccactgggagggctgcgcccgccatggccgaggtttcaacgccaggtacaagatgctcatccacatccgcacacacaccaacgagaagccacaccgctgtccgacctgcagcaagagcttctcccgcctggagaacctgaagatccacaaccggtcgcacacaggtgagaagccctacgtctgcccctacgagggctgcaacaagcgctattccaactccagtgaccgctttaagcacacgcgcacccactatgtggacaagccctactactgcaagatgcccggctgccacaagcgctacacggaccccagctcactgcgcaagcacatcaaggcccatggccactttgtgtcccacgagcagcaagagctcctgcagctgcgcccaccccccaagccgccactgcccgcccccgacggcggcccctatgtcagtggggcccagatcatcatccccaacccagctgccctctttggaggccctggcctgcccggcttacccctacccctggcccccggcccccttgacctcagtgccctggcctgtggcaacggtgggggcagtgggggtggggggggcatgggccctgggctgccaggccccgtcctgcctctcaatctggccaagaacccgctgctgccctcgccctttggggctggcggactgggcttgcctgtggtctccctccttgctggcgcagctggtggcaaggccgagggggagaaggggcgtgggtcggtgcccaccagggccctgggcatggagggccacaagacgccccttgaaaggacggagagcagctgctcccggccaagccccgatggactccccctgctgccaggcaccgtgctggacctgtccacgggcgtcaactcagctgccagcagcccagaggcgttggcccctggctgggtggtcatcccgccgggctcggtgctgctcaaaccggctgtggtgaactgagcccatcctgcggacagttgtggtgcccccccggcagctcccggcactgcccccgacgaacggaaactcttctgtgaaatagcaataatgtcctactgcccgggcagccccagcccagcccgccgggagcaaggatggtgctaggtcattcatggctggcctcccagcccccgggtggggacctggcctgtcatgcagggagagctgtgctcctgggtgctgaagcctcgctcctgtctgtcccccaccacctggccctcagcttctgagaggctttcccctgcccgacctcctcccgtttccctctcccaccctggcacctccctcacctagtgaccacccatggcaagttgccctctcccagcagagggggtgggtggggtggcatctgccctccctgctagcaccaggctcccccttcctgagaggagcccccagggaccagaggcctgcccttccctcctaggcttacccagcccctgccctgggggctccttggacccctttccctctgaccctgcctccagagggaaagcaagacagatgcaggcccctgcaaagccccaggtagaagcatgccccccaggacaaggcgcctcccactagttaggaggaggcccgctctgcagccgccgtcctcaccccaggccaggcctgcagtaccagacgggatagctggccactccacccctgcaccccagggtctcctccctctaccttttggggcaccctgggagcgtgggaagcaggtccgagggcccctgagctggcaaggggaggtgccaggccagctgtggtgccaagatactgagtgacctgggccctggctcagggagcatgtggggccaggcccagcgccccgtcttcctccttctacccccgctgggcctggcctgggcagcgccccctgcagaggcctttgggtccttggtcctgtaacaggaagggggaggctggctggggacgaccgaccacaggctgggacacagctcctggtctgggggctccaagtgacagcatgcaggggagggggctcccagtcagtgctgtgttgggagctttctggaggctgtggactgaaggccttgagggaagcagtggctggaggagggtgctggacccatgacacgttgcttcctctggcttttccctgctgggccgctttctcagaggcacttccccacccctaacacccagtgggcccccccaggttctgtgccactcagagggaccctggcaggggccagaaccacttaagggtggtgctggagggccttgtgccccagtcccatcccaggacgccctgagggatggacgcagccatgcaccccccatctggggcctctccctgctccctctcccacctggcagctgggagttctggcttctaggcctgccctgtcaccaggcctctgagtggccaggcccttccacctccccatctgtaaaacgaggcagctgcccggacagccttggggtccttagtggccctgcaggtcctctggcagctctgctgaccccaccctctcccggactgcccttctgtcccagaggggtcaccctgacccggcccaccttgccactgggctttggactccagccctgacagggcccagccacactggctctgcccctcgaaggggctatgagcaaggtaggagggagctggtctcctttcttcgggccccacccaggccctgagcaccccccacccctgtgagggccccaggccttaagtccctggcggggtcatgggtttgcgacttgagcagagcggaggaacagggcactggaaggccgacgagctcagcatgcgactcggtgacggaccaggctcggcagggccggtgtactttttgtggttgtcattggtgtgttgttgcacattccaggacgtcagtattttaacaggttctaagtgcctttctatcgtagcttatgttttcctcctcttggctccattgctgttagcatagagttttaaaaaaagagataagctaatgactataacaatatattcctccatgggagaggaagtttataaagaaacaataaaagtgagttgcaaagatg

SEQ ID NO: 12140 - DNA, 3705 bp, Homo sapiens
tgaagaccagctgggagcccactgcctgctgccacctccaactccggccccctcaccatgcactccctggacgagccgctcgacctgaagctgagtatcaccaagctccgggcggcaagagagaagcgggagaggacgctgggtgtggtccggccccgtgctctgcacagggagctgggcctggtggatgacagccccacacctggctctccaggctccccgccctcaggcttcctgctgaactccaagttccccgagaaggtggagggacgcttttcagcagcccctctcgtggacctcagcctgtcaccaccatctgggctggactcccccaatggcagcagctcgctgtcccccgagcgccagggcaacggggacctgcctccagtgcccagtgcctcggacttccagccactgcgctatttggatggtgtccccagctccttccagttcttcctgcccctcggctccgggggggccctgcacctgcctgcctcctccttccttacccctcccaaggacaagtgcctctcgccagacctgcccctgcccaagcagctggtgtgtcgctgggccaagtgtaaccagctctttgagctcctgcaagacctggtggaccatgtcaacgattaccatgtcaagcccgagaaggatgcggggtactgctgccactgggagggctgcgcccgccatggccgaggtttcaacgccaggtacaagatgctcatccacatccgcacacacaccaacgagaagccacaccgctgtccgacctgcagcaagagcttctcccgcctggagaacctgaagatccacaaccggtcgcacacaggtgagaagccctacgtctgcccctacgagggctgcaacaagcgctattccaactccagtgaccgctttaagcacacgcgcacccactatgtggacaagccctactactgcaagatgcccggctgccacaagcgctacacggaccccagctcactgcgcaagcacatcaaggcccatggccactttgtgtcccacgagcagcaagagctcctgcagctgcgcccaccccccaagccgccactgcccgcccccgacggcggcccctatgtcagtggggcccagatcatcatccccaacccagctgccctctttggaggccctggcctgcccggcttacccctacccctggcccccggcccccttgacctcagtgccctggcctgtggcaacggtgggggcagtgggggtggggggggcatgggccctgggctgccaggccccgtcctgcctctcaatctggccaagaacccgctgctgccctcgccctttggggctggcggactgggcttgcctgtggtctccctccttgctggcgcagctggtggcaaggccgagggggagaaggggcgtgggtcggtgcccaccagggccctgggcatggagggccacaagacgccccttgaaaggacggagagcagctgctcccggccaagccccgatggactccccctgctgccaggcaccgtgctggacctgtccacgggcgtcaactcagctgccagcagcccagaggcgttggcccctggctgggtggtcatcccgccgggctcggtgctgctcaaaccggctgtggtgaactgagcccatcctgcggacagttgtggtgcccccccggcagctcccggcactgcccccgacgaacggaaactcttctgtgaaatagcaataatgtcctactgcccgggcagccccagcccagcccgccgggagcaaggatggtgctaggtcattcatggctggcctcccagcccccgggtggggacctggcctgtcatgcagggagagctgtgctcctgggtgctgaagcctcgctcctgtctgtcccccaccacctggccctcagcttctgagaggctttcccctgcccgacctcctcccgtttccctctcccaccctggcacctccctcacctagtgaccacccatggcaagttgccctctcccagcagagggggtgggtggggtggcatctgccctccctgctagcaccaggctcccccttcctgagaggagcccccagggaccagaggcctgcccttccctcctaggcttacccagcccctgccctgggggctccttggacccctttccctctgaccctgcctccagagggaaagcaagacagatgcaggcccctgcaaagccccaggtagaagcatgccccccaggacaaggcgcctcccactagttaggaggaggcccgctctgcagccgccgtcctcaccccaggccaggcctgcagtaccagacgggatagctggccactccacccctgcaccccagggtctcctccctctaccttttggggcaccctgggagcgtgggaagcaggtccgagggcccctgagctggcaaggggaggtgccaggccagctgtggtgccaagatactgagtgacctgggccctggctcagggagcatgtggggccaggcccagcgccccgtcttcctccttctacccccgctgggcctggcctgggcagcgccccctgcagaggcctttgggtccttggtcctgtaacaggaagggggaggctggctggggacgaccgaccacaggctgggacacagctcctggtctgggggctccaagtgacagcatgcaggggagggggctcccagtcagtgctgtgttgggagctttctggaggctgtggactgaaggccttgagggaagcagtggctggaggagggtgctggacccatgacacgttgcttcctctggcttttccctgctgggccgctttctcagaggcacttccccacccctaacacccagtgggcccccccaggttctgtgccactcagagggaccctggcaggggccagaaccacttaagggtggtgctggagggccttgtgccccagtcccatcccaggacgccctgagggatggacgcagccatgcaccccccatctggggcctctccctgctccctctcccacctggcagctgggagttctggcttctaggcctgccctgtcaccaggcctctgagtggccaggcccttccacctccccatctgtaaaacgaggcagctgcccggacagccttggggtccttagtggccctgcaggtcctctggcagctctgctgaccccaccctctcccggactgcccttctgtcccagaggggtcaccctgacccggcccaccttgccactgggctttggactccagccctgacagggcccagccacactggctctgcccctcgaaggggctatgagcaaggtaggagggagctggtctcctttcttcgggccccacccaggccctgagcaccccccacccctgtgagggccccaggccttaagtccctggcggggtcatgggtttgcgacttgagcagagcggaggaacagggcactggaaggccgacgagctcagcatgcgactcggtgacggaccaggctcggcagggccggtgtactttttgtggttgtcattggtgtgttgttgcacattccaggacgtcagtattttaacaggttctaagtgcctttctatcgtagcttatgttttcctcctcttggctccattgctgttagcatagagttttaaaaaaagagataagctaatgactataacaatatattcctccatgggagaggaagtttataaagaaacaataaaagtgagttgcaaagatg

SEQ ID NO: 12141 - DNA, 6667 bp, Homo sapiens
atcctttatggttgaagggtgttggaggaagcagagttttcatcagctgctgaagtggcaactaatagaggtttgaatggccgtagaaaaatattgtgttacttgtttgttgtctaggggctcttggctttgggcctcagtgcaagtccattggaaaaggcagctgcaacaatctagtggtcaccagcagtcccatgatggttcagcgactgggactcatttcacctccagcaagccaggtctctacagcatgcaaccagatcagtcctagcttacagagggcaatgaatgcagccaacctgaatatacctccttcagataccaggtcccttatttcgcgtgagtctttggcgtccacgaccttgagtctgacggaaagtcagtcggcctcaagcatgaagcaggagtggtcccagggctacagggccctcccttcgctctccaaccacggctctcagaatggccttgatctaggggatctccttagccttcctcccgggacatccatgtccagcaatagtgtctctaactcattaccatcctacctttttggcacggaaagtagccactctccttaccctagtcctcggcactcatccaccaggtcccactcggcccgctccaagaagagagcgctgtccttgtccccgctgtccgatggcatcgggatagatttcaataccatcatccgcacgtcgcccacgtccttggtggcctacatcaacgggtcgagggcttcgccggccaacctgtccccgcagccggaggtctacgggcatttcctgggcgtgcgcggcagctgcattccccagccgcgcccggtgcccggcagccagaagggcgtgctggtggcccctggaggcctggcgctgccggcctacggcgaggacggggccctggagcacgagcgcatgcaacagctggagcacggcggcctgcagccaggcctggtcaaccacatggtggtgcagcatggcctgccgggccccgacagccagtcggccggcctgttcaagaccgaacgcctggaggagttcccgggcagcaccgtagacctaccccccgcgcctccgctccctcctctgccgccgcccccaggccccccacccccttaccatgcccatgcgcaccttcaccacccggagctcgggccccacgcccagcagctggccttgccccaggccaccctggacgacgacggggagatggacggcatcgggggcaagcattgctgccgctggatcgactgcagcgccctgtacgaccagcaggaggagctcgtgcggcacatcgagaaggtccacatcgaccagcgcaaaggggaggacttcacttgcttctgggccggttgccctcgaagatacaagcccttcaacgcccgctataaactgctgatccacatgagagtccactctggggagaagcccaacaagtgtacgtttgaaggttgcgagaaggccttttcaaggcttgaaaatctcaagatccacttgcggagccacacaggcgagaagccgtatttgtgccagcatccgggttgtcagaaggccttcagtaactccagtgaccgcgccaaacaccagcggacgcatctggacaccaaaccttatgcttgtcaaattccaggatgtaccaaacgctacacagacccaagttccctaagaaagcatgtgaaggcacattcttccaaagagcaacaagcaaggaaaaagttgcggtccagcacagagctccatccagacctgctcacagattgcctcaccgtgcagtccctgcagccggccacttcccctagagatgctgctgctgaagggaccgtgggacgctcccctggacccgggcctgacctctattcagctcccattttctccagcaattattcaagccgaagtggaacagctgctggggccgtaccacccccacatcctgtcagtcacccttctccaggacataatgtacaggggagccctcacaacccctcctcccagttacctccactcacagctgtggacgcaggagctgagaggtttgcaccttctgctccatctcctcaccacatcagcccccggagagttccagctccttcttcaatactgcaaagaacacagcctccctatacccagcagccatcaggttcacacctgaagtcctatcagccagaaacaaactcttcttttcaaccaaatggtatccatgtccatggattttatgggcagctgcagaagttctgtcccccacactaccccgattcccagagaattgtgccgcctgtcagctcctgcagtgtggtgccttcgtttgaggactgcctagtccctacatccatgggccaggccagttttgatgttttccacagagccttctcgactcactcgggcattacagtgtatgatttaccttcaagttcctcgagcctctttggggagtctctccgcagcggggctgaagatgctaccttcttgcagatcagcaccgtggaccgctgtcctagccagctctcctctgtctacaccgaaggctaaaagctctcttggccactcctgcacacccaggaccttgatgttgcttgccaccttttgttttcgtactctcacagactgcttgaggaaggatgtcagcccaatcagcgggccctgcagagttactgatgttctttcagaaggcaggactgaatggcagagctagctttgcaggaatcattacagttgctcctttttctctctggttttcctggactatgtgaccaggaggactgtcttttcaaagggaatttagagcctcactctcctggatacctgttacttcctggctgtcaacccttaaaggaccccagtgaaatgatgtgcatatgaaaatgtagtttggggatgactctacctgaaaactccaaacagggaaaaagacctcaattacgagaggcatagtgacctgcctcacctaatcctcacccttgctgctcctgatgcaaagccaggcacaacaagggaaatccatgtccaaagcatagtgtggtctcaactcttagaaactccctgggtttcccttttctcttagccacatgctaaccagttgcttctcagtgtttctcttcaatagaaaaataaggttttatatgccagcagcctatccttgtttttgcattttaaagacttagttatttatacgtattttaaaatgaaaaaaaaatgtaaaggtctgtgctttggatggaaatcattattattgtaatcaccccagctatagacattttgcacagctgtggttctgcctggccccacctctagcatgttagttttgcagttagcaaaggttacctgagggaaatggagtgggcacctcccgcaccaacagtcctgtagctggaaccttcctgagttgactgtttagtaactccacctcaaagactgtgttcaaagaaaaatgttgtttgactggtttacccattgcctccactctggtgctgcacccagagaagtgccagatgtgagaactgggacagactgagtcatgtgccagcttcccttggaaaaccaaacctagtgatacttgacttccagtgctcagattttactaacgtttttcaggatatccactcatctgtctgtctcttccctacacttctctccaccctctttttgcatccctcttaccctcttcctgactgtggttcatatatccccaccagccgccattgtctgatcatcttgggaaggtagaggtgacagttctcgaaaagtctacagaaagaggcaattctttttctgagttccagtttgaaggcctggaattttcacatagcacttggtcgaaaatatcaagcctaaataggaagtcattttctgtgacacctctacatagctattacagatcctaagtcctagggcatcagctataaaaattggccagtcccaaagacacagtaagttctaacattctggtactatcatatttcaagtattttttctcactttttaaaaatgtttttctgaacaaaagtgaaacaatgccatttatcaaactgagatcattacaatcttcaacaagacaactaaaacagcttgatgttagatgggattctgtgacagtttgtatactgacaggtccttccagtctccctccacagtcccacaagcggaagtattctacctgattccagagttcattccaacatgcagtagaatgaggtgaatgaagaaccaagtgtgggttttgttttcacagtgcacttggtcaatctagtttctctgagtagtgggctgtattctaagaaaagctttcacgtagacgtcaaagtctgcaaaagagatgagttagccactttaaaaaacctgctctgctttacaaaagatgcacaccaggcttcctttacaagtgaactccaaggctgcttgtaaagtaccacccttcctgcagactttgtgggtcgtgtcacttggcctaaacaagtggcctaacatatgcatgctcacagctagtagcatccctcatgcgtcctttgtcatactctggaaagaaaaaaactctgctatcttcagagaaaccatctattcatacttaaatatggaagcctttacaaggaactcaaaatacatttcatttcatttgtacaatgagaaaaaagatgaaaaggcaaggttgttattgcagttgacattgtcagccctgccttttggctttatgtaatttaaaatagaaagggggaaggaggacaagacagaagctcaactttagaaaccatggacatcacctccctctttgagaggagctgcttgtgaaccaggctccagtcttcctgtggcctctcacagtaaccctgcccctttcttacctcacaggggcaagagggactctaaagagggcgtaagcaatagaggcacctgcagccctccttcctcagcaggaaatcaatgtggagccccagagggacattttatctcagagagagcatgctggccacaggacccagtgcagccctgcttcccgcaccgtgggtctttcctgatagctgcaggcttgagattgcagcctcaggataggacacgttcagatgccttccagactacacacactatgcttagattcgagagtctttcctgaccttaaaatttgtcccttgcttactttcacactgcagaagatttatatatatattcatcattatttttgcagcagtacaagtggaaacttcaaaaaaatcattccctttcatgtcctggtctttttaagtcttgatatgtaaccattttcataaatgtccaaacagagattgtcattccccttaaaaacagaaacaaaacacaaaactagtgcttgtgaaaacacacagcgcaaagacaattatcctattgcattaaaaaaaaaatcagtctgcctagagacatttcattggctgcattgtcttaattccctaacgaaactgcatcaaaatgtcagttgtaatttagcctctgatcagctgttaaatattatttaaatatttacaggtcctgtggggtatctcccattacccatgtcgccctcaaattacataagcgatcataaaataagaagaaaaaaaaaggtctttagtagatcacagcagagttaccactgataagagtgttggctttgttcagttgtttctaaattaccagccgtcaagcacagtagcccctaaaaccaattttgagcaaggataaattcaactccctcatctgagaaccttgactttccagttgccttgaagtattgggaatagtaactgtacattttcaatttaattatttggtattttatttgactgtcttggccatgtcattttatggaagcatttttaaatagcactttttgttagtggtgtggaatttctgcggttattatttttttttttttttgcaacagatgaagcaaaaaaaaaaaagcactcattggagaaatagtgagtgtaaaaagagatttattttgtacagacagcaaagtatcctgtgtaatgttgctgacataaagcactttgggggaaaaaagtggaaatctgttttccataaatcacacagactcttgtacatagttatatacactcacgtagagaaatgaactgcatatatcatactggatatggggccgattttactctagaggcacatctggtgcttattgtcataaatcttttaaagaattaggtacacttttttctattaatatgtatagttttgtgatttgtcacagttatgtttcatataatcataagttattttgtcttgttcatgaagtcctttttttatgtcaaaagtaaaatgaagggattgtgcacttggtacagaataaaactggaaatagagaagacgccctcctgcctaaaatcctccttcagcctgtcggtttaaaacacaatggcaaccatcattgtttgtttgtttgtttttttgttttgttttaccatcagcctcttacatactgggaatggtaattataattaaaggcagatgatgcgggagggaatgttcaagtccagctttaaaatgctgcattgctttgggccagagctgtagcctggatttaattatagatatgaggaggaaatggcagtaaaaatgaatgtctccctgagtcctttacatgttgggagtgtccataaataaaacatgaagttttatttcatcagatttaattaaagcttttatacatgttt

SEQ ID NO: 12142 - DNA, 3961 bp, Homo sapiens
cgggaccccctgtacgccgtccgcgccgtccagggtcacaccggcgacggaacccgccggcagcaattagccagcatcccggggtcggcccccagaagcattccccggcccaggacgaggatgaacaggacaggcgaggcacaaagtcgcaactgaactttttagaaacattatttgtgtgtgtatgtgtgtagcaggggagaatgagctgatgccgagggtccagccaccccgcctctgcctcctcctccccctgccgccgctgccctcgcagacgcgcgcgcacacacggcacttgggccgggtttccgcgctccgtccccccgtttggatgggggttttcatttccgaaggaggcacagcccgcggagcgctctgaagggctggagccccaagttactcctcgccagcgccggccgcccgctgtcactcgcgctggccggccgggggaagggacccgcacgccgggctttgttgtggaaatcccggttacctggcttataacccacaccatggataacttattggactttgcctgaaaggagtcattagtgacattggatatttgaccgtcttggccacaggtttttcagaatgaatggaagatcatgcagcatgagtctccaccggacatcgggaaccccacaggggcctaggatggtcagtggtcatcacattcctgccatccgagcccactccgggactcctggcccctcgccctgtggcagcacatcgagtcccactatggcaagccttgctaacaacctccatctcaagatgccctcaggaggagggatggctcctcagaacaacgtggctgagagccgcatccatctgcctgccttaagccccaggagacaaatgctcaccaatgggaagccgcgattccaggtcacccaggctggaggcatgtcagggtcacatactttaaagccaaagcagcaggagtttggaagcccttttcctccaaatcctgggaaaggggctcttggctttgggcctcagtgcaagtccattggaaaaggcagctgcaacaatctagtggtcaccagcagtcccatgatggttcagcgactgggactcatttcacctccagcaagccaggtctctacagcatgcaaccagatcagtcctagcttacagagggcaatgaatgcagccaacctgaatatacctccttcagataccaggtcccttatttcgcgtgagtctttggcgtccacgaccttgagtctgacggaaagtcagtcggcctcaagcatgaagcaggagtggtcccagggctacagggccctcccttcgctctccaaccacggctctcagaatggccttgatctaggggatctccttagccttcctcccgggacatccatgtccagcaatagtgtctctaactcattaccatcctacctttttggcacggaaagtagccactctccttaccctagtcctcggcactcatccaccaggtcccactcggcccgctccaagaagagagcgctgtccttgtccccgctgtccgatggcatcgggatagatttcaataccatcatccgcacgtcgcccacgtccttggtggcctacatcaacgggtcgagggcttcgccggccaacctgtccccgcagccggaggtctacgggcatttcctgggcgtgcgcggcagctgcattccccagccgcgcccggtgcccggcagccagaagggcgtgctggtggcccctggaggcctggcgctgccggcctacggcgaggacggggccctggagcacgagcgcatgcaacagctggagcacggcggcctgcagccaggcctggtcaaccacatggtggtgcagcatggcctgccgggccccgacagccagtcggccggcctgttcaagaccgaacgcctggaggagttcccgggcagcaccgtagacctaccccccgcgcctccgctccctcctctgccgccgcccccaggccccccacccccttaccatgcccatgcgcaccttcaccacccggagctcgggccccacgcccagcagctggccttgccccaggccaccctggacgacgacggggagatggacggcatcgggggcaagcattgctgccgctggatcgactgcagcgccctgtacgaccagcaggaggagctcgtgcggcacatcgagaaggtccacatcgaccagcgcaaaggggaggacttcacttgcttctgggccggttgccctcgaagatacaagcccttcaacgcccgctataaactgctgatccacatgagagtccactctggggagaagcccaacaagtgtacgtttgaaggttgcgagaaggccttttcaaggcttgaaaatctcaagatccacttgcggagccacacaggcgagaagccgtatttgtgccagcatccgggttgtcagaaggccttcagtaactccagtgaccgcgccaaacaccagcggacgcatctggacaccaaaccttatgcttgtcaaattccaggatgtaccaaacgctacacagacccaagttccctaagaaagcatgtgaaggcacattcttccaaagagcaacaagcaaggaaaaagttgcggtccagcacagagctccatccagacctgctcacagattgcctcaccgtgcagtccctgcagccggccacttcccctagagatgctgctgctgaagggaccgtgggacgctcccctggacccgggcctgacctctattcagctcccattttctccagcaattattcaagccgaagtggaacagctgctggggccgtaccacccccacatcctgtcagtcacccttctccaggacataatgtacaggggagccctcacaacccctcctcccagttacctccactcacagctgtggacgcaggagctgagaggtttgcaccttctgctccatctcctcaccacatcagcccccggagagttccagctccttcttcaatactgcaaagaacacagcctccctatacccagcagccatcaggttcacacctgaagtcctatcagccagaaacaaactcttcttttcaaccaaatggtatccatgtccatggattttatgggcagctgcagaagttctgtcccccacactaccccgattcccagagaattgtgccgcctgtcagctcctgcagtgtggtgccttcgtttgaggactgcctagtccctacatccatgggccaggccagttttgatgttttccacagagccttctcgactcactcgggcattacagtgtatgatttaccttcaagttcctcgagcctctttggggagtctctccgcagcggggctgaagatgctaccttcttgcagatcagcaccgtggaccgctgtcctagccagctctcctctgtctacaccgaaggctaaaagctctcttggccactcctgcacacccaggaccttgatgttgcttgccaccttttgttttcgtactctcacagactgcttgaggaaggatgtcagcccaatcagcgggccctgcagagttactgatgttctttcagaaggcaggactgaatggcagagctagctttgcaggaatcattacagttgctcctttttctctctggttttcctggactatgtgaccaggaggactgtcttttcaaagggaatttagagcctcactctcctggatacctgttacttcctggctgtcaacccttaaaggaccccagtgaaatgatgtgcatatgaaaatgtagtttggggatgactctacctgaaaactccaaacagggaaaaagacctcaattacgagaggcatagtgacctgcctcacctaatcctcacccttgctgctcctgatgcaaagccaggcacaacaagggaaatccatgtccaaagcatagtgtggtctcaactcttagaaactccctgggtttcccttttctcttagccacatgctaaccagttgcttctcagtgtttctcttcaatag

SEQ ID NO: 12143 - DNA, 700 bp, Homo sapiens
actgacctcatccatagtgtggtgtttggtctatgagcagttgattcaccagttttcagagcccaagtctaaaatcacagatcctgtgggggatctgggagcatctgccttacctttatgaaggttatggtcagttaagccttgctttcaatgggctcacttcgctatgggaagaaaattctgcagttgttaaaaacaaaaggacactgccttttccaagggagctgacagctattggtttttccggagaggattactggtgaagacagttatgaagaacaagtaactcttgtaaataaacagcatgttcttgcttaaatatttcccagaacagttctaaagaaatataatacaggggctcttggctttgggcctcagtgcaagtccattggaaaaggcagctgcaacaatctagtggtcaccagcagtcccatgatggttcagcgactgggactcatttcacctccagcaagccaggtctctacagcatgcaaccagatcagtcctagcttacagagggcaatgaatgcagccaacctgaatatacctccttcagataccaggtcccttatttcgcgtgagtctttggcgtccacgaccttgagtctgacggaaagtcagtcggcctcaagcatgaagcaggagtggtcccagggctacagggccctcccttcgctctccaaccacggctctcagaatg

SEQ ID NO: 12144 - DNA, 1327 bp, Homo sapiens
cgggaccccctgtacgccgtccgcgccgtccagggtcacaccggcgacggaacccgccggcagcaattagccagcatcccggggtcggcccccagaagcattccccggcccaggacgaggatgaacaggacaggcgaggcacaaagtcgcaactgaactttttagaaacattatttgtgtgtgtatgtgtgtagcaggggagaatgagctgatgccgagggtccagccaccccgcctctgcctcctcctccccctgccgccgctgccctcgcagacgcgcgcgcacacacggcacttgggccgggtttccgcgctccgtccccccgtttggatgggggttttcatttccgaaggaggcacagcccgcggagcgctctgaagggctggagccccaagttactcctcgccagcgccggccgcccgctgtcactcgcgctggccggccgggggaagggacccgcacgccgggctttgttgtggaaatcccggttacctggcttataacccacaccatggataacttattggactttgcctgaaaggagtcattagtgacattggatatttgaccgtcttggccacaggtttttcagaatgaatggaagatcatgcagcatgagtctccaccggacatcgggaaccccacaggggcctaggatggtcagtggtcatcacattcctgccatccgagcccactccgggactcctggcccctcgccctgtggcagcacatcgagtcccactatggcaagccttgctaacaacctccatctcaagatgccctcaggaggagggatggctcctcagaacaacgtggctgagagccgcatccatctgcctgccttaagccccaggagacaaatgctcaccaatgggaagccgcgattccaggtcacccaggctggaggcatgtcagggtcacatactttaaagccaaagcagcaggagtttggaagcccttttcctccaaatcctgggaaaggggctcttggctttgggcctcagtgcaagtccattggaaaaggcagctgcaacaatctagtggtcaccagcagtcccatgatggttcagcgactgggactcatttcacctccagcaagccaggtctctacagcatgcaaccagatcagtcctagcttacagagggcaatgaatgcagccaacctgaatatacctccttcagataccaggtcccttatttcgcgtgagtctttggcgtccacgaccttgagtctgacggaaagtcagtcggcctcaagcatgaagcaggagtggtcccagggctacagggccctcccttcgctctccaaccacggctctcagaatg

SEQ ID NO: 12145 - DNA, 693 bp, Homo sapiens
catttgtcagatgctttcctctctgcactccagcctttgctgaatgtcctggcagttcctgaatgttcctgctgcctgcattttataaaaccaaagagcaagtagccctggaaatgtatgccaagtactctgcacagctgtctgaggcccccagccaagggcaagatataaacaatctatacccacacaggtacacaagcagacactgcatatggaagccccgcagtgcaaggacttcttacttctaacactttaaaatgtcagtggccaaacagcctgagaacatgaataatttaagcatgagatgcttttgctgatgattttgatcatttttcaggaagaataatggggctcttggctttgggcctcagtgcaagtccattggaaaaggcagctgcaacaatctagtggtcaccagcagtcccatgatggttcagcgactgggactcatttcacctccagcaagccaggtctctacagcatgcaaccagatcagtcctagcttacagagggcaatgaatgcagccaacctgaatatacctccttcagataccaggtcccttatttcgcgtgagtctttggcgtccacgaccttgagtctgacggaaagtcagtcggcctcaagcatgaagcaggagtggtcccagggctacagggccctcccttcgctctccaaccacggctctcagaatg

SEQ ID NO: 12146 - DNA, 458 bp, Homo sapiens
agttccaagttactcactggagctgacaagtcacctcggggaccgggaagtcactcaagtgtctggaaatcttggccctggctgatttgtcatcctatggatgattcaattaggggctcttggctttgggcctcagtgcaagtccattggaaaaggcagctgcaacaatctagtggtcaccagcagtcccatgatggttcagcgactgggactcatttcacctccagcaagccaggtctctacagcatgcaaccagatcagtcctagcttacagagggcaatgaatgcagccaacctgaatatacctccttcagataccaggtcccttatttcgcgtgagtctttggcgtccacgaccttgagtctgacggaaagtcagtcggcctcaagcatgaagcaggagtggtcccagggctacagggccctcccttcgctctccaaccacggctctcagaatg

SEQ ID NO: 12147 - DNA, 944 bp, Homo sapiens
agttccaagttactcactggagctgacaagtcacctcggggaccgggaagtcactcaagtgtctggaaatcttggccctggctgatttgtcatcctatggatgattcaattaggcttataacccacaccatggataacttattggactttgcctgaaaggagtcattagtgacattggatatttgaccgtcttggccacaggtttttcagaatgaatggaagatcatgcagcatgagtctccaccggacatcgggaaccccacaggggcctaggatggtcagtggtcatcacattcctgccatccgagcccactccgggactcctggcccctcgccctgtggcagcacatcgagtcccactatggcaagccttgctaacaacctccatctcaagatgccctcaggaggagggatggctcctcagaacaacgtggctgagagccgcatccatctgcctgccttaagccccaggagacaaatgctcaccaatgggaagccgcgattccaggtcacccaggctggaggcatgtcagggtcacatactttaaagccaaagcagcaggagtttggaagcccttttcctccaaatcctgggaaaggggctcttggctttgggcctcagtgcaagtccattggaaaaggcagctgcaacaatctagtggtcaccagcagtcccatgatggttcagcgactgggactcatttcacctccagcaagccaggtctctacagcatgcaaccagatcagtcctagcttacagagggcaatgaatgcagccaacctgaatatacctccttcagataccaggtcccttatttcgcgtgagtctttggcgtccacgaccttgagtctgacggaaagtcagtcggcctcaagcatgaagcaggagtggtcccagggctacagggccctcccttcgctctccaaccacggctctcagaatg

SEQ ID NO: 12148 - DNA, 871 bp, Homo sapiens
cggccccgctgcctgccctgctccaggctccacctgcgccgccgatcgcccgggtatcgcgggggcccaggccagctgagtccgttttccgcgccggggtggcgcccctccaaccgtcctaacgccgggccggcagcaaggagtgttcctgggacctcagagaccaggctcagagcctgacatccctgcgaggggacagcctcatccgcccaggccagtgggggtctctacaagtgcccaggctcaggtgcagcccccagcaatgcatcgccggagactggccctgggtctggggttctgcctgttggcgggcacaagcctcagtgtcctgtgggtgtatcttgagaactggctgccagtctcctatgtcccctattatctcccctgcccagagatcttgctggagtaccgtggcgtgatctcagctcattgcaacctccacctcccgggttcaagcaattgtcatgcctcagccacctgaatagctgggattacaggcacacacgctaatttttgtatttttagtagaaacagcatttcatcatgttggccaggttggtctttgcccccttcggccaggcttcgccccctcatcggcctcccaaagtgctgggattaaaggcgtgaaccaccacccctggccttaatttttttttttttttattattactagtgagactctcatttccctacgtcttcccgttaattgaaatttttcttgtgtgaagtgcttcttccccaccttctctgtttggtccgtttgtgggttctctatcatcactcttggctaagtatacctacaacttttttttttctttccagtttgtctatcttgtgtgtgtgcgtggcggagggagataaggtctggctc

SEQ ID NO: 12149 - DNA, 847 bp, Homo sapiens
cgcggccccgctgcctgccctgctccaggctccacctgcgccgccgatcgcccgggtatcgcgggggcccaggccagctgagtccgttttccgcgccggggtggcgcccctccaaccgtcctaacgccgggccggcagcaaggagtgttcctgggacctcagagaccaggctcagagcctgacatccctgcgaggggacagcctcatccgcccaggccagtgggggtctctacaagtgcccaggctcaggtgcagcccccagcaatgcatcgccggagactggccctgggtctggggttctgcctgttggcgggcacaagcctcagtgtcctgtgggtgtatcttgagaactggctgccagtctcctatgtcccctattatctcccctgcccagagatcttacccatgatgatggctctttcttgcctctgccaccagcaacatgaagctgcactacaagagggagaagccactccagcccgtggtatggtcacagtaccctcagcccaagctgctggagcacaggcccacacagctgctgacactcacaccctggttggcgcccatcgtctccgagggaaccttcaacccagagcttctgcagcacatctaccagccactgaacctgaccattggggtcacggtgtttgccgtggggaagtacactcatttcatccagtccttcctggagtcagccgaggagttcttcatgcgtgggtaccgggtgcactactacatcttcactgacaaccctgcagccgttcccggggtcccgctgggtccccaccggcttctcagctccatccccatccagggtcactcccactgggaggagacatccatgcgc

SEQ ID NO: 12150 - DNA, 1980 bp, Homo sapiens
ctcttttctgtcctctttcctgtctgtcttcctcttttctgtctggcccgcggccccgctgcctgccctgctccaggctccacctgcgccgccgatcgcccgggtatcgcgggggcccaggccagctgagtccgttttccgcgccggggtggcgcccctccaaccgtcctaacgccgggccggcagcaaggagtgttcctgggacctcagagaccaggctcagagcctgacatccctgcgaggggacagcctcatccgcccaggccagtgggggtctctacaagtgcccaggctcaggtgcagcccccagcaatgcatcgccggagactggccctgggtctggggttctgcctgttggcgggcacaagcctcagtgtcctgtgggtgtatcttgagaactggctgccagtctcctatgtcccctattatctcccctgcccagagatcttcaacatgaagctgcactacaagagggagaagccactccagcccgtggtatggtcacagtaccctcagcccaagctgctggagcacaggcccacacagctgctgacactcacaccctggttggcgcccatcgtctccgagggaaccttcaacccagagcttctgcagcacatctaccagccactgaacctgaccattggggtcacggtgtttgccgtggggaagtacactcatttcatccagtccttcctggagtcagccgaggagttcttcatgcgtgggtaccgggtgcactactacatcttcactgacaaccctgcagccgttcccggggtcccgctgggtccccaccggcttctcagctccatccccatccagggtcactcccactgggaggagacatccatgcgccggatggagaccatcagccagcacattgctaagagggctcaccgggaggtggactacctcttctgccttgatgtggacatggtgtttcggaacccgtggggccctgagaccttgggagacctggtggctgccattcacccaagctactacgccgttccccgccagcagttcccctatgagcgcaggcgtgtttccactgcctttgtggcagacagcgaaggggacttctattatggtggggcagtcttcggggggcaggtggccagggtatatgagtttactaggggctgccacatggccatcctggcggacaaggccaatggcatcatggctgcctggcgggaggaaagccacctgaaccgtcacttcatctcaaacaagccgtccaaggtgctgtcccccgagtacctctgggacgacaggaagccccagccacccagcctgaagctgatccgcttttctacactggacaaggatatcagctgcctgaggagctgaccacggagctgggggttgccatggatggggacccaaagacctgcagccaccagtgcttcactagcgtgcagaccagccctgtcccgcctccctgtcagtcaggcgaattcaaccggaaaagggacgtggaaaggccactgtgaactgcagagggctgtgcacacagtagcacacaggatctcacagtaacgcggcatgggaacagtgagacagggggaggggaggcgcagttacaaaggcagggcccggcaggcttgccacgttctgcagccgtgcctttgcggggcaggctctgaagcctcagcccgactcagagtgcctgaaccctgccgcgccagtcccccgtttattgcatattgcccttaacgtagcatttctaataccctggtgtgaaggcgccctagaccccttttctctggtcacaggggtcctgggtcctttgatgtctcccaaccacatgtagccaattcctcactcaggcccccagagtgagcctttgaaatggaacaggtctaggctccctcggtttcctgcaccccaaagtgagccgcactctcaggggactagccacctccttcttaagagggtttggggcagtttataataaagggggcgtgtgctcaa

SEQ ID NO: 12151 - DNA, 1935 bp, Homo sapiens
tcttcctcttttctgtctggcccgcggccccgctgcctgccctgctccaggctccacctgcgccgccgatcgcccgggtatcgcgggggcccaggccagctgagtccgttttccgcgccggggtggcgcccctccaaccgtcctaacgccgggccggcagcaaggagtgttcctgggacctcagagaccaggctcagagcctgacatccctgcgaggggacagcctcatccgcccaggccagtgggggtctctacaagtgcccaggctcaggtgcagcccccagcaatgcatcgccggagactggccctgggtctggggttctgcctgttggcgggcacaagcctcagtgtcctgtgggtgtatcttgagaactggctgccagtctcctatgtcccctattatctcccctgcccagagatcttcaacatgaagctgcactacaagagggagaagccactccagcccgtggtatggtcacagtaccctcagcccaagctgctggagcacaggcccacacagctgctgacactcacaccctggttggcgcccatcgtctccgagggaaccttcaacccagagcttctgcagcacatctaccagccactgaacctgaccattggggtcacggtgtttgccgtggggaatccttcctggagtcagccgaggagttcttcatgcgtgggtaccgggtgcactactacatcttcactgacaaccctgcagccgttcccggggtcccgctgggtccccaccggcttctcagctccatccccatccagggtcactcccactgggaggagacatccatgcgccggatggagaccatcagccagcacattgctaagagggctcaccgggaggtggactacctcttctgccttgatgtggacatggtgtttcggaacccgtggggccctgagaccttgggagacctggtggctgccattcacccaagctactacgccgttccccgccagcagttcccctatgagcgcaggcgtgtttccactgcctttgtggcagacagcgaaggggacttctattatggtggggcagtcttcggggggcaggtggccagggtatatgagtttactaggggctgccacatggccatcctggcggacaaggccaatggcatcatggctgcctggcgggaggaaagccacctgaaccgtcacttcatctcaaacaagccgtccaaggtgctgtcccccgagtacctctgggacgacaggaagccccagccacccagcctgaagctgatccgcttttctacactggacaaggatatcagctgcctgaggagctgaccacggagctgggggttgccatggatggggacccaaagacctgcagccaccagtgcttcactagcgtgcagaccagccctgtcccgcctccctgtcagtcaggcgaattcaaccggaaaagggacgtggaaaggccactgtgaactgcagagggctgtgcacacagtagcacacaggatctcacagtaacgcggcatgggaacagtgagacagggggaggggaggcgcagttacaaaggcagggcccggcaggcttgccacgttctgcagccgtgcctttgcggggcaggctctgaagcctcagcccgactcagagtgcctgaaccctgccgcgccagtcccccgtttattgcatattgcccttaacgtagcatttctaataccctggtgtgaaggcgccctagaccccttttctctggtcacaggggtcctgggtcctttgatgtctcccaaccacatgtagccaattcctcactcaggcccccagagtgagcctttgaaatggaacaggtctaggctccctcggtttcctgcaccccaaagtgagccgcactctcaggggactagccacctccttcttaagagggtttggggcagtttataataaagggggcgtgtgctcaa

SEQ ID NO: 12152 - DNA, 1449 bp, Homo sapiens
ctcttttctgtctggcccgcggccccgctgcctgccctgctccaggctccacctgcgccgccgatcgcccgggtatcgcgggggcccaggccagctgagtccgttttccgcgccggggtggcgcccctccaaccgtcctaacgccgggccggcagcaaggagtgttcctgggacctcagagaccaggctcagagcctgacatccctgcgaggggacagcctcatccgcccaggccagtgggggtctctacaagtgcccaggctcaggtgcagcccccagcaatgcatcgccggagactggccctgggtctggggttctgcctgttggcgggcacaagcctcagtgtcctgtgggtgtatcttgagaactggctgccagtctcctatgtcccctattatctcccctgcccagagatcttgtcacagtaccctcagcccaagctgctggagcacaggcccacacagctgctgacactcacaccctggttggcgcccatcgtctccgagggaaccttcaacccagagcttctgcagcacatctaccagccactgaacctgaccattggggtcacggtgtttgccgtggggaagtacactcatttcatccagtccttcctggagtcagccgaggagttcttcatgcgtgggtaccgggtgcactactacatcttcactgacaaccctgcagccgttcccggggtcccgctgggtccccaccggcttctcagctccatccccatccagggtcactcccactgggaggagacatccatgcgccggatggagaccatcagccagcacattgctaagagggctcaccgggaggtggactacctcttctgccttgatgtggacatggtgtttcggaacccgtggggccctgagaccttgggagacctggtggctgccattcacccaagctactacgccgttccccgccagcagttcccctatgagcgcaggcgtgtttccactgcctttgtggcagacagcgaaggggacttctattatggtggggcagtcttcggggggcaggtggccagggtatatgagtttactaggggctgccacatggccatcctggcggacaaggccaatggcatcatggctgcctggcgggaggaaagccacctgaaccgtcacttcatctcaaacaagccgtccaaggtgctgtcccccgagtacctctgggacgacaggaagccccagccacccagcctgaagctgatccgcttttctacactggacaaggatatcagctgcctgaggagctgaccacggagctgggggttgccatggatggggacccaaagacctgcagccaccagtgcttcactagcgtgcagaccagccctgtcccgcctccctgtcagtcaggcgaattcaaccggaaaagggacgtggaaaggccactgtgaactgcagagggctgtgcacacagtagcacaca

SEQ ID NO: 12153 - DNA, 2051 bp, Homo sapiens
agtttgcaccgaccccgatctggcagcgccgcgaagacgagcggtcaccggcgcccgacccgagcgcgcccagaggacggcggggagccaagccgacccccgagcagcgccgcgcggaccctgaggctcagaggggcagcttcaggggaggacaccccactggccaggacgccccaggctctgctgctctgccactcagctgccctcggaggagcgtacacacccaccaggactgcattgccccagctgtgcagcccctgccagatgtgggaggcagctagctgcccagaggcatgcccccctgccagccacagcgacccctgctgctgttgctgctgctgctggcctgccagccacaggtcccctccgctcaggtgatggacttcctgtttgagaagtggaagctctacggtgaccagtgtcaccacaacctgagcctgctgccccctcccacggagctggtgtgcaacagaaccttcgacaagtattcctgctggccggacacccccgccaataccacggccaacatctcctgcccctggtacctgccttggcaccacaaagtgcaacaccgcttcgtgttcaagagatgcgggcccgacggtcagtgggtgcgtggaccccgggggcagccttggcgtgatgcctcccagtgccagatggatggcgaggagattgaggtccagaaggaggtggccaagatgtacagcagcttccaggtgatgtacacagtgggctacagcctgtccctgggggccctgctcctcgccttggccatcctggggggcctcagcaagctgcactgcacccgcaatgccatccacgcgaatctgtttgcgtccttcgtgctgaaagccagctccgtgctggtcattgatgggctgctcaggacccgctacagccagaaaattggcgacgacctcagtgtcagcacctggctcagtgatggagcggtggctggctgccgtgtggccgcggtgttcatgcaatatggcatcgtggccaactactgctggctgctggtggagggcctgtacctgcacaacctgctgggcctggccaccctccccgagaggagcttcttcagcctctacctgggcatcggctggggtgcccccatgctgttcgtcgtcccctgggcagtggtcaagtgtctgttcgagaacgtccagtgctggaccagcaatgacaacatgggcttctggtggatcctgcggttccccgtcttcctggccatcctgatcaacttcttcatcttcgtccgcatcgttcagctgctcgtggccaagctgcgggcacggcagatgcaccacacagactacaagttccggctggccaagtccacgctgaccctcatccctctgctgggcgtccacgaagtggtcttcgccttcgtgacggacgagcacgcccagggcaccctgcgctccgccaagctcttcttcgacctcttcctcagctccttccagggcctgctggtggctgtcctctactgcttcctcaacaaggaggtgcagtcggagctgcggcggcgttggcaccgctggcgcctgggcaaagtgctatgggaggagcggaacaccagcaaccacagggcctcatcttcgcccggccacggccctcccagcaaggagctgcagtttgggaggggtggtggcagccaggattcatctgcggagacccccttggctggtggcctccctagattggctgagagccccttctgaaccctgctgggaccccagctagggctggactctggcacccagagggcgtcgctggacaacccagaactggacgcccagctgaggctgggggcgggggagccaacagcagcccccacctaccccccacccccagtgtggctgtctgcgagattgggcctcctctccctgcacctgccttgtccctggtgcagaggtgagcagaggagtccagggcgggagtgggggctgtgccgtgaactgcgtgccagtgtccccacgtatgtcggcacgtcccatgtgcatggaaatgtcctccaacaataaagagctcaagtggtcaccgtg

SEQ ID NO: 12154 - DNA, 3105 bp, Homo sapiens
gttccgcaggtggcagcgatggcccagtcctgaactccccgccatggccggcgcccccggcccgctgcgccttgcgctgctgctgctcgggatggtgggcagggccggcccccgcccccagggtgccactgtgtccctctgggagacggtgcagaaatggcgagaataccgacgccagtgccagcgctccctgactgaggatccacctcctgccacagacttgttctgcaaccggaccttcgatgaatacgcctgctggccagatggggagccaggctcgttcgtgaatgtcagctgcccctggtacctgccctgggccagcagtgtgccgcagggccacgtgtaccggttctgcacagctgaaggcctctggctgcagaaggacaactccagcctgccctggagggacttgtcggagtgcgaggagtccaagcgaggggaaagaagctccccggaggagcagctcctgttcctctacatcatctacacggtgggctacgcactctccttctctgctctggttatcgcctctgcgatcctcctcggcttcagacacctgcactgcaccaggaactacatccacctgaacctgtttgcatccttcatcctgcgagcattgtccgtcttcatcaaggacgcagccctgaagtggatgtatagcacagccgcccagcagcaccagtgggatgggctcctctcctaccaggactctctgagctgccgcctggtgtttctgctcatgcagtactgtgtggcggccaattactactggctcttggtggagggcgtgtacctgtacacactgctggccttctcggtcttatctgagcaatggatcttcaggctctacgtgagcataggctggggtgttcccctgctgtttgttgtcccctggggcattgtcaagtacctctatgaggacgagggctgctggaccaggaactccaacatgaactactggctcattatccggctgcccattctctttgccattggggtgaacttcctcatctttgttcgggtcatctgcatcgtggtatccaaactgaaggccaatctcatgtgcaagacagacatcaaatgcagacttgccaagtccacgctgacactcatccccctgctggggactcatgaggtcatctttgcctttgtgatggacgagcacgcccgggggaccctgcgcttcatcaagctgtttacagagctctccttcacctccttccaggggctgatggtggccatattatactgctttgtcaacaatgaggtccagctggaatttcggaagagctgggagcgctggcggcttgagcacttgcacatccagagggacagcagcatgaagcccctcaagtgtcccaccagcagcctgagcagtggagccacggcgggcagcagcatgtacacagccacttgccaggcctcctgcagctgagactccagcgcctgccctccctggggtccttgctgcaggccgggtggccaatccaggtgggagagacactcccagggacaagggaaggaagggacacacacacacacacacacacacacacacacacacacatacatcctgctttccctccccaaacccatcagacaggtaaatgggcagtgcctcctgggaccatggacacattttctcctaggagaagcagcctcctaatttgatcacagtggcgagaggagaggaaaaacgatcgctgtgaaaatgaggaggattgcttcttgtgaaaccacaggcccttggggttcccccagacagagccgcaaatcaaccccagactcaaactcaaggtcaacggcttattagtgaaactggggcttgcaagaggaggtggttctgaaagtggctcttctaacctcagccaaacacagagcgggagtgacgggagcctcctctgcttgcatcacttggggtcaccaccctcccctgtcttctctcaaagggaagctgtttgtgtgtctgggttgcttatttccctcatcttgccccctcatctcactgcccagtttctttttgaggggctttgtttgggccactgccagcagctgtttctggaaatggctgtaggtggtgttgagaaagaatgagcattgagacggtgctcgcttctcctccaggtatttgagttgttttggtgcctgcctctgccatgcccagagaatcagggcaggcttgccaccggggaacccagccctggggtatgagctgccaagtctattttaaagacgctcaagaatcctctggggttcatctagggacacgttaggaatgtccagactgtgggtgtagattacctgccacttccaggagcccagagggccaagagagacattgcctccacctctccttggaaatactttatctgtgaccacacgctgtctcttgagaatttggatacactctctagctttaggggaccatgaagagactctcttagggaaaccaatagtccccatcagcaccatggaggcaggctccccctgcctttgaaattcccccacttgggagcttgtatatacttcactcacttttctttattgctgtgaatagtctgtgtgcacaatgggcaattctgacttctcccatctagtggaaatgagcgaaatcatggttgtagtgatgttgtttgggagagtgcagtagtaattgatttgacccactcacacttggagctaattaaggtttgccctgcctgcagcctcccccacaaataatgaacagcagaaagactggacggggaaacctatcaatcctgcccccagccatggtgaggaagccccaagccatggtgacacacagcagcactgcagatagccagacacatggctatcctagagaggctggcaaggagttcgtggctgcaaaagaagtttctggagcaagagagagctcgctcttgggagtcaggacctccggggagagcagagggttccgacggattcctttatgagtcagtctctctctcccttttaaatggtgggaaccctccccaaaacctttccccagacacattctcctgtgcccctcagagaggcatgtgatgtgcaaggaaaataataggatataaaacacatcaagtagaaaatttcttatacttc

SEQ ID NO: 12155 - DNA, 4059 bp, Homo sapiens
atgaagctgggatcgagcagggcagggcctgggagaggaagcgcgggactcctgcctggcgtccacgagctgcccatgggcatccctgccccctgggggaccagtcctctctccttccacaggaagtgctctctctgggcccctgggaggcccttcctcactctggtcctgctggtttccatcaagcaagttacaggatccctccttgaggaaacgactcggaagtgggctcagtacaaacaggcatgtctgagagacttactcaaggaaccttctggcatattttgtaacgggacatttgatcagtacgtgtgttggcctcattcttctcctggaaatgtctctgtaccctgcccttcatacttaccttggtggagtgaagagagctcaggaagggcctacagacactgcttggctcaggggacttggcagacgatagagaacgccacggatatttggcaggatgactccgaatgctccgagaaccacagcttcaagcaaaacgtggatcgttatgccttgctgtcaaccttgcagctgatgtacaccgtgggatactccttctctcttatctccctcttcctggctctcaccctcctcttgtttcttcgaaaactccactgcacgcgcaactacatccacatgaacttgtttgcttctttcatcctgagaaccctggctgtactggtgaaggacgtcgtcttctacaactcttactccaagaggcctgacaatgagaatgggtggatgtcctacctgtcagagatgtccacctcctgccgctcagtccaggttctcttgcattactttgtgggtgccaattacttatggctgctggttgaaggcctctacctccacacgctgctggagcccacagtgcttcctgagaggcggctgtggcccagatacctgctgttgggttgggccttccctgtgctatttgttgtaccctggggtttcgcccgtgcacacctggagaacacagggtgctggacaacaaatgggaataagaaaatctggtggatcatccgaggacccatgatgctctgtgtaacagtcaatttcttcatcttcctgaaaattctcaagcttctcatttctaagctcaaagctcatcaaatgtgcttcagagattataaatacagattggcaaaatcaacactggtcctcattcctttattgggcgttcatgagatcctcttctctttcatcactgatgatcaagttgaaggatttgcaaaacttatacgacttttcattcagttgacactgagctcctttcatgggttcctggtggccttgcagtatggttttgccaatggagaggtgaaggctgagctgcggaaatactgggtccgcttcttgctagcccgccactcaggctgcagagcctgtgtcctggggaaggacttccggttcctaggaaaatgtcccaagaagctctcggaaggagatggcgctgagaagcttcggaagctgcagccctcacttaacagtgggcggctcctacatctagccatgcgaggtcttggggagctgggcgcccagccccaacaggaccatgcacgctggccccggggcagcagcctgtccgagtgcagtgagggggatgtcaccatggccaacaccatggaggagattctggaagagagtgagatctagggtggagttccaccaccctggctctgctcccagggactcttgagggggcccaggaagaggaagcaaagcaggacacacgttgctgggcacggaatcattctcgttccattcaccatgccactttgatatgaaagctatcacaaggttcttcaagctctgtatgaaagaggctgtgtgtcatgctcacagcctctgcctgctcttctcatcctaataacccccaccagtgtgttttccacaatgcccaccagaccctagggcctggctctaaattcaagccaatgaagtcccaccatgaagagaggtctcctgttatagagaagccagccaatatctcttcctttatcccttggggtgcatgctttccatctgaggttgggtttagggtgcgtgaaaacctcctaggaagcttttaaaatgcagaatcctagacttgtggctaagattctaagacagtgagtctgggaccatggccaggaattggagctgtttaataagcatcccaggtaattctgctgcaagcccacccttggagaacactgggcagggtgagagggagctagaagcgcccccatgtggccatggcaggatgctgcaagagacagtctgctctcccaggtcagctggggtgtgcctgccctccttggagagtatgtaactccacccaccagagtgccactcctctctgctcttcctctcctatcaagtcttgcctctctctctctttgcctcagttctctgtccctgcacagcaggagttctgcttgatcctccctttgaggattggccccagtgcctggggaccctctgaatgtcgtctttggtctgttcctctcctttctggctctatctacctttctgagtttggcttctaccagcctgatttacactaccattctcttggggcaaggaatgtccccaccatttttggtttgccattgatgcattgattgtcacacctgttgtcccaggaagttgacctataactctccatggccagagtccctgctgatcagaattcaatttgcccagtgggaataaatactgaaagcaggagggcccaggtaaagcaataggagtttggctggatctggacatgcccagggtggctctgagagatccaagactttgcatccaccagcctgtgggatctttcctgcctactgtgacccatggaggctgaggagggcccaggcagttggggtcaggctcaatgactgaaagtatagggcaagaggctgtaggaagatcaagggatggacatcctttggaaacagtgtgttaatgcacaggagtgtcactttcatggtatgtaaaatgcatgtgtacgtgggtggggtatgttgctatgggactaaataccaccttgtcttcgggggagtcagtttgatactcctcaagcagggctgccatatttagcaaacaaaaacaaggtactcaattaaatttgaatttcagacaaatagtcttcttgtataagtatatcccatgggcatatttaatctgagattggaattcaatcatgcatcttgtcttttactggcatctctgttttcaaggatactttgccacagggctgggactagggtgaaataatcaaggcactcatctctaaaaagctcaaagtaaatgatcaaaataaatcatattttaatgcaatattctaaaaaaacaaattaacaaactacagcccatgagccatttatagaaatgaaatttgattggagccaggggcaggataagggtgaggcaggagaggccagctcttgcaagtgcaggctctggtcctgactttcaaatgttgtctatgagggacttttaatgtgaatttttatttttagacaattgcattaaaatgttatttatattgactatggggacttttggggcccccttaaattttgcacttgaaatgggatccccacttgtgtcaccccatagtccagccctggttttaggatggggatggaggcaaaggcatcaggcaagtaatgaagcaaaggtttattttttggtgtccagattatccatagctcagtcatgaaaatctatgtctttctatttttctcctttctgcaaatgtccctgcctcggctcatcagccaattagctcctagaaagctggggtcatctcgtattcccagcaagtacccagcacagtgccggttcagagcaggtgctccacacacattcctggaatgagacagcacagaaatggctctcgggagcctcggatgctgctgggagtaagtgatccaggaccttaccgctaagaggagaaactttttttcaaagcatttataaatactccctccacccctcactccacaaatggggtgatcaacacttactgcttgctcttgttctgctaatgattaaaacaagtttatttaattt

SEQ ID NO: 12156 - DNA, 1641 bp, Homo sapiens
gaggagattttgcctttgtggttagcctcagcccagcctggacaagcttaatgccttagaaagaaataccctgcctcaaaaagacacctgcctctaaactggctcgagccccatcgccttctgccagccattcctctgtagctcgaaccccagcctgtctcagccagcttcgtgcattgagcagaaccttcagggtggagcccgctgaccgccttgttctttctcctcagcctgtcaaggaagtcccagaaagcacagctgacttagggaaggtctgggaaaaatctccctgcttttgggggggcaggggcgggggatgagccagggccgagaaggaactctgaagactccgtagattgctctagaccgcctcagacactctcggcgcagcgtggagaggatttgtgcaaacatttcctctgtggaccaagaggaatgcaagaggaggctgcctgcggtgcatcttggacggctagagagatgtacccctacttgtgaaggtgcacgaggaagatgaagctgggatcgagcagggcagggcctgggagaggaagcgcgggactcctgcctggcgtccacgagctgcccatgggcatccctgccccctgggggaccagtcctctctccttccacaggaagtgctctctctgggcccctgggaggcccttcctcactctggtcctgctggtttccatcaagcaagttacaggatccctccttgaggaaacgactcggaagtgggctcagtacaaacaggcatgtctgagagacttactcaaggaaccttctggcatattttgtaacgggacatttgatcagtacgtgtgttggcctcattcttctcctggaaatgtctctgtaccctgcccttcatacttaccttggtggagtgaagagagctcaggaagggcctacagacactgcttggctcaggggacttggcagacgatagagaacgccacggatatttggcaggatgactccgaatgctccgagaaccacagcttcaagcaaaacgtggatcgttatgccttgctgtcaaccttgcagctgatgtacaccgtgggatactccttctctcttatctccctcttcctggctctcaccctcctcttgtttcttcgaaaactccactgcacgcgcaactacatccacatgaacttgtttgcttctttcatcctgagaaccctggctgtactggtgaaggacgtcgtcttctacaactcttactccaagaggcctgacaatgagaatgggtggatgtcctacctgtcagagatgtccacctcctgccgctcagtccaggttctcttgcattactttgtgggtgccaattacttatggctgctggttgaaggcctctacctccacacgctgctggagcccacagtgcttcctgagaggcggctgtggcccagatacctgctgttgggttgggccttccctgtgctatttgttgtaccctggggtttcgcccgtgcacacctggagaacacagggtgctggacaacaaatgggaataagaaaatctggtggatcatccgaggacccatgatgctctgtgtaacagcacttggactagaggaaacgggcttgaagagaaatgggagcattccctttggtcacaaggaagacatttaa

SEQ ID NO: 12157 - DNA, 2175 bp, Homo sapiens
gaggagattttgcctttgtggttagcctcagcccagcctggacaagcttaatgccttagaaagaaataccctgcctcaaaaagacacctgcctctaaactggctcgagccccatcgccttctgccagccattcctctgtagctcgaaccccagcctgtctcagccagcttcgtgcattgagcagaaccttcagggtggagcccgctgaccgccttgttctttctcctcagcctgtcaaggaagtcccagaaagcacagctgacttagggaaggtctgggaaaaatctccctgcttttgggggggcaggggcgggggatgagccagggccgagaaggaactctgaagactccgtagattgctctagaccgcctcagacactctcggcgcagcgtggagaggatttgtgcaaacatttcctctgtggaccaagaggaatgcaagaggaggctgcctgcggtgcatcttggacggctagagagatgtacccctacttgtgaaggtgcacgaggaagatgaagctgggatcgagcagggcagggcctgggagaggaagcgcgggactcctgcctggcgtccacgagctgcccatgggcatccctgccccctgggggaccagtcctctctccttccacaggaagtgctctctctgggcccctgggaggcccttcctcactctggtcctgctggtttccatcaagcaagttacaggatccctccttgaggaaacgactcggaagtgggctcagtacaaacaggcatgtctgagagacttactcaaggaaccttctggcatattttgtaacgggacatttgatcagtacgtgtgttggcctcattcttctcctggaaatgtctctgtaccctgcccttcatacttaccttggtggagtgaagagagctcaggaagggcctacagacactgcttggctcaggggacttggcagacgatagagaacgccacggatatttggcaggatgactccgaatgctccgagaaccacagcttcaagcaaaacgtggatcgttatgccttgctgtcaaccttgcagctgatgtacaccgtgggatactccttctctcttatctccctcttcctggctctcaccctcctcttgtttcttcgaaaactccactgcacgcgcaactacatccacatgaacttgtttgcttctttcatcctgagaaccctggctgtactggtgaaggacgtcgtcttctacaactcttactccaagaggcctgacaatgagaatgggtggatgtcctacctgtcagagatgtccacctcctgccgctcagtccaggttctcttgcattactttgtgggtgccaattacttatggctgctggttgaaggcctctacctccacacgctgctggagcccacagtgcttcctgagaggcggctgtggcccagatacctgctgttgggttgggccttccctgtgctatttgttgtaccctggggtttcgcccgtgcacacctggagaacacagggtgctggacaacaaatgggaataagaaaatctggtggatcatccgaggacccatgatgctctgtgtaacagtcaatttcttcatcttcctgaaaattctcaagcttctcatttctaagctcaaagctcatcaaatgtgcttcagagattataaatacagattggcaaaatcaacactggtcctcattcctttattgggcgttcatgagatcctcttctctttcatcactgatgatcaagttgaaggatttgcaaaacttatacgacttttcattcagttgacactgagctcctttcatgggttcctggtggccttgcagtatggttttgccaatggagaggtgaaggctgagctgcggaaatactgggtccgcttcttgctagcccgccactcaggctgcagagcctgtgtcctggggaaggacttccggttcctaggaaaatgtcccaagaagctctcggaaggagatggcgctgagaagcttcggaagctgcagccctcacttaacagtgggcggctcctacatctagccatgcgaggtcttggggagctgggcgcccagccccaacaggaccatgcacgctggccccggggcagcagcctgtccgagtgcagtgagggggatgtcaccatggccaacaccatggaggagattctggaagagaagagaagccag

SEQ ID NO: 12158 - DNA, 1758 bp, Homo sapiens
acgccacggatatttggcaggatgactccgaatgctccgagaaccacagcttcaagcaaaacgtggatcgttatgccttgctgtcaaccttgcagctgatgtacaccgtgggatactccttctctcttatctccctcttcctggctctcaccctcctcttgtttcttcgaaaactccactgcacgcgcaactacatccacatgaacttgtttgcttctttcatcctgagaaccctggctgtactggtgaaggacgtcgtcttctacaactcttactccaagaggcctgacaatgagaatgggtggatgtcctacctgtcagagatgtccacctcctgccgctcagtccaggttctcttgcattactttgtgggtgccaattacttatggctgctggttgaaggcctctacctccacacgctgctggagcccacagtgcttcctgagaggcggctgtggcccagatacctgctgttgggttgggccttccctgtgctatttgttgtaccctggggtttcgcccgtgcacacctggagaacacagggtgctggacaacaaatgggaataagaaaatctggtggatcatccgaggacccatgatgctctgtgtaacagcacttggactagaggaaacgggcttgaagagaaatgggagcattccctttggtcacaaggaagacatttaaccatgaacttgtaaaacactgacatataccccagagaaaggcattagatcttcatgtctatcagtttacaagaagataatctgtcctgaacaataaggagctaaacctgctgccctcccaatctgcacagctctaggattctaggactctgtgcattggttctagggctccccagagagtggaatttatgtgtcccaccagacatggaagggaaaagaaaggccatgcagaaagaagtgaaagaggcaggctaggagtcaggagcctgggctctatgactgacttgtgatgtgtccttcagccaggtgagttggcctctctgggcctctgtttcttcatctatgaaatcagtcttgaactagaccagtggttttcaaccagaggagattctgacccctggggacatttggctgtgtctggagacatttttaattgtcataaattggggatggggataggaggagaatgttgctactggcatctagtgggtggaggtcagggatgctgctcaacaccctacaacacacagaaccacccccagaataaataattatcctgccccaaatattaagagtgccaacattgaaaaaccctggactagacagtagctgcacattaaaacaacctggggaggattaaaaaaatacccagcccagacttacccagactgatggaatcaaatctcctgccatgtagagcttccttagcactggaatctcattcagccactctcttgtatcttcctttagcattcattgagcaccttcactgggcttggcttggtgctaggttatttcagagtttctatcctcagggaattcagaatttaatagttatcattctgagactcatcagactatgactgaaccaatatctgccttcatttttggtcatatgaccacatgttgcaattttccactgatctgaatagacataaccccaactctaaaagagaattccttaaaccacaacgtggaaggaacctggattcctgaatgactgtatggagcagaactccctccactgcactagactgtgacataaccaataaaataaaataagataaaataaa

SEQ ID NO: 12159 - DNA, 4743 bp, Homo sapiens
ttagttgccattcggagtgaggagtgggtagaagcggcggcggcggcggcggcgtttgcggtggcgcggactccgaggagcgccagcacctcgaggccctttctctctaccctggtccccagaagcaggggtcccggccctccttgcagctgccgggttctcccgtgcgtgcagccctgcgagggctgaggagaaggctgcgagcggccctcggggctgcgtgatccgggccgttgccctgtcagcacgatgcctggagcggtggcggcggcggctccgggctccttgcggccccggccgtgaccgccacaccgagcccagccgggcggttgcggccgttggacgtttgttttcgcagccttcccctcccccctcgccgaggcggcgggggtgtgcgttggggagggggagccccgagactcctcccccacagcgatacccccgcccctcccccttacacactcgcacgcactatcgcgccggctcccacacgctcgcgcgcctcccgccccgcgcctccgtgtcggccggcggcgtccagggcccgcagagccaccatgtccactgcctcctcctcctcctcctccagttcctctcagacccctcatcccccgtcgcagaggatgaggcgcagcgccgcggggtccccgcccgccgtcgccgccgccgggagcgggaacggtgcgggcggcggcggcggcgtgggctgcgccccggctgcgggagccggccggctgctgcagcccatccgcgccacggtgccctaccagctcttgcggggcagccagcacagtcccacgcgtccgcccgtcgccgctgccgccgcctcgctgggcagcctcccggggcccggcgcggcccgcggccccagcccgtccagcccgacgccgccggcggccgcagccccggccgagcaggcgccgcgggccaagggccgcccgagacggtccccagagagccaccggaggagcagctcacctgagagacggagccccggctcgcccgtgtgcagagcggacaaggcaaaatctcagcaagttcggacctctagtacaataaggcgaacctcctctttggatacaataacaggaccttacctcacaggacagtggccacgggatcctcatgttcactacccttcatgcatgaaagacaaagctactcagacacctagctgttgggcagaagagggtgcagaaaagaggtcacatcagcgttctgcgtcatgggggagtgctgatcaactaaaagagcagatcgccaaactgaggcagcaactacaacgcagtaaacagagtagtcgtcacagtaaggagaaagatcgccagtcacctcttcatggcaaccatataacaatcagtcacactcaggctactggatcaaggtcagttcctatgccactgtcaaatatatcagtgccaaaatcatctgtttcgcgtgtgccctgcaatgtagaaggaataagtcctgaattagaaaaggtattcattaaagaaaataatgggaaggaagaagtatccaagccgttggacataccagatggtcgaagagctccacttcctgctcattaccggagcagtagtactcgcagcattgacactcagactccttctgtccaggagcgcagcagtagctgcagcagtcattcaccctgtgtctcccctttttgtcccccggaatcccaggatggtagcccttgctcaacagaagatttgctctatgatcgtgataaagacagtgggagtagctcaccgttacccaagtatgcttcatctcccaaaccaaacaacagctacatgttcaaacgggagcccccagagggatgtgagcgagtgaaggtctttgaggaaatggcgtctcgtcagcctatctcggcccctctcttttcatgtcctgacaaaaacaaggttaatttcatcccaaccggatcagctttctgtcctgtaaaacttctaggccccctcttacctgcttctgaccttatgctcaagaactcccctaactctggccagagctcagctttggcaactctgaccgttgagcagctctcatcccgggtttcctttacgtctctttctgatgacaccagcacagcgggctccatggaggcctctgtccagcagccatcccagcagcagcagctcctgcaggaactgcagggtgaggaccacatctctgctcagaactatgtgatcatctaaaaaagggggagctggcctccaccctatgttccatggattcggaacaagatttcagacatctgcatgagtgacaaactttctgaacaccaccaccaccaataatacttatcagcatcataaagtatctcttaaacactgatcttggcagggacggaactcctattcagcagtttttgtggaaagcagtaatgcttgcaaaacgtgtgtgtcattcagcattttaagtggagactatgcatttcatagtatatttgacagattagtactgtgtcctgtgttttgttccagattcttcagtataaataagctctatatcaaaaagttgcctgtctaaatagaaaatgtcttgctgtgttttgtcctatggaaaatactgtaattcaggattatgtttacaattgatccaggtgtttgtttctaacttctgtaatacatacaatgcaaaaaaaaaaaaaaaaaaatggccacaacagttgcacagtgcccaccctatggcctagcttcaggtacttcagttgaagtctaaactcaggtaacttggaatgtatatcatattgggatattaaatatttcacagctaaaaagctaaagagggaacatcactcttttgcctttccttattttatgcatttccctttcctcattacattccacattcttagaataagaagtgcattcaatcctaggagaatgataatcctggacatgggtgaacatgaggagaaccagcaaaatctgtggtgtttgacatcactttgtcatgtggttacaagtaaaacaactgttgcattcactgtttcaacatgtgtacatgtggcttttttaaaagttcaggtgttgctcagtaaaggactgtgacaatgttgcaaataaagtgttcagtactggactgtacataaacattccacattgtgtgtgatgaaatttaaagacaagaatgtctagagttaatttcaaaataagtgaagtgtttgacggaatggttgagatttttttgtttatgttagccatcagggtcataactgttaccattttatctaaagacatatttatatttagtttctcccttggaaattctttattttgcaggtgaaaaagtgacatactttttgttattgtcttcctcaagcagtttaggtgcatgatcttcatttacatagaatacttgggtctcagaattgatgcaacataagcaggtttttttggtgacttacaagagcaatagtttgaagctatctcatttaagcctctcataatgcataatcatgagtagttttgaaatttgcaacctgtgaggtagagcataaactcaagaaaatagccttgaacttgcagacttttgacacaagttctccacaaagtgtgaagagagccccaggcattcctgattggtcaatgggagagcctaactttcattgttttcttcagtacaaagagtatccaaaagctaagtttttgtattccactactttcagttcaataaaacctagagttgtttcatctgcgcctaaagtgtatggcacaattttcttaagaattaggggaaccaggtgcctacagttaaaggaacgtttcagttcctttcattcattcctgggtttttcttttattttctaagaaggttgaagaaggatgagtgatagagaagaaagcaacaccattgatttttttttttaagaaatgatatatatatgtatatgtttgtgtgtgtgtgtgtgtgtgtgtgtgtgtgtattctgtgcattattttgtcatgatctcaattctcttctttccaccaaagtttgtcgtaatattttctcctgaaggtgcattctggctcctttaaattagtcagtgttatattgtaggagactgtcatggaaaaaaggactcagtttactttcgtcattttcacaggggaaccttttaaaacaatcttttcagcagcagatacctttaaccctaataatctcaggccttgatgaaaatactatattttgtagattatggttaaagggggaaaattactagttccgtaagataaatatgagctccatttgacttctgatgtctggtttagcattacataatatgttgatcttacactctgcttttgtccaaataaaatgcaatagtatcaatatcaatttcagaaaaatggactgaatatgcttttttggtgatgaaatctcatgtacgatatttatagtgatgtgcttttattttctcatgagatactaaatattaattgtgttgtacatttgttcttagcatatattaaagttttgaaccaaatgtgttaaagcttacgctttgccatgtaaatttcccagaagttgttgagctcaaatgtatcctacatccagctgtagaaatttgtcagaaattgtttaaattttgtatataattgtactgtttaattctagccattgcgctgaacagtatttgagttaccatataatatggctttacacaaggaaatgtgtggcttttgttttgtattttttcagtatagaagttcctgtgtcttatttaaataaagttattagtaaaactgaaa

SEQ ID NO: 12160 - DNA, 1912 bp, Homo sapiens
gcgcatgctccgtcgcctgcccgccctggccgctcgccgcccgcccgcccgacggagacgcagtcccagctatctgacttcatgtgaaagatggctaatgcagaagtgagtgtcccagtgggggatgtggttgtggtacctactgaaggaaatgaaggggagaatcctgaagacactaaaacccaagtgattttgcagttacagcctgtgcaacaaggtttgtttatcgatggacacttttacaacaggatttatgaagctgggtcggagaacaacacggcagttgtagcagtagaaactcacacgatacacaaaattgaagaagggattgatacaggcactatagaagcaaatgaggatatggaaattgcttaccccataacttgtggggagagcaaagccatcctcctctggaagaagtttgtatgtccaggaataaacgtgaagtgtgtcaagttcaatgatcagttgatcagccccaagcactttgttcatctggctggcaagtccactctgaaggactggaagagagctattcgtctgggtgggatcatgctcaggaaaatgatggactccggacagattgatttttaccaacatgacaaagtttgctccaatacctgcagaagcaccaaatttgatcttctgatcagcagtgcaagagctccagtgccaggacagcagacaagtgtggtgcagacacccacttcggctgatggtagcatcacgcagattgccatctcagaagagagcatggaagaggcagggctggaatggaactcagctctcaccgctgctgtcaccatggccacggaggagggtgtaaagaaagactcagaggaaatttcagaggacactttgatgttctggaaaggaatagctgatgtagggctgatggaagaggttgtctgcaatatacagaaggaaatagaggagctactcaggggagttcagcagcggctcatccaggctcccttccaagtcacagatgctgctgttctcaacaatgtagcacacacatttggcctaatggacacagtcaagaaggttttagacaacagaaggaaccaagtagagcagggagaagaacagtttctctatactctgacagacttggaacgccagttggaggagcagaagaagcaaggccaggatcacaggctgaaatctcagacagttcaaaatgtggtactgatgcctgtgagcactcctaagcctccaaaaaggccccggctccagcggccagcctccaccactgtcttgagcccttctcctcctgtccagcagcctcagttcacagtcatctcacccatcaccatcaccccagtgggtcagtcattttccatgggcaatattccagtggccaccctcagccagggctccagtcctgtgactgtccacacactgccttctggccctcagctcttccgctatgccacagtggtctcctctgccaagagcagctcaccagacacagtgaccatccacccttcatctagcttggcgctgctgagctctactgccatgcaggatgggagtacactgggcaacatgaccaccatggttagccctgtggaattggtggccatggagtccggcctaacctcggcaattcaggctgttgaaagcacctcagaggatgggcagaccatcattgagattgatccagccccggacccagaagctgaagatactgagggcaaagcagtcatcttggagacagagctgaggactgaggagaaagttgtggctgagatggaagaacaccagcatcaagttcacaatgtggagattgtggtcttagaggattaactggggatctcagggccaggagttatgttttgatttggaattttaattatttgtttatttttatcattgtcccactcatttccacataggaccctttttt

SEQ ID NO: 12161 - DNA, 1894 bp, Homo sapiens
ctgcgcatgctccgtcgcctgcccgccctggccgctcgccgcccgcccgcccgacggagacgtcccagctatctgacttcatgtgaaagatggctaatgcagaagtgagtgtcccagtgggggatgtggttgtggtacctactgaaggaaatgaaggggagaatcctgaagacactaaaacccaagtgattttgcagttacagcctgtgcaacaagggatttatgaagctgggtcggagaacaacacggcagttgtagcagtagaaactcacacgatacacaaaattgaagaagggattgatacaggcactatagaagcaaatgaggatatggaaattgcttaccccataacttgtggggagagcaaagccatcctcctctggaagaagtttgtatgtccaggaataaacgtgaagtgtgtcaagttcaatgatcagttgatcagccccaagcactttgttcatctggctggcaagtccactctgaaggactggaagagagctattcgtctgggtgggatcatgctcaggaaaatgatggactccggacagattgatttttaccaacatgacaaagtttgctccaatacctgcagaagcaccaaatttgatcttctgatcagcagtgcaagagctccagtgccaggacagcagacaagtgtggtgcagacacccacttcggctgatggtagcatcacgcagattgccatctcagaagagagcatggaagaggcagggctggaatggaactcagctctcaccgctgctgtcaccatggccacggaggagggtgtaaagaaagactcagaggaaatttcagaggacactttgatgttctggaaaggaatagctgatgtagggctgatggaagaggttgtctgcaatatacagaaggaaatagaggagctactcaggggagttcagcagcggctcatccaggctcccttccaagtcacagatgctgctgttctcaacaatgtagcacacacatttggcctaatggacacagtcaagaaggttttagacaacagaaggaaccaagtagagcagggagaagaacagtttctctatactctgacagacttggaacgccagttggaggagcagaagaagcaaggccaggatcacaggctgaaatctcagacagttcaaaatgtggtactgatgcctgtgagcactcctaagcctccaaaaaggccccggctccagcggccagcctccaccactgtcttgagcccttctcctcctgtccagcagcctcagttcacagtcatctcacccatcaccatcaccccagtgggtcagtcattttccatgggcaatattccagtggccaccctcagccagggctccagtcctgtgactgtccacacactgccttctggccctcagctcttccgctatgccacagtggtctcctctgccaagagcagctcaccagacacagtgaccatccacccttcatctagcttggcgctgctgagctctactgccatgcaggatgggagtacactgggcaacatgaccaccatggttagccctgtggaattggtggccatggagtccggcctaacctcggcaattcaggctgttgaaagcacctcagaggatgggcagaccatcattgagattgatccagccccggacccagaagctgaagatactgagggcaaagcagtcatcttggagacagagctgaggactgaggagaaagttgtggctgagatggaagaacaccagcatcaagttcacaatgtggagattgtggtcttagaggattaactggggatctcagggccaggagttatgttttgatttggaattttaattatttgtttatttttatcattgtcccactcatttccacataggacccttttttaaaaaaaaaaaaa

SEQ ID NO: 12162 - DNA, 6410 bp, Homo sapiens
aagcccggcctggcggcggcggtggcggtagctgccgtggcggcctctgcgcatgctccgtcgcctgcccgccctggccgctcgccgcccgcccgcccgacggagacgcagtcccagctatctgacttcatgtgaaagatggctaatgcagaagtgagtgtcccagtgggggatgtggttgtggtacctactgaaggaaatgaaggggagaatcctgaagacactaaaacccaagtgattttgcagttacagcctgtgcaacaagggatttatgaagctgggtcggagaacaacacggcagttgtagcagtagaaactcacacgatacacaaaattgaagaagggattgatacaggcactatagaagcaaatgaggatatggaaattgcttaccccataacttgtggggagagcaaagccatcctcctctggaagaagtttgtatgtccaggaataaacgtgaagtgtgtcaagttcaatgatcagttgatcagccccaagcactttgttcatctggctggcaagtccactctgaaggactggaagagagctattcgtctgggtgggatcatgctcaggaaaatgatggactccggacagattgatttttaccaacatgacaaagtttgctccaatacctgcagaagcaccaaatttgatcttctgatcagcagtgcaagagctccagtgccaggacagcagacaagtgtggtgcagacacccacttcggctgatggtagcatcacgcagattgccatctcagaagagagcatggaagaggcagggctggaatggaactcagctctcaccgctgctgtcaccatggccacggaggagggtgtaaagaaagactcagaggaaatttcagaggacactttgatgttctggaaaggaatagctgatgtagggctgatggaagaggttgtctgcaatatacagaaggaaatagaggagctactcaggggagttcagcagcggctcatccaggctcccttccaagtcacagatgctgctgttctcaacaatgtagcacacacatttggcctaatggacacagtcaagaaggttttagacaacagaaggaaccaagtagagcagggagaagaacagtttctctatactctgacagacttggaacgccagttggaggagcagaagaagcaaggccaggatcacaggctgaaatctcagacagttcaaaatgtggtactgatgcctgtgagcactcctaagcctccaaaaaggccccggctccagcggccagcctccaccactgtcttgagcccttctcctcctgtccagcagcctcagttcacagtcatctcacccatcaccatcaccccagtgggtcagtcattttccatgggcaatattccagtggccaccctcagccagggctccagtcctgtgactgtccacacactgccttctggccctcagctcttccgctatgccacagtggtctcctctgccaagagcagctcaccagacacagtgaccatccacccttcatctagcttggcgctgctgagctctactgccatgcaggatgggagtacactgggcaacatgaccaccatggttagccctgtggaattggtggccatggagtccggcctaacctcggcaattcaggctgttgaaagcacctcagaggatgggcagaccatcattgagattgatccagccccggacccagaagctgaagatactgagggcaaagcagtcatcttggagacagagctgaggactgaggagaaagttgtggctgagatggaagaacaccagcatcaagttcacaatgtggagattgtggtcttagaggattaactggggatctcagggccaggagttatgttttgatttggaattttaattatttgtttatttttatcattgtcccactcatttccacataggacccttttttaaaaaaaaaaaaacaaaatcttattgttgtaactgaaaatgttgggttcttcccactccctcattgaaaaatggacaaaacaagctgcccttccagaagttgagagtaggtcattcaatgtcctaatcatcttacaccaagaaagtaatttcttttaggggaagtgtcaagataacaagtaaccctgtccagaaagccatttccaggctcgtctgtgtgtgtaggcatgtggttttattcttgtaaagatgcattgaccaaactctggaacacagatctgacactggaaggcaacccactcgcatgtggatgctgaagggcactttattttgtatcctgaaaagggcctacagaggccagtacaaaactctcaaacaaaaggaagttgactctgctttgaggggaaggtggcatgccagcactagcttaaaaagggaagtgctagccgggcgtggtggctcacgcctgcaatcccagcactttgggaggccgaggcgggtggatcacgaggtcaggagtttgagaccagcctggccaacatggtgaaaccccgtatctactaaaaatacgaaaaaaaaattagccgggtgtggtggcgggagcctgtaatcccagctattcaggaggccaaggcaggagaatcgcttgaacctgggaaggcagaggttgcagtgagccaagatcgcaccactgcactccagcctgggcaacaagagcgagactccatctcaaaaaaaaaaaaaaaaaaaagtgctttggcaagtatggggcagggaaatcatcttacttccagaggtgcaactgacgcctctggagatctccaaaagttagtaccgtgagtgccattttgagaagaaggtggtaataagtggaaggtacatctccacagagcaagtggcagcagtggcctgtggttttgcagaaatggaaagccaaggccgggtgcggtggctcatgcctgtaatcccagcactttgggaggccgaggtgggtgaatcacctgaggtcaggagtttgaggccagcctggccaacatggtgaaaccccgtctctactgaaaatacaaaaaaaaaaaattagctgggcatggtggcacgcgcctgtaatcccagctacttgggaggctgaggcaggagaattgcttgaacctgggaggcggaggttgcagtgagctgagatcatgccattgcactctagcctgggcgaggagtgaaactccgtctcaaaaaaaaagaaagaaatggaaagccaaggatgctgcagctgtgctttggggttcaaggtaatagcttaccttgttccacactttgtcaaagcactcaccctcctaagctaggaccagtccattcatttgaaactgtgcaatgtgatgtaaatggctctggttcttagactgtggctgtcacagggatggggctccaaggccatcattttcattgcatggctccaagagcagggagttcctcaatgaaaccagctgccttttttggtggggccatttttttggctttggaacccaaagcagccactcatttggtgcttcctcttgttctgccctccatccctcaactcttaatggcatctgtctcctagaacccacgctcttcagctttttggctgatttggagaacagtgacaggtgcctgcctgccttcgtccccttttagattcatttataccacagatgtttctgtgagatactgagatcataaaaagctttaggcttggcagagaggactcaacacccccaggctttcctgaggcaccaactagatgtctcttgagtgagctggactccctgggaaagaagcattgtctgcaacattatattataggaaatgtaccaggaatgtcaataataatgctttgggggggggggttattttgttttgttttgtttttaatgttgtttgtatatttagagctgggccattttccgtgctgcgatttcttctctttgaccctcttcagtgtttggggcaagagtggaccctggtttttatttctttgattgcattgtttactgcactaggaaaaatatagagatacagggaaactacagacaaatttaaggaaaaataggtcaaaaaagaaagcacacaccttaagagtgggaggaatatttttattaaaaacaaaacttggacctgtagtttttttttttcttttttatttttaagaaggcacctttcagaagccatgtttcttccaacagatgttggaaaccccatcgagcaagtaaaagttgcattctccatccctcagatggctgtatgtagtcaaagaaaccctgtaacatggtaaggttgctgttttttttttttttttctttttgagatggagtcttgctctgtagcccaggctggagtgcaatggtgtgatctcagctcactgcaacctccgcctccttggttcaagtgattctcctgcctcagcctcctgagtagctgggattacaggctcccaccaccacgcccgggtaatttttgtatttttagtagagacggggttttgccatgttggccaggctggtcttgaactcctgacctcaagcgatccgcccgccttggcctcccaaagtgttgggattacaggcatgagccaccgcacccagcctgaaggtgactcttaagaatgagatttatgaactccatacagttgtagatttcagtttttaaatagtctggggttttatttttcttttcaaaatatctaatagacttagcaatcaatttagaacaaatatttggcccttaatatatctttagtgagggaagtagcttttatttcctgcttgtttaggttttctgttggtacataaaaacaaaattgctgtctcagactgaatctacttgaatctaggaaggcacatctcatccctattgtggtttttagggacacttttctctttcccagagatgagaggaccaattcaggacagaagagccctcgtgaataccaacgtgctagctcaggttcccttctttcctccatcagagctattggtagggttttaaggtcgtgtgtgcatcatgcttccaatgtcaagagatttcctcaaacagcctgtttactagatgaattttccagctggtgaaatacatgagctttgttgttttcctggtcttccaatagcctgtcattattgttagatattatggcacctgttgttgaatgtaggttcccttacagccctggtctagatgatcctagatggggtgagacatatgcaagccattggtatgtgcataagcagttgcaatgaaccttaggctgacttggtagtaggcatttgtctttctgttcatgcattgaataaacatttttaagaaccatctatgtgccaggctttgtgctaggcactgacagtagagagatgaagacatagtccttgcacttaaggaattcatactccagatgtctggagttaagaaatacatatttcagccaggcatggtggctcacacctagaatcccagcactttcagaagctgaggcagaattgcttgaggccaagagtttaagactagcctggtcaacatagccagaccccatctctataaaaaaatgtaaaaattagtcaagtcttgtggctcgcacttgtagacacaattactcaggatgctgaggcaagaggattttgcttgggcctaggagttcaaggctgtagtgagctatgactttgccactgtactctagcccaggtaacagggcaacatccccagctcagaaaaccaaaactacacatttcattataattgtttttttttgtaattttatgtattttatgcattgaaaaacattatttaagaattggttcataggtttcagcagactgccaaaggcacaaacaagcagctctcctttactgaggtactgaaacagatcctactgcgtaagtgctgtgtgtgatagggctattggctaggagctgagagaacaaagcatgaagtgcctaacccagcttagcggtgtagaggtggggtcagcaaataagggagatcttcctggagaaggcatatacctaagctgatttaggagagaccacttttggctaggtttattgtactacttgattttcaagtaattgggcttatttattctagagaaaaagtcttcagtctcttgcttctgcctgcaaagcaaggcagagtcagcaacatgggcagtctccccactggagaacgctgagtcatgcatgggcttctccaagtttccatcagatgggatccagtgttgaatccagtgcaggactggagtctagctggcaaagggtaaatgcccccaaagccttcctgccatatggtttccacgaaggcctgagagtcagctgtacaactgtcttgtcttggccatgtccctgtttggtccctgccttgttctcttccctttctcaatttccaagctccacccactcctaaaaacaccagtcattctgaagtaaaaaatggacaataaacatgaatattcaagattcaaa

SEQ ID NO: 12163 - DNA, 1124 bp, Homo sapiens
ctggcggcggcggtggcggtagctgccgtggcggcctctgcgcatgctccgtcgcctgcccgccctggccgctcgccgcccgcccgcccgacggagacggatttatgaagctgggtcggagaacaacacggcagttgtagcagtagaaactcacacgatacacaaaattgaagaagggattgatacaggcactatagaagcaaatgaggatatggaaattgcttaccccataacttgtggggagagcaaagccatcctcctctggaagaagtttgtatgtccaggaataaacgtgaagtgtgtcaagttcaatgatcagttgatcagccccaagcactttgttcatctggctggcaagtccactctgaaggactggaagagagctattcgtctgggtgggatcatgctcaggaaaatgatggactccggacagattgatttttaccaacatgacaaagtttgctccaatacctgcagaagcaccaaatttgatcttctgatcagcagtgcaagagctccagtgccaggacagcagacaagtgtggtgcagacacccacttcggctgatggtagcatcacgcagattgccatctcagaagagagcatggaagaggcagggctggaatggaactcagctctcaccgctgctgtcaccatggccacggaggagggtgtaaagaaagactcagaggaaatttcagaggacactttgatgttctggaaaggaatagctgatgtagggctgatggaagaggttgtctgcaatatacagaaggaaatagaggagctactcaggggagttcagcagcggctcatccaggctcccttccaagtcacagatgctgctgttctcaacaatgtagcacacacatttggcctaatggacacagtcaagaaggttttagacaacagaaggaaccaagtagagcagggagaagaacagtttctctatactctgacagacttggaacgccagttggaggagcagaagaagcaaggccaggatcacaggctgaaatctcagacagttcaaaatgtggtactgatgcctgtgagcactcctaagcctccaaaaaggccccggctccagcggccagcctccaccactgtcttgagcccttctc

SEQ ID NO: 12164 - DNA, 4559 bp, Homo sapiens
gcgaggacttcttggagtgctttctgcacctgaaactcagttcagggattggggctggctttgagttcaggccaggagagacggaagaactggcaagccgggagcctgcgtccagggaagttgcttggaattccaggcccctcctgtcctcctgctctgagccccacgtggagggagtggctctgtgctttctacccaagggtttcggcttatccagtgggaaaaacgggtggagtgcgcttacaccgccctcggaaccagagcctggagtagcccttctgttgccgctcgtttttgtcaggaggtagcagtctgggactcaagggtgggtctttggagctgattagagatgcctttgtgagtgctatgttgtgtggatgtggagatgactccatccctgtgccctgccttgcttcctccaggacttgggaccctggaggactgacgctgctggcctgggcgtccccttccgctgagccatggcgactcccgacgtgagtgtgcacatggaggaggtggtggttgtgacaactccggacactgcagtggacggcagtggtgtggagggggtgaagaccgtgttggtgacgaccaacttggcccctcacgggggcgacctgacggaagataacatggagacagaaaatgcagcggcagcagctgccgcggccttcacagcctcctcccagctcaaggaagccgtgttagtgaagatggctgaagagggggagaacctggaagctgagattgtgtaccccatcacctgtggagacagcagagccaacctcatctggaggaagtttgtgtgtcccggcatcaatgtgaaatgtgttcagtacgacgagcatgtaatcagcccaaaggaatttgtgcacctggccgggaagtccaccctgaaggactggaagagagccatccgcatgaacggcatcatgctcaggaagatcatggactccggggaactggacttctaccagcatgacaaggtctgctccaacacctgccgcagcacaaagattgacctctcaggagcccgtgtgtccctgagcagccccacgtcggccgagtacattcccctcacgcccgccgcagccgacgtgaatgggtctcctgcgaccatcaccatagagacctgtgaagaccctggcgactggaccgcggccattggagatgacacatttaccttctggcgggggctgaaggacgccggcctgctggacgaggtcatccaggagttccaccaggagctggtggagaccatgagaggcctgcagcagcgggtccaggaccctcccctgcagcttcgagatgctgtacttctcaacaacatcgtgcagaacttcggcatgctggacctggtgaagaaggtgctggccagccacaagtgccagatggaccgctcgcgggagcagtacgcccgggacctggcagccctggagcagcagtgtgatgagcatcgtcgccgagccaaggagctgaagcacaagtcccagcacctcagcaacgtgctcatgacgctgacgccggtctccctgccaccgcctgtgaagcggccccggcttgcacgtgccacatcaggaccggccgccatggcctcgcaggtgctcacccagtctgcccagctggcgcttggcccgggcgtgcccgtcccccagctgaccagcgtgccccttggtaaagtggtgtccaccctgccgtccaccgtcctgggcaagggttcccttcaggcgccccccgccagctccccggcctccccgctgctcgggggatacacagtcttggcctcttccggctccacctaccccagcacagtggagatccacccggacgcgtccagcctcacggtcctgagcacggccgccgtgcaggacggtagcacggtgttcaaggtggtcagcccgctacagctgctcacgttgcctggcctgggccccaccctgcagaacgtggcccaggcctcgcctggctccagcacaattgtgacagtgcccgcaggggctgcccccgggcctgaggagcacacggccaccattgaggtggctgccatggcagaggaccacgagcggaagtagccgacaggagggcgaggcccctgggacggacagggctggctgtctctcagccgcggcagcagggagcgggcagaggccgcagggctggctcgggcaggtgggtcacgtggtctgcagaaccaaagagaggaatcgccaaaacaaatcacgagaagagagaaggggacagaacagcgagagcaacctggaaaatcggtcttcaggtcccacgtttcctcccccttttttcttgggaaatatatttttccatctgttgcttattaatactgtttacacattgggccttgatcaggagccaggtgggcgggggctagggggagcctgggtgcagcagagacagaggaagcagagccaggtgccgagcgcgaccctgcaggtgctggacgcggtgcagcaggtcacgaggcccccatgtctgcacccagccaggtccctggggacgttactaactcatgacttgggagctaagcccaagtgtgaaacctctggatcctatggatttggtttcttcccacagttttctgtaggtttagtgtggctggcgccccgttctcctccagttgggaacatgcacccggagcttggggtgcagatcctgatgggtgcctgcctcccccgcccccagccggtgctcaggtggcccaggggccgcacagacgaggcgtggtccaggcattgttgcacatgtactgagggtgtttttaagtgaattgcttagtaggcttctaggaagagtcagatttatagcattttcaaccaaaataatggtgagtgcctaggcttcccgagttagctctttgggtggcccctgagcccctgtgagtgcacttgaccgggtgcggaggtcctgggcagcctgtccctgagccggcccctcccaggggtctgagatccatgaggtgtgtccctagggcttcagtcctggggcagaggcataaacagaaccagtcactatggaggtcgaggattcccatgtgggcccttcagcttgggctgcttggccacggaacagcccttggctccctggcccccggcccccatgcagcccctgggctggcccttggtggtctctgtccaagggagagcccctgggtgttcaggaggctgccccgggtgggctgctcagggcagctgccgaaggtggagcccagagcctgtctggaagggctgtctgtggctgtcctgagacctggccttggactcacaaggaagaccaggctgaggcccctccaggccagggtcctggggcaggcatctcagggagcagccagcccaggcctcctgccgtctccaacagggcatgtcccgggaggaccctgagtgccagattcccctggacgctcctgctgattctgtcggcagttgaaggcccgtctgaggccccgcaatgcgagggtcctgtgtcccacttcactgctccgaagggaactggctggctgtccgtccagtgagcggcccagaccccacctctgcgccattgtcaccagggccctgtcctggctgccctcacccatgtcaagctactgaggctgtgtcttgtttgttttctctgttacatttttgtttgctgttgtcacagtcagctggtttcggcgtgatgttgatcttttgatgtacatactccgttttaaactcatttccactctagttgagttctgcagcatgcagcggtatgaccctacgggggtcaggagagccctgcggcccccacccaccagctcagaacctgtcactaatacagctgcctgtgaccctgggacccgcaaccttccagctgcttccctttgtcaaagtcacgagtgcgtctgccttgacagccctcgtcaacagaacttccagtgggttgtgggttcatttcctttctttttaagaacagggttgggaccttttctgcccctgccccttagctactgaggcatagggagaggaagttaatttcagagccatacaaaaataagccacaaccagcttcagaattaattcccaatcccccattccaccagggctgggagcccattcccagtgcttcccaaggccctcggggacatctaccgccaacccagctgcttctggcaggggctccaagccccagcgtggggaagggccctggagaagccctcatcctcatgggaaccacactgcagtgggtggggaaggttgttgtcagcaccgcccccggctcctccaggtcctgctggctcctcgggggcagggttccctggacctcccagttctgcgccttggggccagccagtactcagagaggaggaccttctcaaccacgtacagaacacgggttttcatggctgcctttggtttggttttctgagaagataggattggattggattttgcagagggtgagaacttctctgtgcctgctcagaggcgccctagggaagggccatgtttgagttttgctttgtatgttgttttgcaagtatctgcctggtactttgatttaaaataaaaacaattttcatagtt

SEQ ID NO: 12165 - DNA, 4011 bp, Homo sapiens
tgccctgcaggttgtgccctccgggatcctgattctattctctcctcccttcacttcaccaggggcgacctgacggaagataacatggagacagaaaatgcagcggcagcagctgccgcggccttcacagcctcctcccagctcaaggaagccgtgttagtgaagatggctgaagagggggagaacctggaagctgagattgtgtaccccatcacctgtggagacagcagagccaacctcatctggaggaagtttgtgtgtcccggcatcaatgtgaaatgtgttcagtacgacgagcatgtaatcagcccaaaggaatttgtgcacctggccgggaagtccaccctgaaggactggaagagagccatccgcatgaacggcatcatgctcaggaagatcatggactccggggaactggacttctaccagcatgacaaggtctgctccaacacctgccgcagcacaaagattgacctctcaggagcccgtgtgtccctgagcagccccacgtcggccgagtacattcccctcacgcccgccgcagccgacgtgaatgggtctcctgcgaccatcaccatagagacctgtgaagaccctggcgactggaccgcggccattggagatgacacatttaccttctggcgggggctgaaggacgccggcctgctggacgaggtcatccaggagttccaccaggagctggtggagaccatgagaggcctgcagcagcgggtccaggaccctcccctgcagcttcgagatgctgtacttctcaacaacatcgtgcagaacttcggcatgctggacctggtgaagaaggtgctggccagccacaagtgccagatggaccgctcgcgggagcagtacgcccgggacctggcagccctggagcagcagtgtgatgagcatcgtcgccgagccaaggagctgaagcacaagtcccagcacctcagcaacgtgctcatgacgctgacgccggtctccctgccaccgcctgtgaagcggccccggcttgcacgtgccacatcaggaccggccgccatggcctcgcaggtgctcacccagtctgcccagctggcgcttggcccgggcgtgcccgtcccccagctgaccagcgtgccccttggtaaagtggtgtccaccctgccgtccaccgtcctgggcaagggttcccttcaggcgccccccgccagctccccggcctccccgctgctcgggggatacacagtcttggcctcttccggctccacctaccccagcacagtggagatccacccggacgcgtccagcctcacggtcctgagcacggccgccgtgcaggacggtagcacggtgttcaaggtggtcagcccgctacagctgctcacgttgcctggcctgggccccaccctgcagaacgtggcccaggcctcgcctggctccagcacaattgtgacagtgcccgcaggggctgcccccgggcctgaggagcacacggccaccattgaggtggctgccatggcagaggaccacgagcggaagtagccgacaggagggcgaggcccctgggacggacagggctggctgtctctcagccgcggcagcagggagcgggcagaggccgcagggctggctcgggcaggtgggtcacgtggtctgcagaaccaaagagaggaatcgccaaaacaaatcacgagaagagagaaggggacagaacagcgagagcaacctggaaaatcggtcttcaggtcccacgtttcctcccccttttttcttgggaaatatatttttccatctgttgcttattaatactgtttacacattgggccttgatcaggagccaggtgggcgggggctagggggagcctgggtgcagcagagacagaggaagcagagccaggtgccgagcgcgaccctgcaggtgctggacgcggtgcagcaggtcacgaggcccccatgtctgcacccagccaggtccctggggacgttactaactcatgacttgggagctaagcccaagtgtgaaacctctggatcctatggatttggtttcttcccacagttttctgtaggtttagtgtggctggcgccccgttctcctccagttgggaacatgcacccggagcttggggtgcagatcctgatgggtgcctgcctcccccgcccccagccggtgctcaggtggcccaggggccgcacagacgaggcgtggtccaggcattgttgcacatgtactgagggtgtttttaagtgaattgcttagtaggcttctaggaagagtcagatttatagcattttcaaccaaaataatggtgagtgcctaggcttcccgagttagctctttgggtggcccctgagcccctgtgagtgcacttgaccgggtgcggaggtcctgggcagcctgtccctgagccggcccctcccaggggtctgagatccatgaggtgtgtccctagggcttcagtcctggggcagaggcataaacagaaccagtcactatggaggtcgaggattcccatgtgggcccttcagcttgggctgcttggccacggaacagcccttggctccctggcccccggcccccatgcagcccctgggctggcccttggtggtctctgtccaagggagagcccctgggtgttcaggaggctgccccgggtgggctgctcagggcagctgccgaaggtggagcccagagcctgtctggaagggctgtctgtggctgtcctgagacctggccttggactcacaaggaagaccaggctgaggcccctccaggccagggtcctggggcaggcatctcagggagcagccagcccaggcctcctgccgtctccaacagggcatgtcccgggaggaccctgagtgccagattcccctggacgctcctgctgattctgtcggcagttgaaggcccgtctgaggccccgcaatgcgagggtcctgtgtcccacttcactgctccgaagggaactggctggctgtccgtccagtgagcggcccagaccccacctctgcgccattgtcaccagggccctgtcctggctgccctcacccatgtcaagctactgaggctgtgtcttgtttgttttctctgttacatttttgtttgctgttgtcacagtcagctggtttcggcgtgatgttgatcttttgatgtacatactccgttttaaactcatttccactctagttgagttctgcagcatgcagcggtatgaccctacgggggtcaggagagccctgcggcccccacccaccagctcagaacctgtcactaatacagctgcctgtgaccctgggacccgcaaccttccagctgcttccctttgtcaaagtcacgagtgcgtctgccttgacagccctcgtcaacagaacttccagtgggttgtgggttcatttcctttctttttaagaacagggttgggaccttttctgcccctgccccttagctactgaggcatagggagaggaagttaatttcagagccatacaaaaataagccacaaccagcttcagaattaattcccaatcccccattccaccagggctgggagcccattcccagtgcttcccaaggccctcggggacatctaccgccaacccagctgcttctggcaggggctccaagccccagcgtggggaagggccctggagaagccctcatcctcatgggaaccacactgcagtgggtggggaaggttgttgtcagcaccgcccccggctcctccaggtcctgctggctcctcgggggcagggttccctggacctcccagttctgcgccttggggccagccagtactcagagaggaggaccttctcaaccacgtacagaacacgggttttcatggctgcctttggtttggttttctgagaagataggattggattggattttgcagagggtgagaacttctctgtgcctgctcagaggcgccctagggaagggccatgtttgagttttgctttgtatgttgttttgcaagtatctgcctggtactttgatttaaaataaaaacaattttcatagtt

SEQ ID NO: 12166 - DNA, 4223 bp, Homo sapiens
gcggccgccgccgccgcccgccgccgccgcagctcccgacgccgccgcccccgccgggtgcctaagcaggcccggcgcggccccaggacttgggaccctggaggactgacgctgctggcctgggcgtccccttccgctgagccatggcgactcccgacgtgagtgtgcacatggaggaggtggtggttgtgacaactccggacactgcagtggacggcagtggtgtggagggggtgaagaccgtgttggtgacgaccaacttggcccctcacgggggcgacctgacggaagataacatggagacagaaaatgcagcggcagcagctgccgcggccttcacagcctcctcccagctcaaggaagccgtgttagtgaagatggctgaagagggggagaacctggaagctgagattgtgtaccccatcacctgtggagacagcagagccaacctcatctggaggaagtttgtgtgtcccggcatcaatgtgaaatgtgttcagtacgacgagcatgtaatcagcccaaaggaatttgtgcacctggccgggaagtccaccctgaaggactggaagagagccatccgcatgaacggcatcatgctcaggaagatcatggactccggggaactggacttctaccagcatgacaaggtctgctccaacacctgccgcagcacaaagattgacctctcaggagcccgtgtgtccctgagcagccccacgtcggccgagtacattcccctcacgcccgccgcagccgacgtgaatgggtctcctgcgaccatcaccatagagacctgtgaagaccctggcgactggaccgcggccattggagatgacacatttaccttctggcgggggctgaaggacgccggcctgctggacgaggtcatccaggagttccaccaggagctggtggagaccatgagaggcctgcagcagcgggtccaggaccctcccctgcagcttcgagatgctgtacttctcaacaacatcgtgcagaacttcggcatgctggacctggtgaagaaggtgctggccagccacaagtgccagatggaccgctcgcgggagcagtacgcccgggacctggcagccctggagcagcagtgtgatgagcatcgtcgccgagccaaggagctgaagcacaagtcccagcacctcagcaacgtgctcatgacgctgacgccggtctccctgccaccgcctgtgaagcggccccggcttgcacgtgccacatcaggaccggccgccatggcctcgcaggtgctcacccagtctgcccagctggcgcttggcccgggcgtgcccgtcccccagctgaccagcgtgccccttggtaaagtggtgtccaccctgccgtccaccgtcctgggcaagggttcccttcaggcgccccccgccagctccccggcctccccgctgctcgggggatacacagtcttggcctcttccggctccacctaccccagcacagtggagatccacccggacgcgtccagcctcacggtcctgagcacggccgccgtgcaggacggtagcacggtgttcaaggtggtcagcccgctacagctgctcacgttgcctggcctgggccccaccctgcagaacgtggcccaggcctcgcctggctccagcacaattgtgacagtgcccgcaggggctgcccccgggcctgaggagcacacggccaccattgaggtggctgccatggcagaggaccacgagcggaagtagccgacaggagggcgaggcccctgggacggacagggctggctgtctctcagccgcggcagcagggagcgggcagaggccgcagggctggctcgggcaggtgggtcacgtggtctgcagaaccaaagagaggaatcgccaaaacaaatcacgagaagagagaaggggacagaacagcgagagcaacctggaaaatcggtcttcaggtcccacgtttcctcccccttttttcttgggaaatatatttttccatctgttgcttattaatactgtttacacattgggccttgatcaggagccaggtgggcgggggctagggggagcctgggtgcagcagagacagaggaagcagagccaggtgccgagcgcgaccctgcaggtgctggacgcggtgcagcaggtcacgaggcccccatgtctgcacccagccaggtccctggggacgttactaactcatgacttgggagctaagcccaagtgtgaaacctctggatcctatggatttggtttcttcccacagttttctgtaggtttagtgtggctggcgccccgttctcctccagttgggaacatgcacccggagcttggggtgcagatcctgatgggtgcctgcctcccccgcccccagccggtgctcaggtggcccaggggccgcacagacgaggcgtggtccaggcattgttgcacatgtactgagggtgtttttaagtgaattgcttagtaggcttctaggaagagtcagatttatagcattttcaaccaaaataatggtgagtgcctaggcttcccgagttagctctttgggtggcccctgagcccctgtgagtgcacttgaccgggtgcggaggtcctgggcagcctgtccctgagccggcccctcccaggggtctgagatccatgaggtgtgtccctagggcttcagtcctggggcagaggcataaacagaaccagtcactatggaggtcgaggattcccatgtgggcccttcagcttgggctgcttggccacggaacagcccttggctccctggcccccggcccccatgcagcccctgggctggcccttggtggtctctgtccaagggagagcccctgggtgttcaggaggctgccccgggtgggctgctcagggcagctgccgaaggtggagcccagagcctgtctggaagggctgtctgtggctgtcctgagacctggccttggactcacaaggaagaccaggctgaggcccctccaggccagggtcctggggcaggcatctcagggagcagccagcccaggcctcctgccgtctccaacagggcatgtcccgggaggaccctgagtgccagattcccctggacgctcctgctgattctgtcggcagttgaaggcccgtctgaggccccgcaatgcgagggtcctgtgtcccacttcactgctccgaagggaactggctggctgtccgtccagtgagcggcccagaccccacctctgcgccattgtcaccagggccctgtcctggctgccctcacccatgtcaagctactgaggctgtgtcttgtttgttttctctgttacatttttgtttgctgttgtcacagtcagctggtttcggcgtgatgttgatcttttgatgtacatactccgttttaaactcatttccactctagttgagttctgcagcatgcagcggtatgaccctacgggggtcaggagagccctgcggcccccacccaccagctcagaacctgtcactaatacagctgcctgtgaccctgggacccgcaaccttccagctgcttccctttgtcaaagtcacgagtgcgtctgccttgacagccctcgtcaacagaacttccagtgggttgtgggttcatttcctttctttttaagaacagggttgggaccttttctgcccctgccccttagctactgaggcatagggagaggaagttaatttcagagccatacaaaaataagccacaaccagcttcagaattaattcccaatcccccattccaccagggctgggagcccattcccagtgcttcccaaggccctcggggacatctaccgccaacccagctgcttctggcaggggctccaagccccagcgtggggaagggccctggagaagccctcatcctcatgggaaccacactgcagtgggtggggaaggttgttgtcagcaccgcccccggctcctccaggtcctgctggctcctcgggggcagggttccctggacctcccagttctgcgccttggggccagccagtactcagagaggaggaccttctcaaccacgtacagaacacgggttttcatggctgcctttggtttggttttctgagaagataggattggattggattttgcagagggtgagaacttctctgtgcctgctcagaggcgccctagggaagggccatgtttgagttttgctttgtatgttgttttgcaagtatctgcctggtactttgatttaaaataaaaacaattttcatagtt

SEQ ID NO: 12167 - DNA, 2421 bp, Homo sapiens
agtgcagaagccctgggctgccagcctcaggcagctctccatccaagcagccgttgctgccacaggcgggccttacgctccaaggctacagcatgtgctaggcctcagcaggcaggagcatctctgcctcccaaagcatctacctcttagcccctcggagagatggcgatggatgtcacaaggagccaggcccagacagccttgactctggtagagcagatcctggcagagttccagctgcaggaggaggacctgaagaaggtgatgagacggatgcagaaggagatggaccgcggcctgaggctggagacccatgaagaggccagtgtgaagatgctgcccacctacgtgcgctccaccccagaaggctcagaagtcggggacttcctctccctggacctgggtggcactaacttcagggtgatgctggtgaaggtgggagaaggtgaggaggggcagtggagcgtgaagaccaaacaccagatgtactccatccccgaggacgccatgaccggcactgctgagatgctcttcgactacatctctgagtgcatctccgacttcctggacaagcatcagatgaaacacaagaagctgcccctgggcttcaccttctcctttcctgtgaggcacgaagacatcgataagggcatccttctcaactggaccaagggcttcaaggcctcaggagcagaagggaacaatgtcgtggggcttctgcgagacgctatcaaacggagaggggactttgaaatggatgtggtggcaatggtgaatgacacggtggccacgatgatctcctgctactacgaagaccatcagtgcgaggtcggcatgatcgtgggcacgggctgcaatgcctgctacatggaggagatgcagaatgtggagctggtggagggggacgagggccgcatgtgcgtcaataccgagtggggcgccttcggggactccggcgagctggacgagttcctgctggagtatgaccgcctggtggacgagagctctgcaaaccccggtcagcagctgtatgagaagctcataggtggcaagtacatgggcgagctggtgcggcttgtgctgctcaggctcgtggacgaaaacctgctcttccacggggaggcctccgagcagctgcgcacacgcggagccttcgagacgcgcttcgtgtcgcaggtggagagcgacacgggcgaccgcaagcagatctacaacatcctgagcacgctggggctgcgaccctcgaccaccgactgcgacatcgtgcgccgcgcctgcgagagcgtgtctacgcgcgctgcgcacatgtgctcggcggggctggcgggcgtcatcaaccgcatgcgcgagagccgcagcgaggacgtaatgcgcatcactgtgggcgtggatggctccgtgtacaagctgcaccccagcttcaaggagcggttccatgccagcgtgcgcaggctgacgcccagctgcgagatcaccttcatcgagtcggaggagggcagtggccggggcgcggccctggtctcggcggtggcctgtaagaaggcctgtatgctgggccagtgagagcagtggccgcaagcgcagggaggatgccacagccccacagcacccaggctccatggggaagtgctccccacacgtgctcgcagcctggcggggcaggaggcctggccttgtcaggacccaggccgcctgccataccgctggggaacagagcgggcctcttccctcagtttttcggtgggacagccccagggccctaacgggggtgcggcaggagcaggaacagagactctggaagccccccacctttctcgctggaatcaatttcccagaagggagttgctcactcaggactttgatgcatttccacactgtcagagctgttggcctcgcctgggcccaggctctgggaaggggtgccctctggatcctgctgtggcctcacttccctgggaactcatcctgtgtggggaggcagctccaacagcttgaccagacctagacctgggccaaaagggcagccaggggctgctcatcacccagtcctggccattttcttgcctgaggctcaagaggcccagggagcaatgggagggggctccatggaggaggtgtcccaagctttgaatacccccagagaccttttctctcccataccatcactgagtggcttgtgattctgggatggaccctcgcagcaggtgcaagagacagagcccccaagcctctgccccaaggggcccacaaaggggagaagggccagccctacatcttcagctcccatagcgctggctcaggaagaaaccccaagcagcattcagcacaccccaagggacaaccccatcatatgacatgccaccctctccatgcccaacctaagattgtgtgggttttttaattaaaaatgttaaaagtttt

SEQ ID NO: 12168 - DNA, 2539 bp, Homo sapiens
aagccctgggctgccagcctcaggcagctctccatccaagcagccgttgctgccacaggcgggccttacgctccaaggctacagcatgtgctaggcctcagcaggcaggagcatctctgcctcccaaagcatctacctcttagcccctcggagagatggcgatggatgtcacaaggagccaggcccagacagccttgactctgccagactctcctctgaactcgggcctcacatggccaactgctacttggaacaaatcgccccttggctggcagatgtgttaacatgcccagaccaagatcccaactcccacaacccaactcccaggtagagcagatcctggcagagttccagctgcaggaggaggacctgaagaaggtgatgagacggatgcagaaggagatggaccgcggcctgaggctggagacccatgaagaggccagtgtgaagatgctgcccacctacgtgcgctccaccccagaaggctcagaagtcggggacttcctctccctggacctgggtggcactaacttcagggtgatgctggtgaaggtgggagaaggtgaggaggggcagtggagcgtgaagaccaaacaccagatgtactccatccccgaggacgccatgaccggcactgctgagatgctcttcgactacatctctgagtgcatctccgacttcctggacaagcatcagatgaaacacaagaagctgcccctgggcttcaccttctcctttcctgtgaggcacgaagacatcgataagggcatccttctcaactggaccaagggcttcaaggcctcaggagcagaagggaacaatgtcgtggggcttctgcgagacgctatcaaacggagaggggactttgaaatggatgtggtggcaatggtgaatgacacggtggccacgatgatctcctgctactacgaagaccatcagtgcgaggtcggcatgatcgtgggcacgggctgcaatgcctgctacatggaggagatgcagaatgtggagctggtggagggggacgagggccgcatgtgcgtcaataccgagtggggcgccttcggggactccggcgagctggacgagttcctgctggagtatgaccgcctggtggacgagagctctgcaaaccccggtcagcagctgtatgagaagctcataggtggcaagtacatgggcgagctggtgcggcttgtgctgctcaggctcgtggacgaaaacctgctcttccacggggaggcctccgagcagctgcgcacacgcggagccttcgagacgcgcttcgtgtcgcaggtggagagcgacacgggcgaccgcaagcagatctacaacatcctgagcacgctggggctgcgaccctcgaccaccgactgcgacatcgtgcgccgcgcctgcgagagcgtgtctacgcgcgctgcgcacatgtgctcggcggggctggcgggcgtcatcaaccgcatgcgcgagagccgcagcgaggacgtaatgcgcatcactgtgggcgtggatggctccgtgtacaagctgcaccccagcttcaaggagcggttccatgccagcgtgcgcaggctgacgcccagctgcgagatcaccttcatcgagtcggaggagggcagtggccggggcgcggccctggtctcggcggtggcctgtaagaaggcctgtatgctgggccagtgagagcagtggccgcaagcgcagggaggatgccacagccccacagcacccaggctccatggggaagtgctccccacacgtgctcgcagcctggcggggcaggaggcctggccttgtcaggacccaggccgcctgccataccgctggggaacagagcgggcctcttccctcagtttttcggtgggacagccccagggccctaacgggggtgcggcaggagcaggaacagagactctggaagccccccacctttctcgctggaatcaatttcccagaagggagttgctcactcaggactttgatgcatttccacactgtcagagctgttggcctcgcctgggcccaggctctgggaaggggtgccctctggatcctgctgtggcctcacttccctgggaactcatcctgtgtggggaggcagctccaacagcttgaccagacctagacctgggccaaaagggcagccaggggctgctcatcacccagtcctggccattttcttgcctgaggctcaagaggcccagggagcaatgggagggggctccatggaggaggtgtcccaagctttgaatacccccagagaccttttctctcccataccatcactgagtggcttgtgattctgggatggaccctcgcagcaggtgcaagagacagagcccccaagcctctgccccaaggggcccacaaaggggagaagggccagccctacatcttcagctcccatagcgctggctcaggaagaaaccccaagcagcattcagcacaccccaagggacaaccccatcatatgacatgccaccctctccatgcccaacctaagattgtgtgggttttttaattaaaaatgttaaaagtttta

SEQ ID NO: 12169 - DNA, 2729 bp, Homo sapiens
gagcaggaaatgccgagcggcgcctgagccccagggaagcaggctaggatgtgagagacacagtcacctgcagcctaattactcaaaagctgtccccaggtcacagaagggagaggacatttcccactgaatctgtctgaaggacactaagccccacagctcaacacaaccaggagagaaagcgctgaggacgccacccaagcgcccagcaatggccctgcctggagaacatccaggctcagtgaggaagggtccagaagggaatgcttgccgactcgttggagaacaatgaaaaggaggaaactgtgactgaacctcaaaccccaaaccagcccgaggagaaccacattctcccagggacccagggcgggccgtgacccctgcggcggagaagccttggatatttccacttcagaagcctactggggaaggctgaggggtcccagctccccacgctggctgctgtgcagatgctggacgacagagccaggatggaggccgccaagaaggagaaggtagagcagatcctggcagagttccagctgcaggaggaggacctgaagaaggtgatgagacggatgcagaaggagatggaccgcggcctgaggctggagacccatgaagaggccagtgtgaagatgctgcccacctacgtgcgctccaccccagaaggctcagaagtcggggacttcctctccctggacctgggtggcactaacttcagggtgatgctggtgaaggtgggagaaggtgaggaggggcagtggagcgtgaagaccaaacaccagatgtactccatccccgaggacgccatgaccggcactgctgagatgctcttcgactacatctctgagtgcatctccgacttcctggacaagcatcagatgaaacacaagaagctgcccctgggcttcaccttctcctttcctgtgaggcacgaagacatcgataagggcatccttctcaactggaccaagggcttcaaggcctcaggagcagaagggaacaatgtcgtggggcttctgcgagacgctatcaaacggagaggggactttgaaatggatgtggtggcaatggtgaatgacacggtggccacgatgatctcctgctactacgaagaccatcagtgcgaggtcggcatgatcgtgggcacgggctgcaatgcctgctacatggaggagatgcagaatgtggagctggtggagggggacgagggccgcatgtgcgtcaataccgagtggggcgccttcggggactccggcgagctggacgagttcctgctggagtatgaccgcctggtggacgagagctctgcaaaccccggtcagcagctgtatgagaagctcataggtggcaagtacatgggcgagctggtgcggcttgtgctgctcaggctcgtggacgaaaacctgctcttccacggggaggcctccgagcagctgcgcacacgcggagccttcgagacgcgcttcgtgtcgcaggtggagagcgacacgggcgaccgcaagcagatctacaacatcctgagcacgctggggctgcgaccctcgaccaccgactgcgacatcgtgcgccgcgcctgcgagagcgtgtctacgcgcgctgcgcacatgtgctcggcggggctggcgggcgtcatcaaccgcatgcgcgagagccgcagcgaggacgtaatgcgcatcactgtgggcgtggatggctccgtgtacaagctgcaccccagcttcaaggagcggttccatgccagcgtgcgcaggctgacgcccagctgcgagatcaccttcatcgagtcggaggagggcagtggccggggcgcggccctggtctcggcggtggcctgtaagaaggcctgtatgctgggccagtgagagcagtggccgcaagcgcagggaggatgccacagccccacagcacccaggctccatggggaagtgctccccacacgtgctcgcagcctggcggggcaggaggcctggccttgtcaggacccaggccgcctgccataccgctggggaacagagcgggcctcttccctcagtttttcggtgggacagccccagggccctaacgggggtgcggcaggagcaggaacagagactctggaagccccccacctttctcgctggaatcaatttcccagaagggagttgctcactcaggactttgatgcatttccacactgtcagagctgttggcctcgcctgggcccaggctctgggaaggggtgccctctggatcctgctgtggcctcacttccctgggaactcatcctgtgtggggaggcagctccaacagcttgaccagacctagacctgggccaaaagggcagccaggggctgctcatcacccagtcctggccattttcttgcctgaggctcaagaggcccagggagcaatgggagggggctccatggaggaggtgtcccaagctttgaatacccccagagaccttttctctcccataccatcactgagtggcttgtgattctgggatggaccctcgcagcaggtgcaagagacagagcccccaagcctctgccccaaggggcccacaaaggggagaagggccagccctacatcttcagctcccatagcgctggctcaggaagaaaccccaagcagcattcagcacaccccaagggacaaccccatcatatgacatgccaccctctccatgcccaacctaagattgtgtgggttttttaattaaaaatgttaaaagttttaaa

SEQ ID NO: 12170 - DNA, 2186 bp, Homo sapiens
gtgaccagaggggtttgtgtggctgaagaggcaggaggaacagtgtatccacagcgtgggaccatgccaggcacaaaacggtttcaacatgtcattgagaccccggagcctggcaagtgggagttgtctgggtacgaggcagctgtgccaatcacggagaagtcaaacccactgacccaggatctagacaaagcagatgctgagaacattgttcgactgctagggcaatgtgatgctgagatcttccaggaggaggggcaagccctgtccacataccagagactctacagcgaatccattctgaccaccatggtacaggtggctgggaaagttcaggaagtgctgaaggagccagatggggggctggttgtgctgagtggagggggcacctctggccggatggcattcctcatgtcggtgtcctttaatcagctgatgaaaggtctgggacagaaacctctttacacctacctcattgcaggtggtgacaggtctgtggtggcctctagggaggggacagaagatagtgccttgcacgggattgaggaactgaagaaggtggctgccgggaagaagagagtgattgtcattggcatttctgtgggactctctgctccctttgtggcaggccagatggactgctgcatgaacaacacagctgtcttcttgccagtcctggttggcttcaatccagtgagcatggccagaaatgaccccattgaagactggagttcaacattccgacaagtagcagagcggatgcagaaaatgcaggagaaacagaaagcttttgtgctcaatcctgccatcgggcccgagggtctcagcggctcctcccggatgaaaggtggaagtgccaccaagattctgctggaaaccctgttattagcagcccataagactgtggaccagggcattgcagcatctcaaagatgcctcctggaaatcttgcggacatttgagcgagctcatcaggtgacctacagccaaagccccaagattgccaccctgatgaagagtgtcagcaccagtctggagaagaaaggccacgtgtacctggttggctggcagaccctgggcatcattgccatcatggatggagtagagtgcatccacacctttggtgctgatttccgagatgtccgtggctttctcattggtgatcacagtgacatgtttaaccagaaggctgagctcaccaaccagggtccccagttcaccttctcccaggaggacttcctgacttccatccttccctctctcacggaaatcgatactgtggtcttcattttcaccctggatgacaacctcacggaggtgcagactatagtggagcaggtgaaagagaagaccaaccacatccaggccctggcacacagcaccgtgggtcagaccttgctgatccctctgaagaagctctttccctccatcatcagcatcacatggccactgcttttctttgaatatgaagggaacttcatccagaagttccagcgtgagctaagcaccaaatgggtgctgaatacagtgagtacaggtgctcatgtgcttcttggtaagatcctacaaaaccacatgttggaccttcggattagcaactccaagctcttctggcgggcgctggccatgctgcagcggttctctggacagtccaaggctcgatgcatcgagagcctcctccgagcgatccactttccccagccactgtcagatgatattcgggctgctcccatctcctgccatgtccaggttgcacatgagaaggaacaggtgatacccatcgccttgctgagcctcctattccggtgctcgatcactgaggctcaggcacacctggctgcagctccttctgtctgtgaggctgtcaggagtgctcttgctgggccaggtcagaagcgcactgcggaccccctcgagatcctagagcctgacgttcagtgaacccatgtttctgggtgggtgaaaggggcccaaccctgcccacttcagcccagcccgcccaaggggacttgtgccagcagaacatgtgggaggaagaagccccgtttccagggcatccgcagcccagggtagggagaaatattctctccactttgggggagagttcttgctctcgacctagtggtttctactctcaccgacttattctgatttcagaaataaaatgaaatgtcttattttggaaa

SEQ ID NO: 12171 - DNA, 2116 bp, Homo sapiens
agaggggtttgtgtggctgaagaggcaggaggaacagtgtatccacagcgtgggaccatgccaggcacaaaacggtttcaacatgtcattgagaccccggagcctggcaagtgggagttgtctgggtacgaggcagctgtgccaatcacggagaagtcaaacccactgacccaggatctagacaaagcagatgctgagaacattgttcgactgctagggcaatgtgatgctgagatcttccaggaggaggggcaagccctgtccacataccagagactctacagcgaatccattctgaccaccatggtacaggtggctgggaaagttcaggaagtgctgaaggagccagatggggggctggttgtgctgagtggagggggcacctctggccggatggcattcctcatgtcggtgtcctttaatcagctgatgaaaggtctgggacagaaacctctttacacctacctcattgcaggtggtgacaggtggctgccgggaagaagagagtgattgtcattggcatttctgtgggactctctgctccctttgtggcaggccagatggactgctgcatgaacaacacagctgtcttcttgccagtcctggttggcttcaatccagtgagcatggccagaaatgaccccattgaagactggagttcaacattccgacaagtagcagagcggatgcagaaaatgcaggagaaacagaaagcttttgtgctcaatcctgccatcgggcccgagggtctcagcggctcctcccggatgaaaggtggaagtgccaccaagattctgctggaaaccctgttattagcagcccataagactgtggaccagggcattgcagcatctcaaagatgcctcctggaaatcttgcggacatttgagcgagctcatcaggtgacctacagccaaagccccaagattgccaccctgatgaagagtgtcagcaccagtctggagaagaaaggccacgtgtacctggttggctggcagaccctgggcatcattgccatcatggatggagtagagtgcatccacacctttggtgctgatttccgagatgtccgtggctttctcattggtgatcacagtgacatgtttaaccagaaggctgagctcaccaaccagggtccccagttcaccttctcccaggaggacttcctgacttccatccttccctctctcacggaaatcgatactgtggtcttcattttcaccctggatgacaacctcacggaggtgcagactatagtggagcaggtgaaagagaagaccaaccacatccaggccctggcacacagcaccgtgggtcagaccttgctgatccctctgaagaagctctttccctccatcatcagcatcacatggccactgcttttctttgaatatgaagggaacttcatccagaagttccagcgtgagctaagcaccaaatgggtgctgaatacagtgagtacaggtgctcatgtgcttcttggtaagatcctacaaaaccacatgttggaccttcggattagcaactccaagctcttctggcgggcgctggccatgctgcagcggttctctggacagtccaaggctcgatgcatcgagagcctcctccgagcgatccactttccccagccactgtcagatgatattcgggctgctcccatctcctgccatgtccaggttgcacatgagaaggaacaggtgatacccatcgccttgctgagcctcctattccggtgctcgatcactgaggctcaggcacacctggctgcagctccttctgtctgtgaggctgtcaggagtgctcttgctgggccaggtcagaagcgcactgcggaccccctcgagatcctagagcctgacgttcagtgaacccatgtttctgggtgggtgaaaggggcccaaccctgcccacttcagcccagcccgcccaaggggacttgtgccagcagaacatgtgggaggaagaagccccgtttccagggcatccgcagcccagggtagggagaaatattctctccactttgggggagagttcttgctctcgacctagtggtttctactctcaccgacttattctgatttcagaaataaaatgaaatgtcttattttggaaagtt

SEQ ID NO: 12172 - DNA, 5122 bp, Homo sapiens
cccctgtccctggctcacgtgatcgcgcctagggagaaaacgtctgactccagccaccggccttcaaggcacggctttttattccttcggctggtcggcctctcgcccttcagctacctgtgcgtccctccgtcccgtcccgtcccggggtcaccccggagcctgtccgctatgcggctcctgcctctagccccaggtcggctccggcggggcagcccccgccacctgccctcctgcagcccagcgctgctactgctggtgctgggcggctgcctgggggtcttcggggtggctgcgggaacccggaggcccaacgtggtgctgctcctcacggacgaccaggacgaagtgctcggcggcatgacaccgctaaagaaaaccaaagctctcatcggagagatggggatgactttttccagtgcttatgtgccaagtgctctctgctgccccagcagagccagtatcctgacaggaaagtacccacataatcatcacgttgtgaacaacactctggaggggaactgcagtagtaagtcctggcagaagatccaagaaccaaatactttcccagcaattctcagatcaatgtgtggttatcagaccttttttgcagggaaatatttaaatgagtacggagccccagatgcaggtggactagaacacgttcctctgggttggagttactggtatgccttggaaaagaattctaagtattataattacaccctgtctatcaatgggaaggcacggaagcatggtgaaaactatagtgtggactacctgacagatgttttggctaatgtctccttggactttctggactacaagtccaactttgagcccttcttcatgatgatcgccactccagcgcctcattcgccttggacagctgcacctcagtaccagaaggctttccagaatgtctttgcaccaagaaacaagaacttcaacatccatggaacgaacaagcactggttaattaggcaagccaagactccaatgactaattcttcaatacagtttttagataatgcatttaggaaaaggtggcaaactctcctctcagttgatgaccttgtggagaaactggtcaagaggctggagttcactggggagctcaacaacacttacatcttctatacctcagacaatggctatcacacaggacagttttccttgccaatagacaagagacagctgtatgagtttgatatcaaagttccactgttggttcgaggacctgggatcaaaccaaatcagacaagcaagatgctggttgccaacattgacttgggtcctactattttggacattgctggctacgacctaaataagacacagatggatgggatgtccttattgcccattttgagaggtgccagtaacttgacctggcgatcagatgtcctggtggaataccaaggagaaggccgtaacgtcactgacccaacatgcccttccctgagtcctggcgtatctcaatgcttcccagactgtgtatgtgaagatgcttataacaatacctatgcctgtgtgaggacaatgtcagcattgtggaatttgcagtattgcgagtttgatgaccaggaggtgtttgtagaagtctataatctgactgcagacccagaccagatcactaacattgctaaaaccatagacccagagcttttaggaaagatgaactatcggttaatgatgttacagtcctgttctgggccaacctgtcgcactccaggggtttttgaccccggatacaggtttgacccccgtctcatgttcagcaatcgcggcagtgtcaggactcgaagattttccaaacatcttctgtagcgacctcacacagcctctgcagatggatccctgcacgcctctttctgatgaagtgattgtagtaggtgtctgtagctagtcttcaagaccacacctggaagagtttctgggctggctttaagtcctgtttgaaaaagcaacccagtcagctgacttcctcgtgcaatgtgttaaactgtgaactctgcccatgtgtcaggagtggctgtctctggtctcttcctttagctgacaaggacactcctgaggtctttgttctcactgtattctttttatcctggggccacagttcttgattattcctcttgtggttaaagactgaatttgtaaacccattcagataaatggcagtactttaggacacacacaaacacacagacacaccttttgatatgtaagcttgacctaaagtcaaaggacctgtgtagcatttcagattgagcacttcactatcaaaaatactaacatcacatggcttgaagagtaaccatcagagctgaatcatccaagtaagaacaagtaccattgttgattgataagtagagatacattttttatgatgttcatcacagtgtggtaaggttgcaaattcaaaacatgtcacccaagctctgttcatgtttttgtgaattctaggctggtgctgcactgaaatagagcagtaagcttgtgataaaggccaattccaggtagctcttgaaggtgatagccatctactttccagtggctgccaaccacagggagtgccagttaacactggaaggattaaggcaaggtcccttctcttgagactcccctctgagatctgaaaaatgaagtggcttaggaacatcagcagtgaagaactgccaagagttggtgaaggttgtctcttccgagggccttctgaagacagggctcttgaacagacaagtggaagggctgtaccagggataaaggaaagaagtgcctgtccagcagggagcttgaatttaagttccatgtatgaagtcattggctctatctgcatttttctgtcattctcttcatttgttttaaggtggaaaattttcttacagttgatgcaaagtatcaactactttaccctaccttctccccttttagatgggttcttcctgagttttggagtcttgtatgattatcagtattcccctgtcaaaatcaaatctattcaggtttcttcactgttgagaacacctaaatgtttttatttttgagaagtggggacagagtctcactatgtcacccaggctggagtgcaatggcatgatctcagctcactgcaaccttcgcctcctgggttcaagcgattctcctgcctccgcctcctgagtagctgggattataggcacgcaccaccacgcccagctaattttttgtatttttagtagagacagagtttcaccatgttggccaggctggtcttgaactcctgaccttgtgatccacccacctcggcctcccagagtgctgggattacaggcatgagccaccacgcttggctaagaacacctaaatttttatgtttcttggctcaaaaaccagttccatttctaatgttgtcctcacaagaaggctaattggtggtgagacagcaggggaggaggaagagctgtggtttgtaacttgttcaactcaggcaataagcgattttagctttatttaaagtcttctgtccagctttaagcactttgtaagacatggctgaaagtagcttttctatcagaattgcagatagtcatgttgggctaacagtcaattggatatattcctttacctcacatgaccccagcaactgtggtggtatctagaggtgaaacaggcaagtgaaatggacacctctgctgtgaatgttttagagaaggaaattcaaaaaatgttgtaactgaaagcactgttgaatatgggtatcggctttctttttcactttgactcttaacattatcagtcaacttccacattaatgaaagttgaccatagttatttccaaataaaaagaaaccaactcttaccaggtcttggactgtgatgtcatattattcagttttatgcttgttcctgagcagaactcataagagtgacatagtcagctgctgacggcacctcagccacgccactcttactcagttcagtgggtgtgcttgcgtggtaggatgtggtgcagccctctctacgctcttctatttttggtatatttcctatctaaccttcaaatagcttccaattctttttttcttggactggcttcattctgaatttgtgctaaaataatctttcataaagagacctcagtttatagcgtaacagactacacaatgcactgatgttttcataatgtttaagggacccactgcaagaagcttgctgcctccttttaattgtattcatttagattttgattttccatgttaagaaggtgaggtccatgttggtgcccttcagagtagagaaccatgtaaacattaggaatgaacagaggccttaggaatgaatagagagtttgccttatacaatttcctgttacaaagctctccctctcatgcaaagtagggaacaccttttgagcatctttgaatttgacaaatggtgctgttgcaaacactttttttttgagatgaagtctcgcggttgtcacccgggctggagtgcagtggcgtgatctcggctcactgcaacttccacctcctgggttccagcagttctcctgcctcagcctcccaagtagctgagattacaggcgcctgccaccccacctggctgatttttgtaattttagtagagacggggtttcaccatgttggccaggctgattaactcctgacctcaggtgatccacctttctcggcctcccaaagtgctgggattacgggtgtgagccaccgtgcccggcctgcaaacacattttaattgacaacactagggctgttgtacaaaatagtaatgatagccatggaagttttaccttattctgtgagaagtgttcttaaacttattaagtgtctaaactaaggtttagtgcttttttaaaggaaagttgtcccaggattcatcctaaagaaagcaaaagttaattcaactgatccaccaatggaattagatgggtagagttgggttcttgagttttaccaccacttagttcccactgaattttgtaacttcctgtgtttgcatcctctgttcctattctgcccttgctctgtgtcatctcagtcatttgacttagaaagtgcccttcaaaaggaccctgttcactgctgcacttttcaatgaattaaaatttatttctgttcta

SEQ ID NO: 12173 - DNA, 1824 bp, Homo sapiens
gtctgactccagccaccggccttcaaggcacggctttttattccttcggctggtcggcctctcgcccttcagctacctgtgcctgccctcctgcagcccagcgctgctactgctggtgctgggcggctgcctgggggtcttcggggtggctgcgggaacccggaggcccaacgtggtgctgctcctcacggacgaccaggacgaagtgctcggcggcatgtatgtgccaagtgctctctgctgccccagcagagccagtatcctgacaggaaagtacccacataatcatcacgttgtgaacaacactctggaggggaactgcagtagtaagtcctggcagaagatccaagaaccaaatactttcccagcaattctcagatcaatgtgtggttatcagaccttttttgcagggaaatatttaaatgagtacggagccccagatgcaggtggactagaacacgttcctctgggttggagttactggtatgccttggaaaagaattctaagtattataattacaccctgtctatcaatgggaaggcacggaagcatggtgaaaactatagtgtggactacctgacagatgttttggctaatgtctccttggactttctggactacaagtccaactttgagcccttcttcatgatgatcgccactccagcgcctcattcgccttggacagctgcacctcagtaccagaaggctttccagaatgtctttgcaccaagaaacaagaacttcaacatccatggaacgaacaagcactggttaattaggcaagccaagactccaatgactaattcttcaatacagtttttagataatgcatttaggaaaaggtggcaaactctcctctcagttgatgaccttgtggagaaactggtcaagaggctggagttcactggggagctcaacaacacttacatcttctatacctcagacaatggctatcacacaggacagttttccttgccaatagacaagagacagctgtatgagtttgatatcaaagttccactgttggttcgaggacctgggatcaaaccaaatcagacaagcaagatgctggttgccaacattgacttgggtcctactattttggacattgctggctacgacctaaataagacacagatggatgggatgtccttattgcccattttgagaggtgccagtaacttgacctggcgatcagatgtcctggtggaataccaaggagaaggccgtaacgtcactgacccaacatgcccttccctgagtcctggcgtatctcaatgcttcccagactgtgtatgtgaagatgcttataacaatacctatgcctgtgtgaggacaatgtcagcattgtggaatttgcagtattgcgagtttgatgaccaggaggtgtttgtagaagtctataatctgactgcagacccagaccagatcactaacattgctaaaaccatagacccagagcttttaggaaagatgaactatcggttaatgatgttacagtcctgttctgggccaacctgtcgcactccaggggtttttgaccccggatacaggtttgacccccgtctcatgttcagcaatcgcggcagtgtcaggactcgaagattttccaaacatcttctgtagcgacctcacacagcctctgcagatggatccctgcacgcctctttctgatgaagtgattgtagtaggtgtctgtagctagtcttcaagaccacacctggaagagtttctgggctggctttaagtcctgtttgaaaaagcaacccagtcagctgacttcctcgtgcaatgtgttaaactgtgaactctgcccatgtgtc

SEQ ID NO: 12174 - DNA, 2020 bp, Homo sapiens
acgtgatcgcgcctagggagaaaacgtctgactccagccaccggccttcaaggcacggctttttattccttcggctggtcggcctctcgcccttcagctacctgtgcgtccctccgtcccgtcccgtcccggggtcaccccggagcctgtccgctatgcggctcctgcctctagccccaggtcggctccggcggggcagcccccgccacctgccctcctgcagcccagcgctgctactgctggtgctgggcggctgcctgggggtcttcggggtggctgcgggaacccggaggcccaacgtggtgctgctcctcacggacgaccaggacgaagtgctcggcggcatgtatgtgccaagtgctctctgctgccccagcagagccagtatcctgacaggaaagtacccacataatcatcacgttgtgaacaacactctggaggggaactgcagtagtaagtcctggcagaagatccaagaaccaaatactttcccagcaattctcagatcaatgtgtggttatcagaccttttttgcagggaaatatttaaatgagtacggagccccagatgcaggtggactagaacacgttcctctgggttggagttactggtatgccttggaaaagaattctaagtattataattacaccctgtctatcaatgggaaggcacggaagcatggtgaaaactatagtgtggactacctgacagatgttttggctaatgtctccttggactttctggactacaagtccaactttgagcccttcttcatgatgatcgccactccagcgcctcattcgccttggacagctgcacctcagtaccagaaggctttccagaatgtctttgcaccaagaaacaagaacttcaacatccatggaacgaacaagcactggttaattaggcaagccaagactccaatgactaattcttcaatacagtttttagataatgcatttaggaaaaggtggcaaactctcctctcagttgatgaccttgtggagaaactggtcaagaggctggagttcactggggagctcaacaacacttacatcttctatacctcagacaatggctatcacacaggacagttttccttgccaatagacaagagacagctgtatgagtttgatatcaaagttccactgttggttcgaggacctgggatcaaaccaaatcagacaagcaagatgctggttgccaacattgacttgggtcctactattttggacattgctggctacgacctaaataagacacagatggatgggatgtccttattgcccattttgagaggtgccagtaacttgacctggcgatcagatgtcctggtggaataccaaggagaaggccgtaacgtcactgacccaacatgcccttccctgagtcctggcgtatctcaatgcttcccagactgtgtatgtgaagatgcttataacaatacctatgcctgtgtgaggacaatgtcagcattgtggaatttgcagtattgcgagtttgatgaccaggaggtgtttgtagaagtctataatctgactgcagacccagaccagatcactaacattgctaaaaccatagacccagagcttttaggaaagatgaactatcggttaatgatgttacagtcctgttctgggccaacctgtcgcactccaggggtttttgaccccggatacaggtttgacccccgtctcatgttcagcaatcgcggcagtgtcaggactcgaagattttccaaacatcttctgtagcgacctcacacagcctctgcagatggatccctgcacgcctctttctgatgaagtgattgtagtaggtgtctgtagctagtcttcaagaccacacctggaagagtttctgggctggctttaagtcctgtttgaaaaagcaacccagtcagctgacttcctcgtgcaatgtgttaaactgtgaactctgcccatgtgtcaggagtggctgtctctggtctcttcctttagctgacaaggacactcctgaggtctttgttctcactgta

SEQ ID NO: 12175 - DNA, 5089 bp, Homo sapiens
agtctggaattcagatgcctattggtgactgctccgtggcagctaaaccaagaaaacagctgctctgctcattatttcaaaccacactagggtacagagctcgtgcttcgggatggaaacctatggttatctgcagagggagtcatgctttcaaggacctcataaatacatatcgaatgattgaacaagatgactttgacattaacaccaggctacacacaattgtgaggggagaagatgaggcagccatggtggagtcagtaggcctggccctagtgaagctgccagatgtccttaatcgcctgaagcctgatatcatgattgttcatggagacaggtttgatgccctggctctggccacatctgctgccttgatgaacatccgaatccttcacattgaaggtggggaagtcagtgggaccattgatgactctatcagacatgccataacaaaactggctcattatcatgtgtgctgcacccgcagtgcagagcagcacctgatatccatgtgtgaggaccatgatcgcatccttttggcaggctgcccttcctatgacaaacttctctcagccaagaacaaagactacatgagcatcattcgcatgtggctaggtgatgatgtaaaatctaaagattacattgttgcactacagcaccctgtgaccactgacattaagcattccataaaaatgtttgaattaacattggatgcacttatctcatttaacaagcggaccctagtcctgtttccaaatattgacgcagggagcaaagagatggttcgagtgatgcggaagaagggcattgagcatcatcccaactttcgtgcagttaaacacgtcccatttgaccagtttatacagttggttgcccatgctggctgtatgattgggaacagcagctgtggggttcgagaagttggagcttttggaacacctgtgatcaacctgggaacacgtcagattggaagagaaacaggggagaatgttcttcatgtccgggatgctgacacccaagacaaaatattgcaagcactgcaccttcagtttggtaaacagtacccttgttcaaagatatatggggatggaaatgctgttccaaggattttgaagtttctcaaatctatcgatcttcaagagccactgcaaaagaaattctgctttcctcctgtgaaggagaatatctctcaagatattgaccatattcttgaaactctaagtgccttggccgttgatcttggcgggacgaacctccgagttgcaatagtcagcatgaagggtgaaatagttaagaagtatactcagttcaatcctaaaacctatgaagagaggattaatttaatcctacagatgtgtgtggaagctgcagcagaagctgtaaaactgaactgcagaattttgggagtaggcatttccacaggtggccgtgtaaatcctcgggaaggaattgtgctgcattcaaccaaactgatccaagagtggaactctgtggaccttaggacccccctttctgacactttgcatctccctgtgtgggtagacaatgatggcaactgtgctgccctggcggaaaggaaatttggccaaggaaagggactggaaaactttgttacacttatcacaggcacaggaatcggtggtggaattatccatcagcatgaattgatccacggaagctccttctgtgctgcagaactgggccaccttgttgtgtctctggatgggcctgattgttcctgtggaagccatgggtgcattgaagcatacgcctctggaatggccttgcagagggaggcaaaaaagctccatgatgaggacctgctcttggtggaagggatgtcagtgccaaaagatgaggctgtgggtgcgctccatctcatccaagctgcgaaacttggcaatgcgaaggcccagagcatcctaagaacagctggaacagctttgggtcttggggttgtgaacatcctccataccatgaatccctcccttgtgatcctctccggagtcctggccagtcactatatccacattgtcaaagacgtcattcgccagcaggccttgtcctccgtgcaggacgtggatgtggtggtttcggatttggttgaccccgccctgctgggtgctgccagcatggttctggactacacaacacgcaggatctactagacctccaggaacagacatggaccttctctccagagctcctgagtggaatcaagttcttgtctttaggatgaccgtttcttaacaatcaaatctggtattgaactgcaggtgactttggcagagaaatgttttcacttttggtctcctcttccagagtcacctttccccactcctatttttgtagatgctattctttctgatgtcttcttactaggggtcattttagctcaaaccctgtaagttacagtcacaattttctgtgccaaagcagctacaataatagagaggaagccttcttagaactctgcttactaatgtattaataccactgagaccttcaggccttgcctgggatatcacttcatcctgaagtttgcattaataatccttccaggccgggcacagtggctcacgcctgtaatcccagcactttgggaggccgaggcgggcggatcacgaggtcaggagatcgagaccgccctggctaacatggtgaaacatggtgaaaccccgtctctactaaaaatacaaaaaattagctgggtgtggtggcgggtcccagctactcgggaggctgaggcaggagaatggcatgaaccagggaggcggagctggcagtgaactgagaccgcaccactgcactccagcctgggtgacagagcaagactccatctcaaaaataataataataaataataataataataataataataataataatccttccagctgggcgcagtggctcacgcctgtaatcccaacattttgggaggccgagatgggcggatcacctgaggtcaggagttcaagaccagcctggccaacatggtgaaaccccatctctactaaaatacaaaaattagccgggcgtggtggcatgtgcctgtagtcccagctactcgggaggctgaggcaggagaattgcttgaacccgggaggcggaggttgcagtgagccgagatcatgccactgcactccaccctgggtgacagagcgagactccgtctacacacacacacacacacacacacacatccttcctcctctaaccccaaactaagatcacagaaggtgatccagtcagagaacagagggaaatcttaccaggaagggcttaagtacacttttttttaaaacagctttattgtttttaaagcctacaatttgataagccttgacatatgtatacctgtgaaagcatcaccacaatcaagacactggacatatctatcactcccccatctcagatatcccccctaatcctggataccatttgttgaaagatgttattactctagctgaacttacaagagactttagaccagggatctaaattacagtggccttagtgaccttgtccttatcttcttaggacagctgagaagccactgggacttagagcctttaaaaggagattaactgtcccaaaaggatctttgctactgaccagcagacacttcttccttcagtagcctttcatactgtgttgagtaacaccctagggtgtccattaaagttttgagttttacctagagcccagagccatgaatcaggattctgtctacatgattcgtgttttcattggtgtcaaaatacaaaagccaaagttctggctatgaattgttaacttggaagaaatactaactgccaccacttattaagtgcctactgtgtgccaggctctgaactaggtgcttcatatacattatcctaaattatctcaacatatgaggtaggtgttttaatttttattttatagaacttggtgtgtttgactgttaagctatggggctagagagagggtttgatcccaggtccctctgtgcttttgctgctgagccacacaacctctcatttcaaaaacactttcaaaatgctaacatattctaattcactctaggccaccaaaaactttaatactaatatctgatttgtaaatgacttaatgtatccttgaccctatcagctgaatttaatgaaatattcctctctgctgtgaaattttaccagtatagtatttggtctagtgacaggtgttctatttttttgagacgggtctcactctgtcacccaggctggagtgcagtggctcaatgcaacctctgccccccaagttcaagtgattctcctgcctcagcctcttgagtagctgggattacaggcacatgcaccacgcccggctgatttttttttgtatttttagtagacagggtttcaccatgttggccaggctggtcttgaactcctgacctcaggtgatccgcccgcctctgcctcccaaagtgctgggattacaggtgtaagccatcacacctggccctagtgacaggtttttatgggtacttttagatgatctaagaaatcatgtgcatatatctttcagatttctattttgggaaaatgaaggtttctacaacatattgtttcagtgttcaaataaactgaaggactcaacattacatttgaactatatccttcctagtgggttagtgtgaaaaagagtttggctgattcctaaaactctgccagccctgcagtaatctccagggcctggttattgttcagacattccatggtgattcctgggaaggaagcttggctgctcagtttctgagtctggggtgagataatgttctgggaagggacatctgttctttggtgtaatctctcatggtgaaatctgctctgtacatcagacaattgcattgctaccaagtttcataccaaatatttgaaaggatggtattgaatctaaaaccaaatattagtttttattaaactcatgggaaggctaatatattccaacgtaaattattacatatggttaagtaattgcatgttaatttattttaatgtaaatatttttgttactgttctgagccaaattctaaagaaaaaataaatacatttccttgttg

SEQ ID NO: 12176 - DNA, 5314 bp, Homo sapiens
gtgggcgtggctgggcgagcgaggagtggggacaaggtcgagcgacgagtcgtctacccgcgcgcccgagcgcggaaaccgaggggcaggctcgcgctctgcctgcttcgtggcgcttggttcgtccctcgcccgaggagcgcggtggcggcgtgggagggagcctctgacggcgtctggaactctattttaagaacctctcaaaacgaaacaagcaaatcatggagaagaatggaaataaccgaaagctgcgggtttgtgttgctacttgtaaccgtgcagattattctaaacttgccccgatcatgtttggcattaaaaccgaacctgagttctttgaacttgatgttgtggtacttggctctcacctgatagatgactatggaaatacatatcgaatgattgaacaagatgactttgacattaacaccaggctacacacaattgtgaggggagaagatgaggcagccatggtggagtcagtaggcctggccctagtgaagctgccagatgtccttaatcgcctgaagcctgatatcatgattgttcatggagacaggtttgatgccctggctctggccacatctgctgccttgatgaacatccgaatccttcacattgaaggtggggaagtcagtgggaccattgatgactctatcagacatgccataacaaaactggctcattatcatgtgtgctgcacccgcagtgcagagcagcacctgatatccatgtgtgaggaccatgatcgcatccttttggcaggctgcccttcctatgacaaacttctctcagccaagaacaaagactacatgagcatcattcgcatgtggctaggtgatgatgtaaaatctaaagattacattgttgcactacagcaccctgtgaccactgacattaagcattccataaaaatgtttgaattaacattggatgcacttatctcatttaacaagcggaccctagtcctgtttccaaatattgacgcagggagcaaagagatggttcgagtgatgcggaagaagggcattgagcatcatcccaactttcgtgcagttaaacacgtcccatttgaccagtttatacagttggttgcccatgctggctgtatgattgggaacagcagctgtggggttcgagaagttggagcttttggaacacctgtgatcaacctgggaacacgtcagattggaagagaaacaggggagaatgttcttcatgtccgggatgctgacacccaagacaaaatattgcaagcactgcaccttcagtttggtaaacagtacccttgttcaaagatatatggggatggaaatgctgttccaaggattttgaagtttctcaaatctatcgatcttcaagagccactgcaaaagaaattctgctttcctcctgtgaaggagaatatctctcaagatattgaccatattcttgaaactctaagtgccttggccgttgatcttggcgggacgaacctccgagttgcaatagtcagcatgaagggtgaaatagttaagaagtatactcagttcaatcctaaaacctatgaagagaggattaatttaatcctacagatgtgtgtggaagctgcagcagaagctgtaaaactgaactgcagaattttgggagtaggcatttccacaggtggccgtgtaaatcctcgggaaggaattgtgctgcattcaaccaaactgatccaagagtggaactctgtggaccttaggacccccctttctgacactttgcatctccctgtgtgggtagacaatgatggcaactgtgctgccctggcggaaaggaaatttggccaaggaaagggactggaaaactttgttacacttatcacaggcacaggaatcggtggtggaattatccatcagcatgaattgatccacggaagctccttctgtgctgcagaactgggccaccttgttgtgtctctggatgggcctgattgttcctgtggaagccatgggtgcattgaagcatacgcctctggaatggccttgcagagggaggcaaaaaagctccatgatgaggacctgctcttggtggaagggatgtcagtgccaaaagatgaggctgtgggtgcgctccatctcatccaagctgcgaaacttggcaatgcgaaggcccagagcatcctaagaacagctggaacagctttgggtcttggggttgtgaacatcctccataccatgaatccctcccttgtgatcctctccggagtcctggccagtcactatatccacattgtcaaagacgtcattcgccagcaggccttgtcctccgtgcaggacgtggatgtggtggtttcggatttggttgaccccgccctgctgggtgctgccagcatggttctggactacacaacacgcaggatctactagacctccaggaacagacatggaccttctctccagagctcctgagtggaatcaagttcttgtctttaggatgaccgtttcttaacaatcaaatctggtattgaactgcaggtgactttggcagagaaatgttttcacttttggtctcctcttccagagtcacctttccccactcctatttttgtagatgctattctttctgatgtcttcttactaggggtcattttagctcaaaccctgtaagttacagtcacaattttctgtgccaaagcagctacaataatagagaggaagccttcttagaactctgcttactaatgtattaataccactgagaccttcaggccttgcctgggatatcacttcatcctgaagtttgcattaataatccttccaggccgggcacagtggctcacgcctgtaatcccagcactttgggaggccgaggcgggcggatcacgaggtcaggagatcgagaccgccctggctaacatggtgaaacatggtgaaaccccgtctctactaaaaatacaaaaaattagctgggtgtggtggcgggtcccagctactcgggaggctgaggcaggagaatggcatgaaccagggaggcggagctggcagtgaactgagaccgcaccactgcactccagcctgggtgacagagcaagactccatctcaaaaataataataataaataataataataataataataataataataatccttccagctgggcgcagtggctcacgcctgtaatcccaacattttgggaggccgagatgggcggatcacctgaggtcaggagttcaagaccagcctggccaacatggtgaaaccccatctctactaaaatacaaaaattagccgggcgtggtggcatgtgcctgtagtcccagctactcgggaggctgaggcaggagaattgcttgaacccgggaggcggaggttgcagtgagccgagatcatgccactgcactccaccctgggtgacagagcgagactccgtctacacacacacacacacacacacacacatccttcctcctctaaccccaaactaagatcacagaaggtgatccagtcagagaacagagggaaatcttaccaggaagggcttaagtacacttttttttaaaacagctttattgtttttaaagcctacaatttgataagccttgacatatgtatacctgtgaaagcatcaccacaatcaagacactggacatatctatcactcccccatctcagatatcccccctaatcctggataccatttgttgaaagatgttattactctagctgaacttacaagagactttagaccagggatctaaattacagtggccttagtgaccttgtccttatcttcttaggacagctgagaagccactgggacttagagcctttaaaaggagattaactgtcccaaaaggatctttgctactgaccagcagacacttcttccttcagtagcctttcatactgtgttgagtaacaccctagggtgtccattaaagttttgagttttacctagagcccagagccatgaatcaggattctgtctacatgattcgtgttttcattggtgtcaaaatacaaaagccaaagttctggctatgaattgttaacttggaagaaatactaactgccaccacttattaagtgcctactgtgtgccaggctctgaactaggtgcttcatatacattatcctaaattatctcaacatatgaggtaggtgttttaatttttattttatagaacttggtgtgtttgactgttaagctatggggctagagagagggtttgatcccaggtccctctgtgcttttgctgctgagccacacaacctctcatttcaaaaacactttcaaaatgctaacatattctaattcactctaggccaccaaaaactttaatactaatatctgatttgtaaatgacttaatgtatccttgaccctatcagctgaatttaatgaaatattcctctctgctgtgaaattttaccagtatagtatttggtctagtgacaggtgttctatttttttgagacgggtctcactctgtcacccaggctggagtgcagtggctcaatgcaacctctgccccccaagttcaagtgattctcctgcctcagcctcttgagtagctgggattacaggcacatgcaccacgcccggctgatttttttttgtatttttagtagacagggtttcaccatgttggccaggctggtcttgaactcctgacctcaggtgatccgcccgcctctgcctcccaaagtgctgggattacaggtgtaagccatcacacctggccctagtgacaggtttttatgggtacttttagatgatctaagaaatcatgtgcatatatctttcagatttctattttgggaaaatgaaggtttctacaacatattgtttcagtgttcaaataaactgaaggactcaacattacatttgaactatatccttcctagtgggttagtgtgaaaaagagtttggctgattcctaaaactctgccagccctgcagtaatctccagggcctggttattgttcagacattccatggtgattcctgggaaggaagcttggctgctcagtttctgagtctggggtgagataatgttctgggaagggacatctgttctttggtgtaatctctcatggtgaaatctgctctgtacatcagacaattgcattgctaccaagtttcataccaaatatttgaaaggatggtattgaatctaaaaccaaatattagtttttattaaactcatgggaaggctaatatattccaacgtaaattattacatatggttaagtaattgcatgttaatttattttaatgtaaatatttttgttactgttctgagccaaattctaaagaaaaaataaatacatttccttgttgaaa

SEQ ID NO: 12177 - DNA, 5298 bp, Homo sapiens
agtctggaattcagatgcctattggtgactgctccgtggcagctaaaccaagaaaacagctgctctgctcattatttcaaaccacactagggtacagagctcgtgcttcgggatggaaacctatggttatctgcagagggagtcatgctttcaaggacctcatgaactctattttaagaacctctcaaaacgaaacaagcaaatcatggagaagaatggaaataaccgaaagctgcgggtttgtgttgctacttgtaaccgtgcagattattctaaacttgccccgatcatgtttggcattaaaaccgaacctgagttctttgaacttgatgttgtggtacttggctctcacctgatagatgactatggaaatacatatcgaatgattgaacaagatgactttgacattaacaccaggctacacacaattgtgaggggagaagatgaggcagccatggtggagtcagtaggcctggccctagtgaagctgccagatgtccttaatcgcctgaagcctgatatcatgattgttcatggagacaggtttgatgccctggctctggccacatctgctgccttgatgaacatccgaatccttcacattgaaggtggggaagtcagtgggaccattgatgactctatcagacatgccataacaaaactggctcattatcatgtgtgctgcacccgcagtgcagagcagcacctgatatccatgtgtgaggaccatgatcgcatccttttggcaggctgcccttcctatgacaaacttctctcagccaagaacaaagactacatgagcatcattcgcatgtggctaggtgatgatgtaaaatctaaagattacattgttgcactacagcaccctgtgaccactgacattaagcattccataaaaatgtttgaattaacattggatgcacttatctcatttaacaagcggaccctagtcctgtttccaaatattgacgcagggagcaaagagatggttcgagtgatgcggaagaagggcattgagcatcatcccaactttcgtgcagttaaacacgtcccatttgaccagtttatacagttggttgcccatgctggctgtatgattgggaacagcagctgtggggttcgagaagttggagcttttggaacacctgtgatcaacctgggaacacgtcagattggaagagaaacaggggagaatgttcttcatgtccgggatgctgacacccaagacaaaatattgcaagcactgcaccttcagtttggtaaacagtacccttgttcaaagatatatggggatggaaatgctgttccaaggattttgaagtttctcaaatctatcgatcttcaagagccactgcaaaagaaattctgctttcctcctgtgaaggagaatatctctcaagatattgaccatattcttgaaactctaagtgccttggccgttgatcttggcgggacgaacctccgagttgcaatagtcagcatgaagggtgaaatagttaagaagtatactcagttcaatcctaaaacctatgaagagaggattaatttaatcctacagatgtgtgtggaagctgcagcagaagctgtaaaactgaactgcagaattttgggagtaggcatttccacaggtggccgtgtaaatcctcgggaaggaattgtgctgcattcaaccaaactgatccaagagtggaactctgtggaccttaggacccccctttctgacactttgcatctccctgtgtgggtagacaatgatggcaactgtgctgccctggcggaaaggaaatttggccaaggaaagggactggaaaactttgttacacttatcacaggcacaggaatcggtggtggaattatccatcagcatgaattgatccacggaagctccttctgtgctgcagaactgggccaccttgttgtgtctctggatgggcctgattgttcctgtggaagccatgggtgcattgaagcatacgcctctggaatggccttgcagagggaggcaaaaaagctccatgatgaggacctgctcttggtggaagggatgtcagtgccaaaagatgaggctgtgggtgcgctccatctcatccaagctgcgaaacttggcaatgcgaaggcccagagcatcctaagaacagctggaacagctttgggtcttggggttgtgaacatcctccataccatgaatccctcccttgtgatcctctccggagtcctggccagtcactatatccacattgtcaaagacgtcattcgccagcaggccttgtcctccgtgcaggacgtggatgtggtggtttcggatttggttgaccccgccctgctgggtgctgccagcatggttctggactacacaacacgcaggatctactagacctccaggaacagacatggaccttctctccagagctcctgagtggaatcaagttcttgtctttaggatgaccgtttcttaacaatcaaatctggtattgaactgcaggtgactttggcagagaaatgttttcacttttggtctcctcttccagagtcacctttccccactcctatttttgtagatgctattctttctgatgtcttcttactaggggtcattttagctcaaaccctgtaagttacagtcacaattttctgtgccaaagcagctacaataatagagaggaagccttcttagaactctgcttactaatgtattaataccactgagaccttcaggccttgcctgggatatcacttcatcctgaagtttgcattaataatccttccaggccgggcacagtggctcacgcctgtaatcccagcactttgggaggccgaggcgggcggatcacgaggtcaggagatcgagaccgccctggctaacatggtgaaacatggtgaaaccccgtctctactaaaaatacaaaaaattagctgggtgtggtggcgggtcccagctactcgggaggctgaggcaggagaatggcatgaaccagggaggcggagctggcagtgaactgagaccgcaccactgcactccagcctgggtgacagagcaagactccatctcaaaaataataataataaataataataataataataataataataataatccttccagctgggcgcagtggctcacgcctgtaatcccaacattttgggaggccgagatgggcggatcacctgaggtcaggagttcaagaccagcctggccaacatggtgaaaccccatctctactaaaatacaaaaattagccgggcgtggtggcatgtgcctgtagtcccagctactcgggaggctgaggcaggagaattgcttgaacccgggaggcggaggttgcagtgagccgagatcatgccactgcactccaccctgggtgacagagcgagactccgtctacacacacacacacacacacacacacatccttcctcctctaaccccaaactaagatcacagaaggtgatccagtcagagaacagagggaaatcttaccaggaagggcttaagtacacttttttttaaaacagctttattgtttttaaagcctacaatttgataagccttgacatatgtatacctgtgaaagcatcaccacaatcaagacactggacatatctatcactcccccatctcagatatcccccctaatcctggataccatttgttgaaagatgttattactctagctgaacttacaagagactttagaccagggatctaaattacagtggccttagtgaccttgtccttatcttcttaggacagctgagaagccactgggacttagagcctttaaaaggagattaactgtcccaaaaggatctttgctactgaccagcagacacttcttccttcagtagcctttcatactgtgttgagtaacaccctagggtgtccattaaagttttgagttttacctagagcccagagccatgaatcaggattctgtctacatgattcgtgttttcattggtgtcaaaatacaaaagccaaagttctggctatgaattgttaacttggaagaaatactaactgccaccacttattaagtgcctactgtgtgccaggctctgaactaggtgcttcatatacattatcctaaattatctcaacatatgaggtaggtgttttaatttttattttatagaacttggtgtgtttgactgttaagctatggggctagagagagggtttgatcccaggtccctctgtgcttttgctgctgagccacacaacctctcatttcaaaaacactttcaaaatgctaacatattctaattcactctaggccaccaaaaactttaatactaatatctgatttgtaaatgacttaatgtatccttgaccctatcagctgaatttaatgaaatattcctctctgctgtgaaattttaccagtatagtatttggtctagtgacaggtgttctatttttttgagacgggtctcactctgtcacccaggctggagtgcagtggctcaatgcaacctctgccccccaagttcaagtgattctcctgcctcagcctcttgagtagctgggattacaggcacatgcaccacgcccggctgatttttttttgtatttttagtagacagggtttcaccatgttggccaggctggtcttgaactcctgacctcaggtgatccgcccgcctctgcctcccaaagtgctgggattacaggtgtaagccatcacacctggccctagtgacaggtttttatgggtacttttagatgatctaagaaatcatgtgcatatatctttcagatttctattttgggaaaatgaaggtttctacaacatattgtttcagtgttcaaataaactgaaggactcaacattacatttgaactatatccttcctagtgggttagtgtgaaaaagagtttggctgattcctaaaactctgccagccctgcagtaatctccagggcctggttattgttcagacattccatggtgattcctgggaaggaagcttggctgctcagtttctgagtctggggtgagataatgttctgggaagggacatctgttctttggtgtaatctctcatggtgaaatctgctctgtacatcagacaattgcattgctaccaagtttcataccaaatatttgaaaggatggtattgaatctaaaaccaaatattagtttttattaaactcatgggaaggctaatatattccaacgtaaattattacatatggttaagtaattgcatgttaatttattttaatgtaaatatttttgttactgttctgagccaaattctaaagaaaaaataaatacatttccttgttgaaa

SEQ ID NO: 12178 - DNA, 1133 bp, Homo sapiens
aactctattttaagaacctctcaaaacgaaacaagcaaatcatggagaagaatggaaataaccgaaagctgcgggtttgtgttgctacttgtaaccgtgcagattattctaaacttgccccgatcatgtttggcattaaaaccgaacctgagttctttgaacttgatgttgtggtacttggctctcacctgatagatgactatggaaatacatatcgaatgattgaacaagatgactttgacattaacaccaggctacacacaattgtgaggggagaagatgaggcagccatggtggagtcagtaggcctggccctagtgaagctgccagatgtccttaatcgcctgaagcctgatatcatgattgttcatggagacaggtttgatgccctggctctggccacatctgctgccttgatgaacatccgaatccttcacattgaaggtggggaagtcagtgggaccattgatgactctatcagacatgccataacaaaactggctcattatcatgtgtgctgcacccgcagtgcagagcagcacctgatatccatgtgtgaggaccatgatcgcatccttttggcaggctgcccttcctatgacaaacttctctcagccaagaacaaagactacatgagcatcattcgcatgtggctaggtgatgatgtaaaatctaaagattacattgttgcactacagcaccctgtgaccactgacattaagcattccataaaaatgtttgaattaacattggatgcacttatctcatttaacaagcggaccctagtcctgtttccaaatattgacgcagggagcaaagagatggttcgagtgatgcggaagaagggcattgagcatcatcccaactttcgtgcagttaaacacgtcccatttgaccagtttatacagttggttgcccatgctggctgtatgattgggaacagcagctgtggggttcgagaagttggagctctgactaggctttatacatacgtgagttgttataagcacacacacacacacacacacacacatccttcctcctctaaccccaaactaagatcacagaaggtgatccagtcagagaacagagggaaatcttaccaggaagggcttaagtacacttttttttaa

SEQ ID NO: 12179 - DNA, 3657 bp, Homo sapiens
aactctattttaagaacctctcaaaacgaaacaagcaaatcatggagaagaatggaaataaccgaaagctgcgggtttgtgttgctacttgtaaccgtgcagattattctaaacttgccccgatcatgtttggcattaaaaccgaacctgagttctttgaacttgatgttgtggtacttggctctcacctgatagatgactatggaaatacatatcgaatgattgaacaagatgactttgacattaacaccaggctacacacaattgtgaggggagaagatgaggcagccatggtggagtcagtaggcctggccctagtgaagctgccagatgtccttaatcgcctgaagcctgatatcatgattgttcatggagacaggtttgatgccctggctctggccacatctgctgccttgatgaacatccgaatccttcacattgaaggtggggaagtcagtgggaccattgatgactctatcagacatgccataacaaaactggctcattatcatgtgtgctgcacccgcagtgcagagcagcacctgatatccatgtgtgaggaccatgatcgcatccttttggcaggctgcccttcctatgacaaacttctctcagccaagaacaaagactacatgagcatcattcgcatgtggctaggtgatgatgtaaaatctaaagattacattgttgcactacagcaccctgtgaccactgacattaagcattccataaaaatgtttgaattaacattggatgcacttatctcatttaacaagcggaccctagtcctgtttccaaatattgacgcagggagcaaagagatggttcgagtgatgcggaagaagggcattgagcatcatcccaactttcgtgcagttaaacacgtcccatttgaccagtttatacagttggttgcccatgctggctgtatgattgggaacagcagctgtggggttcgagaagttggagcttttggaacacctgtgatcaacctgggaacacgtcagattggaagagaaacaggggagaatgttcttcatgtccgggatgctgacacccaagacaaaatattgcaagcactgcaccttcagtttggtaaacagtacccttgttcaaagatatatggggatggaaatgctgttccaaggattttgaagtttctcaaatctatcgatcttcaagagccactgcaaaagaaattctgctttcctcctgtgaaggagaatatctctcaagatattgaccatattcttgaaactctaagtgccttggccgttgatcttggcgggacgaacctccgagttgcaatagtcagcatgaagggtgaaatagttaagaagtatactcagttcaatcctaaaacctatgaagagaggattaatttaatcctacagatgtgtgtggaagctgcagcagaagctgtaaaactgaactgcagaattttgggagtaggcatttccacaggtggccgtgtaaatcctcgggaaggaattgtgctgcattcaaccaaactgatccaagagtggaactctgtggaccttaggacccccctttctgacactttgcatctccctgtgtgggtagacaatgatggcaactgtgctgccctggcggaaaggaaatttggccaaggaaagggactggaaaactttgttacacttatcacaggcacaggaatcggtggtggaattatccatcagcatgaattgatccacggaagctccttctgtgctgcagaactgggccaccttgttgtgtctctggatgggcctgattgttcctgtggaagccatgggtgcattgaagcatacgcctctggaatggccttgcagagggaggcaaaaaagctccatgatgaggacctgctcttggtggaagggatgtcagtgccaaaagatgaggctgtgggtgcgctccatctcatccaagctgcgaaacttggcaatgcgaaggcccagagcatcctaagaacagctggaacagctttgggtcttggggttgtgaacatcctccataccatgaatccctcccttgtgatcctctccggagtcctggccagtcactatatccacattgtcaaagacgtcattcgccagcaggccttgtcctccgtgcaggacgtggatgtggtggtttcggatttggttgaccccgccctgctgggtgctgccagcatggttctggactacacaacacgcaggatctactagacctccaggaacagacatggaccttctctccagagctcctgagtggaatcaagttcttgtctttaggatgaccgtttcttaacaatcaaatctggtattgaactgcaggtgactttggcagagaaatgttttcacttttggtctcctcttccagagtcacctttccccactcctatttttgtagatgctattctttctgatgtcttcttactaggggtcattttagctcaaaccctgtaagttacagtcacaattttctgtgccaaagcagctacaataatagagaggaagccttcttagaactctgcttactaatgtattaataccactgagaccttcaggccttgcctgggatatcacttcatcctgaagtttgcattaataatccttccaggccgggcacagtggctcacgcctgtaatcccagcactttgggaggccgaggcgggcggatcacgaggtcaggagatcgagaccgccctggctaacatggtgaaacatggtgaaaccccgtctctactaaaaatacaaaaaattagctgggtgtggtggcgggtcccagctactcgggaggctgaggcaggagaatggcatgaaccccaggctggagtgcagtggctcaatgcaacctctgccccccaagttcaagtgattctcctgcctcagcctcttgagtagctgggattacaggcacatgcaccacgcccggctgatttttttttgtatttttagtagacagggtttcaccatgttggccaggctggtcttgaactcctgacctcaggtgatccgcccgcctctgcctcccaaagtgctgggattacaggtgtaagccatcacacctggccctagtgacaggtttttatgggtacttttagatgatctaagaaatcatgtgcatatatctttcagatttctattttgggaaaatgaaggtttctacaacatattgtttcagtgttcaaataaactgaaggactcaacattacatttgaactatatccttcctagtgggttagtgtgaaaaagagtttggctgattcctaaaactctgccagccctgcagtaatctccagggcctggttattgttcagacattccatggtgattcctgggaaggaagcttggctgctcagtttctgagtctggggtgagataatgttctgggaagggacatctgttctttggtgtaatctctcatggtgaaatctgctctgtacatcagacaattgcattgctaccaagtttcataccaaatatttgaaaggatggtattgaatctaaaaccaaatattagtttttattaaactcatgggaaggctaatatattccaacgtaaattattacatatggttaagtaattgcatgttaatttattttaatgtaaatatttttgttactgttctgagccaaattctaaagaaaaaataaatacatttccttgttg

SEQ ID NO: 12180 - DNA, 2174 bp, Homo sapiens
cggcgtctggaactctattttaagaacctctcaaaacgaaacaagcaaatcatggagaagaatggaaataaccgaaagctgcgggtttgtgttgctacttgtaaccgtgcagattattctaaacttgccccgatcatgtttggcattaaaaccgaacctgagttctttgaacttgatgttgtggtacttggctctcacctgatagatgactatggaaatacatatcgaatgattgaacaagatgactttgacattaacaccaggctacacacaattgtgaggggagaagatgaggcagccatggtggagtcagtaggcctggccctagtgaagctgccagatgtccttaatcgcctgaagcctgatatcatgattgttcatggagacaggtttgatgccctggctctggccacatctgctgccttgatgaacatccgaatccttcacattgaaggtggggaagtcagtgggaccattgatgactctatcagacatgccataacaaaactggctcattatcatgtgtgctgcacccgcagtgcagagcagcacctgatatccatgtgtgaggaccatgatcgcatccttttggcaggctgcccttcctatgacaaacttctctcagccaagaacaaagactacatgagcatcattcgcatgtggctaggtgatgatgtaaaatctaaagattacattgttgcactacagcaccctgtgaccactgacattaagcattccataaaaatgtttgaattaacattggatgcacttatctcatttaacaagcggaccctagtcctgtttccaaatattgacgcagggagcaaagagatggttcgagtgatgcggaagaagggcattgagcatcatcccaactttcgtgcagttaaacacgtcccatttgaccagtttatacagttggttgcccatgctggctgtatgattgggaacagcagctgtggggttcgagaagttggagcttttggaacacctgtgatcaacctgggaacacgtcagattggaagagaaacaggggagaatgttcttcatgtccgggatgctgacacccaagacaaaatattgcaagcactgcaccttcagtttggtaaacagtacccttgttcaaagatatatggggatggaaatgctgttccaaggattttgaagtttctcaaatctatcgatcttcaagagccactgcaaaagaaattctgctttcctcctgtgaaggagaatatctctcaagatattgaccatattcttgaaactctaagtgccttggccgttgatcttggcgggacgaacctccgagttgcaatagtcagcatgaagggtgaaatagttaagaagtatactcagttcaatcctaaaacctatgaagagaggattaatttaatcctacagatgtgtgtggaagctgcagcagaagctgtaaaactgaactgcagaattttgggagtaggaatcggtggtggaattatccatcagcatgaattgatccacggaagctccttctgtgctgcagaactgggccaccttgttgtgtctctggatgggcctgattgttcctgtggaagccatgggtgcattgaagcatacgcctctggaatggccttgcagagggaggcaaaaaagctccatgatgaggacctgctcttggtggaagggatgtcagtgccaaaagatgaggctgtgggtgcgctccatctcatccaagctgcgaaacttggcaatgcgaaggcccagagcatcctaagaacagctggaacagctttgggtcttggggttgtgaacatcctccataccatgaatccctcccttgtgatcctctccggagtcctggccagtcactatatccacattgtcaaagacgtcattcgccagcaggccttgtcctccgtgcaggacgtggatgtggtggtttcggatttggttgaccccgccctgctgggtgctgccagcatggttctggactacacaacacgcaggatctactagacctccaggaacagacatggaccttctctccagagctcctgagtggaatcaagttcttgtctttaggatgaccgtttcttaacaatcaaatctggtattgaactgcaggtgactttggcagagaaatgttttcacttttggtctcctcttccagagtcacctttccccactcctat

SEQ ID NO: 12181 - DNA, 2190 bp, Homo sapiens
tacccgcgcgcccgagcgcggaaaccgaggggcaggctcgcgctctgcctgcttcgtggcgcttggttcgtccctcgcccgaggagcgcggtggcggcgtgggagggagcctctgacggcgtctgaaatacatatcgaatgattgaacaagatgactttgacattaacaccaggctacacacaattgtgaggggagaagatgaggcagccatggtggagtcagtaggcctggccctagtgaagctgccagatgtccttaatcgcctgaagcctgatatcatgattgttcatggagacaggtttgatgccctggctctggccacatctgctgccttgatgaacatccgaatccttcacattgaaggtggggaagtcagtgggaccattgatgactctatcagacatgccataacaaaactggctcattatcatgtgtgctgcacccgcagtgcagagcagcacctgatatccatgtgtgaggaccatgatcgcatccttttggcaggctgcccttcctatgacaaacttctctcagccaagaacaaagactacatgagcatcattcgcatgtggctagggagcaaagagatggttcgagtgatgcggaagaagggcattgagcatcatcccaactttcgtgcagttaaacacgtcccatttgaccagtttatacagttggttgcccatgctggctgtatgattgggaacagcagctgtggggttcgagaagttggagcttttggaacacctgtgatcaacctgggaacacgtcagattggaagagaaacaggggagaatgttcttcatgtccgggatgctgacacccaagacaaaatattgcaagcactgcaccttcagtttggtaaacagtacccttgttcaaagatatatggggatggaaatgctgttccaaggattttgaagtttctcaaatctatcgatcttcaagagccactgcaaaagaaattctgctttcctcctgtgaaggagaatatctctcaagatattgaccatattcttgaaactctaagtgccttggccgttgatcttggcgggacgaacctccgagttgcaatagtcagcatgaagggtgaaatagttaagaagtatactcagttcaatcctaaaacctatgaagagaggattaatttaatcctacagatgtgtgtggaagctgcagcagaagctgtaaaactgaactgcagaattttgggagtaggcatttccacaggtggccgtgtaaatcctcgggaaggaattgtgctgcattcaaccaaactgatccaagagtggaactctgtggaccttaggacccccctttctgacactttgcatctccctgtgtgggtagacaatgatggcaactgtgctgccctggcggaaaggaaatttggccaaggaaagggactggaaaactttgttacacttatcacaggcacaggaatcggtggtggaattatccatcagcatgaattgatccacggaagctccttctgtgctgcagaactgggccaccttgttgtgtctctggatgggcctgattgttcctgtggaagccatgggtgcattgaagcatacgcctctggaatggccttgcagagggaggcaaaaaagctccatgatgaggacctgctcttggtggaagggatgtcagtgccaaaagatgaggctgtgggtgcgctccatctcatccaagctgcgaaacttggcaatgcgaaggcccagagcatcctaagaacagctggaacagctttgggtcttggggttgtgaacatcctccataccatgaatccctcccttgtgatcctctccggagtcctggccagtcactatatccacattgtcaaagacgtcattcgccagcaggccttgtcctccgtgcaggacgtggatgtggtggtttcggatttggttgaccccgccctgctgggtgctgccagcatggttctggactacacaacacgcaggatctactagacctccaggaacagacatggaccttctctccagagctcctgagtggaatcaagttcttgtctttaggatgaccgtttcttaacaatcaaatctggtattgaactgcaggtgactttggcagagaaatgttttcacttttggtctcctcttccagagtcacctttccccactcctatttttgtagatgctattctttctgatgtcttcttacta

SEQ ID NO: 12182 - DNA, 2273 bp, Homo sapiens
cggcgcagtcgctgcagccgccgcgggaggcgtccgtgacaagatgaagctcatcatcctggagcactattctcaggcgagcgagtgggcggctaaatacatcaggaaccgcatcatccagtttaacccagggccagagaagtacttcaccctggggctccccactgggagtaccccacttggctgctacaagaagctgattgaatactataagaatggggacctgtcctttaaatatgtgaagaccttcaacatggatgagtacgtgggccttcctcgagaccacccggagagttaccactccttcatgtggaacaacttcttcaagcacattgacatccacccagaaaacacccacattctggatgggaatgcagtcgacctacaggcagaatgtgatgcctttgaagagaagatcaaggctgcaggtgggatcgagctatttgttggaggcatcggccctgatggacacattgccttcaacgagccaggctccagtctggtgtccaggacccgtgtgaagacgctggccatggataccatcctggccaatgctaggttcttcgatggagaactcaccaaggtgcccaccatggccttgacggtgggggtgggcactgtcatggatgctagagaggtgatgatccttatcacaggtgctcacaaggcatttgctctgtacaaggccatcgaggagggagtgaaccacatgtggaccgtgtctgccttccagcagcatccccgcaccgtgtttgtgtgtgacgaggatgccaccttggagctgaaagtgaagactgtcaagtatttcaaaggtttaatgcttgttcataacaagttggtggaccccttgtacagtatcaaagagaaagaaactgagaaaagccaatcttcgaagaaaccatacagcgattagcctgtgctgggacctagtgtcaagtacccatagggaaaggcaggtctttctggaaattgtctttagaagaaagaattgtatttctttaatctagtatggttactccagataagtgggtgaacttattgttcttggccatgaggctgggagcctagtcacggagtttagctatagggagaatgtttgtaacttaatcagaaaaaaaatatctgcaaaatgtactccatcattttgatgtctgccaaacccaggttgggagttttaaactttttgttctgcttcagccatggttcacacatatgacacactcccgtcaggaatttctctccttacacgcactgattttcaagtgggagggaattaggggcttatgtatattggataccacctctttgaagagtcttgagagtccttcttgcacaggcctgccccttggttgagaaccattgttccaagtgaaggcacaaactctcaatatctaaaataagtgcaaggaagcagtctctttggtcagtaacaagtgcaatggaaagaaaacgatcccttccttcttccactttcacagcttttctctgaactaggagaacctgggggtggatttgggtgggtggggccaaagaggaggcttctattgataaatccagagcctcaaggggcccagccacgtcaaacttctctccctcagggactctccagcaccaaaaggcagaaggtggaagccgtttttcccccagagccctgtgtttttgtgaaagcctcactgtggctcctctgttttacatactcattagtaagtgggaggtccactggggcaacagacactgccacaatttcagtgttgtgttcagccaaggggacggtctgggcaggcagcttaagtgtgagtttagtcacaactcctgagtgtcccgctctcctgcttacctaggaggtgagtgccaggaaaatacaccaaatgcttctagtattgtttccccacttaaaatagtcctgcttaaattcacatggtgtggtctgatgttctgagagcatcaggaaatacaacccttttgcccatttacccttctccccggatcccaaggtggtctgttgctctggcttcctttcattgtcttaggccttcatggagtggatgctgcctcctcctggctgtttttgtgcctgtttgaagctactgctgcctccatttctgggaaagacctttgagagcctagcccaggcctaagggctatgtttggtaccagtgttttgtctttagcttttctatgtgattgtgccgtcattctgttttaagctcatggatcaatggatttgtttacaatgtgatattttctattaaatccagtattttcaaataaca

SEQ ID NO: 12183 - DNA, 2163 bp, Homo sapiens
gcagtcgctgcagccgccgcgggaggcgtccgtgacaagatgaagctcatcatcctggagcactattctcaggcgagcgagtgggcggctaaatacatcaggaaccgcatcatccagtttaacccagggccagagaagtacttcaccctggggctccccactggccttcctcgagaccacccggagagttaccactccttcatgtggaacaacttcttcaagcacattgacatccacccagaaaacacccacattctggatgggaatgcagtcgacctacaggcagaatgtgatgcctttgaagagaagatcaaggctgcaggtgggatcgagctatttgttggaggcatcggccctgatggacacattgccttcaacgagccaggctccagtctggtgtccaggacccgtgtgaagacgctggccatggataccatcctggccaatgctaggttcttcgatggagaactcaccaaggtgcccaccatggccttgacggtgggggtgggcactgtcatggatgctagagaggtgatgatccttatcacaggtgctcacaaggcatttgctctgtacaaggccatcgaggagggagtgaaccacatgtggaccgtgtctgccttccagcagcatccccgcaccgtgtttgtgtgtgacgaggatgccaccttggagctgaaagtgaagactgtcaagtatttcaaaggtttaatgcttgttcataacaagttggtggaccccttgtacagtatcaaagagaaagaaactgagaaaagccaatcttcgaagaaaccatacagcgattagcctgtgctgggacctagtgtcaagtacccatagggaaaggcaggtctttctggaaattgtctttagaagaaagaattgtatttctttaatctagtatggttactccagataagtgggtgaacttattgttcttggccatgaggctgggagcctagtcacggagtttagctatagggagaatgtttgtaacttaatcagaaaaaaaatatctgcaaaatgtactccatcattttgatgtctgccaaacccaggttgggagttttaaactttttgttctgcttcagccatggttcacacatatgacacactcccgtcaggaatttctctccttacacgcactgattttcaagtgggagggaattaggggcttatgtatattggataccacctctttgaagagtcttgagagtccttcttgcacaggcctgccccttggttgagaaccattgttccaagtgaaggcacaaactctcaatatctaaaataagtgcaaggaagcagtctctttggtcagtaacaagtgcaatggaaagaaaacgatcccttccttcttccactttcacagcttttctctgaactaggagaacctgggggtggatttgggtgggtggggccaaagaggaggcttctattgataaatccagagcctcaaggggcccagccacgtcaaacttctctccctcagggactctccagcaccaaaaggcagaaggtggaagccgtttttcccccagagccctgtgtttttgtgaaagcctcactgtggctcctctgttttacatactcattagtaagtgggaggtccactggggcaacagacactgccacaatttcagtgttgtgttcagccaaggggacggtctgggcaggcagcttaagtgtgagtttagtcacaactcctgagtgtcccgctctcctgcttacctaggaggtgagtgccaggaaaatacaccaaatgcttctagtattgtttccccacttaaaatagtcctgcttaaattcacatggtgtggtctgatgttctgagagcatcaggaaatacaacccttttgcccatttacccttctccccggatcccaaggtggtctgttgctctggcttcctttcattgtcttaggccttcatggagtggatgctgcctcctcctggctgtttttgtgcctgtttgaagctactgctgcctccatttctgggaaagacctttgagagcctagcccaggcctaagggctatgtttggtaccagtgttttgtctttagcttttctatgtgattgtgccgtcattctgttttaagctcatggatcaatggatttgtttacaatgtgatattttctattaaatccagtattttcaaat

SEQ ID NO: 12184 - DNA, 2319 bp, Homo sapiens
ggcgcagtcgctgcagccgccgcgggaggcgtccgtgaggaaacggctcagagagaacttaggtcctttgaccgaggtcctgcaggtggacaagatgaagctcatcatcctggagcactattctcaggcgagcgagtgggcggctaaatacatcaggaaccgcatcatccagtttaacccagggccagagaagtacttcaccctggggctccccactgggagtaccccacttggctgctacaagaagctgattgaatactataagaatggggacctgtcctttaaatatgtgaagaccttcaacatggatgagtacgtgggccttcctcgagaccacccggagagttaccactccttcatgtggaacaacttcttcaagcacattgacatccacccagaaaacacccacattctggatgggaatgcagtcgacctacaggcagaatgtgatgcctttgaagagaagatcaaggctgcaggtgggatcgagctatttgttggaggcatcggccctgatggacacattgccttcaacgagccaggctccagtctggtgtccaggacccgtgtgaagacgctggccatggataccatcctggccaatgctaggttcttcgatggagaactcaccaaggtgcccaccatggccttgacggtgggggtgggcactgtcatggatgctagagaggtgatgatccttatcacaggtgctcacaaggcatttgctctgtacaaggccatcgaggagggagtgaaccacatgtggaccgtgtctgccttccagcagcatccccgcaccgtgtttgtgtgtgacgaggatgccaccttggagctgaaagtgaagactgtcaagtatttcaaaggtttaatgcttgttcataacaagttggtggaccccttgtacagtatcaaagagaaagaaactgagaaaagccaatcttcgaagaaaccatacagcgattagcctgtgctgggacctagtgtcaagtacccatagggaaaggcaggtctttctggaaattgtctttagaagaaagaattgtatttctttaatctagtatggttactccagataagtgggtgaacttattgttcttggccatgaggctgggagcctagtcacggagtttagctatagggagaatgtttgtaacttaatcagaaaaaaaatatctgcaaaatgtactccatcattttgatgtctgccaaacccaggttgggagttttaaactttttgttctgcttcagccatggttcacacatatgacacactcccgtcaggaatttctctccttacacgcactgattttcaagtgggagggaattaggggcttatgtatattggataccacctctttgaagagtcttgagagtccttcttgcacaggcctgccccttggttgagaaccattgttccaagtgaaggcacaaactctcaatatctaaaataagtgcaaggaagcagtctctttggtcagtaacaagtgcaatggaaagaaaacgatcccttccttcttccactttcacagcttttctctgaactaggagaacctgggggtggatttgggtgggtggggccaaagaggaggcttctattgataaatccagagcctcaaggggcccagccacgtcaaacttctctccctcagggactctccagcaccaaaaggcagaaggtggaagccgtttttcccccagagccctgtgtttttgtgaaagcctcactgtggctcctctgttttacatactcattagtaagtgggaggtccactggggcaacagacactgccacaatttcagtgttgtgttcagccaaggggacggtctgggcaggcagcttaagtgtgagtttagtcacaactcctgagtgtcccgctctcctgcttacctaggaggtgagtgccaggaaaatacaccaaatgcttctagtattgtttccccacttaaaatagtcctgcttaaattcacatggtgtggtctgatgttctgagagcatcaggaaatacaacccttttgcccatttacccttctccccggatcccaaggtggtctgttgctctggcttcctttcattgtcttaggccttcatggagtggatgctgcctcctcctggctgtttttgtgcctgtttgaagctactgctgcctccatttctgggaaagacctttgagagcctagcccaggcctaagggctatgtttggtaccagtgttttgtctttagcttttctatgtgattgtgccgtcattctgttttaagctcatggatcaatggatttgtttacaatgtgatattttctattaaatccagtattttcaaa

SEQ ID NO: 12185 - DNA, 543 bp, Homo sapiens
gcagtcgctgcagccgccgcgggaggcgtccgttctgtgaagtaggtactattgtcccaatttttacataggaggaaacggctcagagagaacttaggtcctttgaccgaggtcctgcaggtggacaagatgaagctcatcatcctggagcactattctcaggcgagcgagtgggcggctaaatacatcaggaaccgcatcatccagtttaacccagggccagagaagtacttcaccctggggctccccactgggagtaccccacttggctgctacaagaagctgattgaatactataagaatggggacctgtcctttaaatatgtgaagaccttcaacatggatgagtacgtgggccttcctcgagaccacccggagagttaccactccttcatgtggaacaacttcttcaagcacattgacatccacccagaaaacacccacattctggatgggaatgcagtcgacctacaggcagaatgtgatgcctttgaagagaagatcaaggctgcaggtgggatcgagctatttgttggaggcatc

SEQ ID NO: 12186 - DNA, 2622 bp, Homo sapiens
cggggaccttcctcgcgggccggagcgcggagcgctgccccagccctacggcactcggggtcgggaccccggggagccgccctcacacattttccaggagggatcggaggggcgatggggtggtaatgggggtgggggacacgctgtaccccaccgacgaccgcgcgggccaccttcgcctctttccttcacactcccactaaccgcagtgctgggggaacaaaatgtcctccttctggagcgattaccttttcccttttgtgctttgggggaaactgaagacccagaggggttcgcaaagcaagtctgtgaagtaggtactattgtcccaatttttacataggaggaaacggctcagagagaacttaggtcctttgaccgaggtcctgcaggtggacaagatgaagctcatcatcctggagcactattctcaggcgagcgagtgggcggctaaatacatcaggaaccgcatcatccagtttaacccagggccagagaagtacttcaccctggggctccccactgggagtaccccacttggctgctacaagaagctgattgaatactataagaatggggacctgtcctttaaatatgtgaagaccttcaacatggatgagtacgtgggccttcctcgagaccacccggagagttaccactccttcatgtggaacaacttcttcaagcacattgacatccacccagaaaacacccacattctggatgggaatgcagtcgacctacaggcagaatgtgatgcctttgaagagaagatcaaggctgcaggtgggatcgagctatttgttggaggcatcggccctgatggacacattgccttcaacgagccaggctccagtctggtgtccaggacccgtgtgaagacgctggccatggataccatcctggccaatgctaggttcttcgatggagaactcaccaaggtgcccaccatggccttgacggtgggggtgggcactgtcatggatgctagagaggtgatgatccttatcacaggtgctcacaaggcatttgctctgtacaaggccatcgaggagggagtgaaccacatgtggaccgtgtctgccttccagcagcatccccgcaccgtgtttgtgtgtgacgaggatgccaccttggagctgaaagtgaagactgtcaagtatttcaaaggtttaatgcttgttcataacaagttggtggaccccttgtacagtatcaaagagaaagaaactgagaaaagccaatcttcgaagaaaccatacagcgattagcctgtgctgggacctagtgtcaagtacccatagggaaaggcaggtctttctggaaattgtctttagaagaaagaattgtatttctttaatctagtatggttactccagataagtgggtgaacttattgttcttggccatgaggctgggagcctagtcacggagtttagctatagggagaatgtttgtaacttaatcagaaaaaaaatatctgcaaaatgtactccatcattttgatgtctgccaaacccaggttgggagttttaaactttttgttctgcttcagccatggttcacacatatgacacactcccgtcaggaatttctctccttacacgcactgattttcaagtgggagggaattaggggcttatgtatattggataccacctctttgaagagtcttgagagtccttcttgcacaggcctgccccttggttgagaaccattgttccaagtgaaggcacaaactctcaatatctaaaataagtgcaaggaagcagtctctttggtcagtaacaagtgcaatggaaagaaaacgatcccttccttcttccactttcacagcttttctctgaactaggagaacctgggggtggatttgggtgggtggggccaaagaggaggcttctattgataaatccagagcctcaaggggcccagccacgtcaaacttctctccctcagggactctccagcaccaaaaggcagaaggtggaagccgtttttcccccagagccctgtgtttttgtgaaagcctcactgtggctcctctgttttacatactcattagtaagtgggaggtccactggggcaacagacactgccacaatttcagtgttgtgttcagccaaggggacggtctgggcaggcagcttaagtgtgagtttagtcacaactcctgagtgtcccgctctcctgcttacctaggaggtgagtgccaggaaaatacaccaaatgcttctagtattgtttccccacttaaaatagtcctgcttaaattcacatggtgtggtctgatgttctgagagcatcaggaaatacaacccttttgcccatttacccttctccccggatcccaaggtggtctgttgctctggcttcctttcattgtcttaggccttcatggagtggatgctgcctcctcctggctgtttttgtgcctgtttgaagctactgctgcctccatttctgggaaagacctttgagagcctagcccaggcctaagggctatgtttggtaccagtgttttgtctttagcttttctatgtgattgtgccgtcattctgttttaagctcatggatcaatggatttgtttacaatgtgatattttctattaaatccagtatttt

SEQ ID NO: 12187 - DNA, 473 bp, Homo sapiens
gtgtaagtgggtagcagggctggcggggaccttcctcgcgggccggagcgcggagcgctgccccagccctacggcactcggggtcgggaccccggggagccgccctcacacattttccaggagggatcggaggggcgatggggtggtaatgggggtgggggacacgctgtaccccaccgacgaccgcgcgggccaccttcgcctctttccttcacactcccactaaccgcagtgctgggggaacaaaatgtcctccttctggagcgattaccttttcccttttgtgctttgggggaaactgaagacccagaggggttcgcaaagcaaggaggaaacggctcagagagaacttaggtcctttgaccgaggtcctgcaggtggacaagatgaagctcatcatcctggagcactattctcaggcgagcgagtgggcggctaaatacatcaggaaccgcatcatccagtttaaccca

SEQ ID NO: 12188 - DNA, 2980 bp, Homo sapiens
ctctttccttcacactcccactaaccgcagtgctgggggaacaaaatgtcctccttctggagcgattaccttttcccttttgtgctttgggggaaactgaagacccagaggggttcgcaaagcaaggtgggccagtaggaagacccctccgctagtccagagagagcacacagctccccaggcagagctcattgccccacctgctctagtggcccagcatgatcccatgacctctctacttctggaggaagagtcttggggtagacggcggggagggggtagggtatcccgttccggtaggggcagggatgagggaggcggggctgagccgagcatctatctggatggtaacagccaacgtagaaaatactaagttgtttacatgcattctctcatttcatattacccgtcgtgaagtctgtgaagtaggtactattgtcccaatttttacataggaggaaacggctcagagagaacttaggtcctttgaccgaggtcctgcaggtggtaagtgaaggagctgagattagaacccagatctgcccccagtggcgcctcctcgtggtctgtgggtggtggagacgactggcctagcctcttagctcctctgtgaatagaaaggcctttttcctggctcagacagcttgggaaggggattgttgctgggtaagagaagcttctcccaccacctccatctctttctctgccccttaccattgattcctttctgtcatcccctctcccccactgcaggacaagatgaagctcatcatcctggagcactattctcaggcgagcgagtgggcggctaaatacatcaggaaccgcatcatccagtttaacccagggccagagaagtacttcaccctggggctccccactgggagtaccccacttggctgctacaagaagctgattgaatactataagaatggggacctgtcctttaaatatgtgaagaccttcaacatggatgagtacgtgggccttcctcgagaccacccggagagttaccactccttcatgtggaacaacttcttcaagcacattgacatccacccagaaaacacccacattctggatgggaatgcagtcgacctacaggcagaatgtgatgcctttgaagagaagatcaaggctgcaggtgggatcgagctatttgttggaggcatcggccctgatggacacattgccttcaacgagccaggctccagtctggtgtccaggacccgtgtgaagacgctggccatggataccatcctggccaatgctaggttcttcgatggagaactcaccaaggtgcccaccatggccttgacggtgggggtgggcactgtcatggatgctagagaggtgatgatccttatcacaggtgctcacaaggcatttgctctgtacaaggccatcgaggagggagtgaaccacatgtggaccgtgtctgccttccagcagcatccccgcaccgtgtttgtgtgtgacgaggatgccaccttggagctgaaagtgaagactgtcaagtatttcaaaggtttaatgcttgttcataacaagttggtggaccccttgtacagtatcaaagagaaagaaactgagaaaagccaatcttcgaagaaaccatacagcgattagcctgtgctgggacctagtgtcaagtacccatagggaaaggcaggtctttctggaaattgtctttagaagaaagaattgtatttctttaatctagtatggttactccagataagtgggtgaacttattgttcttggccatgaggctgggagcctagtcacggagtttagctatagggagaatgtttgtaacttaatcagaaaaaaaatatctgcaaaatgtactccatcattttgatgtctgccaaacccaggttgggagttttaaactttttgttctgcttcagccatggttcacacatatgacacactcccgtcaggaatttctctccttacacgcactgattttcaagtgggagggaattaggggcttatgtatattggataccacctctttgaagagtcttgagagtccttcttgcacaggcctgccccttggttgagaaccattgttccaagtgaaggcacaaactctcaatatctaaaataagtgcaaggaagcagtctctttggtcagtaacaagtgcaatggaaagaaaacgatcccttccttcttccactttcacagcttttctctgaactaggagaacctgggggtggatttgggtgggtggggccaaagaggaggcttctattgataaatccagagcctcaaggggcccagccacgtcaaacttctctccctcagggactctccagcaccaaaaggcagaaggtggaagccgtttttcccccagagccctgtgtttttgtgaaagcctcactgtggctcctctgttttacatactcattagtaagtgggaggtccactggggcaacagacactgccacaatttcagtgttgtgttcagccaaggggacggtctgggcaggcagcttaagtgtgagtttagtcacaactcctgagtgtcccgctctcctgcttacctaggaggtgagtgccaggaaaatacaccaaatgcttctagtattgtttccccacttaaaatagtcctgcttaaattcacatggtgtggtctgatgttctgagagcatcaggaaatacaacccttttgcccatttacccttctccccggatcccaaggtggtctgttgctctggcttcctttcattgtcttaggccttcatggagtggatgctgcctcctcctggctgtttttgtgcctgtttgaagctactgctgcctccatttctgggaaagacctttgagagcctagcccaggcctaagggctatgtttggtaccagtgttttgtctttagcttttctatgtgattgtgccgtcattctgttttaagctcatggatcaatggatttgtttacaatgtgatattttctattaaatccagtatttt

SEQ ID NO: 12189 - DNA, 570 bp, Homo sapiens
gtgtaagtgggtagcagggctggcggggaccttcctcgcgggccggagcgcggagcgctgccccagccctacggcactcggggacaagatgaagctcatcatcctggagcactattctcaggcgagcgagtgggcggctaaatacatcaggaaccgcatcatccagtttaacccagggccagagaagtacttcaccctggggctccccactgggagtaccccacttggctgctacaagaagctgattgaatactataagaatggggacctgtcctttaaatatgtgaagaccttcaacatggatgagtacgtgggccttcctcgagaccacccggagagttaccactccttcatgtggaacaacttcttcaagcacattgacatccacccagaaaacacccacattctggatgggaatgcagtcgacctacaggcagaatgtgatgcctttgaagagaagatcaaggctgcaggtgggatcgagctatttgttggaggcatcggccctgatggacacattgccttcaacgagccaggctccagtctggtgtccaggacccgtgtgaagac

SEQ ID NO: 12190 - DNA, 1063 bp, Homo sapiens
gcagtcgctgcagccgccgcgggaggcgtccgtgacaagatgaagctcatcatcctggagcactattctcaggcgagcgagtgggcggctaaatacatcaggaaccgcatcatccagtttaacccagggccagagaagtacttcaccctggggctccccactgggagtaccccacttggctgctacaagaagctgattgaatactataagaatggggacctgtcctttaaatatgtgaagaccttcaacgagccaggctccagtctggtgtccaggacccgtgtgaagacgctggccatggataccatcctggccaatgctaggttcttcgatggagaactcaccaaggtgcccaccatggccttgacggtgggggtgggcactgtcatggatgctagagaggtgatgatccttatcacaggtgctcacaaggcatttgctctgtacaaggccatcgaggagggagtgaaccacatgtggaccgtgtctgccttccagcagcatccccgcaccgtgtttgtgtgtgacgaggatgccaccttggagctgaaagtgaagactgtcaagtatttcaaaggtttaatgcttgttcataacaagttggtggaccccttgtacagtatcaaagagaaagaaactgagaaaagccaatcttcgaagaaaccatacagcgattagcctgtgctgggacctagtgtcaagtacccatagggaaaggcaggtctttctggaaattgtctttagaagaaagaattgtatttctttaatctagtatggttactccagataagtgggtgaacttattgttcttggccatgaggctgggagcctagtcacggagtttagctatagggagaatgtttgtaacttaatcagaaaaaaaatatctgcaaaatgtactccatcattttgatgtctgccaaacccaggttgggagttttaaactttttgttctgcttcagccatggttcacacatatgacacactcccgtcaggaatttctctccttacacgcactgattttcaagtgggagggaattaggggcttatgtatattggatac

SEQ ID NO: 12191 - DNA, 1930 bp, Homo sapiens
cgcctttatctgcatccgggtccgtgggattcgcgctccactggtcagctggggtcgctctcgggtggttgggtgttgcttgttcccgctgttccagcatcgaagaaccattgggtctgccggtttgaacttgttctggaagctgtgcgtcaccgtaatgaggcttgtaattcttgataactatgacttggctagtgaatgggcagccaaatacatctgtaatcgcatcattcagttcaaacctggacaggacagatattttacactgggtttaccaacagggagtacacctttaggatgctataaaaaactaatagaatatcataagaatggacacctttcttttaaatatgtgaagacctttaatatggatgaatatgtaggacttccaagaaatcatcctgaaagctaccattcttatatgtggaataatttttttaagcatatcgatatagatcctaataatgcacatatccttgacgggaatgctgcagatttacaagcagaatgtgatgcttttgaaaacaaaataaaagaagctggaggaatagatctttttgttggaggaattggtccagatggtcatatcgctttcaatgagcctggatccagtttagtgtcaaggacaagattaaagactctagcaatggataccatcttggcaaatgccaaatattttgatggagatttatcaaaagtgccaactatggctctaactgttggtgtggggacagtgatggatgctagagaagtaatgatccttataacaggggcacacaaggcatttgccctgtacaaagcaatagaagaaggagtcaatcacatgtggactgtttccgctttccagcagcatccccggactatttttgtatgcgatgaagatgctactttagaattaagagttaaaactgtgaaatactttaaaggtctaatgcatgtgcacaataaacttgtggatccactattcagtatgaaagatggaaactgaaggagactggagcaaaattcagcttgaatgaacagagcactttttactaagtagtagatgaattttcagctatgcaatatgacaaaacatggggaattttgaagattgtcattttttcattcgagtctctatgttaaacattccatattttgaatatttatatcttgtacttgggtttaagagaagtagctggctctcaagattgactggctatttattataaagtactgaagtcacatagccacctataaaacagcatagaaatgtctgcctgtttaaaaagtcattttaaaggtagagtgtccacatcaggcaccatttgtgatatgactccagtggcgtatatttcattttttaatgacaagacactccaaacctttcagataacaaactatcattgcagaccttcacttttggaatgcaatctttatattttctgtgcatcacacacatgcttttctgcacgtggttgccttagtcatcttcctacagcaccatctagacatcaaaaattgtgctatatatcattggtaaaggaaatttgaagagatgacagtgcctaaaagtacagtttacatccttttggaaagtatgtgtaagtgcatgttttttgtgcaccttcttctatagcacttttttacaaatatcttatttttatttaacgacttgggttcatgtccctaatataagtatcttgacaattatgagctttatacctagcaagccacttcaggaaattcttttggagaatattttctgattattgttaaacttaatatacaattagctttattccttataaaatgtctaaaagaataatacgaagtatatataaaaggaattactgtaaactacattgccatagcaatttacataaaagtatattgttttttatctttaactcaaataaagcgtgtaataaataagttatctaaatttcca

SEQ ID NO: 12192 - DNA, 5382 bp, Homo sapiens
ggggtcgctctcgggtggttgggtgttgcttgttcccgctgttccagcatcgaagaaccattgggtctgccggtttgaacttgttctggaagctgtgcgtcaccgtaatgaggcttgtaattcttgataactatgacttggctagtgaatgggcagccaaatacatctgtaatcgcatcattcagttcaaacctggacaggacagatattttacactgggtttaccaacagggagtacacctttaggatgctataaaaaactaatagaatatcataagaatggacacctttcttttaaatatgtgaagacctttaatatggatgaatatgtaggacttccaagaaatcatcctgaaagctaccattcttatatgtggaataatttttttaagcatatcgatatagatcctaataatgcacatatccttgacgggaatgctgcagatttacaagcagaatgtgatgcttttgaaaacaaaataaaagaagctggaggaatagatctttttgttggaggaattggtccagatggtcatatcgctttcaatgagcctggatccagtttagtgtcaaggacaagattaaagactctagcaatggataccatcttggcaaatgccaaatattttgatggagatttatcaaaagtgccaactatggctctaactgttggtgtggggacagtgatggatgctagagaagtaatgatccttataacaggggcacacaaggcatttgccctgtacaaagcaatagaagaaggagtcaatcacatgtggactgtttccgctttccagcagcatccccggactatttttgtatgcgatgaagatgctactttagaattaagagttaaaactgtgaaatactttaaaggtgagcactgaatttcaaaagccgactgagataatctgttgtgagtgacaattaaaacttactgtgactgtggggttaaatctcacactgtgacctattgaaaagtggcaacacatagctagttctttcaagtaatggaaagttctcacctcagataatagtatcttcaaagtagtacctttttttttttttcatgaagagaatctcttcagtctctattttcagtaaacaatttttcttgaaatccaaggtttaataatttactttcatattgaatatacaagaccaaataacccaaaagaaaatgtatctttgtccattctggatttcttttcatgtttactagtcccacctcaatccctcttcctcactcccctctaaccttaatttagaacctaatcagtggataagagatctcccactatctaatttaatctttacaattttaagccaatttattcccatatattaaagttataatgtctaaatgttaaaatagtatggaataaactctgcaagtaagcaggagtttgattgcccagacttcatgttgattttcctttttcctgtagtctagttcagtaattcagaaaccttactctaccaggctgtgtattacaaaacacatatgcttgatataatggttttaagagattttcaagggacattttgcctatacccaatgtagaacctattctctgatttaagagtcagctccacatattacacatatgtaagcaaactgtacaaacaggtaattttcataaagcacctgtatttacatagctgatattaaaagttacatagttgatcatatagataggtcagtgattcactatgtagtatgtatgctacttttgctacatgattataccttttaatcttttttactctagtaactaggtatttattttaatgcctattggaaaatacactgaataaatcaaagctatattttttggatattattgcttaagacaaggtccaaaaaagctaccatatttgattggctctaatacacgttgatcttgctgatgttggactgtgtcttaaaactggtgtcagatcatagcttactgggtagcatttttttctcagtggtacataaaatggtgtgtcttacaatttatagcatctcatactcagaaataaagtatataatcttaaatttttaattcaatgcaaagaaaaccaactcatatttcatgtatatgtgtgaatatggcaaatatcttgaaggtgttatacaaataactgacatttggcaagcactgaaaatagtctatttttaaacaaaatgctgatcatgctttgtatatagttttgtatttgtacttatgtttcatgagcattttcctgttttactaaatatttggaagcattttaatggatagttaagtacataaatcataatttatttaaacatttccttattaacacttagattatttctagtcatttatatttttaccatttaaattactaatttaccaagccacaaatatatcaaactgaaaaactgaaaaactgaaaaatttctgatttgtgaataaaagagcatttgatggagttttaactctattttcccatgtaacccttcagatttcatcccaaataatagattccttgactacaaggaatcctcactatccacaaattttaattccagttttaaggagattcatttaacatggccattttctagtcctcattaagtcccagataaatccctgtactaatctaattttgtcacaattaggtttttatcagatttttatatcttggtgaatatttaataagatatttaataacagccagtatctctatgaccaggcactattctaaatgcattttacttattgatttacttatcacaaaaatgttatgaaatgggtattcatagtcccatttttaaattaataggcttaacagacagagacgttaagctacttacccaaagtcatacagcacatatttgggcagagctgggtaatagaaatcaaaatcaggctgatctctggagtatgcaggcttttgtctattctattatactgcctcccagaataaactctaggtatgataccatctacatcaaaaccatatttccatctgcttttttcccatatgataatcactgcttccaaaaaaggtatatcgacatatgttagataatttaaaatagaagggtggtagatgtttatatgtatttagttcttttagttcatctaattgtaagctcttctgaaaaattttgaaacagaccattcgtgagaggatagctgcactgcatcaagaggacacagtattttccactttggagctgtctgtatttctgaagaggtttcagggtatcagcctgttaggatacctccttcaatatgaagacagaatttagacattctgggctacatatgggcctcattttacagcattttagtaaagggtagagaaattgaatattcttaaataaacacatttcaaatgtagtttgtatacttttcatacctccattgagttactagtatatcaaaatactggaggatgtaaattcctataattgtcatccataactcttcaaattccattcacatcactaccctttcttctgtcatcactaaaaagtgctgaccagaatcttaaagggttttatttagtgcctagataagatctaggttaactagatccaaaacaataaaaattgtcagtaaatgcaagtttatttcaatatatacctatataacggtatataccttttgaaagatacaagttaatcacaagacaacaagtttagtacgtggggatttgttttattcattctcgcttttcatttttgctttttaaatagaacagctttgatttttagtatatgacatcatcatcatgaatttttttctcttactttgtatttaggctccacctcagtagtttgacaaaggtagaatgagttcattttgagtcaaaaccataaaagttactttgtatagacattggttagaatctgtgacatttaacctttcttctggtaacgtttcaggaagtctggtgcatttttatcagaagaattatttctgtttgacttaagtagcaattatttatttatataaaattcgtatgtagaaagttgtcagtttttacctaaagtcacagtaaatatttgacttaatatctaaaaagcaattaatagaattttcaaaataattatttctagtttggaagcagtcctatttgatgtataaaagatatatccaatgtaaagaaaaaaattttataaaggagttgaatttttaatatttactgatattttaatttgcatgtattttaaagctctgtgtattctttccgtaatcaaagttgttagcaaatgacagatgaatactatttaagtagaaaaacgatcctctacaaagtgatactctggaaaatgttgcatcttctaaatcatacagctgatattacccttatctttgttgtcccctctcctactggacatgaagtttcaggtgaccttcaagtaggctgttgagcagttgcaggactagtgaatggaatgcttcccccttccctcctttagagtcccattcttatggttagaatttctcctactacacaaacacttcccagtactctttgcttgtcccttaaaagtgggtctttctcaaagctgggattttagagtcctttttgcagcctttctgacaaggaacatctgtttactaacaagcaacctatctctccaatccagtaatcccatttcctgcaaaaccgcattaagtgcctttccccaccctcccatgttcttaatacctggaaaacttaactcatttctttaccctccaaaatataaaatctctggttcattaactgggtcagtctttttagaacttttttctccccaaagaaatatagtactgaggcattaaaacaggagtaactggaagatcagctatttcccaagcagcttccatagctaagagcagtctgcaagtatatgtaccaattacaaaatgaaagttataatctaccggatttaaaatcgtaatttctattctgaattaaatgatttaatacaggttgttttctgtcttgttttagtaaccctccctcagtgtagaatttgtaatcaacctttgtcataaatacacatgccaaactattggaaagtaatttaccagacgaatggatagggtaatgtattaagagtgagacagcagttctgagcccctggctggagtctagtagaggaactgccagaggatcaatatcaacatagacttttagatataattaaaacctattatctaagtcagtattcaaatttgtcatgcttaatctctttgaagacaagaaatgctcttctggttactcccaaagtacctgtacacattctagatctgcactgttacataattataaattggtatttgctaggtagataaaacttaagacattctgaaacatttctatttgtactttttcaataaacttgactatatcaagatgggaact

SEQ ID NO: 12193 - DNA, 2074 bp, Homo sapiens
gggattcgcgctccactggtcagctggggtcgctctcgggtggttgggtgttgcttgttcccgctgttccagcatcgaagaaccattgggtctgccggtttgaacttgttctggaagctgtgcgtcaccgtaatgaggcttgtaattcttgataactatgacttggctagtgaatgggcagccaaatacatctgtaatcgcatcattcagttcaaacctggacaggacagatattttacactgggtttaccaacaggacttccaagaaatcatcctgaaagctaccattcttatatgtggaataatttttttaagcatatcgatatagatcctaataatgcacatatccttgacgggaatgctgcagatttacaagcagaatgtgatgcttttgaaaacaaaataaaagaagctggaggaatagatctttttgttggaggaattggtccagatggtcatatcgctttcaatgagcctggatccagtttagtgtcaaggacaagattaaagactctagcaatggataccatcttggcaaatgccaaatattttgatggagatttatcaaaagtgccaactatggctctaactgttggtgtggggacagtgatggatgctagagaagtaatgatccttataacaggggcacacaaggcatttgccctgtacaaagcaatagaagaaggagtcaatcacatgtggactgtttccgctttccagcagcatccccggactatttttgtatgcgatgaagatgctactttagaattaagagttaaaactgtgaaatactttaaaggtctaatgcatgtgcacaataaacttgtggatccactattcagtatgaaagatggaaactgaaggagactggagcaaaattcagcttgaatgaacagagcactttttactaagtagtagatgaattttcagctatgcaatatgacaaaacatggggaattttgaagattgtcattttttcattcgagtctctatgttaaacattccatattttgaatatttatatcttgtacttgggtttaagagaagtagctggctctcaagattgactggctatttattataaagtactgaagtcacatagccacctataaaacagcatagaaatgtctgcctgtttaaaaagtcattttaaaggtagagtgtccacatcaggcaccatttgtgatatgactccagtggcgtatatttcattttttaatgacaagacactccaaacctttcagataacaaactatcattgcagaccttcacttttggaatgcaatctttatattttctgtgcatcacacacatgcttttctgcacgtggttgccttagtcatcttcctacagcaccatctagacatcaaaaattgtgctatatatcattggtaaaggaaatttgaagagatgacagtgcctaaaagtacagtttacatccttttggaaagtatgtgtaagtgcatgttttttgtgcaccttcttctatagcacttttttacaaatatcttatttttatttaacgacttgggttcatgtccctaatataagtatcttgacaattatgagctttatacctagcaagccacttcaggaaattcttttggagaatattttctgattattgttaaacttaatatacaattagctttattccttataaaatgtctaaaagaataatacgaagtatatataaaaggaattactgtaaactacattgccatagcaatttacataaaagtatattgttttttatctttaactcaaataaagcgtgtaataaataagttatctaaatttccagaagtgaacctgaagaatacatgcattcgactcccaacaattatagtacatgtgaacctgcattcattttgggtttgttaccatcatgcattaggagagttaggttaaaagatgtctttgcctctgtggggagcaaaaaaatgctccttttgcttattttgcatttcataagcccacctggtagaagaagccttacttatctgcttgtctatgtgattaaaatgtagtttcttaaaatattaaaatagcaaataaattaatgaaataaaat

SEQ ID NO: 12194 - DNA, 5518 bp, Homo sapiens
gcgcggggcgggagcttggtggagcaggagcggctgggcatcctcctgagactccggggtcagacgcccactccagcgctttctgcgcagcacaggcaccctcgcctgtcacgcctccctctcctcttcccgtctcccagcgtggatgagggcgcctgcagatcccggctagggcacggaccgcctaggccgagatttctttaaagactcgtgcagcacatcattatcgctggatgcccggacatgtaatacacctgacagcatgtgaagtgctcagaatggggcaggatgtcacctggaatcagcactaagtgattcagactttccttacttttaaatgtgctgctcttcatttcaagatgccgttgcagctctgataaatgcaaactgacaaccttcaaggccacgacggagggaaaatcattggtgcttggagcatagaagactgcccttcacaaaggaaatccctgattattgtttgaaatgctgaggacgttgctgcgaaggagacttttttcttatcccaccaaatactactttatggttcttgttttatccctaatcaccttctccgttttaaggattcatcaaaagcctgaatttgtaagtgtcagacacttggagcttgctggggagaatcctagtagtgatattaattgcaccaaagttttacagggtgatgtaaatgaaatccaaaaggtaaagcttgagatcctaacagtgaaatttaaaaagcgccctcggtggacacctgacgactatataaacatgaccagtgactgttcttctttcatcaagagacgcaaatatattgtagaaccccttagtaaagaagaggcggagtttccaatagcatattctatagtggttcatcacaagattgaaatgcttgacaggctgctgagggccatctatatgcctcagaatttctattgcattcatgtggacacaaaatccgaggattcctatttagctgcagtgatgggcatcgcttcctgttttagtaatgtctttgtggccagccgattggagagtgtggtttatgcatcgtggagccgggttcaggctgacctcaactgcatgaaggatctctatgcaatgagtgcaaactggaagtacttgataaatctttgtggtatggattttcccattaaaaccaacctagaaattgtcaggaagctcaagttgttaatgggagaaaacaacctggaaacggagaggatgccatcccataaagaagaaaggtggaagaagcggtatgaggtcgttaatggaaagctgacaaacacagggactgtcaaaatgcttcctccactcgaaacacctctcttttctggcagtgcctacttcgtggtcagtagggagtatgtggggtatgtactacagaatgaaaaaatccaaaagttgatggagtgggcacaagacacatacagccctgatgagtatctctgggccaccatccaaaggattcctgaagtcccgggctcactccctgccagccataagtatgatctgtctgacatgcaagcagttgccaggtttgtcaagtggcagtactttgagggtgatgtttccaagggtgctccctacccgccctgcgatggagtccatgtgcgctcagtgtgcattttcggagctggtgacttgaactggatgctgcgcaaacaccacttgtttgccaataagtttgacgtggatgttgacctctttgccatccagtgtttggatgagcatttgagacacaaagctttggagacattaaaacactgaccattacgggcaattttatgaacaagaagaaggatacacaaaacgtacccttatctgtttccccttccttgtcagcatcgggaagatggtatgaagtcctctttggggcagggactctagtagatcttcttgtcagagaagctgcatggtttctgcagagcacagttagctagaaaggtgatagcattaaatgttcatctagagttaatagtgggaggagtaaaggtagccttgaggccagagcaggtagcaaggcattgtggaaagaggggaccagggtggctggggaagaggccgatgcataaagtcagcctgttcaaagtgctcagggacttagcaaaatgagaagatgtgacctgtgccaaaactattttgagaattttaaatgtgaccatttttctggtatgaataaacttacagcaacaaataatcaaagatacaattaatctgatattatatttgttgaaatagaaatttgattgtactataaatgatttttgtaaataatttatattctgctctaatactgtactgtgtagtgtgtctccgtatgtcatctcagggagcttaaaatgggcttgatttaacattgtttttgtgttatttttgcttgaaacaacgcacacattttcaacaaccaaaaaatgacaatttctagtttagttaatttctacaaatcatcttatgttattagcaaggttaagacatcttttttaaaaaaattatagcttctaccaagagaaacactcaatttttctagagatttgcctctatcttcctttcctcagtcttcccagactgctatcaagctgtgtaaaaatttactttcactggaccctaaattattgtctctgctatctgactgccagtaattagtgcagaaaactaagacaggatgatacaggtttgaggggctggggagtgggaggggggagaaaaggaatgtatttaaacaatttccgatgcccatgatgagtttaaaaaccagcattgacaccatccccaaaattaaggctgtcgcttattgaatccacttgtgtccaacctcccaggattgttttatcctaatgtcacctgtatattcatttgaaaggacttggccctgttcttgggtcttcccgttacctgccccctgggtggtaagtttcctcctttctcaaccttccacgaggaggaaagaagtgtgcagtcattccacatggcctgttggaaggcctggggagggaactttgggtttgggacagatttttttttttgtttttggtatcattcacagcatacgatttttactctctccatcttcaccataagacagataatttggggttgctataatgctgtcacacatctcaaagtacattcaaatcttaaaaagaaattctcgtacttttgccatgttgatactgttcagcaaacaagctaccaggaactgtgaggctttgtcatttagcattagactttaaacaagaattaaaatcatgtgctgtatttttaaaatctagccaaattaaatagtacatgagaaattcagagtattagacagttttaaggcattcaactgagaaaactttatttgtcaaagtcagaaaacattttcatcttattgagagatatgtttttaaacttttatcatcatttgtaaatgtggaagttggtggattgctgtgtttttgcatgattagcatgggagtctgttggagcaagaggaacatgcttgttttgaaaactcgagatgatgagggtggtacatgcagtgtgttctctctttattggcttctaaaccagttttgtcctttaatgcatgtcaaatatttctcccatgcttctcttagcagaaaagtttttacctataagacagggcaccttttaactctaaaactagtgatactcagtgacatagactttgtcttataaacattttttcattttttattttgaaaaattgcaaatctacagcaaaagtaaaacagtagagtgaacaccatgtaaccctcacctggtgttaacattgtaccctatttgctttaagttgtatgtatttctgaacttggcaaaattggaaattaaaatttttaaaaattacaaatatacaaagttatttatcttagcacatttattatgtgtgactgcatctgatttatatttaaattggcaggttttgagggatttttttcttcatcataaatgtaaacataggattttagagtctatttccccaagcgccacattataactgtaaacttaccatcttctatgtagctgtgatatctcatctttctaaaatggaacttgttaaaaagtgttcaaacactatccctaatgcctgcggcagaatttatatacgatccattcattggggctcaaagtatcttttagacttttaaggacaatttacagcaaatgaaatttatgatgctgtgacaagaaatttaaagaatcaaaacgatggtttgaaaaggaaacctatgatacatgcaggagaagcaaaacccaagtgattggtgagaaatatagaaattatttaaattactttatagtaattattaaacactaatttttgtactgtcattgaaggtgttttatagagaaatctgagaaatcacattcacaaattagaagtcaaacatggccaggcacagtggctcacacctgtaatcttcaggatttcaagaccagcctagccaacatgacgaaaccccatctctactgaaaatagaaaaaaaaaattagccaggcttgcacctgtaatcccagttacctgggaggctgaggcaggagaatctcttgagcccaggaggcggaggttgcagtgagctgagatgccaccaccacaccagcctgggtgacagagtgaaactcgtatctccaaacaaacaaacaaaaagtccttaaacatatgtgaacaaaaattttgtgatggaaggattctagttaatgagtattgcatcaagatttacatctttcttactaaggaaaagagttaataaaaattgttctttattttacaggcagttactgaggctcttcccagatctcagtaaacagccactcagccttgaaaatggagtgttgttgtttctaaacatatatttatgtcatttattaagtacagttcacttaaataacataagtagattttctcttgtagtgatttgggtaggaagaggccatgtttcagttcgttttctctgtagggtcgattgaattggaccttttcagttgttcagaaaaataaaaataatttctcatattaaatacagacgctcctcaacttatgatgtgggtaggtcccagtaaacccattataatttgaaaatatcacattgaaaatgcatttaatatctcttacctgaaatcataacttagccaagcctaccttaaatgttctcagaacatttagcctgcagttgggcaaaaccatttaacacaaagcctattttataatgaagtgttgaatagctcatgttatttactgaatactgttgtgaaagtgaaaaacaatgattgtatgggtactcaaagtataatttctactgaatgcatatcacttgtgcactgttgtaaagctgaaaaaccgttaagcctctacgatttttaagtaagttggggaccatcagtttaaaataaatgcaatactatttcatgataaacatggtcactgtaagttttactcttttgaatgagggtgcgacagaatgcagttagaatcagttcatatcaccattaaaatcatccattcagaaaccaa

SEQ ID NO: 12195 - DNA, 5972 bp, Homo sapiens
acagaccataggtgaactgttaaggagggagaagccgcagtgtcaccttccacagtcctgctcccattaagacctatgaagtggaaaatgcagattattctttgaggtttcctgggaccagaaaaggtcagagactcttaatgggtaatgcagacaactggaatgcaatcatcaggtattcatttctgttttaaggttttatgtctgagaaacctgaaacctgaagaagtaaagcaatcatgattttttaaaaacttaataatatggttttggatttaaaaagaaagactgactcagagctggggaaaacactcacttgtgatacggatcaatgtgaaaacagcttaactctgttccatggcaattcgcacagtgtgactcagagacacctctcttcaccagctctggctcaggggatgtgaagccagaagcagaggtcacagtgacttcatctgagaaggacttaactgaccattgctggttttgaagccggaggaaggcccacagtcaatgaatgagagaggcttcgagaagctagaaatggcaaggaaatagattttcctctaaagctcccagaaagaaacacggttctgctgacacctcgattttaggccagtgagacctgcttcagacttctgacctacagaacgatttctttaaagactcgtgcagcacatcattatcgctggatgcccggacatgtaatacacctgacagcatgtgaagtgctcagaatggggcaggatgtcacctggaatcagcactaagtgattcagactttccttacttttaaatgtgctgctcttcatttcaagatgccgttgcagctctgataaatgcaaactgacaaccttcaaggccacgacggagggaaaatcattggtgcttggagcatagaagactgcccttcacaaaggaaatccctgattattgtttgaaatgctgaggacgttgctgcgaaggagacttttttcttatcccaccaaatactactttatggttcttgttttatccctaatcaccttctccgttttaaggattcatcaaaagcctgaatttgtaagtgtcagacacttggagcttgctggggagaatcctagtagtgatattaattgcaccaaagttttacagggtgatgtaaatgaaatccaaaaggtaaagcttgagatcctaacagtgaaatttaaaaagcgccctcggtggacacctgacgactatataaacatgaccagtgactgttcttctttcatcaagagacgcaaatatattgtagaaccccttagtaaagaagaggcggagtttccaatagcatattctatagtggttcatcacaagattgaaatgcttgacaggctgctgagggccatctatatgcctcagaatttctattgcattcatgtggacacaaaatccgaggattcctatttagctgcagtgatgggcatcgcttcctgttttagtaatgtctttgtggccagccgattggagagtgtggtttatgcatcgtggagccgggttcaggctgacctcaactgcatgaaggatctctatgcaatgagtgcaaactggaagtacttgataaatctttgtggtatggattttcccattaaaaccaacctagaaattgtcaggaagctcaagttgttaatgggagaaaacaacctggaaacggagaggatgccatcccataaagaagaaaggtggaagaagcggtatgaggtcgttaatggaaagctgacaaacacagggactgtcaaaatgcttcctccactcgaaacacctctcttttctggcagtgcctacttcgtggtcagtagggagtatgtggggtatgtactacagaatgaaaaaatccaaaagttgatggagtgggcacaagacacatacagccctgatgagtatctctgggccaccatccaaaggattcctgaagtcccgggctcactccctgccagccataagtatgatctgtctgacatgcaagcagttgccaggtttgtcaagtggcagtactttgagggtgatgtttccaagggtgctccctacccgccctgcgatggagtccatgtgcgctcagtgtgcattttcggagctggtgacttgaactggatgctgcgcaaacaccacttgtttgccaataagtttgacgtggatgttgacctctttgccatccagtgtttggatgagcatttgagacacaaagctttggagacattaaaacactgaccattacgggcaattttatgaacaagaagaaggatacacaaaacgtacccttatctgtttccccttccttgtcagcatcgggaagatggtatgaagtcctctttggggcagggactctagtagatcttcttgtcagagaagctgcatggtttctgcagagcacagttagctagaaaggtgatagcattaaatgttcatctagagttaatagtgggaggagtaaaggtagccttgaggccagagcaggtagcaaggcattgtggaaagaggggaccagggtggctggggaagaggccgatgcataaagtcagcctgttcaaagtgctcagggacttagcaaaatgagaagatgtgacctgtgccaaaactattttgagaattttaaatgtgaccatttttctggtatgaataaacttacagcaacaaataatcaaagatacaattaatctgatattatatttgttgaaatagaaatttgattgtactataaatgatttttgtaaataatttatattctgctctaatactgtactgtgtagtgtgtctccgtatgtcatctcagggagcttaaaatgggcttgatttaacattgtttttgtgttatttttgcttgaaacaacgcacacattttcaacaaccaaaaaatgacaatttctagtttagttaatttctacaaatcatcttatgttattagcaaggttaagacatcttttttaaaaaaattatagcttctaccaagagaaacactcaatttttctagagatttgcctctatcttcctttcctcagtcttcccagactgctatcaagctgtgtaaaaatttactttcactggaccctaaattattgtctctgctatctgactgccagtaattagtgcagaaaactaagacaggatgatacaggtttgaggggctggggagtgggaggggggagaaaaggaatgtatttaaacaatttccgatgcccatgatgagtttaaaaaccagcattgacaccatccccaaaattaaggctgtcgcttattgaatccacttgtgtccaacctcccaggattgttttatcctaatgtcacctgtatattcatttgaaaggacttggccctgttcttgggtcttcccgttacctgccccctgggtggtaagtttcctcctttctcaaccttccacgaggaggaaagaagtgtgcagtcattccacatggcctgttggaaggcctggggagggaactttgggtttgggacagatttttttttttgtttttggtatcattcacagcatacgatttttactctctccatcttcaccataagacagataatttggggttgctataatgctgtcacacatctcaaagtacattcaaatcttaaaaagaaattctcgtacttttgccatgttgatactgttcagcaaacaagctaccaggaactgtgaggctttgtcatttagcattagactttaaacaagaattaaaatcatgtgctgtatttttaaaatctagccaaattaaatagtacatgagaaattcagagtattagacagttttaaggcattcaactgagaaaactttatttgtcaaagtcagaaaacattttcatcttattgagagatatgtttttaaacttttatcatcatttgtaaatgtggaagttggtggattgctgtgtttttgcatgattagcatgggagtctgttggagcaagaggaacatgcttgttttgaaaactcgagatgatgagggtggtacatgcagtgtgttctctctttattggcttctaaaccagttttgtcctttaatgcatgtcaaatatttctcccatgcttctcttagcagaaaagtttttacctataagacagggcaccttttaactctaaaactagtgatactcagtgacatagactttgtcttataaacattttttcattttttattttgaaaaattgcaaatctacagcaaaagtaaaacagtagagtgaacaccatgtaaccctcacctggtgttaacattgtaccctatttgctttaagttgtatgtatttctgaacttggcaaaattggaaattaaaatttttaaaaattacaaatatacaaagttatttatcttagcacatttattatgtgtgactgcatctgatttatatttaaattggcaggttttgagggatttttttcttcatcataaatgtaaacataggattttagagtctatttccccaagcgccacattataactgtaaacttaccatcttctatgtagctgtgatatctcatctttctaaaatggaacttgttaaaaagtgttcaaacactatccctaatgcctgcggcagaatttatatacgatccattcattggggctcaaagtatcttttagacttttaaggacaatttacagcaaatgaaatttatgatgctgtgacaagaaatttaaagaatcaaaacgatggtttgaaaaggaaacctatgatacatgcaggagaagcaaaacccaagtgattggtgagaaatatagaaattatttaaattactttatagtaattattaaacactaatttttgtactgtcattgaaggtgttttatagagaaatctgagaaatcacattcacaaattagaagtcaaacatggccaggcacagtggctcacacctgtaatcttcaggatttcaagaccagcctagccaacatgacgaaaccccatctctactgaaaatagaaaaaaaaaattagccaggcttgcacctgtaatcccagttacctgggaggctgaggcaggagaatctcttgagcccaggaggcggaggttgcagtgagctgagatgccaccaccacaccagcctgggtgacagagtgaaactcgtatctccaaacaaacaaacaaaaagtccttaaacatatgtgaacaaaaattttgtgatggaaggattctagttaatgagtattgcatcaagatttacatctttcttactaaggaaaagagttaataaaaattgttctttattttacaggcagttactgaggctcttcccagatctcagtaaacagccactcagccttgaaaatggagtgttgttgtttctaaacatatatttatgtcatttattaagtacagttcacttaaataacataagtagattttctcttgtagtgatttgggtaggaagaggccatgtttcagttcgttttctctgtagggtcgattgaattggaccttttcagttgttcagaaaaataaaaataatttctcatattaaatacagacgctcctcaacttatgatgtgggtaggtcccagtaaacccattataatttgaaaatatcacattgaaaatgcatttaatatctcttacctgaaatcataacttagccaagcctaccttaaatgttctcagaacatttagcctgcagttgggcaaaaccatttaacacaaagcctattttataatgaagtgttgaatagctcatgttatttactgaatactgttgtgaaagtgaaaaacaatgattgtatgggtactcaaagtataatttctactgaatgcatatcacttgtgcactgttgtaaagctgaaaaaccgttaagcctctacgatttttaagtaagttggggaccatcagtttaaaataaatgcaatactatttcatgataaacatggtcactgtaagttttactcttttgaatgagggtgcgacagaatgcagttagaatcagttcatatcaccattaaaatcatccattcagaaacc

SEQ ID NO: 12196 - DNA, 5476 bp, Homo sapiens
gggcctctgggggcggccccggggcgggccacgctggtgtgagggctgcaggcgcagctccggagcgcctagagcgcggcgcggggcgggagcttggtggagcaggagcggctgggcatcctcctgagactccggggtcagacgcccactccagatttctttaaagactcgtgcagcacatcattatcgctggatgcccggacatgtaatacacctgacagcatgtgaagtgctcagaatggggcaggatgtcacctggaatcagcactaagtgattcagactttccttacttttaaatgtgctgctcttcatttcaagatgccgttgcagctctgataaatgcaaactgacaaccttcaaggccacgacggagggaaaatcattggtgcttggagcatagaagactgcccttcacaaaggaaatccctgattattgtttgaaatgctgaggacgttgctgcgaaggagacttttttcttatcccaccaaatactactttatggttcttgttttatccctaatcaccttctccgttttaaggattcatcaaaagcctgaatttgtaagtgtcagacacttggagcttgctggggagaatcctagtagtgatattaattgcaccaaagttttacagggtgatgtaaatgaaatccaaaaggtaaagcttgagatcctaacagtgaaatttaaaaagcgccctcggtggacacctgacgactatataaacatgaccagtgactgttcttctttcatcaagagacgcaaatatattgtagaaccccttagtaaagaagaggcggagtttccaatagcatattctatagtggttcatcacaagattgaaatgcttgacaggctgctgagggccatctatatgcctcagaatttctattgcattcatgtggacacaaaatccgaggattcctatttagctgcagtgatgggcatcgcttcctgttttagtaatgtctttgtggccagccgattggagagtgtggtttatgcatcgtggagccgggttcaggctgacctcaactgcatgaaggatctctatgcaatgagtgcaaactggaagtacttgataaatctttgtggtatggattttcccattaaaaccaacctagaaattgtcaggaagctcaagttgttaatgggagaaaacaacctggaaacggagaggatgccatcccataaagaagaaaggtggaagaagcggtatgaggtcgttaatggaaagctgacaaacacagggactgtcaaaatgcttcctccactcgaaacacctctcttttctggcagtgcctacttcgtggtcagtagggagtatgtggggtatgtactacagaatgaaaaaatccaaaagttgatggagtgggcacaagacacatacagccctgatgagtatctctgggccaccatccaaaggattcctgaagtcccgggctcactccctgccagccataagtatgatctgtctgacatgcaagcagttgccaggtttgtcaagtggcagtactttgagggtgatgtttccaagggtgctccctacccgccctgcgatggagtccatgtgcgctcagtgtgcattttcggagctggtgacttgaactggatgctgcgcaaacaccacttgtttgccaataagtttgacgtggatgttgacctctttgccatccagtgtttggatgagcatttgagacacaaagctttggagacattaaaacactgaccattacgggcaattttatgaacaagaagaaggatacacaaaacgtacccttatctgtttccccttccttgtcagcatcgggaagatggtatgaagtcctctttggggcagggactctagtagatcttcttgtcagagaagctgcatggtttctgcagagcacagttagctagaaaggtgatagcattaaatgttcatctagagttaatagtgggaggagtaaaggtagccttgaggccagagcaggtagcaaggcattgtggaaagaggggaccagggtggctggggaagaggccgatgcataaagtcagcctgttcaaagtgctcagggacttagcaaaatgagaagatgtgacctgtgccaaaactattttgagaattttaaatgtgaccatttttctggtatgaataaacttacagcaacaaataatcaaagatacaattaatctgatattatatttgttgaaatagaaatttgattgtactataaatgatttttgtaaataatttatattctgctctaatactgtactgtgtagtgtgtctccgtatgtcatctcagggagcttaaaatgggcttgatttaacattgtttttgtgttatttttgcttgaaacaacgcacacattttcaacaaccaaaaaatgacaatttctagtttagttaatttctacaaatcatcttatgttattagcaaggttaagacatcttttttaaaaaaattatagcttctaccaagagaaacactcaatttttctagagatttgcctctatcttcctttcctcagtcttcccagactgctatcaagctgtgtaaaaatttactttcactggaccctaaattattgtctctgctatctgactgccagtaattagtgcagaaaactaagacaggatgatacaggtttgaggggctggggagtgggaggggggagaaaaggaatgtatttaaacaatttccgatgcccatgatgagtttaaaaaccagcattgacaccatccccaaaattaaggctgtcgcttattgaatccacttgtgtccaacctcccaggattgttttatcctaatgtcacctgtatattcatttgaaaggacttggccctgttcttgggtcttcccgttacctgccccctgggtggtaagtttcctcctttctcaaccttccacgaggaggaaagaagtgtgcagtcattccacatggcctgttggaaggcctggggagggaactttgggtttgggacagatttttttttttgtttttggtatcattcacagcatacgatttttactctctccatcttcaccataagacagataatttggggttgctataatgctgtcacacatctcaaagtacattcaaatcttaaaaagaaattctcgtacttttgccatgttgatactgttcagcaaacaagctaccaggaactgtgaggctttgtcatttagcattagactttaaacaagaattaaaatcatgtgctgtatttttaaaatctagccaaattaaatagtacatgagaaattcagagtattagacagttttaaggcattcaactgagaaaactttatttgtcaaagtcagaaaacattttcatcttattgagagatatgtttttaaacttttatcatcatttgtaaatgtggaagttggtggattgctgtgtttttgcatgattagcatgggagtctgttggagcaagaggaacatgcttgttttgaaaactcgagatgatgagggtggtacatgcagtgtgttctctctttattggcttctaaaccagttttgtcctttaatgcatgtcaaatatttctcccatgcttctcttagcagaaaagtttttacctataagacagggcaccttttaactctaaaactagtgatactcagtgacatagactttgtcttataaacattttttcattttttattttgaaaaattgcaaatctacagcaaaagtaaaacagtagagtgaacaccatgtaaccctcacctggtgttaacattgtaccctatttgctttaagttgtatgtatttctgaacttggcaaaattggaaattaaaatttttaaaaattacaaatatacaaagttatttatcttagcacatttattatgtgtgactgcatctgatttatatttaaattggcaggttttgagggatttttttcttcatcataaatgtaaacataggattttagagtctatttccccaagcgccacattataactgtaaacttaccatcttctatgtagctgtgatatctcatctttctaaaatggaacttgttaaaaagtgttcaaacactatccctaatgcctgcggcagaatttatatacgatccattcattggggctcaaagtatcttttagacttttaaggacaatttacagcaaatgaaatttatgatgctgtgacaagaaatttaaagaatcaaaacgatggtttgaaaaggaaacctatgatacatgcaggagaagcaaaacccaagtgattggtgagaaatatagaaattatttaaattactttatagtaattattaaacactaatttttgtactgtcattgaaggtgttttatagagaaatctgagaaatcacattcacaaattagaagtcaaacatggccaggcacagtggctcacacctgtaatcttcaggatttcaagaccagcctagccaacatgacgaaaccccatctctactgaaaatagaaaaaaaaaattagccaggcttgcacctgtaatcccagttacctgggaggctgaggcaggagaatctcttgagcccaggaggcggaggttgcagtgagctgagatgccaccaccacaccagcctgggtgacagagtgaaactcgtatctccaaacaaacaaacaaaaagtccttaaacatatgtgaacaaaaattttgtgatggaaggattctagttaatgagtattgcatcaagatttacatctttcttactaaggaaaagagttaataaaaattgttctttattttacaggcagttactgaggctcttcccagatctcagtaaacagccactcagccttgaaaatggagtgttgttgtttctaaacatatatttatgtcatttattaagtacagttcacttaaataacataagtagattttctcttgtagtgatttgggtaggaagaggccatgtttcagttcgttttctctgtagggtcgattgaattggaccttttcagttgttcagaaaaataaaaataatttctcatattaaatacagacgctcctcaacttatgatgtgggtaggtcccagtaaacccattataatttgaaaatatcacattgaaaatgcatttaatatctcttacctgaaatcataacttagccaagcctaccttaaatgttctcagaacatttagcctgcagttgggcaaaaccatttaacacaaagcctattttataatgaagtgttgaatagctcatgttatttactgaatactgttgtgaaagtgaaaaacaatgattgtatgggtactcaaagtataatttctactgaatgcatatcacttgtgcactgttgtaaagctgaaaaaccgttaagcctctacgatttttaagtaagttggggaccatcagtttaaaataaatgcaatactatttcatgataaacatggtcactgtaagttttactcttttgaatgagggtgcgacagaatgcagttagaatcagttcatatcaccattaaaatcatccattcagaaacc

SEQ ID NO: 12197 - DNA, 1628 bp, Homo sapiens
actctctaacaccagcacctctatcttgctgagctccagccaaagaaggaagatttctttaaagactcgtgcagcacatcattatcgctggatgcccggacatgtaatacacctgacagcatgtgaagtgctcagaatggggcaggatgtcacctggaatcagcactaagtgattcagactttccttacttttaaatgtgctgctcttcatttcaagatgccgttgcagctctgataaatgcaaactgacaaccttcaaggccacgacggagggaaaatcattggtgcttggagcatagaagactgcccttcacaaaggaaatccctgattattgtttgaaatgctgaggacgttgctgcgaaggagacttttttcttatcccaccaaatactactttatggttcttgttttatccctaatcaccttctccgttttaaggattcatcaaaagcctgaatttgtaagtgtcagacacttggagcttgctggggagaatcctagtagtgatattaattgcaccaaagttttacagggtgatgtaaatgaaatccaaaaggtaaagcttgagatcctaacagtgaaatttaaaaagcgccctcggtggacacctgacgactatataaacatgaccagtgactgttcttctttcatcaagagacgcaaatatattgtagaaccccttagtaaagaagaggcggagtttccaatagcatattctatagtggttcatcacaagattgaaatgcttgacaggctgctgagggccatctatatgcctcagaatttctattgcattcatgtggacacaaaatccgaggattcctatttagctgcagtgatgggcatcgcttcctgttttagtaatgtctttgtggccagccgattggagagtgtggtttatgcatcgtggagccgggttcaggctgacctcaactgcatgaaggatctctatgcaatgagtgcaaactggaagtacttgataaatctttgtggtatggattttcccattaaaaccaacctagaaattgtcaggaagctcaagttgttaatgggagaaaacaacctggaaacggagaggatgccatcccataaagaagaaaggtggaagaagcggtatgaggtcgttaatggaaagctgacaaacacagggactgtcaaaatgcttcctccactcgaaacacctctcttttctggcagtgcctacttcgtggtcagtagggagtatgtggggtatgtactacagaatgaaaaaatccaaaagttgatggagtgggcacaagacacatacagccctgatgagtatctctgggccaccatccaaaggattcctgaagtcccgggctcactccctgccagccataagtatgatctgtctgacatgcaagcagttgccaggtttgtcaagtggcagtactttgagggtgatgtttccaagggtgctccctacccgccctgcgatggagtccatgtgcgctcagtgtgcattttcggagctggtgacttgaactggatgctgcgcaaacaccacttgtttgccaataagtttgacgtggatgttgacctctttgccatccagtgtttggatgagcatttgagacacaaagctttggagacattaaaacactga

SEQ ID NO: 12198 - DNA, 4214 bp, Homo sapiens
aaccctggggaactgcagaccaaagtgagagagggacgcaccgcatctccaggcacatccaaaaaggatggacgagacaccgaagcagaggatacaggaggattaaaggattcaggaaagcaagcagccctccggagaagctgtcgaaattcaagactggcaagagaagcaaattcaacctctcacaccgatcatttctcattccctgaaaagaagagattgtttccccagggaagtgaaaataatgaacttttggaggtactgcttttttgctttcactctgctcagcgtggtcatttttgtgagattttacagtagccaattgagcccgccaaaaagttatgagaagctgaacagttccagtgaaaggtattttaggaaaactgcctgtaatcacgccttagagaaaatgccagtctttttgtgggaaaatatattaccatcacctttgcgaagtgtcccttgcaaggattacctgacccagaatcactacatcacaagtcccctgtcggaagaagaggctgcattccctttggcctatgtcatggtcatccataaggactttgacacctttgaaaggctctttagggctatctatatgccccaaaatgtctactgtgttcacgtggatgagaaagccccagctgagtataaggaatctgtgaggcagttactgagttgcttccaaaatgctttcattgcttcaaagacagagtctgtggtttatgcaggcatttccagactccaggctgacctgaactgtctgaaagaccttgtcgcctctgaggttccctggaagtacgtcatcaacacctgtggacaagacttccccctgaaaaccaaccgggagatagttcagcatctgaaaggatttaaagggaaaaatatcaccccaggggtgctgcctcctgaccatgcaattaagcgaactaaatatgtccaccaagagcatacagataaaggtggcttttttgtgaaaaatactaatattttgaaaacttcacctccacatcagctgaccatctactttggcactgcctatgtggcgcttaccagagactttgtcgactttgttctacgtgaccaaagggccattgatctactacaatggtcaaaagatacctatagtcctgatgagcatttctgggtgacacttaatagggtttcaggtgttcctggctctatgccaaatgcatcctggactggaaacctcagagctataaagtggagtgacatggaagacagacacggaggctgccacggccactatgtacatggtatttgtatctatggaaacggagacttaaagtggctggttaattcaccaagcctgtttgctaacaagtttgagcttaatacctacccccttactgtggaatgcctagaactgaggcatcgcgaaagaaccctcaatcagagtgaaactgcgatacaacccagctggtatttttgagctattcatgagctactcatgactgaagggaaactgcagctgggaagaggagcctgtttttgtgagagacttttgccttcgtaatgttaaccgtttcaggaccacgtttatagcttcaggacctggctacgtaattatacttaaaatatccactggacactgtgaaatacactaacaggatggctgggtagagcaatctgggcactttggccaattttagtcttgctgtttcttgatgctcacctctatattagtttattgttaggatcaatgataaatttaaatgacctcagatctttgcaccagatactcatcatatacaaatgttttagtaaaaaagagaattgtagataatactgtctaggaaaataagaattaggtttctttgaagaaggaatcttttataacaccttaacagtcaccactgtgctcaaccagacagatagtgaaacagctttctgggtaattcaccaatttcctttaaaacataagctacctgaatggagaatacatcttgtttctgagtttcaacactagcatttttggcttactcatggacaaagttctgtatatagtataaagtcattaacaagaaacaggatatgctttaagacagaattcactgtctgttgcttcagtaaaaggacctcggggaataaaacatttctctcttatatgccagaatgtaggctggtccctatgtcatgtcttccattaagaacactaaaaagtccttgcaagaatggagatatgcattcaagagaggtgctatcacatagatctagtctgaagtctggaacactttcctcttctatgacccctctctccccagtattatcttacttgcaaaatggagaccaaattctatcctgtgaggcttttaattgcaccatagtatgctctgagtagctttacactgcctggtactgatagtagtggctcgatttttaagagccttcaattgtagatgaacatctctgttatttatccctcattcatccatccgttcattcattcagccttcaatcaacatctcttgagtgtctattatgtacaggacatgtactgagacaaaaaggaaacataagagctttttcactctaaaaatcttggcaataatgtcaacaccagaaagcctcctctggagaatcttacagagtgattgtagtttaatacaggaacacacagggctgtgtagcatgataccaggcccaggagatcagtaattacaaattaagggttaaatcagagattattcaacagagagggagaaaggaggagacagagggaggacctgttgtgttccagccattctggtattcctttatgtatctaatttcattcaaacctcacaacagtcttgtgaggcccttatataattactcccattttgcagatgaagtaactgaggcttagaaaggttaatagcaccggggaacaatttctctgggtgagaattgggactctgttgctggtcttctcagttcatttcctgaggtggatttactgagagaaggtgaaataaagccatatttagtataccagagaaggtagattttaagaatggtctcagtgttaatactgagaaaaagtcctgtcagttcagaaaaaatgtgaagtctactttagtattcctgtaatactaaaccgttgagtttctaaatatttatttattctaacaaaaagcaattactacaaatggatgacacatttaatgaacacaattttattttttttctgtaactgtgcttgttgaatgtcaatcatatttaaagggaatgactttgaagtaaaaccttttttcttgctactgaaaaaaatggagttgttttgggtggtaaagtgttaaggaatagggacagctggtcacacaaggaactcttgaaggccacatgtgaaaacctgtcacttgcacagaggccagtcccactaaggtgaccagagtgggctccaagcacaaactgccattggctatagatgggactgtgtccccccaaaattcatgtgttggagccttaaccctcaatgtgatggtatttgagatggggcctttggtaagggaagtttagatgaggtcacgagggtaggaccctcatgatgggatgagtccccttacaagacctctggcttgggccgggcgtggtggctcacacctgtaatcccaacactttgggaggccaaggcaggtagatcacttgatgccaggagttccagaccaggctggccgacatggtgaaaccccatctctactaaaaaatataaaaattagccgggctttgtggcatgtgcctgtaatcccagctatttggcaggctgaggcatgagaatcgcttgaacccaggaggtggaggttacagtgagctgagagtgccccactgcactccagcctgggtgacagagcgagactttgtcccaaaacaaaataggtgaggggatagcgaatgcactcagggtcagcagtggagtttaaaaattgtctcttttcaacttatttaaatgacagcacctgagaagaggaaccgttttacactggatgtttctcatgtagaacaagaaatctttctggaattgatgtttacatgtctgttgttggtcatctctcctgtgtcttaaatactttaatgttggaagagcatagtgtttgggctagtgggtttctgacagcccatgggaatgccctgaaactactgtatctgatgtttgttttcgatgaggttccatgttttgttttcttgggaataaattaatatattgttttcca

SEQ ID NO: 12199 - DNA, 4381 bp, Homo sapiens
actgcgctcattccctgaatggcagtaaccagggggcgggggtggcatgggaaatgaaagaaagagatatgggaaactaaatctgccgggggaaagagagttaccggagttttagcaaaacagctagcagatgcaaacggggaggcagagggaggagggaaggctgggcttcagcaacctgccacggggatttaaacaaaggaggtttgagagaggcgggatctggctgtaatatcggcacagggacagagacagcagctggactctcgggatgaaacggaatcgattcccagcgtctccaacagggcaggagtgagtggagtatgttgcaaaataagaactcagagaaacgagtgagtttggaaaaaagacttacagattttgacggtctcttgacatttcacccttctttgaggcatgcctttatcaatgcgttacctcttcataatttctgtctctagtgtaattatttttatcgtcttctctgtgttcaattttgggggagatccaagcttccaaaggctaaatatctcagaccctttgaggctgactcaagtttgcacatcttttatcaatggaaaaacacgtttcctgtggaaaaacaaactaatgatccatgagaagtcttcttgcaaggaatacttgacccagagccactacatcacagcccctttatctaaggaagaagctgactttcccttggcatatataatggtcatccatcatcactttgacacctttgcaaggctcttcagggctatttacatgccccaaaatatctactgtgttcatgtggatgaaaaagcaacaactgaatttaaagatgcggtagagcaactattaagctgcttcccaaacgcttttctggcttccaagatggaacccgttgtctatggagggatctccaggctccaggctgacctgaactgcatcagagatctttctgccttcgaggtctcatggaagtacgttatcaacacctgtgggcaagacttccccctgaaaaccaacaaggaaatagttcagtatctgaaaggatttaaaggtaaaaatatcaccccaggggtgctgcccccagctcatgcaattggacggactaaatatgtccaccaagagcacctgggcaaagagctttcctatgtgataagaacaacagcgttgaaaccgcctcccccccataatctcacaatttactttggctctgcctatgtggctctatcaagagagtttgccaactttgttctgcatgacccacgggctgttgatttgctccagtggtccaaggacactttcagtcctgatgagcatttctgggtgacactcaataggattccaggtgttcctggctctatgccaaatgcatcctggactggaaacctcagagctataaagtggagtgacatggaagacagacacggaggctgccacggccactatgtacatggtatttgtatctatggaaacggagacttaaagtggctggttaattcaccaagcctgtttgctaacaagtttgagcttaatacctacccccttactgtggaatgcctagaactgaggcatcgcgaaagaaccctcaatcagagtgaaactgcgatacaacccagctggtatttttgagctattcatgagctactcatgactgaagggaaactgcagctgggaagaggagcctgtttttgtgagagacttttgccttcgtaatgttaaccgtttcaggaccacgtttatagcttcaggacctggctacgtaattatacttaaaatatccactggacactgtgaaatacactaacaggatggctgggtagagcaatctgggcactttggccaattttagtcttgctgtttcttgatgctcacctctatattagtttattgttaggatcaatgataaatttaaatgacctcagatctttgcaccagatactcatcatatacaaatgttttagtaaaaaagagaattgtagataatactgtctaggaaaataagaattaggtttctttgaagaaggaatcttttataacaccttaacagtcaccactgtgctcaaccagacagatagtgaaacagctttctgggtaattcaccaatttcctttaaaacataagctacctgaatggagaatacatcttgtttctgagtttcaacactagcatttttggcttactcatggacaaagttctgtatatagtataaagtcattaacaagaaacaggatatgctttaagacagaattcactgtctgttgcttcagtaaaaggacctcggggaataaaacatttctctcttatatgccagaatgtaggctggtccctatgtcatgtcttccattaagaacactaaaaagtccttgcaagaatggagatatgcattcaagagaggtgctatcacatagatctagtctgaagtctggaacactttcctcttctatgacccctctctccccagtattatcttacttgcaaaatggagaccaaattctatcctgtgaggcttttaattgcaccatagtatgctctgagtagctttacactgcctggtactgatagtagtggctcgatttttaagagccttcaattgtagatgaacatctctgttatttatccctcattcatccatccgttcattcattcagccttcaatcaacatctcttgagtgtctattatgtacaggacatgtactgagacaaaaaggaaacataagagctttttcactctaaaaatcttggcaataatgtcaacaccagaaagcctcctctggagaatcttacagagtgattgtagtttaatacaggaacacacagggctgtgtagcatgataccaggcccaggagatcagtaattacaaattaagggttaaatcagagattattcaacagagagggagaaaggaggagacagagggaggacctgttgtgttccagccattctggtattcctttatgtatctaatttcattcaaacctcacaacagtcttgtgaggcccttatataattactcccattttgcagatgaagtaactgaggcttagaaaggttaatagcaccggggaacaatttctctgggtgagaattgggactctgttgctggtcttctcagttcatttcctgaggtggatttactgagagaaggtgaaataaagccatatttagtataccagagaaggtagattttaagaatggtctcagtgttaatactgagaaaaagtcctgtcagttcagaaaaaatgtgaagtctactttagtattcctgtaatactaaaccgttgagtttctaaatatttatttattctaacaaaaagcaattactacaaatggatgacacatttaatgaacacaattttattttttttctgtaactgtgcttgttgaatgtcaatcatatttaaagggaatgactttgaagtaaaaccttttttcttgctactgaaaaaaatggagttgttttgggtggtaaagtgttaaggaatagggacagctggtcacacaaggaactcttgaaggccacatgtgaaaacctgtcacttgcacagaggccagtcccactaaggtgaccagagtgggctccaagcacaaactgccattggctatagatgggactgtgtccccccaaaattcatgtgttggagccttaaccctcaatgtgatggtatttgagatggggcctttggtaagggaagtttagatgaggtcacgagggtaggaccctcatgatgggatgagtccccttacaagacctctggcttgggccgggcgtggtggctcacacctgtaatcccaacactttgggaggccaaggcaggtagatcacttgatgccaggagttccagaccaggctggccgacatggtgaaaccccatctctactaaaaaatataaaaattagccgggctttgtggcatgtgcctgtaatcccagctatttggcaggctgaggcatgagaatcgcttgaacccaggaggtggaggttacagtgagctgagagtgccccactgcactccagcctgggtgacagagcgagactttgtcccaaaacaaaataggtgaggggatagcgaatgcactcagggtcagcagtggagtttaaaaattgtctcttttcaacttatttaaatgacagcacctgagaagaggaaccgttttacactggatgtttctcatgtagaacaagaaatctttctggaattgatgtttacatgtctgttgttggtcatctctcctgtgtcttaaatactttaatgttggaagagcatagtgtttgggctagtgggtttctgacagcccatgggaatgccctgaaactactgtatctgatgtttgttttcgatgaggttccatgttttgttttcttgggaataaattaatatattgttttcca

SEQ ID NO: 12200 - DNA, 4525 bp, Homo sapiens
atatctctccaggcagtattcacatgctttaaactgaagctcgtagcttggcagtgcagtttaagcaaataaactcaggctgttgaacacaatgattaacaggaagcaggggaggggacatagttactagactctggccgggacaagaggctgaggttaaggtcttagagccgatgacttgcagaatggtcacctcacccacttgtaatttcatggtgggaacaggtggaccccctggaatcagaacctctctgaggacatctgtttttgtgtagacacaggttgcaggttagcaggagaacaggcaagccaaatgcaaaggagccacttcagaaatgtgtcacagaaaagtgaaaatgcaacctagtggtaagtgaagaggggaagaagaaagaaaaaggaccagaaccgtgaactgaagggacagggaacagccagacgagagcttcagccatcacgaggatgatttcggaacctggagaaaatgtaagttaaatatatctacactctgatcctatctcaagagagagatattttactcatttcctggttgtgaatgatgggctcttggaagcactgtctttttagcgcgtctcttatctctgccctgatttttgtatttgtttacaatactgagttatgggagaataaacgttttctgagggcagctctgtccaatgcttcactgttagcagaagcctgtcatcagatttttgaggggaaagttttttacccaacagaaaatgcattgaaaactacccttgatgaagctacctgctatgagtacatggttcgaagccactatgtaacagaaacactctctgaagaagaggctgggttccctttagcttacacagtgaccatccacaaagacttcggcacttttgagaggctcttcagggcgatttatatgccccaaaatgtctactgtgtgcacctggatcagaaggcgacggatgcctttaaaggtgcagtgaaacagttactcagctgcttcccaaatgcttttctggcttccaagaaggagtcggttgtctatggggggatctccaggctccaggctgacctgaactgcctggaagaccttgtggcctctgaagttccctggaagtatgtcatcaacacctgcgggcaagactttcccctgaaaaccaacagggaaatagttcagtatctgaagggatttaaagggaaaaatatcacccccggagtgctgcctcctgaccacgctgttggacggactaaatacgtccaccaagaactgttaaaccacaaaaattcctacgtgattaaaacaacaaaattaaaaactcctcctcctcatgacatggtgatttactttggcacggcctacgtggctctcacaagggactttgctaacttcgtcctccaagaccagctcgcacttgacttactctcctggtccaaggacacctacagccccgacgaacatttctgggtgacactcaacaggattcccggtgttcctggctctatgccaaatgcatcctggactggaaacctcagagctataaagtggagtgacatggaagacagacacggaggctgccacggccactatgtacatggtatttgtatctatggaaacggagacttaaagtggctggttaattcaccaagcctgtttgctaacaagtttgagcttaatacctacccccttactgtggaatgcctagaactgaggcatcgcgaaagaaccctcaatcagagtgaaactgcgatacaacccagctggtatttttgagctattcatgagctactcatgactgaagggaaactgcagctgggaagaggagcctgtttttgtgagagacttttgccttcgtaatgttaaccgtttcaggaccacgtttatagcttcaggacctggctacgtaattatacttaaaatatccactggacactgtgaaatacactaacaggatggctgggtagagcaatctgggcactttggccaattttagtcttgctgtttcttgatgctcacctctatattagtttattgttaggatcaatgataaatttaaatgacctcagatctttgcaccagatactcatcatatacaaatgttttagtaaaaaagagaattgtagataatactgtctaggaaaataagaattaggtttctttgaagaaggaatcttttataacaccttaacagtcaccactgtgctcaaccagacagatagtgaaacagctttctgggtaattcaccaatttcctttaaaacataagctacctgaatggagaatacatcttgtttctgagtttcaacactagcatttttggcttactcatggacaaagttctgtatatagtataaagtcattaacaagaaacaggatatgctttaagacagaattcactgtctgttgcttcagtaaaaggacctcggggaataaaacatttctctcttatatgccagaatgtaggctggtccctatgtcatgtcttccattaagaacactaaaaagtccttgcaagaatggagatatgcattcaagagaggtgctatcacatagatctagtctgaagtctggaacactttcctcttctatgacccctctctccccagtattatcttacttgcaaaatggagaccaaattctatcctgtgaggcttttaattgcaccatagtatgctctgagtagctttacactgcctggtactgatagtagtggctcgatttttaagagccttcaattgtagatgaacatctctgttatttatccctcattcatccatccgttcattcattcagccttcaatcaacatctcttgagtgtctattatgtacaggacatgtactgagacaaaaaggaaacataagagctttttcactctaaaaatcttggcaataatgtcaacaccagaaagcctcctctggagaatcttacagagtgattgtagtttaatacaggaacacacagggctgtgtagcatgataccaggcccaggagatcagtaattacaaattaagggttaaatcagagattattcaacagagagggagaaaggaggagacagagggaggacctgttgtgttccagccattctggtattcctttatgtatctaatttcattcaaacctcacaacagtcttgtgaggcccttatataattactcccattttgcagatgaagtaactgaggcttagaaaggttaatagcaccggggaacaatttctctgggtgagaattgggactctgttgctggtcttctcagttcatttcctgaggtggatttactgagagaaggtgaaataaagccatatttagtataccagagaaggtagattttaagaatggtctcagtgttaatactgagaaaaagtcctgtcagttcagaaaaaatgtgaagtctactttagtattcctgtaatactaaaccgttgagtttctaaatatttatttattctaacaaaaagcaattactacaaatggatgacacatttaatgaacacaattttattttttttctgtaactgtgcttgttgaatgtcaatcatatttaaagggaatgactttgaagtaaaaccttttttcttgctactgaaaaaaatggagttgttttgggtggtaaagtgttaaggaatagggacagctggtcacacaaggaactcttgaaggccacatgtgaaaacctgtcacttgcacagaggccagtcccactaaggtgaccagagtgggctccaagcacaaactgccattggctatagatgggactgtgtccccccaaaattcatgtgttggagccttaaccctcaatgtgatggtatttgagatggggcctttggtaagggaagtttagatgaggtcacgagggtaggaccctcatgatgggatgagtccccttacaagacctctggcttgggccgggcgtggtggctcacacctgtaatcccaacactttgggaggccaaggcaggtagatcacttgatgccaggagttccagaccaggctggccgacatggtgaaaccccatctctactaaaaaatataaaaattagccgggctttgtggcatgtgcctgtaatcccagctatttggcaggctgaggcatgagaatcgcttgaacccaggaggtggaggttacagtgagctgagagtgccccactgcactccagcctgggtgacagagcgagactttgtcccaaaacaaaataggtgaggggatagcgaatgcactcagggtcagcagtggagtttaaaaattgtctcttttcaacttatttaaatgacagcacctgagaagaggaaccgttttacactggatgtttctcatgtagaacaagaaatctttctggaattgatgtttacatgtctgttgttggtcatctctcctgtgtcttaaatactttaatgttggaagagcatagtgtttgggctagtgggtttctgacagcccatgggaatgccctgaaactactgtatctgatgtttgttttcgatgaggttccatgttttgttttcttgggaataaattaatatattgttttcc

SEQ ID NO: 12201 - DNA, 2214 bp, Homo sapiens
aaacaggcttactgtgttcactgctggacgcctctgggcaatcttaccctcctgggaactgagagagacaatgctaggagccagaaacatgaggaatacatgagctcggcgccaatggaacatgctttcacaccgggtgcagctaaccaccacatcatacaaaactcgtcgctgacgttttagatgtataatctgattggcatggactcacagaggagggagtaagggaagagtaagaagatttcaaaggagagacacaggttgcaggttagcaggagaacaggcaagccaaatgcaaaggagccacttcagaaatgtgtcacagaaaagtgaaaatgcaacctagtggtaagtgaagaggggaagaagaaagaaaaaggaccagaaccgtgaactgaagggacagggaacagccagacgagagcttcagccatcacgaggatgatttcggaacctggagaaaatgtaagttaaatatatctacactctgatcctatctcaagagagagatattttactcatttcctggttgtgaatgatgggctcttggaagcactgtctttttagcgcgtctcttatctctgccctgatttttgtatttgtttacaatactgagttatgggagaataaacgttttctgagggcagctctgtccaatgcttcactgttagcagaagcctgtcatcagatttttgaggggaaagttttttacccaacagaaaatgcattgaaaactacccttgatgaagctacctgctatgagtacatggttcgaagccactatgtaacagaaacactctctgaagaagaggctgggttccctttagcttacacagtgaccatccacaaagacttcggcacttttgagaggctcttcagggcgatttatatgccccaaaatgtctactgtgtgcacctggatcagaaggcgacggatgcctttaaaggtgcagtgaaacagttactcagctgcttcccaaatgcttttctggcttccaagaaggagtcggttgtctatggggggatctccaggctccaggctgacctgaactgcctggaagaccttgtggcctctgaagttccctggaagtatgtcatcaacacctgcgggcaagactttcccctgaaaaccaacagggaaatagttcagtatctgaagggatttaaagggaaaaatatcacccccggagtgctgcctcctgaccacgctgttggacggactaaatacgtccaccaagaactgttaaaccacaaaaattcctacgtgattaaaacaacaaaattaaaaactcctcctcctcatgacatggtgatttactttggcacggcctacgtggctctcacaagggactttgctaacttcgtcctccaagaccagctcgcacttgacttactctcctggtccaaggacacctacagccccgacgaacatttctgggtgacactcaacaggattcccggtgttcctggctctatgccaaatgcatcctggactggaaacctcagagctataaagtggagtgacatggaagacagacacggaggctgccacggccactatgtacatggtatttgtatctatggaaacggagacttaaagtggctggttaattcaccaagcctgtttgctaacaagtttgagcttaatacctacccccttactgtggaatgcctagaactgaggcatcgcgaaagaaccctcaatcagagtgaaactgcgatacaacccagctggtatttttgagctattcatgagctactcatgactgaagggaaactgcagctgggaagaggagcctgtttttgtgagagacttttgccttcgtaatgttaaccgtttcaggaccacgtttatagcttcaggacctggctacgtaattatacttaaaatatccactggacactgtgaaatacactaacaggatggctgggtagagcaatctgggcactttggccaattttagtcttgctgtttcttgatgctcacctctatattagtttattgttaggatcaatgataaatttaaatgacctcagatctttgcaccagatactcatcatatacaaatgttttagtaaaaaagagaattgtagataatactgtctaggaaaataagaattaggtttctttgaagaaggaatcttttataacaccttaacagtcaccactgtgctcaaccagacagatagtgaaacagctttctgggtaattca

SEQ ID NO: 12202 - DNA, 3034 bp, Homo sapiens
agtcagagcctcttctctctaagtcacgggaactgcccttgctacttgtgacctgccctttactcagcagtttttgttctgggaagccctgggattctgctaatacctatcactgtaggtgctgaagggaaacagatgaagaacatgacctcaaggagcttcctgtcaatgagaagaccaagctgacgcctggcaaagatattaaagaggagcctgaaactgttccttggacatcttatgaatgtcagaaaataccttttggagggttagaagatcaggggacatggttgttcacatttgctgccacggaacaccgccagtcttcacttggaaacagaatcacgccttgtgaagagatcatccctaagcaggagagaagctactaaaggattgtgtcctcctccaccttccctgtgctcggtctccacctgtctcccattctgtgacgatggttcaatggaagagactctgccagctgcattacttgtgggctctgggctgctatatgctgctggccactgtggctctgaaactttctttcaggttgaagtgtgactctgaccacttgggtctggagtccagggaatctcaaagccagtactgtaggaatatcttgtataatttcctgaaacttccagcaaagaggtctatcaactgttcaggggtcacccgaggggaccaagaggcagtgcttcaggctattctgaataacctggaggtcaagaagaagcgagagcctttcacagacacccactacctctccctcaccagagactgtgagcacttcaaggctgaaaggaagttcatacagttcccactgagcaaagaagaggtggagttccctattgcatactctatggtgattcatgagaagattgaaaactttgaaaggctactgcgagctgtgtatgcccctcagaacatatactgtgtccatgtggatgagaagtccccagaaactttcaaagaggcggtcaaagcaattatttcttgcttcccaaatgtcttcatagccagtaagctggttcgggtggtttatgcctcctggtccagggtgcaagctgacctcaactgcatggaagacttgctccagagctcagtgccgtggaaatacttcctgaatacatgtgggacggactttcctataaagagcaatgcagagatggtccaggctctcaagatgttgaatgggaggaatagcatggagtcagaggtacctcctaagcacaaagaaacccgctggaaatatcactttgaggtagtgagagacacattacacctaaccaacaagaagaaggatcctcccccttataatttaactatgtttacagggaatgcgtacattgtggcttcccgagatttcgtccaacatgttttgaagaaccctaaatcccaacaactgattgaatgggtaaaagacacttatagcccagatgaacacctctgggccacccttcagcgtgcacggtggatgcctggctctgttcccaaccaccccaagtacgacatctcagacatgacttctattgccaggctggtcaagtggcagggtcatgagggagacatcgataagggtgctccttatgctccctgctctggaatccaccagcgggctatctgcgtttatggggctggggacttgaattggatgcttcaaaaccatcacctgttggccaacaagtttgacccaaaggtagatgataatgctcttcagtgcttagaagaatacctacgttataaggccatctatgggactgaactttgagacacactatgagagcgttgctacctgtggggcaagagcatgtacaaacatgctcagaacttgctgggacagtgtgggtgggagaccagggctttgcaattcgtggcatcctttaggataagagggctgctattagagtgtgggtaagtagatcttttgccttgcaaattgctgcctgggtgaatgctgcttgttctctcacccctaaccctagtagttcctccactaactttctcactaagtgagaatgagaactgctgtgatagggagagtgaaggagggatatgtggtagagcacttgatttcagttgaatgcctgctggtagcttttccattctgtggagctgccgttcctaataattccaggtttggtagcgtggaggagaactttgatggaaagagaaccttcccttctgtactgttaacttaaaaataaatagctcctgattcaaagtattacctctactttttgcctagtatgccagaaataatataaatataaacagataaagtgtgtgagactttttctcataactattcatgacatttaaaatccctaggggctggcaagagagttctcattattctgaaatggtcctgacaagctgcatgaatagcaattttttttttgagacagagtcttgctctgtcacccaggctggactgcagtagtgcaatctcagttcactgcaacctccgcctcccaggttcaagcgatactcccacctcagcctcctgagtagctgggactacaggcatgcagcaccatgtctggctaatttttgtatttttagtagaggccgggtttcaccatattcgccaggctggtcttgaactcctgaccttgtgatctgcccgcctcggccttccgaaatgctgggattacaggtgggaactactgcgcctggcctacaaatagcaaattctaacgaagacaggggaacagggatggttcttccattgttaaaagccatcctcattttgtttatattgccaggtttgtgatttttctgtaaaggaaaaggcagggtgatttaaccagtttgaccacctttcctgtactcttacaggaaaatcgcagcactaattctaattttgtccactttacagccaaagcttagctaatgttccataaaggagataatagccaatcaggtaaggtaatgtgtaattcattattcaaagtggaacatgtttttgtagggggagagtctgcactattaataattgtattgagaaataaaaataaactaggactattcagttaaa

SEQ ID NO: 12203 - DNA, 761 bp, Homo sapiens
tgcctctcaagggctggggctgcaaaacatctcagagtttgactctttgcttcgacactaccgtctgcaagttcttgtgctagccgctgtgggaaagacacagctgagtcagacatgatccctgccctcaaggagcttgtgacaccacagtgaagacaagtctattttggtgctgaagggaaacagatgaagaacatgacctcaaggagcttcctgtcaatgagaagaccaagctgacgcctggcaaagatattaaagaggagcctgaaactgttccttggacatcttatgaatgtcagaaaataccttttggagggttagaagatcaggggacatggttgttcacatttgctgccacggaacaccgccagtcttcacttggaaacagaatcacgccttgtgaagagatcatccctaagcaggagagaagctactaaaggattgtgtcctcctccaccttccctgtgctcggtctccacctgtctcccattctgtgacgatggttcaatggaagagactctgccagctgcattacttgtgggctctgggctgctatatgctgctggccactgtggctctgaaactttctttcaggttgaagtgtgactctgaccacttgggtctggagtccagggaatctcaaagccagtactgtaggaatatcttgtataatttcctgaaacttccagcaaagaggtctatcaactgttcaggggtcacccgaggggaccaagaggcagtgcttcaggctattctgaata

SEQ ID NO: 12204 - DNA, 667 bp, Homo sapiens
agttgttccttttctcctggggtggaggtggatccagatccagacttgagtgtggtcggctagtttgtagggtcagattacagatctccatcaacaaaccagatgtaaggggcttctaggcaggtctttactaaggatttttgtccaggattgtgtcctcctccaccttccctgtgctcggtctccacctgtctcccattctgtgacgatggttcaatggaagagactctgccagctgcattacttgtgggctctgggctgctatatgctgctggccactgtggctctgaaactttctttcaggttgaagtgtgactctgaccacttgggtctggagtccagggaatctcaaagccagtactgtaggaatatcttgtataatttcctgaaacttccagcaaagaggtctatcaactgttcaggggtcacccgaggggaccaagaggcagtgcttcaggctattctgaataacctggaggtcaagaagaagcgagagcctttcacagacacccactacctctccctcaccagagactgtgagcacttcaaggctgaaaggaagttcatacagttcccactgagcaaagaagaggtggagttccctattgcatactctatggtgattcatgagaagattgaaaactttgaaaggctactgcgagctgtg

SEQ ID NO: 12205 - DNA, 668 bp, Homo sapiens
aaaggctttcaagttcttgcgtgagcactgacaggcttttatgaatagttggtgacacaggtacaaactgggctgttctggctgaaatatctgtttgccttgtcggatattgccagcattcttcctgcctcactgacctccctgaatgacttgggcttgagaatgtttctgcatgatttctctgagcttgctgtcttacctgagagcaggaagtcaaaaggagagtgatggagccacctgctgccctctactttgcagatattaaagaggagcctgaaactgttccttggacatcttatgaatgtcagaaaataccttttggagggttagaagatcaggggacatggttgttcacatttgctgccacggaacaccgccagtcttcacttggaaacagaatcacgccttgtgaagagatcatccctaagcaggagagaagctactaaaggattgtgtcctcctccaccttccctgtgctcggtctccacctgtctcccattctgtgacgatggttcaatggaagagactctgccagctgcattacttgtgggctctgggctgctatatgctgctggccactgtggctctgaaactttctttcaggttgaagtgtgactctgaccacttgggtctggagtccagggaatctcaaagccagtactgtagga

SEQ ID NO: 12206 - DNA, 2360 bp, Homo sapiens
agtcagagcctcttctctctaagtcacgggaactgcccttgctacttgtgacctgccctttactcagcagtttttgttctgggaagccctgggattctgctaatacctatcactgtaggtgctgaagggaaacagatgaagaacatgacctcaaggagcttcctgtcaatgagaagaccaagctgacgcctggcaaagcattcttcctgcctcactgacctccctgaatgacttgggcttgagaatgtttctgcatgatttctctgagcttgctgtcttacctgagagcaggaagtcaaaaggagagtgatggagccacctgctgccctctactttgcagatattaaagaggagcctgaaactgttccttggacatcttatgaatgtcagaaaataccttttggagggttagaagatcaggggacatggttgttcacatttgctgccacggaacaccgccagtcttcacttggaaacagaatcacgccttgtgaagagatcatccctaagcaggagagaagctactaaaggattgtgtcctcctccaccttccctgtgctcggtctccacctgtctcccattctgtgacgatggttcaatggaagagactctgccagctgcattacttgtgggctctgggctgctatatgctgctggccactgtggctctgaaactttctttcaggttgaagtgtgactctgaccacttgggtctggagtccagggaatctcaaagccagtactgtaggaatatcttgtataatttcctgaaacttccagcaaagaggtctatcaactgttcaggggtcacccgaggggaccaagaggcagtgcttcaggctattctgaataacctggaggtcaagaagaagcgagagcctttcacagacacccactacctctccctcaccagagactgtgagcacttcaaggctgaaaggaagttcatacagttcccactgagcaaagaagaggtggagttccctattgcatactctatggtgattcatgagaagattgaaaactttgaaaggctactgcgagctgtgtatgcccctcagaacatatactgtgtccatgtggatgagaagtccccagaaactttcaaagaggcggtcaaagcaattatttcttgcttcccaaatgtcttcatagccagtaagctggttcgggtggtttatgcctcctggtccagggtgcaagctgacctcaactgcatggaagacttgctccagagctcagtgccgtggaaatacttcctgaatacatgtgggacggactttcctataaagagcaatgcagagatggtccaggctctcaagatgttgaatgggaggaatagcatggagtcagaggtacctcctaagcacaaagaaacccgctggaaatatcactttgaggtagtgagagacacattacacctaaccaacaagaagaaggatcctcccccttataatttaactatgtttacagggaatgcgtacattgtggcttcccgagatttcgtccaacatgttttgaagaaccctaaatcccaacaactgattgaatgggtaaaagacacttatagcccagatgaacacctctgggccacccttcagcgtgcacggtggatgcctggctctgttcccaaccaccccaagtacgacatctcagacatgacttctattgccaggctggtcaagtggcagggtcatgagggagacatcgataagggtgctccttatgctccctgctctggaatccaccagcgggctatctgcgtttatggggctggggacttgaattggatgcttcaaaaccatcacctgttggccaacaagtttgacccaaaggtagatgataatgctcttcagtgcttagaagaatacctacgttataaggccatctatgggactgaactttgagacacactatgagagcgttgctacctgtggggcaagagcatgtacaaacatgctcagaacttgctgggacagtgtgggtgggagaccagggctttgcaattcgtggcatcctttaggataagagggctgctattagagtgtgggtaagtagatcttttgccttgcaaattgctgcctgggtgaatgctgcttgttctctcacccctaaccctagtagttcctccactaactttctcactaagtgagaatgagaactgctgtgatagggagagtgaaggagggatatgtggtagagcacttgatttcagttgaatgcctgctggtagcttttccattctgtggagctgccgttcctaataattccaggtttggtagcgtggaggagaactttgatggaaagagaaccttcccttctgtactgttaacttaaaaataaatagctcctgattcaaa

SEQ ID NO: 12207 - DNA, 1577 bp, Homo sapiens
tgcccagtagggaggaaaaccggaggagagcgcaggaggaaacagtaccggctggaggccggtcttgcaggagcgggggactgctgggggcggggcttggtggtgaccgctggcggggcggggcctggggctcagaggggtgggctttggagatcagagggtcgacgctgcttcgttgcctggactctggtttccgccctggagcaagccggggcctggtcggcagctgggccgccatggagtccacgctgggcgcgggcatcgtgatagccgaggcgctacagaaccagctagcctggctggagaacgtgtggctctggatcacctttctgggcgatcccaagatcctctttctgttctacttccccgcggcctactacgcctcccgccgtgtgggcatcgcggtgctctggatcagcctcatcaccgagtggctcaacctcatcttcaagtggtttctttttggagacaggcccttttggtgggtccatgagtctggttactacagccaggctccagcccaggttcaccagttcccctcttcttgtgagactggtccaggcagcccttctggacactgcatgatcacaggagcagccctctggcccataatgacggccctgtcttcgcaggtggccactcgggcccgcagccgctgggtaagggtgatgcctagcctggcttattgcaccttccttttggcggttggcttgtcgcgaatcttcatcttagcacatttccctcaccaggtgctggctggcctaataactggcgctgtcctgggctggctgatgactccccgagtgcctatggagcgggagctaagcttctatgggttgactgcactggccctcatgctaggcaccagcctcatctattggaccctctttacactgggcctggatctttcttggtccatcagcctagccttcaagtggtgtgagcggcctgagtggatacacgtggatagccggccctttgcctccctgagccgtgactcaggggctgccctgggcctgggcattgccttgcactctccctgctatgcccaggtgcgtcgggcacagctgggaaatggccagaagatagcctgccttgtgctggccatggggctgctgggccccctggactggctgggccacccccctcagatcagcctcttctacattttcaatttcctcaagtacaccctctggccatgcctagtcctggccctcgtgccctgggcagtgcacatgttcagtgcccaggaagcaccgcccatccactcttcctgacttcttgtgtgcctccctttcctttccctcccacaaagccaacactctgtgaccaccacactccaggaggcagccccatccccttccagcccctaagtaggccctcccctccctaaatctgcttccgcaccacctggtcttagccccaaagatgggccttctctctcccagataagttggtcctccctctgcctttcctctcaagcccccaaagagcaaaggcaacagcaagaccagcgggttcttgcaacactgtgaggggcagccagggcggccccaataaagcccttgaatactttg

SEQ ID NO: 12208 - DNA, 645 bp, Homo sapiens
agctccaattgctctatgtttagaattgcctctttttcaagatggatttccttcacaggaatggagtgctcataattcagcatttgcagaaggactaccgagcttactacacttttctaaattttatgtccaatgttggagaccccaggaatatctttttcatttattttccactttgttttcaatttaatcagacagttggaaccaagatgatatgggtagcagtcattggggattggttaaatcttatatttaaatggatattatttggtcatcgaccttactggtgggtccaagaaactcagatttacccaaatcactcaagtccatgccttgaacagttccctactacatgtgaaacaggtccaggaagtccatctggccatgcaatgggcgcatcctgtgtctggtatgtcatggtaaccgctgccctgagccacactgtctgtgggatggataagttctctatcactctgcacaggcatgctggtggcagaggcctttgaacacactccaggcatccaaacggccagtctgggcacatacctgaagaccaacctctttctcttcctgtttgcagttggcttttacctgcttcttagggtgctcaacattgacctgctgtggtccgtgcccatagccaaa

SEQ ID NO: 12209 - DNA, 1214 bp, Homo sapiens
tcgacatgccacaaaggcacagtataaaaacggtgggaatcagagcacttcagctccaattgctctatgtttagaattgcctctttttcaagatggatttccttcacaggaatggagtgctcataattcagcatttgcagaaggactaccgagcttactacacttttctaaattttatgtccaatgttggagaccccaggaatatctttttcatttattttccactttgttttcaatttaatcagacagttggaaccaagatgatatgggtagcagtcattggggattggttaaatcttatatttaaatggatattatttggtcatcgaccttactggtgggtccaagaaactcagatttacccaaatcactcaagtccatgccttgaacagttccctactacatgtgaaacaggtccaggaagtccatctggccatgcaatgggcgcatcctgtgtctggtatgtcatggtaaccgctgccctgagccacactgtctgtgggatggataagttctctatcactctgcacagactgacctggtcatttctttggagtgttttttggttgattcaaatcagtgtctgcatctccagagtattcatagcaacacattttcctcatcaagttattcttggagtaattggtggcatgctggtggcagaggcctttgaacacactccaggcatccaaacggccagtctgggcacatacctgaagaccaacctctttctcttcctgtttgcagttggcttttacctgcttcttagggtgctcaacattgacctgctgtggtccgtgcccatagccaaaaagtggtgtgctaaccccgactggatccacattgacaccacgccttttgctggactcgtgagaaaccttggggtcctctttggcttgggctttgcaatcaactcagagatgttcctcctgagctgccgagggggaaataactacacactgagcttccggttgctctgtgccttgacctcattgacaatactgcagctctaccatttcctccagatcccgactcacgaagagcatttattttatgtgctgtctttttgtaaaagtgcatccattcccctaactgtggttgctttcattccctactctgttcatatgttaatgaaacaaagcggaaagaagagtcagtagagtggtgcctagagttagtgctctgtgtcacagatcacccttctccatccacca

SEQ ID NO: 12210 - DNA, 4194 bp, Homo sapiens
aggggtggggccgggccgggccgggccgggcgcctgcgccataaaggccgccgcgcgcccacgcgcctcgcttgctgcgcgctgccggcgctccttcctcctcggctcgcgtctcactcagtgtaccttctagtcccgccatggccgctctcacccgggacccccagttccagaagctgcagcaatggtaccgcgagcaccgctccgagctgaacctgcgccgcctcttcgatgccaacaaggaccgcttcaaccacttcagcttgaccctcaacaccaaccatgggcatatcctggtggattactccaagaacctggtgacggaggacgtgatgcggatgctggtggacttggccaagtccaggggcgtggaggccgcccgggagcggatgttcaatggtgagaagatcaactacaccgagggtcgagccgtgctgcacgtggctctgcggaaccggtcaaacacacccatcctggtagacggcaaggatgtgatgccagaggtcaacaaggttctggacaagatgaagtctttctgccagcgtgtccggagcggtgactggaaggggtacacaggcaagaccatcacggacgtcatcaacattggcattggcggctccgacctgggacccctcatggtgactgaagcccttaagccatactcttcaggaggtccccgcgtctggtatgtctccaacattgatggaactcacattgccaaaaccctggcccagctgaaccccgagtcctccctgttcatcattgcctccaagacctttactacccaggagaccatcacgaatgcagagacggcgaaggagtggtttctccaggcggccaaggatccttctgcagtggcgaagcactttgttgccctgtctactaacacaaccaaagtgaaggagtttggaattgaccctcaaaacatgttcgagttctgggattgggtgggaggacgctactcgctgtggtcggccatcggactctccattgccctgcacgtgggttttgacaacttcgagcagctgctctcgggggctcactggatggaccagcacttccgcacgacgcccctggagaagaacgcccccgtcttgctggccctgctgggtatctggtacatcaactgctttgggtgtgagacacacgccatgctgccctatgaccagtacctgcaccgctttgctgcgtacttccagcagggcgacatggagtccaatgggaaatacatcaccaaatctggaacccgtgtggaccaccagacaggccccattgtgtggggggagccagggaccaatggccagcatgctttttaccagctcatccaccaaggcaccaagatgataccctgtgacttcctcatcccggtccagacccagcaccccatacggaagggtctgcatcacaagatcctcctggccaacttcttggcccagacagaggccctgatgaggggaaaatcgacggaggaggcccgaaaggagctccaggctgcgggcaagagtccagaggaccttgagaggctgctgccacataaggtctttgaaggaaatcgcccaaccaactctattgtgttcaccaagctcacaccattcatgcttggagccttggtcgccatgtatgagcacaagatcttcgttcagggcatcatctgggacatcaacagctttgaccagtggggagtggagctgggaaagcagctggctaagaaaatagagcctgagcttgatggcagtgctcaagtgacctctcacgacgcttctaccaatgggctcatcaacttcatcaagcagcagcgcgaggccagagtccaataaactcgtgctcatctgcagcctcctctgtgactcccctttctcttctcgtccctcctccccggagccggcactgcatgttcctggacaccacccagagcaccctctggttgtgggcttggaccacgagcccttagcagggaaggctggtctcccccagcctaacccccagcccctccatgtctatgctccctctgtgttagaattggctgaagtgtttttgtgcagctgacttttctgacccatgttcacgttgttcacatcccatgtagaaaaataaagatgccacggaggaggttgtaggctcagcctctgattttttttttcctgtgatggtgctttatgtagcagagggcaggagcgctcagcaggacgcaggctgtgcctctgcggacacttaacactaagtggtgagcgggtctagagtggagcaaggtgccctgagaagacaatagtggggtgggggcacaatcagtcaggacggcaacttggcctgtgtcaccaaatcccaagactgttttccactcctcacctctgtgactgcagaaattggatactctgttcactcgatggttctaaaaactgcattgagattatgtttgtttcgggtgaattcctggacaagaccgaggatgactgccatctcctggcaagacgctcaggtagttcttttgctttaaaaggcagatattgaaaactggaattttttttttttgagtctcgctctgtcacccagactggagtgcagtggtgcaatctcggctcactgcaacctccgcctcccgggttcaagctattctcctgcctcagcctcccgagtagctgggattacacggcgcacaccaccatacccagctaatttttgtatttttagtagtgaaggggttttaccatgttgggcaggctggtcttgaactcctgacctcaggtgatctgcccgcctcagcctcccacagtgctgggattacaggtatgagccaccacgcccggcccattttttttttttttttgacaacttttttttttttttgagacagggtcttgttccattgcccagactggagtgcagtggcatgatcacagctcactgcagccagtaatcctcttgcctcagcctcccaagtagttgagactacaggttgtaccactatgccctgctagttttttcattttttgtagagagacgggtcttttttttttttgagacggagtctcgctctgtcgcccaagctggagtgcagtagcacggtctcagctcattgcaagctccgcctcccaggttcacgccattctcctgcctcagactcctgtgtagctgggagtacaggcacctgccaccatgcccggctaattttttatatatttttttagcagagacagtgtctcactgtgttagtcaggatggtctcgatctcctgacctcgtgatccgcccgcctcagcctcccaaagtgctgggattacaggcgtgagccaccgcgcccagcaaggcgggtcttgctgtgtttcccagactagactggtcttgaattccagggctcaagagatctcccacctcagcctcccacagtgctgggattacaggcgtgagccgccacacccagcctattcaaaatttttttttcttagagacagggtctttgttgcccaggctggactgcagtgatacaatcatagctgactgaagcctcaaattcccaggctaaggtgatcttctcacctcagccttccaagtagctgggtccgcagatgcatgccagtacacccagctcatttaaaaaaaaatttttttcttttttgagagtcttgctttgttgcccaggctggagtgcagtggtgtgatctcggctcactgcaagctccacctcccggcttcacgccattctcctgcctcagcctcccgagtagctgggactacaggtgcccgccaccacacccggctaattttttgtatttttagtagagacggggtttcaccgtgttagccaggatggtcttgatctcctgacctcatgatccgcctgctttggcctcccaaagtgctgggattacaggcgtgagtcaccgcgcccggctcattttaaaatttttgtagatcagtgtactgttgtaaaaaaaaaaaaataagaaaaataaaaaataaatttttgtagtgataggatcccactgaggccagagaatagggtctggagacaaaggagcattcacttcagcctctgactggtggcaggccaagtctttatttacatagggtgtaaccaaataggaaacctctaaagggtacttaaaccccagattttctacacagggcacttgcttgagcctcatcccgctttctggaatgtacttttgcttcaataaatctgtgcttttgttccttc

SEQ ID NO: 12211 - DNA, 4631 bp, Homo sapiens
cgcgtctcactcagtgtaccttctagtcccgccatggccgctctcacccgggacccccagttccagaagctgcagcaatggtaccgcgagcaccgctccgagctgaacctgcgccgcctcttcgatgccaacaaggaccgcttcaaccacttcaggtgcgggcgggccggaggcgggggctgccacgcgcggcgcccggaaccgggcacgcgggcctggggtctggaggcgggggcagcggtgcccggggaccccagtccccgacctccaggccacggactggggcccaggccgagtccgcacttcgtccttggagtctccttggagtgcgttcctgggggcttgcagcctcgccgggagtctcggccccgggtctgcttcgttacgaggaaaaacgggcccctccgtggggacatttcccctcctcctccccgtgcagctctggccatttgagcaggggctcctttcgcagttgtgaagagaggccttggctgacgcagcaagcgggaaagggctgtccctttccatccgctcctggccacatgagcttgggagcgtctgcagggcgggcagcccgggcgggggtgtttgagggagctgggtggaaggatggagacgtcgggcgtgattcctgcagaagacacctgtgcacgaccgggaagtgggaaggagtgtttgagcaaatcatgggcgggagtgcggccaagggagctctgatcactgatactggtggaggcgggggaggggagcgactgtggctccgggctagacgtcccgatggccatccctgtcatctggatgggtgcctgagtaacttacggcagaaagtggaagccctgggaaggggtggtcccccacttcagtccgggctcctcatccagggtctgcctgcatctacggtctgtgaggatggcttctttctctgggctgctgttgcagatcatcctggtgggccagcaggtgacagacaccaccactgtgctgggtggccgcggcccttgtggggcgtgggtcagggaggatgtttcttctgggaacagctcctgcttagggcatggctccccgctagggagaccagggtgtggtcagcagcatctccatctttctgcagcttgaccctcaacaccaaccatgggcatatcctggtggattactccaagaacctggtgacggaggacgtgatgcggatgctggtggacttggccaagtccaggggcgtggaggccgcccgggagcggatgttcaatggtgagaagatcaactacaccgaggtgagcaggccccacataccctctggggcctccttccttccctttggggtttatctgactgttagccgcatcaccctgtgtcttcaccccttctcttgggcaatgcttttgcttaatgaggggcctgaaggcctttttcctcctgcttgtagcagggctttggggtgtgccttccacaagattggtttggtgagctccttggaatggttcccagtgtctgcctgggaggagcatatctcatacccacagggagagtttctcaaggctgacattttcttggagaagttaactctaatatatcctcaatgcaagttttagtagcgacaagaagaatcttagatcaccaaagacttcagcctactcaagcagtaggagtcaataggaagcagtggtgaggccaggcctgggggcccctgttcctgactcagtatgggagcccagcctggaggtataatggacactgagcacccagactctgtcctcatgatgtcattatcctcctcttacatgtgaggagtctgaggttcagaggtcacatcacttatctaagatgtcatagctgtaagaggcagaatggagattcacactcaacctgtcttgcattgtgggtctaagctgagagaggatgcaatcaaggaaggctttctggaggagtgcatttgccaataaaatgtggcgcaggagtggggtctggcagggtgagggtggggtggcatgaagccctccaccttagcaagcctctcactgggtcggaatcccaagatgatccttttcctgcccacctggggtcgttagaccttccctcaaggactcctctgctgacttcaggccatttcactcacgtggctgggccagccgcctggcacccgtcacagacttcaagtctggtttggttcctggcagttggtagttatcgggctgcttggtgagggaagcttgagttgcatgccttgctgcaaatccaaggagctgaggacactgcctaaaacgtgccagcaaacaccatggacacacattgggaggatgaggttacttcaggcttcatgagcactcatcttcggaaagcgtttatttatttatttattttgagatggagtcttgctctgtcgcccaggctggagtgcagtggtgcgatcttggctcactgcaacctctgtctaatgggttcaggcgattctctgcctcagattcctgagtagctggaactacaggtgtgtgccacccccacctggctgatttttgtatttttagtagagacaggatgtcaccatgttggccaggctggtctcgaattcatgacctcaagttatccacctgccatggcctcccagagttccgggattacaggcgtgagccatggcgcccggcctctgaaagcatttattgcttgtttctgacatgtattgttgccattctctgcctttgctcactgttcctcttttctctcactgttcatgccctgagcatctctggcaggccttcggggcctgtcctaggcatatatgggtcccctcctctcctcctgactgtctgcagcacataagtccttggggagctcctactcctctaagcatacagtgggttcttggaacaaggttatggtgctaacagagacctcagggcctgcctgtctagtggatagagggccgagctatggcaccatgcccagctgggagcatggctgcctggggttggggggggcagtctttatatcctgaccgtaatccccagggtcgagccgtgctgcacgtggctctgcggaaccggtcaaacacacccatcctggtagacggcaaggatgtgatgccagaggtcaacaaggttctggacaagatgaagtctttctgccaggtaagtggctactgggccggactcacccttggccgtgtgtgtgagttatttgggaatctgggagccctaaggggcagctcttccctcttcttgtaggcaggactcaggttctcactgcagcttaagggaggggttgcctgtgtgatcgctgaccctggagtctctgctgaggcctgaatttctcctggctctgctctgaaggaatctgctgctggcagaagtggggccagtttctttcctgaattgtagacacctatggactcatggtgacaaaccacagaggcttcaaatgaaaagtggggcccctgagagacaggacagtcaggaaaggaaggagctttttcttttttctttttttttttttgagatggagtctcactctctcgcccagagtggactgcagtcgtgctatctcagctcactgcaacttccgcctcctggattcaagctattctcctacctcagcctggccatcatggtgaaaccccatctccactaaaaatacaaaaattagccagttttggtgacatacgcctgcaatcccagctacttgggagactgaggcaggagaatcgcttgaacccgtgcggcagaggttgcagtgagctgcgattgcgccactgcactccagcctgggcgacagagggagactctgtcaaaaaaaaaaaaaaatttcctcatccccattcccagctaaccctccagaagcagcctttgtaaagtttcctgtagccaggcgcagcagctcatacctctattcccaactattcaggaggctgaggtgggaggatggcttgagcctgggaagttgaggctgcagtgagccatggtgacaccactgcactgcagcctgggcgacagcaagatcgtgtctctaaataaatttaaaaaatagaaaagttttcctgtgaagtcttccagaaagttcctgtgcacatacacatctgtcatctcctctttgaaacacgtacacatgtgcacatgcacacaggttggttttctccctgctcctctgaagcttatttccacctggaagtatgtaagcagtgtccgtgtgtcagtgacagtgcatgtaacatgccttcttttccttgtgtgtagggtggtaggggttgcctcagagaccagctaagtttccccacatcaagcacttgcctcagtgtctaccctagcggtgattctgcaggggtgggttggcagacatcctcacgtctggagaacgagggtgatgccggtgtgcctgtgtgggctgtgcatgctacgagggtgatcgtccaaactcttgtcagctgtgatcatttgctgcttgtcctaggagcagtggcctccatgtgtggctggtcagagtccagttactttggccaagagccactttcagacctgaaaatgggctgggtgcagtggctcacgcctgtaatcccagcactctgggaggctgaggcaggtggatcatgtgaggtcgggagtttgagatcagcctgatcaacatggtgaaacgccgtctgtact

SEQ ID NO: 12212 - DNA, 4257 bp, Homo sapiens
aatagcccttaccaccagcagacacacatcatctgttgtacttgcttatttggcacatatgtatccacagcgcctagaacactgcctgtaacgtggaaggtgttcgatctatagagttttgtcgaatgaatgaatgaagccgactagtgcacagggagtgcagcggcgcgatggtagctctctgcagcctccaacacctgggctccagtgatccccgggctctgcccaccctccccactgccacttccgggcagaggccagcaaagcggcggcgcaagagtcccgccatggccgctctcacccgggacccccagttccagaagctgcagcaatggtaccgcgagcaccgctccgagctgaacctgcgccgcctcttcgatgccaacaaggaccgcttcaaccacttcagcttgaccctcaacaccaaccatgggcatatcctggtggattactccaagaacctggtgacggaggacgtgatgcggatgctggtggacttggccaagtccaggggcgtggaggccgcccgggagcggatgttcaatggtgagaagatcaactacaccgagggtcgagccgtgctgcacgtggctctgcggaaccggtcaaacacacccatcctggtagacggcaaggatgtgatgccagaggtcaacaaggttctggacaagatgaagtctttctgccagggacccctcatggtgactgaagcccttaagccatactcttcaggaggtccccgcgtctggtatgtctccaacattgatggaactcacattgccaaaaccctggcccagctgaaccccgagtcctccctgttcatcattgcctccaagacctttactacccaggagaccatcacgaatgcagagacggcgaaggagtggtttctccaggcggccaaggatccttctgcagtggcgaagcactttgttgccctgtctactaacacaaccaaagtgaaggagtttggaattgaccctcaaaacatgttcgagttctgggattgggtgggaggacgctactcgctgtggtcggccatcggactctccattgccctgcacgtgggttttgacaacttcgagcagctgctctcgggggctcactggatggaccagcacttccgcacgacgcccctggagaagaacgcccccgtcttgctggccctgctgggtatctggtacatcaactgctttgggtgtgagacacacgccatgctgccctatgaccagtacctgcaccgctttgctgcgtacttccagcagggcgacatggagtccaatgggaaatacatcaccaaatctggaacccgtgtggaccaccagacaggccccattgtgtggggggagccagggaccaatggccagcatgctttttaccagctcatccaccaaggcaccaagatgataccctgtgacttcctcatcccggtccagacccagcaccccatacggaagggtctgcatcacaagatcctcctggccaacttcttggcccagacagaggccctgatgaggggaaaatcgacggaggaggcccgaaaggagctccaggctgcgggcaagagtccagaggaccttgagaggctgctgccacataaggtctttgaaggaaatcgcccaaccaactctattgtgttcaccaagctcacaccattcatgcttggagccttggtcgccatgtatgagcacaagatcttcgttcagggcatcatctgggacatcaacagctttgaccagtggggagtggagctgggaaagcagctggctaagaaaatagagcctgagcttgatggcagtgctcaagtgacctctcacgacgcttctaccaatgggctcatcaacttcatcaagcagcagcgcgaggccagagtccaataaactcgtgctcatctgcagcctcctctgtgactcccctttctcttctcgtccctcctccccggagccggcactgcatgttcctggacaccacccagagcaccctctggttgtgggcttggaccacgagcccttagcagggaaggctggtctcccccagcctaacccccagcccctccatgtctatgctccctctgtgttagaattggctgaagtgtttttgtgcagctgacttttctgacccatgttcacgttgttcacatcccatgtagaaaaataaagatgccacggaggaggttgtaggctcagcctctgattttttttttcctgtgatggtgctttatgtagcagagggcaggagcgctcagcaggacgcaggctgtgcctctgcggacacttaacactaagtggtgagcgggtctagagtggagcaaggtgccctgagaagacaatagtggggtgggggcacaatcagtcaggacggcaacttggcctgtgtcaccaaatcccaagactgttttccactcctcacctctgtgactgcagaaattggatactctgttcactcgatggttctaaaaactgcattgagattatgtttgtttcgggtgaattcctggacaagaccgaggatgactgccatctcctggcaagacgctcaggtagttcttttgctttaaaaggcagatattgaaaactggaattttttttttttgagtctcgctctgtcacccagactggagtgcagtggtgcaatctcggctcactgcaacctccgcctcccgggttcaagctattctcctgcctcagcctcccgagtagctgggattacacggcgcacaccaccatacccagctaatttttgtatttttagtagtgaaggggttttaccatgttgggcaggctggtcttgaactcctgacctcaggtgatctgcccgcctcagcctcccacagtgctgggattacaggtatgagccaccacgcccggcccattttttttttttttttgacaacttttttttttttttgagacagggtcttgttccattgcccagactggagtgcagtggcatgatcacagctcactgcagccagtaatcctcttgcctcagcctcccaagtagttgagactacaggttgtaccactatgccctgctagttttttcattttttgtagagagacgggtcttttttttttttgagacggagtctcgctctgtcgcccaagctggagtgcagtagcacggtctcagctcattgcaagctccgcctcccaggttcacgccattctcctgcctcagactcctgtgtagctgggagtacaggcacctgccaccatgcccggctaattttttatatatttttttagcagagacagtgtctcactgtgttagtcaggatggtctcgatctcctgacctcgtgatccgcccgcctcagcctcccaaagtgctgggattacaggcgtgagccaccgcgcccagcaaggcgggtcttgctgtgtttcccagactagactggtcttgaattccagggctcaagagatctcccacctcagcctcccacagtgctgggattacaggcgtgagccgccacacccagcctattcaaaatttttttttcttagagacagggtctttgttgcccaggctggactgcagtgatacaatcatagctgactgaagcctcaaattcccaggctaaggtgatcttctcacctcagccttccaagtagctgggtccgcagatgcatgccagtacacccagctcatttaaaaaaaaatttttttcttttttgagagtcttgctttgttgcccaggctggagtgcagtggtgtgatctcggctcactgcaagctccacctcccggcttcacgccattctcctgcctcagcctcccgagtagctgggactacaggtgcccgccaccacacccggctaattttttgtatttttagtagagacggggtttcaccgtgttagccaggatggtcttgatctcctgacctcatgatccgcctgctttggcctcccaaagtgctgggattacaggcgtgagtcaccgcgcccggctcattttaaaatttttgtagatcagtgtactgttgtaaaaaaaaaaaaataagaaaaataaaaaataaatttttgtagtgataggatcccactgaggccagagaatagggtctggagacaaaggagcattcacttcagcctctgactggtggcaggccaagtctttatttacatagggtgtaaccaaataggaaacctctaaagggtacttaaaccccagattttctacacagggcacttgcttgagcctcatcccgctttctggaatgtacttttgcttcaataaatctgtgcttttgttccttc

SEQ ID NO: 12213 - DNA, 3906 bp, Homo sapiens
gcaaactctgcacaagatggcggcggtagcggcagtggcggcgcgtaggaggcggtcttgggcgtctttggtactggcttttttaggggtctgcctggggattacccttgctgtggatagaagcaactttaagacctgtgaagagagttctttctgcaagcgacagagaagcatacggccaggcctctctccataccgagccttgctggactctctacagcttggtcctgattccctcacggtccatctgatccatgaggtcaccaaggtgttgctggtgctagagcttcaggggcttcaaaagaacatgactcggttcaggattgatgagctggagcctcggcgaccccgataccgtgtaccagatgttttggtggctgatccaccaatagcccggctttctgtctctggtcgtgatgagaacagtgtggagttaaccatggctgagggaccctacaagatcatcttgacagcacggccattccgccttgacctactagaggaccgaagtcttttgcttagtgtcaatgcccgaggactcttggagtttgagcatcagagggcccctagggtctctttctcggataaggttaatctcacgcttggtagcatatgggataagatcaagaaccttttctctaggcaaggatcaaaagacccagctgagggcgatggggcccagcctgaggaaacacccagggatggcgacaagccagaggagactcaggggaaggcagagaaagatgagccaggagcctgggaggagacattcaaaactcactctgacagcaagccgtatggccccatgtctgtgggtttggacttctctctgccaggcatggagcatgtctatgggatccctgagcatgcagacaacctgaggctgaaggtcactgagggtggggagccatatcgcctctacaatttggatgtgttccagtatgagctgtacaacccaatggccttgtatgggtctgtgcctgtgctcctggcacacaaccctcatcgcgacttgggcatcttctggctcaatgctgcagagacctgggttgatatatcttccaacactgccgggaagaccctgtttgggaagatgatggactacctgcagggctctggggagaccccacagacagatgttcgctggatgtcagagactggcatcattgacgtcttcctgctgctggggccctccatctctgatgttttccggcaatatgctagtctcacaggaacccaggcgttgcccccactcttctccctcggctaccaccagagccgttggaactaccgggacgaggctgatgtgctggaagtggatcagggctttgatgatcacaacctgccctgtgatgtcatctggctagacattgaacatgctgatggcaagcggtatttcacctgggaccccagtcgcttccctcagccccgcaccatgcttgagcgcttggcttctaagaggcggaagctggtggccatcgtagacccccacatcaaggtggactccggctaccgagttcacgaggagctgcggaacctggggctgtatgttaaaacccgggatggctctgactatgagggctggtgctggccaggctcagctggttaccctgacttcactaatcccacgatgagggcctggtgggctaacatgttcagctatgacaattatgagggctcagctcccaacctctttgtctggaatgacatgaacgaaccatctgtgttcaatggtcctgaggtcaccatgctcaaggatgcccagcattatgggggctgggagcaccgggatgtgcataacatctatggcctttatgtgcacatggcgactgctgatgggctgagacagcgctctgggggcatggaacgcccctttgtcctggccagggccttcttcgctggctcccagcgctttggagccgtgtggacaggggacaacactgccgagtgggaccatttgaagatctctattcctatgtgtctcagcttggggctggtgggactttccttctgtggggcggatgtgggtggcttcttcaaaaacccagagccagagctgcttgtgcgctggtaccagatgggtgcttaccagccattcttccgggcacatgcccacttggacactgggcgacgagagccatggctgttaccatctcagcacaatgatataatccgagatgccttgggccagcgatattctttgctgcccttctggtacaccctcttatatcaggcccatcgggaaggcattcctgtcatgaggcccctgtgggtgcagtaccctcaggatgtgactaccttcaatatagatgatcagtacttgcttggggatgcgttgctggttcaccctgtatcagactctggagcccatggtgtccaggtctatctgcctggccaaggggaggtgtggtatgacattcaaagctaccagaagcatcatggtccccagaccctgtacctgcctgtaactctaagcagtatccctgtgttccagcgtggagggacaatcgtgcctcgatggatgcgagtgcggcggtcttcagaatgtatgaaggatgaccccatcactctctttgttgcacttagccctcagggtacagctcaaggagagctctttctggatgatgggcacacgttcaactatcagactcgccaagagttcctgctgcgtcgattctcattctctggcaacacccttgtctccagctcagcagaccctgaaggacactttgagacaccaatctggattgagcgggtggtgataataggggctggaaagccagcagctgtggtactccagacaaaaggatctccagaaagccgcctgtccttccagcatgaccctgagacctctgtgttggtcctgcgcaagcctggcatcaatgtggcatctgattggagtattcacctgcgataacccaagggatgttctgggttagggggagggaaggggagcattagtgctgagagatattctttcttctgccttggagttcggccctccccagacttcacttatgctagtctaagacccagattctgccaacatttgggcaggatgagagggctgaccctgggctccaaattcctcttgtgatctcctcacctctcccactccattgataccaactctttcccttcattcccccaacatcctgttgctctaactggagcacattcacttacgaacaccaggaaaccacagggcccttgtcgccccttctctttcccttatttaggagccctgaactcccccagagtctatccattcatgcctcttgtatgttgatgccacttcttggaagaagatgagggcaatgagttagggctccttttccccttccctcccaccagattgctctcccacctttcatttcttcctccaggctttactcccctttttatgccccaccgatacactgggaccaccccttaccccggacaggatgaatggatcaaaggagtgaggttgctaaagaacatccttttccctctcattctacccttttcctctccccgattccttgtagagctgctgcaattcttagaggggcagttctacctcctctgtccctcggcagaaagacgtttccacacctcttaggggatgcgcattaaacttcttttgcccccttcttgtcccctttgaggggcacttaagatggagaaatcagttgtggtttcagtgaatcatggtcacctgtatttattgctaggagaagcctgagggtggggggagatgatcatgtgtgctcggggttggctggaagccctgggtggggggttgggggaggactaatggggagtcggggaatatttgtgggtattttttttacttcctcttggttcccagctgtgacacgttttgatcaaaggagaaacaataaagggataaaccataaataa

SEQ ID NO: 12214 - DNA, 3608 bp, Homo sapiens
agcaaactctgcacaagatggcggcggtagcggcagtggcggcgcgtaggaggcggtcttgggcgtctttggtactggcttttttaggggtctgcctggggattacccttgctgtggatagaagcaactttaagacctgtgaagagagttctttctgcaagcgacagagaagcatacggccaggcctctctccataccgagccttgctggactctctacagcttggtcctgattccctcacggtccatctgatccatgaggtcaccaaggtgttgctggtgctagagcttcaggggcttcaaaagaacatgactcggttcaggattgatgagctggagcctcggcgaccccgataccgtgtaccagatgttttggtggctgatccaccaatagcccggctttctgtctctggtcgtgatgagaacagtgtggagttaaccatggctgagggaccctacaagatcatcttgacagcacggccattccgccttgacctactagaggaccgaagtcttttgcttagtgtcaatgcccgaggactcttggagtttgagcatcagagggcccctagggtctcgcaaggatcaaaagacccagctgagggcgatggggcccagcctgaggaaacacccagggatggcgacaagccagaggagactcaggggaaggcagagaaagatgagccaggagcctgggaggagacattcaaaactcactctgacagcaagccgtatggccccatgtctgtgggtttggacttctctctgccaggcatggagcatgtctatgggatccctgagcatgcagacaacctgaggctgaaggtcactgagggtggggagccatatcgcctctacaatttggatgtgttccagtatgagctgtacaacccaatggccttgtatgggtctgtgcctgtgctcctggcacacaaccctcatcgcgacttgggcatcttctggctcaatgctgcagagacctgggttgatatatcttccaacactgccgggaagaccctgtttgggaagatgatggactacctgcagggctctggggagaccccacagacagatgttcgctggatgtcagagactggcatcattgacgtcttcctgctgctggggccctccatctctgatgttttccggcaatatgctagtctcacaggaacccaggcgttgcccccactcttctccctcggctaccaccagagccgttggaactaccgggacgaggctgatgtgctggaagtggatcagggctttgatgatcacaacctgccctgtgatgtcatctggctagacattgaacatgctgatggcaagcggtatttcacctgggaccccagtcgcttccctcagccccgcaccatgcttgagcgcttggcttctaagaggcggaagctggtggccatcgtagacccccacatcaaggtggactccggctaccgagttcacgaggagctgcggaacctggggctgtatgttaaaacccgggatggctctgactatgagggctggtgctggccaggctcagctggttaccctgacttcactaatcccacgatgagggcctggtgggctaacatgttcagctatgacaattatgagggctcagctcccaacctctttgtctggaatgacatgaacgaaccatctgtgttcaatggtcctgaggtcaccatgctcaaggatgcccagcattatgggggctgggagcaccgggatgtgcataacatctatggcctttatgtgcacatggcgactgctgatgggctgagacagcgctctgggggcatggaacgcccctttgtcctggccagggccttcttcgctggctcccagcgctttggagccgtgtggacaggggacaacactgccgagtgggaccatttgaagatctctattcctatgtgtctcagcttggggctggtgggactttccttctgtggggcggatgtgggtggcttcttcaaaaacccagagccagagctgcttgtgcgctggtaccagatgggtgcttaccagccattcttccgggcacatgcccacttggacactgggcgacgagagccatggctgttaccatctcagcacaatgatataatccgagatgccttgggccagcgatattctttgctgcccttctggtacaccctcttatatcaggcccatcgggaaggcattcctgtcatgaggcccctgtgggtgcagtaccctcaggatgtgactaccttcaatatagatgatcagtacttgcttggggatgcgttgctggttcaccctgtatcagactctggagcccatggtgtccaggtctatctgcctggccaaggggaggtgtggtatgacattcaaagctaccagaagcatcatggtccccagaccctgtacctgcctgtaactctaagcagtatccctgtgttccagcgtggagggacaatcgtgcctcgatggatgcgagtgcggcggtcttcagaatgtatgaaggatgaccccatcactctctttgttgcacttagccctcagggtacagctcaaggagagctctttctggatgatgggcacacgttcaactatcagactcgccaagagttcctgctgcgtcgattctcattctctggcaacacccttgtctccagctcagcagaccctgaaggacactttgagacaccaatctggattgagcgggtggtgataataggggctggaaagccagcagctgtggtactccagacaaaaggatctccagaaagccgcctgtccttccagcatgaccctgagacctctgtgttggtcctgcgcaagcctggcatcaatgtggcatctgattggagtattcacctgcgataacccaagggatgttctgggttagggggagggaaggggagcattagtgctgagagatattctttcttctgccttggagttcggccctccccagacttcacttatgctagtctaagacccagattctgccaacatttgggcaggatgagagggctgaccctgggctccaaattcctcttgtgatctcctcacctctcccactccattgataccaactctttcccttcattcccccaacatcctgttgctctaactggagcacattcacttacgaacaccaggaaaccacagggcccttgtcgccccttctctttcccttatttaggagccctgaactcccccagagtctatccattcatgcctcttgtatgttgatgccacttcttggaagaagatgagggcaatgagttagggctccttttccccttccctcccaccagattgctctcccacctttcatttcttcctccaggctttactcccctttttatgccccaccgatacactgggaccaccccttaccccggacaggatgaatggatcaaaggagtgaggttgctaaagaacatccttttccctctcattctacccttttcctctccccgattccttgtagagctgctgcaattcttagaggggcagttctacctcctctgtccctcggcagaaagacgtttccacacctcttaggggatgcgcattaaacttcttttgcccccttcttgtcccctttgaggggcacttaagatggagaaatca

SEQ ID NO: 12215 - DNA, 2749 bp, Homo sapiens
tctgcacaagatggcggcggtagcggcagtggcggcgcgtaggaggcggtcttgggcgtctttggtactggcttttttaggggtctgcctggggattacccttgctgtggatagaagcaactttaagacctgtgaagagagttctttctgcaagtgttgctggtgctagagcttcaggggcttcaaaagaacatgactcggttcaggattgatgagctggagcctcggcgaccccgataccgtgtaccagatgttttggtggctgatccaccaatagcccggctttctgtctctggtcgtgatgagaacagtgtggagttaaccatggctgagggaccctacaagatcatcttgacagcacggccattccgccttgacctactagaggaccgaagtcttttgcttagtgtcaatgcccgaggactcttggagtttgagcatcagagggcccctagggtctcgcaaggatcaaaagacccagctgagggcgatggggcccagcctgaggaaacacccagggatggcgacaagccagaggagactcaggggaaggcagagaaagatgagccaggagcctgggaggagacattcaaaactcactctgacagcaagccgtatggccccatgtctgtgggtttggacttctctctgccaggcatggagcatgtctatgggatccctgagcatgcagacaacctgaggctgaaggtcactgagggtggggagccatatcgcctctacaatttggatgtgttccagtatgagctgtacaacccaatggccttgtatgggtctgtgcctgtgctcctggcacacaaccctcatcgcgacttgggcatcttctggctcaatgctgcagagacctgggttgatatatcttccaacactgccgggaagaccctgtttgggaagatgatggactacctgcagggctctggggagaccccacagacagatgttcgctggatgtcagagactggcatcattgacgtcttcctgctgctggggccctccatctctgatgttttccggcaatatgctagtctcacaggaacccaggcgttgcccccactcttctccctcggctaccaccagagccgttggaactaccgggacgaggctgatgtgctggaagtggatcagggctttgatgatcacaacctgccctgtgatgtcatctggctagacattgaacatgctgatggcaagcggtatttcacctgggaccccagtcgcttccctcagccccgcaccatgcttgagcgcttggcttctaagaggcggaagctggtggccatcgtagacccccacatcaaggtggactccggctaccgagttcacgaggagctgcggaacctggggctgtatgttaaaacccgggatggctctgactatgagggctggtgctggccaggctcagctggttaccctgacttcactaatcccacgatgagggcctggtgggctaacatgttcagctatgacaattatgagggctcagctcccaacctctttgtctggaatgacatgaacgaaccatctgtgttcaatggtcctgaggtcaccatgctcaaggatgcccagcattatgggggctgggagcaccgggatgtgcataacatctatggcctttatgtgcacatggcgactgctgatgggctgagacagcgctctgggggcatggaacgcccctttgtcctggccagggccttcttcgctggctcccagcgctttggagccgtgtggacaggggacaacactgccgagtgggaccatttgaagatctctattcctatgtgtctcagcttggggctggtgggactttccttctgtggggcggatgtgggtggcttcttcaaaaacccagagccagagctgcttgtgcgctggtaccagatgggtgcttaccagccattcttccgggcacatgcccacttggacactgggcgacgagagccatggctgttaccatctcagcacaatgatataatccgagatgccttgggccagcgatattctttgctgcccttctggtacaccctcttatatcaggcccatcgggaaggcattcctgtcatgaggcccctgtgggtgcagtaccctcaggatgtgactaccttcaatatagatgatcagtacttgcttggggatgcgttgctggttcaccctgtatcagactctggagcccatggtgtccaggtctatctgcctggccaaggggaggtgtggtatgacattcaaagctaccagaagcatcatggtccccagaccctgtacctgcctgtaactctaagcagtatccctgtgttccagcgtggagggacaatcgtgcctcgatggatgcgagtgcggcggtcttcagaatgtatgaaggatgaccccatcactctctttgttgcacttagccctcagggtacagctcaaggagagctctttctggatgatgggcacacgttcaactatcagactcgccaagagttcctgctgcgtcgattctcattctctggcaacacccttgtctccagctcagcagaccctgaaggacactttgagacaccaatctggattgagcgggtggtgataataggggctggaaagccagcagctgtggtactccagacaaaaggatctccagaaagccgcctgtccttccagcatgaccctgagacctctgtgttggtcctgcgcaagcctggcatcaatgtggcatctgattggagtattcacctgcgataacccaagggatgtt

SEQ ID NO: 12216 - DNA, 4512 bp, Homo sapiens
ataatcaagacaaatttgccaaataaatcattgtagaaacgctagtttgggcctgaaaaattccaggagcaagagtcaagatttgtcactccatgagaatctggaggggactcccttcccagaaacttgacgatgaagtactggttgtaattttagaaagacacccaatcggcttttttaaaagatcgcccagggcccttgtcctgagagctgggagctggtcggagtgacagagaagccatggaagcagcagtgaaagaggaaataagtcttgaagatgaagctgtagataaaaacattttcagagactgtaacaagatcgcattttacaggcgtcagaaacagtggctttccaagaagtccacctatcaggcattattggattcagtcacaacagatgaagacagcaccaggttccaaatcatcaatgaagcaagtaaggttcctctcctggctgaaatttatggtatagaaggaaacattttcaggcttaaaattaatgaagagactcctctaaaacccagatttgaagttccggatgtcctcacaagcaagccaagcactgtaaggctgatttcatgctctggggacacaggcagtctgatattggcagatggaaaaggagacctgaagtgccatatcacagcaaacccattcaaggtagacttggtgtctgaagaagaggttgtgattagcataaattccctgggccaattatactttgagcatctacagattcttcacaaacaaagagctgctaaagaaaatgaggaggagacatcagtggacacctctcaggaaaatcaagaagatctgggcctgtgggaagagaaatttggaaaatttgtggatatcaaagctaatggcccttcttctattggtttggatttctccttgcatggatttgagcatctttatgggatcccacaacatgcagaatcacaccaacttaaaaatactggtgatggagatgcttaccgtctttataacctggatgtctatggataccaaatatatgataaaatgggcatttatggttcagtaccttatctcctggcccacaaactgggcagaactataggtattttctggctgaatgcctcggaaacactggtggagatcaatacagagcctgcagtagagtacacactgacccagatgggcccagttgctgctaaacaaaaggtcagatctcgcactcatgtgcactggatgtcagagagtggcatcattgatgtttttctgctgacaggacctacaccttctgatgtcttcaaacagtactcacaccttacaggcacacaagccatgccccctcttttctctttgggataccaccagtgccgctggaactatgaagatgagcaggatgtaaaagcagtggatgcagggtttgatgagcatgacattccttatgatgccatgtggctggacatagagcacactgagggcaagaggtacttcacctgggacaaaaacagattcccaaaccccaagaggatgcaagagctgctcaggagcaaaaagcgtaagcttgtggtcatcagtgatccccacatcaagattgatcctgactactcagtatatgtgaaggccaaagatcagggcttctttgtgaagaatcaggaaggggaagactttgaaggggtgtgttggccaggtctctcctcttacctggatttcaccaatcccaaggtcagagagtggtattcaagtctttttgctttccctgtttatcagggatctacggacatcctcttcctttggaatgacatgaatgagccttctgtctttagagggccagagcaaaccatgcagaagaatgccattcatcatggcaattgggagcacagagagctccacaacatctacggtttttatcatcaaatggctactgcagaaggactgataaaacgatctaaagggaaggagagaccctttgttcttacacgttctttctttgctggatcacaaaagtatggtgccgtgtggacaggcgacaacacagcagaatggagcaacttgaaaatttctatcccaatgttactcactctcagcattactgggatctctttttgcggagctgacataggcgggttcattgggaatccagagacagagctgctagtgcgttggtaccaggctggagcctaccagcccttcttccgtggccatgccaccatgaacaccaagcgacgagagccctggctctttggggaggaacacacccgactcatccgagaagccatcagagagcgctatggcctcctgccatattggtattctctgttctaccatgcacacgtggcttcccaacctgtcatgaggcctctgtgggtagagttccctgatgaactaaagacttttgatatggaagatgaatacatgctggggagtgcattattggttcatccagtcacagaaccaaaagccaccacagttgatgtgtttcttccaggatcaaatgaggtctggtatgactataagacatttgctcattgggaaggagggtgtactgtaaagatcccagtagccttggacactattccagtgtttcagcgaggtggaagtgtgataccaataaagacaactgtaggaaaatccacaggctggatgactgaatcctcctatggactccgggttgctctaagcactaagggttcttcagtgggtgagttatatcttgatgatggccattcattccaatacctccaccagaagcaatttttgcacaggaagttttcattctgttccagtgttctgatcaatagttttgctgaccagaggggtcattatcccagcaagtgtgtggtggagaagatcttggtcttaggcttcaggaaggagccatcttctgtgactacccactcatctgatggtaaagatcagcctgtggcttttacgtattgtgccaaaacatccatcctgagcctggagaagctctcactcaacattgccactgactgggaggtccgcatcatatgacaaagaactgcccctggtgatgtgagcagggacctgcctgcccctttcaacctttcccctcaccttttttgagatttttgctgcaatctgtttgccttccctgaatcaaaataatctttcattcgtcaccattatactaatgaacaatagatttcatgtttcaaaatttcagattttacatgttaagatgtactaacaatattccttgtatcaaacatctccttttctccctgatacatagccctgagacatttatagcgttcaggagtcttctattgcttccattccttcagcagggctgcgtgggtctgttttaacgtgggccaagcctacctgggcagcccatttgccagggcttgcctcaggccatgcagcattggcgctctggctgcagcagctgagttgctcaaggccagtgtccaagtggacagcagcctctggtactccccccagttatcttccacccacatggactgggcagagcagccctcttctgtgtgcactgcatacgctgcagccgtgggagttattctcccctagagatcgacttggcagcacgaaggattcttttctctttcatgcttctcaggctcaatagtttctaattaatcttaaaatccatgtcttttacattgtttttttaattaagtgctgtttactaaccaaataatatttataacatgagtaagctataattaataacaatgaaataaatacccatgtacccaccactggacttcagaagtagaactcatgactgggactaggatgaggcaagggagaccctggccttgggcacaaaatgtaagggatgccaaaaaaatacagtaatcaaagtaagtaatatttcaatccaatatttttaaaaatcagaattaatgcaaaaaaaaccatgatgaacaaaatattaaaatttaaaataaagacaggattagtattactgagttttccttttgtcccaggctctaatatggcttggcatggggcagaacattacaacataccagtcgtgtcatggtgcccaaggctccacagacctcagtggctccctgctgcctgccacagcatctgttttagcagcctcgactcctcagcactcctcagcacacacctcttcttatcaggcttcctccacttagcaacttgctaacggccacctctgtgccttctgatccctgggcgccaatatcctcctgcccttaccatccttccaggcccaacttaaatcccactttcccatgaagcctaactgcgtgaacacccctacccccatacccattagcagtgattttgcccttccccgtaatgctgtcccacttataactgtgctctacttagcattctcagggatcataccttaatgttttcagtatgtctgcgttctcctactagattgtatgtccctcaagagcatgttctgtttctcttctgtctgacagagcactattatacctgactttcagtaactgttagctgtgattagttagctggtggatttaattgattaaaaaattacgattgaatgta

SEQ ID NO: 12217 - DNA, 1437 bp, Homo sapiens
ataatcaagacaaatttgccaaataaatcattgtagaaacgctagtttgggcctgaaaaattccaggagcaagagtcaagatttgtcactccatgagaatctggaggggactcccttcccagaaacttgacgatgaagtactggttgtaattttagaaagacacccaatcggcttttttaaaagatcgcccagggcccttgtcctgagagctgggagctggtcggagtgacagagaagccatggaagcagcagtgaaagaggaaataagtcttgaagatgaagctgtagataaaaacattttcagagactgtaacaagatcgcattttacaggcgtcagaaacagtggctttccaagaagtccacctatcaggcattattggattcagtcacaacagatgaagacagcaccaggttccaaatcatcaatgaagcaagtaaggtcaggtgccaggaccagagcccaacaactctggatgccttcaaaggcaaagaaaccacagtccaggaggagacacaggatctcagcacaagacagcacctggctcaaaaggaagctgaggagcctgataaacaaggacaaattacctgggacatcagcaacgtagctcccaagactgagaactttgaggacctcttggaacaaactccatgctcagcctgtttgcaaggtttcaccagagacaacacttccagcagcttctccgaggatgcaggaatatctctgagcacctctgtgaagttaccccttgcctcttcatctaagcctaatgaaaatgaagctttgcccaaccagccaccttctcagcagataaggcacaactaccgcttattagccagtactgtgtctgcagaaatggccaggaacaggcagctaatttgggaactggccagacaatcagaagcacacctggacaggccagttgtccttggggaacaggccagtgcccagcgtgaggttgccagtattctttgtagaaaatcagtgcttgcaataaaccaactggctgcaactgtagaagggacaattagtgtcctacagcaatttaatgaactattagaccatcctctggatcccgggaggtcttgatcacagctggtagaggtggccactcactgttctatgtcttttaggttaacagttctttacataacagtgaagagtcctggtgcctcaggaaaagcaagatcaacctaccaaggaagagttgatggagtcataattttcctacttaacacccactgcaaatttaaatatgtgttctagggctgtttgttaattctattatggtctttactaattgtgattcccagttctgggtgaataaaaagtttttgttttaatgtaattgtgatcaacactatgcttgaagacatagacaaagctatttctaccaccatgatgtttacaaaatatctggtattttcgcctatatgg

SEQ ID NO: 12218 - DNA, 1937 bp, Homo sapiens
tccctccgctccagttcgtcggggcgggcgcggcggcggcggcgaaggaggagcgcggccggggcgatgcggcgctacctgcgcgtcgtggtgctgtgtgtggcctgcggcttctgctcgctcctttacgctttcagccagctcgccgtgtccctggaagaaggaacgggcggcggtggcgggaagccgcaggccgcggtggcttcctggctcgcgggcggcggacgcggcgccgtgagaggcgccggcgtcgcgggccccgcagcgcatcccggcgtgtcggacaggtacagtctgaaaatacagcctgttgagaaaatgcatctagctgtagttgcctgtggtgaaagactggaagaaactatgaccatgttgaagtcagctatcattttcagcatcaaacctcttcaattccatatttttgctgaagatcagctacatcatagctttaaaggcagacttgacaactggtcatttctacaaacatttaattatacgttataccccataacctttccaagtgagaatgcagcagagtggaaaaaactctttaaaccatgtgcttcgcagagattgttcttgccgttaatcctgaaagaagttgactcactattgtatgtcgacactgatatcctttttttacgaccagttgatgatatttggtctttactaaagaaatttaattccacacaaattgctgcaatggcaccagaacatgaggaacctcgaataggatggtataatcgctttgctaggcatccatattatggaaaaactggagtaaactctggagttatgttgatgaacatgactcgaatgagaaggaagtatttcaagaatgatatgacaactgtacgactacaatggggagatatacttatgccattgcttaaaaaatacaaactaaacatcacatggggtgatcaagatctattgaatatcgtgttttttcataatccagaaagcctttttgtttttccgtgtcaatggaattatcgaccagatcattgtatatatggaagcaattgccaagaagcagaagaaggaggaatctttattcttcatgggaacagaggtgtttaccatgacgataagcaaccagcatttagagctgtttatgaagcactgagaaattgttcttttgaagatgacaacatccgttccttattaaaacctttagaactggaactacaaaaaacagtgcatacatactgtggaaaaatttacaaaatatttatcaaacaactagcaaaaagtgtaagagatcgttatgccagatcaccaaaggaaaagtgattcttggtgactgcttaatcaaatggatgaaaacaaagaatcagaagataagtgtgaaggaatcgtcttggatgaagtattcaggaaggaattactcatctccagaataattttttttttcctaaagaagttaagtaagcagtattttcaggtaatgaagaataagttaaaatcttgggcctcaacattgaacattttttatctctgatgttttgtaatgttacttgctatcattccagtattgatgaaaatactattgaatgggtttaacctgcagacttctgttgactcatactctcaagagtggtaggggtgtgtagatggagaaaatgtacctcaaacagtgccaacactcaagactgtgagtagagcaataattttatgtcagcactaacctcactttaaaagtgtgagaaaaaagtttgtttacaggagcagaaacaggtctgttgtttctgaagaaatgtgatgtaactgatgtaaccattgacaatctatgtgtgcctttatacatttcatctctgttttaaaatatttttatgacaatcatgtttaaaattatttttagattacaagtaagctgcatgttaaaaattgagctgtgtaaggtagaggaaaaatagtgaaaactttgggatttt

SEQ ID NO: 12219 - DNA, 7497 bp, Homo sapiens
gcggcagaggcggtgtccaggcttccgggcgggtagtccttcggctccggagccgcgactgcgctcgcctaggtggtgggcggggagggaaggaagggagcgggcgcaaggcggcggcggcggctgcgggtgaggaacttgttgcgcccgcggctgcgcggtgcccctccctccgctccagttcgtcggggcgggcgcggcggcggcggcgaaggaggagcgcggccggggcgatgcggcgctacctgcgcgtcgtggtgctgtgtgtggcctgcggcttctgctcgctcctttacgctttcagccagctcgccgtgtccctggaagaaggaacgggcggcggtggcgggaagccgcaggccgcggtggcttcctggctcgcgggcggcggacgcggcgccgtgagaggcgccggcgtcgcgggccccgcagcgcatcccggcgtgtcggacaggtgtaaagatttctctctgtgttactggaatccctattggatgctgccctctgatgtttgtggaatgaactgcttttgggaagcggcttttaggtacagtctgaaaatacagcctgttgagaaaatgcatctagctgtagttgcctgtggtgaaagactggaagaaactatgaccatgttgaagtcagctatcattttcagcatcaaacctcttcaattccatatttttgctgaagatcagctacatcatagctttaaaggcagacttgacaactggtcatttctacaaacatttaattatacgttataccccataacctttccaagtgagaatgcagcagagtggaaaaaactctttaaaccatgtgcttcgcagagattgttcttgccgttaatcctgaaagaagttgactcactattgtatgtcgacactgatatcctttttttacgaccagttgatgatatttggtctttactaaagaaatttaattccacacaaattgctgcaatggcaccagaacatgaggaacctcgaataggatggtataatcgctttgctaggcatccatattatggaaaaactggagtaaactctggagttatgttgatgaacatgactcgaatgagaaggaagtatttcaagaatgatatgacaactgtacgactacaatggggagatatacttatgccattgcttaaaaaatacaaactaaacatcacatggggtgatcaagatctattgaatatcgtgttttttcataatccagaaagcctttttgtttttccgtgtcaatggaattatcgaccagatcattgtatatatggaagcaattgccaagaagcagaagaaggaggaatctttattcttcatgggaacagaggtgtttaccatgacgataagcaaccagcatttagagctgtttatgaagcactgagaaattgttcttttgaagatgacaacatccgttccttattaaaacctttagaactggaactacaaaaaacagtgcatacatactgtggaaaaatttacaaaatatttatcaaacaactagcaaaaagtgtaagagatcgttatgccagatcaccaaaggaaaagtgattcttggtgactgcttaatcaaatggatgaaaacaaagaatcagaagataagtgtgaaggaatcgtcttggatgaagtattcaggaaggaattactcatctccagaataattttttttttcctaaagaagttaagtaagcagtattttcaggtaatgaagaataagttaaaatcttgggcctcaacattgaacattttttatctctgatgttttgtaatgttacttgctatcattccagtattgatgaaaatactattgaatgggtttaacctgcagacttctgttgactcatactctcaagagtggtaggggtgtgtagatggagaaaatgtacctcaaacagtgccaacactcaagactgtgagtagagcaataattttatgtcagcactaacctcactttaaaagtgtgagaaaaaagtttgtttacaggagcagaaacaggtctgttgtttctgaagaaatgtgatgtaactgatgtaaccattgacaatctatgtgtgcctttatacatttcatctctgttttaaaatatttttatgacaatcatgtttaaaattatttttagattacaagtaagctgcatgttaaaaattgagctgtgtaaggtagaggaaaaatagtgaaaactttgggattttaatctgtgtgtgcgtgtttgtgtgtgagagagagtgagaaatgtagtgtttcattttgtatgcattaaactgtcttgccaaaactcagatctaagattgttaaatagatatttggggaatttttttttaatcactttaaatgaaaaacgtcagctttactgggcattctggaagcaaaatatattatgctgatggtaaagtgagaaccttaagagtatactcatgatggtggaaagtgtgatggaccaaaatgcataagctatatacttcctgtgagtagtaattttagttacaatggagtagaaaaatatggtccatttaaacttgtcttctacctcataacggccttgcaagatacttttgaagaagcaaatgtctagagccttactttaagtaagttaaacaacttaagtggatgatttggaataagattgttacatccagctgtagaaaatgtggttttaattgggttgatgtgcatttttgaatatcacctaagacagttaatttttttaaatcttgagaaattacttctttggcattcttgacctgttagctaatataactatagattctgaatacttagcatatactatgctggggcacatatcttattttaccaacaatatgattatctatatggttatcttctttttctccctgatattttaatgctcaagtagaaaatggaaaatcatgaaggaaaaatacaacctgtgaaaattgtggcagttagctttgtgaagacacagtgacctctgtggagacatggaatatgcagaaagagatggttagtacagttgttctgtcgtctgcagttcagtcagggacaaattgagagaggaaagtttaagcagggtgcattagaagttgataaccagtccagcattcttagaacagatgggtttagagaacacgagttgtagttccttggcagaatgccatggtgaatataagaaactgtgaaattgagcttactgagtagaaaatgagaatactaaaaatgtgaagtttggagggtatgtattagatcatttctaatggtcctcaaataatgatcattgcctgcctgactatgtaagattcttgttgggagcttaagaatagattcctgagctaggcctttggagactctggcatgctgtgtctaggagggagtctgtaaaacaatttttaatgaagaaatttaaaaattacacaaaactagaatagtgcattggtactcaacatccagatctgacacttatcactatcttaccatgtttgcttcatttgtcatttttttgtttgcttaagtatcttaaaatcccatacattgtgttatttcactgctgtgaacactttgggtagataccacgatatcacacctaacagaggcagcagcagtccttcggcttcatctcatagccagtccttaagcaaatttccctgattatctcaaaaatcatcttctagttggtttgttagaatcaacagaatataagtcacatgatgatttcgtttttaacaatcacctcagatgactttgatgttagctactttgagaaccactggaaattattttgccaacttgaaagttcaagttaggataccacaattcttggcacgtttggtggattataaatgtgattttgaaatattagaggaagcatttggggttaatgacaggatatgaatttatattagtaagtttgataagataaaatttcctcagtgaacggagaatctcagccccatgggctctaattgattgggacttgtgtagagcgtggtcacagtttaatccaactggactgtatgctgtggtctcactcatgttgtggcttatttacactgtcacacacactacattgtggatcagttggaaggttcttcatctggtttatttagacctgacctaattgatcattttaccataaattgaattatagtgaaaactgtcttttgggtactgtttctacctaaaattaaaggtatcacaaaatatgtataataatttttaaatgaattttctgaatttatctttagacaaggtaattcttttgaattctaaagaaatgcagttcttggagttgatgagaggttaaattatagatggacaacttagagaacgtattccatcttcatataaatggtctttcataaaacatagtgtatctatgcagtttatataaactacatgatttattatttgagtctatgtattctgacctcagaactatctctgggctacagtattaccaaagtgggatgcctttaaaatgcagtcaaacttcatttgtatgaagtagaaaagaacttgggaaacctttaaaaatatatattgtgatttatgctttaagaaaatgcatacttttttctaatgaagagtagttcataatatataagggttttaaggccctgaaataacattagtgcttactcattgctctctcatcttgcctccagtcagatgttattggtatagtgaaaagaagaccagattttgaactagatctggattctctttttagtaactcaggcatgttatttacccttctctgtgccttaggtttttaagtacaatcagtgtacccttcaaacctcacaagatgaaactcagaagagataatggatttggaagcattttgcgtggcttatattatgccacgccagtgttactgttgaagttctgttttgttcgttgttttctgtacagagcgttcagtttactcaggctgaatgttttctgacatatatctccagtatgaatttgtttatgtaaggaagagtttttcaggaagagaaagtagagaagaaaagaatgatgtaactaaatcaaaaaagaaggaaaagagaggaagtgagaaaaggggtgaggaaagagaaaggagtaagaatggggatggcaaagggcagagtaagagaaaagatggaatgagtgtatggaaaattgagaagtagagatggagagaaatggtgtggaaacatttactttttgagttgtagccctcacactacatcagtttgcttgcctgggctctctggggtcaggaaaggtgctgacttccatggaatggggcagcagggcctgctgtatttggtttgttagtactagagttgtttcccaatcaccctactcactgatcatttagtgccaattcaacattttatgtcttttttttttagtggatcccagtttgtgagctaggacctgtggaaatacaagtatcttcctttttaactttattgttttagccatcccaagtgttagactgcaagactaactacatattccccagtggaggttggaagtggaggggactgcttcattaggtctgaagggggccaaggaatgtgttgcagcagttttcgcagatgatactgacgagaggccaggtttgggaatcactgccctgccttggatggcaaattaagcaataaattacacctatttattcctcagttgggatactttcagttgaaccattctgagtagatttaagagaacaaaagacagcagaaataccttaaaagatattattggctgtcttatttttcagatatttgtatttaataaataccttagtagtagtcagaacctctttgagatgtttttagaaagaccactgatttgttttttaaaataatttttttggttccttagagtagagaagaaaagtaggggtgcaatatgtcaggtgtggggccagttatccatttattaaatgcaatttcaagtgtcttaaaaacaataattgccttattgcattttaatatttaataaagtagattaaataaagatttgtattataacagttattcttttatccattgccaaagcaacccttttttgcctattaaaatctggctaaactgttctgatgttgtttcttaattcattaaacatgaaactaggttttacaaactaaattatataaagacagaagtctaaaaatggtaccagaaaatttttttttaaaaaattaatgtgttattcaaatatccagcaattaaagactcatgagaaaaacagaatagcatattagatgtaacagtttaaaatggattgcaaatcaatgtcagacttaaatagaaaatatttattatcacctcatttctaccaataatttcagatgtttaatgggactttgaaaagataggaaaaaatagaaatgaaaatttatctcacctttaatactgtgaatactatttggagggtccctggtcagacatttaaatatcaaacttaagaactgacatggagcctttgattagtttatatacaggatctgaatatttacacacatagcacactatagcaacctcttgtaaaaaatcatgaagatagaattcaacagtgtatattctattaaaaagtaaattggctgggtgtggtggctcatgcatgtaatcccagcactttgggaggccgaggcaggaggatcgcttgagcccaagagtttgagaccagcctaggtgacaaagtgagaccccatctctacaaaaaaattaaaaaattatccagatgtggtggtgtttgcctgcggtcctagctacacaggaagttgaggcaggaggattgcttgagtgcaagagtttgaggctgcagagagccaagattgcaccattgcactccagcctgggtgacagagcgagaccctgtctcaaaaaataaaggaaattggctttgactatgaaaaacagccattttcaacctttttataaaacctcttcagggaatattggaatattatttttgtcaggcaaaaataatccagggcttgagcattgctgtagaatatgttatctgttcaaaacttagcagagcacgcatgcatcacatgcattgtcatcagtatttgagagctgaaccaatggtttttgatggttgccgtaacagaagatctgtgaagaggatggtggtttgcacctgttcctgaagtcaaactggaaaaggttgcaggtatttcaattttctcaatcattttgcataaatgtattaatattttgagtagtaatagttctaaacctgcaggaaggcatcattgtatactgtggtatgtagagaatactactcttacactgctctttatcttaaaatgttttggtatactgtgaatattttcctctaagtatttggtgtattttgacagttattaaaggagaatataaaattaaagattctggtctaaactaagaataatggaaagttgcttcgtcctgccttagaggagttttcagttcatcctcttcttgagaaactatgtgttgctgttactaaataaacatttactcaataaacgttttatttcctcaaa

SEQ ID NO: 12220 - DNA, 3260 bp, Homo sapiens
gtcgccgccgccgccggccgcccgccggccgccacgaccccagtccccggcgggcgggcggaggaggcgaccgccgcgcgctgctgcactcatcctgccgccgccgcgatgcgcagaggggccgagccgcctgggggccgccgccgccgccgcgccgcaccatgaagctccgcagcaaggcggcggcgctgctcttgctcgcgctggccgcgctgctgctggcgctgctgtccctgcgcgctggccgcgctgagcccccagcgctgcccgcgcgccccgcgtccgccccgcagcgccaccccgcgcctgtccccgcgcgctggccggggccgggcgccctccccggggccagcccgggagttcggaggcgccggcccccgcgtccgcgcccccgagcgggccgccggggcgctgcgagactggagaagttggcgaggaggcctggagaacccaggagtttccaagctgtgctgccacccgagctctggatccacctggctgtggtggcctgtggcaatcggctggaggagacgctggtcatgctcaaatcagctgtgctttttagccacaggaagatccaattccacatcttcactgaagactctctgaagcccgagtttgataagcagttacgccagtggcctgactcatatacaaagaagtttgagcacagaatctaccccatcacattttctgttggaaaccctcaggagtggaagaaattgttcaaaccctgtgctgcccagagactctttcttccggtgattttaaaggatgtggactcacttctctacgtggacaccgatgtcctctttctgagacctgttgatgacatctggaagcttctgaggctgtttaattccacccagcttgcagccatggcccctgagcacgaaatccccaagattggctggtacagccgctttgctaggcatcctttctatggctctgcaggagttaattcaggagtcatgttaatgaatttaactcggataagaagtacccagttcaagaacagcatgattccaacaggcctggcttgggaggacatgttgtaccctctgtaccagaagtacaagaatgccatcacgtggggagaccaggatttattaaatattattttttatttcaacccagagtgtctctatgtattcccctgccagtggaactaccgtcccgatcactgcatgtacggaagcaactgcagagaggctgagcatgaaggtgtgtctgttctgcatggaaaccgaggcgtctaccatgacgataagcaaccaacgttcagagcactctatgaagcaatacgggattttccctttcaagacaatctctttcaatccatgtattacccccttcagctgaagtttttggagactgtgcacactttatgtggacgaatcccgcaagtttttctgaagcaaattgagaaaacaatgaaaagggcttatgagaaacacgtcatcatccatgttggccccaaccagatgcactgaatattttgtcttgttgcaagtcaattaggtgtcttgtgaccaaggaaatactaatctctaagctgcctgggtctttttgtgtgaatatttaatggtgctccatgactgttgagttttaaaaacctcgttaaattttgccaaatcagttgcccccaaaagggaatatgcttttccttatttttttttctaaaatgctatttatctctaaggaaaaaaaaaaaagactattactcatttaacattgtttaagcaggttgagctagctgtgaaaatagcttttgtgagccttctaattcctaaacgtctgagaccatttcagtggcacctgaggtgttatattgatctagcattcctgagactctttctatgcaactgactcccccacacccgtgttataaaagtaatacacacttttgaaacagagagacacacttgtagagcatatgggtcaagggctcaacatcaagattagattagccataatcctattgaccagtggaaaagattgtttccattttaaagcagttccttacaaccttttttctctacttttgcattttccactctaacacacatctaaaacaggtaatctcagtaaaagctggcctttttgctgagatttttatgtgggagactaaaatattagatgagatgattatgtgtacagaattttatttaaaatacatctgagagaatcattcagatacttgggtagtgttaaaggatgaagcatgtatctgggggtatttcttctttttctttctttctttttttttttttttttttttttgagacggaatctcactctgtagcccaggctagaatgcagtggcaggatctcggctcactgcagcttccacctcctgggttcaagtgattctcatgcctcagcctccccagtagctgggattacaagtgtgtgccaccacacccggctaatttttgtatttttagtagagacacggttttaccatgttggccaggctggtcttgatctccagacctcaagtgatctgcctgcctcagcctcccaaagtgctgggattacaagtgtgagccactgcactcagccaatctgggagtatttctaaagaaaaaaattactttgatttgtggaggactaaatcataatacatttctatgcaacaatagcttctgagaggaaattcaggaatgtttgtgtttaccacagacaaaaacatttgatctgttaatcatcagtagctgtggtcatctctctttcttaaactcttgggcaatgggtggaaatcagagaccaacttcaaatttaatgtgtaaaaaacaaatagttcagctgcttctattggtaagaaaattcaacttcctaccagccttagaaaggtctctttaaacaatttctttccccctagggttacctagctggtccatacaggttttatcacctcactgcaaggaggaagttgaatattctgttccccacggggatctggcttaatccctagttgctcatatagttggtatcagcatagcaatattttgcataatgctttatttttctcaaatgactattgcatagatgatcttgatatttgcaacagcctagtggatttggtagggtcctgaatcatctctataaggcaaacaaggaaattgtaacacaaagaaataaacatattgaatataattgctattctgtaagacatacagtctgtgtaagatgtatcttatttacagagacatttttgaaaattaaaatattaaatactttttgttatatagagacaa

SEQ ID NO: 12221 - DNA, 5037 bp, Homo sapiens
cacacaagcgcttccttgccgagaggctggagctgcggcaccgcaggcctgagccaccccttctctgctgtctccttctcttcctcagggctcccgtgtctgctcgccctccgacgctgctcaggaatttgacaagaaactgaagttttgattcagatatattttgaattgaaaccagagatgttctagagtttagattctttcatttgattaaggtatggtctgaatatgcgttgcttggcagctcgggtcaactataagactttgattattatctgcgcactcttcactttggtcacagtacttttgtggaataagtgttccagtgacaaagcaatccagtttccacggcgttcgagtagtggcttcagagtggatgggtttgaaaaaagagcagcagcatctgagagtaacaactatatgaaccacgtggccaaacaacagtctgaggaagcattccctcaggaacagcagaaagcaccccctgttgttgggggcttcaatagcaatgtgggaagtaaggtgttagggctcaaatatgaagaaattgactgtctcataaatgatgaacacacaattaaagggagacgagaggggaacgaagtctttcttccattcacttgggttgagaaatattttgatgtttatggaaaggtggttcagtatgatggctatgatcggtttgaattctctcatagctattccaaagtctatgcacagagagccccctatcaccccgatggtgtgtttatgtcttttgaaggctacaatgtggaagtccgagacagagtcaagtgcataagtggggttgaaggtgtgccattatctacacaatggggacctcaaggctatttctatccaatccagattgcacagtatggattaagtcattacagcaagaatctaactgagaaacctcctcacatagaggtatatgaaacagcagaagacagagacaaaaacaagcctaatgactggactgtgccaaagggctgctttatggcgaatgtggctgataagtctagattcaccaatgtcaaacagtttattgcaccagaaaccagtgaaggtgtatccttgcaactgggaaacacaaaagattttattatttcatttgacctcaagttcttgacaaatggaagtgtgtccgtggttctagagaccacagaaaagaatcagctcttcactatacattatgtctcaaatgctcagctaattgcttttaaagaaagagatatatactatggcattgggcccagaacttcatggagcacagttaccagggacctggtcactgacctcaggaaaggagtgggtctttcaaacacaaaagctgtcaagccaaccaaaataatgcccaagaaggtggttaggttgattgcaaaaggtaagggattcctcgacaacattaccatctctaccacagcccacatggctgcattttttgctgctagtgattggctagtaaggaaccaggatgagaaaggtggctggccaattatggtgacccgtaagttaggggaagggttcaagtctttagagccaggatggtattctgccatggcccaagggcaagccatttctacattagtcagggcctatctgttaacaaaagaccatatattcctcaattcagctttaagggcaacagccccttataagtttctatctgagcagcatggagttaaagctgtgtttatgaataaacatgactggtatgaagaatatccaaccacacctagctcttttgttttaaatggctttatgtattctttaattgggctgtatgacttaaaagaaactgcaggggaaaaactcggaaaagaagcaaggtccttgtatgagcgtggcatggaatctcttaaagccatgctgcccttgtatgacactggctcaggaaccatctatgacctccgtcacttcatgcttggcatcgctcctaacctggctcgctgggactatcataccacccacatcaatcagttgcagctactcagtaccattgatgagtccccagtcttcaaagaatttgtcaagaggtggaaaagctaccttaaaggcagcagggcaaagcacaactagagctcacaaccaaaactgcacttcagcctctgctgtacacagaaactacaggctctgtctcaggagagcataggcacattttaaaaggttatgtactaggtttttgtggattctatcaaagtgataagtgatccttaaaaccagccttctaaaataattgcattccatgggttgggtatttagaaatgtaggtggcatttagaacacaatgtttaatcaatgggctgaacaaagatgcttcactttgccttgcccatcaccctatacagtttcgcagatagtctagtcactctatgtgagaaagataatggtaagtagttgctactggccaactgtctagcacttacctgaaaacttagtatggagctcttttaaaatgtgattatttatatttatgttgaaagcggactttaaaaaaaataatgtgctgtaacacagtaaatatgtacttgtagcctggatagcagactgtgttcaactttttaaaaagatgtttcctttctaaagattaatttcttgggagcaaatgagtatttgttgcatttgttcaatttgttgtatatggtgaatatttaattatggttttcttgaaacgtgtaaattaaaaacacaatcagtgttcaggcttcagttatataatgtaagcacaactaaaatgaaacttgttgactgcacaagaaattacaaaaatgtttctgttttgaaacttgatctacaatcagtaaaagtttgataatcagtatatcccttcccaacccccattgtgacagtttctttttgtcactgtctagaattttgtattttatttcagactataccttggagttttgtatattttgagagagatatttttgggacattattttggaaacttattacaaatctaaatttggaaaggagctagtagctttaaggccaccaccatattttacttttttaggatttttccccctttaaataaaaatattagatcaaatactatatgcaagaaatcatagcaaagtttttttttcctaccaagatcattcttgatcatcagcttcccaaactagtaagtctgtgcatcattgggtgtttttttttaatttaattttaaattatcccagctattagatagaagggatgttactgcacttatgtgtaatcagatctttatttaggtatacatatcctcctataccgcacataaatagatttcagagcccccatacaatgggcagtgtctgctatagggcttcaggcattaaataaaaccgagggttgttgattttgctgtgacagtacactaaatcaatactatatcttatacagtttgaaaatatgataccctacactttcaggggaccgagtctgacaaacacaatacatttatctgtgacctatatcaagtacacatttaggagccaggtaggttacctgcttacacactatattttaattgaattcaaactatcaagcactacttagaaactggaaaacatatatatgttagcatcaaagggggcagaagcaaagaagatacagatctgcactgaagacattagactggccatagaaaagtaagcttgaactcccaattgatgtgaccacactcttcttaattttgttcacagtaaaaacacttttttgagttattaggcttacccctagcttttgacctttgcatttcatatatgttagatgtctcagcaagaatatctggtctcccctaatttttattcccagtgccgatgttcaaaataaactttctccagtctgggaaccttttttacttccccatatttgttattatttagaatggttcatacgtctgctttgtttgcatactggtcttcagattatgagactcgatgataacagtatggtactgcttctgtgacaaatatcgtgccttaacaatgtggctgtccttttccactgaagaaggaaagacgttttgatctagaaatagcgttgtgatttccttgctgttggttttacactgccttccacattgcaacagcaagttgatttcttgtgatcccagaattttctaagaggatgagttgaatctatagcagcattgtcagtacagaccagtggttctcaaactttaaaatgcctcagcatcacttgggagcttattgaaatgcagatcccagagtcagtaaatctgcctgtgaagtatgatagtctgcatttgtaatgagcattcaagtgattctgatgcaggtgagctgggggcatacagggaggaacactgccctggactatccattgcatttttgcctctaaacaactacagaattttctagggttttaaattatgtaaaatgtttacttattctgagcttagagagaatggggagggtatttttaaattttattgttttatttctttaagtttttctttgctttaagattataggtattaggtttgtttttgtttttccacttatcttgagttcactttgatgttaaatctattgctacttcagttgtaaaaccagccaaaagtttctggatgaaggtcaagtttgaccttttaggagttattgtacataaaggcttcatccacgaaccatccagcgcacagaagcaagtgcaaaaatgacacaagcacaactctccagacgtggctccttctcctttctcagtgcagactctcactgaaagctgctattttcatcctccttgtggttgcttttcttgtttctcttccattgtacatgtgggttatataccatatgttaaatatgcaataaagtgtttacaggatgcccttctgaagggtagtcctttgtaaagctgtacagactttgcagtttaagcacaatgtgcacatgttagttttatatacagcaaaacttgattttttgcagatggaaaggtattttgtttctatacaaagtaaatggattgtttgtgcttaatgtaaagccgctttataaaactgtaaaataaagtttttttctt

SEQ ID NO: 12222 - DNA, 4828 bp, Homo sapiens
gtatggtctgaatatgcgttgcttggcagctcgggtcaactataagactttgattattatctgcgcactcttcactttggtcacagtacttttgtggaataagtgttccagtgacaaagcaatccagtttccacggcgttcgagtagtggcttcagagtggatgggtttgaaaaaagagcagcagcatctgagagtaacaactatatgaaccacgtggccaaacaacagtctgaggaagcattccctcaggaacagcagaaagcaccccctgttgttgggggcttcaatagcaatgtgggaagtaaggtgttagggctcaaatatgaagaaattgactgtctcataaatgatgaacacacaattaaagggagacgagaggggaacgaagtctttcttccattcacttgggttgagaaatattttgatgtttatggaaaggtggttcagtatgatggctatgatcggtttgaattctctcatagctattccaaagtctatgcacagagagccccctatcaccccgatggtgtgtttatgtcttttgaaggctacaatgtggaagtccgagacagagtcaagtgcataagtggggttgaaggtgtgccattatctacacaatggggacctcaaggctatttctatccaatccagattgcacagtatggattaagtcattacagcaagaatctaactgagaaacctcctcacatagaggtatatgaaacagcagaagacagagacaaaaacaagcctaatgactggactgtgccaaagggctgctttatggcgaatgtggctgataagtctagattcaccaatgtcaaacagtttattgcaccagaaaccagtgaaggtgtatccttgcaactgggaaacacaaaagattttattatttcatttgacctcaagttcttgacaaatggaagtgtgtccgtggttctagagaccacagaaaagaatcagctcttcactatacattatgtctcaaatgctcagctaattgcttttaaagaaagagatatatactatggcattgggcccagaacttcatggagcacagttaccagggacctggtcactgacctcaggaaaggagtgggtctttcaaacacaaaagctgtcaagccaaccaaaataatgcccaagaaggtggttaggttgattgcaaaaggtaagggattcctcgacaacattaccatctctaccacagcccacatggctgcattttttgctgctagtgattggctagtaaggaaccaggatgagaaaggtggctggccaattatggtgacccgtaagttaggggaagggttcaagtctttagagccaggatggtattctgccatggcccaagggcaagccatttctacattagtcagggcctatctgttaacaaaagaccatatattcctcaattcagctttaagggcaacagccccttataagtttctatctgagcagcatggagttaaagctgtgtttatgaataaacatgactggtatgaagaatatccaaccacacctagctcttttgttttaaatggctttatgtattctttaattgggctgtatgacttaaaagaaactgcaggggaaaaactcggaaaagaagcaaggtccttgtatgagcgtggcatggaatctcttaaagccatgctgcccttgtatgacactggctcaggaaccatctatgacctccgtcacttcatgcttggcatcgctcctaacctggctcgctgggactatcataccacccacatcaatcagttgcagctactcagtaccattgatgagtccccagtcttcaaagaatttgtcaagaggtggaaaagctaccttaaaggcagcagggcaaagcacaactagagctcacaaccaaaactgcacttcagcctctgctgtacacagaaactacaggctctgtctcaggagagcataggcacattttaaaaggttatgtactaggtttttgtggattctatcaaagtgataagtgatccttaaaaccagccttctaaaataattgcattccatgggttgggtatttagaaatgtaggtggcatttagaacacaatgtttaatcaatgggctgaacaaagatgcttcactttgccttgcccatcaccctatacagtttcgcagatagtctagtcactctatgtgagaaagataatggtaagtagttgctactggccaactgtctagcacttacctgaaaacttagtatggagctcttttaaaatgtgattatttatatttatgttgaaagcggactttaaaaaaaataatgtgctgtaacacagtaaatatgtacttgtagcctggatagcagactgtgttcaactttttaaaaagatgtttcctttctaaagattaatttcttgggagcaaatgagtatttgttgcatttgttcaatttgttgtatatggtgaatatttaattatggttttcttgaaacgtgtaaattaaaaacacaatcagtgttcaggcttcagttatataatgtaagcacaactaaaatgaaacttgttgactgcacaagaaattacaaaaatgtttctgttttgaaacttgatctacaatcagtaaaagtttgataatcagtatatcccttcccaacccccattgtgacagtttctttttgtcactgtctagaattttgtattttatttcagactataccttggagttttgtatattttgagagagatatttttgggacattattttggaaacttattacaaatctaaatttggaaaggagctagtagctttaaggccaccaccatattttacttttttaggatttttccccctttaaataaaaatattagatcaaatactatatgcaagaaatcatagcaaagtttttttttcctaccaagatcattcttgatcatcagcttcccaaactagtaagtctgtgcatcattgggtgtttttttttaatttaattttaaattatcccagctattagatagaagggatgttactgcacttatgtgtaatcagatctttatttaggtatacatatcctcctataccgcacataaatagatttcagagcccccatacaatgggcagtgtctgctatagggcttcaggcattaaataaaaccgagggttgttgattttgctgtgacagtacactaaatcaatactatatcttatacagtttgaaaatatgataccctacactttcaggggaccgagtctgacaaacacaatacatttatctgtgacctatatcaagtacacatttaggagccaggtaggttacctgcttacacactatattttaattgaattcaaactatcaagcactacttagaaactggaaaacatatatatgttagcatcaaagggggcagaagcaaagaagatacagatctgcactgaagacattagactggccatagaaaagtaagcttgaactcccaattgatgtgaccacactcttcttaattttgttcacagtaaaaacacttttttgagttattaggcttacccctagcttttgacctttgcatttcatatatgttagatgtctcagcaagaatatctggtctcccctaatttttattcccagtgccgatgttcaaaataaactttctccagtctgggaaccttttttacttccccatatttgttattatttagaatggttcatacgtctgctttgtttgcatactggtcttcagattatgagactcgatgataacagtatggtactgcttctgtgacaaatatcgtgccttaacaatgtggctgtccttttccactgaagaaggaaagacgttttgatctagaaatagcgttgtgatttccttgctgttggttttacactgccttccacattgcaacagcaagttgatttcttgtgatcccagaattttctaagaggatgagttgaatctatagcagcattgtcagtacagaccagtggttctcaaactttaaaatgcctcagcatcacttgggagcttattgaaatgcagatcccagagtcagtaaatctgcctgtgaagtatgatagtctgcatttgtaatgagcattcaagtgattctgatgcaggtgagctgggggcatacagggaggaacactgccctggactatccattgcatttttgcctctaaacaactacagaattttctagggttttaaattatgtaaaatgtttacttattctgagcttagagagaatggggagggtatttttaaattttattgttttatttctttaagtttttctttgctttaagattataggtattaggtttgtttttgtttttccacttatcttgagttcactttgatgttaaatctattgctacttcagttgtaaaaccagccaaaagtttctggatgaaggtcaagtttgaccttttaggagttattgtacataaaggcttcatccacgaaccatccagcgcacagaagcaagtgcaaaaatgacacaagcacaactctccagacgtggctccttctcctttctcagtgcagactctcactgaaagctgctattttcatcctccttgtggttgcttttcttgtttctcttccattgtacatgtgggttatataccatatgttaaatatgcaataaagtgtttacaggatgcccttctgaagggtagtcctttgtaaagctgtacagactttgcagtttaagcacaatgtgcacatgttagttttatatacagcaaaacttgattttttgcagatggaaaggtattttgtttctatacaaagtaaatggattgtttgtgcttaatgtaaagccgctttataaaactgtaaaataaagtttttttcttaaaaag

SEQ ID NO: 12223 - DNA, 2300 bp, Homo sapiens
gtcctcaaccaagatggcgcggatggcttcaggcgcatcacgacaccggcgcgtcacgcgacccgccctacgggcacctcccgcgcttttcttagcgccgcagacggtggccgagcgggggaccgggaagcatggcccgggggtcggcggttgcctgggcggcgctcgggccgttgttgtggggctgcgcgctggggctgcagggcgggatgctgtacccccaggagagcccgtcgcgggagtgcaaggagctggacggcctctggagcttccgcgccgacttctctgacaaccgacgccggggcttcgaggagcagtggtaccggcggccgctgtgggagtcaggccccaccgtggacatgccagttccctccagcttcaatgacatcagccaggactggcgtctgcggcattttgtcggctgggtgtggtacgaacgggaggtgatcctgccggagcgatggacccaggacctgcgcacaagagtggtgctgaggattggcagtgcccattcctatgccatcgtgtgggtgaatggggtcgacacgctagagcatgaggggggctacctccccttcgaggccgacatcagcaacctggtccaggtggggcccctgccctcccggctccgaatcactatcgccatcaacaacacactcacccccaccaccctgccaccagggaccatccaatacctgactgacacctccaagtatcccaagggttactttgtccagaacacatattttgactttttcaactacgctggactgcagcggtctgtacttctgtacacgacacccaccacctacatcgatgacatcaccgtcaccaccagcgtggagcaagacagtgggctggtgaattaccagatctctgtcaagggcagtaacctgttcaagttggaagtgcgtcttttggatgcagaaaacaaagtcgtggcgaatgggactgggacccagggccaacttaaggtgccaggtgtcagcctctggtggccgtacctgatgcacgaacgccctgcctatctgtattcattggaggtgcagctgactgcacagacgtcactggggcctgtgtctgacttctacacactccctgtggggatccgcactgtggctgtcaccaagagccagttcctcatcaatgggaaacctttctatttccacggtgtcaacaagcatgaggatgcggacatccgagggaagggcttcgactggccgctgctggtgaaggacttcaacctgcttcgctggcttggtgccaacgctttccgtaccagccactacccctatgcagaggaagtgatgcagatgtgtgaccgctatgggattgtggtcatcgatgagtgtcccggcgtgggcctggcgctgccgcagttcttcaacaacgtttctctgcatcaccacatgcaggtgatggaagaagtggtgcgtagggacaagaaccaccccgcggtcgtgatgtggtctgtggccaacgagcctgcgtcccacctagaatctgctggctactacttgaagatggtgatcgctcacaccaaatccttggacccctcccggcctgtgacctttgtgagcaactctaactatgcagcagacaagggggctccgtatgtggatgtgatctgtttgaacagctactactcttggtatcacgactacgggcacctggagttgattcagctgcagctggccacccagtttgagaactggtataagaagtatcagaagcccattattcagagcgagtatggagcagaaacgattgcagggtttcaccaggatccacctctgatgttcactgaagagtaccagaaaagtctgctagagcagtaccatctgggtctggatcaaaaacgcagaaaatacgtggttggagagctcatttggaattttgccgatttcatgactgaacagtcaccgacgagagtgctggggaataaaaaggggatcttcactcggcagagacaaccaaaaagtgcagcgttccttttgcgagagagatactggaagattgccaatgaaaccaggtatccccactcagtagccaagtcacaatgtttggaaaacagcctgtttacttgagcaagactgataccacctgcgtgtcccttcctccccgagtcagggcgacttccacagcagcagaacaagtgcctcctggactgttcacggcagaccagaacgtttctggcctgggttttgtggtcatctattctagcagggaacactaaaggtggaaataaaagattttctattatggaaataaagagttggcatgaaagtggctactgaaaa

SEQ ID NO: 12224 - DNA, 2027 bp, Homo sapiens
acggtggccgagcgggggaccgggaagcatggcccgggggtcggcggttgcctgggcggcgctcgggccgttgttgtggggctgcgcgctggggctgcagggcgggatgctgtacccccaggagagcccgtcgcgggagtgcaaggagctggacggcctctggagcttccgcgccgacttctctgacaaccgacgccggggcttcgaggagcagtggtaccggcggccgctgtgggagtcaggccccaccgtggacatgccagttccctccagcttcaatgacatcagccaggactggcgtctgcggcattttgtcggctgggtgtggtacgaacgggaggtgatcctgccggagcgatggacccaggacctgcgcacaagagtggtgctgaggattggcagtgcccattcctatgccatcgtgtgggtgaatggggtcgacacgctagagcatgaggggggctacctccccttcgaggccgacatcagcaacctggtccaggtggggcccctgccctcccggctccgaatcactatcgccatcaacaacacactcacccccaccaccctgccaccagggaccatccaatacctgactgacacctccaagtatcccaagggttactttgtccagaacacatattttgactttttcaactacgctggactgcagcggtctgtacttctgtacacgacacccaccacctacatcgatgacatcaccgtcaccaccagcgtggagcaagacagtgggctggtgaattaccagatctctgtcaagggcagtaacctgttcaagttggaagtgcgtcttttggatgcagaaaacaaagtcgtggcgaatgggactgggacccagggccaacttaaggtgccaggtgtcagcctctggtggccgtacctgatgcacgaacgccctgcctatctgtattcattggagatccgagggaagggcttcgactggccgctgctggtgaaggacttcaacctgcttcgctggcttggtgccaacgctttccgtaccagccactacccctatgcagaggaagtgatgcagatgtgtgaccgctatgggattgtggtcatcgatgagtgtcccggcgtgggcctggcgctgccgcagttcttcaacaacgtttctctgcatcaccacatgcaggtgatggaagaagtggtgcgtagggacaagaaccaccccgcggtcgtgatgtggtctgtggccaacgagcctgcgtcccacctagaatctgctggctactacttgaagatggtgatcgctcacaccaaatccttggacccctcccggcctgtgacctttgtgagcaactctaactatgcagcagacaagggggctccgtatgtggatgtgatctgtttgaacagctactactcttggtatcacgactacgggcacctggagttgattcagctgcagctggccacccagtttgagaactggtataagaagtatcagaagcccattattcagagcgagtatggagcagaaacgattgcagggtttcaccaggatccacctctgatgttcactgaagagtaccagaaaagtctgctagagcagtaccatctgggtctggatcaaaaacgcagaaaatacgtggttggagagctcatttggaattttgccgatttcatgactgaacagtcaccgacgagagtgctggggaataaaaaggggatcttcactcggcagagacaaccaaaaagtgcagcgttccttttgcgagagagatactggaagattgccaatgaaaccaggtatccccactcagtagccaagtcacaatgtttggaaaacagcctgtttacttgagcaagactgataccacctgcgtgtcccttcctccccgagtcagggcgacttccacagcagcagaacaagtgcctcctggactgttcacggcagaccagaacgtttctggcctgggttttgtggtcatctattctagcagggaacactaaaggtggaaataaaagattttctattatggaaataaagagttggcatg

SEQ ID NO: 12225 - DNA, 1029 bp, Homo sapiens
gagggaactagcgagaacgaggaagcagctggaggtgacgccgggcagattacgcctgtcagggccgagccgagcggatcgctgggcgctgtgcagaggaaaggcgggagtgcccggctcgctgtcgcagagccgagcctgtttctgcgccggaccagtcgaggactctggacagtagaggccccgggacgaccgagctgatggcgtcttcgaccccatcttcgtccgcaacctcctcgaacgcgggagcggaccccaataccactaacctgcgccccacaacgtacgatacctggtgcggcgtggcccatggatgcaccagaaaactggggctcaagatctgcggcttcttgcaaaggaccaacagcctggaagagaagagtcgccttgtgagtgccttcaaggagaggcaatcctccaagaacctgctttcctgtgaaaacagcgaccgggatgcccgcttccggcgcacagagactgacttctctaatctgtttgctagagatctgcttccggctaagaacggtgaggagcaaaccgtgcaattcctcctggaagtggtggacatactcctcaactatgtccgcaagacatttgatcgctccaccaaggtgctggactttcatcacccacaccagttgctggaaggcatggagggcttcaacttggagctctctgaccaccccgagtccctggagcagatcctggttgactgcagagacaccttgaagtatggggttcgcacaggtcatcctcgatttttcaaccagctctccactggattggatattattggcctagctggagaatggctgacatcaacggccaataccaacatgccatcagacatgagggagtgttggttgctacggtgatggggctcagagcagaaccaaagcatgattgtgacctccagaggtgatggtaactgcacacatggtttccaagggtcttcctcctaaatttccaggggcctcccaaggaaaatggacatattctttttggaaataaaatacttctaccaacata

SEQ ID NO: 12226 - DNA, 3604 bp, Homo sapiens
gaattcttcgtaggaattatcttttccctcctctcacccgacagcctgcctatttccaaaggaaaaaaaaaaagcgtgttgagtacgttctggattactcataagaccttttttttttccttccgggcgcaaaaccgtgagctggatttataatcgccctataaagctccagaggcggtcaggcacctgcagaggagccccgccgctccgccgactagctgcccccgcgagcaacggcctcgtgatttccccgccgatccggtccccgcctccccactctgcccccgcctaccccggagccgtgcagccgcctctccgaatctctctcttctcctggcgctcgcgtgcgagagggaactagcgagaacgaggaagcagctggaggtgacgccgggcagattacgcctgtcagggccgagccgagcggatcgctgggcgctgtgcagaggaaaggcgggagtgcccggctcgctgtcgcagagccgagcctgtttctgcgccggaccagtcgaggactctggacagtagaggccccgggacgaccgagctgatggcgtcttcgaccccatcttcgtccgcaacctcctcgaacgcgggagcggaccccaataccactaacctgcgccccacaacgtacgatacctggtgcggcgtggcccatggatgcaccagaaaactggggctcaagatctgcggcttcttgcaaaggaccaacagcctggaagagaagagtcgccttgtgagtgccttcaaggagaggcaatcctccaagaacctgctttcctgtgaaaacagcgaccgggatgcccgcttccggcgcacagagactgacttctctaatctgtttgctagagatctgcttccggctaagaacggtgaggagcaaaccgtgcaattcctcctggaagtggtggacatactcctcaactatgtccgcaagacatttgatcgctccaccaaggtgctggactttcatcacccacaccagttgctggaaggcatggagggcttcaacttggagctctctgaccaccccgagtccctggagcagatcctggttgactgcagagacaccttgaagtatggggttcgcacaggtcatcctcgatttttcaaccagctctccactggattggatattattggcctagctggagaatggctgacatcaacggccaataccaacatgtttacatatgaaattgcaccagtgtttgtcctcatggaacaaataacacttaagaagatgagagagatagttggatggtcaagtaaagatggtgatgggatattttctcctgggggcgccatatccaacatgtacagcatcatggctgctcgctacaagtacttcccggaagttaagacaaagggcatggcggctgtgcctaaactggtcctcttcacctcagaacagagtcactattccataaagaaagctggggctgcacttggctttggaactgacaatgtgattttgataaagtgcaatgaaagggggaaaataattccagctgattttgaggcaaaaattcttgaagccaaacagaagggatatgttcccttttatgtcaatgcaactgctggcacgactgtttatggagcttttgatccgatacaagagattgcagatatatgtgagaaatataacctttggttgcatgtcgatgctgcctggggaggtgggctgctcatgtccaggaagcaccgccataaactcaacggcatagaaagggccaactcagtcacctggaaccctcacaagatgatgggcgtgctgttgcagtgctctgccattctcgtcaaggaaaagggtatactccaaggatgcaaccagatgtgtgcaggatacctcttccagccagacaagcagtatgatgtctcctacgacaccggggacaaggcaattcagtgtggccgccacgtggatatcttcaagttctggctgatgtggaaagcaaagggcacagtgggatttgaaaaccagatcaacaaatgcctggaactggctgaatacctctatgccaagattaaaaacagagaagaatttgagatggttttcaatggcgagcctgagcacacaaacgtctgtttttggtatattccacaaagcctcaggggtgtgccagacagccctcaacgacgggaaaagctacacaaggtggctccaaaaatcaaagccctgatgatggagtcaggtacgaccatggttggctaccagccccaaggggacaaggccaacttcttccggatggtcatctccaacccagccgctacccagtctgacattgacttcctcattgaggagatagaaagactgggccaggatctgtaatcatccttcgcagaacatgagtttatgggaatgccttttccctctggcactccagaacaaacctctatatgttgctgaaacacacaggccatttcattgagggaaaacataatatcttgaagaatattgttaaaaccttacttaaagcttgtttgttctagttagcaggaaatagtgttctttttaaaaagttgcacattaggaacagagtatatatgtacagttatacatacctctctctatatatacatgtatagtgagtgtggcttagtaatagatcacggcatgtttcccgctccaagagaattcactttaccttcagcagttaccgaggagctaaacatgctgccaaccagcttgtccaacaactccaggaaaactgtttttcaaaacgccatgtcctaggggccgagggaaatgctgttggtgagaatcgacctcactgtcagcgtttctccacctgaagtgatgatggatgagaaaaaacaccaccaaatgacaagtcacaccctccccattagtatcctgttaggggaaaatagtagcagagtcattgttacaggtgtactatggctgtatttttagagattaatttgtgtagattgtgtaaattcctgttgtctgaccttggtggtgggagggggagactatgtgtcatgatttcaatgattgtttaattgtaggtcaatgaaatatttgcttatttatattcagagatgtaccatgttaaagaggcgtcttgtattttcttcccatttgtaatgtatcttatttatatatgaagtaagttctgaaaactgtttatggtattttcgtgcatttgtgagccaaagagaaaagattaaaattagtgagatttgtatttatattagagtgcccttaaaataatgatttaagcattttactgtctgtaagagaattctaagattgtacataaagtcatatatatggaaatcctgttacttaaatagcatctgctcttctcttacgctctctgtctggctgtacgtctggtgttctcaatgcttttctagcaactgttggataataactagatctcctgtaattttgtagtagttgatgaccaatctctgtgactcgcttagctgaaacctaaggcaacatttccgaagaccttctgaagatctcagataaagtgaccaggctcacaactgtttttgaagaagggaaattcacactgtgcgttttagagtatgcaagaagaatataaataaataaaaatattctccatggagaatttgaacaaaa

SEQ ID NO: 12227 - DNA, 1252 bp, Homo sapiens
gcaaaaccgtgagctggatttataatcgccctataaagctccagaggcggtcaggcacctgcagaggagccccgccgctccgccgactagctgcccccgcgagcaacggcctcgtgatttccccgccgatccggtccccgcctccccactctgcccccgcctaccccggagccgtgcagccgcctctccgaatctctctcttctcctggcgctcgcgtgcgagagggaactagcgagaacgaggaagcagctggaggtgacgccgggcagattacgcctgtcagggccgagccgagcggatcgctgggcgctgtgcagaggaaaggcgggagtgcccggctcgctgtcgcagagccgaggtggcctgtttctgcgccggaccagtcgaggactctggacagtagaggccccgggacgaccgagctgatggcgtcttcgaccccatcttcgtccgcaacctcctcgaacgcgggagcggaccccaataccactaacctgcgccccacaacgtacgatacctggtgcggcgtggcccatggatgcaccagaaaactggggctcaagatctgcggcttcttgcaaaggaccaacagcctggaagagaagagtcgccttgtgagtgccttcaaggagaggcaatcctccaagaacctgctttcctgtgaaaacagcgaccgggatgcccgcttccggcgcacagagactgacttctctaatctgtttgctagagatctgcttccggctaagaacggtgaggagcaaaccgtgcaattcctcctggaagtggtggacatactcctcaactatgtccgcaagacatttgatcgctccaccaaggtgctggactttcatcacccacaccagttgctggaaggcatggagggcttcaacttggagctctctgaccaccccgagtccctggagcagatcctggttgactgcagagacaccttgaagtatggggttcgcacaggtcatcctcgatttttcaaccagctctccactggattggatattattggcctagctggagaatggctgacatcaacggccaataccaacatgccatcagacatgagggagtgttggttgctacggtgatggggctcagagcagaaccaaagcatgattgtgacctccagaggtgatggtaactgcacacatggtttccaagggtcttcctcctaaatttccaggggcctcccaaggaaaatggacatattctttttggaaataaaatacttctaccaac

SEQ ID NO: 12228 - DNA, 639 bp, Homo sapiens
gtgcgtgtcatcaaccttcaaacgtgattaatcaggaggccttcttttcccatcaccaagggggccaaagcgaggagcgagcgcatagcaaaagggacgcggggtccttttctctgccggtggcactgggtagctgtggccagctccagaggcggtcaggcacctgcagaggagccccgccgctccgccgactagctgcccccgcgagcaacggcctcgtgatttccccgccgatccggtccccgcctccccactctgcccccgcctaccccggagccgtgcagccgcctctccgaatctctctcttctcctggcgctcgcgtgcgagagggaactagcgagaacgaggaagcagctggaggtgacgccgggcagattacgcctgtcagggccgagccgagcggatcgctgggcgctgtgcagaggaaaggcgggagtgcccggctcgctgtcgcagagccgagcctgtttctgcgccggaccagtcgaggactctggacagtagaggccccgggacgaccgagctgatggcgtcttcgaccccatcttcgtccgcaacctcctcgaacgcgggagcggaccccaataccactaacctgcgccccacaacgtacgatacctggtgcggcgtggcccatg

SEQ ID NO: 12229 - DNA, 529 bp, Homo sapiens
attttcctgcctcccagctgtgagtgttgtgtggtctgttgggatgggggtgtggatttagctatgatccttcaaaaaagtccagaataattcagggaactatctttaaagtacaaaaacagcaaatggaccttagctccgacttaagcagaatgaaaggttaagtaacgcttcccccagttctcgtctcgggagacagacgtttaaccgcctgtttctgcgccggaccagtcgaggactctggacagtagaggccccgggacgaccgagctgatggcgtcttcgaccccatcttcgtccgcaacctcctcgaacgcgggagcggaccccaataccactaacctgcgccccacaacgtacgatacctggtgcggcgtggcccatggatgcaccagaaaactggggctcaagatctgcggcttcttgcaaaggaccaacagcctggaagagaagagtcgccttgtgagtgccttcaaggagaggcaatcctccaagaacctgctttcctgtgaaaacagcgaccgggatg

SEQ ID NO: 12230 - DNA, 571 bp, Homo sapiens
ttcttatccctgccctccggattcacgccccggggaagcacggaggctgaggctctagttgaagtggggcaagagcgattttcccttgagcttccatgctgcgagcgcctgtccctccaaagggcgcctgggcagcagcagccgaaggcgctactaggaacgcctgtttctgcgccggaccagtcgaggactctggacagtagaggccccgggacgaccgagctgatggcgtcttcgaccccatcttcgtccgcaacctcctcgaacgcgggagcggaccccaataccactaacctgcgccccacaacgtacgatacctggtgcggcgtggcccatggatgcaccagaaaactggggctcaagatctgcggcttcttgcaaaggaccaacagcctggaagagaagagtcgccttgtgagtgccttcaaggagaggcaatcctccaagaacctgctttcctgtgaaaacagcgaccgggatgcccgcttccggcgcacagagactgacttctctaatctgtttgctagagatctgcttccggctaagaacggtgaggagcaaaccgtgcaat

SEQ ID NO: 12231 - DNA, 556 bp, Homo sapiens
aggtagaggagaaacgctgaaaccggaccgaaacctcgccctaggcttagcgatggctaaaaaccggctgggataagagggaggcaagcaacattccgactcgctgctttctggctgtctggagtgcaagcctgtttctgcgccggaccagtcgaggactctggacagtagaggccccgggacgaccgagctgatggcgtcttcgaccccatcttcgtccgcaacctcctcgaacgcgggagcggaccccaataccactaacctgcgccccacaacgtacgatacctggtgcggcgtggcccatggatgcaccagaaaactggggctcaagatctgcggcttcttgcaaaggaccaacagcctggaagagaagagtcgccttgtgagtgccttcaaggagaggcaatcctccaagaacctgctttcctgtgaaaacagcgaccgggatgcccgcttccggcgcacagagactgacttctctaatctgtttgctagagatctgcttccggctaagaacggtgaggagcaaaccgtgcaattcctcctggaagtggtg

SEQ ID NO: 12232 - DNA, 2462 bp, Homo sapiens
acccgccctcgccgctcggccccgccggtccccgcgcggtgccctcctcccgccacacgggcacgcacgcgcgcgcagggccaagcccgaggcagctcgcccgcagctcgcactcgcaggcgacctgctccagtctccaaagccgatggcatctccgggctctggcttttggtctttcgggtcggaagatggctctggggattccgagaatcccggcacagcgcgagcctggtgccaagtggctcagaagttcacgggcggcatcggaaacaaactgtgcgccctgctctacggagacgccgagaagccggcggagagcggcgggagccaacccccgcgggccgccgcccggaaggccgcctgcgcctgcgaccagaagccctgcagctgctccaaagtggatgtcaactacgcgtttctccatgcaacagacctgctgccggcgtgtgatggagaaaggcccactttggcgtttctgcaagatgttatgaacattttacttcagtatgtggtgaaaagtttcgatagatcaaccaaagtgattgatttccattatcctaatgagcttctccaagaatataattgggaattggcagaccaaccacaaaatttggaggaaattttgatgcattgccaaacaactctaaaatatgcaattaaaacagggcatcctagatacttcaatcaactttctactggtttggatatggttggattagcagcagactggctgacatcaacagcaaatactaacatgttcacctatgaaattgctccagtatttgtgcttttggaatatgtcacactaaagaaaatgagagaaatcattggctggccagggggctctggcgatgggatattttctcccggtggcgccatatctaacatgtatgccatgatgatcgcacgctttaagatgttcccagaagtcaaggagaaaggaatggctgctcttcccaggctcattgccttcacgtctgaacatagtcatttttctctcaagaagggagctgcagccttagggattggaacagacagcgtgattctgattaaatgtgatgagagagggaaaatgattccatctgatcttgaaagaaggattcttgaagccaaacagaaagggtttgttcctttcctcgtgagtgccacagctggaaccaccgtgtacggagcatttgaccccctcttagctgtcgctgacatttgcaaaaagtataagatctggatgcatgtggatgcagcttggggtgggggattactgatgtcccgaaaacacaagtggaaactgagtggcgtggagagggccaactctgtgacgtggaatccacacaagatgatgggagtccctttgcagtgctctgctctcctggttagagaagagggattgatgcagaattgcaaccaaatgcatgcctcctacctctttcagcaagataaacattatgacctgtcctatgacactggagacaaggccttacagtgcggacgccacgttgatgtttttaaactatggctgatgtggagggcaaaggggactaccgggtttgaagcgcatgttgataaatgtttggagttggcagagtatttatacaacatcataaaaaaccgagaaggatatgagatggtgtttgatgggaagcctcagcacacaaatgtctgcttctggtacattcctccaagcttgcgtactctggaagacaatgaagagagaatgagtcgcctctcgaaggtggctccagtgattaaagccagaatgatggagtatggaaccacaatggtcagctaccaacccttgggagacaaggtcaatttcttccgcatggtcatctcaaacccagcggcaactcaccaagacattgacttcctgattgaagaaatagaacgccttggacaagatttataataaccttgctcaccaagctgttccacttctctagagaacatgccctcagctaagccccctactgagaaacttcctttgagaattgtgcgacttcacaaaatgcaaggtgaacaccactttgtctctgagaacagacgttaccaattatggagtgtcaccagctgccaaaatcgtaggtgttggctctgctggtcactggagtagttgctactcttcagaatatggacaaagaaggcacaggtgtaaatatagtagcaggatgaggaacctcaaactgggtatcattttgcacgtgctcttctgttctcaaatgctaaatgcaaacactgtgtatttattagttaggtgtgccaaactaccgttcccaaattggtgtttctgaatgacatcaacattcccccaacattactccattactaaagacagaaaaaaataaaaacataaaatatacaaacatgtggcaacctgttcttcctaccaaatataaacttgtgtatgatccaagtattttatctgtgttgtctctctaaacccaaataaatgtgtaaatgtggacaca

SEQ ID NO: 12233 - DNA, 680 bp, Homo sapiens
tccaagagggctctgaggccgtggcgctcttcccccagcgcggcccttgggatggcgggtggccgacgatccaggcgctcgtgcgctcactgaatcgatgacggctggcttccctaggccgctggggcctcggacctgctgccggcgtgtgatggagaaaggcccactttggcgtttctgcaagatgttatgaacattttacttcagtatgtggtgaaaagtttcgatagatcaaccaaagtgattgatttccattatcctaatgagcttctccaagaatataattgggaattggcagaccaaccacaaaatttggaggaaattttgatgcattgccaaacaactctaaaatatgcaattaaaacagggcatcctagatacttcaatcaactttctactggtttggatatggttggattagcagcagactggctgacatcaacagcaaatactaacatgttcacctatgaaattgctccagtatttgtgcttttggaatatgtcacactaaagaaaatgagagaaatcattggctggccagggggctctggcgatgggatattttctcccggtacatgatatttcaactttctttgtgttttttcttctaatatgcaatgccttgttgtaaacctagggaagattaaaaatctagcctatgcctctgcttaggttaaata

SEQ ID NO: 12234 - DNA, 5858 bp, Homo sapiens
gcggccgcccgcacttcccgcctctggctcgcccgaggacgcgctggcacgcctcccaccccctcactctgactccagctggcgtgcatggtctgcctcgcatcctcacgactcagctccctccctctctcgtgtttttttcctccgccgccccctcattcatccccactgggctccctttccctcaaatgctctggggctctccgcgctttcctgagtccgggctccgaggacccttaggtagtcccggtctcttttaaagctccccggcttccaaagggttgccacgtccctaaaccctgtctccagctcgcatacacacacgcacagacacgcacgttttctgttcctgcgtgacacccgccctcgccgctcggccccgccggtccccgcgcggtgccctcctcccgccacacgggcacgcacgcgcgcgcagggccaagcccgaggcagctcgcccgcagctcgcactcgcaggcgacctgctccagtctccaaagccgatggcatctccgggctctggcttttggtctttcgggtcggaagatggctctggggattccgagaatcccggcacagcgcgagcctggtgccaagtggctcagaagttcacgggcggcatcggaaacaaactgtgcgccctgctctacggagacgccgagaagccggcggagagcggcgggagccaacccccgcgggccgccgcccggaaggccgcctgcgcctgcgaccagaagccctgcagctgctccaaagtggatgtcaactacgcgtttctccatgcaacagacctgctgccggcgtgtgatggagaaaggcccactttggcgtttctgcaagatgttatgaacattttacttcagtatgtggtgaaaagtttcgatagatcaaccaaagtgattgatttccattatcctaatgagcttctccaagaatataattgggaattggcagaccaaccacaaaatttggaggaaattttgatgcattgccaaacaactctaaaatatgcaattaaaacagggcatcctagatacttcaatcaactttctactggtttggatatggttggattagcagcagactggctgacatcaacagcaaatactaacatgttcacctatgaaattgctccagtatttgtgcttttggaatatgtcacactaaagaaaatgagagaaatcattggctggccagggggctctggcgatgggatattttctcccggtggcgccatatctaacatgtatgccatgatgatcgcacgctttaagatgttcccagaagtcaaggagaaaggaatggctgctcttcccaggctcattgccttcacgtctgaacatagtcatttttctctcaagaagggagctgcagccttagggattggaacagacagcgtgattctgattaaatgtgatgagagagggaaaatgattccatctgatcttgaaagaaggattcttgaagccaaacagaaagggtttgttcctttcctcgtgagtgccacagctggaaccaccgtgtacggagcatttgaccccctcttagctgtcgctgacatttgcaaaaagtataagatctggatgcatgtggatgcagcttggggtgggggattactgatgtcccgaaaacacaagtggaaactgagtggcgtggagagggccaactctgtgacgtggaatccacacaagatgatgggagtccctttgcagtgctctgctctcctggttagagaagagggattgatgcagaattgcaaccaaatgcatgcctcctacctctttcagcaagataaacattatgacctgtcctatgacactggagacaaggccttacagtgcggacgccacgttgatgtttttaaactatggctgatgtggagggcaaaggggactaccgggtttgaagcgcatgttgataaatgtttggagttggcagagtatttatacaacatcataaaaaaccgagaaggatatgagatggtgtttgatgggaagcctcagcacacaaatgtctgcttctggtacattcctccaagcttgcgtactctggaagacaatgaagagagaatgagtcgcctctcgaaggtggctccagtgattaaagccagaatgatggagtatggaaccacaatggtcagctaccaacccttgggagacaaggtcaatttcttccgcatggtcatctcaaacccagcggcaactcaccaagacattgacttcctgattgaagaaatagaacgccttggacaagatttataataaccttgctcaccaagctgttccacttctctaggtagacaattaagttgtcacaaactgtgtgaatgtatttgtagtttgttccaaagtaaatctatttctatattgtggtgtcaaagtagagtttaaaaattaaacaaaaaagacattgctccttttaaaagtcctttcttaagtttagaatacctctctaagaattcgtgacaaaaggctatgttctaatcaataaggaaaagcttaaaattgttataaatacttcccttacttttaatatagtgtgcaaagcaaactttattttcacttcagactagtaggactgaatagtgccaaattgcccctgaatcataaaaggttctttggggtgcagtaaaaaggacaaagtaaatataaaatatatgttgacaataaaaactcttgcctttttcatagtattagaaaaaaatttctaatttacctatagcaacatttcaaatgtatttaaatacatataattttacaaaaggaaaatatatatattaaaaaagatatcctattttgtaacatatagatttttattttatataggttatacaaactgcgggggcagatataaaatctaagccagatttttttttcctttctcttaatggaggcacaataaaacacttagcaaagttattttgaaacattgacccacgaaattcttaaaaggtattattgcttctttctatacatgttatggcttatcacatctctaaagttagtatttcaagacaaacacaaaagaatactgcgagttctttaaaataattgatcccattggcagtaagattctcttcccctttaagttttccacccattttactcttagcggactcactctgcaagcgtgacaaaccaggcttcatctcagattaaattagggtaattgtctctattctgctttccagttcggcctgttttgaacagaaggttgatgctagttcttgaggcatcttccaaatagtattcttttattaggtcatttgaattaattagagaaagtaaaaataaaaccttatcagcctgagcaaagaggaatgaagcacactcccagaatgtggtgagcccagaaaattaaagttggccttgggagaagagatctctgtgggacaataatgacatcatcctggcgccatattgccactgtccaggaaagagaaatttacctccaggccagttgcgcatttccatcccctccccattcctccccacaaagtctctcccactagactccctaccactgggacccaaaatagttactttatattccatgggtggttgtttttcttccatgaaatgagcctctcaccctagattttgaggcattatcttaagattttcctttatccatctcccatcgagatccaaagtgaccagaatatgcagaaataataagatccttagaattcaaaatagtatttttaaaacatccttctttccctgtgaacctgatagaaaaacatgagctaacaaaagcttccatagatatttatggggtcacacatcgtcagattccaagtgctgattggagaacaatagattgatatgcagactgcaaatgcaaatttaggaacattctccatttctgaatggaccaggtagttcagtactcagactgcaggtatacaagggaagagagaaggccctgcccttcaacgggtagaaatgccctacaatataacatagagaaatgccctataatataaccacaggatccagccatctgaaattttcataagcttccccctacattatttctcctaggctatatgcaaaaacagtgataacttgatatgaacatggctttgggccctttctgtctagaaaaacaaatgggttcactatgacaatcagaaataaactctttcatctgtcccgcagaatttcatgaaggagtaaccttccattctaggctttgtctaatggccaagcattagacaaagcattagaaagcagttcctttctcaaaactgcctgctgagaataagcacatagctgcccgactatccggagcctcaggcccaaaggttccacttcagagacagagatgctaattgatccaacctgctgtccttcgtggagaagacagtggggcccagtgccctggtgaaccaaccctgctgtactccaggatgctttatcttttgagttacagatcctagattataaactgctgctttttaggttaatgagatggtaaaattttaaaggacaatttgtgcctatatatgaaattccagcaaaacaattctagcaacaacaatagctcttcttccccgctcccctaccccttcccagtactccttcaaattggctgagagccttgctcaggcctgtgcagggaaatccttaccaactgtagcccaaagaaggaagcaaataaaagcctagtaggtcccagtagtttaataaatcatcttgaaaggagatgtggaatcaggtcagaagagagtaagggaggaagggagggagggagggagggagggaaggagggagggaggaaggaaatgaagggagggagggagggaggaaagaagggagattatttttaatattagcccaaattcccagtgccatggtctttatgtgtgcccattctttacaaatcttagaaaagtttggttttagctttaatcagaactgacatggccattttcatttatacagcaatattgtgtttatcatttaaaatacttgaacaaacaagtgtgatatgtctttatctgagacctatacatggtatggacttcatatactgccacaggatgtgaggaaagaaaaggaaatcaattctgactgtgttgcctttattatctggataatactgtcttgtcacctcagattggggttgtgcactttagatctgaactgtacagtgttgcaaatcaacatgtgtttctgtaaaagcttgtacaatatattattgatatgtctttttctgtgtggtagctgtattgaactttgatattatgaaaactacatttgcatctgttcctgttctctctctctctctctttcctaactatatgccctccacatcggctctaatagagaacatgccctcagctaagccccctactgagaaacttcctttgagaattgtgcgacttcacaaaatgcaaggtgaacaccactttgtctctgagaacagacgttaccaattatggagtgtcaccagctgccaaaatcgtaggtgttggctctgctggtcactggagtagttgctactcttcagaatatggacaaagaaggcacaggtgtaaatatagtagcaggatgaggaacctcaaactgggtatcattttgcacgtgctcttctgttctcaaatgctaaatgcaaacactgtgtatttattagttaggtgtgccaaactaccgttcccaaattggtgtttctgaatgacatcaacattcccccaacattactccattactaaagacagaaaaaaataaaaacataaaatatacaaacatgtggcaacctgttcttcctaccaaatataaacttgtgtatgatccaagtattttatctgtgttgtctctctaaacccaaataaatgtgtaaatgtggacaca

SEQ ID NO: 12235 - DNA, 641 bp, Homo sapiens
gcgcgcgcagggccaagcccgaggcagctcgcccgcagctcgcactcgcaggcgacctgctccagtctccaaagccgatggcatctccgggctctggcttttggtctttcgggtcggaagatggctctggggattccgagaatcccggcacagcgcgagcctggtgccaagtggctcagaagttcacgggcggcatcggaaacaaactgtgcgccctgctctacggagacgccgagaagccggcggagagcggcgggagccaacccccgcgggccgccgcccggaaggccgcctgcgcctgcgaccagaagccctgcagctgctccaaagtggatgtcaactacgcgtttctccatgcaacagacctgctgccggcgtgtgatggagaaaggcccactttggcgtttctgcaagatgttatgaacattttacttcagtatgtggtgaaaagtttcgatagatcaaccaaagtgattgatttccattatcctaatgagcttctccaagaatataattgggaattggcagaccaaccacaaaatttggaggaaattttgatgcattgccaaacaactctaaaatatgcaattaaaacaggtattgtctcatcgaaaataataaagctcttttttcgtttacaa

SEQ ID NO: 12236 - DNA, 3039 bp, Homo sapiens
gggcaacccgcgcgggacccttcctccctagtcgcggggagtctgagaaagcgcgcctgtttcgcgaccatcacgcacctcccctccgcttgtggccatgtaccgctacctgggcgaagcgctgttgctgtcccgggccgggcccgctgccctgggctcggcgtccgccgactcggccgcgttgctgggctgggcccggggacagcccgccgccgccccgcagccggggctggcattggccgcccggcgccactacagcgaggcggtggccgaccgcgaggacgaccccaacttcttcaagatggtggagggcttcttcgatcgcggcgccagcatcgtggaggacaagctggtggaggacctgaggacccgggagagcgaggagcagaagcggaaccgggtgcgcggcatcctgcggatcatcaagccctgcaaccatgtgctgagtctctccttccccatccggcgcgacgacggctcctgggaggtcatcgaaggctaccgggcccagcacagccagcaccgcacgccctgcaagggaggtatccgttacagcactgatgtgagtgtagatgaagtaaaagctttggcttctctgatgacatacaagtgtgcagtggttgatgtgccgtttgggggtgctaaagctggtgttaagatcaatcccaagaactatactgataatgaattggaaaagatcacaaggaggttcaccatggagctagcaaaaaagggctttattggtcctggcattgatgtgcctgctccagacatgagcacaggtgagcgggagatgtcctggatcgctgatacctatgccagcaccatagggcactatgatattaatgcacacgcctgtgttactggtaaacccatcagccaagggggaatccatggacgcatctctgctactggccgtggtgtcttccatgggattgaaaatttcatcaatgaagcttcttacatgagcattttaggaatgacaccagggtttggagataaaacatttgttgttcagggatttggtaatgtgggcctacactctatgagatatttacatcgttttggtgctaaatgtattgctgttggtgagtctgatgggagtatatggaatccagatggtattgacccaaaggaactggaagacttcaaattgcaacatgggtccattctgggcttccccaaggcaaagccctatgaaggaagcatcttggaggccgactgtgacatactgatcccagctgccagtgagaagcagttgaccaaatccaacgcacccagagtcaaagccaagatcattgctgaaggtgccaatgggccaacaactccagaagctgacaagatcttcctggagagaaacattatggttattccagatctctacttgaatgctggaggagtgacagtatcttactttgagtggctgaagaatctaaatcatgtcagctatggccgtttgaccttcaaatatgaaagggattctaactaccacttgctcatgtctgttcaagagagtttagaaagaaaatttggaaagcatggtggaactattcccattgtacccacggcagagttccaagacaggatatcgggtgcatctgagaaagacatcgtgcactctggcttggcatacacaatggagcgttctgccaggcaaattatgcgcacagccatgaagtataacctgggattggacctgagaacagctgcctatgttaatgccattgagaaagtcttcaaagtgtacaatgaagctggtgtgaccttcacatagatggatcatggctgacttcctcactatcctcttcacatgtaacttctgcagacctatcacaagtttacatgtaaccacagaaatccctttctctcctgactcattaataatggataccattctcaacaagtcaatccaagtcagcccgttaaggagaaagaaattaaggttagcggatcatgtacaagctgagtgtgaaagtagaaatcacctacaccagagagccattttggtattttgcctttaaataaaaagcctcctttatctggctgtgcagccttgctctgtggcttttcccaacacaatcagtgctagtgctggggaggaacagtcaagagcagtcagttgcttgcttattttttctggatgagtctgggacacactgtaactttaacacatttaagaagtaggtgtgtggccttttcagaaggtggcatggtcctcaagtgagttcttagtattttatatcagcaaaataattcaattttgcaggttgcaaacaaatataaaacctgtttctgtttatgaatattattcttttagaatagaataagtacatgctgctgtaataaaattgcctttaatcacttaacaagcctaaccttgactcaaacagtgaatgcctatagaaataataaatgaaaaaaactagtatttttatatcataaaacaatgtcatttatagcttatcattcatgtattgtccagcagacattaaaagccctgtggataattaagttatcttcatacctgcaaaatggtggaggctattttcattaaaactgtcagaatttgcttactataattatgatacagtccaaagaatgcagtcactttttatcatgttaactaattgttctcttttgaagatctatggttgactaattaaacaataattcaagtagagtgtcccagaaaaaaaccacttgggctccctgtttggagtctggctggctctgagcattgccaatggcccctactcacctgactttgtatcctctccttttagaggctttgcattctgcacccagcttcactaacagtgggctgaaaacatccttgggttgagtgtttcatttgggagttatttggccagggccttttgaacagtagtgtccccatgaagtgctagataatatatgtgtaagagtcagctttttttttttttttaactctaacacccttcagaaatttctaactactttgtaactgcatggcttaacctggtgataaaagcagttattaaaagtctacgttttccaaaa

SEQ ID NO: 12237 - DNA, 2809 bp, Homo sapiens
atgtaccgctacctgggcccggggacagcccgccgccgccccgcagccggggctggcattggccgcccggcgccactacagcgaggcggtggccgaccgcgaggacgaccccaacttcttcaagatggtggagggcttcttcgatcgcggcgccagcatcgtggaggacaagctggtggaggacctgaggacccgggagagcgaggagcagaagcggaaccgggtgcgcggcatcctgcggatcatcaagccctgcaaccatgtgctgagtctctccttccccagcacagccagcaccgcacgccctgcaagggaggtatccgttacagcactgatgtgagtgtagatgaagtaaaagctttggcttctctgatgacatacaagtgtgcagtggttgatgtgccgtttgggggtgctaaagctggtgttaagatcaatcccaagaactatactgataatgaattggaaaagatcacaaggaggttcaccatggagctagcaaaaaagggctttattggtcctggcattgatgtgcctgctccagacatgagcacaggtgagcgggagatgtcctggatcgctgatacctatgccagcaccatagggcactatgatattaatgcacacgcctgtgttactggtaaacccatcagccaagggggaatccatggacgcatctctgctactggccgtggtgtcttccatgggattgaaaatttcatcaatgaagcttcttacatgagcattttaggaatgacaccagggtttggagataaaacatttgttgttcagggatttggtaatgtgggcctacactctatgagatatttacatcgttttggtgctaaatgtattgctgttggtgagtctgatgggagtatatggaatccagatggtattgacccaaaggaactggaagacttcaaattgcaacatgggtccattctgggcttccccaaggcaaagccctatgaaggaagcatcttggaggccgactgtgacatactgatcccagctgccagtgagaagcagttgaccaaatccaacgcacccagagtcaaagccaagatcattgctgaaggtgccaatgggccaacaactccagaagctgacaagatcttcctggagagaaacattatggttattccagatctctacttgaatgctggaggagtgacagtatcttactttgagtggctgaagaatctaaatcatgtcagctatggccgtttgaccttcaaatatgaaagggattctaactaccacttgctcatgtctgttcaagagagtttagaaagaaaatttggaaagcatggtggaactattcccattgtacccacggcagagttccaagacaggatatcgggtgcatctgagaaagacatcgtgcactctggcttggcatacacaatggagcgttctgccaggcaaattatgcgcacagccatgaagtataacctgggattggacctgagaacagctgcctatgttaatgccattgagaaagtcttcaaagtgtacaatgaagctggtgtgaccttcacatagatggatcatggctgacttcctcactatcctcttcacatgtaacttctgcagacctatcacaagtttacatgtaaccacagaaatccctttctctcctgactcattaataatggataccattctcaacaagtcaatccaagtcagcccgttaaggagaaagaaattaaggttagcggatcatgtacaagctgagtgtgaaagtagaaatcacctacaccagagagccattttggtattttgcctttaaataaaaagcctcctttatctggctgtgcagccttgctctgtggcttttcccaacacaatcagtgctagtgctggggaggaacagtcaagagcagtcagttgcttgcttattttttctggatgagtctgggacacactgtaactttaacacatttaagaagtaggtgtgtggccttttcagaaggtggcatggtcctcaagtgagttcttagtattttatatcagcaaaataattcaattttgcaggttgcaaacaaatataaaacctgtttctgtttatgaatattattcttttagaatagaataagtacatgctgctgtaataaaattgcctttaatcacttaacaagcctaaccttgactcaaacagtgaatgcctatagaaataataaatgaaaaaaactagtatttttatatcataaaacaatgtcatttatagcttatcattcatgtattgtccagcagacattaaaagccctgtggataattaagttatcttcatacctgcaaaatggtggaggctattttcattaaaactgtcagaatttgcttactataattatgatacagtccaaagaatgcagtcactttttatcatgttaactaattgttctcttttgaagatctatggttgactaattaaacaataattcaagtagagtgtcccagaaaaaaaccacttgggctccctgtttggagtctggctggctctgagcattgccaatggcccctactcacctgactttgtatcctctccttttagaggctttgcattctgcacccagcttcactaacagtgggctgaaaacatccttgggttgagtgtttcatttgggagttatttggccagggccttttgaacagtagtgtccccatgaagtgctagataatatatgtgtaagagtcagctttttttttttttttaactctaacacccttcagaaatttctaactactttgtaactgcatggcttaacctggtgataaaagcagttattaaaagtctacgttttcc

SEQ ID NO: 12238 - DNA, 1763 bp, Homo sapiens
aaaagggcaacccgcgcgggacccttcctccctagtcgcggggagtctgagaaagcgcgcctgtttcgcgaccatcacgcacctcccctccgcttgtggccgaccgcgaggacgaccccaacttcttcaagatggtggagggcttcttcgatcgcggcgccagcatcgtggaggacaagctggtggaggacctgaggacccgggagagcgaggagcagaagcggaaccgggtgcgcggcatcctgcggatcatcaagccctgcaaccatgtgctgagtctctccttccccatccggcgcgacgacggctcctgggaggtcatcgaaggctaccgggcccagcacagccagcaccgcacgccctgcaagggaggtatccgttacagcactgatgtgagtgtagatgaagtaaaagctttggcttctctgatgacatacaagtgtgcagtggttgatgtgccgtttgggggtgctaaagctggtgttaagatcaatcccaagaactatactgataatgaattggaaaagatcacaaggaggttcaccatggagctagcaaaaaagggctttattggtcctggcattgatgtgcctgctccagacatgagcacaggtgagcgggagatgtcctggatcgctgatacctatgccagcaccatagggcactatgatattaatgcacacgcctgtgttactggtaaacccatcagccaagggggaatccatggacgcatctctgctactggccgtggtgtcttccatgggattgaaaatttcatcaatgaagcttcttacatgagcattttaggaatgacaccagggtttggagataaaacatttgttgttcagggatttggtaatgtgggcctacactctatgagatatttacatcgttttggtgctaaatgtattgctgttggtgagtctgatgggagtatatggaatccagatggtattgacccaaaggaactggaagacttcaaattgcaacatgggtccattctgggcttccccaaggcaaagccctatgaaggaagcatcttggaggccgactgtgacatactgatcccagctgccagtgagaagcagttgaccaaatccaacgcacccagagtcaaagccaagatcattgctgaaggtgccaatgggccaacaactccagaagctgacaagatcttcctggagagaaacattatggttattccagatctctacttgaatgctggaggagtgacagtatcttactttgagtggctgaagaatctaaatcatgtcagctatggccgtttgaccttcaaatatgaaagggattctaactaccacttgctcatgtctgttcaagagagtttagaaagaaaatttggaaagcatggtggaactattcccattgtacccacggcagagttccaagacaggatatcgggtgcatctgagaaagacatcgtgcactctggcttggcatacacaatggagcgttctgccaggcaaattatgcgcacagccatgaagtataacctgggattggacctgagaacagctgcctatgttaatgccattgagaaagtcttcaaagtgtacaatgaagctggtgtgaccttcacatagatggatcatggctgacttcctcactatcctcttcacatgtaacttctgcagacctatcacaagtttacatgtaaccacagaaatccctttctctcctgactcattaataatggataccattctcaacaagtcaatccaagtcagcccgttaaggagaaa

SEQ ID NO: 12239 - DNA, 2035 bp, Homo sapiens
gagaattttattgttgaaggatttggtaatgtgggcctacactctatgagatatttacatcgttttggtgctaaatgtattgctgttggtgagtctgatgggagtatatggaatccagatggtattgacccaaaggaactggaagacttcaaattgcaacatgggtccattctgggcttccccaaggcaaagccctatgaaggaagcatcttggaggccgactgtgacatactgatcccagctgccagtgagaagcagttgaccaaatccaacgcacccagagtcaaagccaagatcattgctgaaggtgccaatgggccaacaactccagaagctgacaagatcttcctggagagaaacattatggttattccagatctctacttgaatgctggaggagtgacagtatcttactttgagtggctgaagaatctaaatcatgtcagctatggccgtttgaccttcaaatatgaaagggattctaactaccacttgctcatgtctgttcaagagagtttagaaagaaaatttggaaagcatggtggaactattcccattgtacccacggcagagttccaagacaggatatcgggtgcatctgagaaagacatcgtgcactctggcttggcatacacaatggagcgttctgccaggcaaattatgcgcacagccatgaagtataacctgggattggacctgagaacagctgcctatgttaatgccattgagaaagtcttcaaagtgtacaatgaagctggtgtgaccttcacatagatggatcatggctgacttcctcactatcctcttcacatgtaacttctgcagacctatcacaagtttacatgtaaccacagaaatccctttctctcctgactcattaataatggataccattctcaacaagtcaatccaagtcagcccgttaaggagaaagaaattaaggttagcggatcatgtacaagctgagtgtgaaagtagaaatcacctacaccagagagccattttggtattttgcctttaaataaaaagcctcctttatctggctgtgcagccttgctctgtggcttttcccaacacaatcagtgctagtgctggggaggaacagtcaagagcagtcagttgcttgcttattttttctggatgagtctgggacacactgtaactttaacacatttaagaagtaggtgtgtggccttttcagaaggtggcatggtcctcaagtgagttcttagtattttatatcagcaaaataattcaattttgcaggttgcaaacaaatataaaacctgtttctgtttatgaatattattcttttagaatagaataagtacatgctgctgtaataaaattgcctttaatcacttaacaagcctaaccttgactcaaacagtgaatgcctatagaaataataaatgaaaaaaactagtatttttatatcataaaacaatgtcatttatagcttatcattcatgtattgtccagcagacattaaaagccctgtggataattaagttatcttcatacctgcaaaatggtggaggctattttcattaaaactgtcagaatttgcttactataattatgatacagtccaaagaatgcagtcactttttatcatgttaactaattgttctcttttgaagatctatggttgactaattaaacaataattcaagtagagtgtcccagaaaaaaaccacttgggctccctgtttggagtctggctggctctgagcattgccaatggcccctactcacctgactttgtatcctctccttttagaggctttgcattctgcacccagcttcactaacagtgggctgaaaacatccttgggttgagtgtttcatttgggagttatttggccagggccttttgaacagtagtgtccccatgaagtgctagataatatatgtgtaagagtcagctttttttttttttttaactctaacacccttcagaaatttctaactactttgtaactgcatggcttaacctggtgataaaagcagttattaaaagtctacgttttcc

SEQ ID NO: 12240 - DNA, 2984 bp, Homo sapiens
atgcagagtagacgctgcaccggtctccttttggtcccggtgtctgtgtcacacacggcgggtcctgccgaaatgcacttctaggaaagggaatgacctgcccgtgtgataatgcctcgtcagtgttcttgggcttttatgcccagctctctcctgtttttataagtcgcagctccgcaaactcactgaagcaactcgtttaccatagtttttactacatgtacctgaggccgttagatttgtctgtgttaaggatttgaaaggaggcagaaattaatacagattcaagtgttcactatcaagtcggaattgttaatatgtgaaatactactgttaaaggcaggaaaggctttattaaggacaagaagacaaactaggagaaggagctactcaagaccttccgattatctttacaaaaaggcaactacacctagaagattctgcagccacacacattctgccttcacttgaggtcaactgccttcaccaaggtatccgttacagcactgatgtgagtgtagatgaagtaaaagctttggcttctctgatgacatacaagtgtgcagtggttgatgtgccgtttgggggtgctaaagctggtgttaagatcaatcccaagaactatactgataatgaattggaaaagatcacaaggaggttcaccatggagctagcaaaaaagggctttattggtcctggcattgatgtgcctgctccagacatgagcacaggtgagcgggagatgtcctggatcgctgatacctatgccagcaccatagggcactatgatattaatgcacacgcctgtgttactggtaaacccatcagccaagggggaatccatggacgcatctctgctactggccgtggtgtcttccatgggattgaaaatttcatcaatgaagcttcttacatgagcattttaggaatgacaccagggtttggagataaaacatttgttgttcagggatttggtaatgtgggcctacactctatgagatatttacatcgttttggtgctaaatgtattgctgttggtgagtctgatgggagtatatggaatccagatggtattgacccaaaggaactggaagacttcaaattgcaacatgggtccattctgggcttccccaaggcaaagccctatgaaggaagcatcttggaggccgactgtgacatactgatcccagctgccagtgagaagcagttgaccaaatccaacgcacccagagtcaaagccaagatcattgctgaaggtgccaatgggccaacaactccagaagctgacaagatcttcctggagagaaacattatggttattccagatctctacttgaatgctggaggagtgacagtatcttactttgagtggctgaagaatctaaatcatgtcagctatggccgtttgaccttcaaatatgaaagggattctaactaccacttgctcatgtctgttcaagagagtttagaaagaaaatttggaaagcatggtggaactattcccattgtacccacggcagagttccaagacaggatatcgggtgcatctgagaaagacatcgtgcactctggcttggcatacacaatggagcgttctgccaggcaaattatgcgcacagccatgaagtataacctgggattggacctgagaacagctgcctatgttaatgccattgagaaagtcttcaaagtgtacaatgaagctggtgtgaccttcacatagatggatcatggctgacttcctcactatcctcttcacatgtaacttctgcagacctatcacaagtttacatgtaaccacagaaatccctttctctcctgactcattaataatggataccattctcaacaagtcaatccaagtcagcccgttaaggagaaagaaattaaggttagcggatcatgtacaagctgagtgtgaaagtagaaatcacctacaccagagagccattttggtattttgcctttaaataaaaagcctcctttatctggctgtgcagccttgctctgtggcttttcccaacacaatcagtgctagtgctggggaggaacagtcaagagcagtcagttgcttgcttattttttctggatgagtctgggacacactgtaactttaacacatttaagaagtaggtgtgtggccttttcagaaggtggcatggtcctcaagtgagttcttagtattttatatcagcaaaataattcaattttgcaggttgcaaacaaatataaaacctgtttctgtttatgaatattattcttttagaatagaataagtacatgctgctgtaataaaattgcctttaatcacttaacaagcctaaccttgactcaaacagtgaatgcctatagaaataataaatgaaaaaaactagtatttttatatcataaaacaatgtcatttatagcttatcattcatgtattgtccagcagacattaaaagccctgtggataattaagttatcttcatacctgcaaaatggtggaggctattttcattaaaactgtcagaatttgcttactataattatgatacagtccaaagaatgcagtcactttttatcatgttaactaattgttctcttttgaagatctatggttgactaattaaacaataattcaagtagagtgtcccagaaaaaaaccacttgggctccctgtttggagtctggctggctctgagcattgccaatggcccctactcacctgactttgtatcctctccttttagaggctttgcattctgcacccagcttcactaacagtgggctgaaaacatccttgggttgagtgtttcatttgggagttatttggccagggccttttgaacagtagtgtccccatgaagtgctagataatatatgtgtaagagtcagctttttttttttttttaactctaacacccttcagaaatttctaactactttgtaactgcatggcttaacctggtgataaaagcagttattaaaagtctacgttttcc

SEQ ID NO: 12241 - DNA, 1537 bp, Homo sapiens
gtatatgctgatcttgcatgcagagtagacgctgcaccggtctccttttggtcccggtgtctgtgtcacacacggcgggtcctgccgaaatgcacttctaggaaagggaatgacctgcccgtgtgataatgcctcgtcagtgttcttgggcttttgtatccgttacagcactgatgtgagtgtagatgaagtaaaagctttggcttctctgatgacatacaagtgtgcagtggttgatgtgccgtttgggggtgctaaagctggtgttaagatcaatcccaagaactatactgataatgaattggaaaagatcacaaggaggttcaccatggagctagcaaaaaagggctttattggtcctggcattgatgtgcctgctccagacatgagcacaggtgagcgggagatgtcctggatcgctgatacctatgccagcaccatagggcactatgatattaatgcacacgcctgtgttactggtaaacccatcagccaagggggaatccatggacgcatctctgctactggccgtggtgtcttccatgggattgaaaatttcatcaatgaagcttcttacatgagcattttaggaatgacaccagggtttggagataaaacatttgttgttcagggatttggtaatgtgggcctacactctatgagatatttacatcgttttggtgctaaatgtattgctgttggtgagtctgatgggagtatatggaatccagatggtattgacccaaaggaactggaagacttcaaattgcaacatgggtccattctgggcttccccaaggcaaagccctatgaaggaagcatcttggaggccgactgtgacatactgatcccagctgccagtgagaagcagttgaccaaatccaacgcacccagagtcaaagccaagatcattgctgaaggtgccaatgggccaacaactccagaagctgacaagatcttcctggagagaaacattatggttattccagatctctacttgaatgctggaggagtgacagtatcttactttgagtggctgaagaatctaaatcatgtcagctatggccgtttgaccttcaaatatgaaagggattctaactaccacttgctcatgtctgttcaagagagtttagaaagaaaatttggaaagcatggtggaactattcccattgtacccacggcagagttccaagacaggatatcgggtgcatctgagaaagacatcgtgcactctggcttggcatacacaatggagcgttctgccaggcaaattatgcgcacagccatgaagtataacctgggattggacctgagaacagctgcctatgttaatgccattgagaaagtcttcaaagtgtacaatgaagctggtgtgaccttcacatagatggatcatggctgacttcctcactatcctcttcacatgtaacttctgcagacctatcacaagtttacatgtaaccacagaaatccctttctctcctgactcattaataatggataccattctcaacaagtcaatccaagtcagcccgtt

SEQ ID NO: 12242 - DNA, 2333 bp, Homo sapiens
ttccttcctagtcgcggggagtctgagaaagcgcacctgttccgcgaccgtcacgcacccctcctccgcctgccgcgatgtaccgctacctggccaaagcgctgctgccgtcccgggccgggcccgctgccctgggctccgcggccaaccactcggccgcgttgctgggccggggccgcggacagcccgccgccgcctcgcagccggggctcgcattggccgcccggcgccactacagcgagttggtggccgaccgcgaggacgaccccaacttcttcaagatggtggagggcttcttcgatcgcggcgccagcatcgtggaggacaagttggtgaaggacctgaggacccaggaaagcgaggagcagaagcggaaccgggtgcgcggcatcctgcggatcatcaagccctgcaaccatgtgctgagtctctccttccccatccggcgcgacgacggctcctgggaggtcatcgaaggctaccgggcccagcacagccagcaccgcacgccctgcaagggaggtatccgttacagcactgatgtgagtgtagatgaagtaaaagctttggcttctctgatgacatacaagtgtgcagtggttgatgtgccgtttgggggtgctaaagctggtgttaagatcaatcccaagaactataccgaaaatgaattggaaaagatcacaaggaggttcaccatggagctagcaaagaagggctttattggtcctggcgttgatgtgcctgctccagacatgaacacaggtgagcgggagatgtcctggattgctgatacctatgccagcaccatagggcactatgatattaatgcacacgcctgtgttactggtaaacccatcagccaagggggaatccatggacgcatctctgctactggccgtggtgtcttccatgggattgaaaacttcatcaatgaagcttcttacatgagcattttaggaatgacaccagggtttagagataaaacatttgttgttcagggatttggtaatgtgggcctacactctatgagatatttacatcgttttggtgctaaatgtattgctgttggtgagtctgatgggagtatatggaatccagatggtattgacccaaaggaactggaagacttcaaattgcaacatgggtccattctgggcttccccaaggcaaagccctatgaaggaagcatcttggaggtcgactgtgacatactgatcccagctgccactgagaagcagttgaccaaatccaacgcacccagagtcaaagccaagatcattgctgaaggtgccaatgggccaacaactccagaagctgataagatcttcctggagagaaacattttggttattccagatctctacttgaatgctggaggagtgacagtatcttactttgagtggctgaagaatctaaatcatgtcagctatggccgtttgaccttcaaatatgaaagggattctaactaccacttgctcctgtctgttcaagagagtttagaaagaaaatttggaaagcatggtggaactattcccattgtacccacggcagagttccaagacagtatatcgggtgcatctgagaaagacattgtgcactctgccttggcatacacaatggagcgttctgccaggcaaattatgcacacagccatgaagtataacctgggattggacctgagaacagctgcctatgtcaatgccattgaaaaagtcttcaaagtgtacagtgaagctggtgtgaccttcacatagatggatcatggctgacttcctcactaacctcttcacgtgtaacttctgcagacctaccacaagtttacatgtaaccacagaaatccctttctctcctgactcattactaatggataccattctcaacaagtcaatccaaatcagcccgttaaggagaaagaaattaatatacaagctgagtgtgaaagtagaaatcacctacaccagagagctattttggtattttgcctttaaataaaaagcctcctccatatggctgtgcagccttgctctgtggcttttcccagcacaatcagtgctagtgctggggaagggacagtcaagagcagtcagttgcttacttattttgctctggatgagtctgggacacgctgtaactttaacacatttaagaagaaggtgtgtggccttttcagaaggtggcatggtcctcaagtgagttcttagtattttatatcagcaaaataactcaattttgcagattgcaaacaaatataaaagctgtttctgtttatgaattttattcttttagaatagaataagtacatgctgctgtaataaaattgcctttaatcactt

SEQ ID NO: 12243 - DNA, 5171 bp, Homo sapiens
gtgattgtgaagggggaggaggctgtggcaggcaggggtggtagtagtagtgaatgacacagatttgccagatgacatgtagcggacctctgcatcagccaagaggaattaagctttgtcactccccactgggactacctttctcctggtatgtgcgcaaggaattcatatgctgctgctgctgcagccaccagagcagagagccttgagtacactttgccacagaaagcagtgagcaagaatgatagctgtctcttttaaatgccgttgtcaaattctgaggcgacttactaaagatgagagtccctacactaaatccgccagccagacaaagccgcctgatggagcgttggctgtgaggagacagagcatcccagaggaattcaagggctccacagtcgtcgagctgatgaagaaggaaggcactaccctgggtctgacggtatcgggaggaattgataaggatggcaagccaagagtatctaatctgcggcaaggaggaattgctgctagaagtgaccagctggatgtgggtgactacatcaaagcagtgaatggaatcaacctggccaaattccgccatgacgagatcatcagcttgctgaagaatgtgggagaaagagtggttcttgaagtagagtacgagcttccaccggtctctgtgcaaggatcaagtgttattttccgaacagtggaggtcacattacataaagaaggcaatacctttggttttgtaattcgagggggagcacatgatgatagaaataaatctcgtccagttgtgataacatgtgttcgtcctggagggcctgctgacagagagggcacgatcaaacccggtgacaggttgctcagtgtggatggaattcggcttcttggaactacgcatgctgaagccatgagtattcttaaacaatgtggacaagaagcagcactgctgatagaatatgatgtctcagtaatggactctgtggcaacagcatccgggccactactagtcgaagttgccaaaactcctggtgccagccttggggttgccctaactacctcgatgtgctgtaacaaacaagtcattgtcatagacaaaatcaaatctgcaagtattgcagacagatgtggcgcattgcatgtgggagatcacatcctctccatcgatggaaccagcatggagtactgtacacttgcagaagcaacccagttcctggccaacaccactgaccaggtcaagcttgagatccttccccatcatcagacccggctggccctaaaggggcccgaccatgtgaaaattcagaggagcgacaggcaacttacctgggattcctgggccagcaaccacagcagccttcacaccaaccatcactataacacgtaccaccctgaccattgcagagtaccagccctgacattcccgaaagcacctcctccaaacagccctccagctttggtgtcttcatccttctctcctacctccatgagtgcatacagcctgagttccctgaacatggggactctacctcgaagcctctactccaccagcccacgtggaaccatgatgaggaggagactgaaaaagaaagacttcaaaagctcattgtccttagcctccagcacagtaggattggctgggcaggttgttcacacagaaaccacagaggttgtgctgacggcagatcctgtcacaggatttgggatccaactgcagggcagtgtgtttgccacagaaactctctcttctccacctctgatttcctatatcgaagctgacagcccagcagagagatgtggggtgctacagattggagacagagtgatggccatcaatggaattccaacagaagacagcaccttcgaagaagccagtcagctcctccgagactcttcaatcacgagcaaggtcacactggaaatcgagtttgatgttgcagagtctgtcatcccaagtagtggaacatttcatgtaaagctgcctaagaagcacaatgtggaacttggaataaccataagttcaccatccagtagaaaaccaggagaccccctcgtcatttcagatatcaagaaagggagtgtggcacacagaactgggaccctggaacttggggataaattgctcgcaatagataatatccggctggacaactgttccatggaagatgcagttcagatcctccagcaatgtgaagacctggtgaagctcaaaatccgcaaagatgaagataattcagatgagcaagaaagttccggagcaattatttacaccgtggagcttaaacgctacggggggccccttggcatcacaatttcaggaactgaagagccgtttgatcctataatcatttcaagcctcactaaagggggattagctgaaagaactggcgcaatccacataggagaccgaatcctagccatcaatagcagcagcttgaaagggaagcctctgagtgaagccatccatttgttacagatggcaggagagactgtcaccttgaaaattaagaaacagacagatgcccagtcagcatcgagccccaagaagttccctatttctagccatttgagtgacctgggggatgtggaggaggactcctcaccagcacagaagccaggcaagctctccgacatgtacccctccacggtgcccagtgtggacagtgctgtggattcatgggatgggtctgcaatagacaccagctatggaactcaaggcactagttttcaggcctcaggatacaatttcaacacctatgactggaggagtccaaaacagagaggcagcttgtccccagtcactaagcctcgaagccagacttacccagatgtggggctgagttatgaagactgggaccggtccacagccagtggttttgcaggggctgccgatagtgcagagacagaacaagaggagaacttctggtctcaagcgctggaggatttggaaacctgcggacagtcaggaattctgagagaactggaggcaacaatcatgtcggggagcacgatgagtttgaatcatgaggctccaacacctcgcagtcagctggggcgacaggccagcttccaggagcgcagcagctcgcggccgcactacagccaaacaactcggagcaacaccctgccttcagatgtgggtaggaagtcagtaaccctgagaaaaatgaaacaagaaataaaggagatcatgtctccaactcctgtggagctgcacaaggtgaccttgtacaaggactctgacatggaggactttgggttcagtgtagcagatggcttactggagaaaggagtgtatgtcaaaaatattcgcccagctgggccaggagatcttggtggcttaaagccctatgacaggctcttacaggtgaatcatgtccgaaccagagactttgactgctgccttgttgtgcccctcatagcagaatccgggaataagctggacctggttattagtagaaacccactggcttcacagaagtctatagaccaacagagtctaccaggagattggagtgaacagaacagtgcttttttccagcagcctagccacggtggtaatttggagacacgagaacccactaatacattatagcaacgctttttataaagcaggacaaaagacaatatctacatggtgctaaaaatcctttaagatttctgtgacctttgaagcacagataatcaatcaacgtggcattaactgcaagcacaggggtcttttaaatctctctcatggctcatgttcacttcccttttcaagttgaagaggtttcttttttggtgaccactatggtatatggtgggcaatgccctgccagtcccaacggtagagaaaaataggccgtcccccacaactctacaattaacatcagaggaaattttttacaagttcatcttactatcactttttaaaaagagaaacatctgtttgaaaatattctctgtgatgatttccttaattcactttgaaatcagtttcttactatgaagtcattaatgtaagaacttggccaacaaagcttttcttctcataggctggctctactaggggaactagtgtttggtaaactgctgggactaccacaatgggaggggtacaggtataaaattaagttatcttaaaatgtttcagcaatgatgcacgtaggagaccataataggtggtggtaaatgttttgcccacgtataggaatgattttaactaagatgtatgctattccctatgcaacaaattatcaaacaggatatgtcttgtgacctgttttttttttaaggacacatttttaatagctgaaaatctctgataatgaattagagtgtgtagtaaacatgagaattagttatattatcttatttttaaaattcaagactaagaacttcagagaatgaagagtctattaaaatgaggttcatcttaatgataggcaaaccaaactcatactgcttgacatgttttgaaaactggtaatattgagggtgtacagcacatgtacttaaaaatgacactggactatcttttgctctgagccatgccacttaccgaaattgtaaatacatttttcacaaatgcattgccaattattaccatccctcaaagcaataaattgtgacagttgctttaaatgtttgtcagcaactgttttcatttgttcagatattttgaatagctacactaataactgttattatttggtgaacataaaaaaataaatagatctgtatattgatggtagactctccatattgaaatgattattttccaaacattttcattttggtcaataattcaaactaccacttaggcaaagtattcgaacactgtgtcctttgtttaaggaaatataaaaaaaaaatcacctttctttttgtgcaaaaaaaatattatttcaatcacatttcagaaccgccagggcaagaaagtataaagcaggatcatgttaagaaaaaagaaaaaaagatcatgagtcacttaaatatgtatttttatttgtaacaaacaagtattaaactgtaaagtatttttgtacaaatttaatactttaatagcatggtatttatcgtctatgtatggttttggggaattcaaaattgttcaaatatttgtatggaaaaaaataaaaccctctaccaaatggaataaacagtgattttaaaaagccaaataaagaggatatgcatta

SEQ ID NO: 12244 - DNA, 5216 bp, Homo sapiens
gtgattgtgaagggggaggaggctgtggcaggcaggggtggtagtagtagtgaatgacacagatttgccagatgacatgtagcggacctctgcatcagccaagaggaattaagctttgtcactccccactgggactacctttctcctggtatgtgcgcaaggaattcatatgctgctgctgctgcagccaccagagcagagagccttgagtacactttgccacagaaagcagtgagcaagaatgatagctgtctcttttaaatgccgttgtcaaattctgaggcgacttactaaagatgagagtccctacactaaatccgccagccagacaaagccgcctgatggagcgttggctgtgaggagacagagcatcccagaggaattcaagggctccacagtcgtcgagctgatgaagaaggaaggcactaccctgggtctgacggtatcgggaggaattgataaggatggcaagccaagagtatctaatctgcggcaaggaggaattgctgctagaagtgaccagctggatgtgggtgactacatcaaagcagtgaatggaatcaacctggccaaattccgccatgacgagatcatcagcttgctgaagaatgtgggagaaagagtggttcttgaagtagagtacgagcttccaccggtctctgtgcaaggatcaagtgttattttccgaacagtggaggtcacattacataaagaaggcaatacctttggttttgtaattcgagggggagcacatgatgatagaaataaatctcgtccagttgtgataacatgtgttcgtcctggagggcctgctgacagagagggcacgatcaaacccggtgacaggttgctcagtgtggatggaattcggcttcttggaactacgcatgctgaagccatgagtattcttaaacaatgtggacaagaagcagcactgctgatagaatatgatgtctcagtaatggactctgtggcaacagcatccgggccactactagtcgaagttgccaaaactcctggtgccagccttggggttgccctaactacctcgatgtgctgtaacaaacaagtcattgtcatagacaaaatcaaatctgcaagtattgcagacagatgtggcgcattgcatgtgggagatcacatcctctccatcgatggaaccagcatggagtactgtacacttgcagaagcaacccagttcctggccaacaccactgaccaggtcaagcttgagatccttccccatcatcagacccggctggccctaaaggggcccgaccatgtgaaaattcagaggagcgacaggcaacttacctgggattcctgggccagcaaccacagcagccttcacaccaaccatcactataacacgtaccaccctgaccattgcagagtaccagccctgacattcccgaaagcacctcctccaaacagccctccagctttggtgtcttcatccttctctcctacctccatgagtgcatacagcctgagttccctgaacatggggactctacctcgaagcctctactccaccagcccacgtggaaccatgatgaggaggagactgaaaaagaaagacttcaaaagctcattgtccttagcctccagcacagtaggattggctgggcaggttgttcacacagaaaccacagaggttgtgctgacggcagatcctgtcacaggatttgggatccaactgcagggcagtgtgtttgccacagaaactctctcttctccacctctgatttcctatatcgaagctgacagcccagcagagagatgtggggtgctacagattggagacagagtgatggccatcaatggaattccaacagaagacagcaccttcgaagaagccagtcagctcctccgagactcttcaatcacgagcaaggtcacactggaaatcgagtttgatgttgcagagtctgtcatcccaagtagtggaacatttcatgtaaagctgcctaagaagcacaatgtggaacttggaataaccataagttcaccatccagtagaaaaccaggagaccccctcgtcatttcagatatcaagaaagggagtgtggcacacagaactgggaccctggaacttggggataaattgctcgcaatagataatatccggctggacaactgttccatggaagatgcagttcagatcctccagcaatgtgaagacctggtgaagctcaaaatccgcaaagatgaagataattcagatgagcaagaaagttccggagcaattatttacaccgtggagcttaaacgctacggggggccccttggcatcacaatttcaggaactgaagagccgtttgatcctataatcatttcaagcctcactaaagggggattagctgaaagaactggcgcaatccacataggagaccgaatcctagccatcaatagcagcagcttgaaagggaagcctctgagtgaagccatccatttgttacagatggcaggagagactgtcaccttgaaaattaagaaacagacagatgcccagtcagcatcgagccccaagaagttccctatttctagccatttgagtgacctgggggatgtggaggaggactcctcaccagcacagaagccaggcaagctctccgacatgtacccctccacggtgcccagtgtggacagtgctgtggattcatgggatgggtctgcaatagacaccagctatggaactcaaggcactagttttcaggcctcaggatacaatttcaacacctatgactggaggagtccaaaacagagaggcagcttgtccccagtcactaagcctcgaagccagacttacccagatgtggggctgagttatgaagactgggaccggtccacagccagtggttttgcaggggctgccgatagtgcagagacagaacaagaggagaacttctggtctcaagcgctggaggatttggaaacctgcggacagtcaggaattctgagagaactggaggagaaagctgacaggcgtgtgtctttgagaaacatgactctcttggcaacaatcatgtcggggagcacgatgagtttgaatcatgaggctccaacacctcgcagtcagctggggcgacaggccagcttccaggagcgcagcagctcgcggccgcactacagccaaacaactcggagcaacaccctgccttcagatgtgggtaggaagtcagtaaccctgagaaaaatgaaacaagaaataaaggagatcatgtctccaactcctgtggagctgcacaaggtgaccttgtacaaggactctgacatggaggactttgggttcagtgtagcagatggcttactggagaaaggagtgtatgtcaaaaatattcgcccagctgggccaggagatcttggtggcttaaagccctatgacaggctcttacaggtgaatcatgtccgaaccagagactttgactgctgccttgttgtgcccctcatagcagaatccgggaataagctggacctggttattagtagaaacccactggcttcacagaagtctatagaccaacagagtctaccaggagattggagtgaacagaacagtgcttttttccagcagcctagccacggtggtaatttggagacacgagaacccactaatacattatagcaacgctttttataaagcaggacaaaagacaatatctacatggtgctaaaaatcctttaagatttctgtgacctttgaagcacagataatcaatcaacgtggcattaactgcaagcacaggggtcttttaaatctctctcatggctcatgttcacttcccttttcaagttgaagaggtttcttttttggtgaccactatggtatatggtgggcaatgccctgccagtcccaacggtagagaaaaataggccgtcccccacaactctacaattaacatcagaggaaattttttacaagttcatcttactatcactttttaaaaagagaaacatctgtttgaaaatattctctgtgatgatttccttaattcactttgaaatcagtttcttactatgaagtcattaatgtaagaacttggccaacaaagcttttcttctcataggctggctctactaggggaactagtgtttggtaaactgctgggactaccacaatgggaggggtacaggtataaaattaagttatcttaaaatgtttcagcaatgatgcacgtaggagaccataataggtggtggtaaatgttttgcccacgtataggaatgattttaactaagatgtatgctattccctatgcaacaaattatcaaacaggatatgtcttgtgacctgttttttttttaaggacacatttttaatagctgaaaatctctgataatgaattagagtgtgtagtaaacatgagaattagttatattatcttatttttaaaattcaagactaagaacttcagagaatgaagagtctattaaaatgaggttcatcttaatgataggcaaaccaaactcatactgcttgacatgttttgaaaactggtaatattgagggtgtacagcacatgtacttaaaaatgacactggactatcttttgctctgagccatgccacttaccgaaattgtaaatacatttttcacaaatgcattgccaattattaccatccctcaaagcaataaattgtgacagttgctttaaatgtttgtcagcaactgttttcatttgttcagatattttgaatagctacactaataactgttattatttggtgaacataaaaaaataaatagatctgtatattgatggtagactctccatattgaaatgattattttccaaacattttcattttggtcaataattcaaactaccacttaggcaaagtattcgaacactgtgtcctttgtttaaggaaatataaaaaaaaaatcacctttctttttgtgcaaaaaaaatattatttcaatcacatttcagaaccgccagggcaagaaagtataaagcaggatcatgttaagaaaaaagaaaaaaagatcatgagtcacttaaatatgtatttttatttgtaacaaacaagtattaaactgtaaagtatttttgtacaaatttaatactttaatagcatggtatttatcgtctatgtatggttttggggaattcaaaattgttcaaatatttgtatggaaaaaaataaaaccctctaccaaatggaataaacagtgattttaaaaagccaaataaagaggatatgcatta

SEQ ID NO: 12245 - DNA, 4888 bp, Homo sapiens
ctgctgctgctgcagccaccagagcagagagccttgagtacactttgccacagaaagcagtgagcaagaatgatagctgtctcttttaaatgccgttgtcaaattctgaggcgacttactaaagatgagagtccctacactaaatccgccagccagacaaagccgcctgatggagcgttggctgtgaggagacagagcatcccagaggaattcaagggctccacagtcgtcgagctgatgaagaaggaaggcactaccctgggtctgacggtatcgggaggaattgataaggatggcaagccaagagtatctaatctgcggcaaggaggaattgctgctagaagtgaccagctggatgtgggtgactacatcaaagcagtgaatggaatcaacctggccaaattccgccatgacgagatcatcagcttgctgaagaatgtgggagaaagagtggttcttgaagtagagtacgagcttccaccggtctctgtgcaaggatcaagtgttattttccgaacagtggaggtcacattacataaagaaggcaatacctttggttttgtaattcgagggggagcacatgatgatagaaataaatctcgtccagttgtgataacatgtgttcgtcctggagggcctgctgacagagagggcacgatcaaacccggtgacaggttgctcagtgtggatggaattcggcttcttggaactacgcatgctgaagccatgagtattcttaaacaatgtggacaagaagcagcactgctgatagaatatgatgtctcagtaatggactctgtggcaacagcatccgggccactactagtcgaagttgccaaaactcctggtgccagccttggggttgccctaactacctcgatgtgctgtaacaaacaagtcattgtcatagacaaaatcaaatctgcaagtattgcagacagatgtggcgcattgcatgtgggagatcacatcctctccatcgatggaaccagcatggagtactgtacacttgcagaagcaacccagttcctggccaacaccactgaccaggtcaagcttgagatccttccccatcatcagacccggctggccctaaaggggcccgaccatgcagctttggtgtcttcatccttctctcctacctccatgagtgcatacagcctgagttccctgaacatggggactctacctcgaagcctctactccaccagcccacgtggaaccatgatgaggaggagactgaaaaagaaagacttcaaaagctcattgtccttagcctccagcacagtaggattggctgggcaggttgttcacacagaaaccacagaggttgtgctgacggcagatcctgtcacaggatttgggatccaactgcagggcagtgtgtttgccacagaaactctctcttctccacctctgatttcctatatcgaagctgacagcccagcagagagatgtggggtgctacagattggagacagagtgatggccatcaatggaattccaacagaagacagcaccttcgaagaagccagtcagctcctccgagactcttcaatcacgagcaaggtcacactggaaatcgagtttgatgttgcagagtctgtcatcccaagtagtggaacatttcatgtaaagctgcctaagaagcacaatgtggaacttggaataaccataagttcaccatccagtagaaaaccaggagaccccctcgtcatttcagatatcaagaaagggagtgtggcacacagaactgggaccctggaacttggggataaattgctcgcaatagataatatccggctggacaactgttccatggaagatgcagttcagatcctccagcaatgtgaagacctggtgaagctcaaaatccgcaaagatgaagataattcagatgagcaagaaagttccggagcaattatttacaccgtggagcttaaacgctacggggggccccttggcatcacaatttcaggaactgaagagccgtttgatcctataatcatttcaagcctcactaaagggggattagctgaaagaactggcgcaatccacataggagaccgaatcctagccatcaatagcagcagcttgaaagggaagcctctgagtgaagccatccatttgttacagatggcaggagagactgtcaccttgaaaattaagaaacagacagatgcccagtcagcatcgagccccaagaagttccctatttctagccatttgagtgacctgggggatgtggaggaggactcctcaccagcacagaagccaggcaagctctccgacatgtacccctccacggtgcccagtgtggacagtgctgtggattcatgggatgggtctgcaatagacaccagctatggaactcaaggcactagttttcaggcctcaggatacaatttcaacacctatgactggaggagtccaaaacagagaggcagcttgtccccagtcactaagcctcgaagccagacttacccagatgtggggctgagttatgaagactgggaccggtccacagccagtggttttgcaggggctgccgatagtgcagagacagaacaagaggagaacttctggtctcaagcgctggaggatttggaaacctgcggacagtcaggaattctgagagaactggaggagaaagctgacaggcgtgtgtctttgagaaacatgactctcttggcaacaatcatgtcggggagcacgatgagtttgaatcatgaggctccaacacctcgcagtcagctggggcgacaggccagcttccaggagcgcagcagctcgcggccgcactacagccaaacaactcggagcaacaccctgccttcagatgtgggtaggaagtcagtaaccctgagaaaaatgaaacaagaaataaaggagatcatgtctccaactcctgtggagctgcacaaggtgaccttgtacaaggactctgacatggaggactttgggttcagtgtagcagatggcttactggagaaaggagtgtatgtcaaaaatattcgcccagctgggccaggagatcttggtggcttaaagccctatgacaggctcttacaggtgaatcatgtccgaaccagagactttgactgctgccttgttgtgcccctcatagcagaatccgggaataagctggacctggttattagtagaaacccactggcttcacagaagtctatagaccaacagagtctaccaggagattggagtgaacagaacagtgcttttttccagcagcctagccacggtggtaatttggagacacgagaacccactaatacattatagcaacgctttttataaagcaggacaaaagacaatatctacatggtgctaaaaatcctttaagatttctgtgacctttgaagcacagataatcaatcaacgtggcattaactgcaagcacaggggtcttttaaatctctctcatggctcatgttcacttcccttttcaagttgaagaggtttcttttttggtgaccactatggtatatggtgggcaatgccctgccagtcccaacggtagagaaaaataggccgtcccccacaactctacaattaacatcagaggaaattttttacaagttcatcttactatcactttttaaaaagagaaacatctgtttgaaaatattctctgtgatgatttccttaattcactttgaaatcagtttcttactatgaagtcattaatgtaagaacttggccaacaaagcttttcttctcataggctggctctactaggggaactagtgtttggtaaactgctgggactaccacaatgggaggggtacaggtataaaattaagttatcttaaaatgtttcagcaatgatgcacgtaggagaccataataggtggtggtaaatgttttgcccacgtataggaatgattttaactaagatgtatgctattccctatgcaacaaattatcaaacaggatatgtcttgtgacctgttttttttttaaggacacatttttaatagctgaaaatctctgataatgaattagagtgtgtagtaaacatgagaattagttatattatcttatttttaaaattcaagactaagaacttcagagaatgaagagtctattaaaatgaggttcatcttaatgataggcaaaccaaactcatactgcttgacatgttttgaaaactggtaatattgagggtgtacagcacatgtacttaaaaatgacactggactatcttttgctctgagccatgccacttaccgaaattgtaaatacatttttcacaaatgcattgccaattattaccatccctcaaagcaataaattgtgacagttgctttaaatgtttgtcagcaactgttttcatttgttcagatattttgaatagctacactaataactgttattatttggtgaacataaaaaaataaatagatctgtatattgatggtagactctccatattgaaatgattattttccaaacattttcattttggtcaataattcaaactaccacttaggcaaagtattcgaacactgtgtcctttgtttaaggaaatataaaaaaaaaatcacctttctttttgtgcaaaaaaaatattatttcaatcacatttcagaaccgccagggcaagaaagtataaagcaggatcatgttaagaaaaaagaaaaaaagatcatgagtcacttaaatatgtatttttatttgtaacaaacaagtattaaactgtaaagtatttttgtacaaatttaatactttaatagcatggtatttatcgtctatgtatggttttggggaattcaaaattgttcaaatatttgtatggaaaaaaataaaaccctctaccaaatggaataaacagtgattttaaaaagccaaataaagaggatatgcatta

SEQ ID NO: 12246 - DNA, 5260 bp, Homo sapiens
gtgtgtgcgcgcgcgcgtgagtgagagaggagagagggagaagagagcgcgagagagggggggctatttcctaggggcgccgatcaagaatacagtgcatttcgagtagggatggttcagttttccacttcggagttcagactgacaccccacatcgacaatttggaggtggcaaacagcttcgcagtcactaatgctttctgctcccagttttcgagaggagtctatgctatttttggattttatgacaagaagtctgtaaataccatcacatcattttgcggaacactccacgtctccttcatcactcccagcttcccaacagatggcacacatccatttgtcattcagatgagacccgacctcaaaggagctctccttagcttgattgaatactatcaatgggacaagtttgcatacctctatgacagtgacagaggcttatcaacactgcaagctgtgctggattctgctgctgaaaagaaatggcaagtgactgctatcaatgtgggaaacattaacaatgacaagaaagatgagatgtaccgatcactttttcaagatctggagttaaaaaaggaacggcgtgtaattctggactgtgaaagggataaagtaaacgacattgtagaccaggttattaccattggaaaacatgttaaagggtaccactacatcattgcaaatctgggatttactgatggagacctattaaaaatccagtttggaggtgcaaatgtctctggatttcagatagtggactatgatgattcgttggtatctaaatttatagaaagatggtcaacactggaagaaaaagaataccctggagctcacacaacaacaattaagtatacttctgctctgacctatgatgccgttcaagtgatgactgaagccttccgcaacctaaggaagcaaagaattgaaatctcccgaagggggaatgcaggagactgtctggcaaacccagcagtgccctggggacaaggtgtagaaatagaaagggccctcaaacaggttcaggttgaaggtctctcaggaaatataaagtttgaccagaatggaaaaagaataaactatacaattaacatcatggagctcaaaactaatgggccccggaagattggctactggagtgaagtggacaaaatggttgttacccttactgagctcccttctggaaatgacacctctgggcttgagaataagactgttgttgtcaccacaattttggaatctccgtatgttatgatgaagaaaaatcatgaaatgcttgaaggcaatgagcgctatgagggctactgtgttgacctggctgcagaaatcgccaaacattgtgggttcaagtacaagttgacaattgttggtgatggcaagtatggggccagggatgcagacacgaaaatttggaatgggatggttggagaacttgtatatgggaaagctgatattgcaattgctccattaactattacccttgtgagagaagaggtgattgacttctcaaagcccttcatgagcctcgggatatctatcatgatcaagaagcctcagaagtccaaaccaggagtgttttcctttcttgatcctttagcctatgagatctggatgtgcattgtttttgcctacattggggtcagtgtagttttattcctggtcagcagatttagcccctacgagtggcacactgaggagtttgaagatggaagagaaacacaaagtagtgaatcaactaatgaatttgggatttttaatagtctctggttttccttgggtgcctttatgcagcaaggatgcgatatttcgccaagatccctctctgggcgcattgttggaggtgtgtggtggttctttaccctgatcataatctcctcctacacggctaacttagctgccttcctgactgtagagaggatggtgtctcccatcgaaagtgctgaggatctttctaagcaaacagaaattgcttatggaacattagactctggctccactaaagagtttttcaggagatctaaaattgcagtgtttgataaaatgtggacctacatgcggagtgcggagccctctgtgtttgtgaggactacggccgaaggggtggctagagtgcggaagtccaaagggaaatatgcctacttgttggagtccacgatgaacgagtacattgagcaaaggaagccttgcgacaccatgaaagttggtggaaacctggattccaaaggctatggcatcgcaacacctaaaggatcctcattaagaaccccagtaaatcttgcagtattgaaactcagtgagcaaggcgtcttagacaagctgaaaaacaaatggtggtacgataaaggtgaatgtggagccaaggactctggaagtaaggaaaagaccagtgccctcagtctgagcaacgttgctggagtattctacatccttgtcgggggccttggtttggcaatgctggtggctttgattgagttctgttacaagtcaagggccgaggcgaaacgaatgaaggtggcaaagaatgcacagaatattaacccatcttcctcgcagaattcacagaattttgcaacttataaggaaggttacaacgtatatggcatcgaaagtgttaaaatttaggggatgaccttgaatgatgccatgaggaacaaggcaaggctgtcaattacaggaagtactggagaaaatggacgtgttatgactccagaatttcccaaagcagtgcatgctgtcccttacgtgagtcctggcatgggaatgaatgtcagtgtgactgatctctcgtgattgataagaaccttttgagtgccttacacaatggttttcttgtgtgtttattgtcaaagtggtgagaggcatccagtatcttgaagacttttctttcagccaagaattcttaaatatgtggagttcatcttgaattgtaaggaatgattaattaaaacacaacatctttttctactcgagttacagacaaagcgtggtggacatgcacagctaacatggaagtactataatttacctgaagtctttgtacagacaacaaacctgtttctgcagccactattgttagtctcttgattcataatgacttaagcacacttgacatcaactgcatcaagatgtgacatgttttataaaaaaaggaaaaaaaacatttaaaactaaaaaatatttttaggtattttcacaaacaaactggcttttaaataaatttgcttccatattggttgaataagacaaaaacaattaaactgagtgggaagtgaataaaaaaaggctttaggtatcgattccatatttttcaaagccaaatatgtaaatgctaaggaaagtaaacaaagaggagattccaatcttgtaatttaatattgttattaaaactttaatgtatcctattctttaacatttggtgttaatataaaattacttggcaatgcttgacatttgaaataaacatttttctattgttttattgcaagtggtccaattaattttgcttagctacagtttggtcataaatcaagtgagtttaaagacactaccaagttgttaggtgcccagagaaaatttctcccttttaaaaaggccaggtgatttttcaaatgtaatcttgcccccaaagtaatatctgaatatctttttgacatgtctaaatatatatatatataaagaaatatttgttaacacaaaagcatttgatctatgtagataaatgctaatagatttaaaaagctaatattaacaaataccagaatacgtgaagttccatttttaaagtgtttgagcttacagaagagaaacattcattttaaatgaagtaaaaaatgccttgaaagtaattctttagatagttgcccattgattaaattccaaaaactaaatatgtttttagctttaaaattataaaagctgtcataaactttatatattatgaattttaaaatatgtttgagtctcctgcaatatagtttcatcccattgacatcaattaaaaataaccctaatatattatttttatatttattcctcaggtggaatggctattttaatatgcccagtgtggataaaatgtcacatttctgtaacttttgactaaagagcctatatttatctagttaatgaatttaaaggatctatctttcccttcataaaatacctcttatttccattaaagccccccaagtttaattaatttaggattttgaatgattattgacatccaatagttatttttaatatttgtattcttgttatttctggaagaaagcctttgtgtagcacttggtattttgcaaagtgcttttaaaacattcttacttaccgtatttcatagaagggaaggaaaaatgtaaggtttaacagtaagcacttgcattgaacatggaggcatgtggtatcatgatattcttcactaaatttagctgtccctaatcacagatcctaaggtaatataatataattttagtgcatttctcctcatcaggaatgctggaggtgcattttaagttttaataataagtgctagaatgaccaaattgcagactaattgtttccatattgtacttaaaatgagtttttaaaagtgaaaaagaaatgactatatacaatcaatgctatttattgtacctctgggcctactcttctaaaaattgtagcttatcgatttttctctgtcaagcttgaactaatgtaaataattgaaataatgtaaagttatattttcatgtttttatagatacaacatgacaagaatacataatgtaagagtatttcaactatggataatgttgattggataatgcacatctcagttacaagcagtactcatagtttaatatccatgtaacggtgcatcaatatattgctatataaatatgtctgtgtgcatataagtgaaaagtggtcaaacaagagtgatgacagctgtctaaaggtttttttattcattttatataaaaactgttatggaaagaccaaaatgtttatgaactattcttatgtaaatttacaattgtcctttactgtacttttttgtttacagtatagtaccttattttctgctgtgttaagtgggtgtcaaactccaagaagacatacactttctataacttctattgaagatattggaatttccaatttttcatgtgtactatgtcagaaaatgctttcgattttatttttaaatctaacatcggatggcttttccggagtgttgtaaaaacttcaatcatacataaaacatgttcttacaaaa

SEQ ID NO: 12247 - DNA, 3940 bp, Homo sapiens
gagcccatgagcaccatgcgcctgctgacgctcgccctgctgttctcctgctccgtcgcccgtgccgcgtgcgaccccaagatcgtcaacattggcgcggtgctgagcacgcggaagcacgagcagatgttccgcgaggccgtgaaccaggccaacaagcggcacggctcctggaagattcagctcaatgccacctccgtcacgcacaagcccaacgccatccagatggctctgtcggtgtgcgaggacctcatctccagccaggtctacgccatcctagttagccatccacctacccccaacgaccacttcactcccacccctgtctcctacacagccggcttctaccgcatacccgtgctggggctgaccacccgcatgtccatctactcggacaagagcatccacctgagcttcctgcgcaccgtgccgccctactcccaccagtccagcgtgtggtttgagatgatgcgtgtctacagctggaaccacatcatcctgctggtcagcgacgaccacgagggccgggcggctcagaaacgcctggagacgctgctggaggagcgtgagtccaaggcagagaaggtgctgcagtttgacccagggaccaagaacgtgacggccctgctgatggaggcgaaagagctggaggcccgggtcatcatcctttctgccagcgaggacgatgctgccactgtataccgcgcagccgcgatgctgaacatgacgggctccgggtacgtgtggctggtcggcgagcgcgagatctcggggaacgccctgcgctacgccccagacggcatcctcgggctgcagctcatcaacggcaagaacgagtcggcccacatcagcgacgccgtgggcgtggtggcccaggccgtgcacgagctcctcgagaaggagaacatcaccgacccgccgcggggctgcgtgggcaacaccaacatctggaagaccgggccgctcttcaagagagtgctgatgtcttccaagtatgcggatggggtgactggtcgcgtggagttcaatgaggatggggaccggaagttcgccaactacagcatcatgaacctgcagaaccgcaagctggtgcaagtgggcatctacaatggcacccacgtcatccctaatgacaggaagatcatctggccaggcggagagacagagaagcctcgagggtaccagatgtccaccagactgaagattgtgacgatccaccaggagcccttcgtgtacgtcaagcccacgctgagtgatgggacatgcaaggaggagttcacagtcaacggcgacccagtcaagaaggtgatctgcaccgggcccaacgacacgtcgccgggcagcccccgccacacggtgcctcagtgttgctacggcttttgcatcgacctgctcatcaagctggcacggaccatgaacttcacctacgaggtgcacctggtggcagatggcaagttcggcacacaggagcgggtgaacaacagcaacaagaaggagtggaatgggatgatgggcgagctgctcagcgggcaggcagacatgatcgtggcgccgctaaccataaacaacgagcgcgcgcagtacatcgagttttccaagcccttcaagtaccagggcctgactattctggtcaagaaggagattccccggagcacgctggactcgttcatgcagccgttccagagcacactgtggctgctggtggggctgtcggtgcacgtggtggccgtgatgctgtacctgctggaccgcttcagccccttcggccggttcaaggtgaacagcgaggaggaggaggaggacgcactgaccctgtcctcggccatgtggttctcctggggcgtcctgctcaactccggcatcggggaaggcgcccccagaagcttctcagcgcgcatcctgggcatggtgtgggccggctttgccatgatcatcgtggcctcctacaccgccaacctggcggccttcctggtgctggaccggccggaggagcgcatcacgggcatcaacgaccctcggctgaggaacccctcggacaagtttatctacgccacggtgaagcagagctccgtggatatctacttccggcgccaggtggagctgagcaccatgtaccggcatatggagaagcacaactacgagagtgcggcggaggccatccaggccgtgagagacaacaagctgcatgccttcatctgggactcggcggtgctggagttcgaggcctcgcagaagtgcgacctggtgacgactggagagctgtttttccgctcgggcttcggcataggcatgcgcaaagacagcccctggaagcagaacgtctccctgtccatcctcaagtcccacgagaatggcttcatggaagacctggacaagacgtgggttcggtatcaggaatgtgactcgcgcagcaacgcccctgcgacccttacttttgagaacatggccggggtcttcatgctggtagctgggggcatcgtggccgggatcttcctgattttcatcgagattgcctacaagcggcacaaggatgctcgccggaagcagatgcagctggcctttgccgccgttaacgtgtggcggaagaacctgcagagcaccgggggtggacgcggcgctttgcaaaaccaaaaagacacagtgctgccgcgacgcgctattgagagggaggagggccagctgcagctgtgttcccgtcatagggagagctgagactccccgcccgccctcctctgccccctcccccgcagacagacagacagacggacgggacagcggcccggcccacgcagagccccggagcaccacggggtcgggggaggagcacccccagcctcccccaggctgcgcctgcccgcccgccggttggccggctggccggtccaccccgtcccggccccgcgcgtgcccccagcgtggggctaacgggcgccttgtctgtgtatttctattttgcagcagtaccatcccactgatatcacgggcccgctcaacctctcagatccctcggtcagcaccgtggtgtgaggcccccggaggcgcccacctgcccagttagcccggccaaggacactgatgggtcctgctgctcgggaaggcctgagggaagcccacccgccccagagactgcccaccctgggcctcccgtccgtccgcccgcccaccccgctgcctggcgggcagcccctgctggaccaaggtgcggaccggagcggctgaggacggggcagagctgagtcggctgggcagggccgcagggcgctccggcagaggcagggccctggggtctctgagcagtggggagcgggggctaactggccccaggcggaggggcttggagcagagacggcagccccatccttcccgcagcaccagcctgagccacagtggggcccatggccccagctggctgggtcgcccctcctcgggcgcctgcgctcctctgcagcctgagctccaccctcccctcttcttgcggcaccgcccacccacaccccgtctgccccttgaccccacacgccggggctggccctgccctcccccacggccgtccctgacttcccagctggcagcgcctcccgccgcctcgggccgcctcctccagactcgagagggctgagcccctcctctcctcgtccggcctgcagcccagaacgggcctccccgggggtccccggacgctggctcgggactgtcttcaaccctgccctgcaccttgggcacgggagagcgccacccgcccgcccccgccctcgctccgggtgcgtgaccggcccgccaccttgtacagaaccagcactcccagggcccgagcgcgtgccttccccgtgcggcccgtgcgcagccgcgctctgcccctccgtccccagggtgcaggcgcgcaccgcccaacccccacctcccggtgtatgcagtggtgatgcctaaaggaatgtcacgc

SEQ ID NO: 12248 - DNA, 3577 bp, Homo sapiens
gagcccatgagcaccatgcgcctgctgacgctcgccctgctgttctcctgctccgtcgcccgtgccgcgtgcgaccccaagatcgtcaacattggcgcggtgctgagcacgcggaagcacgagcagatgttccgcgaggccgtgaaccaggccaacaagcggcacggctcctggaagattcagctcaatgccacctccgtcacgcacaagcccaacgccatccagatggctctgtcggtgtgcgaggacctcatctccagccaggtctacgccatcctagttagccatccacctacccccaacgaccacttcactcccacccctgtctcctacacagccggcttctaccgcatacccgtgctggggctgaccacccgcatgtccatctactcggacaagagcatccacctgagcttcctgcgcaccgtgccgccctactcccaccagtccagcgtgtggtttgagatgatgcgtgtctacagctggaaccacatcatcctgctggtcagcgacgaccacgagggccgggcggctcagaaacgcctggagacgctgctggaggagcgtgagtccaaggcagagaaggtgctgcagtttgacccagggaccaagaacgtgacggccctgctgatggaggcgaaagagctggaggcccgggtcatcatcctttctgccagcgaggacgatgctgccactgtataccgcgcagccgcgatgctgaacatgacgggctccgggtacgtgtggctggtcggcgagcgcgagatctcggggaacgccctgcgctacgccccagacggcatcctcgggctgcagctcatcaacggcaagaacgagtcggcccacatcagcgacgccgtgggcgtggtggcccaggccgtgcacgagctcctcgagaaggagaacatcaccgacccgccgcggggctgcgtgggcaacaccaacatctggaagaccgggccgctcttcaagagagtgctgatgtcttccaagtatgcggatggggtgactggtcgcgtggagttcaatgaggatggggaccggaagttcgccaactacagcatcatgaacctgcagaaccgcaagctggtgcaagtgggcatctacaatggcacccacgtcatccctaatgacaggaagatcatctggccaggcggagagacagagaagcctcgagggtaccagatgtccaccagactgaagattgtgacgatccaccaggagcccttcgtgtacgtcaagcccacgctgagtgatgggacatgcaaggaggagttcacagtcaacggcgacccagtcaagaaggtgatctgcaccgggcccaacgacacgtcgccgggcagcccccgccacacggtgcctcagtgttgctacggcttttgcatcgacctgctcatcaagctggcacggaccatgaacttcacctacgaggtgcacctggtggcagatggcaagttcggcacacaggagcgggtgaacaacagcaacaagaaggagtggaatgggatgatgggcgagctgctcagcgggcaggcagacatgatcgtggcgccgctaaccataaacaacgagcgcgcgcagtacatcgagttttccaagcccttcaagtaccagggcctgactattctggtcaagaaggagattccccggagcacgctggactcgttcatgcagccgttccagagcacactgtggctgctggtggggctgtcggtgcacgtggtggccgtgatgctgtacctgctggaccgcttcagccccttcggccggttcaaggtgaacagcgaggaggaggaggaggacgcactgaccctgtcctcggccatgtggttctcctggggcgtcctgctcaactccggcatcggggaaggcgcccccagaagcttctcagcgcgcatcctgggcatggtgtgggccggctttgccatgatcatcgtggcctcctacaccgccaacctggcggccttcctggtgctggaccggccggaggagcgcatcacgggcatcaacgaccctcggctgaggaacccctcggacaagtttatctacgccacggtgaagcagagctccgtggatatctacttccggcgccaggtggagctgagcaccatgtaccggcatatggagaagcacaactacgagagtgcggcggaggccatccaggccgtgagagacaacaagctgcatgccttcatctgggactcggcggtgctggagttcgaggcctcgcagaagtgcgacctggtgacgactggagagctgtttttccgctcgggcttcggcataggcatgcgcaaagacagcccctggaagcagaacgtctccctgtccatcctcaagtcccacgagaatggcttcatggaagacctggacaagacgtgggttcggtatcaggaatgtgactcgcgcagcaacgcccctgcgacccttacttttgagaacatggccggggtcttcatgctggtagctgggggcatcgtggccgggatcttcctgattttcatcgagattgcctacaagcggcacaaggatgctcgccggaagcagatgcagctggcctttgccgccgttaacgtgtggcggaagaacctgcagcagtaccatcccactgatatcacgggcccgctcaacctctcagatccctcggtcagcaccgtggtgtgaggcccccggaggcgcccacctgcccagttagcccggccaaggacactgatgggtcctgctgctcgggaaggcctgagggaagcccacccgccccagagactgcccaccctgggcctcccgtccgtccgcccgcccaccccgctgcctggcgggcagcccctgctggaccaaggtgcggaccggagcggctgaggacggggcagagctgagtcggctgggcagggccgcagggcgctccggcagaggcagggccctggggtctctgagcagtggggagcgggggctaactggccccaggcggaggggcttggagcagagacggcagccccatccttcccgcagcaccagcctgagccacagtggggcccatggccccagctggctgggtcgcccctcctcgggcgcctgcgctcctctgcagcctgagctccaccctcccctcttcttgcggcaccgcccacccacaccccgtctgccccttgaccccacacgccggggctggccctgccctcccccacggccgtccctgacttcccagctggcagcgcctcccgccgcctcgggccgcctcctccagactcgagagggctgagcccctcctctcctcgtccggcctgcagcccagaacgggcctccccgggggtccccggacgctggctcgggactgtcttcaaccctgccctgcaccttgggcacgggagagcgccacccgcccgcccccgccctcgctccgggtgcgtgaccggcccgccaccttgtacagaaccagcactcccagggcccgagcgcgtgccttccccgtgcggcccgtgcgcagccgcgctctgcccctccgtccccagggtgcaggcgcgcaccgcccaacccccacctcccggtgtatgcagtggtgatgcctaaaggaatgtcacgc

SEQ ID NO: 12249 - DNA, 4236 bp, Homo sapiens
agtgctgggctgttggagagagcgagcagcaagccggtgagcgcgagcgcggcgcgccggccggctaacccgagagcgcgaggcgccccaggctggcaggcgccgcgggacccctcaccctctctggtcgcccctccccggattcccccaccctccgtgcctgcaggagcccctgggctttcccggaggagctcgccctgaagggcccggacctcggcgagcccaccaccgttccctccagcgccgccgccgccaccgcagcagccggagcagcatggtccagctgaggaagctgctccgcgtcctgactttgatgaagttcccctgctgcgtgctggaggtgctcctgtgcgcgctggcggcggcggcgcgcggccaggagatgtacgccccgcactcaatccggatcgagggggacgtcaccctcggggggctgttccccgtgcacgccaagggtcccagcggagtgccctgcggcgacatcaagagggaaaacgggatccacaggctggaagcgatgctctacgccctggaccagatcaacagtgatcccaacctactgcccaacgtgacgctgggcgcgcggatcctggacacttgttccagggacacttacgcgctcgaacagtcgcttactttcgtccaggcgctcatccagaaggacacctccgacgtgcgctgcaccaacggcgaaccgccggttttcgtcaagccggagaaagtagttggagtgattggggcttcggggagttcggtctccatcatggtagccaacatcctgaggctcttccagatcccccagattagttatgcatcaacggcacccgagctaagtgatgaccggcgctatgacttcttctctcgcgtggtgccacccgattccttccaagcccaggccatggtagacattgtaaaggccctaggctggaattatgtgtctaccctcgcatcggaaggaagttatggagagaaaggtgtggagtccttcacgcagatttccaaagaggcaggtggactctgcattgcccagtccgtgagaatcccccaggaacgcaaagacaggaccattgactttgatagaattatcaaacagctcctggacacccccaactccagggccgtcgtgatttttgccaacgatgaggatataaagcagatccttgcagcagccaaaagagctgaccaagttggccattttctttgggtgggatcagacagctggggatccaaaataaacccactgcaccagcatgaagatatcgcagaaggggccatcaccattcagcccaagcgagccacggtggaagggtttgatgcctactttacgtcccgtacacttgaaaacaacagaagaaatgtatggtttgccgaatactgggaggaaaacttcaactgcaagttgacgattagtgggtcaaaaaaagaagacacagatcgcaaatgcacaggacaggagagaattggaaaagattccaactatgagcaggagggtaaagtccagttcgtgattgacgcagtctatgctatggctcacgcccttcaccacatgaacaaggatctctgtgctgactaccggggtgtctgcccagagatggagcaagctggaggcaagaagttgctgaagtatatacgcaatgttaatttcaatggtagtgctggcactccagtgatgtttaacaagaacggggatgcacctgggcgttatgacatctttcagtaccagaccacaaacaccagcaacccgggttaccgtctgatcgggcagtggacagacgaacttcagctcaatatagaagacatgcagtggggtaaaggagtccgagagatacccgcctcagtgtgcacactaccatgtaagccaggacagagaaagaagacacagaaaggaactccttgctgttggacctgtgagccttgcgatggttaccagtaccagtttgatgagatgacatgccagcattgcccctatgaccagaggcccaatgaaaatcgaaccggatgccaggatattcccatcatcaaactggagtggcactccccctgggctgtgattcctgtcttcctggcaatgttggggatcattgccaccatctttgtcatggccactttcatccgctacaatgacacgcccattgtccgggcatctgggcgggaactcagctatgttcttttgacgggcatctttctttgctacatcatcactttcctgatgattgccaaaccagatgtggcagtgtgttctttccggcgagttttcttgggcttgggtatgtgcatcagttatgcagccctcttgacgaaaacaaatcggatttatcgcatatttgagcagggcaagaaatcagtaacagctcccagactcataagcccaacatcacaactggcaatcacttccagtttaatatcagttcagcttctaggggtgttcatttggtttggtgttgatccacccaacatcatcatagactatgatgaacacaagacaatgaaccctgagcaagccagaggggttctcaagtgtgacattacagatctccaaatcatttgctccttgggatatagcattcttctcatggtcacatgtactgtgtatgccatcaagactcggggtgtacccgagaattttaacgaagccaagcccattggattcactatgtacacgacatgtatagtatggcttgccttcattccaattttttttggcaccgctcaatcagcggaaaagctctacatacaaactaccacgcttacaatctccatgaacctaagtgcatcagtggcgctggggatgctatacatgccgaaagtgtacatcatcattttccaccctgaactcaatgtccagaaacggaagcgaagcttcaaggcggtagtcacagcagccaccatgtcatcgaggctgtcacacaaacccagtgacagacccaacggtgaggcaaagaccgagctctgtgaaaacgtagacccaaacaactgtataccaccagtaagaaagagtgtacaaaagtctgttacttggtacactatcccaccaacagtatagcttttgactgctttcccaaaggccctgctgcaaaaaagaagtatgtcagttataataacctggttatctaacctgttccattccatggaaccatggaggaggaagaccctcagttattttgtcacccaacctggcataggactctttggtcctacccgcttcccatcaccggaggagcttccccggccgggagaccagtgttagaggatccaagcgacctaaacagctgctttatgaaatatccttactttatctgggcttaataagtcactgacatcagcactgccaactcggctgcaattgtggaccttccctaccaaagggagtgttgaaactcaagtcccgccctggctctttagaatggaccactgagagccacaggaccgttttggggctgacctgtcttattacgtatgtacttctaggttgcaaggttttgaaattttctgtacagtttgtgaggacctttgcactttgccatctgatgtcgtacctcggttcactgtttgttttcgaatgccttgttttcatagagccctattctctcagacggtggaatatttggaaaaattttaaaacaattaaaattttaaagcaatcttggcagactaaaacaagtacatctgtacatgactgtataattacgattatagtaccactgcacatcatgtttttttttttaagacaaaaaagatgtttaaagaccaaaaactgtgctgagaaagtatgccccacctatctttggtatatgataggttacataaaaggaaggtattggctgaactgaatagaggtcttgatctttggaatgcatgccagtaatgtattttacagtacatgtttattatgttcaatatttgtatttgtgttctcttttgttatttttaattagggtatatgaatattttgcaataattttaataattattaagctgtttgaaggaaagaatatggatttttcatgtcttgaggttttgttcatgccccctttgactgatcagtgtgataaggactttaggaaaaaaagcatgtatgttttttactgtttgtaataagtactttcgttaatcttgctgcttatgtgccaatttagtggaaaaaaacaacccttgctgaaaaattccctctttccattctctttcaattctgtgatattgtccaagaatgtatcaataaaatactttggttaactt

SEQ ID NO: 12250 - DNA, 5172 bp, Homo sapiens
agagatcctgggagcgagagggagagagagggagcaagaaaggaagagagagcgagcgagagagagcgagcgaataagagagagagtaagagggagagagaagaagaggaagaagaggaggcggcggcagcggaggaggaggaggactagtgtggggtggaaaggaagagtgagcgagagcaagttaaggggagggggtgtaagagccagcgaattctttttctttttctattattattttgacgactcctgagttgcgcccatgctcttgtcagcttcgttttaggcgtacatggccaggcagaagaaaatggggcaaagcgtgctccgggcggtcttctttttagtcctggggcttttgggtcattctcacggaggattccccaacaccatcagcataggtggacttttcatgagaaacacagtgcaggagcacagcgctttccgctttgccgtgcagttatacaacaccaaccagaacaccaccgagaagcccttccatttgaattaccacgtagatcacttggattcctccaatagtttttccgtgacaaatgctttctgctcccagttctcgagaggggtgtatgccatctttggattctatgaccagatgtcaatgaacaccctgacctccttctgtggggccctgcacacatcctttgttacgcctagcttccccactgacgcagatgtgcagtttgtcatccagatgcgcccagccttgaagggcgctattctgagtcttctgggtcattacaagtgggagaagtttgtgtacctctatgacacagaacgaggattttccatcctccaagcgattatggaagcagcagtgcaaaacaactggcaagtaacagcaaggtctgtgggaaacataaaggacgtccaagaattcaggcgcatcattgaagaaatggacaggaggcaggaaaagcgatacttgattgactgcgaagtcgaaaggattaacacaattttggaacaggttgtgatcctagggaaacactcaagaggttatcactacatgctcgctaacctgggttttactgatattttactggaaagagtcatgcatgggggagccaacattacaggtttccagattgtcaacaatgaaaaccctatggttcagcagttcatacagcgctgggtgaggctggatgaaagggaattccctgaagccaagaatgcaccactaaagtatacatctgcattgacacacgacgcaatactggtcatagcagaagctttccgctacctgaggaggcagcgagtagatgtgtcccggagaggaagtgctggagactgcttagcaaatcctgctgtgccctggagtcaaggaattgatattgagagagctctgaaaatggtgcaagtacaaggaatgactggaaatattcaatttgacacttatggacgtaggacaaattataccatcgatgtgtatgaaatgaaagtcagtggctctcgaaaagctggctactggaatgagtatgaaaggtttgtgcctttctcagatcagcaaatcagcaatgacagtgcatcctcagagaatcggaccatagtagtgactaccattctggaatcaccatatgtaatgtacaagaagaaccatgagcaactggaaggaaatgaacgatatgaaggctattgtgtagacctagcctatgaaatagccaaacatgtaaggatcaaatacaaattgtccatcgttggtgacgggaaatatggtgcaagggatccagagactaaaatatggaacggcatggttggggaacttgtctatgggagagctgatatagctgttgctccactcactataacattggtccgtgaagaagtcatagatttttcaaagccattcatgagcctgggcatctccatcatgataaagaagcctcagaaatcaaaaccaggcgtattctcatttctggatcccctggcttatgaaatctggatgtgcattgtctttgcttacattggagtcagcgtagttcttttcctagtcagcaggttcagtccttatgaatggcacttggaagacaacaatgaagaacctcgtgacccacaaagtcctcctgatcctccaaatgaatttggaatatttaacagtctttggttttccttgggtgcctttatgcagcaaggatgtgatatttctccaagatcactctccgggcgcattgttggaggggtttggtggttcttcaccctgatcataatttcttcctatactgccaatctcgctgctttcctgactgtggagaggatggtttctcccatagagagtgctgaagacttagctaaacagactgaaattgcatatgggaccctggactccggttcaacaaaagaatttttcagaagatccaaaattgctgtgtacgagaaaatgtggtcttacatgaaatcagcggagccatctgtgtttaccaaaacaacagcagacggagtggcccgagtgcgaaagtccaagggaaagttcgccttcctgctggagtcaaccatgaatgagtacattgagcagagaaaaccatgtgatacgatgaaagttggtggaaatctggattccaaaggctatggtgtggcaacccctaaaggctcagcattaagaaatgctgttaacctggcagtattaaaactgaatgagcaaggcctcttggacaaattgaaaaacaaatggtggtacgacaaaggagagtgcggcagcgggggcggtgactccaaggacaagaccagcgctctgagcctgagcaatgtggcaggcgttttctatatacttgtcggaggtctggggctggccatgatggtggctttgatagaattctgttacaaatcacgggcagagtccaaacgcatgaaactcacaaagaacacccaaaactttaagcctgctcctgccaccaacactcagaattatgctacatacagagaaggctacaacgtgtatggaacagagagtgttaagatctagggatcccttcccactggaggcatgtgatgagaggaaatcaccgaaaacgtggctgcttcaaggatcctgagccagatttcactctccttggtgtcgggcatgacacgaatattgctgatggtgcaatgacctttcaataggaaaaactgatttttttttccttcagtgccttatggaacactctgagactcgcgacaatgcaaaccatcattgaaatctttttgctttgcttgaaaaaaaataattaaaataaaaaccaacaaaaatggacatgcaagattccagtatgcgaaaaaaaatcttattaagtcaattcaacaaaagccattctttgataccactgcagagtatataaacaccatgttctttaatacacacacacacacacacacacacacacacacacatttaaattccaattcagcaaagaggcccatctaagctaaaaaaattaattcttcctgattaaaaagaaaaaatctgtctcccagtgtttgggaagacggactggcatttcttctaggatctgctgaccagatgtttttggtatttcctgttggtggtgatgttctgtgcactctatttcctttcaatgttgctgaaatgtgtatatctttagaatgtaaatgcaacacttaagaaaattcaaacactttggaaaagggactaaacagtgatttctctgtgttcttgaaatggttttgtgaaaatgctttgataacttcccactcaaagaagagatttacagagctttcgaaattgactttgtgtgtagcaagggacggggcactatcaggatacctcttggtgctttcctaaaatggatcccggggctttccaaggagcctggaatttcagctcacagatctgtttttcttgcttcagtgtgcattttaagtcaatagagctgagtatctagcattgaggtgagggaaatgctgcctatactcccagatgtgtttagaatatctcagaaacaacactgtgtttagctcggctttctctgctaagtatgcctttcaagtgtacaccacggagacaggaccgcgttgcaaggcgggacagcaggttcagaccacagttctcagtctgactttactcttgctaggtctgtcctactagctgttgcctgctaccgcccatggctctccatcggactgcatgtgtccttttctagtttgcaaagactaaaatgcattcccaaacctactgctaatctgagggcctcagcatcacttccagatccttgcttggagcagtctctctattgactctctcagatcgctccactgctccatgggctatcaagtaactaactgcatacctgccgttggcatcatcagaacagtccgaagaaatagtctccactcactaattacctcctatataacgacgtatgcttcctgtagttcagtagtttgctctcatcgataacgtgcattgggaagtttccagactgcaaaaactaggagctcgcattcatttcccaagtgtgacccttagatgcttagttgactcgctgcatatttgctcttgtcttcagaaaagaaaggaagaagtatcgttccaacgaaatgtttccagaaaagtgtactataaactttcattccaaaaatggtgtcataagcaaacaactcacttgtcaaatttcaaatggtattgaacaaaaaaagaaagctgttgtgtttttgttttgttttgttttcatgaaactgtgattttcaacttatgaatgctataatgtcccagcgcgggaagctcacgctgtgtgaacatgaagttgtataaaacaaaccaaccaacctacacacaaatgttttcataggcactgtataaagaaaaatgtatgtttattaactcaaatcagtttttcagagaggaaacgtcactgagatgaagaggcgggtaaattggtttgttattttttaaaaaaaacttgcatgtttaaaaaaaagttgattgcttcaaatttctgctactaacttcaagctatgggagtttggcagtagtcacttgaggattttttttccaattcttttctttttgttgttaaagctgtacttcagtgaacagaaaaattgccaagcaaactaatggctataaaagcgtaatttgcatgtgtgggcataaactacagagcctcattgccatgaggtattgtacaaagttttaatacattttgtaaataaaattgt

SEQ ID NO: 12251 - DNA, 596 bp, Homo sapiens
agcggaggaggaggaggactagtgtggggtggaaaggaagagtgagcgagagcaagttaaggggagggggtgtaagagccagcgaattctttttctttttctattattattttgacgactcctgagttgcgcccatgctcttgtcagcttcgttttaggcgtacatggccaggcagaagaaaatggggcaaagcgtgctccgggcggtcttctttttagtcctggggcttttgggtcattctcacggaggattccccaacaccatcagcataggtggacttttcatgagaaacacagtgcaggagcacagcgctttccgctttgccgtgcagttatacaacaccaaccagaacaccaccgagaagcccttccatttgaattaccacgtagatcacttggattcctccaatagtttttccgtgacaaatgcttgtcctgctgaaagggactacctgccttggccaggaagcatcagggaaaacaattggacagctctgccgtgctgcaaagatcatgggctgctgcacctaaaatgttcaccaggtgggcgccaaaactgggcctattgtatctggggcgttacaggtgaactgtaa

SEQ ID NO: 12252 - DNA, 2739 bp, Homo sapiens
tgacgactcctgagttgcgcccatgctcttgtcagcttcgttttaggcgtacatggccaggcagaagaaaatggggcaaagcgtgctccgggcggtcttctttttagtcctggggcttttgggtcattctcacggaggattccccaacaccatcagcataggtggacttttcatgagaaacacagtgcaggagcacagcgctttccgctttgccgtgcagttatacaacaccaaccagaacaccaccgagaagcccttccatttgaattaccacgtagatcacttggattcctccaatagtttttccgtgacaaatgctttctgctcccagttctcgagaggggtgtatgccatctttggattctatgaccagatgtcaatgaacaccctgacctccttctgtggggccctgcacacatcctttgttacgcctagcttccccactgacgcagatgtgcagtttgtcatccagatgcgcccagccttgaagggcgctattctgagtcttctgggtcattacaagtgggagaagtttgtgtacctctatgacacagaacgaggattttccatcctccaagcgattatggaagcagcagtgcaaaacaactggcaagtaacagcaaggtctgtgggaaacataaaggacgtccaagaattcaggcgcatcattgaagaaatggacaggaggcaggaaaagcgatacttgattgactgcgaagtcgaaaggattaacacaattttggaacaggttgtgatcctagggaaacactcaagaggttatcactacatgctcgctaacctgggttttactgatattttactggaaagagtcatgcatgggggagccaacattacaggtttccagattgtcaacaatgaaaaccctatggttcagcagttcatacagcgctgggtgaggctggatgaaagggaattccctgaagccaagaatgcaccactaaagtatacatctgcattgacacacgacgcaatactggtcatagcagaagctttccgctacctgaggaggcagcgagtagatgtgtcccggagaggaagtgctggagactgcttagcaaatcctgctgtgccctggagtcaaggaattgatattgagagagctctgaaaatggtgcaagtacaaggaatgactggaaatattcaatttgacacttatggacgtaggacaaattataccatcgatgtgtatgaaatgaaagtcagtggctctcgaaaagctggctactggaatgagtatgaaaggtttgtgcctttctcagatcagcaaatcagcaatgacagtgcatcctcagagaatcggaccatagtagtgactaccattctggaatcaccatatgtaatgtacaagaagaaccatgagcaactggaaggaaatgaacgatatgaaggctattgtgtagacctagcctatgaaatagccaaacatgtaaggatcaaatacaaattgtccatcgttggtgacgggaaatatggtgcaagggatccagagactaaaatatggaacggcatggttggggaacttgtctatgggagagctgatatagctgttgctccactcactataacattggtccgtgaagaagtcatagatttttcaaagccattcatgagcctgggcatctccatcatgataaagaagcctcagaaatcaaaaccaggcgtattctcatttctggatcccctggcttatgaaatctggatgtgcattgtctttgcttacattggagtcagcgtagttcttttcctagtcagcaggttcagtccttatgaatggcacttggaagacaacaatgaagaacctcgtgacccacaaagtcctcctgatcctccaaatgaatttggaatatttaacagtctttggttttccttgggtgcctttatgcagcaaggatgtgatatttctccaagatcactctccgggcgcattgttggaggggtttggtggttcttcaccctgatcataatttcttcctatactgccaatctcgctgctttcctgactgtggagaggatggtttctcccatagagagtgctgaagacttagctaaacagactgaaattgcatatgggaccctggactccggttcaacaaaagaatttttcagaagatccaaaattgctgtgtacgagaaaatgtggtcttacatgaaatcagcggagccatctgtgtttaccaaaacaacagcagacggagtggcccgagtgcgaaagtccaagggaaagttcgccttcctgctggagtcaaccatgaatgagtacattgagcagagaaaaccatgtgatacgatgaaagttggtggaaatctggattccaaaggctatggtgtggcaacccctaaaggctcagcattaagaaatgctgttaacctggcagtattaaaactgaatgagcaaggcctcttggacaaattgaaaaacaaatggtggtacgacaaaggagagtgcggcagcgggggcggtgactccaaggacaagaccagcgctctgagcctgagcaatgtggcaggcgttttctatatacttgtcggaggtctggggctggccatgatggtggctttgatagaattctgttacaaatcacgggcagagtccaaacgcatgaaactcacaaagaacacccaaaactttaagcctgctcctgccaccaacactcagaattatgctacatacagagaaggctacaacgtgtatggaacagagagtgttaagatctaggg

SEQ ID NO: 12253 - DNA, 4942 bp, Homo sapiens
tgacgactcctgagttgcgcccatgctcttgtcagcttcgttttaggcgtacatggccaggcagaagaaaatggggcaaagcgtgctccgggcggtcttctttttagtcctggggcttttgggtcattctcacggaggattccccaacaccatcagcataggtggacttttcatgagaaacacagtgcaggagcacagcgctttccgctttgccgtgcagttatacaacaccaaccagaacaccaccgagaagcccttccatttgaattaccacgtagatcacttggattcctccaatagtttttccgtgacaaatgctttctgctcccagttctcgagaggggtgtatgccatctttggattctatgaccagatgtcaatgaacaccctgacctccttctgtggggccctgcacacatcctttgttacgcctagcttccccactgacgcagatgtgcagtttgtcatccagatgcgcccagccttgaagggcgctattctgagtcttctgggtcattacaagtgggagaagtttgtgtacctctatgacacagaacgaggattttccatcctccaagcgattatggaagcagcagtgcaaaacaactggcaagtaacagcaaggtctgtgggaaacataaaggacgtccaagaattcaggcgcatcattgaagaaatggacaggaggcaggaaaagcgatacttgattgactgcgaagtcgaaaggattaacacaattttggaacaggttgtgatcctagggaaacactcaagaggttatcactacatgctcgctaacctgggttttactgatattttactggaaagagtcatgcatgggggagccaacattacaggtttccagattgtcaacaatgaaaaccctatggttcagcagttcatacagcgctgggtgaggctggatgaaagggaattccctgaagccaagaatgcaccactaaagtatacatctgcattgacacacgacgcaatactggtcatagcagaagctttccgctacctgaggaggcagcgagtagatgtgtcccggagaggaagtgctggagactgcttagcaaatcctgctgtgccctggagtcaaggaattgatattgagagagctctgaaaatggtgcaagtacaaggaatgactggaaatattcaatttgacacttatggacgtaggacaaattataccatcgatgtgtatgaaatgaaagtcagtggctctcgaaaagctggctactggaatgagtatgaaaggtttgtgcctttctcagatcagcaaatcagcaatgacagtgcatcctcagagaatcggaccatagtagtgactaccattctggaatcaccatatgtaatgtacaagaagaaccatgagcaactggaaggaaatgaacgatatgaaggctattgtgtagacctagcctatgaaatagccaaacatgtaaggatcaaatacaaattgtccatcgttggtgacgggaaatatggtgcaagggatccagagactaaaatatggaacggcatggttggggaacttgtctatgggagagctgatatagctgttgctccactcactataacattggtccgtgaagaagtcatagatttttcaaagccattcatgagcctgggcatctccatcatgataaagaagcctcagaaatcaaaaccaggcgtattctcatttctggatcccctggcttatgaaatctggatgtgcattgtctttgcttacattggagtcagcgtagttcttttcctagtcagcaggttcagtccttatgaatggcacttggaagacaacaatgaagaacctcgtgacccacaaagtcctcctgatcctccaaatgaatttggaatatttaacagtctttggttttccttgggtgcctttatgcagcaaggatgtgatatttctccaagatcactctccgggcgcattgttggaggggtttggtggttcttcaccctgatcataatttcttcctatactgccaatctcgctgctttcctgactgtggagaggatggtttctcccatagagagtgctgaagacttagctaaacagactgaaattgcatatgggaccctggactccggttcaacaaaagaatttttcagaagatccaaaattgctgtgtacgagaaaatgtggtcttacatgaaatcagcggagccatctgtgtttaccaaaacaacagcagacggagtggcccgagtgcgaaagtccaagggaaagttcgccttcctgctggagtcaaccatgaatgagtacattgagcagagaaaaccatgtgatacgatgaaagttggtggaaatctggattccaaaggctatggtgtggcaacccctaaaggctcagcattaagaacgcctgtaaaccttgcagtattgaaactcagtgaacaaggcatcttagacaagctgaaaaacaaatggtggtacgataagggggaatgtggagccaaggactccgggagtaaggacaagaccagcgctctgagcctgagcaatgtggcaggcgttttctatatacttgtcggaggtctggggctggccatgatggtggctttgatagaattctgttacaaatcacgggcagagtccaaacgcatgaaactcacaaagaacacccaaaactttaagcctgctcctgccaccaacactcagaattatgctacatacagagaaggctacaacgtgtatggaacagagagtgttaagatctagggatcccttcccactggaggcatgtgatgagaggaaatcaccgaaaacgtggctgcttcaaggatcctgagccagatttcactctccttggtgtcgggcatgacacgaatattgctgatggtgcaatgacctttcaataggaaaaactgatttttttttccttcagtgccttatggaacactctgagactcgcgacaatgcaaaccatcattgaaatctttttgctttgcttgaaaaaaaataattaaaataaaaaccaacaaaaatggacatgcaagattccagtatgcgaaaaaaaatcttattaagtcaattcaacaaaagccattctttgataccactgcagagtatataaacaccatgttctttaatacacacacacacacacacacacacacacacacacatttaaattccaattcagcaaagaggcccatctaagctaaaaaaattaattcttcctgattaaaaagaaaaaatctgtctcccagtgtttgggaagacggactggcatttcttctaggatctgctgaccagatgtttttggtatttcctgttggtggtgatgttctgtgcactctatttcctttcaatgttgctgaaatgtgtatatctttagaatgtaaatgcaacacttaagaaaattcaaacactttggaaaagggactaaacagtgatttctctgtgttcttgaaatggttttgtgaaaatgctttgataacttcccactcaaagaagagatttacagagctttcgaaattgactttgtgtgtagcaagggacggggcactatcaggatacctcttggtgctttcctaaaatggatcccggggctttccaaggagcctggaatttcagctcacagatctgtttttcttgcttcagtgtgcattttaagtcaatagagctgagtatctagcattgaggtgagggaaatgctgcctatactcccagatgtgtttagaatatctcagaaacaacactgtgtttagctcggctttctctgctaagtatgcctttcaagtgtacaccacggagacaggaccgcgttgcaaggcgggacagcaggttcagaccacagttctcagtctgactttactcttgctaggtctgtcctactagctgttgcctgctaccgcccatggctctccatcggactgcatgtgtccttttctagtttgcaaagactaaaatgcattcccaaacctactgctaatctgagggcctcagcatcacttccagatccttgcttggagcagtctctctattgactctctcagatcgctccactgctccatgggctatcaagtaactaactgcatacctgccgttggcatcatcagaacagtccgaagaaatagtctccactcactaattacctcctatataacgacgtatgcttcctgtagttcagtagtttgctctcatcgataacgtgcattgggaagtttccagactgcaaaaactaggagctcgcattcatttcccaagtgtgacccttagatgcttagttgactcgctgcatatttgctcttgtcttcagaaaagaaaggaagaagtatcgttccaacgaaatgtttccagaaaagtgtactataaactttcattccaaaaatggtgtcataagcaaacaactcacttgtcaaatttcaaatggtattgaacaaaaaaagaaagctgttgtgtttttgttttgttttgttttcatgaaactgtgattttcaacttatgaatgctataatgtcccagcgcgggaagctcacgctgtgtgaacatgaagttgtataaaacaaaccaaccaacctacacacaaatgttttcataggcactgtataaagaaaaatgtatgtttattaactcaaatcagtttttcagagaggaaacgtcactgagatgaagaggcgggtaaattggtttgttattttttaaaaaaaacttgcatgtttaaaaaaaagttgattgcttcaaatttctgctactaacttcaagctatgggagtttggcagtagtcacttgaggattttttttccaattcttttctttttgttgttaaagctgtacttcagtgaacagaaaaattgccaagcaaactaatggctataaaagcgtaatttgcatgtgtgggcataaactacagagcctcattgccatgaggtattgtacaaagttttaatacattttgtaaataaaattgtaaagaaagaa

SEQ ID NO: 12254 - DNA, 934 bp, Homo sapiens
cgagagagagcgagcgaataagagagagagtaagagggagagagaagaagaggaagaagaggaggcggcggcagcggaggaggaggaggactagtgtggggtggaaaggaagagtgagcgagagcaagttaaggggagggggtgtaagagccagcgaattctttttctttttctattattattttgacgactcctgagttgcgcccatgctcttgtcagcttcgttttaggcgtacatggccaggcagaagaaaatggggcaaagcgtgctccgggcggtcttctttttagtcctggggcttttgggtcattctcacggaggattccccaacaccatcagcataggtggacttttcatgagaaacacagtgcaggagcacagcgctttccgctttgccgtgcagttatacaacaccaaccagaacaccaccgagaagcccttccatttgaattaccacgtagatcacttggattcctccaatagtttttccgtgacaaatgcttgtcctgctgaaagggactacctgccttggccaggaagcatcagggaaaacaattggacagctctgccgtgctgcaaagatcatgggctgctgcacctaaaatgttcaccaggtgggcccgccaaaactgggcctattgtatctggggcgttacaggtgaactgtaagatgagaacaagatcacaagtcagcactacctcctcccttcttgagttctcaactgagtgagcatcatggagggagaagaaagaaagaagttcagcctgggtgtgtgaagctgtaaagttgcaggttgaacccaaacccattttagagacagaagaaactaccctctggagataaaataaaaagatgaagctgagatgggacaggatcaaagttgatgaaatatcaagagaggttaataaaggaacattaatttattcctcaaa

SEQ ID NO: 12255 - DNA, 782 bp, Homo sapiens
cgctttggcaaacccagcttgcagccaatgaacccgccttccagattggtgtgaagacagaagtgagcttcgttttaggcgtacatggccaggcagaagaaaatggggcaaagcgtgctccgggcggtcttctttttagtcctggggcttttgggtcattctcacggaggattccccaacaccatcagcataggtggacttttcatgagaaacacagtgcaggagcacagcgctttccgctttgccgtgcagttatacaacaccaaccagaacaccaccgagaagcccttccatttgaattaccacgtagatcacttggattcctccaatagtttttccgtgacaaatgcttgtcctgctgaaagggactacctgccttggccaggaagcatcagggaaaacaattggacagctctgccgtgctgcaaagatcatgggctgctgcacctaaaatgttcaccaggtgggcccgccaaaactgggcctattgtatctggggcgttacaggtgaactgtaagatgagaacaagatcacaagtcagcactacctcctcccttcttgagttctcaactgagtgagcatcatggagggagaagaaagaaagaagttcagcctgggtgtgtgaagctgtaaagttgcaggttgaacccaaacccattttagagacagaagaaactaccctctggagataaaataaaaagatgaagctgagatgggacaggatcaaagttgatgaaatatcaagagaggttaataaaggaacattaatttattcctcaaa

SEQ ID NO: 12256 - DNA, 2169 bp, Homo sapiens
agcaccggaggcgagcaggaggctgggatgctgcaagggggtgaagagtcgaggcttttcggctcgctgctctggactttgccatggcgtggacttttcatgagaaacacagtgcaggagcacagcgctttccgctttgccgtgcagttatacaacaccaaccagaacaccaccgagaagcccttccatttgaattaccacgtagatcacttggattcctccaatagtttttccgtgacaaatgctttctgctcccagttctcgagaggggtgtatgccatctttggattctatgaccagatgtcaatgaacaccctgacctccttctgtggggccctgcacacatcctttgttacgcctagcttccccactgacgcagatgtgcagtttgtcatccagatgcgcccagccttgaagggcgctattctgagtcttctgggtcattacaagtgggagaagtttgtgtacctctatgacacagaacgaggattttccatcctccaagcgattatggaagcagcagtgcaaaacaactggcaagtaacagcaaggtctgtgggaaacataaaggacgtccaagaattcaggcgcatcattgaagaaatggacaggaggcaggaaaagcgatacttgattgactgcgaagtcgaaaggattaacacaattttggaacaggttgtgatcctagggaaacactcaagaggttatcactacatgctcgctaacctgggttttactgatattttactggaaagagtcatgcatgggggagccaacattacaggtttccagattgtcaacaatgaaaaccctatggttcagcagttcatacagcgctgggtgaggctggatgaaagggaattccctgaagccaagaatgcaccactaaagtatacatctgcattgacacacgacgcaatactggtcatagcagaagctttccgctacctgaggaggcagcgagtagatgtgtcccggagaggaagtgctggagactgcttagcaaatcctgctgtgccctggagtcaaggaattgatattgagagagctctgaaaatggtgcaagtacaaggaatgactggaaatattcaatttgacacttatggacgtaggacaaattataccatcgatgtgtatgaaatgaaagtcagtggctctcgaaaagctggctactggaatgagtatgaaaggtttgtgcctttctcagatcagcaaatcagcaatgacagtgcatcctcagagaatcggaccatagtagtgactaccattctggaatcaccatatgtaatgtacaagaagaaccatgagcaactggaaggaaatgaacgatatgaaggctattgtgtagacctagcctatgaaatagccaaacatgtaaggatcaaatacaaattgtccatcgttggtgacgggaaatatggtgcaagggatccagagactaaaatatggaacggcatggttggggaacttgtctatgggagagctgatatagctgttgctccactcactataacattggtccgtgaagaagtcatagatttttcaaagccattcatgagcctgggcatctccatcatgataaagaagcctcagaaatcaaaaccaggcgtattctcatttctggatcccctggcttatgaaatctggatgtgcattgtctttgcttacattggagtcagcgtagttcttttcctagtcagcaggttcagtccttatgaatggcacttggaagacaacaatgaagaacctcgtgacccacaaagtcctcctgatcctccaaatgaatttggaatatttaacagtctttggttttccttgggtgcctttatgcagcaaggatgtgatatttctccaaggtttgtttttgtggcatactcaatgcctcattgcattttatggtcatactccattcatgtacatatggtattcatccatctcaactccagatttttttcatttaacattccatcaaatgacagattatcatcaagccattgtgtttgcttatgtccatgaagtgagtgtgtcattggtgttgctttgaatgtctttcatgcatttctatggtattgtatatacattaaaacaaacatttgaactctggataaaggcaacattgccactaatattaatattattcagataaagtaaatactaaatcttcatcag

SEQ ID NO: 12257 - DNA, 2990 bp, Homo sapiens
agcggaggaggaggaggactagtgtggggtggaaaggaagagtgagcgagagcaagttaaggggagggggtgtaagagccagcgaattctttttctttttctattattattttgacgactcctgagttgcgcccatgctcttgtcagcttcgttttaggcgtacatggccaggcagaagaaaatggggcaaagcgtgctccgggcggtcttctttttagtcctggggcttttgggtcattctcacggaggattccccaacaccatcagcataggtggacttttcatgagaaacacagtgcaggagcacagcgctttccgctttgccgtgcagttatacaacaccaaccagaacaccaccgagaagcccttccatttgaattaccacgtagatcacttggattcctccaatagtttttccgtgacaaatgctttctgctcccagttctcgagaggggtgtatgccatctttggattctatgaccagatgtcaatgaacaccctgacctccttctgtggggccctgcacacatcctttgttacgcctagcttccccactgacgcagatgtgcagtttgtcatccagatgcgcccagccttgaagggcgctattctgagtcttctgggtcattacaagtgggagaagtttgtgtacctctatgacacagaacgaggattttccatcctccaagcgattatggaagcagcagtgcaaaacaactggcaagtaacagcaaggtctgtgggaaacataaaggacgtccaagaattcaggcgcatcattgaagaaatggacaggaggcaggaaaagcgatacttgattgactgcgaagtcgaaaggattaacacaattttggaacaggttgtgatcctagggaaacactcaagaggttatcactacatgctcgctaacctgggttttactgatattttactggaaagagtcatgcatgggggagccaacattacaggtttccagattgtcaacaatgaaaaccctatggttcagcagttcatacagcgctgggtgaggctggatgaaagggaattccctgaagccaagaatgcaccactaaagtatacatctgcattgacacacgacgcaatactggtcatagcagaagctttccgctacctgaggaggcagcgagtagatgtgtcccggagaggaagtgctggagactgcttagcaaatcctgctgtgccctggagtcaaggaattgatattgagagagctctgaaaatggtgcaagtacaaggaatgactggaaatattcaatttgacacttatggacgtaggacaaattataccatcgatgtgtatgaaatgaaagtcagtggctctcgaaaagctggctactggaatgagtatgaaaggtttgtgcctttctcagatcagcaaatcagcaatgacagtgcatcctcagagaatcggaccatagtagtgactaccattctggaatcaccatatgtaatgtacaagaagaaccatgagcaactggaaggaaatgaacgatatgaaggctattgtgtagacctagcctatgaaatagccaaacatgtaaggatcaaatacaaattgtccatcgttggtgacgggaaatatggtgcaagggatccagagactaaaatatggaacggcatggttggggaacttgtctatgggagagctgatatagctgttgctccactcactataacattggtccgtgaagaagtcatagatttttcaaagccattcatgagcctgggcatctccatcatgataaagaagcctcagaaatcaaaaccaggcgtattctcatttctggatcccctggcttatgaaatctggatgtgcattgtctttgcttacattggagtcagcgtagttcttttcctagtcagcaggttcagtccttatgaatggcacttggaagacaacaatgaagaacctcgtgacccacaaagtcctcctgatcctccaaatgaatttggaatatttaacagtctttggttttccttgggtgcctttatgcagcaaggatgtgatatttctccaagatcactctccgggcgcattgttggaggggtttggtggttcttcaccctgatcataatttcttcctatactgccaatctcgctgctttcctgactgtggagaggatggtttctcccatagagagtgctgaagacttagctaaacagactgaaattgcatatgggaccctggactccggttcaacaaaagaatttttcagaagatccaaaattgctgtgtacgagaaaatgtggtcttacatgaaatcagcggagccatctgtgtttaccaaaacaacagcagacggagtggcccgagtgcgaaagtccaagggaaagttcgccttcctgctggagtcaaccatgaatgagtacattgagcagagaaaaccatgtgatacgatgaaagttggtggaaatctggattccaaaggctatggtgtggcaacccctaaaggctcagcattaagaaatgctgttaacctggcagtattaaaactgaatgagcaaggcctcttggacaaattgaaaaacaaatggtggtacgacaaaggagagtgcggcagcgggggcggtgactccaagaacgcctgtaaaccttgcagtattgaaactcagtgaacaaggcatcttagacaagctgaaaaacaaatggtggtacgataagggggaatgtggagccaaggactccgggagtaaggacaagaccagcgctctgagcctgagcaatgtggcaggcgttttctatatacttgtcggaggtctggggctggccatgatggtggctttgatagaattctgttacaaatcacgggcagagtccaaacgcatgaaactcacaaagaacacccaaaactttaagcctgctcctgccaccaacactcagaattatgctacatacagagaaggctacaacgtgtatggaacagagagtgttaagatctagggatcccttcccactggaggcatgtg

SEQ ID NO: 12258 - DNA, 5508 bp, Homo sapiens
agtggcagaagagggctaggctgagagggaagccaggactgtaggagagggaggcagcccgtcctcctcacgaacctgcaaggatgcggcaggggcctgggggcatggggaggtactaaccccccggagcccccgattggggcttgcagacctggcccgtgggcggattttctgcctagcgcagccgagaagcagaggtgccaggaaaaccaagagaggggcgctgggggtgcccatccccagagtcggtccctctgcgaaccgaggaagaaaagaggagggagtcagcgagtggtcagaagggaaaacctgacaccagactggctccggagcgtccgggagactggggcgctccgcgccatcgtcttcaatgcttctctgaacagcctttaggaagagtgcgagagaaagagagagagcgcgcgccagggagaggagaaaagaagatgaggattatttccagacagattgtcttgttattttctggattttggggactcgccatgggagcctttccgagcagcgtgcaaataggtggtctcttcatccgaaacacagatcaggaatacactgcttttcgattagcaatttttcttcataacaccagccccaatgcgtcggaagctccttttaatttggtacctcatgtggacaacattgagacagccaacagttttgctgtaacaaacgccttctgttcccagtattctagaggagtatttgccatttttggactctatgataagaggtcggtacataccttgacctcattctgcagcgccttacatatctccctcatcacaccaagtttccctactgagggggagagccagtttgtgctgcaactaagaccttcgttacgaggagcactcttgagtttgctggatcactacgaatggaactgttttgtcttcctgtatgacacagacaggggatactcgatactccaagctattatggaaaaagcaggacaaaatggttggcatgtcagcgctatatgtgtggaaaattttaatgatgtcagctataggcaacttctagaagaacttgacagaagacaagagaagaagtttgtaatagactgtgagatagagagacttcaaaacatattagaacagattgtaagtgttggaaagcatgttaaaggctaccattatatcattgcaaacttgggattcaaggatatttctcttgagaggtttatacatggtggagccaatgttactggattccagttggtggattttaatacacctatggtaatcaaactaatggatcgctggaagaaactagatcagagagagtatccaggatctgagactcctccaaagtacacctctgctctgacttatgatggagtccttgtgatggctgaaactttccgaagtcttaggaggcagaaaattgatatctcaaggagaggaaatgctggggattgtctggcaaatcctgctgctccatggggccagggaattgacatggagaggacactcaaacaggttcgaattcaagggctgacagggaatgttcagtttgaccactatggacgtagagtcaattacacaatggatgtgtttgagctgaaaagcacaggacctagaaaggttggttactggaatgatatggataagttagtcttgattcaagatgtaccaactcttggcaatgacacagctgctattgagaacagaacagtggttgtaaccacaattatggaatccccatatgttatgtacaagaaaaatcatgaaatgtttgaaggaaatgacaagtatgaaggatactgtgtagatttggcatctgaaattgcaaaacatattggtatcaagtataaaattgccattgtccctgatggaaaatatggagcaagggatgcagacacaaaaatctggaatgggatggtaggagaacttgtttatgggaaagcagagattgctattgcccctctgacaatcactttggtacgagaggaggtcattgacttttctaagcccttcatgagtttgggcatatctatcatgatcaaaaagcctcagaaatccaaaccaggagtgttttccttcttggatcctctggcctatgagatttggatgtgcatagtctttgcctacattggtgtcagcgtggtcttattcctagttagtagatttagtccatatgagtggcacacagaagagccagaggacggaaaggaaggacccagcgaccagcctcccaatgagtttggcatctttaacagcctctggttttccctgggtgcttttatgcagcaaggatgtgacatttcacccagatccctctcaggtcgaattgttggaggtgtttggtggttctttacactcatcattatatcatcttatactgctaacctcgctgctttcctgacggttgagcgaatggtctctcccatagaaagtgcagaagacctggccaaacaaacagaaattgcctatggaacactggattcaggatcaacaaaagaattcttcagaagatcaaaaatagcagtgtatgaaaagatgtggacctacatgcgatcagcagagccatcagtattcactaggactacagctgagggagtagctcgtgtccgcaaatccaagggcaaatttgcctttctcctggagtccactatgaatgaatacattgagcagcgaaagccatgtgacacgatgaaagtgggaggaaatctggattccaaaggctatggagtagcaacgcccaagggttcctcattaagaactcctgtaaaccttgccgttttgaaactcagtgaggcaggcgtcttagacaagctgaaaaacaaatggtggtacgataaaggtgaatgtggacccaaggactctggaagcaaggacaagacgagtgccttgagcctgagcaatgtagcaggcgtcttctacattctggttggcggcttgggcttggcaatgctggtggctttgatagagttctgttacaagtccagggcagaagcgaagagaatgaagctgaccttttctgaagccataagaaacaaagccagattatccatcactgggagtgtgggagagaatggccgcgtcttgacgcctgactgcccaaaggctgtacacactggaactgcaatcagacaaagttcaggattggctgtcattgcatcggacctaccataaaaaccaaaaaaataattgagtgccttaattaaactgttggtgactggtggaaacgcagccctgagggacacgccacgcgcgggtctttgctaaaccaatcctttggctgagagcgggaagtccgtcctaacgcgctggccggacatcagcagcagcaacgtgtgcatgagctcagctcggaaacccaaactcagattttatatcaggaaaactcacaattgaggtttttttcggggagtgggtgggggagggatctgggatgggtgtattaacagcaacaaatttcattcgagtggactcaaaaactaatcagacttatgagttagcgcattaaactgtgaagttcttgctcagaaaggcctttgtcttcaccggaaaggataaaatagttgtagaagtccgtgaacatgctaacctgtgtctccagaacatccatatagtccatggaagaaaatccagctgagaaaacaaatcactaaactgtgataagaaaataatgaacaaacatgtaaaacctgtgggaaaaaaaaataaaggaagtatgtacacttactttggagaaaacaaatactgaaacatgcttgctttttaactgacgtaaattcagtagaggacaacacaattcttttttctaaccatcttagggaacaatacattgcaataattgatataaatgccatcactgtaataaactttagagacttttttttataaaagttgttggtcatcttcttgtttgctgtaaccttcactatgtcacatgagtcgattcaccgattgcatttgtctcacaaccaggaagaaaagcaaaaggaagaaaacgtttaggttcaatcatcagtctgcggtgtagactcgaaagagatgacaggtcactcatgttaatggtattatttataatctcattctgtgtacaacattgtggtttttgtacccaccaaaaagaataaaacagcagatgttcttacaatatctacagagcttaaaagttttttcttatcgttataaaagttatttgagaaattataagactataagagagattgtattagtggtgggccatagtggaaaatgtagctagccctcattattttttgcatactaagctacccctccttttcagatctttgactcattaacagattaaactgtcaaagatggagtctttgagttggggaatgaatcactgtcctaacaacaacataccttgtaattgtgtgttgaaattttacttgactgtattttgctgcataaaattatgtgtctcttgggcttcttcccttattcctattgttccctttaaatcatatgaaggcattcataatagcttggggtagataacaaatgaagaattagtctttgttttcaactggaaattgtaaagaaaattatactcatgtttatttataaaaatcaccttatgtatgaattaaactaacatggttcaaaagaaggtttggttcatttgaaataataaataagtactctaatacagataaaaatcatgtacttagggtattggcagaaagcacaagttaggatgatttcagaagtctggccttgaaggatgagttgagttttaacaggaggagaaggtgttaagagccatatgagtgagcagtggcccaaagccatgcacatcagtggctcatttaaggaatgaatgccattagatgggctactgagagtacagggatattatggaagataaagttggaaaagctgaaggattgattttcttccatcaactctcaagatcccattcgccattcaatctctgtgctgcagtaagagcaatcttaaacagtataaatcacacacacacacacacacacacacacacacacacacaagtccctcaggaaaaattccaagctcttgagaagatcacatgagccccttcatgacctggcgcttgcttatttcttccaggacttctctcacttctatccagctattcccgtcagcaaatgaacctccaaagcagcacatggagcactgcatagactatttcctcagtgcgtaactcctccctgtctcctctttacctgagtaacttgtactcatccttcaatactccaactgaattttacttaccctgaaaagatttccatggctatccaccacccccctgcctgtgagactgagttaggtgccctttttcatgtctttcccccatcacggcacttaccatactgcgttgtaattgcctgtgtactcgtctgtataactactagactgtaagctccttgagggcagggactgtgtctatcttgttcacagttgtatccccagcacccagcacagtgcctggcatattgtaggtgcttaataaatatttgttgaatgaatg

SEQ ID NO: 12259 - DNA, 2994 bp, Homo sapiens
aaatctttgctgcagcgaggaccggagtcccccgcgcgcagcccagtggcagaagagggctaggctgagagggaagccaggactgtaggagagggaggcagcccgtcctcctcacgaacctgcaaggatgcggcaggggcctgggggcatggggaggtactaaccccccggagcccccgattggggcttgcagacctggcccgtgggcggattttctgcctagcgcagccgagaagcagaggtgccaggaaaaccaagagaggggcgctgggggtgcccatccccagagtcggtccctctgcgaaccgaggaagaaaagaggagggagtcagcgagtggtcagaagggaaaacctgacaccagactggctccggagcgtccgggagactggggcgctccgcgccatcgtcttcaatgcttctctgaacagcctttaggaagagtgcgagagaaagagagagagcgcgcgccagggagaggagaaaagaagatgaggattatttccagacagattgtcttgttattttctggattttggggactcgccatgggagcctttccgagcagcgtgcaaataggtggtctcttcatccgaaacacagatcaggaatacactgcttttcgattagcaatttttcttcataacaccagccccaatgcgtcggaagctccttttaatttggtacctcatgtggacaacattgagacagccaacagttttgctgtaacaaacgccttctgttcccagtattctagaggagtatttgccatttttggactctatgataagaggtcggtacataccttgacctcattctgcagcgccttacatatctccctcatcacaccaagtttccctactgagggggagagccagtttgtgctgcaactaagaccttcgttacgaggagcactcttgagtttgctggatcactacgaatggaactgttttgtcttcctgtatgacacagacaggggatactcgatactccaagctattatggaaaaagcaggacaaaatggttggcatgtcagcgctatatgtgtggaaaattttaatgatgtcagctataggcaacttctagaagaacttgacagaagacaagagaagaagtttgtaatagactgtgagatagagagacttcaaaacatattagaacagattgtaagtgttggaaagcatgttaaaggctaccattatatcattgcaaacttgggattcaaggatatttctcttgagaggtttatacatggtggagccaatgttactggattccagttggtggattttaatacacctatggtaatcaaactaatggatcgctggaagaaactagatcagagagagtatccaggatctgagactcctccaaagtacacctctgctctgacttatgatggagtccttgtgatggctgaaactttccgaagtcttaggaggcagaaaattgatatctcaaggagaggaaatgctggggattgtctggcaaatcctgctgctccatggggccagggaattgacatggagaggacactcaaacaggttcgaattcaagggctgacagggaatgttcagtttgaccactatggacgtagagtcaattacacaatggatgtgtttgagctgaaaagcacaggacctagaaaggttggttactggaatgatatggataagttagtcttgattcaagatgtaccaactcttggcaatgacacagctgctattgagaacagaacagtggttgtaaccacaattatgcctctgatgaagaatcctattttaagaaattgatcaagaaagaaaagagttccgcgctgttcgaccattcctaactaaggctcaagtcttgttctccagtgtagtaaatttaagcttatttttcatgtgggattcttcttggatgaccaactctggactaccagaaaaaaaaaattttaagttctgtgacttttctgagatactagaacaaaagaagaattaatcttcatctttctcaagaaatagatgttgacaaagaatcacttagcgattctgacatatcaattcccctatcttgaaatgaggtcactgtatgtaaatgatggaattatatcactccatttccaagggtagattttctataagtaaatatctcggaatttgtgtgcttgttttctgaatatatacagttgttttctttaaagatctcttggaattttgcctgttctgtgtgaaataaagtgttttaatgtgcattataggtatgatatagagaatctcctttccatccttgttactaaagggactggacaaataaatcttaaaaccaaaatactgaattaattttgcaagcatggctagtttttaggaagcatgctatcaaaaaaaaaaagactaaaaatgactgaaaaaatccaactgttttatatatatataaatatatatatatttatatatatatataaaggatattctgtaaagttatatgttgtttgacagtaaagccatcaatatttttgctatcaaaatagtataatactagtatctttttgtatgaaaatgtaatctttatataaataatacctctgatatttgcaactgcataatcgttcagtaattcaaaaagacatactagaatcctttttctgaaagtgttccttcaatttgcttttgttgaaaacggtagtccaggacctatgatatccctccacttcattcattatgaaagaaatcccttgtagataaacaagatattggcatctgcatgtaattatccccagattcagctgaaaactcccaacacagatggaattggctagacattttaatatatgtgatacctatatctagatatagaaggctgagagtgagcactggatataattcattttgattgaaattgatatggtgttattgttcttccagttgtctgtcctttgtgtatgttcttatttatatgttgatacactgtaacactatatgctattgctaaataaaattgattgagaaattca

SEQ ID NO: 12260 - DNA, 5621 bp, Homo sapiens
agtggcagaagagggctaggctgagagggaagccaggactgtaggagagggaggcagcccgtcctcctcacgaacctgcaaggatgcggcaggggcctgggggcatggggaggtactaaccccccggagcccccgattggggcttgcagacctggcccgtgggcggattttctgcctagcgcagccgagaagcagaggtgccaggaaaaccaagagaggggcgctgggggtgcccatccccagagtcggtccctctgcgaaccgaggaagaaaagaggagggagtcagcgagtggtcagaagggaaaacctgacaccagactggctccggagcgtccgggagactggggcgctccgcgccatcgtcttcaatgcttctctgaacagcctttaggaagagtgcgagagaaagagagagagcgcgcgccagggagaggagaaaagaagatgaggattatttccagacagattgtcttgttattttctggattttggggactcgccatgggagcctttccgagcagcgtgcaaataggtggtctcttcatccgaaacacagatcaggaatacactgcttttcgattagcaatttttcttcataacaccagccccaatgcgtcggaagctccttttaatttggtacctcatgtggacaacattgagacagccaacagttttgctgtaacaaacgccttctgttcccagtattctagaggagtatttgccatttttggactctatgataagaggtcggtacataccttgacctcattctgcagcgccttacatatctccctcatcacaccaagtttccctactgagggggagagccagtttgtgctgcaactaagaccttcgttacgaggagcactcttgagtttgctggatcactacgaatggaactgttttgtcttcctgtatgacacagacaggggatactcgatactccaagctattatggaaaaagcaggacaaaatggttggcatgtcagcgctatatgtgtggaaaattttaatgatgtcagctataggcaacttctagaagaacttgacagaagacaagagaagaagtttgtaatagactgtgagatagagagacttcaaaacatattagaacagattgtaagtgttggaaagcatgttaaaggctaccattatatcattgcaaacttgggattcaaggatatttctcttgagaggtttatacatggtggagccaatgttactggattccagttggtggattttaatacacctatggtaatcaaactaatggatcgctggaagaaactagatcagagagagtatccaggatctgagactcctccaaagtacacctctgctctgacttatgatggagtccttgtgatggctgaaactttccgaagtcttaggaggcagaaaattgatatctcaaggagaggaaatgctggggattgtctggcaaatcctgctgctccatggggccagggaattgacatggagaggacactcaaacaggttcgaattcaagggctgacagggaatgttcagtttgaccactatggacgtagagtcaattacacaatggatgtgtttgagctgaaaagcacaggacctagaaaggttggttactggaatgatatggataagttagtcttgattcaagatgtaccaactcttggcaatgacacagctgctattgagaacagaacagtggttgtaaccacaattatggaatccccatatgttatgtacaagaaaaatcatgaaatgtttgaaggaaatgacaagtatgaaggatactgtgtagatttggcatctgaaattgcaaaacatattggtatcaagtataaaattgccattgtccctgatggaaaatatggagcaagggatgcagacacaaaaatctggaatgggatggtaggagaacttgtttatgggaaagcagagattgctattgcccctctgacaatcactttggtacgagaggaggtcattgacttttctaagcccttcatgagtttgggcatatctatcatgatcaaaaagcctcagaaatccaaaccaggagtgttttccttcttggatcctctggcctatgagatttggatgtgcatagtctttgcctacattggtgtcagcgtggtcttattcctagttagtagatttagtccatatgagtggcacacagaagagccagaggacggaaaggaaggacccagcgaccagcctcccaatgagtttggcatctttaacagcctctggttttccctgggtgcttttatgcagcaaggatgtgacatttcacccagatccctctcaggtcgaattgttggaggtgtttggtggttctttacactcatcattatatcatcttatactgctaacctcgctgctttcctgacggttgagcgaatggtctctcccatagaaagtgcagaagacctggccaaacaaacagaaattgcctatggaacactggattcaggatcaacaaaagaattcttcagaagatcaaaaatagcagtgtatgaaaagatgtggacctacatgcgatcagcagagccatcagtattcactaggactacagctgagggagtagctcgtgtccgcaaatccaagggcaaatttgcctttctcctggagtccactatgaatgaatacattgagcagcgaaagccatgtgacacgatgaaagtgggaggaaatctggattccaaaggctatggagtagcaacgcccaagggttcctcattaagaaatgctgttaacctcgcagttttaaaactgaatgaacaaggcctcttggacaaattgaaaaacaaatggtggtacgacaaaggagaatgtggcagcgggggaggtgactccaaggacaagacgagtgccttgagcctgagcaatgtagcaggcgtcttctacattctggttggcggcttgggcttggcaatgctggtggctttgatagagttctgttacaagtccagggcagaagcgaagagaatgaaggtggcaaagagtgcacagacttttaacccaacttcctcgcagaatacccagaatttagcaacctatagagaaggttacaacgtatatggaaccgaaagtattaaaatttagggctgaccttttctgaagccataagaaacaaagccagattatccatcactgggagtgtgggagagaatggccgcgtcttgacgcctgactgcccaaaggctgtacacactggaactgcaatcagacaaagttcaggattggctgtcattgcatcggacctaccataaaaaccaaaaaaataattgagtgccttaattaaactgttggtgactggtggaaacgcagccctgagggacacgccacgcgcgggtctttgctaaaccaatcctttggctgagagcgggaagtccgtcctaacgcgctggccggacatcagcagcagcaacgtgtgcatgagctcagctcggaaacccaaactcagattttatatcaggaaaactcacaattgaggtttttttcggggagtgggtgggggagggatctgggatgggtgtattaacagcaacaaatttcattcgagtggactcaaaaactaatcagacttatgagttagcgcattaaactgtgaagttcttgctcagaaaggcctttgtcttcaccggaaaggataaaatagttgtagaagtccgtgaacatgctaacctgtgtctccagaacatccatatagtccatggaagaaaatccagctgagaaaacaaatcactaaactgtgataagaaaataatgaacaaacatgtaaaacctgtgggaaaaaaaaataaaggaagtatgtacacttactttggagaaaacaaatactgaaacatgcttgctttttaactgacgtaaattcagtagaggacaacacaattcttttttctaaccatcttagggaacaatacattgcaataattgatataaatgccatcactgtaataaactttagagacttttttttataaaagttgttggtcatcttcttgtttgctgtaaccttcactatgtcacatgagtcgattcaccgattgcatttgtctcacaaccaggaagaaaagcaaaaggaagaaaacgtttaggttcaatcatcagtctgcggtgtagactcgaaagagatgacaggtcactcatgttaatggtattatttataatctcattctgtgtacaacattgtggtttttgtacccaccaaaaagaataaaacagcagatgttcttacaatatctacagagcttaaaagttttttcttatcgttataaaagttatttgagaaattataagactataagagagattgtattagtggtgggccatagtggaaaatgtagctagccctcattattttttgcatactaagctacccctccttttcagatctttgactcattaacagattaaactgtcaaagatggagtctttgagttggggaatgaatcactgtcctaacaacaacataccttgtaattgtgtgttgaaattttacttgactgtattttgctgcataaaattatgtgtctcttgggcttcttcccttattcctattgttccctttaaatcatatgaaggcattcataatagcttggggtagataacaaatgaagaattagtctttgttttcaactggaaattgtaaagaaaattatactcatgtttatttataaaaatcaccttatgtatgaattaaactaacatggttcaaaagaaggtttggttcatttgaaataataaataagtactctaatacagataaaaatcatgtacttagggtattggcagaaagcacaagttaggatgatttcagaagtctggccttgaaggatgagttgagttttaacaggaggagaaggtgttaagagccatatgagtgagcagtggcccaaagccatgcacatcagtggctcatttaaggaatgaatgccattagatgggctactgagagtacagggatattatggaagataaagttggaaaagctgaaggattgattttcttccatcaactctcaagatcccattcgccattcaatctctgtgctgcagtaagagcaatcttaaacagtataaatcacacacacacacacacacacacacacacacacacacaagtccctcaggaaaaattccaagctcttgagaagatcacatgagccccttcatgacctggcgcttgcttatttcttccaggacttctctcacttctatccagctattcccgtcagcaaatgaacctccaaagcagcacatggagcactgcatagactatttcctcagtgcgtaactcctccctgtctcctctttacctgagtaacttgtactcatccttcaatactccaactgaattttacttaccctgaaaagatttccatggctatccaccacccccctgcctgtgagactgagttaggtgccctttttcatgtctttcccccatcacggcacttaccatactgcgttgtaattgcctgtgtactcgtctgtataactactagactgtaagctccttgagggcagggactgtgtctatcttgttcacagttgtatccccagcacccagcacagtgcctggcatattgtaggtgcttaataaatatttgttgaatgaatg

SEQ ID NO: 12261 - DNA, 2778 bp, Homo sapiens
atttgcagccggacagaaaacctctcccagggctatggagactgcgggaaaaatctggcggctcgcgatggattgctaaggagaactagtcataatcttaaaccaccgaaacctctttccttttttttctttcttttctttcttttctttttttttttttttttttggttgattttaattttagcgccatcgtcttcaatgcttctctgaacagcctttaggaagagtgcgagagaaagagagagagcgcgcgccagggagaggagaaaagaagatgaggattatttccagacagattgtcttgttattttctggattttggggactcgccatgggagcctttccgagcagcgtgcaaataggtggtctcttcatccgaaacacagatcaggaatacactgcttttcgattagcaatttttcttcataacaccagccccaatgcgtcggaagctccttttaatttggtacctcatgtggacaacattgagacagccaacagttttgctgtaacaaacgccttctgttcccagtattctagaggagtatttgccatttttggactctatgataagaggtcggtacataccttgacctcattctgcagcgccttacatatctccctcatcacaccaagtttccctactgagggggagagccagtttgtgctgcaactaagaccttcgttacgaggagcactcttgagtttgctggatcactacgaatggaactgttttgtcttcctgtatgacacagacaggggatactcgatactccaagctattatggaaaaagcaggacaaaatggttggcatgtcagcgctatatgtgtggaaaattttaatgatgtcagctataggcaacttctagaagaacttgacagaagacaagagaagaagtttgtaatagactgtgagatagagagacttcaaaacatattagaacagattgtaagtgttggaaagcatgttaaaggctaccattatatcattgcaaacttgggattcaaggatatttctcttgagaggtttatacatggtggagccaatgttactggattccagttggtggattttaatacacctatggtaatcaaactaatggatcgctggaagaaactagatcagagagagtatccaggatctgagactcctccaaagtacacctctgctctgacttatgatggagtccttgtgatggctgaaactttccgaagtcttaggaggcagaaaattgatatctcaaggagaggaaatgctggggattgtctggcaaatcctgctgctccatggggccagggaattgacatggagaggacactcaaacaggttcgaattcaagggctgacagggaatgttcagtttgaccactatggacgtagagtcaattacacaatggatgtgtttgagctgaaaagcacaggacctagaaaggttggttactggaatgatatggataagttagtcttgattcaagatgtaccaactcttggcaatgacacagctgctattgagaacagaacagtggttgtaaccacaattatgcctctgatgaagaatcctattttaagaaattgatcaagaaagaaaagagttccgcgctgttcgaccattcctaactaaggctcaagtcttgttctccagtgtagtaaatttaagcttatttttcatgtgggattcttcttggatgaccaactctggactaccagaaaaaaaaaattttaagttctgtgacttttctgagatactagaacaaaagaagaattaatcttcatctttctcaagaaatagatgttgacaaagaatcacttagcgattctgacatatcaattcccctatcttgaaatgaggtcactgtatgtaaatgatggaattatatcactccatttccaagggtagattttctataagtaaatatctcggaatttgtgtgcttgttttctgaatatatacagttgttttctttaaagatctcttggaattttgcctgttctgtgtgaaataaagtgttttaatgtgcattataggtatgatatagagaatctcctttccatccttgttactaaagggactggacaaataaatcttaaaaccaaaatactgaattaattttgcaagcatggctagtttttaggaagcatgctatcaaaaaaaaaaagactaaaaatgactgaaaaaatccaactgttttatatatatataaatatatatatatttatatatatatataaaggatattctgtaaagttatatgttgtttgacagtaaagccatcaatatttttgctatcaaaatagtataatactagtatctttttgtatgaaaatgtaatctttatataaataatacctctgatatttgcaactgcataatcgttcagtaattcaaaaagacatactagaatcctttttctgaaagtgttccttcaatttgcttttgttgaaaacggtagtccaggacctatgatatccctccacttcattcattatgaaagaaatcccttgtagataaacaagatattggcatctgcatgtaattatccccagattcagctgaaaactcccaacacagatggaattggctagacattttaatatatgtgatacctatatctagatatagaaggctgagagtgagcactggatataattcattttgattgaaattgatatggtgttattgttcttccagttgtctgtcctttgtgtatgttcttatttatatgttgatacactgtaacactatatgctattgctaaataaaattgattgagaaattca

SEQ ID NO: 12262 - DNA, 2822 bp, Homo sapiens
atgaggattatttccagacagattgtcttgttattttctggattttggggactcgccatgggagcctttccgagcagcgtgcaaataggtggtctcttcatccgaaacacagatcaggaatacactgcttttcgattagcaatttttcttcataacaccagccccaatgcgtcggaagctccttttaatttggtacctcatgtggacaacattgagacagccaacagttttgctgtaacaaacgccttctgttcccagtattctagaggagtatttgccatttttggactctatgataagaggtcggtacataccttgacctcattctgcagcgccttacatatctccctcatcacaccaagtttccctactgagggggagagccagtttgtgctgcaactaagaccttcgttacgaggagcactcttgagtttgctggatcactacgaatggaactgttttgtcttcctgtatgacacagacaggggatactcgatactccaagctattatggaaaaagcaggacaaaatggttggcatgtcagcgctatatgtgtggaaaattttaatgatgtcagctataggcaacttctagaagaacttgacagaagacaagagaagaagtttgtaatagactgtgagatagagagacttcaaaacatattagaacagattgtaagtgttggaaagcatgttaaaggctaccattatatcattgcaaacttgggattcaaggatatttctcttgagaggtttatacatggtggagccaatgttactggattccagttggtggattttaatacacctatggtaatcaaactaatggatcgctggaagaaactagatcagagagagtatccaggatctgagactcctccaaagtacacctctgctctgacttatgatggagtccttgtgatggctgaaactttccgaagtcttaggaggcagaaaattgatatctcaaggagaggaaatgctggggattgtctggcaaatcctgctgctccatggggccagggaattgacatggagaggacactcaaacaggttcgaattcaagggctgacagggaatgttcagtttgaccactatggacgtagagtcaattacacaatggatgtgtttgagctgaaaagcacaggacctagaaaggttggttactggaatgatatggataagttagtcttgattcaagatgtaccaactcttggcaatgacacagctgctattgagaacagaacagtggttgtaaccacaattatggaatccccatatgttatgtacaagaaaaatcatgaaatgtttgaaggaaatgacaagtatgaaggatactgtgtagatttggcatctgaaattgcaaaacatattggtatcaagtataaaattgccattgtccctgatggaaaatatggagcaagggatgcagacacaaaaatctggaatgggatggtaggagaacttgtttatgggaaagcagagattgctattgcccctctgacaatcactttggtacgagaggaggtcattgacttttctaagcccttcatgagtttgggcatatctatcatgatcaaaaagcctcagaaatccaaaccaggagtgttttccttcttggatcctctggcctatgagatttggatgtgcatagtctttgcctacattggtgtcagcgtggtcttattcctagttagtagatttagtccatatgagtggcacacagaagagccagaggacggaaaggaaggacccagcgaccagcctcccaatgagtttggcatctttaacagcctctggttttccctgggtgcttttatgcagcaaggatgtgacatttcacccagatccctctcaggtcgaattgttggaggtgtttggtggttctttacactcatcattatatcatcttatactgctaacctcgctgctttcctgacggttgagcgaatggtctctcccatagaaagtgcagaagacctggccaaacaaacagaaattgcctatggaacactggattcaggatcaacaaaagaattcttcagaagatcaaaaatagcagtgtatgaaaagatgtggacctacatgcgatcagcagagccatcagtattcactaggactacagctgagggagtagctcgtgtccgcaaatccaagggcaaatttgcctttctcctggagtccactatgaatgaatacattgagcagcgaaagccatgtgacacgatgaaagtgggaggaaatctggattccaaaggctatggagtagcaacgcccaagggttcctcattaagaaatgctgttaacctcgcagttttaaaactgaatgaacaaggcctcttggacaaattgaaaaacaaatggtggtacgacaaaggagaatgtggcagcgggggaggtgactccaaggacaagacgagtgccttgagcctgagcaatgtagcaggcgtcttctacattctggttggcggcttgggcttggcaatgctggtggctttgatagagttctgttacaagtccagggcagaagcgaagagaatgaaggtggcaaagagtgcacagacttttaacccaacttcctcgcagaatacccagaatttagcaacctatagagaaggttacaacgtatatggaaccgaaagtattaaaatttagggctgaccttttctgaagccataagaaacaaagccagattatccatcactgggagtgtgggagagaatggccgcgtcttgacgcctgactgcccaaaggctgtacacactggaactgcaatcagacaaagttcaggattggctgtcattgcatcggacctaccataa

SEQ ID NO: 12263 - DNA, 470 bp, Homo sapiens
agaggtgccaggaaaaccaagagaggggcgctgggggtgcccatccccagagtcggtccctctgcgaaccgaggaagaaaagaggagggagtcagcgagtggtcagaagggaaaacctgacaccagactggctccggagcgtccgggagactggggcgctccgcctttaggaagagtgcgagagaaagagagagagcgcgcgccagggagaggagaaaagaagatgaggattatttccagacagattgtcttgttattttctggattttggggactcgccatgggagcctttccgagcagcgtgcaaataggtggtctcttcatccgaaacacagatcaggaatacactgcttttcgattagcaatttttcttcataacaccagccccaatgcgtcggaagctccttttaatttggtacctcatgtggacaacattgagacagccaacagttttgctgtaacaaacgcct

SEQ ID NO: 12264 - DNA, 367 bp, Homo sapiens
aggctctccagattcccgggctgtttgctgcgccatcgtcttcaatgcttctctgaacagcctttaggaagagtgcgagagaaagagagagagcgcgcgccagggagaggagaaaagaagatgaggattatttccagacagattgtcttgttattttctggattttggggactcgccatgggagcctttccgagcagcgtgcaaataggtggtctcttcatccgaaacacagatcaggaatacactgcttttcgattagcaatttttcttcataacaccagccccaatgcgtcggaagctccttttaatttggtacctcatgtggacaacattgagacagccaacagttttgctgtaacaaacgcct

SEQ ID NO: 12265 - DNA, 5059 bp, Homo sapiens
atgaggattatttccagacagattgtcttgttattttctggattttggggactcgccatgggagcctttccgagcagcgtgcaaataggtggtctcttcatccgaaacacagatcaggaatacactgcttttcgattagcaatttttcttcataacaccagccccaatgcgtcggaagctccttttaatttggtacctcatgtggacaacattgagacagccaacagttttgctgtaacaaacgccttctgttcccagtattctagaggagtatttgccatttttggactctatgataagaggtcggtacataccttgacctcattctgcagcgccttacatatctccctcatcacaccaagtttccctactgagggggagagccagtttgtgctgcaactaagaccttcgttacgaggagcactcttgagtttgctggatcactacgaatggaactgttttgtcttcctgtatgacacagacaggggatactcgatactccaagctattatggaaaaagcaggacaaaatggttggcatgtcagcgctatatgtgtggaaaattttaatgatgtcagctataggcaacttctagaagaacttgacagaagacaagagaagaagtttgtaatagactgtgagatagagagacttcaaaacatattagaacagattgtaagtgttggaaagcatgttaaaggctaccattatatcattgcaaacttgggattcaaggatatttctcttgagaggtttatacatggtggagccaatgttactggattccagttggtggattttaatacacctatggtaatcaaactaatggatcgctggaagaaactagatcagagagagtatccaggatctgagactcctccaaagtacacctctgctctgacttatgatggagtccttgtgatggctgaaactttccgaagtcttaggaggcagaaaattgatatctcaaggagaggaaatgctggggattgtctggcaaatcctgctgctccatggggccagggaattgacatggagaggacactcaaacaggttcgaattcaagggctgacagggaatgttcagtttgaccactatggacgtagagtcaattacacaatggatgtgtttgagctgaaaagcacaggacctagaaaggttggttactggaatgatatggataagttagtcttgattcaagatgtaccaactcttggcaatgacacagctgctattgagaacagaacagtggttgtaaccacaattatggaatccccatatgttatgtacaagaaaaatcatgaaatgtttgaaggaaatgacaagtatgaaggatactgtgtagatttggcatctgaaattgcaaaacatattggtatcaagtataaaattgccattgtccctgatggaaaatatggagcaagggatgcagacacaaaaatctggaatgggatggtaggagaacttgtttatgggaaagcagagattgctattgcccctctgacaatcactttggtacgagaggaggtcattgacttttctaagcccttcatgagtttgggcatatctatcatgatcaaaaagcctcagaaatccaaaccaggagtgttttccttcttggatcctctggcctatgagatttggatgtgcatagtctttgcctacattggtgtcagcgtggtcttattcctagttagtagatttagtccatatgagtggcacacagaagagccagaggacggaaaggaaggacccagcgaccagcctcccaatgagtttggcatctttaacagcctctggttttccctgggtgcttttatgcagcaaggatgtgacatttcacccagatccctctcaggtcgaattgttggaggtgtttggtggttctttacactcatcattatatcatcttatactgctaacctcgctgctttcctgacggttgagcgaatggtctctcccatagaaagtgcagaagacctggccaaacaaacagaaattgcctatggaacactggattcaggatcaacaaaagaattcttcagaagatcaaaaatagcagtgtatgaaaagatgtggacctacatgcgatcagcagagccatcagtattcactaggactacagctgagggagtagctcgtgtccgcaaatccaagggcaaatttgcctttctcctggagtccactatgaatgaatacattgagcagcgaaagccatgtgacacgatgaaagtgggaggaaatctggattccaaaggctatggagtagcaacgcccaagggttcctcattaagaactcctgtaaaccttgccgttttgaaactcagtgaggcaggcgtcttagacaagctgaaaaacaaatggtggtacgataaaggtgaatgtggacccaaggactctggaagcaaggacaagacgagtgccttgagcctgagcaatgtagcaggcgtcttctacattctggttggcggcttgggcttggcaatgctggtggctttgatagagttctgttacaagtccagggcagaagcgaagagaatgaagctgaccttttctgaagccataagaaacaaagccagattatccatcactgggagtgtgggagagaatggccgcgtcttgacgcctgactgcccaaaggctgtacacactggaactgcaatcagacaaagttcaggattggctgtcattgcatcggacctaccataaaaaccaaaaaaataattgagtgccttaattaaactgttggtgactggtggaaacgcagccctgagggacacgccacgcgcgggtctttgctaaaccaatcctttggctgagagcgggaagtccgtcctaacgcgctggccggacatcagcagcagcaacgtgtgcatgagctcagctcggaaacccaaactcagattttatatcaggaaaactcacaattgaggtttttttcggggagtgggtgggggagggatctgggatgggtgtattaacagcaacaaatttcattcgagtggactcaaaaactaatcagacttatgagttagcgcattaaactgtgaagttcttgctcagaaaggcctttgtcttcaccggaaaggataaaatagttgtagaagtccgtgaacatgctaacctgtgtctccagaacatccatatagtccatggaagaaaatccagctgagaaaacaaatcactaaactgtgataagaaaataatgaacaaacatgtaaaacctgtgggaaaaaaaaataaaggaagtatgtacacttactttggagaaaacaaatactgaaacatgcttgctttttaactgacgtaaattcagtagaggacaacacaattcttttttctaaccatcttagggaacaatacattgcaataattgatataaatgccatcactgtaataaactttagagacttttttttataaaagttgttggtcatcttcttgtttgctgtaaccttcactatgtcacatgagtcgattcaccgattgcatttgtctcacaaccaggaagaaaagcaaaaggaagaaaacgtttaggttcaatcatcagtctgcggtgtagactcgaaagagatgacaggtcactcatgttaatggtattatttataatctcattctgtgtacaacattgtggtttttgtacccaccaaaaagaataaaacagcagatgttcttacaatatctacagagcttaaaagttttttcttatcgttataaaagttatttgagaaattataagactataagagagattgtattagtggtgggccatagtggaaaatgtagctagccctcattattttttgcatactaagctacccctccttttcagatctttgactcattaacagattaaactgtcaaagatggagtctttgagttggggaatgaatcactgtcctaacaacaacataccttgtaattgtgtgttgaaattttacttgactgtattttgctgcataaaattatgtgtctcttgggcttcttcccttattcctattgttccctttaaatcatatgaaggcattcataatagcttggggtagataacaaatgaagaattagtctttgttttcaactggaaattgtaaagaaaattatactcatgtttatttataaaaatcaccttatgtatgaattaaactaacatggttcaaaagaaggtttggttcatttgaaataataaataagtactctaatacagataaaaatcatgtacttagggtattggcagaaagcacaagttaggatgatttcagaagtctggccttgaaggatgagttgagttttaacaggaggagaaggtgttaagagccatatgagtgagcagtggcccaaagccatgcacatcagtggctcatttaaggaatgaatgccattagatgggctactgagagtacagggatattatggaagataaagttggaaaagctgaaggattgattttcttccatcaactctcaagatcccattcgccattcaatctctgtgctgcagtaagagcaatcttaaacagtataaatcacacacacacacacacacacacacacacacacacacaagtccctcaggaaaaattccaagctcttgagaagatcacatgagccccttcatgacctggcgcttgcttatttcttccaggacttctctcacttctatccagctattcccgtcagcaaatgaacctccaaagcagcacatggagcactgcatagactatttcctcagtgcgtaactcctccctgtctcctctttacctgagtaacttgtactcatccttcaatactccaactgaattttacttaccctgaaaagatttccatggctatccaccacccccctgcctgtgagactgagttaggtgccctttttcatgtctttcccccatcacggcacttaccatactgcgttgtaattgcctgtgtactcgtctgtataactactagactgtaagctccttgagggcagggactgtgtctatcttgttcacagttgtatccccagcacccagcacagtgcctggcatattgtaggtgcttaataaatatttgttgaatga

SEQ ID NO: 12266 - DNA, 2444 bp, Homo sapiens
tgaggattatttccagacagattgtcttgttattttctggattttggggactcgccatgggagcctttccgagcagcgtgcaaataggtggtctcttcatccgaaacacagatcaggaatacactgcttttcgattagcaatttttcttcataacaccagccccaatgcgtcggaagctccttttaatttggtacctcatgtggacaacattgagacagccaacagttttgctgtaacaaacgccttctgttcccagtattctagaggagtatttgccatttttggactctatgataagaggtcggtacataccttgacctcattctgcagcgccttacatatctccctcatcacaccaagtttccctactgagggggagagccagtttgtgctgcaactaagaccttcgttacgaggagcactcttgagtttgctggatcactacgaatggaactgttttgtcttcctgtatgacacagacaggggatactcgatactccaagctattatggaaaaagcaggacaaaatggttggcatgtcagcgctatatgtgtggaaaattttaatgatgtcagctataggcaacttctagaagaacttgacagaagacaagagaagaagtttgtaatagactgtgagatagagagacttcaaaacatattagaacagattgtaagtgttggaaagcatgttaaaggctaccattatatcattgcaaacttgggattcaaggatatttctcttgagaggtttatacatggtggagccaatgttactggattccagttggtggattttaatacacctatggtaatcaaactaatggatcgctggaagaaactagatcagagagagtatccaggatctgagactcctccaaagtacacctctgctctgacttatgatggagtccttgtgatggctgaaactttccgaagtcttaggaggcagaaaattgatatctcaaggagaggaaatgctggggattgtctggcaaatcctgctgctccatggggccagggaattgacatggagaggacactcaaacaggttcgaattcaagggctgacagggaatgttcagtttgaccactatggacgtagagtcaattacacaatggatgtgtttgagctgaaaagcacaggacctagaaaggttggttactggaatgatatggataagttagtcttgattcaagatgtaccaactcttggcaatgacacagctgctattgagaacagaacagtggttgtaaccacaattatggaatccccatatgttatgtacaagaaaaatcatgaaatgtttgaaggaaatgacaagtatgaaggatactgtgtagatttggcatctgaaattgcaaaacatattggtatcaagtataaaattgccattgtccctgatggaaaatatggagcaagggatgcagacacaaaaatctggaatgggatggtaggagaacttgtttatgggaaagcagagattgctattgcccctctgacaatcactttggtacgagaggaggtcattgacttttctaagcccttcatgagtttgggcatatctatcatgatcaaaaagcctcagaaatccaaaccaggagtgttttccttcttggatcctctggcctatgagatttggatgtgcatagtctttgcctacattggtgtcagcgtggtcttattcctagttagtagatttagtccatatgagtggcacacagaagagccagaggacggaaaggaaggacccagcgaccagcctcccaatgagtttggcatctttaacagcctctggttttccctgggtgcttttatgcagcaaggatgtgacatttcacccagatccctctcaggtcgaattgttggaggtgtttggtggttctttacactcatcattatatcatcttatactgctaacctcgctgctttcctgacggttgagcgaatggtctctcccatagaaagtgcagaagacctggccaaacaaacagaaattgcctatggaacactggattcaggatcaacaaaagaattcttcagaagatcaaaaatagcagtgtatgaaaagatgtggacctacatgcgatcagcagagccatcagtattcactaggactacagctgagggagtagctcgtgtccgcaaatccaagggcaaatttgcctttctcctggagtccactatgaatgaatacattgagcagcgaaagccatgtgacacgatgaaagtgggaggaaatctggattccaaaggctatggagtagcaacgcccaagggttcctcattaagaaatgctgttaacctcgcagttttaaaactgaatgaacaaggcctcttggacaaattgaaaaacaaatggtggtacgacaaaggagaatgtggcagcgggggaggtgactccaagaactcctgtaaaccttgccgttttgaaactcagtga

SEQ ID NO: 12267 - DNA, 5519 bp, Homo sapiens
gtgtgagggggagagcgagagagagcaagggagggagagagaggcaggctgcgaggggagaggagagggagtgggggagccagcgctccagctagcatgaggacgggcttcttttcccgtgctcagttaatctggctgtcagttggtgttaacgctgcagtttaagtgttcggattccaagggaaacagacaaacctcacgaaaggaaggaagcaagcaagcaaggaaggaactgcaggaggaaaagaacaggcagaacagcgagaagaataaagggaaagggggggaaacaccaaatctatgattggacctgggcttctttttcgccaatgcaaaaaggaatatgcagcacatttttgccttcttctgcaccggtttcctaggcgcggtagtaggtgccaatttccccaacaatatccagatcgggggattatttccaaaccagcagtcacaggaacatgctgcttttagatttgctttgtcgcaactcacagagcccccgaagctgctcccccagattgatattgtgaacatcagcgacagctttgagatgacctatagattctgttcccagttctccaaaggagtctatgccatctttgggttttatgaacgtaggactgtcaacatgctgacctccttttgtggggccctccacgtctgcttcattacgccgagctttcccgttgatacatccaatcagtttgtccttcagctgcgccctgaactgcaggatgccctcatcagcatcattgaccattacaagtggcagaaatttgtctacatttatgatgccgaccggggcttatccgtcctgcagaaagtcctggatacagctgctgagaagaactggcaggtgacagcagtcaacattttgacaaccacagaggagggataccggatgctctttcaggacctggagaagaaaaaggagcggctggtggtggtggactgtgaatcagaacgcctcaatgctatcttgggccagattataaagctagagaagaatggcatcggctaccactacattcttgcaaatctgggcttcatggacattgacttaaacaaattcaaggagagtggcgccaatgtgacaggtttccagctggtgaactacacagacactattccggccaagatcatgcagcagtggaagaatagtgatgctcgagaccacacacgggtggactggaagagacccaagtacacctctgcgctcacctacgatggggtgaaggtgatggctgaggctttccagagcctgcggaggcagagaattgatatatctcgccgggggaatgctggggattgtctggctaacccagctgttccctggggccaagggatcgacatccagagagctctgcagcaggtgcgatttgaaggtttaacaggaaacgtgcagtttaatgagaaaggacgccggaccaactacacgctccacgtgattgaaatgaaacatgacggcatccgaaagattggttactggaatgaagatgataagtttgtccctgcagccaccgatgcccaagctgggggcgataattcaagtgttcagaacagaacatacatcgtcacaacaatcctagaagatccttatgtgatgctcaagaagaacgccaatcagtttgagggcaatgaccgttacgagggctactgtgtagagctggcggcagagattgccaagcacgtgggctactcctaccgtctggagattgtcagtgatggaaaatacggagcccgagaccctgacacgaaggcctggaatggcatggtgggagagctggtctatggaagagcagatgtggctgtggctcccttaactatcactttggtccgggaagaagttatagatttctccaaaccatttatgagtttggggatctccatcatgattaaaaaaccacagaaatccaagccgggtgtcttctccttccttgatcctttggcttatgagatttggatgtgcattgtttttgcctacattggagtgagtgttgtcctcttcctggtcagccgcttcagtccctatgaatggcacagtgaagagtttgaggaaggacgggaccagacaaccagtgaccagtccaatgagtttgggatattcaacagtttgtggttctccctgggagccttcatgcagcaaggatgtgacatttctcccaggtccctgtctggtcgcatcgttggtggcgtctggtggttcttcaccttaatcatcatctcctcatatacagccaatctggccgccttcctgaccgtggagaggatggtgtctcccattgagagtgcagaggacctagcgaagcagacagaaattgcctacgggacgctggaagcaggatctactaaggagttcttcaggaggtctaaaattgctgtgtttgagaagatgtggacatacatgaagtcagcagagccatcagtttttgtgcggaccacagaggaggggatgattcgagtgaggaaatccaaaggcaaatatgcctacctcctggagtccaccatgaatgagtacattgagcagcggaaaccctgtgacaccatgaaggtgggaggtaacttggattccaaaggctatggcattgcaacacccaaggggtctgccctgagaaatccagtaaacctggcagtgttaaaactgaacgagcaggggcttttggacaaattgaaaaacaaatggtggtacgacaagggcgagtgcggcagcgggggaggtgattccaaggacaagacaagcgctctgagcctcagcaatgtggcaggcgtgttctacatcctgatcggaggacttggactagccatgctggttgccttaatcgagttctgctacaaatcccgtagtgaatccaagcggatgaagggtttttgtttgatcccacagcaatccatcaacgaagccatacggacatcgaccctcccccgcaacagcggggcaggagccagcagcggcggcagtggagagaatggtcgggtggtcagccatgacttccccaagtccatgcaatcgattccttgcatgagccacagttcagggatgcccttgggagccacgggattgtaactggagcagatggagaccccttggggagcaggctcgggctccccagccccatcccaaacccttcagtgccaaaaacaacaacaaaatgaaacgcaaccaccaccaaccactgcgaccacaagaaggatgattcaacaggttttcctgaagaattgaaaaaccattttgctgtcccttttccttttttgatgttctttcacccttttctgtttgctaagtgaggatgaaaaaataacactgtactgcaataaggggagagtaaccctgtctaatgaaacctgtgtctctgagagtagagtcactggaacactaatgaggaaactgcactgttttattttaattcagttgttagtgtgtcttagtgtgtgcaattttttttcttactaatatccatggtttgcaggttctgttaggccctttccttctccttacttcttatccccaactccctacccacccctcttcagttttcagattggagattcaagatttgttccactttacaagcaagaggaaaaaaaagcaaccttcaaactaattctccatgggggctctccatgttaccctccactccttggcccaaacctctgatggagatagacattgttggagaagtgggctgccttccccaagtggggcactgcttaagcacttattcagtggagaacacaggtgaaaagcaactcaggatgagggtggtggagagggcaggggcagatgtgcagtcagagaaggactcctgaagttactgctgctcagaaaaacagttcctttaatgtggaagagccatttcataggtcataggtggtatggtatatttcttcagagtcaaccttggccctgagaagtatgtcctcctggtgtgctcaggctcaacggcagtctggtggctgaaggcacttggcctcctaaaccaagcagaattttgggaagagataacagccagggagatattgcccatgattctcactttttctttgcctggcatctaagcaggaacccattgtggagtagactctcttcttctatggagcctctgacatggggagcaatgctaagcaagctaagtgtaaaagaaaagtgacagaataattttggaagaggaagcctcatcaaaagctcacacaaaatagagcttcccatggtgtgccctatcctaggtttaagaaaacacgtatgaagtttatgctgatgcaaagaacttgggtttttatgttaatataaagtgttgttttagcatgtggccagatgatgctctgtcatctttagaaagtgagataaccaaggaaataattgaaggagtatagggagatggattaagttgataatgacatttagggcaacttaagacctttgatcccaggttctaactcaaagaggctgaccttcccccagctaagatagcatgaggacgttgtattccaatatacgtatgattggggctacaaagctgaactaaagcaagattggtgaagtggcagggtttatagagagaagcccaggctgagttcagcttttgttggaagtgagaatccctgacatatagctttcttggagatcccaactctcattcttggtgcaactggcttccagctctccagcagtcactctcctaggtgcatgattcagtgcgtgccatgtgtcattagcttttactgataaccatattctggcttgttcccttaccccctacttctatccaattttctctgctaggggttatcattagcaattgacatgctaaaggttttggagcccacctaggggtaggtgcagctttattggcttttctgtggattctctcagtggacccacaccatctctatgtctctccactctcctgccttcagccatagcaaagaatccttccaaaatcaaactcttcacttttttgactcaagtgttgttgttcagtctctcgcgtgtcaatgtggtcatggttcatgaaaccggaccctcaagatggatgattgcttttaactactgccagctgatgtctctcagcccctgccctcatacaagatttttctcagccttcagcctaccactgcagaatccgatgtgacccaccattagggagtctgcatcttggaagagttggaaataaccctttaacatcaacatgcttcaaagactttttgcctttggcctagtaagatgcctctccagctactgagcccacaagtaacatgagcggataaaaagagacttgtttgtgctagaaatgagggtctatgctatgagggggtccaagactctggcgaaatgtgctttttcatcaatggagaaatgaaaggaaaacacaagcaagaaaaaagttaacttgtattatgtatttttactacacttttcttaaaaatagagcattgggaaaactctgaaagagactgacatttttctcaacaggaatccatacttaacagttctggctttcattaaattttgctctttggta

SEQ ID NO: 12268 - DNA, 3170 bp, Homo sapiens
taaagggaaagggggggaaacaccaaatctatgattggacctgggcttctttttcgccaatgcaaaaaggaatatgcagcacatttttgccttcttctgcaccggtttcctaggcgcggtagtaggtgccaatttccccaacaatatccagatcgggggattatttccaaaccagcagtcacaggaacatgctgcttttagatttgctttgtcgcaactcacagagcccccgaagctgctcccccagattgatattgtgaacatcagcgacagctttgagatgacctatagattctgttcccagttctccaaaggagtctatgccatctttgggttttatgaacgtaggactgtcaacatgctgacctccttttgtggggccctccacgtctgcttcattacgccgagctttcccgttgatacatccaatcagtttgtccttcagctgcgccctgaactgcaggatgccctcatcagcatcattgaccattacaagtggcagaaatttgtctacatttatgatgccgaccggggcttatccgtcctgcagaaagtcctggatacagctgctgagaagaactggcaggtgacagcagtcaacattttgacaaccacagaggagggataccggatgctctttcaggacctggagaagaaaaaggagcggctggtggtggtggactgtgaatcagaacgcctcaatgctatcttgggccagattataaagctagagaagaatggcatcggctaccactacattcttgcaaatctgggcttcatggacattgacttaaacaaattcaaggagagtggcgccaatgtgacaggtttccagctggtgaactacacagacactattccggccaagatcatgcagcagtggaagaatagtgatgctcgagaccacacacgggtggactggaagagacccaagtacacctctgcgctcacctacgatggggtgaaggtgatggctgaggctttccagagcctgcggaggcagagaattgatatatctcgccgggggaatgctggggattgtctggctaacccagctgttccctggggccaagggatcgacatccagagagctctgcagcaggtgcgatttgaaggtttaacaggaaacgtgcagtttaatgagaaaggacgccggaccaactacacgctccacgtgattgaaatgaaacatgacggcatccgaaagattggttactggaatgaagatgataagtttgtccctgcagccaccgatgcccaagctgggggcgataattcaagtgttcagaacagaacatacatcgtcacaacaatcctagaagatccttatgtgatgctcaagaagaacgccaatcagtttgagggcaatgaccgttacgagggctactgtgtagagctggcggcagagattgccaagcacgtgggctactcctaccgtctggagattgtcagtgatggaaaatacggagcccgagaccctgacacgaaggcctggaatggcatggtgggagagctggtctatggaagagcagatgtggctgtggctcccttaactatcactttggtccgggaagaagttatagatttctccaaaccatttatgagtttggggatctccatcatgattaaaaaaccacagaaatccaagccgggtgtcttctccttccttgatcctttggcttatgagatttggatgtgcattgtttttgcctacattggagtgagtgttgtcctcttcctggtcagccgcttcagtccctatgaatggcacagtgaagagtttgaggaaggacgggaccagacaaccagtgaccagtccaatgagtttgggatattcaacagtttgtggttctccctgggagccttcatgcagcaaggatgtgacatttctcccaggtccctgtctggtcgcatcgttggtggcgtctggtggttcttcaccttaatcatcatctcctcatatacagccaatctggccgccttcctgaccgtggagaggatggtgtctcccattgagagtgcagaggacctagcgaagcagacagaaattgcctacgggacgctggaagcaggatctactaaggagttcttcaggaggtctaaaattgctgtgtttgagaagatgtggacatacatgaagtcagcagagccatcagtttttgtgcggaccacagaggaggggatgattcgagtgaggaaatccaaaggcaaatatgcctacctcctggagtccaccatgaatgagtacattgagcagcggaaaccctgtgacaccatgaaggtgggaggtaacttggattccaaaggctatggcattgcaacacccaaggggtctgccctgagaggtcccgtaaacctagcggttttgaaactcagtgagcaaggcgtcttagacaagctgaaaagcaaatggtggtacgataaaggggaatgtggaagcaaggactccggaagtaaggacaagacaagcgctctgagcctcagcaatgtggcaggcgtgttctacatcctgatcggaggacttggactagccatgctggttgccttaatcgagttctgctacaaatcccgtagtgaatccaagcggatgaagggtttttgtttgatcccacagcaatccatcaacgaagccatacggacatcgaccctcccccgcaacagcggggcaggagccagcagcggcggcagtggagagaatggtcgggtggtcagccatgacttccccaagtccatgcaatcgattccttgcatgagccacagttcagggatgcccttgggagccacgggattgtaactggagcagatggagaccccttggggagcaggctcgggctccccagccccatcccaaacccttcagtgccaaaaacaacaacaaaatgaaacgcaaccaccaccaaccactgcgaccacaagaaggatgattcaacaggttttcctgaagaattgaaaaaccattttgctgtcccttttccttttttgatgttctttcacccttttctgtttgctaagtgaggatgaaaaaataacactgtactgcaataaggggagagtaaccctgtctaatgaaacctgtgtctctgagagtagagtcactggaacactaatgaggaaactgcactgttttattttaattcagttgttagtgtgtcttagtgtgtgcaattttt

SEQ ID NO: 12269 - DNA, 3041 bp, Homo sapiens
gtgcaattgatattttgtcgggcatacatgtgctgcagtacccatctctttcagcctctccagctagctggcggcttggagtggccatggagtaacttgctttgtttcctgacacctgttaagctacatcctgaagtgtggggattatttccaaaccagcagtcacaggaacatgctgcttttagatttgctttgtcgcaactcacagagcccccgaagctgctcccccagattgatattgtgaacatcagcgacagctttgagatgacctatagattctgttcccagttctccaaaggagtctatgccatctttgggttttatgaacgtaggactgtcaacatgctgacctccttttgtggggccctccacgtctgcttcattacgccgagctttcccgttgatacatccaatcagtttgtccttcagctgcgccctgaactgcaggatgccctcatcagcatcattgaccattacaagtggcagaaatttgtctacatttatgatgccgaccggggcttatccgtcctgcagaaagtcctggatacagctgctgagaagaactggcaggtgacagcagtcaacattttgacaaccacagaggagggataccggatgctctttcaggacctggagaagaaaaaggagcggctggtggtggtggactgtgaatcagaacgcctcaatgctatcttgggccagattataaagctagagaagaatggcatcggctaccactacattcttgcaaatctgggcttcatggacattgacttaaacaaattcaaggagagtggcgccaatgtgacaggtttccagctggtgaactacacagacactattccggccaagatcatgcagcagtggaagaatagtgatgctcgagaccacacacgggtggactggaagagacccaagtacacctctgcgctcacctacgatggggtgaaggtgatggctgaggctttccagagcctgcggaggcagagaattgatatatctcgccgggggaatgctggggattgtctggctaacccagctgttccctggggccaagggatcgacatccagagagctctgcagcaggtgcgatttgaaggtttaacaggaaacgtgcagtttaatgagaaaggacgccggaccaactacacgctccacgtgattgaaatgaaacatgacggcatccgaaagattggttactggaatgaagatgataagtttgtccctgcagccaccgatgcccaagctgggggcgataattcaagtgttcagaacagaacatacatcgtcacaacaatcctagaagatccttatgtgatgctcaagaagaacgccaatcagtttgagggcaatgaccgttacgagggctactgtgtagagctggcggcagagattgccaagcacgtgggctactcctaccgtctggagattgtcagtgatggaaaatacggagcccgagaccctgacacgaaggcctggaatggcatggtgggagagctggtctatggaagagcagatgtggctgtggctcccttaactatcactttggtccgggaagaagttatagatttctccaaaccatttatgagtttggggatctccatcatgattaaaaaaccacagaaatccaagccgggtgtcttctccttccttgatcctttggcttatgagatttggatgtgcattgtttttgcctacattggagtgagtgttgtcctcttcctggtcagccgcttcagtccctatgaatggcacagtgaagagtttgaggaaggacgggaccagacaaccagtgaccagtccaatgagtttgggatattcaacagtttgtggttctccctgggagccttcatgcagcaaggatgtgacatttctcccaggtccctgtctggtcgcatcgttggtggcgtctggtggttcttcaccttaatcatcatctcctcatatacagccaatctggccgccttcctgaccgtggagaggatggtgtctcccattgagagtgcagaggacctagcgaagcagacagaaattgcctacgggacgctggaagcaggatctactaaggagttcttcaggaggtctaaaattgctgtgtttgagaagatgtggacatacatgaagtcagcagagccatcagtttttgtgcggaccacagaggaggggatgattcgagtgaggaaatccaaaggcaaatatgcctacctcctggagtccaccatgaatgagtacattgagcagcggaaaccctgtgacaccatgaaggtgggaggtaacttggattccaaaggctatggcattgcaacacccaaggggtctgccctgagaggtcccgtaaacctagcggttttgaaactcagtgagcaaggcgtcttagacaagctgaaaagcaaatggtggtacgataaaggggaatgtggaagcaaggactccggaagtaaggacaagacaagcgctctgagcctcagcaatgtggcaggcgtgttctacatcctgatcggaggacttggactagccatgctggttgccttaatcgagttctgctacaaatcccgtagtgaatccaagcggatgaagggtttttgtttgatcccacagcaatccatcaacgaagccatacggacatcgaccctcccccgcaacagcggggcaggagccagcagcggcggcagtggagagaatggtcgggtggtcagccatgacttccccaagtccatgcaatcgattccttgcatgagccacagttcagggatgcccttgggagccacgggattgtaactggagcagatggagaccccttggggagcaggctcgggctccccagccccatcccaaacccttcagtgccaaaaacaacaacaaaatgaaacgcaaccaccaccaaccactgcgaccacaagaaggatgattcaacaggttttcctgaagaattgaaaaaccattttgctgtcccttttccttttttgatgttctttcacccttttctgtttgctaagtgaggatgaaaaaataacactgtactgcaataaggggagagtaac

SEQ ID NO: 12270 - DNA, 2761 bp, Homo sapiens
tcttttcccgtgctcagttaatctggctgtcagttggtgttaacgctgcagtttaagtgttcggattccaagggaaacagacaaacctcacgaaaggaaggaagcaagcaagcaaggaaggaactgcaggaggaaaagaacaggcagaacagcgagaagaataaagggaaagggggggaaacaccaaatctatgattggacctgggcttctttttcgccaatgcaaaaaggaatatgcagcacatttttgccttcttctgcaccggtttcctaggcgcggtagtaggtgccaatttccccaacaatatccagatcgggggattatttccaaaccagcagtcacaggaacatgctgcttttagatttgctttgtcgcaactcacagagcccccgaagctgctcccccagattgatattgtgaacatcagcgacagctttgagatgacctatagatgcttatccgtcctgcagaaagtcctggatacagctgctgagaagaactggcaggtgacagcagtcaacattttgacaaccacagaggagggataccggatgctctttcaggacctggagaagaaaaaggagcggctggtggtggtggactgtgaatcagaacgcctcaatgctatcttgggccagattataaagctagagaagaatggcatcggctaccactacattcttgcaaatctgggcttcatggacattgacttaaacaaattcaaggagagtggcgccaatgtgacaggtttccagctggtgaactacacagacactattccggccaagatcatgcagcagtggaagaatagtgatgctcgagaccacacacgggtggactggaagagacccaagtacacctctgcgctcacctacgatggggtgaaggtgatggctgaggctttccagagcctgcggaggcagagaattgatatatctcgccgggggaatgctggggattgtctggctaacccagctgttccctggggccaagggatcgacatccagagagctctgcagcaggtgcgatttgaaggtttaacaggaaacgtgcagtttaatgagaaaggacgccggaccaactacacgctccacgtgattgaaatgaaacatgacggcatccgaaagattggttactggaatgaagatgataagtttgtccctgcagccaccgatgcccaagctgggggcgataattcaagtgttcagaacagaacatacatcgtcacaacaatcctagaagatccttatgtgatgctcaagaagaacgccaatcagtttgagggcaatgaccgttacgagggctactgtgtagagctggcggcagagattgccaagcacgtgggctactcctaccgtctggagattgtcagtgatggaaaatacggagcccgagaccctgacacgaaggcctggaatggcatggtgggagagctggtctatggaagagcagatgtggctgtggctcccttaactatcactttggtccgggaagaagttatagatttctccaaaccatttatgagtttggggatctccatcatgattaaaaaaccacagaaatccaagccgggtgtcttctccttccttgatcctttggcttatgagatttggatgtgcattgtttttgcctacattggagtgagtgttgtcctcttcctggtcagccgcttcagtccctatgaatggcacagtgaagagtttgaggaaggacgggaccagacaaccagtgaccagtccaatgagtttgggatattcaacagtttgtggttctccctgggagccttcatgcagcaaggatgtgacatttctcccaggtccctgtctggtcgcatcgttggtggcgtctggtggttcttcaccttaatcatcatctcctcatatacagccaatctggccgccttcctgaccgtggagaggatggtgtctcccattgagagtgcagaggacctagcgaagcagacagaaattgcctacgggacgctggaagcaggatctactaaggagttcttcaggaggtctaaaattgctgtgtttgagaagatgtggacatacatgaagtcagcagagccatcagtttttgtgcggaccacagaggaggggatgattcgagtgaggaaatccaaaggcaaatatgcctacctcctggagtccaccatgaatgagtacattgagcagcggaaaccctgtgacaccatgaaggtgggaggtaacttggattccaaaggctatggcattgcaacacccaaggggtctgccctgagaaatccagtaaacctggcagtgttaaaactgaacgagcaggggcttttggacaaattgaaaaacaaatggtggtacgacaagggcgagtgcggcagcgggggaggtgattccaaggacaagacaagcgctctgagcctcagcaatgtggcaggcgtgttctacatcctgatcggaggacttggactagccatgctggttgccttaatcgagttctgctacaaatcccgtagtgaatccaagcggatgaagggtttttgtttgatcccacagcaatccatcaacgaagccatacggacatcgaccctcccccgcaacagcggggcaggagccagcagcggcggcagtggagagaatggtcgggtggtcagccatgacttccccaagtccatgcaatcgattccttgcatgagccacagttcagggatgcccttgggagccacgggattgtaactggagcagatggagaccccttggggagcaggctcgggctccccag

SEQ ID NO: 12271 - DNA, 5233 bp, Homo sapiens
gtgcaattgatattttgtcgggcatacatgtgctgcagtacccatctctttcagcctctccagctagctggcggcttggagtggccatggagtaacttgctttgtttcctgacacctgttaagctacatcctgaagtgtggggattatttccaaaccagcagtcacaggaacatgctgcttttagatttgctttgtcgcaactcacagagcccccgaagctgctcccccagattgatattgtgaacatcagcgacagctttgagatgacctatagattctgttcccagttctccaaaggagtctatgccatctttgggttttatgaacgtaggactgtcaacatgctgacctccttttgtggggccctccacgtctgcttcattacgccgagctttcccgttgatacatccaatcagtttgtccttcagctgcgccctgaactgcaggatgccctcatcagcatcattgaccattacaagtggcagaaatttgtctacatttatgatgccgaccggggcttatccgtcctgcagaaagtcctggatacagctgctgagaagaactggcaggtgacagcagtcaacattttgacaaccacagaggagggataccggatgctctttcaggacctggagaagaaaaaggagcggctggtggtggtggactgtgaatcagaacgcctcaatgctatcttgggccagattataaagctagagaagaatggcatcggctaccactacattcttgcaaatctgggcttcatggacattgacttaaacaaattcaaggagagtggcgccaatgtgacaggtttccagctggtgaactacacagacactattccggccaagatcatgcagcagtggaagaatagtgatgctcgagaccacacacgggtggactggaagagacccaagtacacctctgcgctcacctacgatggggtgaaggtgatggctgaggctttccagagcctgcggaggcagagaattgatatatctcgccgggggaatgctggggattgtctggctaacccagctgttccctggggccaagggatcgacatccagagagctctgcagcaggtgcgatttgaaggtttaacaggaaacgtgcagtttaatgagaaaggacgccggaccaactacacgctccacgtgattgaaatgaaacatgacggcatccgaaagattggttactggaatgaagatgataagtttgtccctgcagccaccgatgcccaagctgggggcgataattcaagtgttcagaacagaacatacatcgtcacaacaatcctagaagatccttatgtgatgctcaagaagaacgccaatcagtttgagggcaatgaccgttacgagggctactgtgtagagctggcggcagagattgccaagcacgtgggctactcctaccgtctggagattgtcagtgatggaaaatacggagcccgagaccctgacacgaaggcctggaatggcatggtgggagagctggtctatggaagagcagatgtggctgtggctcccttaactatcactttggtccgggaagaagttatagatttctccaaaccatttatgagtttggggatctccatcatgattaaaaaaccacagaaatccaagccgggtgtcttctccttccttgatcctttggcttatgagatttggatgtgcattgtttttgcctacattggagtgagtgttgtcctcttcctggtcagccgcttcagtccctatgaatggcacagtgaagagtttgaggaaggacgggaccagacaaccagtgaccagtccaatgagtttgggatattcaacagtttgtggttctccctgggagccttcatgcagcaaggatgtgacatttctcccaggtccctgtctggtcgcatcgttggtggcgtctggtggttcttcaccttaatcatcatctcctcatatacagccaatctggccgccttcctgaccgtggagaggatggtgtctcccattgagagtgcagaggacctagcgaagcagacagaaattgcctacgggacgctggaagcaggatctactaaggagttcttcaggaggtctaaaattgctgtgtttgagaagatgtggacatacatgaagtcagcagagccatcagtttttgtgcggaccacagaggaggggatgattcgagtgaggaaatccaaaggcaaatatgcctacctcctggagtccaccatgaatgagtacattgagcagcggaaaccctgtgacaccatgaaggtgggaggtaacttggattccaaaggctatggcattgcaacacccaaggggtctgccctgagaaatccagtaaacctggcagtgttaaaactgaacgagcaggggcttttggacaaattgaaaaacaaatggtggtacgacaagggcgagtgcggcagcgggggaggtgattccaaggacaagacaagcgctctgagcctcagcaatgtggcaggcgtgttctacatcctgatcggaggacttggactagccatgctggttgccttaatcgagttctgctacaaatcccgtagtgaatccaagcggatgaagggtttttgtttgatcccacagcaatccatcaacgaagccatacggacatcgaccctcccccgcaacagcggggcaggagccagcagcggcggcagtggagagaatggtcgggtggtcagccatgacttccccaagtccatgcaatcgattccttgcatgagccacagttcagggatgcccttgggagccacgggattgtaactggagcagatggagaccccttggggagcaggctcgggctccccagccccatcccaaacccttcagtgccaaaaacaacaacaaaatgaaacgcaaccaccaccaaccactgcgaccacaagaaggatgattcaacaggttttcctgaagaattgaaaaaccattttgctgtcccttttccttttttgatgttctttcacccttttctgtttgctaagtgaggatgaaaaaataacactgtactgcaataaggggagagtaaccctgtctaatgaaacctgtgtctctgagagtagagtcactggaacactaatgaggaaactgcactgttttattttaattcagttgttagtgtgtcttagtgtgtgcaattttttttcttactaatatccatggtttgcaggttctgttaggccctttccttctccttacttcttatccccaactccctacccacccctcttcagttttcagattggagattcaagatttgttccactttacaagcaagaggaaaaaaaagcaaccttcaaactaattctccatgggggctctccatgttaccctccactccttggcccaaacctctgatggagatagacattgttggagaagtgggctgccttccccaagtggggcactgcttaagcacttattcagtggagaacacaggtgaaaagcaactcaggatgagggtggtggagagggcaggggcagatgtgcagtcagagaaggactcctgaagttactgctgctcagaaaaacagttcctttaatgtggaagagccatttcataggtcataggtggtatggtatatttcttcagagtcaaccttggccctgagaagtatgtcctcctggtgtgctcaggctcaacggcagtctggtggctgaaggcacttggcctcctaaaccaagcagaattttgggaagagataacagccagggagatattgcccatgattctcactttttctttgcctggcatctaagcaggaacccattgtggagtagactctcttcttctatggagcctctgacatggggagcaatgctaagcaagctaagtgtaaaagaaaagtgacagaataattttggaagaggaagcctcatcaaaagctcacacaaaatagagcttcccatggtgtgccctatcctaggtttaagaaaacacgtatgaagtttatgctgatgcaaagaacttgggtttttatgttaatataaagtgttgttttagcatgtggccagatgatgctctgtcatctttagaaagtgagataaccaaggaaataattgaaggagtatagggagatggattaagttgataatgacatttagggcaacttaagacctttgatcccaggttctaactcaaagaggctgaccttcccccagctaagatagcatgaggacgttgtattccaatatacgtatgattggggctacaaagctgaactaaagcaagattggtgaagtggcagggtttatagagagaagcccaggctgagttcagcttttgttggaagtgagaatccctgacatatagctttcttggagatcccaactctcattcttggtgcaactggcttccagctctccagcagtcactctcctaggtgcatgattcagtgcgtgccatgtgtcattagcttttactgataaccatattctggcttgttcccttaccccctacttctatccaattttctctgctaggggttatcattagcaattgacatgctaaaggttttggagcccacctaggggtaggtgcagctttattggcttttctgtggattctctcagtggacccacaccatctctatgtctctccactctcctgccttcagccatagcaaagaatccttccaaaatcaaactcttcacttttttgactcaagtgttgttgttcagtctctcgcgtgtcaatgtggtcatggttcatgaaaccggaccctcaagatggatgattgcttttaactactgccagctgatgtctctcagcccctgccctcatacaagatttttctcagccttcagcctaccactgcagaatccgatgtgacccaccattagggagtctgcatcttggaagagttggaaataaccctttaacatcaacatgcttcaaagactttttgcctttggcctagtaagatgcctctccagctactgagcccacaagtaacatgagcggataaaaagagacttgtttgtgctagaaatgagggtctatgctatgagggggtccaagactctggcgaaatgtgctttttcatcaatggagaaatgaaaggaaaacacaagcaagaaaaaagttaacttgtattatgtatttttactacacttttcttaaaaatagagcattgggaaaactctgaaagagactgacatttttctcaacaggaatccatacttaacagttctggctttcattaaattttgctctttggta

SEQ ID NO: 12272 - DNA, 2643 bp, Homo sapiens
agttaatctggctgtcagttggtgttaacgctgcagtttaagtgttcggattccaagggaaacagacaaacctcacgaaaggaaggaagcaagcaagcaaggaaggaactgcaggaggaaaagaacaggcagaacagcgagaagaataaagggaaagggggggaaacaccaaatctatgattggacctgggcttctttttcgccaatgcaaaaaggaatatgcagcacatttttgccttcttctgcaccggtttcctaggcgcggtagtaggtgccaatttccccaacaatatccagatcgtctgttcccagttctccaaaggagtctatgccatctttgggttttatgaacgtaggactgtcaacatgctgacctccttttgtggggccctccacgtctgcttcattacgccgagctttcccgttgatacatccaatcagtttgtccttcagctgcgccctgaactgcaggatgccctcatcagcatcattgaccattacaagtggcagaaatttgtctacatttatgatgccgaccggggcttatccgtcctgcagaaagtcctggatacagctgctgagaagaactggcaggtgacagcagtcaacattttgacaaccacagaggagggataccggatgctctttcaggacctggagaagaaaaaggagcggctggtggtggtggactgtgaatcagaacgcctcaatgctatcttgggccagattataaagctagagaagaatggcatcggctaccactacattcttgcaaatctgggcttcatggacattgacttaaacaaattcaaggagagtggcgccaatgtgacaggtttccagctggtgaactacacagacactattccggccaagatcatgcagcagtggaagaatagtgatgctcgagaccacacacgggtggactggaagagacccaagtacacctctgcgctcacctacgatggggtgaaggtgatggctgaggctttccagagcctgcggaggcagagaattgatatatctcgccgggggaatgctggggattgtctggctaacccagctgttccctggggccaagggatcgacatccagagagctctgcagcaggtgcgatttgaaggtttaacaggaaacgtgcagtttaatgagaaaggacgccggaccaactacacgctccacgtgattgaaatgaaacatgacggcatccgaaagattggttactggaatgaagatgataagtttgtccctgcagccaccgatgcccaagctgggggcgataattcaagtgttcagaacagaacatacatcgtcacaacaatcctagaagatccttatgtgatgctcaagaagaacgccaatcagtttgagggcaatgaccgttacgagggctactgtgtagagctggcggcagagattgccaagcacgtgggctactcctaccgtctggagattgtcagtgatggaaaatacggagcccgagaccctgacacgaaggcctggaatggcatggtgggagagctggtctatggaagagcagatgtggctgtggctcccttaactatcactttggtccgggaagaagttatagatttctccaaaccatttatgagtttggggatctccatcatgattaaaaaaccacagaaatccaagccgggtgtcttctccttccttgatcctttggcttatgagatttggatgtgcattgtttttgcctacattggagtgagtgttgtcctcttcctggtcagccgcttcagtccctatgaatggcacagtgaagagtttgaggaaggacgggaccagacaaccagtgaccagtccaatgagtttgggatattcaacagtttgtggttctccctgggagccttcatgcagcaaggatgtgacatttctcccaggtccctgtctggtcgcatcgttggtggcgtctggtggttcttcaccttaatcatcatctcctcatatacagccaatctggccgccttcctgaccgtggagaggatggtgtctcccattgagagtgcagaggacctagcgaagcagacagaaattgcctacgggacgctggaagcaggatctactaaggagttcttcaggaggtctaaaattgctgtgtttgagaagatgtggacatacatgaagtcagcagagccatcagtttttgtgcggaccacagaggaggggatgattcgagtgaggaaatccaaaggcaaatatgcctacctcctggagtccaccatgaatgagtacattgagcagcggaaaccctgtgacaccatgaaggtgggaggtaacttggattccaaaggctatggcattgcaacacccaaggggtctgccctgaggacaagacaagcgctctgagcctcagcaatgtggcaggcgtgttctacatcctgatcggaggacttggactagccatgctggttgccttaatcgagttctgctacaaatcccgtagtgaatccaagcggatgaagggtttttgtttgatcccacagcaatccatcaacgaagccatacggacatcgaccctcccccgcaacagcggggcaggagccagcagcggcggcagtggagagaatggtcgggtggtcagccatgacttccccaagtccatgcaatcgattccttgca

SEQ ID NO: 12273 - DNA, 3262 bp, Homo sapiens
gagtgggggagccagcgctccagctagcatgaggacgggcttcttttcccgtgctcagttaatctggctgtcagttggtgttaacgctgcagtttaagtgttcggattccaagggaaacagacaaacctcacgaaaggaaggaagcaagcaagcaaggaaggaactgcaggaggaaaaggaatatgcagcacatttttgccttcttctgcaccggtttcctaggcgcggtagtaggtgccaatttccccaacaatatccagatcgggggattatttccaaaccagcagtcacaggaacatgctgcttttagatttgctttgtcgcaactcacagagcccccgaagctgctcccccagattgatattgtgaacatcagcgacagctttgagatgacctatagattctgttcccagttctccaaaggagtctatgccatctttgggttttatgaacgtaggactgtcaacatgctgacctccttttgtggggccctccacgtctgcttcattacgccgagctttcccgttgatacatccaatcagtttgtccttcagctgcgccctgaactgcaggatgccctcatcagcatcattgaccattacaagtggcagaaatttgtctacatttatgatgccgaccggggcttatccgtcctgcagaaagtcctggatacagctgctgagaagaactggcaggtgacagcagtcaacattttgacaaccacagaggagggataccggatgctctttcaggacctggagaagaaaaaggagcggctggtggtggtggactgtgaatcagaacgcctcaatgctatcttgggccagattataaagctagagaagaatggcatcggctaccactacattcttgcaaatctgggcttcatggacattgacttaaacaaattcaaggagagtggcgccaatgtgacaggtttccagctggtgaactacacagacactattccggccaagatcatgcagcagtggaagaatagtgatgctcgagaccacacacgggtggactggaagagacccaagtacacctctgcgctcacctacgatggggtgaaggtgatggctgaggctttccagagcctgcggaggcagagaattgatatatctcgccgggggaatgctggggattgtctggctaacccagctgttccctggggccaagggatcgacatccagagagctctgcagcaggtgcgatttgaaggtttaacaggaaacgtgcagtttaatgagaaaggacgccggaccaactacacgctccacgtgattgaaatgaaacatgacggcatccgaaagattggttactggaatgaagatgataagtttgtccctgcagccaccgatgcccaagctgggggcgataattcaagtgttcagaacagaacatacatcgtcacaacaatcctagaagatccttatgtgatgctcaagaagaacgccaatcagtttgagggcaatgaccgttacgagggctactgtgtagagctggcggcagagattgccaagcacgtgggctactcctaccgtctggagattgtcagtgatggaaaatacggagcccgagaccctgacacgaaggcctggaatggcatggtgggagagctggtctatggaagagcagatgtggctgtggctcccttaactatcactttggtccgggaagaagttatagatttctccaaaccatttatgagtttggggatctccatcatgattaaaaaaccacagaaatccaagccgggtgtcttctccttccttgatcctttggcttatgagatttggatgtgcattgtttttgcctacattggagtgagtgttgtcctcttcctggtcagccgcttcagtccctatgaatggcacagtgaagagtttgaggaaggacgggaccagacaaccagtgaccagtccaatgagtttgggatattcaacagtttgtggttctccctgggagccttcatgcagcaaggatgtgacatttctcccaggtccctgtctggtcgcatcgttggtggcgtctggtggttcttcaccttaatcatcatctcctcatatacagccaatctggccgccttcctgaccgtggagaggatggtgtctcccattgagagtgcagaggacctagcgaagcagacagaaattgcctacgggacgctggaagcaggatctactaaggagttcttcaggaggtctaaaattgctgtgtttgagaagatgtggacatacatgaagtcagcagagccatcagtttttgtgcggaccacagaggaggggatgattcgagtgaggaaatccaaaggcaaatatgcctacctcctggagtccaccatgaatgagtacattgagcagcggaaaccctgtgacaccatgaaggtgggaggtaacttggattccaaaggctatggcattgcaacacccaaggggtctgccctgagaggtcccgtaaacctagcggttttgaaactcagtgagcaaggcgtcttagacaagctgaaaagcaaatggtggtacgataaaggggaatgtggaagcaaggactccggaagtaaggacaagacaagcgctctgagcctcagcaatgtggcaggcgtgttctacatcctgatcggaggacttggactagccatgctggttgccttaatcgagttctgctacaaatcccgtagtgaatccaagcggatgaagggtttttgtttgatcccacagcaatccatcaacgaagccatacggacatcgaccctcccccgcaacagcggggcaggagccagcagcggcggcagtggagagaatggtcgggtggtcagccatgacttccccaagtccatgcaatcgattccttgcatgagccacagttcagggatgcccttgggagccacgggattgtaactggagcagatggagaccccttggggagcaggctcgggctccccagccccatcccaaacccttcagtgccaaaaacaacaacaaaatgaaacgcaaccaccaccaaccactgcgaccacaagaaggatgattcaacaggttttcctgaagaattgaaaaaccattttgctgtcccttttccttttttgatgttctttcacccttttctgtttgctaagtgaggatgaaaaaataacactgtactgcaataaggggagagtaaccctgtctaatgaaacctgtgtctctgagagtagagtcactggaacactaatgaggaaactgcactgttttattttaattcagttgttagtgtgtc

SEQ ID NO: 12274 - DNA, 3069 bp, Homo sapiens
attgcttggtagatggtgcttgattccatttttaatggggattatttccaaaccagcagtcacaggaacatgctgcttttagatttgctttgtcgcaactcacagagcccccgaagctgctcccccagattgatattgtgaacatcagcgacagctttgagatgacctatagattctgttcccagttctccaaaggagtctatgccatctttgggttttatgaacgtaggactgtcaacatgctgacctccttttgtggggccctccacgtctgcttcattacgccgagctttcccgttgatacatccaatcagtttgtccttcagctgcgccctgaactgcaggatgccctcatcagcatcattgaccattacaagtggcagaaatttgtctacatttatgatgccgaccggggcttatccgtcctgcagaaagtcctggatacagctgctgagaagaactggcaggtgacagcagtcaacattttgacaaccacagaggagggataccggatgctctttcaggacctggagaagaaaaaggagcggctggtggtggtggactgtgaatcagaacgcctcaatgctatcttgggccagattataaagctagagaagaatggcatcggctaccactacattcttgcaaatctgggcttcatggacattgacttaaacaaattcaaggagagtggcgccaatgtgacaggtttccagctggtgaactacacagacactattccggccaagatcatgcagcagtggaagaatagtgatgctcgagaccacacacgggtggactggaagagacccaagtacacctctgcgctcacctacgatggggtgaaggtgatggctgaggctttccagagcctgcggaggcagagaattgatatatctcgccgggggaatgctggggattgtctggctaacccagctgttccctggggccaagggatcgacatccagagagctctgcagcaggtgcgatttgaaggtttaacaggaaacgtgcagtttaatgagaaaggacgccggaccaactacacgctccacgtgattgaaatgaaacatgacggcatccgaaagattggttactggaatgaagatgataagtttgtccctgcagccaccgatgcccaagctgggggcgataattcaagtgttcagaacagaacatacatcgtcacaacaatcctagaagatccttatgtgatgctcaagaagaacgccaatcagtttgagggcaatgaccgttacgagggctactgtgtagagctggcggcagagattgccaagcacgtgggctactcctaccgtctggagattgtcagtgatggaaaatacggagcccgagaccctgacacgaaggcctggaatggcatggtgggagagctggtctatggaagagcagatgtggctgtggctcccttaactatcactttggtccgggaagaagttatagatttctccaaaccatttatgagtttggggatctccatcatgattaaaaaaccacagaaatccaagccgggtgtcttctccttccttgatcctttggcttatgagatttggatgtgcattgtttttgcctacattggagtgagtgttgtcctcttcctggtcagccgcttcagtccctatgaatggcacagtgaagagtttgaggaaggacgggaccagacaaccagtgaccagtccaatgagtttgggatattcaacagtttgtggttctccctgggagccttcatgcagcaaggatgtgacatttctcccaggtccctgtctggtcgcatcgttggtggcgtctggtggttcttcaccttaatcatcatctcctcatatacagccaatctggccgccttcctgaccgtggagaggatggtgtctcccattgagagtgcagaggacctagcgaagcagacagaaattgcctacgggacgctggaagcaggatctactaaggagttcttcaggaggtctaaaattgctgtgtttgagaagatgtggacatacatgaagtcagcagagccatcagtttttgtgcggaccacagaggaggggatgattcgagtgaggaaatccaaaggcaaatatgcctacctcctggagtccaccatgaatgagtacattgagcagcggaaaccctgtgacaccatgaaggtgggaggtaacttggattccaaaggctatggcattgcaacacccaaggggtctgccctgagaaatccagtaaacctggcagtgttaaaactgaacgagcaggggcttttggacaaattgaaaaacaaatggtggtacgacaagggcgagtgcggcagcgggggaggtgattccaaggacaagacaagcgctctgagcctcagcaatgtggcaggcgtgttctacatcctgatcggaggacttggactagccatgctggttgccttaatcgagttctgctacaaatcccgtagtgaatccaagcggatgaagggtttttgtttgatcccacagcaatccatcaacgaagccatacggacatcgaccctcccccgcaacagcggggcaggagccagcagcggcggcagtggagagaatggtcgggtggtcagccatgacttccccaagtccatgcaatcgattccttgcatgagccacagttcagggatgcccttgggagccacgggattgtaactggagcagatggagaccccttggggagcaggctcgggctccccagccccatcccaaacccttcagtgccaaaaacaacaacaaaatgaaacgcaaccaccaccaaccactgcgaccacaagaaggatgattcaacaggttttcctgaagaattgaaaaaccattttgctgtcccttttccttttttgatgttctttcacccttttctgtttgctaagtgaggatgaaaaaataacactgtactgcaataaggggagagtaaccctgtctaatgaaacctgtgtctctgagagtagagtcactggaacactaatgaggaaactgcactgttttattttaattcagttgttagtgtgtcttagtgtgtgcaattttttttcttactaatatccat

SEQ ID NO: 12275 - DNA, 3445 bp, Homo sapiens
ccgagacactgggaccacagcggcagctccgctgaaaactgcattcagccagtcctccggacttctggagcggggacagggcgcagggcatcagcagccaccagcaggacctgggaaatagggattcttctgcctccacttcaggttttagcagcttggtgctaaattgctgtctcaaaatgcagaggatctaatttgcagaggaaaacagccaaagaaggaagaggaggaaaaggaaaaaaaaaggggtatattgtggatgctctacttttcttggaaatgcaaaagattatgcatatttctgtcctcctttctcctgttttatggggactgatttttggtgtctcttctaacagcatacagataggggggctatttcctaggggcgccgatcaagaatacagtgcatttcgagtagggatggttcagttttccacttcggagttcagactgacaccccacatcgacaatttggaggtggcaaacagcttcgcagtcactaatgctttctgctcccagttttcgagaggagtctatgctatttttggattttatgacaagaagtctgtaaataccatcacatcattttgcggaacactccacgtctccttcatcactcccagcttcccaacagatggcacacatccatttgtcattcagatgagacccgacctcaaaggagctctccttagcttgattgaatactatcaatgggacaagtttgcatacctctatgacagtgacagaggcttatcaacactgcaagctgtgctggattctgctgctgaaaagaaatggcaagtgactgctatcaatgtgggaaacattaacaatgacaagaaagatgagatgtaccgatcactttttcaagatctggagttaaaaaaggaacggcgtgtaattctggactgtgaaagggataaagtaaacgacattgtagaccaggttattaccattggaaaacatgttaaagggtaccactacatcattgcaaatctgggatttactgatggagacctattaaaaatccagtttggaggtgcaaatgtctctggatttcagatagtggactatgatgattcgttggtatctaaatttatagaaagatggtcaacactggaagaaaaagaataccctggagctcacacaacaacaattaagtatacttctgctctgacctatgatgccgttcaagtgatgactgaagccttccgcaacctaaggaagcaaagaattgaaatctcccgaagggggaatgcaggagactgtctggcaaacccagcagtgccctggggacaaggtgtagaaatagaaagggccctcaaacaggttcaggttgaaggtctctcaggaaatataaagtttgaccagaatggaaaaagaataaactatacaattaacatcatggagctcaaaactaatgggccccggaagattggctactggagtgaagtggacaaaatggttgttacccttactgagctcccttctggaaatgacacctctgggcttgagaataagactgttgttgtcaccacaattttggaatctccgtatgttatgatgaagaaaaatcatgaaatgcttgaaggcaatgagcgctatgagggctactgtgttgacctggctgcagaaatcgccaaacattgtgggttcaagtacaagttgacaattgttggtgatggcaagtatggggccagggatgcagacacgaaaatttggaatgggatggttggagaacttgtatatgggaaagctgatattgcaattgctccattaactattacccttgtgagagaagaggtgattgacttctcaaagcccttcatgagcctcgggatatctatcatgatcaagaagcctcagaagtccaaaccaggagtgttttcctttcttgatcctttagcctatgagatctggatgtgcattgtttttgcctacattggggtcagtgtagttttattcctggtcagcagatttagcccctacgagtggcacactgaggagtttgaagatggaagagaaacacaaagtagtgaatcaactaatgaatttgggatttttaatagtctctggttttccttgggtgcctttatgcagcaaggatgcgatatttcgccaagatccctctctgggcgcattgttggaggtgtgtggtggttctttaccctgatcataatctcctcctacacggctaacttagctgccttcctgactgtagagaggatggtgtctcccatcgaaagtgctgaggatctttctaagcaaacagaaattgcttatggaacattagactctggctccactaaagagtttttcaggagatctaaaattgcagtgtttgataaaatgtggacctacatgcggagtgcggagccctctgtgtttgtgaggactacggccgaaggggtggctagagtgcggaagtccaaagggaaatatgcctacttgttggagtccacgatgaacgagtacattgagcaaaggaagccttgcgacaccatgaaagttggtggaaacctggattccaaaggctatggcatcgcaacacctaaaggatcctcattaagaaatgcggttaacctcgcagtactaaaactgaatgaacaaggcctgttggacaaattgaaaaacaaatggtggtacgacaaaggagagtgcggcagcgggggaggtgattccaaggaaaagaccagtgccctcagtctgagcaacgttgctggagtattctacatccttgtcgggggccttggtttggcaatgctggtggctttgattgagttctgttacaagtcaagggccgaggcgaaacgaatgaaggtggcaaagaatgcacagaatattaacccatcttcctcgcagaattcacagaattttgcaacttataaggaaggttacaacgtatatggcatcgaaagtgttaaaatttaggggatgaccttgaatgatgccatgaggaacaaggcaaggctgtcaattacaggaagtactggagaaaatggacgtgttatgactccagaatttcccaaagcagtgcatgctgtcccttacgtgagtcctggcatgggaatgaatgtcagtgtgactgatctctcgtgattgataagaaccttttgagtgccttacacaatggttttcttgtgtgtttattgtcaaagtggtgagaggcatccagtatcttgaagacttttctttcagccaagaattcttaaatatgtggagttcatcttgaattgtaaggaatgattaattaaaacacaacatctttttctactcgagttacagacaaagcgtggtggacatgcacagctaacatggaagtactataatttacctgaagtctttgtacagacaacaaacctgtttctgcagccactattgttagtctcttgattcataatgacttaagcacacttgacatcaactgcatcaagatgtgacatgt

SEQ ID NO: 12276 - DNA, 5621 bp, Homo sapiens
gagagagggtgagtgtgtgtgagtgcatgggagggtgctgaatattccgagacactgggaccacagcggcagctccgctgaaaactgcattcagccagtcctccggacttctggagcggggacagggcgcagggcatcagcagccaccagcaggacctgggaaatagggattcttctgcctccacttcaggttttagcagcttggtgctaaattgctgtctcaaaatgcagaggatctaatttgcagaggaaaacagccaaagaaggaagaggaggaaaaggaaaaaaaaaggggtatattgtggatgctctacttttcttggaaatgcaaaagattatgcatatttctgtcctcctttctcctgttttatggggactgatttttggtgtctcttctaacagcatacagataggggggctatttcctaggggcgccgatcaagaatacagtgcatttcgagtagggatggttcagttttccacttcggagttcagactgacaccccacatcgacaatttggaggtggcaaacagcttcgcagtcactaatgctttctgctcccagttttcgagaggagtctatgctatttttggattttatgacaagaagtctgtaaataccatcacatcattttgcggaacactccacgtctccttcatcactcccagcttcccaacagatggcacacatccatttgtcattcagatgagacccgacctcaaaggagctctccttagcttgattgaatactatcaatgggacaagtttgcatacctctatgacagtgacagaggcttatcaacactgcaagctgtgctggattctgctgctgaaaagaaatggcaagtgactgctatcaatgtgggaaacattaacaatgacaagaaagatgagatgtaccgatcactttttcaagatctggagttaaaaaaggaacggcgtgtaattctggactgtgaaagggataaagtaaacgacattgtagaccaggttattaccattggaaaacatgttaaagggtaccactacatcattgcaaatctgggatttactgatggagacctattaaaaatccagtttggaggtgcaaatgtctctggatttcagatagtggactatgatgattcgttggtatctaaatttatagaaagatggtcaacactggaagaaaaagaataccctggagctcacacaacaacaattaagtatacttctgctctgacctatgatgccgttcaagtgatgactgaagccttccgcaacctaaggaagcaaagaattgaaatctcccgaagggggaatgcaggagactgtctggcaaacccagcagtgccctggggacaaggtgtagaaatagaaagggccctcaaacaggttcaggttgaaggtctctcaggaaatataaagtttgaccagaatggaaaaagaataaactatacaattaacatcatggagctcaaaactaatgggccccggaagattggctactggagtgaagtggacaaaatggttgttacccttactgagctcccttctggaaatgacacctctgggcttgagaataagactgttgttgtcaccacaattttggaatctccgtatgttatgatgaagaaaaatcatgaaatgcttgaaggcaatgagcgctatgagggctactgtgttgacctggctgcagaaatcgccaaacattgtgggttcaagtacaagttgacaattgttggtgatggcaagtatggggccagggatgcagacacgaaaatttggaatgggatggttggagaacttgtatatgggaaagctgatattgcaattgctccattaactattacccttgtgagagaagaggtgattgacttctcaaagcccttcatgagcctcgggatatctatcatgatcaagaagcctcagaagtccaaaccaggagtgttttcctttcttgatcctttagcctatgagatctggatgtgcattgtttttgcctacattggggtcagtgtagttttattcctggtcagcagatttagcccctacgagtggcacactgaggagtttgaagatggaagagaaacacaaagtagtgaatcaactaatgaatttgggatttttaatagtctctggttttccttgggtgcctttatgcagcaaggatgcgatatttcgccaagatccctctctgggcgcattgttggaggtgtgtggtggttctttaccctgatcataatctcctcctacacggctaacttagctgccttcctgactgtagagaggatggtgtctcccatcgaaagtgctgaggatctttctaagcaaacagaaattgcttatggaacattagactctggctccactaaagagtttttcaggagatctaaaattgcagtgtttgataaaatgtggacctacatgcggagtgcggagccctctgtgtttgtgaggactacggccgaaggggtggctagagtgcggaagtccaaagggaaatatgcctacttgttggagtccacgatgaacgagtacattgagcaaaggaagccttgcgacaccatgaaagttggtggaaacctggattccaaaggctatggcatcgcaacacctaaaggatcctcattaagaaccccagtaaatcttgcagtattgaaactcagtgagcaaggcgtcttagacaagctgaaaaacaaatggtggtacgataaaggtgaatgtggagccaaggactctggaagtaaggaaaagaccagtgccctcagtctgagcaacgttgctggagtattctacatccttgtcgggggccttggtttggcaatgctggtggctttgattgagttctgttacaagtcaagggccgaggcgaaacgaatgaaggtggcaaagaatgcacagaatattaacccatcttcctcgcagaattcacagaattttgcaacttataaggaaggttacaacgtatatggcatcgaaagtgttaaaatttaggggatgaccttgaatgatgccatgaggaacaaggcaaggctgtcaattacaggaagtactggagaaaatggacgtgttatgactccagaatttcccaaagcagtgcatgctgtcccttacgtgagtcctggcatgggaatgaatgtcagtgtgactgatctctcgtgattgataagaaccttttgagtgccttacacaatggttttcttgtgtgtttattgtcaaagtggtgagaggcatccagtatcttgaagacttttctttcagccaagaattcttaaatatgtggagttcatcttgaattgtaaggaatgattaattaaaacacaacatctttttctactcgagttacagacaaagcgtggtggacatgcacagctaacatggaagtactataatttacctgaagtctttgtacagacaacaaacctgtttctgcagccactattgttagtctcttgattcataatgacttaagcacacttgacatcaactgcatcaagatgtgacatgttttataaaaaaaggaaaaaaaacatttaaaactaaaaaatatttttaggtattttcacaaacaaactggcttttaaataaatttgcttccatattggttgaataagacaaaaacaattaaactgagtgggaagtgaataaaaaaaggctttaggtatcgattccatatttttcaaagccaaatatgtaaatgctaaggaaagtaaacaaagaggagattccaatcttgtaatttaatattgttattaaaactttaatgtatcctattctttaacatttggtgttaatataaaattacttggcaatgcttgacatttgaaataaacatttttctattgttttattgcaagtggtccaattaattttgcttagctacagtttggtcataaatcaagtgagtttaaagacactaccaagttgttaggtgcccagagaaaatttctcccttttaaaaaggccaggtgatttttcaaatgtaatcttgcccccaaagtaatatctgaatatctttttgacatgtctaaatatatatatatataaagaaatatttgttaacacaaaagcatttgatctatgtagataaatgctaatagatttaaaaagctaatattaacaaataccagaatacgtgaagttccatttttaaagtgtttgagcttacagaagagaaacattcattttaaatgaagtaaaaaatgccttgaaagtaattctttagatagttgcccattgattaaattccaaaaactaaatatgtttttagctttaaaattataaaagctgtcataaactttatatattatgaattttaaaatatgtttgagtctcctgcaatatagtttcatcccattgacatcaattaaaaataaccctaatatattatttttatatttattcctcaggtggaatggctattttaatatgcccagtgtggataaaatgtcacatttctgtaacttttgactaaagagcctatatttatctagttaatgaatttaaaggatctatctttcccttcataaaatacctcttatttccattaaagccccccaagtttaattaatttaggattttgaatgattattgacatccaatagttatttttaatatttgtattcttgttatttctggaagaaagcctttgtgtagcacttggtattttgcaaagtgcttttaaaacattcttacttaccgtatttcatagaagggaaggaaaaatgtaaggtttaacagtaagcacttgcattgaacatggaggcatgtggtatcatgatattcttcactaaatttagctgtccctaatcacagatcctaaggtaatataatataattttagtgcatttctcctcatcaggaatgctggaggtgcattttaagttttaataataagtgctagaatgaccaaattgcagactaattgtttccatattgtacttaaaatgagtttttaaaagtgaaaaagaaatgactatatacaatcaatgctatttattgtacctctgggcctactcttctaaaaattgtagcttatcgatttttctctgtcaagcttgaactaatgtaaataattgaaataatgtaaagttatattttcatgtttttatagatacaacatgacaagaatacataatgtaagagtatttcaactatggataatgttgattggataatgcacatctcagttacaagcagtactcatagtttaatatccatgtaacggtgcatcaatatattgctatataaatatgtctgtgtgcatataagtgaaaagtggtcaaacaagagtgatgacagctgtctaaaggtttttttattcattttatataaaaactgttatggaaagaccaaaatgtttatgaactattcttatgtaaatttacaattgtcctttactgtacttttttgtttacagtatagtaccttattttctgctgtgttaagtgggtgtcaaactccaagaagacatacactttctataacttctattgaagatattggaatttccaatttttcatgtgtactatgtcagaaaatgctttcgattttatttttaaatctaacatcggatggcttttccggagtgttgtaaaaacttcaatcatacataaaacatgttcttacaaaaggcaaa

SEQ ID NO: 12277 - DNA, 2798 bp, Homo sapiens
attccagatttaaactacctagaatatacatgtttttcttaggatgaagcaaaaggaaaagactatgcctttgatacaatagaagaaaaggtcctctcatttcggatccccaaattttattaattctgccttagcgacattttccagtttgctcagattttcttggggtctgaatgcaaagcttgtgattacatggaaaggtgaaggtttctggccgcctacctcgccttcagactctcatctgggtcttgaccccttggctagcttttggatattccacccccgctgtccgagtccgtaggggggctatttcctaggggcgccgatcaagaatacagtgcatttcgagtagggatggttcagttttccacttcggagttcagactgacaccccacatcgacaatttggaggtggcaaacagcttcgcagtcactaatgctttctgctcccagttttcgagaggagtctatgctatttttggattttatgacaagaagtctgtaaataccatcacatcattttgcggaacactccacgtctccttcatcactcccagcttcccaacagatggcacacatccatttgtcattcagatgagacccgacctcaaaggagctctccttagcttgattgaatactatcaatgggacaagtttgcatacctctatgacagtgacagaggcttatcaacactgcaagctgtgctggattctgctgctgaaaagaaatggcaagtgactgctatcaatgtgggaaacattaacaatgacaagaaagatgagatgtaccgatcactttttcaagatctggagttaaaaaaggaacggcgtgtaattctggactgtgaaagggataaagtaaacgacattgtagaccaggttattaccattggaaaacatgttaaagggtaccactacatcattgcaaatctgggatttactgatggagacctattaaaaatccagtttggaggtgcaaatgtctctggatttcagatagtggactatgatgattcgttggtatctaaatttatagaaagatggtcaacactggaagaaaaagaataccctggagctcacacaacaacaattaagtatacttctgctctgacctatgatgccgttcaagtgatgactgaagccttccgcaacctaaggaagcaaagaattgaaatctcccgaagggggaatgcaggagactgtctggcaaacccagcagtgccctggggacaaggtgtagaaatagaaagggccctcaaacaggttcaggttgaaggtctctcaggaaatataaagtttgaccagaatggaaaaagaataaactatacaattaacatcatggagctcaaaactaatgggccccggaagattggctactggagtgaagtggacaaaatggttgttacccttactgagctcccttctggaaatgacacctctgggcttgagaataagactgttgttgtcaccacaattttggaatctccgtatgttatgatgaagaaaaatcatgaaatgcttgaaggcaatgagcgctatgagggctactgtgttgacctggctgcagaaatcgccaaacattgtgggttcaagtacaagttgacaattgttggtgatggcaagtatggggccagggatgcagacacgaaaatttggaatgggatggttggagaacttgtatatgggaaagctgatattgcaattgctccattaactattacccttgtgagagaagaggtgattgacttctcaaagcccttcatgagcctcgggatatctatcatgatcaagaagcctcagaagtccaaaccaggagtgttttcctttcttgatcctttagcctatgagatctggatgtgcattgtttttgcctacattggggtcagtgtagttttattcctggtcagcagatttagcccctacgagtggcacactgaggagtttgaagatggaagagaaacacaaagtagtgaatcaactaatgaatttgggatttttaatagtctctggttttccttgggtgcctttatgcagcaaggatgcgatatttcgccaagatccctctctgggcgcattgttggaggtgtgtggtggttctttaccctgatcataatctcctcctacacggctaacttagctgccttcctgactgtagagaggatggtgtctcccatcgaaagtgctgaggatctttctaagcaaacagaaattgcttatggaacattagactctggctccactaaagagtttttcaggagatctaaaattgcagtgtttgataaaatgtggacctacatgcggagtgcggagccctctgtgtttgtgaggactacggccgaaggggtggctagagtgcggaagtccaaagggaaatatgcctacttgttggagtccacgatgaacgagtacattgagcaaaggaagccttgcgacaccatgaaagttggtggaaacctggattccaaaggctatggcatcgcaacacctaaaggatcctcattaagtggagtcacattcaagacactgttatttgtttgttgtggataaatgcggttaacctcgcagtactaaaactgaatgaacaaggcctgttggacaaattgaaaaacaaatggtggtacgacaaaggagagtgcggcagcgggggaggtgattccaagaaccccagtaaatcttgcagtattgaaactcagtgagcaaggcgtcttagacaagctgaaaaacaaatggtggtacgataaaggtgaatgtggagccaaggactctggaagtaaggaaaagaccagtgccctcagtct

SEQ ID NO: 12278 - DNA, 2757 bp, Homo sapiens
attccagatttaaactacctagaatatacatgtttttcttaggatgaagcaaaaggaaaagactatgcctttgatacaatagaagaaaaggtcctctcatttcggatccccaaattttattaattctgccttagcgacattttccagtttgctcagattttcttggggtctgaatgcaaagcttgtgattacatggaaaggtgaaggtttctggccgcctacctcgccttcagactctcatctgggtcttgaccccttggctagcttttggatattccacccccgctgtccgagtccgtaggggggctatttcctaggggcgccgatcaagaatacagtgcatttcgagtagggatggttcagttttccacttcggagttcagactgacaccccacatcgacaatttggaggtggcaaacagcttcgcagtcactaatgctttctgctcccagttttcgagaggagtctatgctatttttggattttatgacaagaagtctgtaaataccatcacatcattttgcggaacactccacgtctccttcatcactcccagcttcccaacagatggcacacatccatttgtcattcagatgagacccgacctcaaaggagctctccttagcttgattgaatactatcaatgggacaagtttgcatacctctatgacagtgacagaggcttatcaacactgcaagctgtgctggattctgctgctgaaaagaaatggcaagtgactgctatcaatgtgggaaacattaacaatgacaagaaagatgagatgtaccgatcactttttcaagatctggagttaaaaaaggaacggcgtgtaattctggactgtgaaagggataaagtaaacgacattgtagaccaggttattaccattggaaaacatgttaaagggtaccactacatcattgcaaatctgggatttactgatggagacctattaaaaatccagtttggaggtgcaaatgtctctggatttcagatagtggactatgatgattcgttggtatctaaatttatagaaagatggtcaacactggaagaaaaagaataccctggagctcacacaacaacaattaagtatacttctgctctgacctatgatgccgttcaagtgatgactgaagccttccgcaacctaaggaagcaaagaattgaaatctcccgaagggggaatgcaggagactgtctggcaaacccagcagtgccctggggacaaggtgtagaaatagaaagggccctcaaacaggttcaggttgaaggtctctcaggaaatataaagtttgaccagaatggaaaaagaataaactatacaattaacatcatggagctcaaaactaatgggccccggaagattggctactggagtgaagtggacaaaatggttgttacccttactgagctcccttctggaaatgacacctctgggcttgagaataagactgttgttgtcaccacaattttggaatctccgtatgttatgatgaagaaaaatcatgaaatgcttgaaggcaatgagcgctatgagggctactgtgttgacctggctgcagaaatcgccaaacattgtgggttcaagtacaagttgacaattgttggtgatggcaagtatggggccagggatgcagacacgaaaatttggaatgggatggttggagaacttgtatatgggaaagctgatattgcaattgctccattaactattacccttgtgagagaagaggtgattgacttctcaaagcccttcatgagcctcgggatatctatcatgatcaagaagcctcagaagtccaaaccaggagtgttttcctttcttgatcctttagcctatgagatctggatgtgcattgtttttgcctacattggggtcagtgtagttttattcctggtcagcagatttagcccctacgagtggcacactgaggagtttgaagatggaagagaaacacaaagtagtgaatcaactaatgaatttgggatttttaatagtctctggttttccttgggtgcctttatgcagcaaggatgcgatatttcgccaagatccctctctgggcgcattgttggaggtgtgtggtggttctttaccctgatcataatctcctcctacacggctaacttagctgccttcctgactgtagagaggatggtgtctcccatcgaaagtgctgaggatctttctaagcaaacagaaattgcttatggaacattagactctggctccactaaagagtttttcaggagatctaaaattgcagtgtttgataaaatgtggacctacatgcggagtgcggagccctctgtgtttgtgaggactacggccgaaggggtggctagagtgcggaagtccaaagggaaatatgcctacttgttggagtccacgatgaacgagtacattgagcaaaggaagccttgcgacaccatgaaagttggtggaaacctggattccaaaggctatggcatcgcaacacctaaaggatcctcattaagtggagtcacattcaagacactgatttgtttgttgtggataaatgcggttaacctcgcagtactaaaactgaatgaacaaggcctgttggacaaattgaaaaacaaatggtggtacgacaaaggagagtgcggcagcgggggaggtgattccaagaaccccagtaaatcttgcagtattgaaactcagtgagcaaggcgtcttagacaagctgaaaaacaaatggtggtacgataaaggtgaatgtggagccaa

SEQ ID NO: 12279 - DNA, 5209 bp, Homo sapiens
ggggggctatttcctaggggcgccgatcaagaatacagtgcatttcgagtagggatggttcagttttccacttcggagttcagactgacaccccacatcgacaatttggaggtggcaaacagcttcgcagtcactaatgctttctgctcccagttttcgagaggagtctatgctatttttggattttatgacaagaagtctgtaaataccatcacatcattttgcggaacactccacgtctccttcatcactcccagcttcccaacagatggcacacatccatttgtcattcagatgagacccgacctcaaaggagctctccttagcttgattgaatactatcaatgggacaagtttgcatacctctatgacagtgacagaggcttatcaacactgcaagctgtgctggattctgctgctgaaaagaaatggcaagtgactgctatcaatgtgggaaacattaacaatgacaagaaagatgagatgtaccgatcactttttcaagatctggagttaaaaaaggaacggcgtgtaattctggactgtgaaagggataaagtaaacgacattgtagaccaggttattaccattggaaaacatgttaaagggtaccactacatcattgcaaatctgggatttactgatggagacctattaaaaatccagtttggaggtgcaaatgtctctggatttcagatagtggactatgatgattcgttggtatctaaatttatagaaagatggtcaacactggaagaaaaagaataccctggagctcacacaacaacaattaagtatacttctgctctgacctatgatgccgttcaagtgatgactgaagccttccgcaacctaaggaagcaaagaattgaaatctcccgaagggggaatgcaggagactgtctggcaaacccagcagtgccctggggacaaggtgtagaaatagaaagggccctcaaacaggttcaggttgaaggtctctcaggaaatataaagtttgaccagaatggaaaaagaataaactatacaattaacatcatggagctcaaaactaatgggccccggaagattggctactggagtgaagtggacaaaatggttgttacccttactgagctcccttctggaaatgacacctctgggcttgagaataagactgttgttgtcaccacaattttggaatctccgtatgttatgatgaagaaaaatcatgaaatgcttgaaggcaatgagcgctatgagggctactgtgttgacctggctgcagaaatcgccaaacattgtgggttcaagtacaagttgacaattgttggtgatggcaagtatggggccagggatgcagacacgaaaatttggaatgggatggttggagaacttgtatatgggaaagctgatattgcaattgctccattaactattacccttgtgagagaagaggtgattgacttctcaaagcccttcatgagcctcgggatatctatcatgatcaagaagcctcagaagtccaaaccaggagtgttttcctttcttgatcctttagcctatgagatctggatgtgcattgtttttgcctacattggggtcagtgtagttttattcctggtcagcagatttagcccctacgagtggcacactgaggagtttgaagatggaagagaaacacaaagtagtgaatcaactaatgaatttgggatttttaatagtctctggttttccttgggtgcctttatgcagcaaggatgcgatatttcgccaagatccctctctgggcgcattgttggaggtgtgtggtggttctttaccctgatcataatctcctcctacacggctaacttagctgccttcctgactgtagagaggatggtgtctcccatcgaaagtgctgaggatctttctaagcaaacagaaattgcttatggaacattagactctggctccactaaagagtttttcaggagatctaaaattgcagtgtttgataaaatgtggacctacatgcggagtgcggagccctctgtgtttgtgaggactacggccgaaggggtggctagagtgcggaagtccaaagggaaatatgcctacttgttggagtccacgatgaacgagtacattgagcaaaggaagccttgcgacaccatgaaagttggtggaaacctggattccaaaggctatggcatcgcaacacctaaaggatcctcattaagaaccccagtaaatcttgcagtattgaaactcagtgagcaaggcgtcttagacaagctgaaaaacaaatggtggtacgataaaggtgaatgtggagccaaggactctggaagtaaggaaaagaccagtgccctcagtctgagcaacgttgctggagtattctacatccttgtcgggggccttggtttggcaatgctggtggctttgattgagttctgttacaagtcaagggccgaggcgaaacgaatgaaggtggcaaagaatgcacagaatattaacccatcttcctcgcagaattcacagaattttgcaacttataaggaaggttacaacgtatatggcatcgaaagtgttaaaatttaggggatgaccttgaatgatgccatgaggaacaaggcaaggctgtcaattacaggaagtactggagaaaatggacgtgttatgactccagaatttcccaaagcagtgcatgctgtcccttacgtgagtcctggcatgggaatgaatgtcagtgtgactgatctctcgtgattgataagaaccttttgagtgccttacacaatggttttcttgtgtgtttattgtcaaagtggtgagaggcatccagtatcttgaagacttttctttcagccaagaattcttaaatatgtggagttcatcttgaattgtaaggaatgattaattaaaacacaacatctttttctactcgagttacagacaaagcgtggtggacatgcacagctaacatggaagtactataatttacctgaagtctttgtacagacaacaaacctgtttctgcagccactattgttagtctcttgattcataatgacttaagcacacttgacatcaactgcatcaagatgtgacatgttttataaaaaaaggaaaaaaaacatttaaaactaaaaaatatttttaggtattttcacaaacaaactggcttttaaataaatttgcttccatattggttgaataagacaaaaacaattaaactgagtgggaagtgaataaaaaaaggctttaggtatcgattccatatttttcaaagccaaatatgtaaatgctaaggaaagtaaacaaagaggagattccaatcttgtaatttaatattgttattaaaactttaatgtatcctattctttaacatttggtgttaatataaaattacttggcaatgcttgacatttgaaataaacatttttctattgttttattgcaagtggtccaattaattttgcttagctacagtttggtcataaatcaagtgagtttaaagacactaccaagttgttaggtgcccagagaaaatttctcccttttaaaaaggccaggtgatttttcaaatgtaatcttgcccccaaagtaatatctgaatatctttttgacatgtctaaatatatatatatataaagaaatatttgttaacacaaaagcatttgatctatgtagataaatgctaatagatttaaaaagctaatattaacaaataccagaatacgtgaagttccatttttaaagtgtttgagcttacagaagagaaacattcattttaaatgaagtaaaaaatgccttgaaagtaattctttagatagttgcccattgattaaattccaaaaactaaatatgtttttagctttaaaattataaaagctgtcataaactttatatattatgaattttaaaatatgtttgagtctcctgcaatatagtttcatcccattgacatcaattaaaaataaccctaatatattatttttatatttattcctcaggtggaatggctattttaatatgcccagtgtggataaaatgtcacatttctgtaacttttgactaaagagcctatatttatctagttaatgaatttaaaggatctatctttcccttcataaaatacctcttatttccattaaagccccccaagtttaattaatttaggattttgaatgattattgacatccaatagttatttttaatatttgtattcttgttatttctggaagaaagcctttgtgtagcacttggtattttgcaaagtgcttttaaaacattcttacttaccgtatttcatagaagggaaggaaaaatgtaaggtttaacagtaagcacttgcattgaacatggaggcatgtggtatcatgatattcttcactaaatttagctgtccctaatcacagatcctaaggtaatataatataattttagtgcatttctcctcatcaggaatgctggaggtgcattttaagttttaataataagtgctagaatgaccaaattgcagactaattgtttccatattgtacttaaaatgagtttttaaaagtgaaaaagaaatgactatatacaatcaatgctatttattgtacctctgggcctactcttctaaaaattgtagcttatcgatttttctctgtcaagcttgaactaatgtaaataattgaaataatgtaaagttatattttcatgtttttatagatacaacatgacaagaatacataatgtaagagtatttcaactatggataatgttgattggataatgcacatctcagttacaagcagtactcatagtttaatatccatgtaacggtgcatcaatatattgctatataaatatgtctgtgtgcatataagtgaaaagtggtcaaacaagagtgatgacagctgtctaaaggtttttttattcattttatataaaaactgttatggaaagaccaaaatgtttatgaactattcttatgtaaatttacaattgtcctttactgtacttttttgtttacagtatagtaccttattttctgctgtgttaagtgggtgtcaaactccaagaagacatacactttctataacttctattgaagatattggaatttccaatttttcatgtgtactatgtcagaaaatgctttcgattttatttttaaatctaacatcggatggcttttccggagtgttgtaaaaacttcaatcatacataaaacatgttcttacaaaaggcaaa

SEQ ID NO: 12280 - DNA, 558 bp, Homo sapiens
agcgcgcgcccctcctttccctcccggggcactgacactgttctcttgcttgctgtttgttctttgcaggggggctatttcctaggggcgccgatcaagaatacagtgcatttcgagtagggatggttcagttttccacttcggagttcagactgacaccccacatcgacaatttggaggtggcaaacagcttcgcagtcactaatgctttctgctcccagttttcgagaggagtctatgctatttttggattttatgacaagaagtctgtaaataccatcacatcattttgcggaacactccacgtctccttcatcactcccagcttcccaacagatggcacacatccatttgtcattcagatgagacccgacctcaaaggagctctccttagcttgattgaatactatcaatgggacaagtttgcatacctctatgacagtgacagaggcttatcaacactgcaagctgtgctggattctgctgctgaaaagaaatggcaagtgactgctatcaatgtgggaaacattaacaatgacaagaaagatgagatgtacc

SEQ ID NO: 12281 - DNA, 429 bp, Homo sapiens
ttcagccagtcctccggacttctggagcggggacagggcgcagggcatcagcagccaccagcaggacctgggaaatagggattcttctgcctccacttcaggttttagcagcttggtgctaaattgctgtctcaaaatgcagaggatctaatttgcagaggaaaacagccaaagaaggaagaggaggaaaaggaaaaaaaaaggggggggctatttcctaggggcgccgatcaagaatacagtgcatttcgagtagggatggttcagttttccacttcggagttcagactgacaccccacatcgacaatttggaggtggcaaacagcttcgcagtcactaatgctttctgctcccagttttcgagaggagtctatgctatttttggattttatgacaagaagtctgtaaataccatcacatcattttgc

SEQ ID NO: 12282 - DNA, 3041 bp, Homo sapiens
aggtgaggaggatgacagggcttctgtattgctaaatgggttttcacaggagatggaagataaaaatcaaaattatttgtaacgtaagacagcagggcctggtgagaggacgcttcgccgccaacaattagcaattcggcttctacacagcagccggagatcagctttgctgcatttggtccaggttggagcatctccgcagcagctgcaacagccgcacgaaggggggctatttcctaggggcgccgatcaagaatacagtgcatttcgagtagggatggttcagttttccacttcggagttcagactgacaccccacatcgacaatttggaggtggcaaacagcttcgcagtcactaatgctttctgctcccagttttcgagaggagtctatgctatttttggattttatgacaagaagtctgtaaataccatcacatcattttgcggaacactccacgtctccttcatcactcccagcttcccaacagatggcacacatccatttgtcattcagatgagacccgacctcaaaggagctctccttagcttgattgaatactatcaatgggacaagtttgcatacctctatgacagtgacagaggcttatcaacactgcaagctgtgctggattctgctgctgaaaagaaatggcaagtgactgctatcaatgtgggaaacattaacaatgacaagaaagatgagatgtaccgatcactttttcaagatctggagttaaaaaaggaacggcgtgtaattctggactgtgaaagggataaagtaaacgacattgtagaccaggttattaccattggaaaacatgttaaagggtaccactacatcattgcaaatctgggatttactgatggagacctattaaaaatccagtttggaggtgcaaatgtctctggatttcagatagtggactatgatgattcgttggtatctaaatttatagaaagatggtcaacactggaagaaaaagaataccctggagctcacacaacaacaattaagtatacttctgctctgacctatgatgccgttcaagtgatgactgaagccttccgcaacctaaggaagcaaagaattgaaatctcccgaagggggaatgcaggagactgtctggcaaacccagcagtgccctggggacaaggtgtagaaatagaaagggccctcaaacaggttcaggttgaaggtctctcaggaaatataaagtttgaccagaatggaaaaagaataaactatacaattaacatcatggagctcaaaactaatgggccccggaagattggctactggagtgaagtggacaaaatggttgttacccttactgagctcccttctggaaatgacacctctgggcttgagaataagactgttgttgtcaccacaattttggaatctccgtatgttatgatgaagaaaaatcatgaaatgcttgaaggcaatgagcgctatgagggctactgtgttgacctggctgcagaaatcgccaaacattgtgggttcaagtacaagttgacaattgttggtgatggcaagtatggggccagggatgcagacacgaaaatttggaatgggatggttggagaacttgtatatgggaaagctgatattgcaattgctccattaactattacccttgtgagagaagaggtgattgacttctcaaagcccttcatgagcctcgggatatctatcatgatcaagaagcctcagaagtccaaaccaggagtgttttcctttcttgatcctttagcctatgagatctggatgtgcattgtttttgcctacattggggtcagtgtagttttattcctggtcagcagatttagcccctacgagtggcacactgaggagtttgaagatggaagagaaacacaaagtagtgaatcaactaatgaatttgggatttttaatagtctctggttttccttgggtgcctttatgcagcaaggatgcgatatttcgccaagatccctctctgggcgcattgttggaggtgtgtggtggttctttaccctgatcataatctcctcctacacggctaacttagctgccttcctgactgtagagaggatggtgtctcccatcgaaagtgctgaggatctttctaagcaaacagaaattgcttatggaacattagactctggctccactaaagagtttttcaggagatctaaaattgcagtgtttgataaaatgtggacctacatgcggagtgcggagccctctgtgtttgtgaggactacggccgaaggggtggctagagtgcggaagtccaaagggaaatatgcctacttgttggagtccacgatgaacgagtacattgagcaaaggaagccttgcgacaccatgaaagttggtggaaacctggattccaaaggctatggcatcgcaacacctaaaggatcctcattaagaaccccagtaaatcttgcagtattgaaactcagtgagcaaggcgtcttagacaagctgaaaaacaaatggtggtacgataaaggtgaatgtggagccaaggactctggaagtaaggaaaagaccagtgccctcagtctgagcaacgttgctggagtattctacatccttgtcgggggccttggtttggcaatgctggtggctttgattgagttctgttacaagtcaagggccgaggcgaaacgaatgaaggtggcaaagaatgcacagaatattaacccatcttcctcgcagaattcacagaattttgcaacttataaggaaggttacaacgtatatggcatcgaaagtgttaaaatttaggggatgaccttgaatgatgccatgaggaacaaggcaaggctgtcaattacaggaagtactggagaaaatggacgtgttatgactccagaatttcccaaagcagtgcatgctgtcccttacgtgagtcctggcatgggaatgaatgtcagtgtgactgatctctcgtgattgataagaaccttttgagtgccttacacaatggttttcttgtgtgtttattgtcaaagtggtgagaggcatccagtatcttgaa

SEQ ID NO: 12283 - DNA, 544 bp, Homo sapiens
agagaggagagagggagaagagagcgcgagagagggttttagcagcttggtgctaaattgctgtctcaaaatgcagaggatctaatttgcagaggaaaacagccaaagaaggaagaggaggaaaaggaaaaaaaaaggggtatattgtggatgctctacttttcttggaaatgcaaaagattatgcatatttctgtcctcctttctcctgttttatggggactgatttttggtgtctcttctaacagcatacagataggggggctatttcctaggggcgccgatcaagaatacagtgcatttcgagtagggatggttcagttttccacttcggagttcagactgacaccccacatcgacaatttggaggtggcaaacagcttcgcagtcactaatgctttctgctcccagttttcgagaggagtctatgctatttttggattttatgacaagaagtctgtaaataccatcacatcattttgcggaacactccacgtctccttcatcactcccagcttcccaacagatggcacacatccatttgt

SEQ ID NO: 12284 - DNA, 522 bp, Homo sapiens
cccgtgcgctctgtaactaggcgagtcagcatcacagcccaatggaatatactctaaagatgggattttcatgcaaaatatttaaaagattccatcttgatctcttgtgcggcttaagcatttaaagatataacttggggttctccctggatcctggctacatcccatgaagcccaagtgcacaattttggaatatttcctccacggtgctttgcttgcttgtttgctttcggctgggtcaggttttagcagcttggtgctaaattgctgtctcaaaatgcagaggatctaatttgcagaggaaaacagccaaagaaggaagaggaggaaaaggaaaaaaaaaggggtatattgtggatgctctacttttcttggaaatgcaaaagattatgcatatttctgtcctcctttctcctgttttatggggactgatttttggtgtctcttctaacagcatacagataggggggctatttcctaggggcgccgatcaagaatacagtgcatttcgagtagggatgg

SEQ ID NO: 12285 - DNA, 5834 bp, Homo sapiens
actgcaccgggaccagcgcctccccgcttcgcgctgccctcggcctcgccccgggcccgggtggatgagccgcgcgcccgggggacatggaagcgctgacgctgtggcttctcccctggatatgccagtgcgtgtcggtgcgggccgactccatcatccacatcggtgccatcttcgaggagaacgcggccaaggacgacagggtgttccagttggcggtatccgacctgagcctcaacgatgacatcctgcagagcgagaagatcacctactccatcaaggtcatcgaggccaacaacccattccaggctgtgcaggaagcctgtgacctcatgacccaggggattttggccttggtcacgtccactggctgtgcatctgccaatgccctgcagtccctcacggatgccatgcacatcccacacctctttgtccagcgcaacccgggagggtcgccacgcaccgcatgccacctgaaccccagccccgatggtgaggcctacacactggcttcgagaccacccgtccgcctcaatgatgtcatgctcaggctggtgacggagctgcgctggcagaagttcgtcatgttctacgacagcgagtatgatatccgtgggcttcaaagctttctggaccaggcctcgcggctgggccttgacgtctctttacaaaaggtggacaagaacattagccacgtattcaccagcctcttcaccacgatgaagacagaggagctgaatcgctaccgggacacgcttcgccgcgccatcctgctgctcagcccacagggagcccactccttcatcaacgaggccgtggagaccaacctggcttccaaggacagccactgggtctttgtgaatgaggaaatcagtgacccggagatcctggatctggtccatagtgcccttggaaggatgaccgtggtccggcaaatctttccgtctgcaaaggacaatcagaaatgcacgaggaacaaccaccgcatctcctccctgctctgcgacccccaggaaggctacctccagatgctgcagatctccaacctctatctgtatgacagtgttctgatgctggccaacgcctttcacaggaagctggaggaccggaagtggcatagcatggcgagcctcaactgcatacggaaatccactaagccatggaatggtgggaggtccatgctggataccatcaaaaagggccacatcactggcctcactggggtgatggagtttcgggaggacagttcgaatccctatgtccagtttgaaatccttggcactacctatagtgagacttttggcaaagacatgcgcaagttggcgacatgggactcagagaagggcttgaatggcagcttgcaagagaggcccatgggcagccgcctccaaggattgactcttaaagtggtgactgtcttggaagagcctttcgtgatggtggctgagaacatcctaggacagcccaagcgctacaaagggttctccatagatgtcctggatgcactggccaaggctctgggctttaaatatgagatttaccaagcccctgatggcaggtacggtcaccagctccataacacctcctggaacgggatgatcggggagctcatcagcaagagagcagacttggccatctctgccatcaccatcaccccagagagggagagcgttgtggacttcagcaagcggtacatggactattcagtggggattctaattaagaagcccgaggagaaaatcagcatcttctccctctttgctccatttgatttcgctgtgtgggcctgcattgcagcagccatccctgtggttggtgtgctgatatttgtgttgaacaggatacaggctgtgagggctcagagtgctgcccagcccaggccgtcagcttctgccactctgcacagcgccatctggattgtctatggagccttcgtacagcaaggtggcgaatcttccgtgaactccatggccatgcgcatcgtgatgggcagctggtggctcttcacgctcattgtgtgctcctcctacacagccaaccttgctgccttcctcacagtgtccaggatggacaaccccataaggactttccaggacctgtccaaacaagtggaaatgtcttatggcactgtccgggattctgctgtatatgagtacttccgagccaagggcaccaaccccctggagcaggacagcacgtttgctgaactctggcggaccatcagcaagaacggaggggctgacaactgcgtgtccagtccttcagaaggcatcaggaaggcaaagaaggggaactacgccttcctgtgggatgtggccgtggtggaatacgcagccctgacggatgacgactgctcggtgactgtcatcggcaacagcatcagcagcaagggttacgggattgccctgcagcatggcagcccctacagggacctcttctcccagaggatcctggagctgcaggacacaggggacctggatgtgctgaagcagaagtggtggccgcacatgggccgctgtgacctcaccagccatgccagcgcccaggccgacggcaaatccctcaagctgcacagcttcgccggggtcttctgcatcctggccattggcctgctcctggcctgcctggtggctgccctggagttgtggtggaacagcaaccggtgccaccaggagacccccaaggaggacaaagaagtgaacttggagcaggtccaccggcgcatgaacagcctcatggatgaagacattgctcacaagcagatttccccagcgtcgattgagctctcggccctggagatggggggcctggctcccacccagaccttggagccgacacgggagtaccagaacacccagctctcggtcagcacctttctgccagagcagagcagccatggcaccagccggacactctcatcagggcccagcagcaacctgccgctgccgctgagcagctcggcgaccatgccctccatgcagtgcaaacacaggtcacccaacggggggctgttccggcagagcccggtgaagacccccatccccatgtccttccagcccgtgcctggaggcgtccttccagaggctctggacacctcccacgggacctccatctgactgcgccgcctgccctcctgcccaccctcccacccacccgaccagcagagctttttaatacaagaaaacaacaacacaaaccacacacactcgcacacacacacatacacagagactctttcatttttcttgtacatatgtgtaaataatgacagaatggagtggggtaaaagtgtattttgaatattcccaattttcgaagtcagtaaaaaaacacaaaaactgtatgaatgactttgtaaattttgttctatatgaataaaaaggcaaattacttgtgatcattctgaagtgccaaaggagcccccccattcctgggcctttctgagggcaggaggggcgaccagataaggagcccctctctgctgggggagaagggaagacgaggaaccccacatgccactcgctgccttgtcccacagcttgctgccccatttctttgctcctggcacctcgtcccttttagtccctcagcttgataaagagtgagtttggagcccgcattgggctggcccactgggttgctgtgctgtagggtgatcggctgttctgggtagcctggggctgaggaggtgccctggactcagggctatcctgtcctgtcttggatcttgcgggacgagttagtcaccgctgtgtgtgttgcagtgtgcctctgccccatgggcccgagagaagctgacaattacccatagtgaggtaattgagggctttgatactgagctgttctcatatcatactgttggccttgtttttcattttcttttcaaaattagaagaatcaaaaagtgatagaatattgggggaaggagggcagactccatcgtttcctcagggagactgggcggaggtggggttggtctggaagaaggtccatgggggcagggagttgcgaggtggggttagttgcatggaccaggtgaggtggtggaacaaaaggccaggtagaggaagaatattcccttgggtttggacccatggtcccaggtgagagaaggaagtgaggccatagatgcagggagtagaagctttgtggtgtcaggcaaacggactctgttagtaagagttgggggaggtgcccaggtgggtggaccagtactccaggtgatggggcatgctgagaaatagagaaaagagaccatgtttatttgggtaggaggaagccttgccttgcgccttaggtgagaagcataagtgtaactcccatccaccagggaagttgcttgtagccccaaaagtaaaggcctatctctgggtcataaatcctgcaggcagtccaacaaacagggctggctccagcacaaactctcccttccacctttacgaccctctccagaccagacctggagtcctcttcaagcagcaatccaacccagagcaggggccctccccactcaggcatctgataacctctgagatttccaggcctatccctgtgcaggtacagctgcagggaagcccagttttctaagcctaggaccacctaacagcgccccctccttcagttgccctttctgaggcaactaaactacagaatcagggaaagaaccattaggagtggaactgggggaatctgagttgtgtcacttcagttcctctcctaaagacaaaggttagtctgatctccagacccgtcagaatggaatacacagcccacatctgtcactgaaggaggtggagctcccacagccagcagtaatcagggagctgagagcctggttctgtgatcatggagaaatacaaagtcctattgattgcttcttctatagccttgtagagtttctagagagatgtatttatgagggtgataactagcccaggattgatttctttcctaaagtccctagtgacatgattgagcagtaaagaacggccaaatcacacagtcagctaaaagcactgtggggaagagagtgtttataattatgttatttattgctggatgctgagaatggtctgatattcgtgctacctaggcaatccattgacatttctccaatcagagcatgtggaccttggagccaggcatgctcagagaagcctaggtgggctaccatgaccccgaggaagagcaggctttgttttccatcagcacgttgggggccctgccctgaatggtcaatttttcacatatatatctctctatttttttaatcaaactctggtctcactgccttatctcacaccaactctgtttcctcattgccccctgagatggcctgtcttctggggtatagcttggatgtcttcttggatggttctgcttagaatgagtgtcaaggaggaaagagagggagatggaggatgtgtttgtgcgcctgtgtgtgtgtgtttgtgtgtgtgtgtgtgtgtgagagagagagagagagagagagagaccagcatcttcaagagaagtattctgcttatacaaaatccttaacacctcatggtgttattcttcaccatgtttatatatatatatatatatttttttttttttttagaattttctacccttggcatgaggggaaatgattgatattcaagcaagttctctaggaaaaaaaaaaacttcccaactcagatttctgtgtcagctcagaatgtatctttttttcatgctttgctctttggatttataactctgtttagactattccatacattttaggtatattttgtgccttcagacactgcaaataataatcagcatttggattaaagttgtttaataat

SEQ ID NO: 12286 - DNA, 2199 bp, Homo sapiens
attcaccttcaaagagagctggctccctgtttcagaaagtgtagggagggactggggaccagggtcaggagcttgctggggccgtccttggcttctgtgagaattgttggcgacatgggactcagagaagggcttgaatggcagcttgcaagagaggcccatgggcagccgcctccaaggattgactcttaaagtggtgactgtcttggaagagcctttcgtgatggtggctgagaacatcctaggacagcccaagcgctacaaagggttctccatagatgtcctggatgcactggccaaggctctgggctttaaatatgagatttaccaagcccctgatggcaggtacggtcaccagctccataacacctcctggaacgggatgatcggggagctcatcagcaagagagcagacttggccatctctgccatcaccatcaccccagagagggagagcgttgtggacttcagcaagcggtacatggactattcagtggggattctaattaagaagcccgaggagaaaatcagcatcttctccctctttgctccatttgatttcgctgtgtgggcctgcattgcagcagccatccctgtggttggtgtgctgatatttgtgttgaacaggatacaggctgtgagggctcagagtgctgcccagcccaggccgtcagcttctgccactctgcacagcgccatctggattgtctatggagccttcgtacagcaaggtggcgaatcttccgtgaactccatggccatgcgcatcgtgatgggcagctggtggctcttcacgctcattgtgtgctcctcctacacagccaaccttgctgccttcctcacagtgtccaggatggacaaccccataaggactttccaggacctgtccaaacaagtggaaatgtcttatggcactgtccgggattctgctgtatatgagtacttccgagccaagggcaccaaccccctggagcaggacagcacgtttgctgaactctggcggaccatcagcaagaacggaggggctgacaactgcgtgtccagtccttcagaaggcatcaggaaggcaaagaaggggaactacgccttcctgtgggatgtggccgtggtggaatacgcagccctgacggatgacgactgctcggtgactgtcatcggcaacagcatcagcagcaagggttacgggattgccctgcagcatggcagcccctacagggacctcttctcccagaggatcctggagctgcaggacacaggggacctggatgtgctgaagcagaagtggtggccgcacatgggccgctgtgacctcaccagccatgccagcgcccaggccgacggcaaatccctcaagctgcacagcttcgccggggtcttctgcatcctggccattggcctgctcctggcctgcctggtggctgccctggagttgtggtggaacagcaaccggtgccaccaggagacccccaaggaggacaaagaagtgaacttggagcaggtccaccggcgcatgaacagcctcatggatgaagacattgctcacaagcagatttccccagcgtcgattgagctctcggccctggagatggggggcctggctcccacccagaccttggagccgacacgggagtaccagaacacccagctctcggtcagcacctttctgccagagcagagcagccatggcaccagccggacactctcatcagggcccagcagcaacctgccgctgccgctgagcagctcggcgaccatgccctccatgcagtgcaaacacaggtcacccaacggggggctgttccggcagagcccggtgaagacccccatccccatgtccttccagcccgtgcctggaggcgtccttccagaggctctggacacctcccacgggacctccatctgactgcgccgcctgccctcctgcccaccctcccacccacccgaccagcagagctttttaatacaagaaaacaacaacacaaaccacacacactcgcacacacacacatacacagagactctttcatttttcttgtacatatgtgtaaataatgacagaatggagtggggtaaaagtgtattttgaatattcccaattttcgaagtcagtaaaaaaacacaaaaactgtatgaatgactttgtaaattttgttctatatgaataaaaaggcaaattacttgtgatcattctgaagtgcc

SEQ ID NO: 12287 - DNA, 5340 bp, Homo sapiens
tgcaaacaactctggcgatgccaaaattcccctccaagtgacacggctttgcgaaggaggtttcctcaggctgggctctttctgtcattcccttctgcctttctcggcgacgataaaaggctttgctctggcaataggaatttagaaaaaaagaaaaagctgcgctaaactccaccgtgacctcaaactctttggactgtttgaaaaaaaaaaaattggaagaaaatccatcctccaagagaatcggcataggaggagatggaagttttcccctttctcttggttttgtccgtctggtggtctcgaacctgggactcggcgaatgcggattcgatcattcacatcggagcaatttttgatgaatctgccaaaaaggatgatgaggtatttcgcactgcggttggtgaccttaaccagaatgaggagatcttacagactgagaaaatcacattttcagtgacgtttgttgatggcaacaaccctttccaagcagttcaagaagcctgtgaacttatgaatcaaggcatcttggccctggtcagctccattggctgcacgtcagcaggatccctccagtctttggcagacgccatgcatatcccccacctcttcattcagcgctcaacagctgggaccccaaggagtggctgtggactcacccggagcaacaggaatgatgactacactctctcagttcgcccacctgtctacttgcatgatgttatcctaagagtggtcacagagtatgcctggcagaaattcattatattctatgatagtgaatacgatatccgtggaatacaggagttcttggacaaagtctctcagcagggaatggatgttgcacttcagaaggtagaaaacaacatcaataaaatgattaccactctctttgacaccatgagaatagaagaactgaatcgctatcgagacactcttaggcgagcgatccttgttatgaatcctgctacagccaaatccttcattactgaggttgtggagactaatttggttgcttttgactgtcactggatcattataaatgaggaaataaacgatgtggacgtacaggaacttgtaagaaggtcaattggaaggttaacgattattcggcagacatttccagttccccagaacataagtcagcggtgtttccgtggcaaccatcgaatatcttcaacattgtgtgatccaaaggatccatttgctcagaatatggagatttccaacctttacatatatgacacggtgcttctgcttgctaatgcttttcataagaagctggaggaccgaaagtggcacagcatggcaagtctgtcatgtatcagaaagaactcaaagccctggcagggtgggcgctccatgttggagaccatcaagaagggtggagttagtgggttgactggagagctagaatttggagaaaatggaggcaatcccaatgtccactttgaaatccttggaaccaactatggagaagagcttggcagaggtgttcgaaaacttggttgctggaatcctgtcacaggtctgaatgggtcactgactgacaagaaattggagaataacatgcgtggagtggttctacgtgtagtaactgttctggaagaaccttttgtgatggtctctgaaaatgtcttgggtaagccgaagaaataccagggcttctccattgatgttttggatgccttatctaactacctgggttttaactacgaaatttacgtagcaccggatcacaaatacggaagcccacaagaagatgggacatggaatggcttggtaggagaacttgtctttaagagagccgacatagggatttctgctttaaccatcactccagatcgtgaaaatgtggtggactttacgacacgttacatggactactcagtgggggtactacttcgaagggctgaaaagacagtggatatgtttgcctgtcttgcaccatttgatctctctctatgggcttgcattgctggcacagtccttctggtgggtctactggtctacctcttgaactggcttaatcccccacgattacaaatgggatcaatgacgtctactactctctacaactccatgtggtttgtgtatggatcttttgtacaacaaggcggggaagtcccgtacacgactctggctacccgaatgatgatgggggcttggtggctatttgctttgattgttatctcatcttacacggcaaacctcgctgctttcctcactattacacgcattgaaagttccatccagtctctccaggacctttccaagcaaacagaaatcccttatggcacagtcctagactctgcggtatatgagcatgtccgcatgaaaggactgaatccttttgagagggacagcatgtattcccaaatgtggcggatgatcaaccgaagcaatggatcggagaacaatgttctggagtcccaggcaggcattcaaaaggtaaaatatggaaattatgctttcgtatgggatgcagctgtattggaatatgtggctatcaatgacccagattgttccttttacaccattggaaatactgttgctgatcggggatatggaattgcattacaacatggcagtccttaccgagatgttttttcacaaaggatcctggagcttcagcagaatggtgacatggacatcctgaagcacaaatggtggcctaagaatggccagtgtgacctgtactcgtcagtggacacaaagcagaaaggaggcgccctggacataaagagctttgcaggggtcttttgtatcctggctgctggaattgtcctctcctgcttcatagccatgctggagacgtggtggaacaagaggaaaggctcccgggttccatcaaaagaggatgacaaggaaattgacctggagcacctccatagacgtgtaaatagcttgtgcacagatgacgacagcccccataaacagttttccacctcgtcaattgatttgacccctctggacattgacactttgccaacacgacaagcactggagcaaatcagtgatttcaggaacactcatattaccacaacaacctttatcccagagcagatccagactcttagccgcacactgtcagctaaagctgcttctggtttcacttttggcaacgtgcctgagcaccgaactggcccttttaggcacagggcacctaatgggggctttttcaggagtcctataaaaacaatgtcatctattccttatcaaccaactcctaccctggggctcaatctgggtaatgatccagaccgaggcacctccatatgagcatcaaacaaatctcttcactgtttcttttttaggactccctttgcaaggagcaactgtaatattgtgggactaacatggatgtaacgtttaaaaaaaagatcaggattattagtaacaattctagttttttcctcccaccttctccctctcctctctcctctatgattttctctctttccccctcccttcctgtacattttcctccactttttttcattactcaacttgttccccaagaaggtagtgtactaggatcctattagtctgcttttcatatactgtacatcaagtataggaaatgtgcactgagtatactaaaagtatatgcaggattaattttacataaaggcctcttctgtaacatttctctattttttgaaatacaattgcaataacttcagtctttttacattcttctgctgcatccatacaatgctccactgctgttgagtgtcctttaactgtggaccaaaggcaacccctgcagtgtttataaaacaattttaagaccattcaggccacataagatgagaatgcaattttgtaggattacaaaaaagccattaatatgccagtcaagactacagttaaaactactcttgcactgcaacagtgcatatgacctttatgtgattgtacagtattaaaagttttttcttatgtacagtaaactttatcatatggcagaagcctctattgtgttaaataaattagtatttcatatatatacatatatatgcacctatataatgtgtatatatataaaaaggcagccattgctattgcaattcatttaataaagctttagtttaaacaaaagtattgtatacaggaactatgtatagtgcaggggttcttttcagttagaaaaggcaggttgctttaatgttattctgactcgcattgtttgccaacagaaaatattttatacttttgttattaaagcatccagggcaatttaatatttgttcctagatgtaactcatttgaataggttttgcatttgttattcagcagtgtataaagctaaccttgataattttacttttaattaattatctaaatgaaaaatgctattagctgaaccacatccacaacagcacatagagctctagaagagttgaaacatagatcattgaaggttaaaaatcctcttccaaagcagcaagtcaatcaatacaataatgatatttggggaggggtgggagcccttaagaactattgatgtggccttaaattactgtcatttattatcctaaagaagaaaacataataaccataatgggctctcaactcaactcccttttttatttagttctatttggaggagttatgtattttttacattagtgccaagtatatagaaggatgacagcaaaaacagtgcctctttgtgcacaatccttttaaagtagcattcttacttgttagaaatgtagaatgaactttgtttgtaatccttaaattaaaatgtggtaagtaggaagcaagaacttattctgtgtttttacgcagccatacacttactttaatctaactcattctgtggctaggattgatataggaatcaacctatgtgatttgctttaggagaaattaaaaggtatattcttaagatatattatattttgatgctaattctgttctggggagcatcttgtattgtcactgttttgtactaaatcttcaaatattgtctactgtgtaaggcagaaaaatttcttatcatgcaaaaaccattttgtttccagggtaacaagtaactaagtgcatgcacaacttgttttcccttgtaacattcatgatctcatttacaactctgattttaaaacaaaaaaatctttacaacaagctatatagggacataccagatgttgcagtgattttagctatcaacaaactgttaaccatgtacaatatttaaaataggcttattttgatgtatcgcctattatacaaacacacaaaacatttttggaggcctcagttatgagtgacagagctttctgtgtataatttgtctaaataatttgtctaataaaaatgttttctaaa

SEQ ID NO: 12288 - DNA, 2739 bp, Homo sapiens
atggaagttttcccctttctcttggttttgtccgtctggtggtctcgaacctgggactcggcgaatgcggattcgatcattcacatcggagcaatttttgatgaatctgccaaaaaggatgatgaggtatttcgcactgcggttggtgaccttaaccagaatgaggagatcttacagactgagaaaatcacattttcagtgacgtttgttgatggcaacaaccctttccaagcagttcaagaagatatccgtggaatacaggagttcttggacaaagtctctcagcagggaatggatgttgcacttcagaaggtagaaaacaacatcaataaaatgattaccactctctttgacaccatgagaatagaagaactgaatcgctatcgagacactcttaggcgagcgatccttgttatgaatcctgctacagccaaatccttcattactgaggttgtggagactaatttggttgcttttgactgtcactggatcattataaatgaggaaataaacgatgtggacgtacaggaacttgtaagaaggtcaattggaaggttaacgattattcggcagacatttccagttccccagaacataagtcagcggtgtttccgtggcaaccatcgaatatcttcaacattgtgtgatccaaaggatccatttgctcagaatatggagatttccaacctttacatatatgacacggtgcttctgcttgctaatgcttttcataagaagctggaggaccgaaagtggcacagcatggcaagtctgtcatgtatcagaaagaactcaaagccctggcagggtgggcgctccatgttggagaccatcaagaagggtggagttagtgggttgactggagagctagaatttggagaaaatggaggcaatcccaatgtccactttgaaatccttggaaccaactatggagaagagcttggcagaggtgttcgaaaacttggttgctggaatcctgtcacaggtctgaatgggtcactgactgacaagaaattggagaataacatgcgtggagtggttctacgtgtagtaactgttctggaagaaccttttgtgatggtctctgaaaatgtcttgggtaagccgaagaaataccagggcttctccattgatgttttggatgccttatctaactacctgggttttaactacgaaatttacgtagcaccggatcacaaatacggaagcccacaagaagatgggacatggaatggcttggtaggagaacttgtctttaagagagccgacatagggatttctgctttaaccatcactccagatcgtgaaaatgtggtggactttacgacacgttacatggactactcagtgggggtactacttcgaagggctgaaaagacagtggatatgtttgcctgtcttgcaccatttgatctctctctatgggcttgcattgctggcacagtccttctggtgggtctactggtctacctcttgaactggcttaatcccccacgattacaaatgggatcaatgacgtctactactctctacaactccatgtggtttgtgtatggatcttttgtacaacaaggcggggaagtcccgtacacgactctggctacccgaatgatgatgggggcttggtggctatttgctttgattgttatctcatcttacacggcaaacctcgctgctttcctcactattacacgcattgaaagttccatccagtctctccaggacctttccaagcaaacagaaatcccttatggcacagtcctagactctgcggtatatgagcatgtccgcatgaaaggactgaatccttttgagagggacagcatgtattcccaaatgtggcggatgatcaaccgaagcaatggatcggagaacaatgttctggagtcccaggcaggcattcaaaaggtaaaatatggaaattatgctttcgtatgggatgcagctgtattggaatatgtggctatcaatgacccagattgttccttttacaccattggaaatactgttgctgatcggggatatggaattgcattacaacatggcagtccttaccgagatgttttttcacaaaggatcctggagcttcagcagaatggtgacatggacatcctgaagcacaaatggtggcctaagaatggccagtgtgacctgtactcgtcagtggacacaaagcagaaaggaggcgccctggacataaagagctttgcaggggtcttttgtatcctggctgctggaattgtcctctcctgcttcatagccatgctggagacgtggtggaacaagaggaaaggctcccgggttccatcaaaagaggatgacaaggaaattgacctggagcacctccatagacgtgtaaatagcttgtgcacagatgacgacagcccccataaacagttttccacctcgtcaattgatttgacccctctggacattgacactttgccaacacgacaagcactggagcaaatcagtgatttcaggaacactcatattaccacaacaacctttatcccagagcagatccagactcttagccgcacactgtcagctaaagctgcttctggtttcacttttggcaacgtgcctgagcaccgaactggcccttttaggcacagggcacctaatgggggctttttcaggagtcctataaaaacaatgtcatctattccttatcaaccaactcctaccctggggctcaatctgggtaatgatccagaccgaggcacctccatatga

SEQ ID NO: 12289 - DNA, 2763 bp, Homo sapiens
atggagcacggcacactcctcgcccagcccgggctctggaccagggacaccagctgggcactcctctatttcctctgctatatcctccctcagaccgccccgcaagtactcaggatcggagggatttttgaaacagtggaaaatgagcctgttaatgttgaagaattagctttcaagtttgcagtcaccagcattaacagaaaccgaaccctgatgcctaacaccacattaacctatgacatccagagaattaacctttttgatagttttgaagcctcgcggagagcatgtgaccagctggctcttggtgtggctgctctctttggcccttcccatagctcctccgtcagtgctgtgcagtctatttgcaatgctctcgaagttccacacatacagacccgctggaaacacccctcggtggacaacaaagatttgttttacatcaacctttacccagattatgcagctatcagcagggcgatcctggatctggtcctctattacaactggaaaacagtgacagtggtgtatgaagacagcacaggtctaattcgtctacaagagctcatcaaagctccctccagatataatattaaaatcaaaatccgccagctgccctctgggaataaagatgccaagcctttactcaaggagatgaagaaaggcaaggagttctatgtgatatttgattgttcacatgaaacagccgctgaaatccttaagcagattctgttcatgggcatgatgaccgagtactatcactactttttcacaaccctggacttatttgctttggatctggaactctataggtacagtggcgtaaacatgaccgggtttcggctgcttaacattgacaaccctcacgtgtcatccatcattgagaagtggtccatggagagactgcaggccccacccaggcccgagactggccttttggatggcatgatgacaactgaagcggctctgatgtacgatgctgtgtacatggtggccattgcctcgcaccgggcatcccagctgaccgtcagctccctgcagtgccatagacataagccatggcgcctcggacccagatttatgaacctgatcaaagaggcaactgcccggtgggatggcttgactgggcatatcacctttaataaaaccaatggcttgaggaaggattttgatctggacattattagtctcaaagaggaaggaactgaaaaggctgctggcgaagtgtctaaacacttgtataaagtgtggaagaagattgggatttggaattccaacagtgggcttaacatgacggacagcaacaaagacaagtccagcaatatcactgattcattggccaacagaacactcattgtcaccaccattctggaagaaccctatgttatgtacaggaaatctgataagcctctatatggaaatgacagatttgaaggatattgcctagacctgttgaaagaattgtcaaacatcctgggtttcatttatgatgttaaactagttcccgatggcaaatatggggcccagaatgacaaaggggagtggaacgggatggttaaagaactcatagatcacagggctgacctggcagtggctcctcttaccatcacctacgtgcgggagaaagtcattgacttctccaaacccttcatgaccctaggcatcagcattctctaccggaagcccaatggtaccaatccaggcgttttctccttcctcaaccccctgtctccagatatttggatgtatgtgctcttagcctgcttgggagtcagctgtgtactctttgtgattgcaaggtttacaccctacgagtggtataacccccacccatgcaaccctgactcagacgtggtggaaaacaattttactttactaaatagtttctggtttggagttggagctctcatgcagcaaggatcagagctgatgcccaaagctctatcgaccagaatagttggagggatatggtggtttttcaccctaatcatcatttcatcctacacggccaatctggctgccttcttgacagtagagagaatggaatcccccatagattcggcagatgatctggcaaagcaaaccaagatagaatatggggcggttagagatggatcaacaatgaccttcttcaagaaatcaaaaatctccacctatgagaagatgtgggctttcatgagcagcaggcagcagaccgccctggtaagaaacagtgatgaggggatccagagagtgctcaccacagactacgcgctgctgatggagtccaccagcattgagtatgtgacgcagagaaactgcaacctcactcagatcgggggcctcattgactccaaaggttacggagtgggaacacctattggttctccttaccgggataaaattactattgctattcttcaactccaagaagaagggaagctgcatatgatgaaagagaagtggtggcgtgggaatggctgccccgaggaagacaacaaagaagccagtgccctgggagtggaaaatattggaggcatcttcattgttctggctgccggactggtcctttctgtatttgtagctattggagaattcatatacaaatcacggaagaataatgatattgaacaggctttttgtttcttttatggactgcaatgtaagcaaacccatccaaccaactccacttctggaactactttatctacggatttagaatgtggtaaattaattcgagaggagagagggattcgaaaacagtcctcagttcatactgtgtaa

SEQ ID NO: 12290 - DNA, 3179 bp, Homo sapiens
tgtatctcggcatgaattaagaagctaggaagatggagcacggcacactcctcgcccagcccgggctctggaccagggacaccagctgggcactcctctatttcctctgctatatcctccctcagaccgccccgcaagtactcaggatcggagggatttttgaaacagtggaaaatgagcctgttaatgttgaagaattagctttcaagtttgcagtcaccagcattaacagaaaccgaaccctgatgcctaacaccacattaacctatgacatccagagaattaacctttttgatagttttgaagcctcgcggagagcatgtgaccagctggctcttggtgtggctgctctctttggcccttcccatagctcctccgtcagtgctgtgcagtctatttgcaatgctctcgaagttccacacatacagacccgctggaaacacccctcggtggacaacaaagatttgttttacatcaacctttacccagattatgcagctatcagcagggcgatcctggatctggtcctctattacaactggaaaacagtgacagtggtgtatgaagacagcacaggtctaattcgtctacaagagctcatcaaagctccctccagatataatattaaaatcaaaatccgccagctgccctctgggaataaagatgccaagcctttactcaaggagatgaagaaaggcaaggagttctatgtgatatttgattgttcacatgaaacagccgctgaaatccttaagcagattctgttcatgggcatgatgaccgagtactatcactactttttcacaaccctggacttatttgctttggatctggaactctataggtacagtggcgtaaacatgaccgggtttcggctgcttaacattgacaaccctcacgtgtcatccatcattgagaagtggtccatggagagactgcaggccccacccaggcccgagactggccttttggatggcatgatgacaactgaagcggctctgatgtacgatgctgtgtacatggtggccattgcctcgcaccgggcatcccagctgaccgtcagctccctgcagtgccatagacataagccatggcgcctcggacccagatttatgaacctgatcaaagaggcccggtgggatggcttgactgggcatatcacctttaataaaaccaatggcttgaggaaggattttgatctggacattattagtctcaaagaggaaggaactgaaaaggctgctggcgaagtgtctaaacacttgtataaagtgtggaagaagattgggatttggaattccaacagtgggcttaacatgacggacagcaacaaagacaagtccagcaatatcactgattcattggccaacagaacactcattgtcaccaccattctggaagaaccctatgttatgtacaggaaatctgataagcctctatatggaaatgacagatttgaaggatattgcctagacctgttgaaagaattgtcaaacatcctgggtttcatttatgatgttaaactagttcccgatggcaaatatggggcccagaatgacaaaggggagtggaacgggatggttaaagaactcatagatcacagggctgacctggcagtggctcctcttaccatcacctacgtgcgggagaaagtcattgacttctccaaacccttcatgaccctaggcatcagcattctctaccggaagcccaatggtaccaatccaggcgttttctccttcctcaaccccctgtctccagatatttggatgtatgtgctcttagcctgcttgggagtcagctgtgtactctttgtgattgcaaggtttacaccctacgagtggtataacccccacccatgcaaccctgactcagacgtggtggaaaacaattttactttactaaatagtttctggtttggagttggagctctcatgcagcaaggatcagagctgatgcccaaagctctatcgaccagaatagttggagggatatggtggtttttcaccctaatcatcatttcatcctacacggccaatctggctgccttcttgacagtagagagaatggaatcccccatagattcggcagatgatctggcaaagcaaaccaagatagaatatggggcggttagagatggatcaacaatgaccttcttcaagaaatcaaaaatctccacctatgagaagatgtgggctttcatgagcagcaggcagcagaccgccctggtaagaaacagtgatgaggggatccagagagtgctcaccacagactacgcgctgctgatggagtccaccagcattgagtatgtgacgcagagaaactgcaacctcactcagatcgggggcctcattgactccaaaggttacggagtgggaacacctattggttctccttaccgggataaaattactattgctattcttcaactccaagaagaagggaagctgcatatgatgaaagagaagtggtggcgtgggaatggctgccccgaggaagacaacaaagaagccagtgccctgggagtggaaaatattggaggcatcttcattgttctggctgccggactggtcctttctgtatttgtagctattggagaattcatatacaaatcacggaagaataatgatattgaacagaaaggaaagtcatcaagaattagattttattttaggaacaaagtaaggtttcatgggagaaaaaaacaaagccttggtgtagagaagtgtctctctttcaacgctatcatggaagaactgggaatctcactgaagaatcagaaaaaaataaagaaaaagtcaagaactaaggggaaatcttccttcacaagtatccttacttgtcatcagagacgaactcagagaaaagagactgtggcgtgatccaaggaaacgcctgtaggaagaaaaaggatgcattccctacagatttttggagaaaggatttctgaggagtgtgtgatgtgtttccatatatctatatccataactctgattatgaatacagatataagaaatacaaaagtttaaaaagctcacatagatatgacttgggaagtgacaccagttcttttaaaataaatttgtatgctcaattattttgcattttttctttttccccaataaattgttgtgtgtgctttctaaataataataaaacaacagggtttttttccagaa

SEQ ID NO: 12291 - DNA, 2712 bp, Homo sapiens
tgtatctcggcatgaattaagaagctaggaagatggagcacggcacactcctcgcccagcccgggctctggaccagggacaccagctgggcactcctctatttcctctgctatatcctccctcagaccgccccgcaagtactcaggatcggagggatttttgaaacagtggaaaatgagcctgttaatgttgaagaattagctttcaagtttgcagtcaccagcattaacagaaaccgaaccctgatgcctaacaccacattaacctatgacatccagagaattaacctttttgatagttttgaagcctcgcggagagcatgtgaccagctggctcttggtgtggctgctctctttggcccttcccatagctcctccgtcagtgctgtgcagtctatttgcaatgctctcgaagttccacacatacagacccgctggaaacacccctcggtggacaacaaagatttgttttacatcaacctttacccagattatgcagctatcagcagggcgatcctggatctggtcctctattacaactggaaaacagtgacagtggtgtatgaagacagcacaggtctaattcgtctacaagagctcatcaaagctccctccagatataatattaaaatcaaaatccgccagctgccctctgggaataaagatgccaagcctttactcaaggagatgaagaaaggcaaggagttctatgtgatatttgattgttcacatgaaacagccgctgaaatccttaagcagattctgttcatgggcatgatgaccgagtactatcactactttttcacaaccctggacttatttgctttggatctggaactctataggtacagtggcgtaaacatgaccgggtttcggctgcttaacattgacaaccctcacgtgtcatccatcattgagaagtggtccatggagagactgcaggccccacccaggcccgagactggccttttggatggcatgatgacaactgaagcggctctgatgtacgatgctgtgtacatggtggccattgcctcgcaccgggcatcccagctgaccgtcagctccctgcagtgccatagacataagccatggcgcctcggacccagatttatgaacctgatcaaagaggcccggtgggatggcttgactgggcatatcacctttaataaaaccaatggcttgaggaaggattttgatctggacattattagtctcaaagaggaaggaactgaaaaggctgctggcgaagtgtctaaacacttgtataaagtgtggaagaagattgggatttggaattccaacagtgggcttaacatgacggacagcaacaaagacaagtccagcaatatcactgattcattggccaacagaacactcattgtcaccaccattctggaagaaccctatgttatgtacaggaaatctgataagcctctatatggaaatgacagatttgaaggatattgcctagacctgttgaaagaattgtcaaacatcctgggtttcatttatgatgttaaactagttcccgatggcaaatatggggcccagaatgacaaaggggagtggaacgggatggttaaagaactcatagatcacagggctgacctggcagtggctcctcttaccatcacctacgtgcgggagaaagtcattgacttctccaaacccttcatgaccctaggcatcagcattctctaccggaagcccaatggtaccaatccaggcgttttctccttcctcaaccccctgtctccagatatttggatgtatgtgctcttagcctgcttgggagtcagctgtgtactctttgtgattgcaaggtttacaccctacgagtggtataacccccacccatgcaaccctgactcagacgtggtggaaaacaattttactttactaaatagtttctggtttggagttggagctctcatgcagcaaggatcagagctgatgcccaaagctctatcgaccagaatagttggagggatatggtggtttttcaccctaatcatcatttcatcctacacggccaatctggctgccttcttgacagtagagagaatggaatcccccatagattcggcagatgatctggcaaagcaaaccaagatagaatatggggcggttagagatggatcaacaatgaccttcttcaagaaatcaaaaatctccacctatgagaagatgtgggctttcatgagcagcaggcagcagaccgccctggtaagaaacagtgatgaggggatccagagagtgctcaccacagactacgcgctgctgatggagtccaccagcattgagtatgtgacgcagagaaactgcaacctcactcagatcgggggcctcattgactccaaaggttacggagtgggaacacctattggttctccttaccgggataaaattactattgctattcttcaactccaagaagaagggaagctgcatatgatgaaagagaagtggtggcgtgggaatggctgccccgaggaagacaacaaagaagccagtgccctgggagtggaaaatattggaggcatcttcattgttctggctgccggactggtcctttctgtatttgtagctattggagaattcatatacaaatcacggaagaataatgatattgaacagcattactgaagtgtccgtatgccttgataatcctatcaatgtttggatcatctcagtgggggaaatgacttaa

SEQ ID NO: 12292 - DNA, 3140 bp, Homo sapiens
agcgcgcagcgtgcttggaaccggagcatccagagaggatgaggcggggacccggcccaagttgggtgcatctctcgggcgtccggcagcggctgtatctcggcatgaattaagaagctaggaagatggagcacggcacactcctcgcccagcccgggctctggaccagggacaccagctgggcactcctctatttcctctgctatatcctccctcagaccgccccgcaagtactcaggatcggagggatttttgaaacagtggaaaatgagcctgttaatgttgaagaattagctttcaagtttgcagtcaccagcattaacagaaaccgaaccctgatgcctaacaccacattaacctatgacatccagagaattaacctttttgatagttttgaagcctcgcggagagcatgtgaccagctggctcttggtgtggctgctctctttggcccttcccatagctcctccgtcagtgctgtgcagtctatttgcaatgctctcgaagttccacacatacagacccgctggaaacacccctcggtggacaacaaagatttgttttacatcaacctttacccagattatgcagctatcagcagggcgatcctggatctggtcctctattacaactggaaaacagtgacagtggtgtatgaagacagcacaggtctaattcgtctacaagagctcatcaaagctccctccagatataatattaaaatcaaaatccgccagctgccctctgggaataaagatgccaagcctttactcaaggagatgaagaaaggcaaggagttctatgtgatatttgattgttcacatgaaacagccgctgaaatccttaagcagattctgttcatgggcatgatgaccgagtactatcactactttttcacaaccctggacttatttgctttggatctggaactctataggtacagtggcgtaaacatgaccgggtttcggctgcttaacattgacaaccctcacgtgtcatccatcattgagaagtggtccatggagagactgcaggccccacccaggcccgagactggccttttggatggcatgatgacaactgaagcggctctgatgtacgatgctgtgtacatggtggccattgcctcgcaccgggcatcccagctgaccgtcagctccctgcagtgccatagacataagccatggcgcctcggacccagatttatgaacctgatcaaagaggcccggtgggatggcttgactgggcatatcacctttaataaaaccaatggcttgaggaaggattttgatctggacattattagtctcaaagaggaaggaactgaaaagattgggatttggaattccaacagtgggcttaacatgacggacagcaacaaagacaagtccagcaatatcactgattcattggccaacagaacactcattgtcaccaccattctggaagaaccctatgttatgtacaggaaatctgataagcctctatatggaaatgacagatttgaaggatattgcctagacctgttgaaagaattgtcaaacatcctgggtttcatttatgatgttaaactagttcccgatggcaaatatggggcccagaatgacaaaggggagtggaacgggatggttaaagaactcatagatcacagggctgacctggcagtggctcctcttaccatcacctacgtgcgggagaaagtcattgacttctccaaacccttcatgaccctaggcatcagcattctctaccggaagcccaatggtaccaatccaggcgttttctccttcctcaaccccctgtctccagatatttggatgtatgtgctcttagcctgcttgggagtcagctgtgtactctttgtgattgcaaggtttacaccctacgagtggtataacccccacccatgcaaccctgactcagacgtggtggaaaacaattttactttactaaatagtttctggtttggagttggagctctcatgcagcaaggatcagagctgatgcccaaagctctatcgaccagaatagttggagggatatggtggtttttcaccctaatcatcatttcatcctacacggccaatctggctgccttcttgacagtagagagaatggaatcccccatagattcggcagatgatctggcaaagcaaaccaagatagaatatggggcggttagagatggatcaacaatgaccttcttcaagaaatcaaaaatctccacctatgagaagatgtgggctttcatgagcagcaggcagcagaccgccctggtaagaaacagtgatgaggggatccagagagtgctcaccacagactacgcgctgctgatggagtccaccagcattgagtatgtgacgcagagaaactgcaacctcactcagatcgggggcctcattgactccaaaggttacggagtgggaacacctattggttctccttaccgggataaaattactattgctattcttcaactccaagaagaagggaagctgcatatgatgaaagagaagtggtggcgtgggaatggctgccccgaggaagacaacaaagaagccagtgccctgggagtggaaaatattggaggcatcttcattgttctggctgccggactggtcctttctgtatttgtagctattggagaattcatatacaaatcacggaagaataatgatattgaacagtgtctctctttcaacgctatcatggaagaactgggaatctcactgaagaatcagaaaaaaataaagaaaaagtcaagaactaaggggaaatcttccttcacaagtatccttacttgtcatcagagacgaactcagagaaaagagactgtggcgtgatccaaggaaacgcctgtaggaagaaaaaggatgcattccctacagatttttggagaaaggatttctgaggagtgtgtgatgtgtttccatatatctatatccataactctgattatgaatacagatataagaaatacaaaagtttaaaaagctcacatagatatgacttgggaagtgacaccagttcttttaaaataaatttgtatgctcaattattttgcattttttctttttccccaataaattgttgtgtgtgctttctaaataataataaaacaacagggtttttttccagaa

SEQ ID NO: 12293 - DNA, 3472 bp, Homo sapiens
ctttcccccttttccctcctctgtctgtgcctatcccccgacttttgcatctgaccaaaggacgaatgagggagacgttcctgcagatcggggcagcaactttcctcagctggtctctgggctccgggagccagagagcgctgatcctccgcggtctgcggcccatggaagaggaggaggaggagccgtgatgggctagcgacagcactgaggagccccgagagagctcagccttgccagccagctccgcggtcccacgcgggttccctcgagctcgctccgtggggagcgcgcagcgtgcttggaaccggagcatccagagaggatgaggcggggacccggcccaagttgggtgcatctctcgggcgtccggcagcggctgtatctcggcatgaattaagaagctaggaagatggagcacggcacactcctcgcccagcccgggctctggaccagggacaccagctgggcactcctctatttcctctgctatatcctccctcagaccgccccgcaagtactcaggatcggagggatttttgaaacagtggaaaatgagcctgttaatgttgaagaattagctttcaagtttgcagtcaccagcattaacagaaaccgaaccctgatgcctaacaccacattaacctatgacatccagagaattaacctttttgatagttttgaagcctcgcggagagcatgtgaccagctggctcttggtgtggctgctctctttggcccttcccatagctcctccgtcagtgctgtgcagtctatttgcaatgctctcgaagttccacacatacagacccgctggaaacacccctcggtggacaacaaagatttgttttacatcaacctttacccagattatgcagctatcagcagggcgatcctggatctggtcctctattacaactggaaaacagtgacagtggtgtatgaagacagcacaggtctaattcgtctacaagagctcatcaaagctccctccagatataatattaaaatcaaaatccgccagctgccctctgggaataaagatgccaagcctttactcaaggagatgaagaaaggcaaggagttctatgtgatatttgattgttcacatgaaacagccgctgaaatccttaagcagattctgttcatgggcatgatgaccgagtactatcactactttttcacaaccctggacttatttgctttggatctggaactctataggtacagtggcgtaaacatgaccgggtttcggctgcttaacattgacaaccctcacgtgtcatccatcattgagaagtggtccatggagagactgcaggccccacccaggcccgagactggccttttggatggcatgatgacaactgaagcggctctgatgtacgatgctgtgtacatggtggccattgcctcgcaccgggcatcccagctgaccgtcagctccctgcagtgccatagacataagccatggcgcctcggacccagatttatgaacctgatcaaagaggcccggtgggatggcttgactgggcatatcacctttaataaaaccaatggcttgaggaaggattttgatctggacattattagtctcaaagaggaaggaactgaaaaggctgctggcgaagtgtctaaacacttgtataaagtgtggaagaagattgggatttggaattccaacagtgggcttaacatgacggacagcaacaaagacaagtccagcaatatcactgattcattggccaacagaacactcattgtcaccaccattctggaagaaccctatgttatgtacaggaaatctgataagcctctatatggaaatgacagatttgaaggatattgcctagacctgttgaaagaattgtcaaacatcctgggtttcatttatgatgttaaactagttcccgatggcaaatatggggcccagaatgacaaaggggagtggaacgggatggttaaagaactcatagatcacagggctgacctggcagtggctcctcttaccatcacctacgtgcgggagaaagtcattgacttctccaaacccttcatgaccctaggcatcagcattctctaccggaagcccaatggtaccaatccaggcgttttctccttcctcaaccccctgtctccagatatttggatgtatgtgctcttagcctgcttgggagtcagctgtgtactctttgtgattgcaaggtttacaccctacgagtggtataacccccacccatgcaaccctgactcagacgtggtggaaaacaattttactttactaaatagtttctggtttggagttggagctctcatgcagcaaggatcagagctgatgcccaaagctctatcgaccagaatagttggagggatatggtggtttttcaccctaatcatcatttcatcctacacggccaatctggctgccttcttgacagtagagagaatggaatcccccatagattcggcagatgatctggcaaagcaaaccaagatagaatatggggcggttagagatggatcaacaatgaccttcttcaagaaatcaaaaatctccacctatgagaagatgtgggctttcatgagcagcaggcagcagaccgccctggtaagaaacagtgatgaggggatccagagagtgctcaccacagactacgcgctgctgatggagtccaccagcattgagtatgtgacgcagagaaactgcaacctcactcagatcgggggcctcattgactccaaaggttacggagtgggaacacctattggttctccttaccgggataaaattactattgctattcttcaactccaagaagaagggaagctgcatatgatgaaagagaagtggtggcgtgggaatggctgccccgaggaagacaacaaagaagccagtgccctgggagtggaaaatattggaggcatcttcattgttctggctgccggactggtcctttctgtatttgtagctattggagaattcatatacaaatcacggaagaataatgatattgaacaggctttttgtttcttttatggactgcaatgtaagcaaacccatccaaccaactccacttctggaactactttatctacggatttagaatgtggtaaattaattcgagaggagagagggattcgaaaacagtcctcagttcatactgtgtaatcagtttaaaaaaaaaaaaaaagatgtgcccagtagaaaatgtttttgctaattggtgttgttgatatttgtatttgctaagcataaatagccacaattctctattcctttaggatagcaaaactcatgtattctagacattgaaatgaatacactggaaagatacttgcactgtatgttgaagcaggggcatattaggggtataaagacttctagaaatgtgtatttacaggaatcttctctgtcccactcatcatcttagttctatcttcatgcattaaaaataagtaactcttccttcat

SEQ ID NO: 12294 - DNA, 3427 bp, Homo sapiens
ctttcccccttttccctcctctgtctgtgcctatcccccgacttttgcatctgaccaaaggacgaatgagggagacgttcctgcagatcggggcagcaactttcctcagctggtctctgggctccgggagccagagagcgctgatcctccgcggtctgcggcccatggaagaggaggaggaggagccgtgatgggctagcgacagcactgaggagccccgagagagctcagccttgccagccagctccgcggtcccacgcgggttccctcgagctcgctccgtggggagcgcgcagcgtgcttggaaccggagcatccagagaggatgaggcggggacccggcccaagttgggtgcatctctcgggcgtccggcagcggctgtatctcggcatgaattaagaagctaggaagatggagcacggcacactcctcgcccagcccgggctctggaccagggacaccagctgggcactcctctatttcctctgctatatcctccctcagaccgccccgcaagtactcaggatcggagggatttttgaaacagtggaaaatgagcctgttaatgttgaagaattagctttcaagtttgcagtcaccagcattaacagaaaccgaaccctgatgcctaacaccacattaacctatgacatccagagaattaacctttttgatagttttgaagcctcgcggagagcatgtgaccagctggctcttggtgtggctgctctctttggcccttcccatagctcctccgtcagtgctgtgcagtctatttgcaatgctctcgaagttccacacatacagacccgctggaaacacccctcggtggacaacaaagatttgttttacatcaacctttacccagattatgcagctatcagcagggcgatcctggatctggtcctctattacaactggaaaacagtgacagtggtgtatgaagacagcacaggtctaattcgtctacaagagctcatcaaagctccctccagatataatattaaaatcaaaatccgccagctgccctctgggaataaagatgccaagcctttactcaaggagatgaagaaaggcaaggagttctatgtgatatttgattgttcacatgaaacagccgctgaaatccttaagcagattctgttcatgggcatgatgaccgagtactatcactactttttcacaaccctggacttatttgctttggatctggaactctataggtacagtggcgtaaacatgaccgggtttcggctgcttaacattgacaaccctcacgtgtcatccatcattgagaagtggtccatggagagactgcaggccccacccaggcccgagactggccttttggatggcatgatgacaactgaagcggctctgatgtacgatgctgtgtacatggtggccattgcctcgcaccgggcatcccagctgaccgtcagctccctgcagtgccatagacataagccatggcgcctcggacccagatttatgaacctgatcaaagaggcccggtgggatggcttgactgggcatatcacctttaataaaaccaatggcttgaggaaggattttgatctggacattattagtctcaaagaggaaggaactgaaaagattgggatttggaattccaacagtgggcttaacatgacggacagcaacaaagacaagtccagcaatatcactgattcattggccaacagaacactcattgtcaccaccattctggaagaaccctatgttatgtacaggaaatctgataagcctctatatggaaatgacagatttgaaggatattgcctagacctgttgaaagaattgtcaaacatcctgggtttcatttatgatgttaaactagttcccgatggcaaatatggggcccagaatgacaaaggggagtggaacgggatggttaaagaactcatagatcacagggctgacctggcagtggctcctcttaccatcacctacgtgcgggagaaagtcattgacttctccaaacccttcatgaccctaggcatcagcattctctaccggaagcccaatggtaccaatccaggcgttttctccttcctcaaccccctgtctccagatatttggatgtatgtgctcttagcctgcttgggagtcagctgtgtactctttgtgattgcaaggtttacaccctacgagtggtataacccccacccatgcaaccctgactcagacgtggtggaaaacaattttactttactaaatagtttctggtttggagttggagctctcatgcagcaaggatcagagctgatgcccaaagctctatcgaccagaatagttggagggatatggtggtttttcaccctaatcatcatttcatcctacacggccaatctggctgccttcttgacagtagagagaatggaatcccccatagattcggcagatgatctggcaaagcaaaccaagatagaatatggggcggttagagatggatcaacaatgaccttcttcaagaaatcaaaaatctccacctatgagaagatgtgggctttcatgagcagcaggcagcagaccgccctggtaagaaacagtgatgaggggatccagagagtgctcaccacagactacgcgctgctgatggagtccaccagcattgagtatgtgacgcagagaaactgcaacctcactcagatcgggggcctcattgactccaaaggttacggagtgggaacacctattggttctccttaccgggataaaattactattgctattcttcaactccaagaagaagggaagctgcatatgatgaaagagaagtggtggcgtgggaatggctgccccgaggaagacaacaaagaagccagtgccctgggagtggaaaatattggaggcatcttcattgttctggctgccggactggtcctttctgtatttgtagctattggagaattcatatacaaatcacggaagaataatgatattgaacaggctttttgtttcttttatggactgcaatgtaagcaaacccatccaaccaactccacttctggaactactttatctacggatttagaatgtggtaaattaattcgagaggagagagggattcgaaaacagtcctcagttcatactgtgtaatcagtttaaaaaaaaaaaaaaagatgtgcccagtagaaaatgtttttgctaattggtgttgttgatatttgtatttgctaagcataaatagccacaattctctattcctttaggatagcaaaactcatgtattctagacattgaaatgaatacactggaaagatacttgcactgtatgttgaagcaggggcatattaggggtataaagacttctagaaatgtgtatttacaggaatcttctctgtcccactcatcatcttagttctatcttcatgcattaaaaataagtaactcttccttcat

SEQ ID NO: 12295 - DNA, 3234 bp, Homo sapiens
agccagctccgcggtcccacgcgggttccctcgagctcgctccgtggggagcgcgcagcgtgcttggaaccggagcatccagagaggatgaggcggggacccggcccaagttgggtgcatctctcgggcgtccggcagcggctgtatctcggcatgaattaagaagctaggaagatggagcacggcacactcctcgcccagcccgggctctggaccagggacaccagctgggcactcctctatttcctctgctatatcctccctcagaccgccccgcaagtactcaggatcggagggatttttgaaacagtggaaaatgagcctgttaatgttgaagaattagctttcaagtttgcagtcaccagcattaacagaaaccgaaccctgatgcctaacaccacattaacctatgacatccagagaattaacctttttgatagttttgaagcctcgcggagagcatgtgaccagctggctcttggtgtggctgctctctttggcccttcccatagctcctccgtcagtgctgtgcagtctatttgcaatgctctcgaagttccacacatacagacccgctggaaacacccctcggtggacaacaaagatttgttttacatcaacctttacccagattatgcagctatcagcagggcgatcctggatctggtcctctattacaactggaaaacagtgacagtggtgtatgaagacagcacaggtctaattcgtctacaagagctcatcaaagctccctccagatataatattaaaatcaaaatccgccagctgccctctgggaataaagatgccaagcctttactcaaggagatgaagaaaggcaaggagttctatgtgatatttgattgttcacatgaaacagccgctgaaatccttaagcagattctgttcatgggcatgatgaccgagtactatcactactttttcacaaccctggacttatttgctttggatctggaactctataggtacagtggcgtaaacatgaccgggtttcggctgcttaacattgacaaccctcacgtgtcatccatcattgagaagtggtccatggagagactgcaggccccacccaggcccgagactggccttttggatggcatgatgacaactgaagcggctctgatgtacgatgctgtgtacatggtggccattgcctcgcaccgggcatcccagctgaccgtcagctccctgcagtgccatagacataagccatggcgcctcggacccagatttatgaacctgatcaaagaggcccggtgggatggcttgactgggcatatcacctttaataaaaccaatggcttgaggaaggattttgatctggacattattagtctcaaagaggaaggaactgaaaaggctgctggcgaagtgtctaaacacttgtataaagtgtggaagaagattgggatttggaattccaacagtgggcttaacatgacggacagcaacaaagacaagtccagcaatatcactgattcattggccaacagaacactcattgtcaccaccattctggaagaaccctatgttatgtacaggaaatctgataagcctctatatggaaatgacagatttgaaggatattgcctagacctgttgaaagaattgtcaaacatcctgggtttcatttatgatgttaaactagttcccgatggcaaatatggggcccagaatgacaaaggggagtggaacgggatggttaaagaactcatagatcacagggctgacctggcagtggctcctcttaccatcacctacgtgcgggagaaagtcattgacttctccaaacccttcatgaccctaggcatcagcattctctaccggaagcccaatggtaccaatccaggcgttttctccttcctcaaccccctgtctccagatatttggatgtatgtgctcttagcctgcttgggagtcagctgtgtactctttgtgattgcaaggtttacaccctacgagtggtataacccccacccatgcaaccctgactcagacgtggtggaaaacaattttactttactaaatagtttctggtttggagttggagctctcatgcagcaaggatcagagctgatgcccaaagctctatcgaccagaatagttggagggatatggtggtttttcaccctaatcatcatttcatcctacacggccaatctggctgccttcttgacagtagagagaatggaatcccccatagattcggcagatgatctggcaaagcaaaccaagatagaatatggggcggttagagatggatcaacaatgaccttcttcaagaaatcaaaaatctccacctatgagaagatgtgggctttcatgagcagcaggcagcagaccgccctggtaagaaacagtgatgaggggatccagagagtgctcaccacagactacgcgctgctgatggagtccaccagcattgagtatgtgacgcagagaaactgcaacctcactcagatcgggggcctcattgactccaaaggttacggagtgggaacacctattggttctccttaccgggataaaattactattgctattcttcaactccaagaagaagggaagctgcatatgatgaaagagaagtggtggcgtgggaatggctgccccgaggaagacaacaaagaagccagtgccctgggagtggaaaatattggaggcatcttcattgttctggctgccggactggtcctttctgtatttgtagctattggagaattcatatacaaatcacggaagaataatgatattgaacagtgtctctctttcaacgctatcatggaagaactgggaatctcactgaagaatcagaaaaaaataaagaaaaagtcaagaactaaggggaaatcttccttcacaagtatccttacttgtcatcagagacgaactcagagaaaagagactgtggcgtgatccaaggaaacgcctgtaggaagaaaaaggatgcattccctacagatttttggagaaaggatttctgaggagtgtgtgatgtgtttccatatatctatatccataactctgattatgaatacagatataagaaatacaaaagtttaaaaagctcacatagatatgacttgggaagtgacaccagttcttttaaaataaatttgtatgctcaattattttgcattttttctttttccccaataaattgttgtgtgtgctttctaaataataataaaacaacagggtttttttccagaa

SEQ ID NO: 12296 - DNA, 3624 bp, Homo sapiens
agaagccggaacgtggctccgctcccagttaacctgctggagctcatcaggcttgctcagagcccctgcaccaactcaccctgtaccctctctccttcttcgttagtcttctttcccccttttccctcctctgtctgtgcctatcccccgacttttgcatctgaccaaaggacgaatgagggagacgttcctgcagatcggggcagcaactttcctcagctggtctctgggctccgggagccagagagcgctgatcctccgcggtctgcggcccatggaagaggaggaggaggagccgtgatgggctagcgacagcactgaggagccccgagagagctcagccttgccagccagctccgcggtcccacgcgggttccctcgagctcgctccgtggggagcgcgcagcgtgcttggaaccggagcatccagagaggatgaggcggggacccggcccaagttgggtgcatctctcgggcgtccggcagcggctgtatctcggcatgaattaagaagctaggaagatggagcacggcacactcctcgcccagcccgggctctggaccagggacaccagctgggcactcctctatttcctctgctatatcctccctcagaccgccccgcaagtactcaggatcggagggatttttgaaacagtggaaaatgagcctgttaatgttgaagaattagctttcaagtttgcagtcaccagcattaacagaaaccgaaccctgatgcctaacaccacattaacctatgacatccagagaattaacctttttgatagttttgaagcctcgcggagagcatgtgaccagctggctcttggtgtggctgctctctttggcccttcccatagctcctccgtcagtgctgtgcagtctatttgcaatgctctcgaagttccacacatacagacccgctggaaacacccctcggtggacaacaaagatttgttttacatcaacctttacccagattatgcagctatcagcagggcgatcctggatctggtcctctattacaactggaaaacagtgacagtggtgtatgaagacagcacaggtctaattcgtctacaagagctcatcaaagctccctccagatataatattaaaatcaaaatccgccagctgccctctgggaataaagatgccaagcctttactcaaggagatgaagaaaggcaaggagttctatgtgatatttgattgttcacatgaaacagccgctgaaatccttaagcagattctgttcatgggcatgatgaccgagtactatcactactttttcacaaccctggacttatttgctttggatctggaactctataggtacagtggcgtaaacatgaccgggtttcggctgcttaacattgacaaccctcacgtgtcatccatcattgagaagtggtccatggagagactgcaggccccacccaggcccgagactggccttttggatggcatgatgacaactgaagcggctctgatgtacgatgctgtgtacatggtggccattgcctcgcaccgggcatcccagctgaccgtcagctccctgcagtgccatagacataagccatggcgcctcggacccagatttatgaacctgatcaaagaggcccggtgggatggcttgactgggcatatcacctttaataaaaccaatggcttgaggaaggattttgatctggacattattagtctcaaagaggaaggaactgaaaagattgggatttggaattccaacagtgggcttaacatgacggacagcaacaaagacaagtccagcaatatcactgattcattggccaacagaacactcattgtcaccaccattctggaagaaccctatgttatgtacaggaaatctgataagcctctatatggaaatgacagatttgaaggatattgcctagacctgttgaaagaattgtcaaacatcctgggtttcatttatgatgttaaactagttcccgatggcaaatatggggcccagaatgacaaaggggagtggaacgggatggttaaagaactcatagatcacagggctgacctggcagtggctcctcttaccatcacctacgtgcgggagaaagtcattgacttctccaaacccttcatgaccctaggcatcagcattctctaccggaagcccaatggtaccaatccaggcgttttctccttcctcaaccccctgtctccagatatttggatgtatgtgctcttagcctgcttgggagtcagctgtgtactctttgtgattgcaaggtttacaccctacgagtggtataacccccacccatgcaaccctgactcagacgtggtggaaaacaattttactttactaaatagtttctggtttggagttggagctctcatgcagcaaggatcagagctgatgcccaaagctctatcgaccagaatagttggagggatatggtggtttttcaccctaatcatcatttcatcctacacggccaatctggctgccttcttgacagtagagagaatggaatcccccatagattcggcagatgatctggcaaagcaaaccaagatagaatatggggcggttagagatggatcaacaatgaccttcttcaagaaatcaaaaatctccacctatgagaagatgtgggctttcatgagcagcaggcagcagaccgccctggtaagaaacagtgatgaggggatccagagagtgctcaccacagactacgcgctgctgatggagtccaccagcattgagtatgtgacgcagagaaactgcaacctcactcagatcgggggcctcattgactccaaaggttacggagtgggaacacctattggttctccttaccgggataaaattactattgctattcttcaactccaagaagaagggaagctgcatatgatgaaagagaagtggtggcgtgggaatggctgccccgaggaagacaacaaagaagccagtgccctgggagtggaaaatattggaggcatcttcattgttctggctgccggactggtcctttctgtatttgtagctattggagaattcatatacaaatcacggaagaataatgatattgaacagaaaggaaagtcatcaagaattagattttattttaggaacaaagtaaggtttcatgggagaaaaaaacaaagccttggtgtagagaagtgtctctctttcaacgctatcatggaagaactgggaatctcactgaagaatcagaaaaaaataaagaaaaagtcaagaactaaggggaaatcttccttcacaagtatccttacttgtcatcagagacgaactcagagaaaagagactgtggcgtgatccaaggaaacgcctgtaggaagaaaaaggatgcattccctacagatttttggagaaaggatttctgaggagtgtgtgatgtgtttccatatatctatatccataactctgattatgaatacagatataagaaatacaaaagtttaaaaagctcacatagatatgacttgggaagtgacaccagttcttttaaaataaatttgtatgctcaattattttgcattttttctttttccccaataaattgttgtgtgtgctttctaaataataataaaacaacagggtttttttccagaa

SEQ ID NO: 12297 - DNA, 2769 bp, Homo sapiens
atggagcacggcacactcctcgcccagcccgggctctggaccagggacaccagctgggcactcctctatttcctctgctatatcctccctcagaccgccccgcaagtactcaggatcggagggatttttgaaacagtggaaaatgagcctgttaatgttgaagaattagctttcaagtttgcagtcaccagcattaacagaaaccgaaccctgatgcctaacaccacattaacctatgacatccagagaattaacctttttgatagttttgaagcctcgcggagagcatgtgaccagctggctcttggtgtggctgctctctttggcccttcccatagctcctccgtcagtgctgtgcagtctatttgcaatgctctcgaagttccacacatacagacccgctggaaacacccctcggtggacaacaaagatttgttttacatcaacctttacccagattatgcagctatcagcagggcgatcctggatctggtcctctattacaactggaaaacagtgacagtggtgtatgaagacagcacaggtctaattcgtctacaagagctcatcaaagctccctccagatataatattaaaatcaaaatccgccagctgccctctgggaataaagatgccaagcctttactcaaggagatgaagaaaggcaaggagttctatgtgatatttgattgttcacatgaaacagccgctgaaatccttaagcagattctgttcatgggcatgatgaccgagtactatcactactttttcacaaccctggacttatttgctttggatctggaactctataggtacagtggcgtaaacatgaccgggtttcggctgcttaacattgacaaccctcacgtgtcatccatcattgagaagtggtccatggagagactgcaggccccacccaggcccgagactggccttttggatggcatgatgacaactgaagcggctctgatgtacgatgctgtgtacatggtggccattgcctcgcaccgggcatcccagctgaccgtcagctccctgcagtgccatagacataagccatggcgcctcggacccagatttatgaacctgatcaaagaggcaactgcccggtgggatggcttgactgggcatatcacctttaataaaaccaatggcttgaggaaggattttgatctggacattattagtctcaaagaggaaggaactgaaaaggctgctggcgaagtgtctaaacacttgtataaagtgtggaagaagattgggatttggaattccaacagtgggcttaacatgacggacagcaacaaagacaagtccagcaatatcactgattcattggccaacagaacactcattgtcaccaccattctggaagaaccctatgttatgtacaggaaatctgataagcctctatatggaaatgacagatttgaaggatattgcctagacctgttgaaagaattgtcaaacatcctgggtttcatttatgatgttaaactagttcccgatggcaaatatggggcccagaatgacaaaggggagtggaacgggatggttaaagaactcatagatcacagggctgacctggcagtggctcctcttaccatcacctacgtgcgggagaaagtcattgacttctccaaacccttcatgaccctaggcatcagcattctctaccggaagcccaatggtaccaatccaggcgttttctccttcctcaaccccctgtctccagatatttggatgtatgtgctcttagcctgcttgggagtcagctgtgtactctttgtgattgcaaggtttacaccctacgagtggtataacccccacccatgcaaccctgactcagacgtggtggaaaacaattttactttactaaatagtttctggtttggagttggagctctcatgcagcaaggatcagagctgatgcccaaagctctatcgaccagaatagttggagggatatggtggtttttcaccctaatcatcatttcatcctacacggccaatctggctgccttcttgacagtagagagaatggaatcccccatagattcggcagatgatctggcaaagcaaaccaagatagaatatggggcggttagagatggatcaacaatgaccttcttcaagaaatcaaaaatctccacctatgagaagatgtgggctttcatgagcagcaggcagcagaccgccctggtaagaaacagtgatgaggggatccagagagtgctcaccacagactacgcgctgctgatggagtccaccagcattgagtatgtgacgcagagaaactgcaacctcactcagatcgggggcctcattgactccaaaggttacggagtgggaacacctattggttctccttaccgggataaaattactattgctattcttcaactccaagaagaagggaagctgcatatgatgaaagagaagtggtggcgtgggaatggctgccccgaggaagacaacaaagaagccagtgccctgggagtggaaaatattggaggcatcttcattgttctggctgccggactggtcctttctgtatttgtagctattggagaattcatatacaaatcacggaagaataatgatattgaacagtgtctctctttcaacgctatcatggaagaactgggaatctcactgaagaatcagaaaaaaataaagaaaaagtcaagaactaaggggaaatcttccttcacaagtatccttacttgtcatcagagacgaactcagagaaaagagactgtggcgtga

SEQ ID NO: 12298 - DNA, 2244 bp, Homo sapiens
atggagcacggcacactcctcgcccagcccgggctctggaccagggacaccagctgggcactcctctatttcctctgctatatcctccctcagaccgccccgcaagtactcaggatcgcatgtgaccagctggctcttggtgtggctgctctctttggcccttcccatagctcctccgtcagtgctgtgcagtctatttgcaatgctctcgaagttccacacatacagacccgctggaaacacccctcggtggacaacaaagatttgttttacatcaacctttacccagattatgcagctatcagcagggcgatcctggatctggtcctctattacaactggaaaacagtgacagtggtgtatgaagacagcacaggtctaattcgtctacaagagctcatcaaagctccctccagatataatattaaaatcaaaatccgccagctgccctctgggaataaagatgccaagcctttactcaaggagatgaagaaaggcaaggagttctatgtgatatttgattgttcacatgaaacagccgctgaaatccttaagcagattctgttcatgggcatgatgaccgagtactatcactactttttcacaaccctggacttatttgctttggatctggaactctataggtacagtggcgtaaacatgaccgggtttcggctgcttaacattgacaaccctcacgtgtcatccatcattgagaagtggtccatggagagactgcaggccccacccaggcccgagactggccttttggatggcatgatgacaactgaagcggctctgatgtacgatgctgtgtacatggtggccattgcctcgcaccgggcatcccagctgaccgtcagctccctgcagtgccatagacataagccatggcgcctcggacccagatttatgaacctgatcaaagaggcccggtgggatggcttgactgggcatatcacctttaataaaaccaatggcttgaggaaggattttgatctggacattattagtctcaaagaggaaggaactgaaaagattgggatttggaattccaacagtgggcttaacatgacggacagcaacaaagacaagtccagcaatatcactgattcattggccaacagaacactcattgtcaccaccattctgagggctgacctggcagtggctcctcttaccatcacctacgtgcgggagaaagtcattgacttctccaaacccttcatgaccctaggcatcagcattctctaccggaagcccaatggtaccaatccaggcgttttctccttcctcaaccccctgtctccagatatttggatgtatgtgctcttagcctgcttgggagtcagctgtgtactctttgtgattgcaaggtttacaccctacgagtggtataacccccacccatgcaaccctgactcagacgtggtggaaaacaattttactttactaaatagtttctggtttggagttggagctctcatgcagcaaggatcagagctgatgcccaaagctctatcgaccagaatagttggagggatatggtggtttttcaccctaatcatcatttcatcctacacggccaatctggctgccttcttgacagtagagagaatggaatcccccatagattcggcagatgatctggcaaagcaaaccaagatagaatatggggcggttagagatggatcaacaatgaccttcttcaagaaatcaaaaatctccacctatgagaagatgtgggctttcatgagcagcaggcagcagaccgccctggtaagaaacagtgatgaggggatccagagagtgctcaccacagactacgcgctgctgatggagtccaccagcattgagtatgtgacgcagagaaactgcaacctcactcagatcgggggcctcattgactccaaaggttacggagtgggaacacctattggttctccttaccgggataaaattactattgctattcttcaactccaagaagaagggaagctgcatatgatgaaagagaagtggtggcgtgggaatggctgccccgaggaagacaacaaagaagccagtgccctgggagtggaaaatattggaggcatcttcattgttctggctgccggactggtcctttctgtatttgtagctattggagaattcatatacaaatcacggaagaataatgatattgaacagtgtctctctttcaacgctatcatggaagaactgggaatctcactgaagaatcag

SEQ ID NO: 12299 - DNA, 2610 bp, Homo sapiens
atgaagattattttcccgattctaagtaatccagtcttcaggcgcaccgttaaactcctgctctgtttactgtggattggatattctcaaggaaccacacatgtattaagatttggtggtatttttgaatatgtggaatctggcccaatgggagctgaggaacttgcattcagatttgctgtgaacacaattaacagaaacagaacattgctacccaatactacccttacctatgatacccagaagataaacctttatgatagttttgaagcatccaagaaagcctgtgatcagctgtctcttggggtggctgccatcttcgggccttcacacagctcatcagcaaacgcagtgcagtccatctgcaatgctctgggagttccccacatacagacccgctggaagcaccaggtgtcagacaacaaagattccttctatgtcagtctctacccagacttctcttcactcagccgtgccattttagacctggtgcagtttttcaagtggaaaaccgtcacggttgtgtatgatgacagcactggtctcattcgtttgcaagagctcatcaaagctccatcaaggtataatcttcgactcaaaattcgtcagttacctgctgatacaaaggatgcaaaacccttactaaaagaaatgaaaagaggcaaggagtttcatgtaatctttgattgtagccatgaaatggcagcaggcattttaaaacaggcattagctatgggaatgatgacagaatactatcattatatctttaccactctggacctctttgctcttgatgttgagccctaccgatacagtggtgttaacatgacagggttcagaatattaaatacagaaaatacccaagtctcctccatcattgaaaagtggtcgatggaacgattgcaggcacctccgaaacccgattcaggtttgctggatggatttatgacgactgatgctgctctaatgtatgatgctgtgcatgtggtgtctgtggccgttcaacagtttccccagatgacagtcagttccttgcagtgtaatcgacataaaccctggcgcttcgggacccgctttatgagtctaattaaagaggcacattgggaaggcctcacaggcagaataactttcaacaaaaccaatggcttgagaacagattttgatttggatgtgatcagtctgaaggaagaaggtctagaaaagattggaacgtgggatccagccagtggcctgaatatgacagaaagtcaaaagggaaagccagcgaacatcacagattccttatccaatcgttctttgattgttaccaccattttggaagagccttatgtcctttttaagaagtctgacaaacctctctatggtaatgatcgatttgaaggctattgcattgatctcctcagagagttatctacaatccttggctttacatatgaaattagacttgtggaagatgggaaatatggagcccaggatgatgccaatggacaatggaatggaatggttcgtgaactaattgatcataaagctgaccttgcagttgctccactggctattacctatgttcgagagaaggtcatcgacttttccaagccctttatgacacttggaataagtattttgtaccgcaagcccaatggtacaaacccaggcgtcttctccttcctgaatcctctctcccctgatatctggatgtatattctgctggcttacttgggtgtcagttgtgtgctctttgtcatagccaggtttagtccttatgagtggtataatccacacccttgcaaccctgactcagacgtggtggaaaacaattttaccttgctaaatagtttctggtttggagttggagctctcatgcagcaaggttctgagctcatgcccaaagcactgtccaccaggatagtgggaggcatttggtggtttttcacacttatcatcatttcttcgtatactgctaacttagccgcctttctgacagtggaacgcatggaatcccctattgactctgctgatgatttagctaaacaaaccaagatagaatatggagcagtagaggatggtgcaaccatgacttttttcaagaaatcaaaaatctccacgtatgacaaaatgtgggcctttatgagtagcagaaggcagtcagtgctggtcaaaagtaatgaagaaggaatccagcgagtcctcacctctgattatgctttcctaatggagtcaacaaccatcgagtttgttacccagcggaactgtaacctgacacagattggcggccttatagactctaaaggttatggcgttggcactcccatgggttctccatatcgagacaaaattaccatagcaattcttcagctgcaagaggaaggcaaactgcatatgatgaaggagaaatggtggaggggcaatggttgcccagaagaggagagcaaagaggccagtgccctgggggttcagaatattggtggcatcttcattgttctggcagccggcttggtgctttcagtttttgtggcagtgggagaatttttatacaaatccaaaaaaaacgctcaattggaaaaggaatcttctatttggttagtgccaccataccatccagacactgtttag

SEQ ID NO: 12300 - DNA, 2840 bp, Homo sapiens
agcaattggcaaatccagaatgttaaacccggtctagctccaaataaatgttatatataagggtagagagtaaagaagaataccactgttcttctccacatacacagaaggaatctaggtggtatttttgaatatgtggaatctggcccaatgggagctgaggaacttgcattcagatttgctgtgaacacaattaacagaaacagaacattgctacccaatactacccttacctatgatacccagaagataaacctttatgatagttttgaagcatccaagaaagcctgtgatcagctgtctcttggggtggctgccatcttcgggccttcacacagctcatcagcaaacgcagtgcagtccatctgcaatgctctgggagttccccacatacagacccgctggaagcaccaggtgtcagacaacaaagattccttctatgtcagtctctacccagacttctcttcactcagccgtgccattttagacctggtgcagtttttcaagtggaaaaccgtcacggttgtgtatgatgacagcactggtctcattcgtttgcaagagctcatcaaagctccatcaaggtataatcttcgactcaaaattcgtcagttacctgctgatacaaaggatgcaaaacccttactaaaagaaatgaaaagaggcaaggagtttcatgtaatctttgattgtagccatgaaatggcagcaggcattttaaaacaggcattagctatgggaatgatgacagaatactatcattatatctttaccactctggacctctttgctcttgatgttgagccctaccgatacagtggtgttaacatgacagggttcagaatattaaatacagaaaatacccaagtctcctccatcattgaaaagtggtcgatggaacgattgcaggcacctccgaaacccgattcaggtttgctggatggatttatgacgactgatgctgctctaatgtatgatgctgtgcatgtggtgtctgtggccgttcaacagtttccccagatgacagtcagttccttgcagtgtaatcgacataaaccctggcgcttcgggacccgctttatgagtctaattaaagaggcacattgggaaggcctcacaggcagaataactttcaacaaaaccaatggcttgagaacagattttgatttggatgtgatcagtctgaaggaagaaggtctagaaaagattggaacgtgggatccagccagtggcctgaatatgacagaaagtcaaaagggaaagccagcgaacatcacagattccttatccaatcgttctttgattgttaccaccattttggaagagccttatgtcctttttaagaagtctgacaaacctctctatggtaatgatcgatttgaaggctattgcattgatctcctcagagagttatctacaatccttggctttacatatgaaattagacttgtggaagatgggaaatatggagcccaggatgatgccaatggacaatggaatggaatggttcgtgaactaattgatcataaagctgaccttgcagttgctccactggctattacctatgttcgagagaaggtcatcgacttttccaagccctttatgacacttggaataagtattttgtaccgcaagcccaatggtacaaacccaggcgtcttctccttcctgaatcctctctcccctgatatctggatgtatattctgctggcttacttgggtgtcagttgtgtgctctttgtcatagccaggtttagtccttatgagtggtataatccacacccttgcaaccctgactcagacgtggtggaaaacaattttaccttgctaaatagtttctggtttggagttggagctctcatgcagcaaggttctgagctcatgcccaaagcactgtccaccaggatagtgggaggcatttggtggtttttcacacttatcatcatttcttcgtatactgctaacttagccgcctttctgacagtggaacgcatggaatcccctattgactctgctgatgatttagctaaacaaaccaagatagaatatggagcagtagaggatggtgcaaccatgacttttttcaagaaatcaaaaatctccacgtatgacaaaatgtgggcctttatgagtagcagaaggcagtcagtgctggtcaaaagtaatgaagaaggaatccagcgagtcctcacctctgattatgctttcctaatggagtcaacaaccatcgagtttgttacccagcggaactgtaacctgacacagattggcggccttatagactctaaaggttatggcgttggcactcccatgggttctccatatcgagacaaaattaccatagcaattcttcagctgcaagaggaaggcaaactgcatatgatgaaggagaaatggtggaggggcaatggttgcccagaagaggagagcaaagaggccagtgccctgggggttcagaatattggtggcatcttcattgttctggcagccggcttggtgctttcagtttttgtggcagtgggagaatttttatacaaatccaaaaaaaacgctcaattggaaaagaggtccttctgtagtgccatggtagaagaattgaggatgtccctgaagtgccagcgtcggttaaaacataagccacaggccccagttattgtgaaaacagaagaagttatcaacatgcacacatttaacgacagaaggttgccaggtaaagaaaccatggcataaagctgggaggccaaacacccaagcacaaactgtcgtctttttccaaacaatttagccagaatgtttcctgtggaaatatgcaacctgtgcaaaataaaatgagttacctc

SEQ ID NO: 12301 - DNA, 2499 bp, Homo sapiens
atgaagattattttcccgattctaagtaatccagtcttcaggcgcaccgttaaactcctgctctgtttactgtggattggatattctcaaggaaccacacatgtattaagatttggtggtatttttgaatatgtggaatctggcccaatgggagctgaggaacttgcattcagatttgctgtgaacacaattaacagaaacagaacattgctacccaatactacccttacctatgatacccagaagataaacctttatgatagttttgaagcatccaagaaagcctgtgatcagctgtctcttggggtggctgccatcttcgggccttcacacagctcatcagcaaacgcagtgcagtccatctgcaatgctctgggagttccccacatacagacccgctggaagcaccaggtgtcagacaacaaagattccttctatgtcagtctctacccagacttctcttcactcagccgtgccattttagacctggtgcagtttttcaagtggaaaaccgtcacggttgtgtatgatgacagcactggtctcattcgtttgcaagagctcatcaaagctccatcaaggtataatcttcgactcaaaattcgtcagttacctgctgatacaaaggatgcaaaacccttactaaaagaaatgaaaagaggcaaggagtttcatgtaatctttgattgtagccatgaaatggcagcaggcattttaaaacaggcattagctatgggaatgatgacagaatactatcattatatctttaccactctggacctctttgctcttgatgttgagccctaccgatacagtggtgttaacatgacagggttcagaatattaaatacagaaaatacccaagtctcctccatcattgaaaagtggtcgatggaacgattgcaggcacctccgaaacccgattcaggtttgctggatggatttatgacgactgatgctgctctaatgtatgatgctgtgcatgtggtgtctgtggccgttcaacagtttccccagatgacagtcagttccttgcagtgtaatcgacataaaccctggcgcttcgggacccgctttatgagtctaattaaagaggcacattgggaaggcctcacaggcagaataactttcaacaaaaccaatggcttgagaacagattttgatttggatgtgatcagtctgaaggaagaaggtctagaaaagattggaacgtgggatccagccagtggcctgaatatgacagaaagtcaaaagggaaagccagcgaacatcacagattccttatccaatcgttctttgattgttaccaccattttggaagagccttatgtcctttttaagaagtctgacaaacctctctatggtaatgatcgatttgaaggctattgcattgatctcctcagagagttatctacaatccttggctttacatatgaaattagacttgtggaagatgggaaatatggagcccaggatgatgccaatggacaatggaatggaatggttcgtgaactaattgatcataaagctgaccttgcagttgctccactggctattacctatgttcgagagaaggtcatcgacttttccaagccctttatgacacttggaataagtattttgtaccgcaagcccaatggttctgagctcatgcccaaagcactgtccaccaggatagtgggaggcatttggtggtttttcacacttatcatcatttcttcgtatactgctaacttagccgcctttctgacagtggaacgcatggaatcccctattgactctgctgatgatttagctaaacaaaccaagatagaatatggagcagtagaggatggtgcaaccatgacttttttcaagaaatcaaaaatctccacgtatgacaaaatgtgggcctttatgagtagcagaaggcagtcagtgctggtcaaaagtaatgaagaaggaatccagcgagtcctcacctctgattatgctttcctaatggagtcaacaaccatcgagtttgttacccagcggaactgtaacctgacacagattggcggccttatagactctaaaggttatggcgttggcactcccatgggttctccatatcgagacaaaattaccatagcaattcttcagctgcaagaggaaggcaaactgcatatgatgaaggagaaatggtggaggggcaatggttgcccagaagaggagagcaaagaggccagtgccctgggggttcagaatattggtggcatcttcattgttctggcagccggcttggtgctttcagtttttgtggcagtgggagaatttttatacaaatccaaaaaaaacgctcaattggaaaagaggtccttctgtagtgccatggtagaagaattgaggatgtccctgaagtgccagcgtcggttaaaacataagccacaggccccagttattgtgaaaacagaagaagttatcaacatgcacacatttaacgacagaaggttgccaggtaaagaaaccatggcataa

SEQ ID NO: 12302 - DNA, 4921 bp, Homo sapiens
ggagagcagctatctcagtctttctcacttaatcttggcttcacgtcagaagctgtgcagcagtgcagtagaatagggcctggcaaaacctttgctagcaaagcgccttttgtgccgggctgtggctcgctatcgacatctcgtccgttaccaaggctgggtttcctactgatttccctcctcctctgctttcacaggctcgcgcggccggacattgtgggtgtgcgtgctggatttctcccggatgctctccgactaacatggatgtcccaccattccttgcagtggaaggttgttccttggcgcagtgagtgaagaacatgcagcgattgctaatgggtttgggaagcggagactccttcctctctctatgaccatgccgtgatcgtgtctgcggtcaccactcgacgcatcctcatttctacccgaacccaggagccgaacgctagatcggggaagtgggtgccgtgcgtgtgggcacagaaacaccatgaagattattttcccgattctaagtaatccagtcttcaggcgcaccgttaaactcctgctctgtttactgtggattggatattctcaaggaaccacacatgtattaagatttggtggtatttttgaatatgtggaatctggcccaatgggagctgaggaacttgcattcagatttgctgtgaacacaattaacagaaacagaacattgctacccaatactacccttacctatgatacccagaagataaacctttatgatagttttgaagcatccaagaaagcctgtgatcagctgtctcttggggtggctgccatcttcgggccttcacacagctcatcagcaaacgcagtgcagtccatctgcaatgctctgggagttccccacatacagacccgctggaagcaccaggtgtcagacaacaaagattccttctatgtcagtctctacccagacttctcttcactcagccgtgccattttagacctggtgcagtttttcaagtggaaaaccgtcacggttgtgtatgatgacagcactggtctcattcgtttgcaagagctcatcaaagctccatcaaggtataatcttcgactcaaaattcgtcagttacctgctgatacaaaggatgcaaaacccttactaaaagaaatgaaaagaggcaaggagtttcatgtaatctttgattgtagccatgaaatggcagcaggcattttaaaacaggcattagctatgggaatgatgacagaatactatcattatatctttaccactctggacctctttgctcttgatgttgagccctaccgatacagtggtgttaacatgacagggttcagaatattaaatacagaaaatacccaagtctcctccatcattgaaaagtggtcgatggaacgattgcaggcacctccgaaacccgattcaggtttgctggatggatttatgacgactgatgctgctctaatgtatgatgctgtgcatgtggtgtctgtggccgttcaacagtttccccagatgacagtcagttccttgcagtgtaatcgacataaaccctggcgcttcgggacccgctttatgagtctaattaaagaggcacattgggaaggcctcacaggcagaataactttcaacaaaaccaatggcttgagaacagattttgatttggatgtgatcagtctgaaggaagaaggtctagaaaagattggaacgtgggatccagccagtggcctgaatatgacagaaagtcaaaagggaaagccagcgaacatcacagattccttatccaatcgttctttgattgttaccaccattttggaagagccttatgtcctttttaagaagtctgacaaacctctctatggtaatgatcgatttgaaggctattgcattgatctcctcagagagttatctacaatccttggctttacatatgaaattagacttgtggaagatgggaaatatggagcccaggatgatgccaatggacaatggaatggaatggttcgtgaactaattgatcataaagctgaccttgcagttgctccactggctattacctatgttcgagagaaggtcatcgacttttccaagccctttatgacacttggaataagtattttgtaccgcaagcccaatggtacaaacccaggcgtcttctccttcctgaatcctctctcccctgatatctggatgtatattctgctggcttacttgggtgtcagttgtgtgctctttgtcatagccaggtttagtccttatgagtggtataatccacacccttgcaaccctgactcagacgtggtggaaaacaattttaccttgctaaatagtttctggtttggagttggagctctcatgcagcaaggttctgagctcatgcccaaagcactgtccaccaggatagtgggaggcatttggtggtttttcacacttatcatcatttcttcgtatactgctaacttagccgcctttctgacagtggaacgcatggaatcccctattgactctgctgatgatttagctaaacaaaccaagatagaatatggagcagtagaggatggtgcaaccatgacttttttcaagaaatcaaaaatctccacgtatgacaaaatgtgggcctttatgagtagcagaaggcagtcagtgctggtcaaaagtaatgaagaaggaatccagcgagtcctcacctctgattatgctttcctaatggagtcaacaaccatcgagtttgttacccagcggaactgtaacctgacacagattggcggccttatagactctaaaggttatggcgttggcactcccatgggttctccatatcgagacaaaattaccatagcaattcttcagctgcaagaggaaggcaaactgcatatgatgaaggagaaatggtggaggggcaatggttgcccagaagaggagagcaaagaggccagtgccctgggggttcagaatattggtggcatcttcattgttctggcagccggcttggtgctttcagtttttgtggcagtgggagaatttttatacaaatccaaaaaaaacgctcaattggaaaagagagccaagactaagttacctcaagactatgtattcctccctattttggagtcagtttccatttctacagtgttgtcatcatcaccatcttcatcatcattatcatcatgttcttaataagtacatctaataaggtccttctgtagtgccatggtagaagaattgaggatgtccctgaagtgccagcgtcggttaaaacataagccacaggccccagttattgtgaaaacagaagaagttatcaacatgcacacatttaacgacagaaggttgccaggtaaagaaaccatggcataaagctgggaggccaaacacccaagcacaaactgtcgtctttttccaaacaatttagccagaatgtttcctgtggaaatatgcaacctgtgcaaaataaaatgagttacctcatgccgctgtgtctatgaactagagactctgtgatctaagcagttgcaatgatcagacttgatttacaagcatcatggatcaaccaagttacacggggttacactgttaatcatgggttcctcccttcttctgagtgaatgttaacatgcgcattttgtggctgatttcaaatgcagtccagtgagaaattacaggttccttttgaagctcaactgttgccaggagatggaatatcaatgcccaacagggcaaccaataaaagtgtcactaagaatataaatatttggaatcagcaaaaactgtagtgttacaggaaacagtacagtcttctgaacacccagatcatagaggtgatgatgttactagcccccaactactcagtataattattgtctgaatgcaaagtatgtgtttataggatgtgaaaaaatgtaatgcaaaacaaatttgaatcccatggcagttggaatataaagcagatgttcatcacttattttccttttttcttttcttatttttttttttgacagtctgtgtcactgattgagatagaaatgccaattatcaaggaaataatgttttcttaagttccctaaggcagaagatttaacatgcaattctaccagatcccttcctattcccccaacaccttttctctaacccccatatcccaaataataataataataataataataataataataataataataaaagcagttggttcagtgattctgaattaaaaggataatgttttgcaatgttcaagttgtaaaaactggccgagtattggctgtgtggaagactaaagctttcattctaacattcagacatagcaatccaaacccttgttcctgctgtaaatgaacttgatggagcatgggcagatttcagtgatacgagaaaggggactggtcatctatagaaaaatctgtgagagaacttggaagtggactgcgtttatcaatacagtcacaatgttaaatgaacaaaattcttgaacagttttttttcaaaaaatgttcaggtttatttgtggaaatgcaagatttctatgaaaatagtttttgtatggaaatttttgtaatactttttatcaacaaaacaagaacatgtgttcctgtcaggggtgtgatgtcaagcatgaatggtagtgcgtgtgcaccaccaacgtttggtgaaaactatttttatcaagaaaaaaggaatcatagaagagaaatattttcaagttagataatataaaagctaggtgcactaccaccactgcttaccatgccacacccctggtttccacgaggctgacaacatactgtaatgaacaattgtgtgtaaaatggtaaaagacacagacctcttgacaacattgtgataacagttgagtgcacacagtttgctgtttgaatccaatgcacaaaattaaaaaaaatcattaaaactatgttcattttactttca

SEQ ID NO: 12303 - DNA, 1752 bp, Homo sapiens
atgaagattattttcccgattctaagtaatccagtcttcaggcgcaccgttaaactcctgctctgtttactgtggattggatattctcaaggaaccacacatgtattaagatttggtggtatttttgaatatgtggaatctggcccaatgggagctgaggaacttgcattcagatttgctgtgaacacaattaacagaaacagaacattgctacccaatactacccttacctatgatacccagaagataaacctttatgatagttttgaagcatccaagaaagcctgtgatcagctgtctcttggggtggctgccatcttcgggccttcacacagctcatcagcaaacgcagtgcagtccatctgcaatgctctgggagttccccacatacagacccgctggaagcaccaggtgtcagacaacaaagattccttctatgtcagtctctacccagacttctcttcactcagccgtgccattttagacctggtgcagtttttcaagtggaaaaccgtcacggttgtgtatgatgacagcactggtctcattcgtttgcaagagctcatcaaagctccatcaaggtataatcttcgactcaaaattcgtcagttacctgctgatacaaaggatgcaaaacccttactaaaagaaatgaaaagaggcaaggagtttcatgtaatctttgattgtagccatgaaatggcagcaggcattttaaaacaggcattagctatgggaatgatgacagaatactatcattatatctttaccactctggacctctttgctcttgatgttgagccctaccgatacagtggtgttaacatgacagggttcagaatattaaatacagaaaatacccaagtctcctccatcattgaaaagtggtcgatggaacgattgcaggcacctccgaaacccgattcaggtttgctggatggatttatgacgactgatgctgctctaatgtatgatgctgtgcatgtggtgtctgtggccgttcaacagtttccccagatgacagtcagttccttgcagtgtaatcgacataaaccctggcgcttcgggacccgctttatgagtctaattaaagaggcacattgggaaggcctcacaggcagaataactttcaacaaaaccaatggcttgagaacagattttgatttggatgtgatcagtctgaaggaagaaggtctagaaaagattggaacgtgggatccagccagtggcctgaatatgacagaaagtcaaaagggaaagccagcgaacatcacagattccttatccaatcgttctttgattgttaccaccattttggaagagccttatgtcctttttaagaagtctgacaaacctctctatggtaatgatcgatttgaaggctattgcattgatctcctcagagagttatctacaatccttggctttacatatgaaattagacttgtggaagatgggaaatatggagcccaggatgatgccaatggacaatggaatggaatggttcgtgaactaattgatcataaagctgaccttgcagttgctccactggctattacctatgttcgagagaaggtcatcgacttttccaagccctttatgacacttggaataagtattttgtaccgcaagcccaatggtacaaacccaggcgtcttctccttcctgaatcctctctcccctgatatctggatgtatattctgctggcttacttgggtgtcagttgtgtgctctttgtcatagccagattt

SEQ ID NO: 12304 - DNA, 4876 bp, Homo sapiens
ggagagcagctatctcagtctttctcacttaatcttggcttcacgtcagaagctgtgcagcagtgcagtagaatagggcctggcaaaacctttgctagcaaagcgccttttgtgccgggctgtggctcgctatcgacatctcgtccgttaccaaggctgggtttcctactgatttccctcctcctctgctttcacaggctcgcgcggccggacattgtgggtgtgcgtgctggatttctcccggatgctctccgactaacatggatgtcccaccattccttgcagtggaaggttgttccttggcgcagtgagtgaagaacatgcagcgattgctaatgggtttgggaagcggagactccttcctctctctatgaccatgccgtgatcgtgtctgcggtcaccactcgacgcatcctcatttctacccgaacccaggagccgaacgctagatcggggaagtgggtgccgtgcgtgtgggcacagaaacaccatgaagattattttcccgattctaagtaatccagtcttcaggcgcaccgttaaactcctgctctgtttactgtggattggatattctcaaggaaccacacatgtattaagatttggtggtatttttgaatatgtggaatctggcccaatgggagctgaggaacttgcattcagatttgctgtgaacacaattaacagaaacagaacattgctacccaatactacccttacctatgatacccagaagataaacctttatgatagttttgaagcatccaagaaagcctgtgatcagctgtctcttggggtggctgccatcttcgggccttcacacagctcatcagcaaacgcagtgcagtccatctgcaatgctctgggagttccccacatacagacccgctggaagcaccaggtgtcagacaacaaagattccttctatgtcagtctctacccagacttctcttcactcagccgtgccattttagacctggtgcagtttttcaagtggaaaaccgtcacggttgtgtatgatgacagcactggtctcattcgtttgcaagagctcatcaaagctccatcaaggtataatcttcgactcaaaattcgtcagttacctgctgatacaaaggatgcaaaacccttactaaaagaaatgaaaagaggcaaggagtttcatgtaatctttgattgtagccatgaaatggcagcaggcattttaaaacaggcattagctatgggaatgatgacagaatactatcattatatctttaccactctggacctctttgctcttgatgttgagccctaccgatacagtggtgttaacatgacagggttcagaatattaaatacagaaaatacccaagtctcctccatcattgaaaagtggtcgatggaacgattgcaggcacctccgaaacccgattcaggtttgctggatggatttatgacgactgatgctgctctaatgtatgatgctgtgcatgtggtgtctgtggccgttcaacagtttccccagatgacagtcagttccttgcagtgtaatcgacataaaccctggcgcttcgggacccgctttatgagtctaattaaagaggcacattgggaaggcctcacaggcagaataactttcaacaaaaccaatggcttgagaacagattttgatttggatgtgatcagtctgaaggaagaaggtctagaaaagattggaacgtgggatccagccagtggcctgaatatgacagaaagtcaaaagggaaagccagcgaacatcacagattccttatccaatcgttctttgattgttaccaccattttggaagagccttatgtcctttttaagaagtctgacaaacctctctatggtaatgatcgatttgaaggctattgcattgatctcctcagagagttatctacaatccttggctttacatatgaaattagacttgtggaagatgggaaatatggagcccaggatgatgccaatggacaatggaatggaatggttcgtgaactaattgatcataaagctgaccttgcagttgctccactggctattacctatgttcgagagaaggtcatcgacttttccaagccctttatgacacttggaataagtattttgtaccgcaagcccaatggtacaaacccaggcgtcttctccttcctgaatcctctctcccctgatatctggatgtatattctgctggcttacttgggtgtcagttgtgtgctctttgtcatagccaggtttagtccttatgagtggtataatccacacccttgcaaccctgactcagacgtggtggaaaacaattttaccttgctaaatagtttctggtttggagttggagctctcatgcagcaaggttctgagctcatgcccaaagcactgtccaccaggatagtgggaggcatttggtggtttttcacacttatcatcatttcttcgtatactgctaacttagccgcctttctgacagtggaacgcatggaatcccctattgactctgctgatgatttagctaaacaaaccaagatagaatatggagcagtagaggatggtgcaaccatgacttttttcaagaaatcaaaaatctccacgtatgacaaaatgtgggcctttatgagtagcagaaggcagtcagtgctggtcaaaagtaatgaagaaggaatccagcgagtcctcacctctgattatgctttcctaatggagtcaacaaccatcgagtttgttacccagcggaactgtaacctgacacagattggcggccttatagactctaaaggttatggcgttggcactcccatgggttctccatatcgagacaaaattaccatagcaattcttcagctgcaagaggaaggcaaactgcatatgatgaaggagaaatggtggaggggcaatggttgcccagaagaggagagcaaagaggccagtgccctgggggttcagaatattggtggcatcttcattgttctggcagccggcttggtgctttcagtttttgtggcagtgggagaatttttatacaaatccaaaaaaaacgctcaattggaaaaggaatcttctatttggttagtgccaccataccatccagacactgtttagtaatcttttgaaacttactaaaagaggtttttaataatgaggtccttctgtagtgccatggtagaagaattgaggatgtccctgaagtgccagcgtcggttaaaacataagccacaggccccagttattgtgaaaacagaagaagttatcaacatgcacacatttaacgacagaaggttgccaggtaaagaaaccatggcataaagctgggaggccaaacacccaagcacaaactgtcgtctttttccaaacaatttagccagaatgtttcctgtggaaatatgcaacctgtgcaaaataaaatgagttacctcatgccgctgtgtctatgaactagagactctgtgatctaagcagttgcaatgatcagacttgatttacaagcatcatggatcaaccaagttacacggggttacactgttaatcatgggttcctcccttcttctgagtgaatgttaacatgcgcattttgtggctgatttcaaatgcagtccagtgagaaattacaggttccttttgaagctcaactgttgccaggagatggaatatcaatgcccaacagggcaaccaataaaagtgtcactaagaatataaatatttggaatcagcaaaaactgtagtgttacaggaaacagtacagtcttctgaacacccagatcatagaggtgatgatgttactagcccccaactactcagtataattattgtctgaatgcaaagtatgtgtttataggatgtgaaaaaatgtaatgcaaaacaaatttgaatcccatggcagttggaatataaagcagatgttcatcacttattttccttttttcttttcttatttttttttttgacagtctgtgtcactgattgagatagaaatgccaattatcaaggaaataatgttttcttaagttccctaaggcagaagatttaacatgcaattctaccagatcccttcctattcccccaacaccttttctctaacccccatatcccaaataataataataataataataataataataataataataataaaagcagttggttcagtgattctgaattaaaaggataatgttttgcaatgttcaagttgtaaaaactggccgagtattggctgtgtggaagactaaagctttcattctaacattcagacatagcaatccaaacccttgttcctgctgtaaatgaacttgatggagcatgggcagatttcagtgatacgagaaaggggactggtcatctatagaaaaatctgtgagagaacttggaagtggactgcgtttatcaatacagtcacaatgttaaatgaacaaaattcttgaacagttttttttcaaaaaatgttcaggtttatttgtggaaatgcaagatttctatgaaaatagtttttgtatggaaatttttgtaatactttttatcaacaaaacaagaacatgtgttcctgtcaggggtgtgatgtcaagcatgaatggtagtgcgtgtgcaccaccaacgtttggtgaaaactatttttatcaagaaaaaaggaatcatagaagagaaatattttcaagttagataatataaaagctaggtgcactaccaccactgcttaccatgccacacccctggtttccacgaggctgacaacatactgtaatgaacaattgtgtgtaaaatggtaaaagacacagacctcttgacaacattgtgataacagttgagtgcacacagtttgctgtttgaatccaatgcacaaaattaaaaaaaatcattaaaactatgttcattttactttca

SEQ ID NO: 12305 - DNA, 4789 bp, Homo sapiens
ggagagcagctatctcagtctttctcacttaatcttggcttcacgtcagaagctgtgcagcagtgcagtagaatagggcctggcaaaacctttgctagcaaagcgccttttgtgccgggctgtggctcgctatcgacatctcgtccgttaccaaggctgggtttcctactgatttccctcctcctctgctttcacaggctcgcgcggccggacattgtgggtgtgcgtgctggatttctcccggatgctctccgactaacatggatgtcccaccattccttgcagtggaaggttgttccttggcgcagtgagtgaagaacatgcagcgattgctaatgggtttgggaagcggagactccttcctctctctatgaccatgccgtgatcgtgtctgcggtcaccactcgacgcatcctcatttctacccgaacccaggagccgaacgctagatcggggaagtgggtgccgtgcgtgtgggcacagaaacaccatgaagattattttcccgattctaagtaatccagtcttcaggcgcaccgttaaactcctgctctgtttactgtggattggatattctcaaggaaccacacatgtattaagatttggtggtatttttgaatatgtggaatctggcccaatgggagctgaggaacttgcattcagatttgctgtgaacacaattaacagaaacagaacattgctacccaatactacccttacctatgatacccagaagataaacctttatgatagttttgaagcatccaagaaagcctgtgatcagctgtctcttggggtggctgccatcttcgggccttcacacagctcatcagcaaacgcagtgcagtccatctgcaatgctctgggagttccccacatacagacccgctggaagcaccaggtgtcagacaacaaagattccttctatgtcagtctctacccagacttctcttcactcagccgtgccattttagacctggtgcagtttttcaagtggaaaaccgtcacggttgtgtatgatgacagcactggtctcattcgtttgcaagagctcatcaaagctccatcaaggtataatcttcgactcaaaattcgtcagttacctgctgatacaaaggatgcaaaacccttactaaaagaaatgaaaagaggcaaggagtttcatgtaatctttgattgtagccatgaaatggcagcaggcattttaaaacaggcattagctatgggaatgatgacagaatactatcattatatctttaccactctggacctctttgctcttgatgttgagccctaccgatacagtggtgttaacatgacagggttcagaatattaaatacagaaaatacccaagtctcctccatcattgaaaagtggtcgatggaacgattgcaggcacctccgaaacccgattcaggtttgctggatggatttatgacgactgatgctgctctaatgtatgatgctgtgcatgtggtgtctgtggccgttcaacagtttccccagatgacagtcagttccttgcagtgtaatcgacataaaccctggcgcttcgggacccgctttatgagtctaattaaagaggcacattgggaaggcctcacaggcagaataactttcaacaaaaccaatggcttgagaacagattttgatttggatgtgatcagtctgaaggaagaaggtctagaaaagattggaacgtgggatccagccagtggcctgaatatgacagaaagtcaaaagggaaagccagcgaacatcacagattccttatccaatcgttctttgattgttaccaccattttggaagagccttatgtcctttttaagaagtctgacaaacctctctatggtaatgatcgatttgaaggctattgcattgatctcctcagagagttatctacaatccttggctttacatatgaaattagacttgtggaagatgggaaatatggagcccaggatgatgccaatggacaatggaatggaatggttcgtgaactaattgatcataaagctgaccttgcagttgctccactggctattacctatgttcgagagaaggtcatcgacttttccaagccctttatgacacttggaataagtattttgtaccgcaagcccaatggtacaaacccaggcgtcttctccttcctgaatcctctctcccctgatatctggatgtatattctgctggcttacttgggtgtcagttgtgtgctctttgtcatagccaggtttagtccttatgagtggtataatccacacccttgcaaccctgactcagacgtggtggaaaacaattttaccttgctaaatagtttctggtttggagttggagctctcatgcagcaaggttctgagctcatgcccaaagcactgtccaccaggatagtgggaggcatttggtggtttttcacacttatcatcatttcttcgtatactgctaacttagccgcctttctgacagtggaacgcatggaatcccctattgactctgctgatgatttagctaaacaaaccaagatagaatatggagcagtagaggatggtgcaaccatgacttttttcaagaaatcaaaaatctccacgtatgacaaaatgtgggcctttatgagtagcagaaggcagtcagtgctggtcaaaagtaatgaagaaggaatccagcgagtcctcacctctgattatgctttcctaatggagtcaacaaccatcgagtttgttacccagcggaactgtaacctgacacagattggcggccttatagactctaaaggttatggcgttggcactcccatgggttctccatatcgagacaaaattaccatagcaattcttcagctgcaagaggaaggcaaactgcatatgatgaaggagaaatggtggaggggcaatggttgcccagaagaggagagcaaagaggccagtgccctgggggttcagaatattggtggcatcttcattgttctggcagccggcttggtgctttcagtttttgtggcagtgggagaatttttatacaaatccaaaaaaaacgctcaattggaaaagaggtccttctgtagtgccatggtagaagaattgaggatgtccctgaagtgccagcgtcggttaaaacataagccacaggccccagttattgtgaaaacagaagaagttatcaacatgcacacatttaacgacagaaggttgccaggtaaagaaaccatggcataaagctgggaggccaaacacccaagcacaaactgtcgtctttttccaaacaatttagccagaatgtttcctgtggaaatatgcaacctgtgcaaaataaaatgagttacctcatgccgctgtgtctatgaactagagactctgtgatctaagcagttgcaatgatcagacttgatttacaagcatcatggatcaaccaagttacacggggttacactgttaatcatgggttcctcccttcttctgagtgaatgttaacatgcgcattttgtggctgatttcaaatgcagtccagtgagaaattacaggttccttttgaagctcaactgttgccaggagatggaatatcaatgcccaacagggcaaccaataaaagtgtcactaagaatataaatatttggaatcagcaaaaactgtagtgttacaggaaacagtacagtcttctgaacacccagatcatagaggtgatgatgttactagcccccaactactcagtataattattgtctgaatgcaaagtatgtgtttataggatgtgaaaaaatgtaatgcaaaacaaatttgaatcccatggcagttggaatataaagcagatgttcatcacttattttccttttttcttttcttatttttttttttgacagtctgtgtcactgattgagatagaaatgccaattatcaaggaaataatgttttcttaagttccctaaggcagaagatttaacatgcaattctaccagatcccttcctattcccccaacaccttttctctaacccccatatcccaaataataataataataataataataataataataataataataaaagcagttggttcagtgattctgaattaaaaggataatgttttgcaatgttcaagttgtaaaaactggccgagtattggctgtgtggaagactaaagctttcattctaacattcagacatagcaatccaaacccttgttcctgctgtaaatgaacttgatggagcatgggcagatttcagtgatacgagaaaggggactggtcatctatagaaaaatctgtgagagaacttggaagtggactgcgtttatcaatacagtcacaatgttaaatgaacaaaattcttgaacagttttttttcaaaaaatgttcaggtttatttgtggaaatgcaagatttctatgaaaatagtttttgtatggaaatttttgtaatactttttatcaacaaaacaagaacatgtgttcctgtcaggggtgtgatgtcaagcatgaatggtagtgcgtgtgcaccaccaacgtttggtgaaaactatttttatcaagaaaaaaggaatcatagaagagaaatattttcaagttagataatataaaagctaggtgcactaccaccactgcttaccatgccacacccctggtttccacgaggctgacaacatactgtaatgaacaattgtgtgtaaaatggtaaaagacacagacctcttgacaacattgtgataacagttgagtgcacacagtttgctgtttgaatccaatgcacaaaattaaaaaaaatcattaaaactatgttcattttactttca

SEQ ID NO: 12306 - DNA, 2139 bp, Homo sapiens
ggtggtatttttgaatatgtggaatctggcccaatgggagctgaggaacttgcattcagatttgctgtgaacacaattaacagaaacagaacattgctacccaatactacccttacctatgatacccagaagataaacctttatgatagttttgaagcatccaagaaagcctgtgatcagctgtctcttggggtggctgccatcttcgggccttcacacagctcatcagcaaacgcagtgcagtccatctgcaatgctctgggagttccccacatacagacccgctggaagcaccaggtgtcagacaacaaagattccttctatgtcagtctctacccagacttctcttcactcagccgtgccattttagacctggtgcagtttttcaagtggaaaaccgtcacggttgtgtatgatgacagcactggtctcattcgtttgcaagagctcatcaaagctccatcaaggtataatcttcgactcaaaattcgtcagttacctgctgatacaaaggatgcaaaacccttactaaaagaaatgaaaagaggcaaggagtttcatgtaatctttgattgtagccatgaaatggcagcaggcattttaaaacaggcattagctatgggaatgatgacagaatactatcattatatctttaccactctggacctctttgctcttgatgttgagccctaccgatacagtggtgttaacatgacagggttcagaatattaaatacagaaaatacccaagtctcctccatcattgaaaagtggtcgatggaacgattgcaggcacctccgaaacccgattcaggtttgctggatggatttatgacgactgatgctgctctaatgtatgatgctgtgcatgtggtgtctgtggccgttcaacagtttccccagatgacagtcagttccttgcagtgtaatcgacataaaccctggcgcttcgggacccgctttatgagtctaattaaagaggcacattgggaaggcctcacaggcagaataactttcaacaaaaccaatggcttgagaacagattttgatttggatgtgatcagtctgaaggaagaaggtctagaaaagattggaacgtgggatccagccagtggcctgaatatgacagaaagtcaaaagggaaagccagcgaacatcacagattccttatccaatcgttctttgattgttaccaccattttggaagagccttatgtcctttttaagaagtctgacaaacctctctatggtaatgatcgatttgaaggctattgcattgatctcctcagagagttatctacaatccttggctttacatatgaaattagacttgtggaagatgggaaatatggagcccaggatgatgccaatggacaatggaatggaatggttcgtgaactaattgatcataaatcaaaaatctccacgtatgacaaaatgtgggcctttatgagtagcagaaggcagtcagtgctggtcaaaagtaatgaagaaggaatccagcgagtcctcacctctgattatgctttcctaatggagtcaacaaccatcgagtttgttacccagcggaactgtaacctgacacagattggcggccttatagactctaaaggttatggcgttggcactcccatgggttctccatatcgagacaaaattaccatagcaattcttcagctgcaagaggaaggcaaactgcatatgatgaaggagaaatggtggaggggcaatggttgcccagaagaggagagcaaagaggccagtgccctgggggttcagaatattggtggcatcttcattgttctggcagccggcttggtgctttcagtttttgtggcagtgggagaatttttatacaaatccaaaaaaaacgctcaattggaaaaggaatcttctatttggttagtgccaccataccatccagacactgtttagtaatcttttgaaacttactaaaagaggtttttaataatgaggtccttctgtagtgccatggtagaagaattgaggatgtccctgaagtgccagcgtcggttaaaacataagccacaggccccagttattgtgaaaacagaagaagttatcaacatgcacacatttaacgacagaaggttgccaggtaaagaaaccatggcataa

SEQ ID NO: 12307 - DNA, 9101 bp, Homo sapiens
ctcggcggcgcccaacgatgaccgctccctggcggcgcctccggagtctggtttgggaatactgggccgggctcctcgtgtgcgccttctggatcccggactcgcgcgggatgccccacgtcatccggatcggaggaatcttcgagtatgcggacggccccaacgcccaggtcatgaatgccgaggagcatgcctttcgattttctgccaacatcatcaacaggaacaggactctgctgcccaacacaaccttgacctatgacatacagaggattcacttccatgacagcttcgaggcgaccaaaaaggcctgtgaccagctggcactgggcgtggtggcgatcttcggcccatcacagggctcctgcaccaatgccgtccagtccatctgcaatgccctggaggtgccccacatccagctgcgttggaagcaccacccgctggacaacaaggacaccttctacgtgaacctctaccccgactacgcctcgctcagccatgccatcctcgacctggtccagtacctcaagtggcggtcagccaccgtggtctatgacgacagtacagggctcatccgactgcaggagctcatcatggccccatcaagatacaacatccgcctgaagatccgtcagctccccatcgactctgacgactcgcgccccttgctcaaggagatgaagcgaggccgggaattccgcattatcttcgactgcagccacactatggcggcccagatcctcaagcaggccatggccatgggcatgatgactgagtactaccacttcatcttcaccactctggatctctacgctttagacctggagccctaccgctactcaggcgtgaacctgacaggattccggattctcaatgtggacaacccacacgtctcggccattgtggagaagtggtccatggagcggctgcaggcagctccccggtccgagtctggcctgctggatggagtgatgatgactgatgcagccttactgtacgacgccgtccatatcgtgtccgtgtgctaccagcgggcaccacagatgaccgtgaactccctgcagtgccatcggcacaaggcctggcgctttggcggccgcttcatgaacttcatcaaggaggctcaatgggaaggattaactggacgaattgttttcaacaaaactagtggcttgcggacggattttgatctggacatcatcagcctgaaagaggatggcctggagaaggttggggtgtggagtcctgccgacgggctcaacatcactgaggttgccaaaggccgaggccctaatgtcaccgactctctgacaaacagatcactcattgtcaccacagtgctggaggagcccttcgtcatgtttcggaaatcagacaggacgctatacgggaatgaccggttcgagggctactgcatcgacctgctaaaggagctggcccacatccttggtttctcctatgagatccggctggtggaggacggcaagtacggggcacaggatgacaagggccagtggaacggcatggtcaaggagctcatcgaccacaaggcagatctggccgtggcccccctgaccatcacccatgttcgagagaaggccatcgacttctccaagcccttcatgacacttggtgtgagcatcctgtatcgaaagcccaatggcaccaaccccagcgtcttctccttcctcaatcccctgtccccagacatctggatgtatgttctcctcgcctacctgggggtcagctgtgtcctcttcgtcatcgccaggttcagcccttatgagtggtacgatgctcacccctgcaaccctggctccgaggtggtggaaaataacttcactctgcttaacagcttctggtttggaatgggatccctgatgcagcaagggtctgagctgatgcccaaagccctgtccacacgcatcattggtggcatctggtggttcttcacgctcatcatcatctcttcctacacggccaacctggctgcctttctgaccgtggagcgcatggaatcacccattgactctgctgatgacctggccaagcaaaccaaaatcgagtatggggctgtcaaggatggggccaccatgaccttcttcaagaaatccaagatctccaccttcgagaagatgtgggccttcatgagcagcaagccatcggcgctggtgaagaacaacgaggagggcatccagagggccctgacggccgactacgcgctgctcatggagtccaccaccatcgagtacgtcacgcagaggaactgcaacctcacccagatcgggggcctcattgactccaagggctacggcatcggcacgcccatgggctccccataccgggacaagatcaccatcgccatcctgcagcttcaggaggaggacaagctgcatatcatgaaggagaagtggtggcggggcagcgggtgtcctgaggaggaaaacaaagaggccagtgccctggggatccagaagatcgggggcatcttcattgtcctggccgccgggctggtcctctctgtgctggtggccgtgggcgagtttgtgtacaagctccgcaaaacagcagagagagagcagcgttccttctgcagcaccgtggccgatgagatccgtttctcccttacctgccagcgtcgagtcaagcacaagcctcagcctcccatgatggtcaagactgacgccgtcatcaacatgcacacattcaatgaccgccggcttcccggcaaggacagcatggcctgcagcacatccttagcccctgtgttcccctaggcacagctggggtggggacctcaggcctgggggctgggcagaggaaagcaaaggagattggaaggaacgtcccctgtccccgcactgggcttggggaccagagctgccacctgcctgttgggccaggagcctcctgcccttacctgccaggaagccagcaggctctcaggccagctgcttgggcttcatcctcctcagatcttctgtgggtttctaaagctgccagccgagatagccaaggccaaaggaagcacatgcctctctcaggccaaactcacctgcccctcaactctcctccagagtcagaagtttctgccgcagccctgcagagggcacagaaaatggaagacagctcttatattgccatttcttccacaagagcccaggcctcctacagcttgaccgtgaggccagagacacaagccttcggcgccttaaggatgttctagcatggctgccaatgggagctcatggtgagggatacccatcccatatgcctgggcagaaggaagacttcatccctctggggctgttcacgtggtcctaatcttctgaacttggcgctgcccctggcagcccctgttctggcagagttgaagacagagctacacaggggaaaagaggagtttggggtatgggagagaagagaatgcacaaacagaggccgccattttggattcttatggacaatgacccagtggttcctaatcctctaggaggtctctaagaatataagtgggggagtggccacagaaaattcttctccactttctagccagaggagagaggaccccctgaatttctcacaaaggatgcccaaagatgcagccggtatttgaagcccagcagaggaaaagcagattccatggaagtcccaccggctcttgtgccaatggatctcactttcctggttagcaagctgttgtctaaaccctgttcacatttggaaacctgggctctttgccatcttctcatcaacaactccccattcctggctggttgaccttggcctcactctgtctttttgaaagaagagttggttgaagtgaaagtcaagttgtccctcctcaaaaaaggagttagtgtcctactacacagactaactttgggctaggtgagggaaaccagaagagaccaaaagaacttctggtctcctggacttaccaaacctagagatgctccccaggaaaagaaagtttccagggacataatatcatagctggcagaggccccaagggtggggaggaagaagctgcctcctggagaattaaccaaagaccccacacagagacatgaggccatcctggccccttgtctgttgtccagagcagctatggcattgtggggcttggggaagacagcagagaagtagcagcaggttgggtaccagccagggggtggacctatgagttccagcttgctgtgatgaatgctctagaggtctgtgactttaagagtcttggaaaagaatgagacatgaaggattaggaacaaagtgtccttaaagagaacatgatgggccagcagggttaccatggccaaggatggaggggcaggttttgaacaggggagggaggttctggggattctggatgagaactggggcataccagccactcccctcccacctctgtcccatgctgcttgggaagcccggttagggaagagcttcatttggatctcaagggctttctcatctgggtgaagggcaatctctagcaaagcaggagaccacagtgggctcatgtgataaacactgtccctcctccagactgtgagctgcaggaccaaaccagcaggttcccagaatcctagcagctctgactggctatgtacattggacgagggagaggagggctagacatacaccaaagccccatgcatgtaatgttaggaaaagccatgctgtcataagcttcagggtacagagggcgtgtgcatgtgtgtctgtgtctttgtgtttgtatgtgtgagcttcgggggctggggcacaggacagatctggacatataacatagtccagggcatgcaataataggtgaatccttggggatctgatgtgtgcatatgcgtgcgtatgtgtatctgagtgaattggggacgagggagacaaatatgtgaagcagcaaggccccatatatgtaaaaacaggagaagccatgtcataatggggccctggtgggtatgcatatgtaagcatgcatgcatgcataggtgtgtgcatgctggtgtgtgtgtgtgcacatgtacactgaatggcataggatggagatcaggatcttacctgcagctagccaaatatgcgtaaaaggagaagccatgtcaccaaggggtccatgtctgagtgcatgtgaacacatgtgtacaggcatgtgtgcacagtggggagcggggggaaggccaggaccagagagtcgtgtgacatgggtcaatgcatgctgtagacaagaagccacgtggagttgaagtttccgagtgtgtgggacacacacatatgttccaggtcacagtggaagcaaagacagacaatcaggaaggccgggcaccagggtctgtttgcacttctgtcatgggagagatcatttgtcacagagaggttccaaggttgcatgggcacacttgccaggagacgggggcacaacccttcaggggctcatgctgctgatgcctttgctgtggacatcatgtcctgtttgaagggaaaactcttttttgtaattcccaggtaacaggattctaatgaaggtatttgccaatttgctgtcagcaaacacaatcattaagcgccgtcttactttgtccagtatagtttcagagcacgtgcctcattcttgctcttgtctcacacatgtgttgtgtgtgtgatgctacatgagcatgttcttcagaggctatgcatatatgtggattgtgacaggaggaagaagaagtggtgagaatttttataaaacgaacaaagaatagtggataaatagaggcagaattcaattcgagaaaccccccaaaatgtaccgactggtctttagactcctgtgtggaagcaggagggcatgctgcctcatctcctctcccaggcaaaccttgcgtcctgatgttcaggtgttgtcggtgtggctgatatttggcttctggccaatatcctgcatttgtcctagagaccagcctagtgttcaaagtgcagtggggaccacagctgcccaagcatgagctctgtctctcccggggcactgaaaatgatgctacatctgtgaggtgggacggagtggggaggtgttttcagtgaggcagatcttgtgtttttttaagtttaggtctgtcctgccagtgggcatggagctgagctggggcaggtgcatgcgtgtgtgtgtatgtgtgtgtatgcatgtgtagtgtgtgtgcacacacgcaggcactgagaggtgatgggaagcatgaaagcttgcttggatggagcagaagaaggaacctgcctgagcagatgctggactgtccctgcgtggtgccacatgccagccctgaacagaagaatgtccccactgcatccccaaatgcaagtgcctcctctccacctgctcaagctggccaagttgaggggcagtggtaagaagacaccaaccccaccgcccctgccgaggccctgggactaaggacagtgagccctcccaatcactctccccttgtcctgctgctggtttctctgctctggacagaagaaaatcctgaaagcgttgtcaatgttcaagtggccccatgctgcaagagtctctcgcgaggggtgacgcccccttggccagtgtgctggactttgagtgtctgaggggtaagagggccaccccctcctcacagccgagactctatctaacctggaagcacactctggctccacccccaacccctgccatgccctaggccctggaagatgggaatcctggcccaggccagggtaaagggccaaacaggttagaagttgctcccctccaccaggcgtgcactcaccaagaacgatcaaaagctccctttctgcctacttttccaggggtactgggtgtggggggtgggtcacagctcctgcttcatcactcagcatgaagttggtccctccctgagccactcccagctacatgcacaaacatctgaaagtaggctggcctctctggctcacatctggagtggtcctgtgtggatacccatctgcaaaggggctagaggtttggacaaacagctgcatggacttatcatctgggatgggcccagcctcatggacagatacaagaaatgagcccaactctgtgggcaggtctctggattagacacatctgaaagttgcaggtcaagtggacacatctggaagtggcccggctgctggctgccatggaagggccgtgccctctgtccccatggcagtttaaatcaggccttcccttcagtcctggatttgccctggagtaaaaatttcagagctgaggtcatacgtgagtcacaaaacttttaggtagaaggttaatgttctgtacaatatatatatgaatgtaaaatatatatatatactgtatatatatatatatatgcacagtgtatatatgacctgtagcccatgtgtatacaaccctttcctgcacgtctgcacacggagtgtacagaacccagccagcacgggtgaggaccagatgagagatgggggctgcagcagcaaagtctgggacggaggtctcagagagccccttggggtggcgaaggccctccacacatcagagctccagaccctgaagaagagggcagagctacatggtgctgccaggtgagtcctgcaccgccagggcctcctgtgggaggggcaggaatggccaacggacctcatctccatccgagcctgtctgaggcaggacagctgggtgtgtctgagaagcaatgtcatgctagtactcagcccctgtgccaatattacattctagttctggggcaattcatcaggagcagaagggctgggaaagagcaggccactccccaggcctgttctcacacctgcctgcagaatcacaggtaggtttcaggctccatctaggataccctagaaggcggggctattctaggtagcaaaagcctctgcctctgattctcacccacatgcagaagcagtcacaacttgcacacaacacagctcacaactagggaaagcacttgttaaagagaatgcccccagggcatggccagcatgccgatacagtgttcccatgcccctgttactgatcctgtcctcctgccttctagaacagtggacctcacatcacctcccagattgtctccattttatggattgaaactctgaggcctccagacatgaagaagcagccatagattcagtcaaatgccagccaagggtttgccttgcctcagacaacctccccagccccatttgacccagagaccagctgtcagggagcgacctcagagccagaggggtgaaagatgagaggcaagaaggtagctcctatcctagcacagcccaggctccatctgtctgcctttctctcccctgcggcatcctggcagggcagttggcagagtgccccctccccaggaggctgcagatctctgtccctggctcacccagatcggtctgttctctgcagttccattcctttagcctctttcgcaggtctgagcatctctggagcatgcaggggaggagatatctgaggtgggcttccgtgcagtcagcagcctgccccagcttcagcctcaggcgtcaggctggtctgcactgaactctgggtctgcctctggggccctgaccaagcacgcctgactccagccccatgaggagcatcctgtcttggttccgtagggatcatgggtcctcttaccactgtgcgccaagcccccagcccacctctgcctgggccgacttcctggttgggcctcccatggtaggggcctcagttcccaggctctgggctgagcccccagggagcaccatgggcctctgagaccctagacctgtcccaccacccagaccagagtgcctggacgccccccactcccactcaacatggttcccacacactggtctctgggccattcaggggatgccctttgtggacatgcagaatttctatgaatatagttttttgtaaacattttgtaacaatttgggtttcatagtaactgtgttacttgccaatcattctaggctgatgtaaataaatttccaaacaaatctgattattttcctttttaagacactgtgatatatcaaagtgcacagtttgctgtatgaagtaatatggttttaaattttaaataaaatgtttctagaaaacaggg

SEQ ID NO: 12308 - DNA, 2955 bp, Homo sapiens
cacgctcggcggcgcccaacgatgaccgctccctggcggcgcctccggagtctggtttgggaatactgggccgggctcctcgtgtgcgccttctggatcccggactcgcgcgggatgccccacgtcatccggatcggaggaatcttcgagtatgcggacggccccaacgcccaggtcatgaatgccgaggagcatgcctttcgattttctgccaacatcatcaacaggaacaggactctgctgcccaacacaaccttgacctatgacatacagaggattcacttccatgacagcttcgaggcgaccaaaaaggcctgtgaccagctggcactgggcgtggtggcgatcttcggcccatcacagggctcctgcaccaatgccgtccagtccatctgcaatgccctggaggtgccccacatccagctgcgttggaagcaccacccgctggacaacaaggacaccttctacgtgaacctctaccccgactacgcctcgctcagccatgccatcctcgacctggtccagtacctcaagtggcggtcagccaccgtggtctatgacgacagtacagggctcatccgactgcaggagctcatcatggccccatcaagatacaacatccgcctgaagatccgtcagctccccatcgactctgacgactcgcgccccttgctcaaggagatgaagcgaggccgggaattccgcattatcttcgactgcagccacactatggcggcccagatcctcaagcaggccatggccatgggcatgatgactgagtactaccacttcatcttcaccactctggatctctacgctttagacctggagccctaccgctactcaggcgtgaacctgacaggattccggattctcaatgtggacaacccacacgtctcggccattgtggagaagtggtccatggagcggctgcaggcagctccccggtccgagtctggcctgctggatggagtgatgatgactgatgcagccttactgtacgacgccgtccatatcgtgtccgtgtgctaccagcgggcaccacagatgaccgtgaactccctgcagtgccatcggcacaaggcctggcgctttggcggccgcttcatgaacttcatcaaggaggctcaatgggaaggattaactggacgaattgttttcaacaaaactagtggcttgcggacggattttgatctggacatcatcagcctgaaagaggatggcctggagaaggttggggtgtggagtcctgccgacgggctcaacatcactgaggttgccaaaggccgaggccctaatgtcaccgactctctgacaaacagatcactcattgtcaccacagtgctggaggagcccttcgtcatgtttcggaaatcagacaggacgctatacgggaatgaccggttcgagggctactgcatcgacctgctaaaggagctggcccacatccttggtttctcctatgagatccggctggtggaggacggcaagtacggggcacaggatgacaagggccagtggaacggcatggtcaaggagctcatcgaccacaaggcagatctggccgtggcccccctgaccatcacccatgttcgagagaaggccatcgacttctccaagcccttcatgacacttggtgtgagcatcctgtatcgaaagcccaatggcaccaaccccagcgtcttctccttcctcaatcccctgtccccagacatctggatgtatgttctcctcgcctacctgggggtcagctgtgtcctcttcgtcatcgccaggttcagcccttatgagtggtacgatgctcacccctgcaaccctggctccgaggtggtggaaaataacttcactctgcttaacagcttctggtttggaatgggatccctgatgcagcaagggtctgagctgatgcccaaagccctgtccacacgcatcattggtggcatctggtggttcttcacgctcatcatcatctcttcctacacggccaacctggctgcctttctgaccgtggagcgcatggaatcacccattgactctgctgatgacctggccaagcaaaccaaaatcgagtatggggctgtcaaggatggggccaccatgaccttcttcaagaaatccaagatctccaccttcgagaagatgtgggccttcatgagcagcaagccatcggcgctggtgaagaacaacgaggagggcatccagagggccctgacggccgactacgcgctgctcatggagtccaccaccatcgagtacgtcacgcagaggaactgcaacctcacccagatcgggggcctcattgactccaagggctacggcatcggcacgcccatgggctccccataccgggacaagatcaccatcgccatcctgcagcttcaggaggaggacaagctgcatatcatgaaggagaagtggtggcggggcagcgggtgtcctgaggaggaaaacaaagaggccagtgccctggggatccagaagatcgggggcatcttcattgtcctggccgccgggctggtcctctctgtgctggtggccgtgggcgagtttgtgtacaagctccgcaaaacagcagagagagagcaggtaagccttagagcttggagcctgcacaggatgggaaatggagattcgcgctgatttcactcctgtatgtgccaggcacacagtggtgtctcatctcagcctcacaacagctcaccctgcatccagtcggccagcaagccctgccactctacctctgtcctgacctggcacttttttccatcgccgttgccccaccccaggccaagccccatcacctcctgcctggattatgccgcagccttcaaactggccctccagcctccatgcttccccaacaccatccacaattcacacagcaactggtaccttgtttaaaacttaattcaaaccatatcattttcctgcataaaaccctccagggtaattgtt

SEQ ID NO: 12309 - DNA, 4214 bp, Homo sapiens
cctttcccgattccccgacgtttcgggaggagtggggtcggagcgcagggctgggaagggtcttaggacccaggaaggagacgggtgcctcccagagaggaccccatcccctccgaggtccgggcggctcccggcctctccctggggtgccgtagcccccctcgacccgccttcccgcagccgcagtcgttcgggcctggaggtggccgggcatcggtgccgacgccgcgagggcagcgcccgcggcgggaatactaatgcaccctaaagggcacggccgccgccgcagcagagttatgtcatgcccaggccagcagggggctccatgaggattcatagaagatgccccgcgtctcggcgcctttggtgctgcttcctgcgtggctcgtgatggtcgcctgcagcccgcactccttgaggatcgctgctatcttggacgaccccatggagtgcagcagaggggagcggctctccatcaccctggccaagaaccgcatcaaccgcgctcctgagaggctgggcaaggccaaggtcgaagtggacatctttgagcttctcagagacagcgagtacgagactgcagaaaccatgtgtcagatcctccccaagggggtggtcgctgtcctcggaccatcgtccagcccagcctccagctccatcatcagcaacatctgtggagagaaggaggtccctcacttcaaagtggccccagaggagttcgtcaagttccagttccagagattcacaaccctgaacctccaccccagcaacactgacatcagcgtggctgtagctgggatcctgaacttcttcaactgcaccaccgcctgcctcatctgtgccaaagcagaatgccttttaaacctagagaagctgctccggcaattccttatctccaaggacacgctgtccgtccgcatgctggatgacacccgggaccccaccccgctcctcaaggagatccgggacgacaagaccgccaccatcatcatccacgccaacgcctccatgtcccacaccatcctcctgaaggcagccgaacttgggatggtgtcagcctattacacatacatcttcactaatctggagttctcactccagagaatggacagccttgtggatgatcgtgtcaacatcctgggattttccattttcaaccaatcccatgctttcttccaagagtttgcccagagcctcaaccagtcctggcaggagaactgtgaccatgtgcccttcactgggcctgcgctctcctcggccctgctgtttgatgctgtctatgctgtggtgactgcggtgcaggaactgaaccggagccaagagatcggcgtgaagcccttgtcctgcggctcggcccagatctggcagcacggcaccagcctcatgaactacctgcgcatggtagaattggaaggtcttaccggccacattgaattcaacagcaaaggccagaggtccaactacgctttgaaaatcttacagttcacaaggaatggttttcggcagatcggccagtggcacgtggcagagggcctcagcatggacagccacctctatgcctccaacatctcggacactctcttcaacaccaccctggtcgtcaccaccatcctggagaacccatatttaatgctgaaggggaaccaccaggagatggaaggcaatgaccgctacgagggcttctgtgtggacatgctcaaggagctggcagagatcctccgattcaactacaagatccgcctggttggggatggcgtgtacggcgttcccgaggccaacggcacctggacgggaatggtcggggagctgatcgctaggaaagcagatctggctgtggcaggcctcaccattacagctgaacgggagaaggtgattgatttctctaagccattcatgactctgggaattagcattctttaccgcgttcatatgggacgcaaacccggctatttctccttcctggacccattttctccgggcgtctggctcttcatgcttctagcctatctggccgtcagctgtgtcctcttcctggtggctcggttgacgccctacgagtggtacagcccacacccatgtgcccagggccggtgcaacctcctggtgaaccagtactccctgggcaacagcctctggtttccggtcggggggttcatgcagcaaggctccaccatcgcccctcgcgccttatccacccgctgtgtcagtggcgtctggtgggcattcacgctgatcatcatctcatcctacacggccaacctggcagccttcctgaccgtgcagcgcatggatgtgcccattgagtcagtggatgacctggctgaccagaccgccattgaatatggcacaattcacggaggctccagcatgaccttcttccaaaattcccgctaccagacctaccaacgcatgtggaattacatgtattccaagcagcccagcgtgttcgtgaagagcacagaggagggaatcgccagggtgttgaattccaactacgccttcctcctggaatccaccatgaacgagtactatcggcagcgaaactgcaacctcactcagattgggggcctgctggacaccaagggctatgggattggcatgccagtcggctcggttttccgggacgagtttgatctggccattctccagctgcaggagaacaaccgcctggagatcctgaagcgcaaatggtgggaaggagggaagtgccccaaggaggaagatcacagagctaaaggcctgggaatggagaatattggtggaatctttgtggttcttatttgtggcttaatcgtggccatttttatggctatgttggagtttttatggactctcagacactcagaagcaactgaggtgtccgtctgccaggagatggtgaccgagctgcgcagcattatcctgtgtcaggacagtatccacccccgccggcggcgcgccgcagtcccgccgccccggccccccatccccgaggagcgccgaccgcggggcacggcgacgctcagcaacgggaagctgtgcggggcaggggagcccgaccagctcgcgcagagactggcgcaggaggccgccctggtggcccgcggctgcacgcacatccgcgtctgccccgagtgccgccgcttccagggcctgcgggcacggccgtcgcccgcccgcagcgaggagagcctggagtgggagaaaaccaccaacagcagcgagcccgagtagtcccggaggccacaggacgcgcagaggccgggcggggcgggaggggaggggcggggcgggcgctgctgtcagccgccagccggaacttgtacagcgtcgacacctctccagatttcggatccagtcacttttcaaaaagatcaaggagcctgacgccccagccagagaccgcgcccggtcagggagcagggtccacccggaaacgttgcacccaaagggcaaaggacggccctccctcctgggcacaaggacccatcttctcccagtgggtctttccctctcgccaaaataacaagagtatagggtggggggtccctacccagaccagtccaatgaattggtggaatcatcagttgaatttccccctagtcaggggccaatgtaccctccgtctagttcttacagaaaaaaaaaaaattaaacagggaagtttttcttttctggatttgtatatttttgttaatgttcttttcccttttctttcctcctctccttttcttctttgtcatcttctcagtcctgttaatttgttttgtgttttttggagggggaggctgggttagggaatggaagcctaaataatccctatttcttctttttcctgaattttggaatattgcgttaccagtgcatccgatttcaggtgcttaactctctgtatggtgactgaggggcctgcaggagcacaggagaaggagtcttgggaagaatcagatggagagtctcaaaagtccattgcagtaaactttgagatgccaaaaagcaattaactcatcctatactcagaccttgaaacgcctggaatgtcaagggttaatctgtcttttctttccctttctctttctgactgtcactattactgggtttgatttgatctttttgtgaatgtagtctctgaagacagacaggggaggagaacagaatgcacaaagtatcctaggactttgtttaaggagcggaaagagcagatagaattttcccataccatggccttggcttcc

SEQ ID NO: 12310 - DNA, 5290 bp, Homo sapiens
agctgcgggcggatcgggctggagccgccacggctgctgcggaagaggaaaaacggccaacagcagccccgcggccggcccggcagcgcccggcccccggctcagcccccggagtgcggagccgaccagcagatactttctgagtgcctactatgtgccagcctgtgctaggcactgaggacacaggtggaaaagcccgaattgctccctgctctcctggcgctcatcaccccggagagttatgtcatgcccaggccagcagggggctccatgaggattcatagaagatgccccgcgtctcggcgcctttggtgctgcttcctgcgtggctcgtgatggtcgcctgcagcccgcactccttgaggatcgctgctatcttggacgaccccatggagtgcagcagaggggagcggctctccatcaccctggccaagaaccgcatcaaccgcgctcctgagaggctgggcaaggccaaggtcgaagtggacatctttgagcttctcagagacagcgagtacgagactgcagaaaccatgtgtcagatcctccccaagggggtggtcgctgtcctcggaccatcgtccagcccagcctccagctccatcatcagcaacatctgtggagagaaggaggtccctcacttcaaagtggccccagaggagttcgtcaagttccagttccagagattcacaaccctgaacctccaccccagcaacactgacatcagcgtggctgtagctgggatcctgaacttcttcaactgcaccaccgcctgcctcatctgtgccaaagcagaatgccttttaaacctagagaagctgctccggcaattccttatctccaaggacacgctgtccgtccgcatgctggatgacacccgggaccccaccccgctcctcaaggagatccgggacgacaagaccgccaccatcatcatccacgccaacgcctccatgtcccacaccatcctcctgaaggcagccgaacttgggatggtgtcagcctattacacatacatcttcactaatctggagttctcactccagagaatggacagccttgtggatgatcgtgtcaacatcctgggattttccattttcaaccaatcccatgctttcttccaagagtttgcccagagcctcaaccagtcctggcaggagaactgtgaccatgtgcccttcactgggcctgcgctctcctcggccctgctgtttgatgctgtctatgctgtggtgactgcggtgcaggaactgaaccggagccaagagatcggcgtgaagcccttgtcctgcggctcggcccagatctggcagcacggcaccagcctcatgaactacctgcgcatggtagaattggaaggtcttaccggccacattgaattcaacagcaaaggccagaggtccaactacgctttgaaaatcttacagttcacaaggaatggttttcggcagatcggccagtggcacgtggcagagggcctcagcatggacagccacctctatgcctccaacatctcggacactctcttcaacaccaccctggtcgtcaccaccatcctggagaacccatatttaatgctgaaggggaaccaccaggagatggaaggcaatgaccgctacgagggcttctgtgtggacatgctcaaggagctggcagagatcctccgattcaactacaagatccgcctggttggggatggcgtgtacggcgttcccgaggccaacggcacctggacgggaatggtcggggagctgatcgctaggaaagcagatctggctgtggcaggcctcaccattacagctgaacgggagaaggtgattgatttctctaagccattcatgactctgggaattagcattctttaccgcgttcatatgggacgcaaacccggctatttctccttcctggacccattttctccgggcgtctggctcttcatgcttctagcctatctggccgtcagctgtgtcctcttcctggtggctcggttgacgccctacgagtggtacagcccacacccatgtgcccagggccggtgcaacctcctggtgaaccagtactccctgggcaacagcctctggtttccggtcggggggttcatgcagcaaggctccaccatcgcccctcgcgccttatccacccgctgtgtcagtggcgtctggtgggcattcacgctgatcatcatctcatcctacacggccaacctggcagccttcctgaccgtgcagcgcatggatgtgcccattgagtcagtggatgacctggctgaccagaccgccattgaatatggcacaattcacggaggctccagcatgaccttcttccaaaattcccgctaccagacctaccaacgcatgtggaattacatgtattccaagcagcccagcgtgttcgtgaagagcacagaggagggaatcgccagggtgttgaattccaactacgccttcctcctggaatccaccatgaacgagtactatcggcagcgaaactgcaacctcactcagattgggggcctgctggacaccaagggctatgggattggcatgccagtcggctcggttttccgggacgagtttgatctggccattctccagctgcaggagaacaaccgcctggagatcctgaagcgcaaatggtgggaaggagggaagtgccccaaggaggaagatcacagagctaaaggcctgggaatggagaatattggtggaatctttgtggttcttatttgtggcttaatcgtggccatttttatggctatgttggagtttttatggactctcagacactcagaagcaactgaggtgtccgtctgccaggagatggtgaccgagctgcgcagcattatcctgtgtcaggacagtatccacccccgccggcggcgcgccgcagtcccgccgccccggccccccatccccgaggagcgccgaccgcggggcacggcgacgctcagcaacgggaagctgtgcggggcaggggagcccgaccagctcgcgcagagactggcgcaggaggccgccctggtggcccgcggctgcacgcacatccgcgtctgccccgagtgccgccgcttccagggcctgcgggcacggccgtcgcccgcccgcagcgaggagagcctggagtgggagaaaaccaccaacagcagcgagcccgagtagtcccggaggccacaggacgcgcagaggccgggcggggcgggaggggaggggcggggcgggcgctgctgtcagccgccagccggaacttgtacagcgtcgacacctctccagatttcggatccagtcacttttcaaaaagatcaaggagcctgacgccccagccagagaccgcgcccggtcagggagcagggtccacccggaaacgttgcacccaaagggcaaaggacggccctccctcctgggcacaaggacccatcttctcccagtgggtctttccctctcgccaaaataacaagagtatagggtggggggtccctacccagaccagtccaatgaattggtggaatcatcagttgaatttccccctagtcaggggccaatgtaccctccgtctagttcttacagaaaaaaaaaaaattaaacagggaagtttttcttttctggatttgtatatttttgttaatgttcttttcccttttctttcctcctctccttttcttctttgtcatcttctcagtcctgttaatttgttttgtgttttttggagggggaggctgggttagggaatggaagcctaaataatccctatttcttctttttcctgaattttggaatattgcgttaccagtgcatccgatttcaggtgcttaactctctgtatggtgactgaggggcctgcaggagcacaggagaaggagtcttgggaagaatcagatggagagtctcaaaagtccattgcagtaaactttgagatgccaaaaagcaattaactcatcctatactcagaccttgaaacgcctggaatgtcaagggttaatctgtcttttctttccctttctctttctgactgtcactattactgggtttgatttgatctttttgtgaatgtagtctctgaagacagacaggggaggagaacagaatgcacaaagtatcctaggactttgtttaaggagcggaaagagcagatagaattttcccataccatggccttggcttccggtggaacgtgccgttcacagaggcggaaggactgggccaccccgttggtatggtgcatactttgtcaactgcatctcttttcaaccaaactcaaatgagtggctgcctatgaagccagacccccaagactatcatggattgggtggtttcttgctacttagacgtgagacctgggtgcaagtgtatgtgtgtgtatgtgtgcgcgcgtgtgcgtgtgtgtatttattcaacagaaagaccttaagtattcaagaatttgctaggttcctgggagagaggtggagtctcctagtcaatacacgggcctgggaaccaggaactcttgagtcgtaacctcagcttgagcagtagccctcccaccttgtatgactttaggtaaagcatttaacttctcttccatctaccaaataggagttactgatgctgtccaggttaccaggtgactgctagtgactgctctccatgtgagaagtttgcagagtccagagcacacatctgatgggaggggcgaggctttctacagctgcttgacctttgcttggcttcactaattgggagtttcacgcagagttctcattggctgatggaaaacaaattctatgcaatttctgattgtaaacttagaaaattcagagagaaacaaacagccgctaccaaccacctccacctccaccaccgctgccaccaccttgaatggaattgtcctcacttttgttgctgttgcaaatgtactaaaataaagacatctttggaagatgacgagcttaattcatgtttttgccatttgggttggtcggcatcctctttatgccaggacaatcagttagggctgccgtcctgggggccaaatggtaccctgattattcctgtgagggatactcgttttgtcctcacctgacctcactcatgaatttgaatcctttatcttttttctctttaaccatcaaatgacaacaagctgtgcaagacacttgtgtctttttttaaaccttgccttgatcctcgtggagaaacgtggatttggtgggaagggcacccgaaggccagctgacaacaaaccccaatggtgccactctgctccaacctgcagctccatcctatgcttctcacagacaacgtggttcctactg

SEQ ID NO: 12311 - DNA, 3524 bp, Homo sapiens
cgcggcagctgcgtccccatgaggaggggaggaagatgccggctgagctgctgctgctgctgattgttgccttcgccagccccagctgccaggtgctctcatcactgcgcatggctgcaatcctggatgatcagacagtgtgtggccgcggtgagcgtctggccttggccttggcccgggagcagatcaacgggatcatcgaggtcccagccaaggcccgagtggaagtagacatctttgagctgcagcgggacagccagtacgagaccacggacaccatgtgtcagatcttacccaaaggggttgtgtctgtccttgggccctcctctagcccagcatctgcctccaccgtgagccatatctgtggagagaaggagatcccccacatcaaggtgggtcccgaggagacaccccgccttcagtaccttcgcttcgcgtctgtcagcctgtaccccagtaacgaggacgtcagcttggcggtctcccgaatcctcaagtccttcaactacccctcggccagcctcatctgcgccaaggctgagtgcctgctgcgattggaggaactggtgcgtggcttcctcatctccaaggagacgctgtcagtgaggatgttggacgacagccgggaccccacaccactgctcaaggagatccgtgatgacaaggtgtccaccatcatcatcgacgccaacgcctccatctcccacctcatcctccgtaaggcctcggaactgggaatgacctcagcgttttacaagtacatcctcaccaccatggacttccccatcctgcatctggacggtattgtggaggactcctccaacatcctgggcttctccatgttcaacacgtcccaccccttctaccctgagtttgtccgcagcctcaacatgtcctggagggagaactgtgaagccagcacctacctgggccctgcgctgtcagccgccctgatgtttgacgccgtgcacgtggtggtgagcgctgtccgagagctgaaccgcagccaggagatcggtgtgaagcctctggcctgtacatcggccaacatttggccccacgggaccagcctcatgaactacctgcgcatggtagagtatgatgggctgaccgggcgggtcgagttcaacagcaaagggcagagaaccaactacaccctgcgcatcctagaaaagtcccggcagggccaccgtgagattggggtgtggtactctaaccgcaccctggccatgaatgccaccaccctggacatcaacctgtcgcagacactggccaacaagaccctggtggtcacaaccatcctggagaacccatacgtcatgcgccggcccaacttccaggccctgtcggggaacgaacgcttcgagggcttctgcgtggacatgctgcgggagctggccgagctgctgcgcttccgctaccgcctgcggttggtggaggatgggctgtacggggcgcccgagcccaacggctcctggacgggcatggttggcgagctcatcaaccggaaggcagacctggctgtggccgccttcaccatcacagctgagcgggagaaggtcatcgacttttccaagccctttatgaccctggggatcagcatcctctaccgagtgcacatgggccgcaagcctggctacttctccttcctggaccccttctcccctgctgtgtggctcttcatgcttcttgcctacctggctgtcagctgcgtcctgtttctggctgccaggctgagcccctatgagtggtataacccacacccatgcctgcgggcacgcccccacatcctggagaaccagtacacgctgggcaacagcctgtggtttcccgtggggggcttcatgcagcagggctcggagatcatgccccgggcgctgtccacgcgctgtgtcagcggagtctggtgggccttcaccttgatcatcatctcctcctacacggccaacctggccgccttcctcaccgtgcagcgcatggaggtgcctgtggagtcggccgatgacctggcagatcagaccaacatcgagtatggcaccatccacgccggctccaccatgaccttcttccagaattcacggtaccaaacgtaccagcgcatgtggaactacatgcagtcgaagcagcccagcgtgttcgtcaagagcacagaagagggcattgcccgcgtcctcaactcccgctacgccttcctgctcgagtccaccatgaacgaataccaccggcgcctcaactgcaacctcacccagatcgggggactcctcgacaccaagggctacggcattggcatgccgctgggctccccgttccgggatgagatcacactggccatcctgcagcttcaggagaacaaccggctggagatcctgaagcgcaagtggtgggaggggggccggtgccccaaggaggaggaccatcgagctaaaggtttgggcatggagaacattggtggcatttttatcgtgctcatctgtggcctcatcattgctgtcttcgtggcggtcatggaattcatatggtccacacggaggtcagctgagtccgaggaggtgtcggtgtgccaggagatgctgcaggagctgcgccacgccgtttcttgccgcaagacgtcgcgttcccgccggcgccgacgcccgggcggcccgagccgggccctgctgtcactgcgcgcggtccgcgagatgcgcctcagcaacggcaagctctactcggccggcgcgggcggggatgcgggcagcgcgcacgggggcccgcagcgcctcctggacgacccggggccccccagcggagcccgacccgccgcccccaccccctgcacccacgtgcgcgtctgccaggagtgccggcgcatccaggcgctgcgggcctcgggggccggcgcgcctccgcgtggcctgggcgtccccgccgaagccaccagcccgccccggccgcggcctggccccgccggcccccgggagctggcggagcacgagtgaccacgggcggggctgtgcgggcgcccggactgaccgaagggacggggcccgccccaggccccagcagtctccgctcccgcagcgggcgcgggacaggacttgtgcgccggcgccccggacgccgcgattttgcctttggttccccgcgaagtccgaggcctggctctggagcccgcctgcgccccccagtggactcgcgagagggtgccgcgggcgagaagggcgcaggaaccgaggactccaggggctggggacttcgggggcggctctgggaagcggaaagcagtcagcggagaggaccccattctgggactgctcaggctccccaagacttgacgcagccccccacgcttctggaggtggggagggcctctggacagatgggtgtcccctggtgcccctccactcttctcttcctctcttttttggggggagaaacctcggaatttctatgagacctcccccagggagggggtcagttgggcccccatccctccccttgccacatcgcagcccctgttggaataaaaaaaagaacaaaacccc

SEQ ID NO: 12312 - DNA, 3305 bp, Homo sapiens
cgcggcagctgcgtccccatgaggaggggaggaagatgccggctgagctgctgctgctgctgattgttgccttcgccagccccagctgccaggtgctctcatcactgcgcatggctgcaatcctggatgatcagacagtgtgtggccgcggtgagcgtctggccttggccttggcccgggagcagatcaacgggatcatcgaggtcccagccaaggcccgagtggaagtagacatctttgagctgcagcgggacagccagtacgagaccacggacaccatgtgtcagatcttacccaaaggggttgtgtctgtccttgggccctcctctagcccagcatctgcctccaccgtgagccatatctgtggagagaaggagatcccccacatcaaggtgggtcccgaggagacaccccgccttcagtaccttcgcttcgcgtctgtcagcctgtaccccagtaacgaggacgtcagcttggcggtctcccgaatcctcaagtccttcaactacccctcggccagcctcatctgcgccaaggctgagtgcctgctgcgattggaggaactggtgcgtggcttcctcatctccaaggagacgctgtcagtgaggatgttggacgacagccgggaccccacaccactgctcaaggagatccgtgatgacaaggtgtccaccatcatcatcgacgccaacgcctccatctcccacctcatcctccgtaaggcctcggaactgggaatgacctcagcgttttacaagtacatcctcaccaccatggacttccccatcctgcatctggacggtattgtggaggactcctccaacatcctgggcttctccatgttcaacacgtcccaccccttctaccctgagtttgtccgcagcctcaacatgtcctggagggagaactgtgaagccagcacctacctgggccctgcgctgtcagccgccctgatgtttgacgccgtgcacgtggtggtgagcgctgtccgagagctgaaccgcagccaggagatcggtgtgaagcctctggcctgtacatcggccaacatttggccccacgggaccagcctcatgaactacctgcgcatggtagagtatgatgggctgaccgggcgggtcgagttcaacagcaaagggcagagaaccaactacaccctgcgcatcctagaaaagtcccggcagggccaccgtgagattggggtgtggtactctaaccgcaccctggccatgaatgccaccaccctggacatcaacctgtcgcagacactggccaacaagaccctggtggtcacaaccatcctggagaacccatacgtcatgcgccggcccaacttccaggccctgtcggggaacgaacgcttcgagggcttctgcgtggacatgctgcgggagctggccgagctgctgcgcttccgctaccgcctgcggttggtggaggatgggctgtacggggcgcccgagcccaacggctcctggacgggcatggttggcgagctcatcaaccggaaggcagacctggctgtggccgccttcaccatcacagctgagcgggagaaggtcatcgacttttccaagccctttatgaccctggggatcagcatcctctaccgagtgcacatgggccgcaagcctggctacttctccttcctggaccccttctcccctgctgtgtggctcttcatgcttcttgcctacctggctgtcagctgcgtcctgtttctggctgccaggctgagcccctatgagtggtataacccacacccatgcctgcgggcacgcccccacatcctggagaaccagtacacgctgggcaacagcctgtggtttcccgtggggggcttcatgcagcagggctcggagatcatgccccgggcgctgtccacgcgctgtgtcagcggagtctggtgggccttcaccttgatcatcatctcctcctacacggccaacctggccgccttcctcaccgtgcagcgcatggaggtgcctgtggagtcggccgatgacctggcagatcagaccaacatcgagtatggcaccatccacgccggctccaccatgaccttcttccagaattcacggtaccaaacgtaccagcgcatgtggaactacatgcagtcgaagcagcccagcgtgttcgtcaagagcacagaagagggcattgcccgcgtcctcaactcccgctacgccttcctgctcgagtccaccatgaacgaataccaccggcgcctcaactgcaacctcacccagatcgggggactcctcgacaccaagggctacggcattggcatgccgctgggctccccgttccgggatgagatcacactggccatcctgcagcttcaggagaacaaccggctggagatcctgaagcgcaagtggtgggaggggggccggtgccccaaggaggaggaccatcgagctaaaggtttgggcatggagaacattggtggcatttttatcgtgctcatctgtggcctcatcattgctgtcttcgtggcggtcatggaattcatatggtccacacggaggtcagctgagtccgaggagaccccagctctgcatccagctgcctgccagtgttctgcacttggcccaaggactcctctgaaggagccgtccatgctgctagtaaaggtgccctccacccgtgtccaggttgccttctcaaggacatccctccggcaagtctgtcctttcctcctgcagcatcagttgtcctctctttattggattcaggccaccaacgtacaaatatgctgtcatttctccagtcttaaaccctctcctgacctcactttccctcccagccaccgcccactttcttcccttctctttacagccttggcagcagtggggggtctccctgatgcttccagtttcttctttcctcccatttcctcttgccccccactccagtctggcatcggtccctgccactccactgaagccactcttgtcaccagcaacttccatgtctgaaattcccggtctcaggcctcatgtatatgaggtagcagtgggcttcggcacagccagtcactctcaatcctcaaagccccttcttccccttctcccacttctccggtcactccttcccaggctccctcgttgggtttctctttctccccaggctctgtttgttgtggggctccagggctcagtccttagactgcttctcttctcggtctttctccactacttgaatgatcccaccagccaaatggctcttaagacccactatgtgctggtgattcttgtgttagttatctattgctatcataacaaatgaccttaacagctttt

SEQ ID NO: 12313 - DNA, 1404 bp, Homo sapiens
gtgggccttcaccttgatcatcatctcctcctacacggccaacctggccgccttcctcaccgtgcagcgcatggaggtgcctgtggagtcggccgatgacctggcagatcagaccaacatcgagtatggcaccatccacgccggctccaccatgaccttcttccagaattcacggtaccaaacgtaccagcgcatgtggaactacatgcagtcgaagcagcccagcgtgttcgtcaagagcacagaagagggcattgcccgcgtcctcaactcccgctacgccttcctgctcgagtccaccatgaacgaataccaccggcgcctcaactgcaacctcacccagatcgggggactcctcgacaccaagggctacggcattggcatgccgctgggctccccgttccgggatgagatcacactggccatcctgcagcttcaggagaacaaccggctggagatcctgaagcgcaagtggtgggaggggggccggtgccccaaggaggaggaccatcgagctaaaggtttgggcatggagaacattggtggcatttttatcgtgctcatctgtggcctcatcattgctgtcttcgtggcggtcatggaattcatatggtccacacggaggtcagctgagtccgaggagaccccagctctgcatccagctgcctgccagtgttctgcacttggcccaaggactcctctgaaggagccgtccatgctgctagtaaaggtgccctccacccgtgtccaggttgccttctcaaggacatccctccggcaagtctgtcctttcctcctgcagcatcagttgtcctctctttattggattcaggccaccaacgtacaaatatgctgtcatttctccagtcttaaaccctctcctgacctcactttccctcccagccaccgcccactttcttcccttctctttacagccttggcagcagtggggggtctccctgatgcttccagtttcttctttcctcccatttcctcttgccccccactccagtctggcatcggtccctgccactccactgaagccactcttgtcaccagcaacttccatgtctgaaattcccggtctcaggcctcatgtatatgaggtagcagtgggcttcggcacagccagtcactctcaatcctcaaagccccttcttccccttctcccacttctccggtcactccttcccaggctccctcgttgggtttctctttctccccaggctctgtttgttgtggggctccagggctcagtccttagactgcttctcttctcggtctttctccactacttgaatgatcccaccagccaaatggctcttaagacccactatgtgctggtgattcttgtgttagttatctattgctatcataacaaatgaccttaacagcttttaaaaa

SEQ ID NO: 12314 - DNA, 4779 bp, Homo sapiens
ggtaaggctctggaaaagggggcgctgggagcgcattgcgagggggctggagagggagagaggagcggaagctgagggtgtgaaacggctggccccgaacacacctcgcggcgctccagtgattcctggtgtccgacctcagccccagtcagtgcgggtccagtttccaggctctcgcggaaggcctggctgagcacatgcggcagccacggtcaccctccctattcctcttagcccgaggaggggggtcccaagttacatggccacgcagatggggcctctccctcatttctgaaccttgtggggaggggaaccttgaagggagcgccccccagagccatggcttagggcctcccccacccctctggagctccagtctgcaagagtcaggagccgaaatatcgctgactgtgggtgacgactcttgcgcgcacacacacatacaagcgggcacgacgcgttcggtcctattaaaaggcacgcaagggtgcgggctgcacgcggtgacacggacccctctaacgtttccaaactgagctccctgcaggtccccgacagcacaggcccctgtcccaggacccctccaggcacgcgctcacacgcacacgcgcgctccccggctcacgcgcgctccgacacacacgctcacgcgaacgcaggcgcacgctctggcgcgggaggcgcccccttcgcctccgtgttgggaagcgggggcggcgggaggggcaggagacgttggccccgctcgcgtttctgcagctgctgcagtcgccgcagcgtccggaccggaaccagcgccgtccgcggagccgccgccgccgccgccgggccctttccaagccgggcgctcggagctgtgcccggccccgcttcagcaccgcggacagcgccggccgcgtggggctgagccccgagcccccgcgcacgcttcagcgccccttccctcggccgacgtcccgggaccgccgctccgggggagacgtggcgtccgcagcccgcggggccgggcgagcgcaggacggcccggaagccccgcgggggatgcgccgagggccccgcgttcgcgccgcgcagagccaggcccgcggcccgagcccatgagcaccatgcgcctgctgacgctcgccctgctgttctcctgctccgtcgcccgtgccgcgtgcgaccccaagatcgtcaacattggcgcggtgctgagcacgcggaagcacgagcagatgttccgcgaggccgtgaaccaggccaacaagcggcacggctcctggaagattcagctcaatgccacctccgtcacgcacaagcccaacgccatccagatggctctgtcggtgtgcgaggacctcatctccagccaggtctacgccatcctagttagccatccacctacccccaacgaccacttcactcccacccctgtctcctacacagccggcttctaccgcatacccgtgctggggctgaccacccgcatgtccatctactcggacaagagcatccacctgagcttcctgcgcaccgtgccgccctactcccaccagtccagcgtgtggtttgagatgatgcgtgtctacagctggaaccacatcatcctgctggtcagcgacgaccacgagggccgggcggctcagaaacgcctggagacgctgctggaggagcgtgagtccaaggcagagaaggtgctgcagtttgacccagggaccaagaacgtgacggccctgctgatggaggcgaaagagctggaggcccgggtcatcatcctttctgccagcgaggacgatgctgccactgtataccgcgcagccgcgatgctgaacatgacgggctccgggtacgtgtggctggtcggcgagcgcgagatctcggggaacgccctgcgctacgccccagacggcatcctcgggctgcagctcatcaacggcaagaacgagtcggcccacatcagcgacgccgtgggcgtggtggcccaggccgtgcacgagctcctcgagaaggagaacatcaccgacccgccgcggggctgcgtgggcaacaccaacatctggaagaccgggccgctcttcaagagagtgctgatgtcttccaagtatgcggatggggtgactggtcgcgtggagttcaatgaggatggggaccggaagttcgccaactacagcatcatgaacctgcagaaccgcaagctggtgcaagtgggcatctacaatggcacccacgtcatccctaatgacaggaagatcatctggccaggcggagagacagagaagcctcgagggtaccagatgtccaccagactgaagattgtgacgatccaccaggagcccttcgtgtacgtcaagcccacgctgagtgatgggacatgcaaggaggagttcacagtcaacggcgacccagtcaagaaggtgatctgcaccgggcccaacgacacgtcgccgggcagcccccgccacacggtgcctcagtgttgctacggcttttgcatcgacctgctcatcaagctggcacggaccatgaacttcacctacgaggtgcacctggtggcagatggcaagttcggcacacaggagcgggtgaacaacagcaacaagaaggagtggaatgggatgatgggcgagctgctcagcgggcaggcagacatgatcgtggcgccgctaaccataaacaacgagcgcgcgcagtacatcgagttttccaagcccttcaagtaccagggcctgactattctggtcaagaaggagattccccggagcacgctggactcgttcatgcagccgttccagagcacactgtggctgctggtggggctgtcggtgcacgtggtggccgtgatgctgtacctgctggaccgcttcagccccttcggccggttcaaggtgaacagcgaggaggaggaggaggacgcactgaccctgtcctcggccatgtggttctcctggggcgtcctgctcaactccggcatcggggaaggcgcccccagaagcttctcagcgcgcatcctgggcatggtgtgggccggctttgccatgatcatcgtggcctcctacaccgccaacctggcggccttcctggtgctggaccggccggaggagcgcatcacgggcatcaacgaccctcggctgaggaacccctcggacaagtttatctacgccacggtgaagcagagctccgtggatatctacttccggcgccaggtggagctgagcaccatgtaccggcatatggagaagcacaactacgagagtgcggcggaggccatccaggccgtgagagacaacaagctgcatgccttcatctgggactcggcggtgctggagttcgaggcctcgcagaagtgcgacctggtgacgactggagagctgtttttccgctcgggcttcggcataggcatgcgcaaagacagcccctggaagcagaacgtctccctgtccatcctcaagtcccacgagaatggcttcatggaagacctggacaagacgtgggttcggtatcaggaatgtgactcgcgcagcaacgcccctgcgacccttacttttgagaacatggccggggtcttcatgctggtagctgggggcatcgtggccgggatcttcctgattttcatcgagattgcctacaagcggcacaaggatgctcgccggaagcagatgcagctggcctttgccgccgttaacgtgtggcggaagaacctgcaggatagaaagagtggtagagcagagcctgaccctaaaaagaaagccacatttagggctatcacctccaccctggcttccagcttcaagaggcgtaggtcctccaaagacacgcagtaccatcccactgatatcacgggcccgctcaacctctcagatccctcggtcagcaccgtggtgtgaggcccccggaggcgcccacctgcccagttagcccggccaaggacactgatgggtcctgctgctcgggaaggcctgagggaagcccacccgccccagagactgcccaccctgggcctcccgtccgtccgcccgcccaccccgctgcctggcgggcagcccctgctggaccaaggtgcggaccggagcggctgaggacggggcagagctgagtcggctgggcagggccgcagggcgctccggcagaggcagggccctggggtctctgagcagtggggagcgggggctaactggccccaggcggaggggcttggagcagagacggcagccccatccttcccgcagcaccagcctgagccacagtggggcccatggccccagctggctgggtcgcccctcctcgggcgcctgcgctcctctgcagcctgagctccaccctcccctcttcttgcggcaccgcccacccacaccccgtctgccccttgaccccacacgccggggctggccctgccctcccccacggccgtccctgacttcccagctggcagcgcctcccgccgcctcgggccgcctcctccagactcgagagggctgagcccctcctctcctcgtccggcctgcagcccagaacgggcctccccgggggtccccggacgctggctcgggactgtcttcaaccctgccctgcaccttgggcacgggagagcgccacccgcccgcccccgccctcgctccgggtgcgtgaccggcccgccaccttgtacagaaccagcactcccagggcccgagcgcgtgccttccccgtgcggcccgtgcgcagccgcgctctgcccctccgtccccagggtgcaggcgcgcaccgcccaacccccacctcccggtgtatgcagtggtgatgcctaaaggaatgtcacgc

SEQ ID NO: 12315 - DNA, 4184 bp, Homo sapiens
ggcccggaagccccgcgggggatgcgccgagggccccgcgttcgcgccgcgcagagccaggcccgcggcccgagcccatgagcaccatgcgcctgctgacgctcgccctgctgttctcctgctccgtcgcccgtgccgcgtgcgaccccaagatcgtcaacattggcgcggtgctgagcacgcggaagcacgagcagatgttccgcgaggccgtgaaccaggccaacaagcggcacggctcctggaagattcagctcaatgccacctccgtcacgcacaagcccaacgccatccagatggctctgtcggtgtgcgaggacctcatctccagccaggtctacgccatcctagttagccatccacctacccccaacgaccacttcactcccacccctgtctcctacacagccggcttctaccgcatacccgtgctggggctgaccacccgcatgtccatctactcggacaagagcatccacctgagcttcctgcgcaccgtgccgccctactcccaccagtccagcgtgtggtttgagatgatgcgtgtctacagctggaaccacatcatcctgctggtcagcgacgaccacgagggccgggcggctcagaaacgcctggagacgctgctggaggagcgtgagtccaaggcagagaaggtgctgcagtttgacccagggaccaagaacgtgacggccctgctgatggaggcgaaagagctggaggcccgggtcatcatcctttctgccagcgaggacgatgctgccactgtataccgcgcagccgcgatgctgaacatgacgggctccgggtacgtgtggctggtcggcgagcgcgagatctcggggaacgccctgcgctacgccccagacggcatcctcgggctgcagctcatcaacggcaagaacgagtcggcccacatcagcgacgccgtgggcgtggtggcccaggccgtgcacgagctcctcgagaaggagaacatcaccgacccgccgcggggctgcgtgggcaacaccaacatctggaagaccgggccgctcttcaagagagtgctgatgtcttccaagtatgcggatggggtgactggtcgcgtggagttcaatgaggatggggaccggaagttcgccaactacagcatcatgaacctgcagaaccgcaagctggtgcaagtgggcatctacaatggcacccacgtcatccctaatgacaggaagatcatctggccaggcggagagacagagaagcctcgagggtaccagatgtccaccagactgaagattgtgacgatccaccaggagcccttcgtgtacgtcaagcccacgctgagtgatgggacatgcaaggaggagttcacagtcaacggcgacccagtcaagaaggtgatctgcaccgggcccaacgacacgtcgccgggcagcccccgccacacggtgcctcagtgttgctacggcttttgcatcgacctgctcatcaagctggcacggaccatgaacttcacctacgaggtgcacctggtggcagatggcaagttcggcacacaggagcgggtgaacaacagcaacaagaaggagtggaatgggatgatgggcgagctgctcagcgggcaggcagacatgatcgtggcgccgctaaccataaacaacgagcgcgcgcagtacatcgagttttccaagcccttcaagtaccagggcctgactattctggtcaagaaggagattccccggagcacgctggactcgttcatgcagccgttccagagcacactgtggctgctggtggggctgtcggtgcacgtggtggccgtgatgctgtacctgctggaccgcttcagccccttcggccggttcaaggtgaacagcgaggaggaggaggaggacgcactgaccctgtcctcggccatgtggttctcctggggcgtcctgctcaactccggcatcggggaaggcgcccccagaagcttctcagcgcgcatcctgggcatggtgtgggccggctttgccatgatcatcgtggcctcctacaccgccaacctggcggccttcctggtgctggaccggccggaggagcgcatcacgggcatcaacgaccctcggctgaggaacccctcggacaagtttatctacgccacggtgaagcagagctccgtggatatctacttccggcgccaggtggagctgagcaccatgtaccggcatatggagaagcacaactacgagagtgcggcggaggccatccaggccgtgagagacaacaagctgcatgccttcatctgggactcggcggtgctggagttcgaggcctcgcagaagtgcgacctggtgacgactggagagctgtttttccgctcgggcttcggcataggcatgcgcaaagacagcccctggaagcagaacgtctccctgtccatcctcaagtcccacgagaatggcttcatggaagacctggacaagacgtgggttcggtatcaggaatgtgactcgcgcagcaacgcccctgcgacccttacttttgagaacatggccggggtcttcatgctggtagctgggggcatcgtggccgggatcttcctgattttcatcgagattgcctacaagcggcacaaggatgctcgccggaagcagatgcagctggcctttgccgccgttaacgtgtggcggaagaacctgcaggtagggcaggccaccctccgaggcctggtgcccagggcccggcctggccacggccctcctccatccccgaaggccgtggcactggctctggctctggtgggcaggactggagctaggagccatggccaggggcagtggtgagtgctcccagggcacgggggcagcaccggtggggggctgcctgcaggtggctgcccactgcaaagccggggccgagggaggccacgcaccctgctccaagcctccgcctggcccctctgtctccagagtcgcccgccggtacccattccataggaaggcaatcaggcagggtaagacaggggcccgcctgtgtatggcacgtgagtccaagatgcattttgccctccgccgacccaagccccttgacacccttcggagacccccccctttcctgctatgtccttgtgctccgtgactctaatccgaattgggccaggtccggtcctgcctggtgcccaggttgtatccatgagaatttgccaccagcaagggcagccacggcccacctgggacagggtgggcagtgggcctgtacaggcctaagggctcgtggcccgcggtcgagttccggttcactccgtctcttctctttctctgggtgccgtcctggagcctgtgtcctgagatgaagccgacagtgcggccagggctgctgggggatgggggttgctggaggctccacacctctcatccgcccgctcttgctcttggcccccacaggtcccctggggacctggccgctgccagcactggcgggcacaggccacctggccatcagacctgaggccagagtcccgggagctgcctctgtcactccaattccacctcgacacctgcctccagccctcggccccttcctgaatcttggtgtgtgccccttgggggtcagtggcctccacgcagacagctggtgtggcctgaggggcaactcctccagtcctcagaggactcctcctcctcgggacgcctgtaagccagggccacccaggagccagggagccaggcggacctcccaggaagagccagccgagagcccccaagcccagccccagcacgagcaaggtcaggcccgagaccccgggcaggagaagaggccaccctcgaacgtccgctgtcggcccgtctgtccagcacagggaggcaggcaggagcgagggcccaagtggccggccaggctgggcagcggcccatgcaggagcaggcgagggcaggtgtggccaccaccctagccatctaatcacttatacatattcattttaggatagaaagagtggtagagcagagcctgaccctaaaaagaaagccacatttagggctatcacctccaccctggcttccagcttcaagaggcgtaggtcctccaaagacacggtaagggggagagcaccccagtcccgcgtccgactccacctgccctgccctgcgtgtgtctcccgccccatcaccccgccccggaccctgggctcctgtggcccactctgcccctgtctccctgtg

SEQ ID NO: 12316 - DNA, 3751 bp, Homo sapiens
gagcccatgagcaccatgcgcctgctgacgctcgccctgctgttctcctgctccgtcgcccgtgccgcgtgcgaccccaagatcgtcaacattggcgcggtgctgagcacgcggaagcacgagcagatgttccgcgaggccgtgaaccaggccaacaagcggcacggctcctggaagattcagctcaatgccacctccgtcacgcacaagcccaacgccatccagatggctctgtcggtgtgcgaggacctcatctccagccaggtctacgccatcctagttagccatccacctacccccaacgaccacttcactcccacccctgtctcctacacagccggcttctaccgcatacccgtgctggggctgaccacccgcatgtccatctactcggacaagagcatccacctgagcttcctgcgcaccgtgccgccctactcccaccagtccagcgtgtggtttgagatgatgcgtgtctacagctggaaccacatcatcctgctggtcagcgacgaccacgagggccgggcggctcagaaacgcctggagacgctgctggaggagcgtgagtccaagagtaaaaaaaggaactatgaaaacctcgaccaactgtcctatgacaacaagcgcggacccaaggcagagaaggtgctgcagtttgacccagggaccaagaacgtgacggccctgctgatggaggcgaaagagctggaggcccgggtcatcatcctttctgccagcgaggacgatgctgccactgtataccgcgcagccgcgatgctgaacatgacgggctccgggtacgtgtggctggtcggcgagcgcgagatctcggggaacgccctgcgctacgccccagacggcatcctcgggctgcagctcatcaacggcaagaacgagtcggcccacatcagcgacgccgtgggcgtggtggcccaggccgtgcacgagctcctcgagaaggagaacatcaccgacccgccgcggggctgcgtgggcaacaccaacatctggaagaccgggccgctcttcaagagagtgctgatgtcttccaagtatgcggatggggtgactggtcgcgtggagttcaatgaggatggggaccggaagttcgccaactacagcatcatgaacctgcagaaccgcaagctggtgcaagtgggcatctacaatggcacccacgtcatccctaatgacaggaagatcatctggccaggcggagagacagagaagcctcgagggtaccagatgtccaccagactgaagattgtgacgatccaccaggagcccttcgtgtacgtcaagcccacgctgagtgatgggacatgcaaggaggagttcacagtcaacggcgacccagtcaagaaggtgatctgcaccgggcccaacgacacgtcgccgggcagcccccgccacacggtgcctcagtgttgctacggcttttgcatcgacctgctcatcaagctggcacggaccatgaacttcacctacgaggtgcacctggtggcagatggcaagttcggcacacaggagcgggtgaacaacagcaacaagaaggagtggaatgggatgatgggcgagctgctcagcgggcaggcagacatgatcgtggcgccgctaaccataaacaacgagcgcgcgcagtacatcgagttttccaagcccttcaagtaccagggcctgactattctggtcaagaaggagattccccggagcacgctggactcgttcatgcagccgttccagagcacactgtggctgctggtggggctgtcggtgcacgtggtggccgtgatgctgtacctgctggaccgcttcagccccttcggccggttcaaggtgaacagcgaggaggaggaggaggacgcactgaccctgtcctcggccatgtggttctcctggggcgtcctgctcaactccggcatcggggaaggcgcccccagaagcttctcagcgcgcatcctgggcatggtgtgggccggctttgccatgatcatcgtggcctcctacaccgccaacctggcggccttcctggtgctggaccggccggaggagcgcatcacgggcatcaacgaccctcggctgaggaacccctcggacaagtttatctacgccacggtgaagcagagctccgtggatatctacttccggcgccaggtggagctgagcaccatgtaccggcatatggagaagcacaactacgagagtgcggcggaggccatccaggccgtgagagacaacaagctgcatgccttcatctgggactcggcggtgctggagttcgaggcctcgcagaagtgcgacctggtgacgactggagagctgtttttccgctcgggcttcggcataggcatgcgcaaagacagcccctggaagcagaacgtctccctgtccatcctcaagtcccacgagaatggcttcatggaagacctggacaagacgtgggttcggtatcaggaatgtgactcgcgcagcaacgcccctgcgacccttacttttgagaacatggccggggtcttcatgctggtagctgggggcatcgtggccgggatcttcctgattttcatcgagattgcctacaagcggcacaaggatgctcgccggaagcagatgcagctggcctttgccgccgttaacgtgtggcggaagaacctgcaggatagaaagagtggtagagcagagcctgaccctaaaaagaaagccacatttagggctatcacctccaccctggcttccagcttcaagaggcgtaggtcctccaaagacacgcagtaccatcccactgatatcacgggcccgctcaacctctcagatccctcggtcagcaccgtggtgtgaggcccccggaggcgcccacctgcccagttagcccggccaaggacactgatgggtcctgctgctcgggaaggcctgagggaagcccacccgccccagagactgcccaccctgggcctcccgtccgtccgcccgcccaccccgctgcctggcgggcagcccctgctggaccaaggtgcggaccggagcggctgaggacggggcagagctgagtcggctgggcagggccgcagggcgctccggcagaggcagggccctggggtctctgagcagtggggagcgggggctaactggccccaggcggaggggcttggagcagagacggcagccccatccttcccgcagcaccagcctgagccacagtggggcccatggccccagctggctgggtcgcccctcctcgggcgcctgcgctcctctgcagcctgagctccaccctcccctcttcttgcggcaccgcccacccacaccccgtctgccccttgaccccacacgccggggctggccctgccctcccccacggccgtccctgacttcccagctggcagcgcctcccgccgcctcgggccgcctcctccagactcgagagggctgagcccctcctctcctcgtccggcctgcagcccagaacgggcctccccgggggtccccggacgctggctcgggactgtcttcaaccctgccctgcaccttgggcacgggagagcgccacccgcccgcccccgccctcgctccgggtgcgtgaccggcccgccaccttgtacagaaccagcactcccagggcccgagcgcgtgccttccccgtgcggcccgtgcgcagccgcgctctgcccctccgtccccagggtgcaggcgcgcaccgcccaacccccacctcccggtgtatgcagtggtgatgcctaaaggaatgtcacgc

SEQ ID NO: 12317 - DNA, 4003 bp, Homo sapiens
gagcccatgagcaccatgcgcctgctgacgctcgccctgctgttctcctgctccgtcgcccgtgccgcgtgcgaccccaagatcgtcaacattggcgcggtgctgagcacgcggaagcacgagcagatgttccgcgaggccgtgaaccaggccaacaagcggcacggctcctggaagattcagctcaatgccacctccgtcacgcacaagcccaacgccatccagatggctctgtcggtgtgcgaggacctcatctccagccaggtctacgccatcctagttagccatccacctacccccaacgaccacttcactcccacccctgtctcctacacagccggcttctaccgcatacccgtgctggggctgaccacccgcatgtccatctactcggacaagagcatccacctgagcttcctgcgcaccgtgccgccctactcccaccagtccagcgtgtggtttgagatgatgcgtgtctacagctggaaccacatcatcctgctggtcagcgacgaccacgagggccgggcggctcagaaacgcctggagacgctgctggaggagcgtgagtccaagagtaaaaaaaggaactatgaaaacctcgaccaactgtcctatgacaacaagcgcggacccaaggcagagaaggtgctgcagtttgacccagggaccaagaacgtgacggccctgctgatggaggcgaaagagctggaggcccgggtcatcatcctttctgccagcgaggacgatgctgccactgtataccgcgcagccgcgatgctgaacatgacgggctccgggtacgtgtggctggtcggcgagcgcgagatctcggggaacgccctgcgctacgccccagacggcatcctcgggctgcagctcatcaacggcaagaacgagtcggcccacatcagcgacgccgtgggcgtggtggcccaggccgtgcacgagctcctcgagaaggagaacatcaccgacccgccgcggggctgcgtgggcaacaccaacatctggaagaccgggccgctcttcaagagagtgctgatgtcttccaagtatgcggatggggtgactggtcgcgtggagttcaatgaggatggggaccggaagttcgccaactacagcatcatgaacctgcagaaccgcaagctggtgcaagtgggcatctacaatggcacccacgtcatccctaatgacaggaagatcatctggccaggcggagagacagagaagcctcgagggtaccagatgtccaccagactgaagattgtgacgatccaccaggagcccttcgtgtacgtcaagcccacgctgagtgatgggacatgcaaggaggagttcacagtcaacggcgacccagtcaagaaggtgatctgcaccgggcccaacgacacgtcgccgggcagcccccgccacacggtgcctcagtgttgctacggcttttgcatcgacctgctcatcaagctggcacggaccatgaacttcacctacgaggtgcacctggtggcagatggcaagttcggcacacaggagcgggtgaacaacagcaacaagaaggagtggaatgggatgatgggcgagctgctcagcgggcaggcagacatgatcgtggcgccgctaaccataaacaacgagcgcgcgcagtacatcgagttttccaagcccttcaagtaccagggcctgactattctggtcaagaaggagattccccggagcacgctggactcgttcatgcagccgttccagagcacactgtggctgctggtggggctgtcggtgcacgtggtggccgtgatgctgtacctgctggaccgcttcagccccttcggccggttcaaggtgaacagcgaggaggaggaggaggacgcactgaccctgtcctcggccatgtggttctcctggggcgtcctgctcaactccggcatcggggaaggcgcccccagaagcttctcagcgcgcatcctgggcatggtgtgggccggctttgccatgatcatcgtggcctcctacaccgccaacctggcggccttcctggtgctggaccggccggaggagcgcatcacgggcatcaacgaccctcggctgaggaacccctcggacaagtttatctacgccacggtgaagcagagctccgtggatatctacttccggcgccaggtggagctgagcaccatgtaccggcatatggagaagcacaactacgagagtgcggcggaggccatccaggccgtgagagacaacaagctgcatgccttcatctgggactcggcggtgctggagttcgaggcctcgcagaagtgcgacctggtgacgactggagagctgtttttccgctcgggcttcggcataggcatgcgcaaagacagcccctggaagcagaacgtctccctgtccatcctcaagtcccacgagaatggcttcatggaagacctggacaagacgtgggttcggtatcaggaatgtgactcgcgcagcaacgcccctgcgacccttacttttgagaacatggccggggtcttcatgctggtagctgggggcatcgtggccgggatcttcctgattttcatcgagattgcctacaagcggcacaaggatgctcgccggaagcagatgcagctggcctttgccgccgttaacgtgtggcggaagaacctgcagagcaccgggggtggacgcggcgctttgcaaaaccaaaaagacacagtgctgccgcgacgcgctattgagagggaggagggccagctgcagctgtgttcccgtcatagggagagctgagactccccgcccgccctcctctgccccctcccccgcagacagacagacagacggacgggacagcggcccggcccacgcagagccccggagcaccacggggtcgggggaggagcacccccagcctcccccaggctgcgcctgcccgcccgccggttggccggctggccggtccaccccgtcccggccccgcgcgtgcccccagcgtggggctaacgggcgccttgtctgtgtatttctattttgcagcagtaccatcccactgatatcacgggcccgctcaacctctcagatccctcggtcagcaccgtggtgtgaggcccccggaggcgcccacctgcccagttagcccggccaaggacactgatgggtcctgctgctcgggaaggcctgagggaagcccacccgccccagagactgcccaccctgggcctcccgtccgtccgcccgcccaccccgctgcctggcgggcagcccctgctggaccaaggtgcggaccggagcggctgaggacggggcagagctgagtcggctgggcagggccgcagggcgctccggcagaggcagggccctggggtctctgagcagtggggagcgggggctaactggccccaggcggaggggcttggagcagagacggcagccccatccttcccgcagcaccagcctgagccacagtggggcccatggccccagctggctgggtcgcccctcctcgggcgcctgcgctcctctgcagcctgagctccaccctcccctcttcttgcggcaccgcccacccacaccccgtctgccccttgaccccacacgccggggctggccctgccctcccccacggccgtccctgacttcccagctggcagcgcctcccgccgcctcgggccgcctcctccagactcgagagggctgagcccctcctctcctcgtccggcctgcagcccagaacgggcctccccgggggtccccggacgctggctcgggactgtcttcaaccctgccctgcaccttgggcacgggagagcgccacccgcccgcccccgccctcgctccgggtgcgtgaccggcccgccaccttgtacagaaccagcactcccagggcccgagcgcgtgccttccccgtgcggcccgtgcgcagccgcgctctgcccctccgtccccagggtgcaggcgcgcaccgcccaacccccacctcccggtgtatgcagtggtgatgcctaaaggaatgtcacgc

SEQ ID NO: 12318 - DNA, 3640 bp, Homo sapiens
gagcccatgagcaccatgcgcctgctgacgctcgccctgctgttctcctgctccgtcgcccgtgccgcgtgcgaccccaagatcgtcaacattggcgcggtgctgagcacgcggaagcacgagcagatgttccgcgaggccgtgaaccaggccaacaagcggcacggctcctggaagattcagctcaatgccacctccgtcacgcacaagcccaacgccatccagatggctctgtcggtgtgcgaggacctcatctccagccaggtctacgccatcctagttagccatccacctacccccaacgaccacttcactcccacccctgtctcctacacagccggcttctaccgcatacccgtgctggggctgaccacccgcatgtccatctactcggacaagagcatccacctgagcttcctgcgcaccgtgccgccctactcccaccagtccagcgtgtggtttgagatgatgcgtgtctacagctggaaccacatcatcctgctggtcagcgacgaccacgagggccgggcggctcagaaacgcctggagacgctgctggaggagcgtgagtccaagagtaaaaaaaggaactatgaaaacctcgaccaactgtcctatgacaacaagcgcggacccaaggcagagaaggtgctgcagtttgacccagggaccaagaacgtgacggccctgctgatggaggcgaaagagctggaggcccgggtcatcatcctttctgccagcgaggacgatgctgccactgtataccgcgcagccgcgatgctgaacatgacgggctccgggtacgtgtggctggtcggcgagcgcgagatctcggggaacgccctgcgctacgccccagacggcatcctcgggctgcagctcatcaacggcaagaacgagtcggcccacatcagcgacgccgtgggcgtggtggcccaggccgtgcacgagctcctcgagaaggagaacatcaccgacccgccgcggggctgcgtgggcaacaccaacatctggaagaccgggccgctcttcaagagagtgctgatgtcttccaagtatgcggatggggtgactggtcgcgtggagttcaatgaggatggggaccggaagttcgccaactacagcatcatgaacctgcagaaccgcaagctggtgcaagtgggcatctacaatggcacccacgtcatccctaatgacaggaagatcatctggccaggcggagagacagagaagcctcgagggtaccagatgtccaccagactgaagattgtgacgatccaccaggagcccttcgtgtacgtcaagcccacgctgagtgatgggacatgcaaggaggagttcacagtcaacggcgacccagtcaagaaggtgatctgcaccgggcccaacgacacgtcgccgggcagcccccgccacacggtgcctcagtgttgctacggcttttgcatcgacctgctcatcaagctggcacggaccatgaacttcacctacgaggtgcacctggtggcagatggcaagttcggcacacaggagcgggtgaacaacagcaacaagaaggagtggaatgggatgatgggcgagctgctcagcgggcaggcagacatgatcgtggcgccgctaaccataaacaacgagcgcgcgcagtacatcgagttttccaagcccttcaagtaccagggcctgactattctggtcaagaaggagattccccggagcacgctggactcgttcatgcagccgttccagagcacactgtggctgctggtggggctgtcggtgcacgtggtggccgtgatgctgtacctgctggaccgcttcagccccttcggccggttcaaggtgaacagcgaggaggaggaggaggacgcactgaccctgtcctcggccatgtggttctcctggggcgtcctgctcaactccggcatcggggaaggcgcccccagaagcttctcagcgcgcatcctgggcatggtgtgggccggctttgccatgatcatcgtggcctcctacaccgccaacctggcggccttcctggtgctggaccggccggaggagcgcatcacgggcatcaacgaccctcggctgaggaacccctcggacaagtttatctacgccacggtgaagcagagctccgtggatatctacttccggcgccaggtggagctgagcaccatgtaccggcatatggagaagcacaactacgagagtgcggcggaggccatccaggccgtgagagacaacaagctgcatgccttcatctgggactcggcggtgctggagttcgaggcctcgcagaagtgcgacctggtgacgactggagagctgtttttccgctcgggcttcggcataggcatgcgcaaagacagcccctggaagcagaacgtctccctgtccatcctcaagtcccacgagaatggcttcatggaagacctggacaagacgtgggttcggtatcaggaatgtgactcgcgcagcaacgcccctgcgacccttacttttgagaacatggccggggtcttcatgctggtagctgggggcatcgtggccgggatcttcctgattttcatcgagattgcctacaagcggcacaaggatgctcgccggaagcagatgcagctggcctttgccgccgttaacgtgtggcggaagaacctgcagcagtaccatcccactgatatcacgggcccgctcaacctctcagatccctcggtcagcaccgtggtgtgaggcccccggaggcgcccacctgcccagttagcccggccaaggacactgatgggtcctgctgctcgggaaggcctgagggaagcccacccgccccagagactgcccaccctgggcctcccgtccgtccgcccgcccaccccgctgcctggcgggcagcccctgctggaccaaggtgcggaccggagcggctgaggacggggcagagctgagtcggctgggcagggccgcagggcgctccggcagaggcagggccctggggtctctgagcagtggggagcgggggctaactggccccaggcggaggggcttggagcagagacggcagccccatccttcccgcagcaccagcctgagccacagtggggcccatggccccagctggctgggtcgcccctcctcgggcgcctgcgctcctctgcagcctgagctccaccctcccctcttcttgcggcaccgcccacccacaccccgtctgccccttgaccccacacgccggggctggccctgccctcccccacggccgtccctgacttcccagctggcagcgcctcccgccgcctcgggccgcctcctccagactcgagagggctgagcccctcctctcctcgtccggcctgcagcccagaacgggcctccccgggggtccccggacgctggctcgggactgtcttcaaccctgccctgcaccttgggcacgggagagcgccacccgcccgcccccgccctcgctccgggtgcgtgaccggcccgccaccttgtacagaaccagcactcccagggcccgagcgcgtgccttccccgtgcggcccgtgcgcagccgcgctctgcccctccgtccccagggtgcaggcgcgcaccgcccaacccccacctcccggtgtatgcagtggtgatgcctaaaggaatgtcacgc

SEQ ID NO: 12319 - DNA, 5142 bp, Homo sapiens
ggtaaggctctggaaaagggggcgctgggagcgcattgcgagggggctggagagggagagaggagcggaagctgagggtgtgaaacggctggccccgaacacacctcgcggcgctccagtgattcctggtgtccgacctcagccccagtcagtgcgggtccagtttccaggctctcgcggaaggcctggctgagcacatgcggcagccacggtcaccctccctattcctcttagcccgaggaggggggtcccaagttacatggccacgcagatggggcctctccctcatttctgaaccttgtggggaggggaaccttgaagggagcgccccccagagccatggcttagggcctcccccacccctctggagctccagtctgcaagagtcaggagccgaaatatcgctgactgtgggtgacgactcttgcgcgcacacacacatacaagcgggcacgacgcgttcggtcctattaaaaggcacgcaagggtgcgggctgcacgcggtgacacggacccctctaacgtttccaaactgagctccctgcaggtccccgacagcacaggcccctgtcccaggacccctccaggcacgcgctcacacgcacacgcgcgctccccggctcacgcgcgctccgacacacacgctcacgcgaacgcaggcgcacgctctggcgcgggaggcgcccccttcgcctccgtgttgggaagcgggggcggcgggaggggcaggagacgttggccccgctcgcgtttctgcagctgctgcagtcgccgcagcgtccggaccggaaccagcgccgtccgcggagccgccgccgccgccgccgggccctttccaagccgggcgctcggagctgtgcccggccccgcttcagcaccgcggacagcgccggccgcgtggggctgagccccgagcccccgcgcacgcttcagcgccccttccctcggccgacgtcccgggaccgccgctccgggggagacgtggcgtccgcagcccgcggggccgggcgagcgcaggacggcccggaagccccgcgggggatgcgccgagggccccgcgttcgcgccgcgcagagccaggcccgcggcccgagcccatgagcaccatgcgcctgctgacgctcgccctgctgttctcctgctccgtcgcccgtgccgcgtgcgaccccaagatcgtcaacattggcgcggtgctgagcacgcggaagcacgagcagatgttccgcgaggccgtgaaccaggccaacaagcggcacggctcctggaagattcagctcaatgccacctccgtcacgcacaagcccaacgccatccagatggctctgtcggtgtgcgaggacctcatctccagccaggtctacgccatcctagttagccatccacctacccccaacgaccacttcactcccacccctgtctcctacacagccggcttctaccgcatacccgtgctggggctgaccacccgcatgtccatctactcggacaagagcatccacctgagcttcctgcgcaccgtgccgccctactcccaccagtccagcgtgtggtttgagatgatgcgtgtctacagctggaaccacatcatcctgctggtcagcgacgaccacgagggccgggcggctcagaaacgcctggagacgctgctggaggagcgtgagtccaaggcagagaaggtgctgcagtttgacccagggaccaagaacgtgacggccctgctgatggaggcgaaagagctggaggcccgggtcatcatcctttctgccagcgaggacgatgctgccactgtataccgcgcagccgcgatgctgaacatgacgggctccgggtacgtgtggctggtcggcgagcgcgagatctcggggaacgccctgcgctacgccccagacggcatcctcgggctgcagctcatcaacggcaagaacgagtcggcccacatcagcgacgccgtgggcgtggtggcccaggccgtgcacgagctcctcgagaaggagaacatcaccgacccgccgcggggctgcgtgggcaacaccaacatctggaagaccgggccgctcttcaagagagtgctgatgtcttccaagtatgcggatggggtgactggtcgcgtggagttcaatgaggatggggaccggaagttcgccaactacagcatcatgaacctgcagaaccgcaagctggtgcaagtgggcatctacaatggcacccacgtcatccctaatgacaggaagatcatctggccaggcggagagacagagaagcctcgagggtaccagatgtccaccagactgaagattgtgacgatccaccaggagcccttcgtgtacgtcaagcccacgctgagtgatgggacatgcaaggaggagttcacagtcaacggcgacccagtcaagaaggtgatctgcaccgggcccaacgacacgtcgccgggcagcccccgccacacggtgcctcagtgttgctacggcttttgcatcgacctgctcatcaagctggcacggaccatgaacttcacctacgaggtgcacctggtggcagatggcaagttcggcacacaggagcgggtgaacaacagcaacaagaaggagtggaatgggatgatgggcgagctgctcagcgggcaggcagacatgatcgtggcgccgctaaccataaacaacgagcgcgcgcagtacatcgagttttccaagcccttcaagtaccagggcctgactattctggtcaagaaggagattccccggagcacgctggactcgttcatgcagccgttccagagcacactgtggctgctggtggggctgtcggtgcacgtggtggccgtgatgctgtacctgctggaccgcttcagccccttcggccggttcaaggtgaacagcgaggaggaggaggaggacgcactgaccctgtcctcggccatgtggttctcctggggcgtcctgctcaactccggcatcggggaaggcgcccccagaagcttctcagcgcgcatcctgggcatggtgtgggccggctttgccatgatcatcgtggcctcctacaccgccaacctggcggccttcctggtgctggaccggccggaggagcgcatcacgggcatcaacgaccctcggctgaggaacccctcggacaagtttatctacgccacggtgaagcagagctccgtggatatctacttccggcgccaggtggagctgagcaccatgtaccggcatatggagaagcacaactacgagagtgcggcggaggccatccaggccgtgagagacaacaagctgcatgccttcatctgggactcggcggtgctggagttcgaggcctcgcagaagtgcgacctggtgacgactggagagctgtttttccgctcgggcttcggcataggcatgcgcaaagacagcccctggaagcagaacgtctccctgtccatcctcaagtcccacgagaatggcttcatggaagacctggacaagacgtgggttcggtatcaggaatgtgactcgcgcagcaacgcccctgcgacccttacttttgagaacatggccggggtcttcatgctggtagctgggggcatcgtggccgggatcttcctgattttcatcgagattgcctacaagcggcacaaggatgctcgccggaagcagatgcagctggcctttgccgccgttaacgtgtggcggaagaacctgcaggatagaaagagtggtagagcagagcctgaccctaaaaagaaagccacatttagggctatcacctccaccctggcttccagcttcaagaggcgtaggtcctccaaagacacgagcaccgggggtggacgcggcgctttgcaaaaccaaaaagacacagtgctgccgcgacgcgctattgagagggaggagggccagctgcagctgtgttcccgtcatagggagagctgagactccccgcccgccctcctctgccccctcccccgcagacagacagacagacggacgggacagcggcccggcccacgcagagccccggagcaccacggggtcgggggaggagcacccccagcctcccccaggctgcgcctgcccgcccgccggttggccggctggccggtccaccccgtcccggccccgcgcgtgcccccagcgtggggctaacgggcgccttgtctgtgtatttctattttgcagcagtaccatcccactgatatcacgggcccgctcaacctctcagatccctcggtcagcaccgtggtgtgaggcccccggaggcgcccacctgcccagttagcccggccaaggacactgatgggtcctgctgctcgggaaggcctgagggaagcccacccgccccagagactgcccaccctgggcctcccgtccgtccgcccgcccaccccgctgcctggcgggcagcccctgctggaccaaggtgcggaccggagcggctgaggacggggcagagctgagtcggctgggcagggccgcagggcgctccggcagaggcagggccctggggtctctgagcagtggggagcgggggctaactggccccaggcggaggggcttggagcagagacggcagccccatccttcccgcagcaccagcctgagccacagtggggcccatggccccagctggctgggtcgcccctcctcgggcgcctgcgctcctctgcagcctgagctccaccctcccctcttcttgcggcaccgcccacccacaccccgtctgccccttgaccccacacgccggggctggccctgccctcccccacggccgtccctgacttcccagctggcagcgcctcccgccgcctcgggccgcctcctccagactcgagagggctgagcccctcctctcctcgtccggcctgcagcccagaacgggcctccccgggggtccccggacgctggctcgggactgtcttcaaccctgccctgcaccttgggcacgggagagcgccacccgcccgcccccgccctcgctccgggtgcgtgaccggcccgccaccttgtacagaaccagcactcccagggcccgagcgcgtgccttccccgtgcggcccgtgcgcagccgcgctctgcccctccgtccccagggtgcaggcgcgcaccgcccaacccccacctcccggtgtatgcagtggtgatgcctaaaggaatgtcacgc

SEQ ID NO: 12320 - DNA, 5031 bp, Homo sapiens
cgctcagcagctcccggtcgcacaactcccagcagccggcgctggggaggtggtagggggtgcgggtggaggtgcccagttagcttctcgtgggtggccaacctggggctcccattctcctgtgcaccctggagtggagctcccgctatcagccacaggggctgaggatccgcactgggggcgtcgtgggcatcgggcttcagcttcccccctcttgtctagcccccctgggcgcataggggggcttgtgagcactgcagactgcagccttcccctcaaccctccctcccctcgttggtgggctgaccctgcctctccttctctcctccgccccgttagagccctgctgcagagcctccggctgggatagccgccccccgtgggggcgatgcggacagcgcgggacagccaggggagcgcgctggggccgcagcatgcgggaacccgctaaacccggtggctgctgaggcggccgagatgctcgtgcgcgcagcgcgccccactgcatcctcgaccttctcgggctacagggaccgtcagtggcgactatgggcagagtgggctattggaccctgctggtgctgccggcccttctggtctggcgcggtccggcgccgagcgcggcggcggagaagggtccccccgcgctaaatattgcggtgatgctgggtcacagccacgacgtgacagagcgcgaacttcgaacactgtggggccccgagcaggcggcggggctgcccctggacgtgaacgtggtagctctgctgatgaaccgcaccgaccccaagagcctcatcacgcacgtgtgcgacctcatgtccggggcacgcatccacggcctcgtgtttggggacgacacggaccaggaggccgtagcccagatgctggattttatctcctcccacaccttcgtccccatcttgggcattcatgggggcgcatctatgatcatggctgacaaggatccgacgtctaccttcttccagtttggagcgtccatccagcagcaagccacggtcatgctgaagatcatgcaggattatgactggcatgtcttctccctggtgaccactatcttccctggctacagggaattcatcagcttcgtcaagaccacagtggacaacagctttgtgggctgggacatgcagaatgtgatcacactggacacttcctttgaggatgcaaagacacaagtccagctgaagaagatccactcttctgtcatcttgctctactgttccaaagacgaggctgttctcattctgagtgaggcccgctcccttggcctcaccgggtatgatttcttctggattgtccccagcttggtctctgggaacacggagctcatcccaaaagagtttccatcgggactcatttctgtctcctacgatgactgggactacagcctggaggcgagagtgagggacggcattggcatcctaaccaccgctgcatcttctatgctggagaagttctcctacatccccgaggccaaggccagctgctacgggcagatggagaggccagaggtcccgatgcacaccttgcacccatttatggtcaatgttacatgggatggcaaagacttatccttcactgaggaaggctaccaggtgcaccccaggctggtggtgattgtgctgaacaaagaccgggaatgggaaaaggtgggcaagtgggagaaccatacgctgagcctgaggcacgccgtgtggcccaggtacaagtccttctccgactgtgagccggatgacaaccatctcagcatcgtcaccctggaggaggccccattcgtcatcgtggaagacatagaccccctgaccgagacgtgtgtgaggaacaccgtgccatgtcggaagttcgtcaaaatcaacaattcaaccaatgaggggatgaatgtgaagaaatgctgcaaggggttctgcattgatattctgaagaagctttccagaactgtgaagtttacttacgacctctatctggtgaccaatgggaagcatggcaagaaagttaacaatgtgtggaatggaatgatcggtgaagtggtctatcaacgggcagtcatggcagttggctcgctcaccatcaatgaggaacgttctgaagtggtggacttctctgtgccctttgtggaaacgggaatcagtgtcatggtttcaagaagtaatggcaccgtctcaccttctgcttttctagaaccattcagcgcctctgtctgggtgatgatgtttgtgatgctgctcattgtttctgccatagctgtttttgtctttgaatacttcagccctgttggatacaacagaaacttagccaaagggaaagcaccccatgggccttcttttacaattggaaaagctatatggcttctttggggcctggtgttcaataactccgtgcctgtccagaatcctaaagggaccaccagcaagatcatggtatctgtatgggccttcttcgctgtcatattcctggctagctacacagccaatctggctgccttcatgatccaagaggaatttgtggaccaagtgaccggcctcagtgacaaaaagtttcagagacctcatgactattccccaccttttcgatttgggacagtgcctaatggaagcacggagagaaacattcggaataactatccctacatgcatcagtacatgaccaaatttaatcagaaaggagtagaggacgccttggtcagcctgaaaacggggaagctggacgctttcatctacgatgccgcagtcttgaattacaaggctgggagggatgaaggctgcaagctggtgaccatcgggagtgggtacatctttgccaccaccggttatggaattgcccttcagaaaggctctccttggaagaggcagatcgacctggccttgcttcagtttgtgggtgatggtgagatggaggagctggagaccctgtggctcactgggatctgccacaacgagaagaacgaggtgatgagcagccagctggacattgacaacatggcgggcgtattctacatgctggctgccgccatggcccttagcctcatcaccttcatctgggagcacctcttctactggaagctgcgcttctgtttcacgggcgtgtgctccgaccggcctgggttgctcttctccatcagcaggggcatctacagctgcattcatggagtgcacattgaagaaaagaagaagtctccagacttcaatctgacgggatcccagagcaacatgttaaaactcctccggtcagccaaaaacatttccagcatgtccaacatgaactcctcaagaatggactcacccaaaagagctgctgacttcatccaaagaggttccctcatcatggacatggtttcagataaggggaatttgatgtactcagacaacaggtcctttcaggggaaagagagcatttttggagacaacatgaacgaactccaaacatttgtggccaaccggcagaaggataacctcaataactatgtattccagggacaacatcctcttactctcaatgagtccaaccctaacacggtggaggtggccgtgagcacagaatccaaagcgaactctagaccccggcagctgtggaagaaatccgtggattccatacgccaggattcactatcccagaatccagtctcccagagggatgaggcaacagcagagaataggacccactccctaaagagccctaggtatcttccagaagagatggcccactctgacatttcagaaacgtcaaatcgggccacgtgccacagggaacctgacaacagtaagaaccacaaaaccaaggacaactttaaaaggtcagtggcctccaaataccccaaggactgtagtgaggtcgagcgcacctacctgaaaaccaaatcaagctcccctagagacaagatctacactatagatggtgagaaggagcctggtttccacttagatccaccccagtttgttgaaaatgtgaccctgcccgagaacgtggacttcccggacccctaccaggatcccagtgaaaacttccgcaagggggactccacgctgccaatgaaccggaaccccttgcataatgaagaggggctttccaacaacgaccagtataaactctactccaagcacttcaccttgaaagacaagggttccccgcacagtgagaccagcgagcgataccggcagaactccacgcactgcagaagctgcctttccaacatgcccacctattcaggccacttcaccatgaggtcccccttcaagtgcgatgcctgcctgcggatggggaacctctatgacatcgatgaagaccagatgcttcaggagacaggtaacccagccaccggggagcaggtctaccagcaggactgggcacagaacaatgcccttcaattacaaaagaacaagctaaggattagccgtcagcattcctacgataacattgtcgacaaacctagggagctagaccttagcaggccctcccggagcataagcctcaaggacagggaacggcttctggagggaaatttttacggcagcctgtttagtgtcccctcaagcaaactctcggggaaaaaaagctcccttttcccccaaggtctggaggacagcaagaggagcaagtctctcttgccagaccacacctccgataaccctttcctccactcccacagggatgaccaacgcttggttattgggagatgcccctcggacccttacaaacactcgttgccatcccaggcggtgaatgacagctatcttcggtcgtccttgaggtcaacggcatcgtactgttccagggacagtcggggccacaatgatgtgtatatttcggagcatgttatgccttatgctgcaaataagaataatatgtactctacccccagggttttaaattcctgcagcaatagacgcgtgtacaagaaaatgcctagtatcgaatctgatgtttaaaaatcttccattaatgttttatctatagggaaatatacgtaatggccaatgttctggagggtaaatgttggatgtccaatagtgccct

SEQ ID NO: 12321 - DNA, 14450 bp, Homo sapiens
atcatgggaccgggtgagcgctgagaatcgcggccgcagccatcagccctggagatgaccaggagcggccactgctgagaactatgtggagagaggctgcgagccctgctgcagagcctccggctgggatagccgccccccgtgggggcgatgcggacagcgcgggacagccaggggagcgcgctggggccgcagcatgcgggaacccgctaaacccggtggctgctgaggcggccgagatgctcgtgcgcgcagcgcgccccactgcatcctcgaccttctcgggctacagggaccgtcagtggcgactatgggcagagtgggctattggaccctgctggtgctgccggcccttctggtctggcgcggtccggcgccgagcgcggcggcggagaagggtccccccgcgctaaatattgcggtgatgctgggtcacagccacgacgtgacagagcgcgaacttcgaacactgtggggccccgagcaggcggcggggctgcccctggacgtgaacgtggtagctctgctgatgaaccgcaccgaccccaagagcctcatcacgcacgtgtgcgacctcatgtccggggcacgcatccacggcctcgtgtttggggacgacacggaccaggaggccgtagcccagatgctggattttatctcctcccacaccttcgtccccatcttgggcattcatgggggcgcatctatgatcatggctgacaaggatccgacgtctaccttcttccagtttggagcgtccatccagcagcaagccacggtcatgctgaagatcatgcaggattatgactggcatgtcttctccctggtgaccactatcttccctggctacagggaattcatcagcttcgtcaagaccacagtggacaacagctttgtgggctgggacatgcagaatgtgatcacactggacacttcctttgaggatgcaaagacacaagtccagctgaagaagatccactcttctgtcatcttgctctactgttccaaagacgaggctgttctcattctgagtgaggcccgctcccttggcctcaccgggtatgatttcttctggattgtccccagcttggtctctgggaacacggagctcatcccaaaagagtttccatcgggactcatttctgtctcctacgatgactgggactacagcctggaggcgagagtgagggacggcattggcatcctaaccaccgctgcatcttctatgctggagaagttctcctacatccccgaggccaaggccagctgctacgggcagatggagaggccagaggtcccgatgcacaccttgcacccatttatggtcaatgttacatgggatggcaaagacttatccttcactgaggaaggctaccaggtgcaccccaggctggtggtgattgtgctgaacaaagaccgggaatgggaaaaggtgggcaagtgggagaaccatacgctgagcctgaggcacgccgtgtggcccaggtacaagtccttctccgactgtgagccggatgacaaccatctcagcatcgtcaccctggaggaggccccattcgtcatcgtggaagacatagaccccctgaccgagacgtgtgtgaggaacaccgtgccatgtcggaagttcgtcaaaatcaacaattcaaccaatgaggggatgaatgtgaagaaatgctgcaaggggttctgcattgatattctgaagaagctttccagaactgtgaagtttacttacgacctctatctggtgaccaatgggaagcatggcaagaaagttaacaatgtgtggaatggaatgatcggtgaagtggtctatcaacgggcagtcatggcagttggctcgctcaccatcaatgaggaacgttctgaagtggtggacttctctgtgccctttgtggaaacgggaatcagtgtcatggtttcaagaagtaatggcaccgtctcaccttctgcttttctagaaccattcagcgcctctgtctgggtgatgatgtttgtgatgctgctcattgtttctgccatagctgtttttgtctttgaatacttcagccctgttggatacaacagaaacttagccaaagggaaagcaccccatgggccttcttttacaattggaaaagctatatggcttctttggggcctggtgttcaataactccgtgcctgtccagaatcctaaagggaccaccagcaagatcatggtatctgtatgggccttcttcgctgtcatattcctggctagctacacagccaatctggctgccttcatgatccaagaggaatttgtggaccaagtgaccggcctcagtgacaaaaagtttcagagacctcatgactattccccaccttttcgatttgggacagtgcctaatggaagcacggagagaaacattcggaataactatccctacatgcatcagtacatgaccaaatttaatcagaaaggagtagaggacgccttggtcagcctgaaaacggggaagctggacgctttcatctacgatgccgcagtcttgaattacaaggctgggagggatgaaggctgcaagctggtgaccatcgggagtgggtacatctttgccaccaccggttatggaattgcccttcagaaaggctctccttggaagaggcagatcgacctggccttgcttcagtttgtgggtgatggtgagatggaggagctggagaccctgtggctcactgggatctgccacaacgagaagaacgaggtgatgagcagccagctggacattgacaacatggcgggcgtattctacatgctggctgccgccatggcccttagcctcatcaccttcatctgggagcacctcttctactggaagctgcgcttctgtttcacgggcgtgtgctccgaccggcctgggttgctcttctccatcagcaggggcatctacagctgcattcatggagtgcacattgaagaaaagaagaagtctccagacttcaatctgacgggatcccagagcaacatgttaaaactcctccggtcagccaaaaacatttccagcatgtccaacatgaactcctcaagaatggactcacccaaaagagctgctgacttcatccaaagaggttccctcatcatggacatggtttcagataaggggaatttgatgtactcagacaacaggtcctttcaggggaaagagagcatttttggagacaacatgaacgaactccaaacatttgtggccaaccggcagaaggataacctcaataactatgtattccagggacaacatcctcttactctcaatgagtccaaccctaacacggtggaggtggccgtgagcacagaatccaaagcgaactctagaccccggcagctgtggaagaaatccgtggattccatacgccaggattcactatcccagaatccagtctcccagagggatgaggcaacagcagagaataggacccactccctaaagagccctaggtatcttccagaagagatggcccactctgacatttcagaaacgtcaaatcgggccacgtgccacagggaacctgacaacagtaagaaccacaaaaccaaggacaactttaaaaggtcagtggcctccaaataccccaaggactgtagtgaggtcgagcgcacctacctgaaaaccaaatcaagctcccctagagacaagatctacactatagatggtgagaaggagcctggtttccacttagatccaccccagtttgttgaaaatgtgaccctgcccgagaacgtggacttcccggacccctaccaggatcccagtgaaaacttccgcaagggggactccacgctgccaatgaaccggaaccccttgcataatgaagaggggctttccaacaacgaccagtataaactctactccaagcacttcaccttgaaagacaagggttccccgcacagtgagaccagcgagcgataccggcagaactccacgcactgcagaagctgcctttccaacatgcccacctattcaggccacttcaccatgaggtcccccttcaagtgcgatgcctgcctgcggatggggaacctctatgacatcgatgaagaccagatgcttcaggagacaggtaacccagccaccggggagcaggtctaccagcaggactgggcacagaacaatgcccttcaattacaaaagaacaagctaaggattagccgtcagcattcctacgataacattgtcgacaaacctagggagctagaccttagcaggccctcccggagcataagcctcaaggacagggaacggcttctggagggaaatttttacggcagcctgtttagtgtcccctcaagcaaactctcggggaaaaaaagctcccttttcccccaaggtctggaggacagcaagaggagcaagtctctcttgccagaccacacctccgataaccctttcctccactcccacagggatgaccaacgcttggttattgggagatgcccctcggacccttacaaacactcgttgccatcccaggcggtgaatgacagctatcttcggtcgtccttgaggtcaacggcatcgtactgttccagggacagtcggggccacaatgatgtgtatatttcggagcatgttatgccttatgctgcaaataagaataatatgtactctacccccagggttttaaattcctgcagcaatagacgcgtgtacaagaaaatgcctagtatcgaatctgatgtttaaaaatcttccattaatgttttatctatagggaaatatacgtaatggccaatgttctggagggtaaatgttggatgtccaatagtgccctgctaagaggaagaagatgtagggaggtattttgttgttgttgttgttggctcttttgcacacggcttcatgccataatcttccactcaaggaatcttgtgaggtgtgtgctgagcatggcagacaccagataggtgagtccttaaccaaaaataactaactacataagggcaagtctccgggacatgcctactgggtatgttggcaataatgatgcattggatgccaatggtgatgttatgatttcctatattccaaattccattaaggtcagcccaccatgtaattttctcatcagaaatgcctaatggtttctctaatacagaataagcaatatggtgtgcatgtaaacctgacacagacaaaataaaaacagttaagaatgcatctgcactgtagtgcgattgacatgtgcaagagattaggaagtttggctcgtaacagtttcagctttcttgttatgccttccatcacagcccaggctcaccccaagaactccaggctcccctaaagaatagcaaatcagtgtgttcgtgatgactgtgctaccttcattatagttcatttccaagacacatctggagccaaaggcccgagggaccctcaggtggggagagctacaggaatctctttggatgttgatgtgtgtttctctcaccctcggcttcgatggtcttgttcagagctgcataaactaacacatttatgtctccgagatctaagtgtggatcttctgtctgtgacacagtggccattgtagtttatcccgaagacgcctatgtacgtaagtttgcatttcctcccttctggtgatgactcagggttgtatagtatctgttaccccttccctcccagagtaaccataactcgttccgtttccaaacagccatggtggtgtccaattagctgtgtatcgctcttcccagagttgttaatgtggtgacatgcaccaacagccgtatgtgtactgtgatctgtaagaagtacaatgccatctgtctgccgaaggctagcatggttttaggtttatcttccttcacatccagaaattctgttggacactcacttccaccccaaactcctcaaatcaaaagccttcaaaacacgaggcactcttggatctaccctgagtatcctccaaactgtggatacagtttagtgagacaagcaatttctcccttctgagttattctctctgttggtggcaaaccacttcatagcaccaacagagatgtaggaaaaattcctcaaagtatttgtcatttctgagtcgcctgcattatcccattcttattctcctcaaacctgtgcatatatgacatgaaatgatatccattttttttttaagttagagacagagaggggaatacttatgcatggggagcctgttagcacagtgcctgccacaaaaacaagtgcccccgacaagatagttgctatgttatgacactttctcagatcaggattttctagtttaaaaattaaatatcataaaaccagcaaataatattaactaaaccttttatatagttctactctgttaattagtgtatttcatgtacatgaatatttttgaagtatttgggataactagccatcagtgtttgcagaagacctcagtctgttttgggccattacggaaacactaagctaatgtagactcgcctggccatttcctggtttcctcctgcattctgctttacattcttgaagaaagggataaagtggcaggttgaaaaattatcccatttcttctcctcatggtgtgcgttctgttttgtaagtattattttcttgcatgtgggcaagtgtcagggatgattcccttaaagctcaaggatgcatggaatagctccatctttgggaaagtacacctgacctacagtgttcctataatgaaaagtggttgcaataaatttcagggtcaatcatagggagacagagggaggcagtgggtgagaggagcttcctttcatttttgaaaggcagaaggggctgactaggtgctggggatgcatgtgcttgaaaatgacattttatttcccggatgctgtacctctgctgccccaagacccagccatggagaagcctggatcgaagggcccagaatagtcaccccaacatctgatcctaaatctgaatctccatgactgtgtagccttttagccctttctaccttctgcccttccagtgcattccagaccttaatccaccccagcaaggatcgcctccatttcctcatgagtctgggatgttttgacatgaatgaattaaaaagtcttcccagaatacagaagagtgatttgtcgtcaagccaaagaggctttctgtcttcctctggtgtcctctaaacccagggggctgccaaatgccacagagacctccagggagagtgagagttatacttggactgacttcatcggtcagaaagccttcccctaacagcagcattatttctgctattaaccccatacatctctggataaagaaactgaaaacgtggcctttggaagaatcaacagtaatgttgtgaaaaaaatatatattcttttcactgaccgaagtgttttttcaaataaataatcagaaatgttatgctacacaaagtttatggtatcccttctctactaattcaatgactcttcaatgtgatgatcccaagcaaaaaaaaaaaaaaaaaaaaaaaatcaactactgatcagatggtcaatttctaaggaaaagatgtagagttattcaaaggtcatctaagtcagttcagtctttgcaaaaagaatatcaggaatgtaacgtccagtggtaaatggaacccacagtatgagaagtaacaagaattaaataggaagcctggaagcctgagactatagatctatcacagaagattcccgtaacatatcccagctctgagttcttagatttgttgatgtcaaggagcccaaatttctgaacacaaatgcctgagtttcagctggcttaagtcagagctggcatccataatgatattttgttaattctaattggttttccccacttgagaaggacccaactagtcctcagataggtacacttgaatgcaaacggttgggtctctgtccatgggtaatagcacgcacatgcaaccaatttaaaatactctgggtaagagagtcttctagagcataaactgtacttgagaaacctttgtgcttctggaaaatgggtttcatcatccttacatctgcaggttcttaggccacttatggtttcaatgctctgagctggcaagtccctataggtctatctttctgccagagagacttgcaggattataatctcacaatctcaccactcattactgttatgtcctctgcaaatctctctgcgttattttagccagcaccatgactgggcatccacggattactcttgattttctcttccctgattcacaggatgccagagagtctgagtatttagtttttctggtgaaagcattaaaattcacacattgcagcaaaatctgtcaaatcatttcacgcttattttctggggagaaaaatagaaaattacaccttgtttacaaatgaaatagtttcacttaaatgggactctagccaaggcagttaattagtcaaaagatccacagctgtcatatagtcacacattgtttattctatttgctatgtcgaccactgatgtgtatttaatattctgcatccttcacaggaaatgacaaatgccctgaattatttgcaaatagaattgctaatgaaaaagaaaaaaaatgttgatgttaattaaatggtgattaaaaatttatctcctttaaatctaaaaagtgcagctttaataatcagttgtcatataaataagtaccttgtactgaaatcccttgcggtttaagacctaaataaacactaatttgagaactctaaataccttacagaggagctggatatattcgttaacattatgcacattcctgtactgtttctttgtgcatagctgttgtgcatgaatccttgaaaaggggacatgcgttgtttctgaaatggagcctgtttgtattaaccatggctatagtagacatgattggactcaaagaaaaagaagtttgagtaggtggaagctaaatgtgttgcttgatatttaatgagtgaagggttctatgtaaaggcaattttccttccaaaagtactgtttattttcactggagacaaaattagacctttccagataccccatctctttttggtgaacagggttgaaagtgctgtggggtctatacttgaaaagttctcccaatatgcagttactgtttcccattcaatccctatacattgtactgtgttcatatctaattgtatcagatgaggtcagcttgccacttgatatagatcagagatgatcaaatgcacttatcctgtgaatacaactgcttgtgtacacatgtatataatatacatgcttgatttctacaattcacacgtaagtgtattatccaaataaaattgtacatattgtaaagtttatgttaaaaattaaatggtgatgatggtattaacacatggaaaacccattctggttatttttatgggaggatatttctgtagagagggcactatatttttttaatctcagttgtagggaggatgacagagcctaagtagaatatgggtgttggcgttcttggccccttctttaaaaaacaaaactctgggatgaggggtatagaatatattctgctcgcatttgcttctgaagacaatgccgatatggacttgtgtgtgatttccttaaacacatcaaagggcatagatttcctatttaaattccttatcctctttcctcacctgcactctttctgtgcccagcagtactttcagtatagtattagctagaagtgcctgcccagaagggtcttagaaaaatagagttcgtagaaccacaccaaaagttaggagaaggggaggagagatgagaaaaatgaagtttacaaatgggcagttgcctgtttaagatcatcaagttagagagtatcagagcgaggattagatccaagacatggttcaatttctggctcgattctctgaccgggctgacttatttctaggtttctttcaaggggaaactcctgagtagctctggaataagagccagagatccccataaggctgccctggtttttgttttgttttgttttttgtttttgccacttgccccagaaagacctacccatgcttctttgaatttggttttcctttaaactccctcacaatccctgtcttaaagttcctagaagagaaaacttttctcagagaccgtctccttaggaaaaatcaacagggatattgtttaaaacctcaaactgaagataaaaggctggcagtgaccattgaaataattgaggtctatgtatcatgcattgaggaagaaccaagcacattgaccagctaataggacttcactgaatgtccactttattttgaaagccagtttgggattgtgggggaggggatgcaaaataaatagaaaatatagtctcttcccataagtagcttatggtttagaagttcagttctctaatacaaaggataaccaaggacccatgcaatgcaaacagagactaaacagcaaaaattagaaatgacaactaaagttgtagccaggaaaaaaaaaataatctgattctatgagcataccttttttaaaaaaaaaaaaaaagtccttccctaaacctttaagtaactccggagaatagagttagtggtcccggaaatgcagttgatttattttaatcttcaaataatggacttaggagacccaggagctgctaaccaggtgaacacactcacactcctacatttttgcacaggaaggcttttgtctggttccaaccagttctccagtccttgccaaatcatgcctcctcccagccttgcattatgacatgtgcctcaagaaaaggttgaaaaaattccccaaaggattagaaaatagaccatgatgtaaaaagacgaagcatttccctaaagcttttttgtttggttttgtttttgacatttgaagaacccttctgatacaccagggtatgaatgtatcagggaagcatagagggaaaattctttatcaagttccaagtgcctactgctgtggctgacagaaagcatcaggttccctagagagaaaacggggcaaagagatggcaaaaggaatagaggtgtatttcaggaaggatggcgaggtggagagggagcttttgtcactctgtctatcccattctgtgcattcttggaatgttacattttctgcttatcgcaagtacttgccatggatctgcacctgaatttgaaaatatcaaaatatatctaaattgagtgtaggcgatattctaggcatatcctagaatgtgatcctcaaaacaaccttaagatataaatatgattgctcccattttacagataaggaaactgaggctcaggtttttctcaacctcgtcagcaactagaattagctagtaaatccctaacgttagacatattttcaaagtgcctggtctcctccagggaggtcagaatagaagtcagaaagagaggtgtgctcttttgaggttcctgggcatatacccttgagtatcagcctctgtgacagggaagtctgttagggtcttacccctcattgcctgatctgtgtgtatggagaacttctggggatctcacctctgttcatagttccttctgagacttgaacactgtttgtgtctccctttcatatgcttgcacttagcatttaaaaaaatttctggggagttattttctctacttagcatgtgcctaatcttaaatatctctttcctaatgtctcatctttttatcagtcaacatcagggctaattccattaaacatatatacatagtacatgctctcatgtgtgtgggtatgcacacacacacacacagccatgtgaccctccattaaagtcctcctaaatattgtgacccatgttcaaagaggtgatattatttgcaagttgactattcctcctatttcatgtctatgtttggttatctttgccaggcagatggaatgagtttcagaggtgggacagggaataggaaatagagtttctgcatgaatgatggagagctttggtagtcagaatgattgaggaccagctattaaaatgttgttgttgttttccttcttggtctgttcctttttttttttcttttccaaattgtcttagagataattcccggctcacttagcattaggataatgacggttattctgtcccactgaagagtgttgaactggaacgcttccaccgggctttataggtacccagaatggcctaatgtttaacatatcctgcaggcatgcccctgagcacacactgcctttcctgcattcccccctctccatggtctaagccacatttctttcctggcatttatatttactgagaggtgaggggtgcattaggcccatttgatggatgaggacactagcggggatttgaaggaatgtctttctgggagtctccatgaattctctggagagttagctaacttaatgcaagttaagtgctagtctatgagaaaaatttctcagctgttttcatctttcaagctggcagtaaaaagccttttaagacagaaagattattatttgttatttggagatcctgttgttgggtctacaagtgcgtgaccatgttctccttggaatgttgagctatgcagaaatggagcactccaaagaacgatttgaccaatagcatttcttctctgggggttgtatttcaaagcatgcaactctccagggaaccagaactaaattgcttaaaatgaagtcattcctcagattaacttcctcagataaagtgtcagcggtctgcagaaacgaagaagacaaaactgagattatcactcataattctcttacttactatgtcagtgaaacaatgagtttgcatttttgcaatcctagaacattcttcattagccctgggtcatgacctcttccagttaattctctttcacacctttaggaaagatttaagatgaaccttcaataggatattaacataactcatagccaataccacagctgcctttcaaattaatgaggttaattgttctccagcaaacatgagtttgtctttggcattttaaatgcttcccattgatctgacattttgctgtttcaagttttaaagggctcaaatcaaagactattgataactgagcaaagagcgaagatccagaaatacgaaaacattgtctttttttttccatgaaaaacaatcatagccttttgaattcaatcgaagtttctacattagccatctaagacttatttaattatttctgttctcagtcaagctaattcaagtgaatgaacagtattgacttttaaaatcttttttaaatttttttaaatctttagtttattaagtttgtagaaaagctctggggccatgaccacttacgtaaatgtttcagtttaaaaacaaaagattcaggcctctaatttgagccaaatccaggtgatcttgtttgaaatttttgatgaatttgaaaagatgaaagtggaacttttaacattcatgttccccaaatttttcactgggaagggatgctaattgcctacttaagatataagttcaagaataacattttcatagaaaattcagaaaactgcttgacacagcagtgacatagttagatgtggctcagatgccttccaaacctgagggtccccaaagatttctttaccagttgtttttaactatgaatcttaatcttgttcattcccctgccaaaacaaatttaaaagcataaacctgctgaattaattggcagaattcaccatagtttatatcaccccagaatgtttatgtgtatatgtttatgtatagtatatatatttcaagctgaatgttcagaaagaataaggtgagtttcttggtagcttgaataagaattagatcataaaaattataaataatggccttctcaaagaggataaatgattcatttttcactcacgtattaataatatgacttgttgcataatacacaagctggtcattgcctgcaagaaagttattgaattaagcagctatccaggtttatgtctgagtccatttttaacccaacaaggctaggattgaactccatatgcagagggtttctattcacagctacattcaaacagaatccaaaacccacatcagaactgacttgatgtcttgtatggtggagctgaaagcaagctgtctgctctaagcaatggtcttcatttgggaattaatgttcactgatcaactgcagcagtttatatctgtcatgttttaatccactgcatgaggaagtgctaataagtgtattaaatatttccaagcatagctacaaaattatatgtttgcttaacacctttctatgatagaggaagtatatactatggttgtcttcttgtagtatgtcttttaattttgttcaatgtgttatcaactgttttaaggaatggggattgaaattcgtgtgcaaactgatatgtatataactcctgaggcaacagaagtgcccggtcatatggtgtaaaaatgtaaatacaggaaaatttcatttttctaataaagataatttctgccaattgatatgaaaatgagaaa

SEQ ID NO: 12322 - DNA, 4395 bp, Homo sapiens
atgggcagagtgggctattggaccctgctggtgctgccggcccttctggtctggcgcggtccggcgccgagcgcggcggcggagaagggtccccccgcgctaaatattgcggtgatgctgggtcacagccacgacgtgacagagcgcgaacttcgaacactgtggggccccgagcaggcggcggggctgcccctggacgtgaacgtggtagctctgctgatgaaccgcaccgaccccaagagcctcatcacgcacgtgtgcgacctcatgtccggggcacgcatccacggcctcgtgtttggggacgacacggaccaggaggccgtagcccagatgctggattttatctcctcccacaccttcgtccccatcttgggcattcatgggggcgcatctatgatcatggctgacaaggatccgacgtctaccttcttccagtttggagcgtccatccagcagcaagccacggtcatgctgaagatcatgcaggattatgactggcatgtcttctccctggtgaccactatcttccctggctacagggaattcatcagcttcgtcaagaccacagtggacaacagctttgtgggctgggacatgcagaatgtgatcacactggacacttcctttgaggatgcaaagacacaagtccagctgaagaagatccactcttctgtcatcttgctctactgttccaaagacgaggctgttctcattctgagtgaggcccgctcccttggcctcaccgggtatgatttcttctggattgtccccagcttggtctctgggaacacggagctcatcccaaaagagtttccatcgggactcatttctgtctcctacgatgactgggactacagcctggaggcgagagtgagggacggcattggcatcctaaccaccgctgcatcttctatgctggagaagttctcctacatccccgaggccaaggccagctgctacgggcagatggagaggccagaggtcccgatgcacaccttgcacccatttatggtcaatgttacatgggatggcaaagacttatccttcactgaggaaggctaccaggtgcaccccaggctggtggtgattgtgctgaacaaagaccgggaatgggaaaaggtgggcaagtgggagaaccatacgctgagcctgaggcacgccgtgtggcccaggtacaagtccttctccgactgtgagccggatgacaaccatctcagcatcgtcaccctggaggaggccccattcgtcatcgtggaagacatagaccccctgaccgagacgtgtgtgaggaacaccgtgccatgtcggaagttcgtcaaaatcaacaattcaaccaatgaggggatgaatgtgaagaaatgctgcaaggggttctgcattgatattctgaagaagctttccagaactgtgaagtttacttacgacctctatctggtgaccaatgggaagcatggcaagaaagttaacaatgtgtggaatggaatgatcggtgaagtggtctatcaacgggcagtcatggcagttggctcgctcaccatcaatgaggaacgttctgaagtggtggacttctctgtgccctttgtggaaacgggaatcagtgtcatggtttcaagaagtaatggcaccgtctcaccttctgcttttctagaaccattcagcgcctctgtctgggtgatgatgtttgtgatgctgctcattgtttctgccatagctgtttttgtctttgaatacttcagccctgttggatacaacagaaacttagccaaagggaaagcaccccatgggccttcttttacaattggaaaagctatatggcttctttggggcctggtgttcaataactccgtgcctgtccagaatcctaaagggaccaccagcaagatcatggtatctgtatgggccttcttcgctgtcatattcctggctagctacacagccaatctggctgccttcatgatccaagaggaatttgtggaccaagtgaccggcctcagtgacaaaaagtttcagagacctcatgactattccccaccttttcgatttgggacagtgcctaatggaagcacggagagaaacattcggaataactatccctacatgcatcagtacatgaccaaatttaatcagaaaggagtagaggacgccttggtcagcctgaaaacggggaagctggacgctttcatctacgatgccgcagtcttgaattacaaggctgggagggatgaaggctgcaagctggtgaccatcgggagtgggtacatctttgccaccaccggttatggaattgcccttcagaaaggctctccttggaagaggcagatcgacctggccttgcttcagtttgtgggtgatggtgagatggaggagctggagaccctgtggctcactgggatctgccacaacgagaagaacgaggtgatgagcagccagctggacattgacaacatggcgggcgtattctacatgctggctgccgccatggcccttagcctcatcaccttcatctgggagcacctcttctactggaagctgcgcttctgtttcacgggcgtgtgctccgaccggcctgggttgctcttctccatcagcaggggcatctacagctgcattcatggagtgcacattgaagaaaagaagaagtctccagacttcaatctgacgggatcccagagcaacatgttaaaactcctccggtcagccaaaaacatttccagcatgtccaacatgaactcctcaagaatggactcacccaaaagagctgctgacttcatccaaagaggttccctcatcatggacatggtttcagataaggggaatttgatgtactcagacaacaggtcctttcaggggaaagagagcatttttggagacaacatgaacgaactccaaacatttgtggccaaccggcagaaggataacctcaataactatgtattccagggacaacatcctcttactctcaatgagtccaaccctaacacggtggaggtggccgtgagcacagaatccaaagcgaactctagaccccggcagctgtggaagaaatccgtggattccatacgccaggattcactatcccagaatccagtctcccagagggatgaggcaacagcagagaataggacccactccctaaagagccctaggtatcttccagaagagatggcccactctgacatttcagaaacgtcaaatcgggccacgtgccacagggaacctgacaacagtaagaaccacaaaaccaaggacaactttaaaaggtcagtggcctccaaataccccaaggactgtagtgaggtcgagcgcacctacctgaaaaccaaatcaagctcccctagagacaagatctacactatagatggtgagaaggagcctggtttccacttagatccaccccagtttgttgaaaatgtgaccctgcccgagaacgtggacttcccggacccctaccaggatcccagtgaaaacttccgcaagggggactccacgctgccaatgaaccggaaccccttgcataatgaagaggggctttccaacaacgaccagtataaactctactccaagcacttcaccttgaaagacaagggttccccgcacagtgagaccagcgagcgataccggcagaactccacgcactgcagaagctgcctttccaacatgcccacctattcaggccacttcaccatgaggtcccccttcaagtgcgatgcctgcctgcggatggggaacctctatgacatcgatgaagaccagatgcttcaggagacaggtaacccagccaccggggagcaggtctaccagcaggactgggcacagaacaatgcccttcaattacaaaagaacaagctaaggattagccgtcagcattcctacgataacattgtcgacaaacctagggagctagaccttagcaggccctcccggagcataagcctcaaggacagggaacggcttctggagggaaatttttacggcagcctgtttagtgtcccctcaagcaaactctcggggaaaaaaagctcccttttcccccaaggtctggaggacagcaagaggagcaagtctctcttgccagaccacacctccgataaccctttcctccactcccacagggatgaccaacgcttggttattgggagatgcccctcggacccttacaaacactcgttgccatcccaggcggtgaatgacagctatcttcggtcgtccttgaggtcaacggcatcgtactgttccagggacagtcggggccacaatgatgtgtatatttcggagcatgttatgccttatgctgcaaataagaataatatgtactctacccccagggttttaaattcctgcagcaatagacgcgtgtacaagaaaatgcctagtatcgaatctgatgtttaa

SEQ ID NO: 12323 - DNA, 4734 bp, Homo sapiens
agccctgctgcagagcctccggctgggatagccgccccccgtgggggcgatgcggacagcgcgggacagccaggggagcgcgctggggccgcagcatgcgggaacccgctaaacccggtggctgctgaggcggccgagatgctcgtgcgcgcagcgcgccccactgcatcctcgaccttctcgggctacagggaccgtcagtggcgactatgggcagagtgggctattggaccctgctggtgctgccggcccttctggtctggcgcggtccggcgccgagcgcggcggcggagaagggtccccccgcgctaaatattgcggtgatgctgggtcacagccacgacgtgacagagcgcgaacttcgaacactgtggggccccgagcaggcggcggggctgcccctggacgtgaacgtggtagctctgctgatgaaccgcaccgaccccaagagcctcatcacgcacgtgtgcgacctcatgtccggggcacgcatccacggcctcgtgtttggggacgacacggaccaggaggccgtagcccagatgctggattttatctcctcccacaccttcgtccccatcttgggcattcatgggggcgcatctatgatcatggctgacaaggatccgacgtctaccttcttccagtttggagcgtccatccagcagcaagccacggtcatgctgaagatcatgcaggattatgactggcatgtcttctccctggtgaccactatcttccctggctacagggaattcatcagcttcgtcaagaccacagtggacaacagctttgtgggctgggacatgcagaatgtgatcacactggacacttcctttgaggatgcaaagacacaagtccagctgaagaagatccactcttctgtcatcttgctctactgttccaaagacgaggctgttctcattctgagtgaggcccgctcccttggcctcaccgggtatgatttcttctggattgtccccagcttggtctctgggaacacggagctcatcccaaaagagtttccatcgggactcatttctgtctcctacgatgactgggactacagcctggaggcgagagtgagggacggcattggcatcctaaccaccgctgcatcttctatgctggagaagttctcctacatccccgaggccaaggccagctgctacgggcagatggagaggccagaggtcccgatgcacaccttgcacccatttatggtcaatgttacatgggatggcaaagacttatccttcactgaggaaggctaccaggtgcaccccaggctggtggtgattgtgctgaacaaagaccgggaatgggaaaaggtgggcaagtgggagaaccatacgctgagcctgaggcacgccgtgtggcccaggtacaagtccttctccgactgtgagccggatgacaaccatctcagcatcgtcaccctggaggaggccccattcgtcatcgtggaagacatagaccccctgaccgagacgtgtgtgaggaacaccgtgccatgtcggaagttcgtcaaaatcaacaattcaaccaatgaggggatgaatgtgaagaaatgctgcaaggggttctgcattgatattctgaagaagctttccagaactgtgaagtttacttacgacctctatctggtgaccaatgggaagcatggcaagaaagttaacaatgtgtggaatggaatgatcggtgaagtggtctatcaacgggcagtcatggcagttggctcgctcaccatcaatgaggaacgttctgaagtggtggacttctctgtgccctttgtggaaacgggaatcagtgtcatggtttcaagaagtaatggcaccgtctcaccttctgcttttctagaaccattcagcgcctctgtctgggtgatgatgtttgtgatgctgctcattgtttctgccatagctgtttttgtctttgaatacttcagccctgttggatacaacagaaacttagccaaagggaaagcaccccatgggccttcttttacaattggaaaagctatatggcttctttggggcctggtgttcaataactccgtgcctgtccagaatcctaaagggaccaccagcaagatcatggtatctgtatgggccttcttcgctgtcatattcctggctagctacacagccaatctggctgccttcatgatccaagaggaatttgtggaccaagtgaccggcctcagtgacaaaaagtttcagagacctcatgactattccccaccttttcgatttgggacagtgcctaatggaagcacggagagaaacattcggaataactatccctacatgcatcagtacatgaccaaatttaatcagaaaggagtagaggacgccttggtcagcctgaaaacggggaagctggacgctttcatctacgatgccgcagtcttgaattacaaggctgggagggatgaaggctgcaagctggtgaccatcgggagtgggtacatctttgccaccaccggttatggaattgcccttcagaaaggctctccttggaagaggcagatcgacctggccttgcttcagtttgtgggtgatggtgagatggaggagctggagaccctgtggctcactgggatctgccacaacgagaagaacgaggtgatgagcagccagctggacattgacaacatggcgggcgtattctacatgctggctgccgccatggcccttagcctcatcaccttcatctgggagcacctcttctactggaagctgcgcttctgtttcacgggcgtgtgctccgaccggcctgggttgctcttctccatcagcaggggcatctacagctgcattcatggagtgcacattgaagaaaagaagaagtctccagacttcaatctgacgggatcccagagcaacatgttaaaactcctccggtcagccaaaaacatttccagcatgtccaacatgaactcctcaagaatggactcacccaaaagagctgctgacttcatccaaagaggttccctcatcatggacatggtttcagataaggggaatttgatgtactcagacaacaggtcctttcaggggaaagagagcatttttggagacaacatgaacgaactccaaacatttgtggccaaccggcagaaggataacctcaataactatgtattccagggacaacatcctcttactctcaatgagtccaaccctaacacggtggaggtggccgtgagcacagaatccaaagcgaactctagaccccggcagctgtggaagaaatccgtggattccatacgccaggattcactatcccagaatccagtctcccagagggatgaggcaacagcagagaataggacccactccctaaagagccctaggtatcttccagaagagatggcccactctgacatttcagaaacgtcaaatcgggccacgtgccacagggaacctgacaacagtaagaaccacaaaaccaaggacaactttaaaaggtcagtggcctccaaataccccaaggactgtagtgaggtcgagcgcacctacctgaaaaccaaatcaagctcccctagagacaagatctacactatagatggtgagaaggagcctggtttccacttagatccaccccagtttgttgaaaatgtgaccctgcccgagaacgtggacttcccggacccctaccaggatcccagtgaaaacttccgcaagggggactccacgctgccaatgaaccggaaccccttgcataatgaagaggggctttccaacaacgaccagtataaactctactccaagcacttcaccttgaaagacaagggttccccgcacagtgagaccagcgagcgataccggcagaactccacgcactgcagaagctgcctttccaacatgcccacctattcaggccacttcaccatgaggtcccccttcaagtgcgatgcctgcctgcggatggggaacctctatgacatcgatgaagaccagatgcttcaggagacagggatgaccaacgcttggttattgggagatgcccctcggacccttacaaacactcgttgccatcccaggcggtgaatgacagctatcttcggtcgtccttgaggtcaacggcatcgtactgttccagggacagtcggggccacaatgatgtgtatatttcggagcatgttatgccttatgctgcaaataagaataatatgtactctacccccagggttttaaattcctgcagcaatagacgcgtgtacaagaaaatgcctagtatcgaatctgatgtttaaaaatcttccattaatgttttatctatagggaaatatacgtaatggccaatgttctggagggtaaatgttggatgtccaatagtgccctgctaagaggaagaagatgtagggaggtattttgttgttgttgttgttggctcttttgcacacggcttcatgccataatcttccactcaaggaatcttgtgaggtgtgtgctgagcatggcagacaccagataggtgagtccttaaccaaaaataactaactacataagggcaagtctccgggacatgcctactgggtatgttggcaataatgatgcattggatgccaatggtgatgttatgatttcctatattccaaattccattaaggtcagcccaccatgtaattttctcatcagaaatgcctaatggtttctctaatacagaataagcaatatggtgtgcatgtaaacctgacacagacaaaataaaaacagttaagaatgc

SEQ ID NO: 12324 - DNA, 4164 bp, Homo sapiens
atatatccaatatttctcctgttgagagtttaccagcctgtaattttcttaaggatccgacgtctaccttcttccagtttggagcgtccatccagcagcaagccacggtcatgctgaagatcatgcaggattatgactggcatgtcttctccctggtgaccactatcttccctggctacagggaattcatcagcttcgtcaagaccacagtggacaacagctttgtgggctgggacatgcagaatgtgatcacactggacacttcctttgaggatgcaaagacacaagtccagctgaagaagatccactcttctgtcatcttgctctactgttccaaagacgaggctgttctcattctgagtgaggcccgctcccttggcctcaccgggtatgatttcttctggattgtccccagcttggtctctgggaacacggagctcatcccaaaagagtttccatcgggactcatttctgtctcctacgatgactgggactacagcctggaggcgagagtgagggacggcattggcatcctaaccaccgctgcatcttctatgctggagaagttctcctacatccccgaggccaaggccagctgctacgggcagatggagaggccagaggtcccgatgcacaccttgcacccatttatggtcaatgttacatgggatggcaaagacttatccttcactgaggaaggctaccaggtgcaccccaggctggtggtgattgtgctgaacaaagaccgggaatgggaaaaggtgggcaagtgggagaaccatacgctgagcctgaggcacgccgtgtggcccaggtacaagtccttctccgactgtgagccggatgacaaccatctcagcatcgtcaccctggaggaggccccattcgtcatcgtggaagacatagaccccctgaccgagacgtgtgtgaggaacaccgtgccatgtcggaagttcgtcaaaatcaacaattcaaccaatgaggggatgaatgtgaagaaatgctgcaaggggttctgcattgatattctgaagaagctttccagaactgtgaagtttacttacgacctctatctggtgaccaatgggaagcatggcaagaaagttaacaatgtgtggaatggaatgatcggtgaagtggtctatcaacgggcagtcatggcagttggctcgctcaccatcaatgaggaacgttctgaagtggtggacttctctgtgccctttgtggaaacgggaatcagtgtcatggtttcaagaagtaatggcaccgtctcaccttctgcttttctagaaccattcagcgcctctgtctgggtgatgatgtttgtgatgctgctcattgtttctgccatagctgtttttgtctttgaatacttcagccctgttggatacaacagaaacttagccaaagggaaagcaccccatgggccttcttttacaattggaaaagctatatggcttctttggggcctggtgttcaataactccgtgcctgtccagaatcctaaagggaccaccagcaagatcatggtatctgtatgggccttcttcgctgtcatattcctggctagctacacagccaatctggctgccttcatgatccaagaggaatttgtggaccaagtgaccggcctcagtgacaaaaagtttcagagacctcatgactattccccaccttttcgatttgggacagtgcctaatggaagcacggagagaaacattcggaataactatccctacatgcatcagtacatgaccaaatttaatcagaaaggagtagaggacgccttggtcagcctgaaaacggggaagctggacgctttcatctacgatgccgcagtcttgaattacaaggctgggagggatgaaggctgcaagctggtgaccatcgggagtgggtacatctttgccaccaccggttatggaattgcccttcagaaaggctctccttggaagaggcagatcgacctggccttgcttcagtttgtgggtgatggtgagatggaggagctggagaccctgtggctcactgggatctgccacaacgagaagaacgaggtgatgagcagccagctggacattgacaacatggcgggcgtattctacatgctggctgccgccatggcccttagcctcatcaccttcatctgggagcacctcttctactggaagctgcgcttctgtttcacgggcgtgtgctccgaccggcctgggttgctcttctccatcagcaggggcatctacagctgcattcatggagtgcacattgaagaaaagaagaagtctccagacttcaatctgacgggatcccagagcaacatgttaaaactcctccggtcagccaaaaacatttccagcatgtccaacatgaactcctcaagaatggactcacccaaaagagctgctgacttcatccaaagaggttccctcatcatggacatggtttcagataaggggaatttgatgtactcagacaacaggtcctttcaggggaaagagagcatttttggagacaacatgaacgaactccaaacatttgtggccaaccggcagaaggataacctcaataactatgtattccagggacaacatcctcttactctcaatgagtccaaccctaacacggtggaggtggccgtgagcacagaatccaaagcgaactctagaccccggcagctgtggaagaaatccgtggattccatacgccaggattcactatcccagaatccagtctcccagagggatgaggcaacagcagagaataggacccactccctaaagagccctaggtatcttccagaagagatggcccactctgacatttcagaaacgtcaaatcgggccacgtgccacagggaacctgacaacagtaagaaccacaaaaccaaggacaactttaaaaggtcagtggcctccaaataccccaaggactgtagtgaggtcgagcgcacctacctgaaaaccaaatcaagctcccctagagacaagatctacactatagatggtgagaaggagcctggtttccacttagatccaccccagtttgttgaaaatgtgaccctgcccgagaacgtggacttcccggacccctaccaggatcccagtgaaaacttccgcaagggggactccacgctgccaatgaaccggaaccccttgcataatgaagaggggctttccaacaacgaccagtataaactctactccaagcacttcaccttgaaagacaagggttccccgcacagtgagaccagcgagcgataccggcagaactccacgcactgcagaagctgcctttccaacatgcccacctattcaggccacttcaccatgaggtcccccttcaagtgcgatgcctgcctgcggatggggaacctctatgacatcgatgaagaccagatgcttcaggagacagggatgaccaacgcttggttattgggagatgcccctcggacccttacaaacactcgttgccatcccaggcggtgaatgacagctatcttcggtcgtccttgaggtcaacggcatcgtactgttccagggacagtcggggccacaatgatgtgtatatttcggagcatgttatgccttatgctgcaaataagaataatatgtactctacccccagggttttaaattcctgcagcaatagacgcgtgtacaagaaaatgcctagtatcgaatctgatgtttaaaaatcttccattaatgttttatctatagggaaatatacgtaatggccaatgttctggagggtaaatgttggatgtccaatagtgccctgctaagaggaagaagatgtagggaggtattttgttgttgttgttgttggctcttttgcacacggcttcatgccataatcttccactcaaggaatcttgtgaggtgtgtgctgagcatggcagacaccagataggtgagtccttaaccaaaaataactaactacataagggcaagtctccgggacatgcctactgggtatgttggcaataatgatgcattggatgccaatggtgatgttatgatttcctatattccaaattccattaaggtcagcccaccatgtaattttctcatcagaaatgcctaatggtttctctaatacagaataagcaatatggtgtgcatgtaaacctgacacagacaaaataaaaacagttaagaatgc

SEQ ID NO: 12325 - DNA, 6238 bp, Homo sapiens
tttgaatttgcatctcttcaagacacaagattaaaacaaaatttacgctaaattggattttaaattatcttccgttcatttatccttcgtctttcttatgtggatatgcaagcgagaagaagggactggacattcccaacatgctcactcccttaatctgtccgtctagaggtttggcttctacaaaccaagggagtcgacgagttgaagatgaagcccagagcggagtgctgttctcccaagttctggttggtgttggccgtcctggccgtgtcaggcagcagagctcgttctcagaagagcccccccagcattggcattgctgtcatcctcgtgggcacttccgacgaggtggccatcaaggatgcccacgagaaagatgatttccaccatctctccgtggtaccccgggtggaactggtagccatgaatgagaccgacccaaagagcatcatcacccgcatctgtgatctcatgtctgaccggaagatccagggggtggtgtttgctgatgacacagaccaggaagccatcgcccagatcctcgatttcatttcagcacagactctcacccccatcctgggcatccacgggggctcctctatgataatggcagataaggatgaatcctccatgttcttccagtttggcccatcaattgaacagcaagcttccgtaatgctcaacatcatggaagaatatgactggtacatcttttctatcgtcaccacctatttccctggctaccaggactttgtaaacaagatccgcagcaccattgagaatagctttgtgggctgggagctagaggaggtcctcctactggacatgtccctggacgatggagattctaagatccagaatcagctcaagaaacttcaaagccccatcattcttctttactgtaccaaggaagaagccacctacatctttgaagtggccaactcagtagggctgactggctatggctacacgtggatcgtgcccagtctggtggcaggggatacagacacagtgcctgcggagttccccactgggctcatctctgtatcatatgatgaatgggactatggcctccccgccagagtgagagatggaattgccataatcaccactgctgcttctgacatgctgtctgagcacagcttcatccctgagcccaaaagcagttgttacaacacccacgagaagagaatctaccagtccaatatgctaaataggtatctgatcaatgtcacttttgaggggaggaatttgtccttcagtgaagatggctaccagatgcacccgaaactggtgataattcttctgaacaaggagaggaagtgggaaagggtggggaagtggaaagacaagtccctgcagatgaagtactatgtgtggccccgaatgtgtccagagactgaagagcaggaggatgaccatctgagcattgtgaccctggaggaggcaccatttgtcattgtggaaagtgtggaccctctgagtggaacctgcatgaggaacacagtcccctgccaaaaacgcatagtcactgagaataaaacagacgaggagccgggttacatcaaaaaatgctgcaaggggttctgtattgacatccttaagaaaatttctaaatctgtgaagttcacctatgacctttacctggttaccaatggcaagcatgggaagaaaatcaatggaacctggaatggtatgattggagaggtggtcatgaagagggcctacatggcagtgggctcactcaccatcaatgaggaacgatcggaggtggtcgacttctctgtgcccttcatagagacaggcatcagtgtcatggtgtcacgcagcaatgggactgtctcaccttctgccttcttagagccattcagcgctgacgtatgggtgatgatgtttgtgatgctgctcatcgtctcagccgtggctgtctttgtctttgagtacttcagccctgtgggttataacaggtgcctcgctgatggcagagagcctggtggaccctctttcaccatcggcaaagctatttggttgctctggggtctggtgtttaacaactccgtacctgtgcagaacccaaaggggaccacctccaagatcatggtgtcagtgtgggccttctttgctgtcatcttcctggccagctacactgccaacttagctgccttcatgatccaagaggaatatgtggaccaggtttctggcctgagcgacaaaaagttccagagacctaatgacttctcaccccctttccgctttgggaccgtgcccaacggcagcacagagagaaatattcgcaataactatgcagaaatgcatgcctacatgggaaagttcaaccagaggggtgtagatgatgcattgctctccctgaaaacagggaaactggatgccttcatctatgatgcagcagtgctgaactatatggcaggcagagatgaaggctgcaagctggtgaccattggcagtgggaaggtctttgcttccactggctatggcattgccatccaaaaagattctgggtggaagcgccaggtggaccttgctatcctgcagctctttggagatggggagatggaagaactggaagctctctggctcactggcatttgtcacaatgagaagaatgaggtcatgagcagccagctggacattgacaacatggcaggggtcttctacatgttgggggcggccatggctctcagcctcatcaccttcatctgcgaacaccttttctattggcagttccgacattgctttatgggtgtctgttctggcaagcctggcatggtcttctccatcagcagaggtatctacagctgcatccatggggtggcgatcgaggagcgccagtctgtaatgaactcccccaccgcaaccatgaacaacacacactccaacatcctgcgcctgctgcgcacggccaagaacatggctaacctgtctggtgtgaatggctcaccgcagagcgccctggacttcatccgacgggagtcatccgtctatgacatctcagagcaccgccgcagcttcacgcattctgactgcaaatcctacaacaacccgccctgtgaggagaacctcttcagtgactacatcagtgaggtagagagaacgttcgggaacctgcagctgaaggacagcaacgtgtaccaagatcactaccaccatcaccaccggccccatagtattggcagtgccagctccatcgatgggctctacgactgtgacaacccacccttcaccacccagtccaggtccatcagcaagaagcccctggacatcggcctcccctcctccaagcacagccagctcagtgacctgtacggcaaattctccttcaagagcgaccgctacagtggccacgacgacttgatccgctccgatgtctctgacatctcaacccacaccgtcacctatgggaacatcgagggcaatgccgccaagaggcgtaagcagcaatataaggacagcctgaagaagcggcctgcctcggccaagtcccgcagggagtttgacgagatcgagctggcctaccgtcgccgaccgccccgctcccctgaccacaagcgctacttcagggacaaggaagggctacgggacttctacctggaccagttccgaacaaaggagaactcaccccactgggagcacgtagacctgaccgacatctacaaggagcggagtgatgactttaagcgcgactccgtcagcggaggagggccctgtaccaacaggtctcacatcaagcacgggacgggcgacaaacacggcgtggtcagcggggtacctgcaccttgggagaagaacctgaccaacgtggagtgggaggaccggtccgggggcaacttctgccgcagctgtccctccaagctgcacaactactccacgacggtgacgggtcagaactcgggcaggcaggcgtgcatccggtgtgaggcttgcaagaaagcaggcaacctgtatgacatcagtgaggacaactccctgcaggaactggaccagccggctgccccagtggcggtgacgtcaaacgcctccaccactaagtaccctcagagcccgactaattccaaggcccagaagaagaaccggaacaaactgcgccggcagcactcctacgacaccttcgtggacctgcagaaggaagaagccgccctggccccgcgcagcgtaagcctgaaagacaagggccgattcatggatgggagcccctacgcccacatgtttgagatgtcagctggcgagagcacctttgccaacaacaagtcctcagtgcccactgccggacatcaccaccacaacaaccccggcggcgggtacatgctcagcaagtcgctctaccctgaccgggtcacgcaaaaccctttcatccccacttttggggacgaccagtgcttgctccatggcagcaaatcctacttcttcaggcagcccacggtggcgggggcgtcgaaagccaggccggacttccgggcccttgtcaccaacaagccggtggtctcggcccttcatggggccgtgccagcccgtttccagaaggacatctgtatagggaaccagtccaacccctgtgtgcctaacaacaaaaaccccagggctttcaatggctccagcaatgggcatgtttatgagaaactttctagtattgagtctgatgtctgagtgagggaacagagaggttaaggtgggtacgggagggtaaggctgtgggtcgcgtgatgcgcatgtcacggagggtgacgggggtgaacttggttcccatttgctcctttcttgttttaatttatttatgggatcctggagttctggttcctactgggggcaaccctggtgaccagcaccatctctcctccttttcacagttctctccttcttccccccgctgtcagccattcctgttcccatgagatgatgccatgggccctctcagcaggggagggtagagcggagaaaggaagggctgcatgcgggcttcctcctggtgtggaagagctccttgatatcctctttgagtgaagctgggagaaccaaaaagaggctatgtgagcacaaaggtagcttttcccaaactgatcttttcatttaggtgaggaagcaaaagcatctatgtgagaccatttagcacactgcttgtgaaaggaaagaggctctggctaaattcatgctgcttagatgacatctgtctaggaatcatgtgccaagcagaggttgggaggccatttgtgtttatatataagccaaaaaatgcttgcttcaaccccatgagactcgatagtggtggtgaacagaacaaaaggtcattggtggcagagtggattcttgaacaaactggaaagtacgttatgatagtgtcccacggtgccttggggacaagagcaggtggattgtgcgtgcatgtgtgttcatgcacacttgcacccatgtgtagtcaggtgcctcaagagaaggcaaccttgactctttctattgtttctttcaatatccccaagcagtgtgattgtttggcttatatacagacagagatggccatgtattacctgaattttggctgtgtctcccttcatccttctggaataaggagaatgaaaattcttgataaagaagattctgtggtctaaacaaaaaaaggcggtgagcaatcctgcaagaacaaggtacataaacaagtcctcagtggttggcaattgtttcaaccagtttgaaccaagaactttccaggaaggctaaagggaaaccgaattttcacagccatgattcttttgcccacacttgggagcaaaagattctacaaagctcttttgagcatttagactctcgactggccaaggtttggggaagaacgaagccacctttgaagaagtaaggagtcgtgtatggtagggtaagtgagagagggggatgtttccaatgctttgatcccttcttacttaacctgaagctagacgagcaggcttcttccccccaaaactgattacaactgctacagagcagacagttaagagaaatgagcttgacctttaagagaaatgagctgcactccatgagtgcagctctggaggtacgaaaagaggggaagagacttggaaatgggagacgggggcagagagggaccctccaccacctctttgggcctggctccctgggaatgtgacttgagcccagagtgaacactcttggtagaagcccttctaccttcctgcaacaccttgtttccctctcagattgtaccattgag

SEQ ID NO: 12326 - DNA, 4261 bp, Homo sapiens
tgtccttgagccgcgggtgacggtggctctcgctgctcgcgccccctcctcccgcggggggagcctgatgccacgttccctatgaattatttatcgccggcctaaaaataccccgaacttcacagcccgagtgaccctccggtggacatgggtggggccctggggccggccctgttgctcacctcgctcttcggtgcctgggcagggctgggtccggggcagggcgagcagggcatgacggtggctgtggtgtttagcagctcagggccgccccaggcccagttccgtgcccgcctcaccccccagagcttcctggacctacccctggagatccagccgctcacagttggggtcaacaccaccaaccccagcagcctcctcacccagatctgcggcctcctgggtgctgcccacgtccacggcattgtctttgaggacaacgtggacaccgaggcggtggcccagatccttgacttcatctcctcccagacccatgtgcccatcctcagcatcagcggaggctctgctgtggtcctcacccccaaggagccgggctccgccttcctgcagctgggcgtgtccctggagcagcagctgcaggtgctgttcaaggtgctggaagagtacgactggagcgccttcgccgtcatcaccagcctgcacccgggccacgcgctcttcctggagggcgtgcgcgccgtcgccgacgccagccacgtgagttggcggctgctggacgtggtcacgctggagctgggcccgggagggccgcgcgcgcgcacgcagcgcctgctgcgccagctcgacgcgcccgtgtttgtggcctactgctcgcgcgaggaggccgaggtgctcttcgccgaggcggcgcaggccggtctggtggggcccggccacgtgtggctggtgcccaacctggcgctgggcagcaccgatgcgccccccgccaccttccccgtgggcctcatcagcgtcgtcaccgagagctggcgcctcagcctgcgccagaaggtgcgcgacggcgtggccattctggccctgggcgcccacagctactggcgccagcatggaaccctgccagccccggccggggactgccgtgttcaccctgggcccgtcagccctgcccgggaggccttctacaggcacctactgaatgtcacctgggagggccgagacttctccttcagccctggtgggtacctggtccagcccaccatggtggtgatcgccctcaaccggcaccgcctctgggagatggtggggcgctgggagcatggcgtcctatacatgaagtaccccgtgtggcctcgctacagtgcctctctgcagcctgtggtggacagtcggcacctgacggtggccacgctggaagagcggccctttgtcatcgtggagagccctgaccctggcacaggaggctgtgtccccaacaccgtgccctgccgcaggcagagcaaccacaccttcagcagcggggacgtggccccctacaccaagctctgctgtaagggattctgcatcgacatcctcaagaagctggccagagtggtcaaattctcctacgacctgtacctggtgaccaacggcaagcatggcaagcgggtgcgcggcgtatggaacggcatgattggggaggtgtactacaagcgggcagacatggccatcggctccctcaccatcaatgaggaacgctccgagatcgtagacttctctgtaccctttgtggagacgggcatcagtgtgatggtggctcgcagcaatggcaccgtctccccctcggccttcttggagccatatagccctgcagtgtgggtgatgatgtttgtcatgtgcctcactgtggtggccatcaccgtcttcatgttcgagtacttcagccctgtcagctacaaccagaacctcaccagaggcaagaagtccgggggcccagctttcactatcggcaagtccgtgtggctgctgtgggcgctggtcttcaacaactcagtgcccatcgagaacccgcggggcaccaccagcaagatcatggttctggtctgggccttctttgctgtcatcttcctcgccagctacacggccaacctggccgccttcatgatccaagagcaatacatcgacactgtgtcgggcctcagtgacaagaagtttcagcggcctcaagatcagtacccacctttccgcttcggcacggtgcccaacggcagcacggagcggaacatccgcagtaactaccgtgacatgcacacccacatggtcaagttcaaccagcgctcggtggaggacgcgctcaccagcctcaagatggggaagctggatgccttcatctatgatgctgctgtcctcaactacatggcaggcaaggacgagggctgcaagctggtcaccattgggtctggcaaggtctttgctaccactggctacggcatcgccatgcagaaggactcccactggaagcgggccatagacctggcgctcttgcagttcctgggggacggagagacacagaaactggagacagtgtggctctcagggatctgccagaatgagaagaacgaggtgatgagcagcaagctggacatcgacaacatggcaggcgtcttctacatgctgctggtggccatggggctggccctgctggtcttcgcctgggagcacctggtctactggaagctgcgccactcggtgcccaactcatcccagctggacttcctgctggctttcagcaggggcatctacagctgcttcagcggggtgcagagcctcgccagcccaccgcggcaggccagcccggacctcacggccagctcggcccaggccagcgtgctcaagatgctgcaggcagcccgcgacatggtgaccacggcgggcgtaagcagctccctggaccgcgccactcgcaccatcgagaattggggtggcggccgccgtgcgcccccaccgtccccctgcccgaccccgcggtctggccccagcccatgcctgcccacccccgacccgcccccagagccgagccccacgggctggggaccgccagacgggggtcgcgcggcgcttgtgcgcagggctccgcagcccccgggccgccccccgacgccggggccgcccctgtccgacgtctcccgagtgtcgcgccgcccagcctgggaggcgcggtggccggtgcggaccgggcactgcgggaggcacctctcggcctccgagcggcccctgtcgcccgcgcgctgtcactacagctcctttcctcgagccgaccgatccggccgccccttcctcccgctcttcccggagctggaggacctgccgctgctcggtccggagcagctggcccggcgggaggccctgctgcacgcggcctgggcccggggctcgcgcccgcgtcacgcttccctgcccagctccgtggccgaggccttcgctcggcccagctcgctgcccgctgggtgcaccggccccgcctgcgcccgccccgacggccactcggcctgcaggcgcttggcgcaggcgcagtcgatgtgcttgccgatctaccgggaggcctgccaggagggcgagcaggcaggggcccccgcctggcagcacagacagcacgtctgcctgcacgcccacgcccacctgccattttgctggggggctgtctgtcctcaccttccaccctgtgccagccacggctcctggctctccggggcctgggggcctctggggcacaggggcaggactctggggctgggcacaggctacagagacagtgggggactggacgagatcagcagggtagcccgtgggacgcaaggcttcccgggaccctgcacctggagacggatctccagtctggagtcagaagtgtgagttatcagccactcaggctccgagccagctggattctctgcctgccactgtcagggttaagcggcaggcaggattgggcttttctggcttctgccatgaaatcctggccatgggaccccagtgacagatgatgtcttccatggtcatcagtgacctcagtagcctcaaatcatggtgagggctgggcttttgctgtcctcttctcacgcagagttctgccaggagggtgtgctgtgggggtcagactcctgaggctctcccttccctggggctagccagttactggtcatggctgctgtgggcatggaggctggaacttgtggttgaggcagggccatcccgatccttgctctacctggctagagtttcttctcatcagagcactgggacattaaaccaaccttttacaaca

SEQ ID NO: 12327 - DNA, 3032 bp, Homo sapiens
gcgagtcccgcttcttccccttccagctctgccccatctcctttgccccagcctagctctctccttcctgcgacctgggagaatcggagtgggcttccagagtagtggcatcttgcagatgctggcccgtgcccggctcccgggcttccagagcgcaaagggaagggtaggcagagagggcactgggcgagcaagacctggcgctgggccctggctgcgcaccagccgcctgcgccggtctctgggggcttcgcccaggatccccgacggcggggaggggaagccccgagtctcctgtttcctgcctacgcgggcagggcggggacacgcggagcaaaggcacccggcaacctgaacccccaggtgcgtcccgcgaccctgcaaggagctgctgggaccctccggtggacatgggtggggccctggggccggccctgttgctcacctcgctcttcggtgcctgggcagggctgggtccggggcagggcgagcagggcatgacggtggctgtggtgtttagcagctcagggccgccccaggcccagttccgtgcccgcctcaccccccagagcttcctggacctacccctggagatccagccgctcacagttggggtcaacaccaccaaccccagcagcctcctcacccagatctgcggcctcctgggtgctgcccacgtccacggcattgtctttgaggacaacgtggacaccgaggcggtggcccagatccttgacttcatctcctcccagacccatgtgcccatcctcagcatcagcggaggctctgctgtggtcctcacccccaaggagccgggctccgccttcctgcagctgggcgtgtccctggagcagcagctgcaggtgctgttcaaggtgctggaagagtacgactggagcgccttcgccgtcatcaccagcctgcacccgggccacgcgctcttcctggagggcgtgcgcgccgtcgccgacgccagccacgtgagttggcggctgctggacgtggtcacgctggagctgggcccgggagggccgcgcgcgcgcacgcagcgcctgctgcgccagctcgacgcgcccgtgtttgtggcctactgctcgcgcgaggaggccgaggtgctcttcgccgaggcggcgcaggccggtctggtggggcccggccacgtgtggctggtgcccaacctggcgctgggcagcaccgatgcgccccccgccaccttccccgtgggcctcatcagcgtcgtcaccgagagctggcgcctcagcctgcgccagaaggtgcgcgacggcgtggccattctggccctgggcgcccacagctactggcgccagcatggaaccctgccagccccggccggggactgccgtgttcaccctgggcccgtcagccctgcccgggaggccttctacaggcacctactgaatgtcacctgggagggccgagacttctccttcagccctggtgggtacctggtccagcccaccatggtggtgatcgccctcaaccggcaccgcctctgggagatggtggggcgctgggagcatggcgtcctatacatgaagtaccccgtgtggcctcgctacagtgcctctctgcagcctgtggtggacagtcggcacctgacggtggccacgctggaagagcggccctttgtcatcgtggagagccctgaccctggcacaggaggctgtgtccccaacaccgtgccctgccgcaggcagagcaaccacaccttcagcagcggggacgtggccccctacaccaagctctgctgtaagggattctgcatcgacatcctcaagaagctggccagagtggtcaaattctcctacgacctgtacctggtgaccaacggcaagcatggcaagcgggtgcgcggcgtatggaacggcatgattggggaggtgtactacaagcgggcagacatggccatcggctccctcaccatcaatgaggaacgctccgagatcgtagacttctctgtaccctttgtggagacgggcatcagtgtgatggtggctcgcagcaatggcaccgtctccccctcggccttcttggagccatatagccctgcagtgtgggtgatgatgtttgtcatgtgcctcactgtggtggccatcaccgtcttcatgttcgagtacttcagccctgtcagctacaaccagaacctcaccagaggcaagaagtccgggggcccagctttcactatcggcaagtccgtgtggctgctgtgggcgctggtcttcaacaactcagtgcccatcgagaacccgcggggcaccaccagcaagatcatggttctggtctgggccttctttgctgtcatcttcctcgccagctacacggccaacctggccgccttcatgatccaagagcaatacatcgacactgtgtcgggcctcagtgacaagaagtttcagcggcctcaagatcagtacccacctttccgcttcggcacggtgcccaacggcagcacggagcggaacatccgcagtaactaccgtgacatgcacacccacatggtcaagttcaaccagcgctcggtggaggacgcgctcaccagcctcaagatggggaagctggatgccttcatctatgatgctgctgtcctcaactacatggcaggcaaggacgagggctgcaagctggtcaccattgggtctggcaaggtctttgctaccactggctacggcatcgccatgcagaaggactcccactggaagcgggccatagacctggcgctcttgcagttcctgggggacggagagacacagaaactggagacagtgtggctctcagggatctgccagaatgagaagaacgaggtgatgagcagcaagctggacatcgacaacatggcaggcgtcttctacatgctgctggtggccatggggctggccctgctggtcttcgcctgggagcacctggtctactggaagctgcgccactcggtgcccaactcatcccagctggacttcctgctggctttcagcagggtgggtgcccacccctccccacacaggccaaagttttaa

SEQ ID NO: 12328 - DNA, 5092 bp, Homo sapiens
ggacgccgggttccggtcctggcccccccgccatccccccaacagaacagggtcatgaaaagaggccgcccggcggggcccgcaggcgatgcgcggcgccggtggcccccgcggccctcggggccccgctaagatgctgctgctgctggcgctggcctgcgccagcccgttcccggaggaggcgccggggccgggcggggccggtgggcccggcggcggcctcggcggggcgcggccgctcaacgtggcgctcgtgttctcggggcccgcgtacgcggccgaggcggcacgcctgggcccggccgtggcggcggcggtgcgcagcccgggcctagacgtgcggcccgtggcgctggtgctcaacggctcggacccgcgcagcctcgtgctgcagctctgcgacctgctgtcggggttgcgcgtgcacggcgtggtcttcgaagacgactcgcgcgcgcccgccgtcgcgcccatcctcgacttcctgtcggcgcagacctcgctgcccatcgtggccgtgcacggcggcgccgcgctcgtgctcacgcccaaggagaagggctccaccttcctgcagctgggctcttccaccgagcaacagcttcaggtcatctttgaggtgctggaggagtatgactggacgtcctttgtagccgtgaccactcgtgcccctggccaccgggccttcctgtcctacattgaggtgctgactgacggtagtctggtgggctgggagcaccgcggagcgctgacgctggaccctggggcgggcgaggccgtgctcagtgcccagctccgcagtgtcagcgcgcagatccgcctgctcttctgcgcccgagaggaggccgagcccgtgttccgcgcagctgaggaggctggcctcactggatctggctacgtctggttcatggtggggccccagctggctggaggcgggggctctggggcccctggtgagccccctcttctgccaggaggcgcccccctgcctgccgggctgtttgcagtgcgctcggctggctggcgggatgacctggctcggcgagtggcagctggcgtggccgtagtggccagaggtgcccaggccctgctgcgtgattatggtttccttcctgagctcggccacgactgtcgcgcccagaaccgcacccaccgcggcgagagtctgcataggtacttcatgaacatcacgtgggataaccgggattactccttcaatgaggacggcttcctagtgaacccctccctggtggtcatctccctcaccagagacaggacgtgggaggtggtgggcagctgggagcagcagacgctccgcctcaagtacccgctgtggtcccgctatggtcgcttcctgcagccagtggacgacacgcagcacctcacggtggccacgctggaggaaaggccgtttgtcatcgtggagcctgcagaccctatcagcggcacctgcatccgagactccgtcccctgccggagccagctcaaccgaacccacagccctccaccggatgccccccgcccggaaaagcgctgctgcaagggtttctgcatcgacattctgaagcggctggcgcataccatcggcttcagctacgacctctacctggtcaccaatggcaagcacggaaagaagatcgatggcgtctggaacggcatgatcggggaggtgttctaccagcgcgcagacatggccatcggctccctcaccatcaacgaggagcgctccgagatcgtggacttctccgtccccttcgtggagaccggcatcagcgtcatggtggcgcgcagcaatggcacggtgtccccctcggccttcctcgagccctacagccccgccgtgtgggtgatgatgttcgtcatgtgcctcactgtggtcgccgtcactgttttcatcttcgagtacctcagtcctgttggttacaaccgcagcctggccacgggcaagcgccctggcggttcaaccttcaccattgggaaatccatctggctgctctgggccctggtgttcaataattcggtgcccgtggagaacccccggggaaccaccagcaaaatcatggtgctggtgtgggccttcttcgccgtcatcttcctcgccagctacacagccaacctggccgccttcatgatccaggaggagtacgtggatactgtgtctgggctcagtgaccgcaagttccagaggccccaggagcagtacccgcccctgaagtttgggaccgtgcccaacggctccacggagaagaacatccgcagcaactatcccgacatgcacagctacatggtgcgctacaaccagccccgcgtagaggaagcgctcactcagctcaaggcagggaagctggacgccttcatctacgatgctgcagtgctcaattacatggcccgcaaggacgagggctgcaagcttgtcaccatcggctccggcaaggtcttcgccacgacaggctatggcatcgccctgcacaagggctcccgctggaagcggcccatcgacctggcgttgctgcagttcctgggggatgatgagatcgagatgctggagcggctgtggctctctgggatctgccacaatgacaaaatcgaggtgatgagcagcaagctggacatcgacaacatggcgggcgtcttctacatgctcctggtggccatgggcctgtccctgctggtcttcgcctgggagcacctggtgtactggcgcctgcggcactgcctggggcccacccaccgcatggacttcctgctggccttctccaggggcatgtacagctgctgcagcgctgaggccgccccaccgcccgccaagcccccgccgccgccacagcccctgcccagccccgcgtaccccgcgccgcggccggctcccgggcccgcacctttcgtgccccgcgagcgcgcctcagtggaccgctggcgccggaccaagggcgcggggccgccggggggcgcgggcctggccgacggcttccaccgctactacggccccatcgagccgcagggcctaggcctcggcctgggcgaagcgcgcgcggcaccgcggggcgcagccgggcgcccgctgtccccgccggccgctcagcccccgcagaagccgccgccctcctatttcgccatcgtacgcgacaaggagccagccgagccccccgccggcgccttccccggcttcccgtcgccgcccgcgccccccgccgccgcggccaccgccgtcgggccgccactctgccgcttggccttcgaggacgagagcccgccggcgcccgcgcggtggccgcgctcggaccccgagagccaacccctgctggggccaggcgcgggcggcgcggggggcacggggggcgcaggcggaggagccccggccgctccgcccccgtgccgcgccgcgccgcccccgtgcccttacctcgatctcgagccgtcgccgtcggactcggaggactcggagagcctgggcggcgcgtcgctgggcggcctggagccctggtggttcgccgacttcccttacccgtatgccgagcgcctcgggccgccgcccggccgctactggtcggtcgacaagctcgggggctggcgcgccgggagctgggactacctgcccccgcgcagcggtccggccgcctggcactgtcggcactgcgccagcctggagctgctgccgccgccgcgccatctcagctgctcgcacgatggcctggacggcggctggtgggcgccaccgcctccaccctgggccgccgggcccctgccccgacgccgggcccgctgcgggtgcccgcggtcgcacccgcaccgcccgcgggcctcgcaccgcacgcccgccgccgccgcgccccaccaccacaggcaccggcgcgccgctgggggctgggacctcccgccgcccgcgcccacctcgcgctcgctcgaggacctcagctcgtgccctcgcgccgcccctgcgcgcaggcttaccgggccctcccgccacgctcgcaggtgtccgcacgccgcgcactgggggccgccgctgcccacagcttcccaccggagacaccggggcggggacctgggcacccgcaggggctcggcgcacttctctagcctcgagtccgaggtatgacgcggccccgggggccccaccgcccccttggtcagcgcaggccacggcccgagggggcgcccgcagtggacaggacccgcgtgggttgggaaggaaagcagtggaactggccggaccccgcctggagcagcgtcctgcgccccctggttctggaggaaccgcaagccggagaggatttggtccctcaactatcacccagcctgagaacgagggggcgggggccttggagcccaccggacttttttttaaacccgacaagggctttttaacgtcaccagatggggcgggaggtggggggttcacgccactcccgcgtcccacctccacgcccggggccgtggcccccacatcactgtgcagctccccggccccagccgcgcctccggggaagcccgtttttaacctttcatccattgggactcaaaactgtgagacgcgttcgccaaactgtgaccccagaccttggccccgccacacagaaacccctgacccagactgtgacatccgactcctaaaatggtcatccgactccagactgtgacccctgaccccaaactgtgacccgaaccccagactgtgccccgaccagactgtgacccttgacatcaaaccgtgacaccccctcctcctcttccaccctcggtcgcttttccctactctgacctaggacacgtccccaacggaagccccgccttcccttgcaccgcgatgaacccaacctccctgaagccaaaacttcccaccctgccgcacctccggaccaccccacttgccaccaagcacatcctctccaaatccaacccttatttgcgacccttcagtgatgacccagcagacctccaaaaagcctcctctgcccagatctccagccgggtctggggctgggttgcggaggggagggtctgggagtccacacttctccaccaacttcccttcccactctcttattccacattgcagtgtttggaataaaccatgtttttatgcctcctc

SEQ ID NO: 12329 - DNA, 1968 bp, Homo sapiens
aaggccccgctgcgtcttccgagccgcaggcgcaggcccagctgagcggccgccgagcgggtgcgggtgcgggcgcatcggccatcaccgcgcggccgcgcagcggacaccgtgcgtaccggcctgcggcgcccggccaccggtgagtccccggcccgagcccaggagcgcctctgacccgctgcgccgcgcggcctgccgcccccgcccccgcccccacgcggatcttgcgcatccgagcgtggccgcctcgggggcggaccgcggaacccgaggccatgtcccatgaaaagagttttttggtgtctggggacaactatcctccccccaaccctggatatccgggggggccccagccacccatgcccccctatgctcagcctccctaccctggggccccttacccacagccccctttccagccctccccctacggtcagccagggtacccccatggccccagcccctacccccaagggggctacccacagggtccctacccccaagggggctacccacagggcccctacccacaagagggctacccacagggcccctacccccaagggggctacccccaggggccatatccccagagccccttcccccccaacccctatggacagccacaggtcttcccaggacaagaccctgactcaccccagcatggaaactaccaggaggagggtcccccatcctactatgacaaccaggacttccctgccaccaactgggatgacaagagcatccgacaggccttcatccgcaaggtgttcctagtgctgaccttgcagctgtcggtgaccctgtccacggtgtctgtgttcacttttgttgcggaggtgaagggctttgtccgggagaatgtctggacctactatgtctcctatgctgtcttcttcatctctctcatcgtcctcagctgttgtggggacttccggcgaaagcacccctggaaccttgttgcactgtcggtcctgaccgccagcctgtcgtacatggtggggatgatcgccagcttctacaacaccgaggcagtcatcatggccgtgggcatcaccacagccgtctgcttcaccgtcgtcatcttctccatgcagacccgctacgacttcacctcatgcatgggcgtgctcctggtgagcatggtggtgctcttcatcttcgccattctctgcatcttcatccggaaccgcatcctggagatcgtgtacgcctcactgggcgctctgctcttcacctgcttcctcgcagtggacacccagctgctactggggaacaagcagctgtccctgagcccagaagagtatgtgtttgctgcgctgaacctgtacacagacatcatcaacatcttcctgtacatcctcaccatcattggccgcgccaaggagtagccgagctccagctcgctgtgcccgctcaggtggcacggctggcctggaccctgcccctggcacggcagtgccagctgtacttcccctctctcttgtccccaggcacagcctagggaaaaggatgcctctctccaaccctcctgtatgtacactgcagatacttccatttggacccgctgtggccacagcatggcccctttagtcctcccgcccccgccaaggggcaccaaggccacgtttccgtgccacctcctgtctactcattgttgcatgagccctgtctgccagcccaccccagggactgggggcagcaccaggtcccggggagagggattgagccaagaggtgagggtgcacgtcttccctcctgtcccagctccccagcctggcgtagagcacccctcccctcccccccacccccctggagtgctgccctctggggacatgcggagtgggggtcttatccctgtgctgagccctgagggcagagaggatggcatgtttcaggggagggggaagccttcctctcaatttgttgtcagtgaaattccaataaatgggatttgctctctgc

SEQ ID NO: 12330 - DNA, 1814 bp, Homo sapiens
tgagcggccgccgagcgggtgcgggtgcgggcgcatcggccatcaccgcgcggccgcgcagcggacaccgtgcgtaccggcctgcggcgcccggccaccggggcggaccgcggaacccgaggccatgtcccatgaaaagagttttttggtgtctggggacaactatcctccccccaaccctggatatccgggggggccccagccacccatgcccccctatgctcagcctccctaccctggggccccttacccacagccccctttccagccctccccctacggtcagccagggtacccccatggccccagcccctacccccaagggggctacccacagggtccctacccccaagggggctacccacagggcccctacccacaagagggctacccacagggcccctacccccaagggggctacccccaggggccatatccccagagccccttcccccccaacccctatggacagccacaggtcttcccaggacaagaccctgactcaccccagcatggaaactaccaggaggagggtcccccatcctactatgacaaccaggacttccctgccaccaactgggatgacaagagcatccgacaggccttcatccgcaaggtgttcctagtgctgaccttgcagctgtcggtgaccctgtccacggtgtctgtgttcacttttgttgcggaggtgaagggctttgtccgggagaatgtctggacctactatgtctcctatgctgtcttcttcatctctctcatcgtcctcagctgttgtggggacttccggcgaaagcacccctggaaccttgttgcactgtcggtcctgaccgccagcctgtcgtacatggtggggatgatcgccagcttctacaacaccgaggcagtcatcatggccgtgggcatcaccacagccgtctgcttcaccgtcgtcatcttctccatgcagacccgctacgacttcacctcatgcatgggcgtgctcctggtgagcatggtggtgctcttcatcttcgccattctctgcatcttcatccggaaccgcatcctggagatcgtgtacgcctcactgggcgctctgctcttcacctgcttcctcgcagtggacacccagctgctactggggaacaagcagctgtccctgagcccagaagagtatgtgtttgctgcgctgaacctgtacacagacatcatcaacatcttcctgtacatcctcaccatcattggccgcgccaaggagtagccgagctccagctcgctgtgcccgctcaggtggcacggctggcctggaccctgcccctggcacggcagtgccagctgtacttcccctctctcttgtccccaggcacagcctagggaaaaggatgcctctctccaaccctcctgtatgtacactgcagatacttccatttggacccgctgtggccacagcatggcccctttagtcctcccgcccccgccaaggggcaccaaggccacgtttccgtgccacctcctgtctactcattgttgcatgagccctgtctgccagcccaccccagggactgggggcagcaccaggtcccggggagagggattgagccaagaggtgagggtgcacgtcttccctcctgtcccagctccccagcctggcgtagagcacccctcccctcccccccacccccctggagtgctgccctctggggacatgcggagtgggggtcttatccctgtgctgagccctgagggcagagaggatggcatgtttcaggggagggggaagccttcctctcaatttgttgtcagtgaaattccaataaatgggatttgctctctgc

SEQ ID NO: 12331 - DNA, 1075 bp, Homo sapiens
gcaggcgcaggcccagctgagcggccgccgagcgggtgcgggtgcgggcgcatcggccatcaccgcgcggccgcgcagcggacaccgtgcgtaccggcctgcggcgcccggccaccggtgagtccccggcccgagcccaggagcgcctctgacccgctgcgccgcgcggcctgccgcccccgcccccgcccccacgcggatcttgcgcatccgagcgtggccgcctcgggggcggaccgcggaacccgaggccatgtcccatgaaaagagttttttggtgtctggggacaactatcctccccccaaccctggatatccgggggggccccagccacccatgcccccctatgctcagcctccctaccctggggccccttacccacagccccctttccagccctccccctacggtcagccagggtacccccatggccccagcccctacccccaagggggctacccacagggtccctacccccaagggggctacccacagggcccctacccacaagagggctacccacagggcccctacccccaagggggctacccccaggggccatatccccagagccccttcccccccaacccctatggacagccacaggtcttcccaggacaagaccctgactcaccccagcatggaaactaccaggaggagggtcccccatcctactatgacaaccaggacttccctgccaccaactgggatgacaagagcatccgacaggccttcatccgcaaggtgttcctagtgctgaccttgcagctgtcggtgaccctgtccacggtgtctgtgttcacttttgttgcggaggtgaagggctttgtccgggagaatgtctggacctactatgtctcctatgctgtcttcttcatctctctcatcgtcctcagctgttgtggggacttccggcgaaagcacccctggaaccttgttgcactgtcggtcctgaccgccagcctgtcgtacatggtggggatgatcgccagcttctacaacaccgaggcagtcatcatggccgtgggcatcaccacagccgtctgcttcaccgtcgtcatcttctccatgcag

SEQ ID NO: 12332 - DNA, 558 bp, Homo sapiens
gttgttgggctcgcgggggtgggggggctcgggcctttgttggtcacagatggcccggggatttcctgggatagaaatagccgccggctccggccccttaaagctgcttaaggggcgggatgcggaggggagggtccgggcacaccccacacgtccccggccgagaccccagcctccgcgctgagctcccacccgggagacgccggcagcggcgcaggcctccggttgcttgggcggaccgcggaacccgaggccatgtcccatgaaaagagttttttggtgtctggggacaactatcctccccccaaccctggatatccgggggggccccagccacccatgcccccctatgctcagcctccctaccctggggccccttacccacagccccctttccagccctccccctacggtcagccagggtacccccatggccccagcccctacccccaagggggctacccacagggtccctacccccaagggggctacccacagggcccctacccacaagagggctacccacagggcccctacccccaagggggctacccccag

SEQ ID NO: 12333 - DNA, 1633 bp, Homo sapiens
atgtcccatgaaaagagttttttggtgtctggggacaactatcctcctccctaccctggggccccttacccacagccccctttccagccctccccctacggtcagccagggtacccccatggccccagcccctacccccaagggggctacccacagggtccctacccccaagggggctacccacagggcccctacccacaagagggctacccacagggcccctacccccaagggggctacccccaggggccatatccccagagccccttcccccccaacccctatggacagccacaggtcttcccaggacaagaccctgactcaccccagcatggaaactaccaggaggagggtcccccatcctactatgacaaccaggacttccctgccaccaactgggatgacaagagcatccgacaggccttcatccgcaaggtgttcctagtgctgaccttgcagctgtcggtgaccctgtccacggtgtctgtgttcacttttgttgcggaggtgaagggctttgtccgggagaatgtctggacctactatgtctcctatgctgtcttcttcatctctctcatcgtcctcagctgttgtggggacttccggcgaaagcacccctggaaccttgttgcactgtcggtcctgaccgccagcctgtcgtacatggtggggatgatcgccagcttctacaacaccgaggcagtcatcatggccgtgggcatcaccacagccgtctgcttcaccgtcgtcatcttctccatgcagacccgctacgacttcacctcatgcatgggcgtgctcctggtgagcatggtggtgctcttcatcttcgccattctctgcatcttcatccggaaccgcatcctggagatcgtgtacgcctcactgggcgctctgctcttcacctgcttcctcgcagtggacacccagctgctactggggaacaagcagctgtccctgagcccagaagagtatgtgtttgctgcgctgaacctgtacacagacatcatcaacatcttcctgtacatcctcaccatcattggccgcgccaaggagtagccgagctccagctcgctgtgcccgctcaggtggcacggctggcctggaccctgcccctggcacggcagtgccagctgtacttcccctctctcttgtccccaggcacagcctagggaaaaggatgcctctctccaaccctcctgtatgtacactgcagatacttccatttggacccgctgtggccacagcatggcccctttagtcctcccgcccccgccaaggggcaccaaggccacgtttccgtgccacctcctgtctactcattgttgcatgagccctgtctgccagcccaccccagggactgggggcagcaccaggtcccggggagagggattgagccaagaggtgagggtgcacgtcttccctcctgtcccagctccccagcctggcgtagagcacccctcccctcccccccacccccctggagtgctgccctctggggacatgcggagtgggggtcttatccctgtgctgagccctgagggcagagaggatggcatgtttcaggggagggggaagccttcctctcaatttgttgtcagtgaaattccaataaatgggatttgctctctgc

SEQ ID NO: 12334 - DNA, 7770 bp, Homo sapiens
cagagaggaagtagcgagagaagagagaaaatgaagtcggcgctgggggagcctgcaggagggtggccaacagtggaggaaggtggatttggcttcttttccgcaccccgggcgtgaaagccctctccaacgcgaccccaggaaataagtgggtctcgcctgggcagaaaaggaaaagaatccaggcgagagcgcgtcgctcctctgtcactgctgcccccgaggaactccggctgcttctcatcccggccgcctcgcggggccggacgcagtgcccgaggcgccctgcagatggggcgggcagggaacgggcgctccagctgcgggtgacaggcgccggcccgcccgcctgcctgctcagcgcagtgaccgggcgggcagaggatgccaggcggagggacctgggagcgggatctgagactgccggaggcgcgctacgctccaacttgcatggcctagagaccgctccagctcctgggaccgcttcaccgagtggagtgaagctgcgcgcgggacctggaggcggagacctcaggcagcggctgcagaggggcgagccgggcgcaggagggggcgcgctttctccctgcgggtctcagtaatgaggagactgagtttgtggtggctgctgagcagggtctgtctgctgttgccgccgccctgcgcactggtgctggccggggtgcccagctcctcctcgcacccgcagccctgccagatcctcaagcgcatcgggcacgcggtgagggtgggcgcggtgcacttgcagccctggaccaccgccccccgcgcggccagccgcgctccggacgacagccgagcaggagcccagagggatgagccggagccagggactaggcggtccccggcgccctcgccgggcgcacgctggttggggagcaccctgcatggccgggggccgccgggctcccgtaagcccggggagggcgccagggcggaggccctgtggccacgggacgccctcctatttgccgtggacaacctgaaccgcgtggaagggctgctaccctacaacctgtctttggaagtagtgatggccatcgaggcaggcctgggcgatctgccacttttgcccttctcctcccctagttcgccatggagcagtgaccctttctccttcctgcaaagtgtgtgccataccgtggtggtgcaaggggtgtcggcgctgctcgccttcccccagagccagggcgaaatgatggagctcgacttggtcagcttagtcctgcacattccagtgatcagcatcgtgcgccacgagtttccacgggagagtcagaatccccttcacctacaactgagtttagaaaattcattaagttctgatgctgatgtcactgtctcaatcctgaccatgaacaactggtacaattttagcttgttgctgtgccaggaagactggaacatcaccgacttcctcctccttacccagaataattccaagttccaccttggttctatcatcaacatcaccgctaacctcccctccacccaggacctcttgagcttcctacagatccagcttgagagtattaagaacagcacacccacagtggtgatgtttggctgcgacatggaaagtatccggcggattttcgaaattacaacccagtttggggtcatgccccctgaacttcgttgggtgctgggagattcccagaatgtggaggaactgaggacagagggtctgcccttagggctcattgctcatggaaaaacaacacagtctgtctttgagcactacgtacaagatgctatggagctggtcgcaagagctgtagccacagccaccatgatccaaccagaacttgctctcattcccagcacgatgaactgcatggaggtggaaactacaaatctcacttcaggacaatatttatcaaggtttctagccaataccactttcagaggcctcagtggttccatcagagtaaaaggttccaccatcgtcagctcagaaaacaactttttcatctggaatcttcaacatgaccccatgggaaagccaatgtggacccgcttgggcagctggcaggggggaaagattgtcatggactatggaatatggccagagcaggcccagagacacaaaacccacttccaacatccaagtaagctacacttgagagtggttaccctgattgagcatccttttgtcttcacaagggaggtagatgatgaaggcttgtgccctgctggccaactctgtctagaccccatgactaatgactcttccacattggacagcctttttagcagcctccatagcagtaatgatacagtgcccattaaattcaagaagtgctgctatggatattgcattgatctgctggaaaagatagcagaagacatgaactttgacttcgacctctatattgtaggggatggaaagtatggagcatggaaaaatgggcactggactgggctagtgggtgatctcctgagagggactgcccacatggcagtcacttcctttagcatcaatactgcacggagccaggtgatagatttcaccagccctttcttctccaccagcttgggcatcttagtgaggacccgagatacagcagctcccattggagccttcatgtggccactccactggacaatgtggctggggatttttgtggctctgcacatcactgccgtcttcctcactctgtatgaatggaagagtccatttggtttgactcccaaggggcgaaatagaagtaaagtcttctccttttcttcagccttgaacatctgttatgccctcttgtttggcagaacagtggccatcaaacctccaaaatgttggactggaaggtttctaatgaacctttgggccattttctgtatgttttgcctttccacatacacggcaaacttggctgctgtcatggtaggtgagaagatctatgaagagctttctggaatacatgaccccaagttacatcatccttcccaaggattccgctttggaactgtccgagaaagcagtgctgaagattatgtgagacaaagtttcccagagatgcatgaatatatgagaaggtacaatgttccagccacccctgatggagtggagtatctgaagaatgatccagagaaactagacgccttcatcatggacaaagcccttctggattatgaagtgtcaatagatgctgactgcaaacttctcactgtggggaagccatttgccatagaaggatacggcattggcctcccacccaactctccattgaccgccaacatatccgagctaatcagtcaatacaagtcacatgggtttatggatatgctccatgacaagtggtacagggtggttccctgtggcaagagaagttttgctgtcacggagactttgcaaatgggcatcaaacacttctctgggctctttgtgctgctgtgcattggatttggtctgtccattttgaccaccattggtgagcacatagtatacaggctgctgctaccacgaatcaaaaacaaatccaagctgcaatactggctccacaccagccagagattacacagagcaataaatacatcatttatagaggaaaagcagcagcatttcaagaccaaacgtgtggaaaagaggtctaatgtgggaccccgtcagcttaccgtatggaatacttccaatctgagtcatgacaaccgacggaaatacatctttagtgatgaggaaggacaaaaccagctgggcatccggatccaccaggacatccccctccctccaaggagaagagagctccctgccttgcggaccaccaatgggaaagcagactccctaaatgtatctcggaactcagtgatgcaggaactctcagagctcgagaagcagattcaggtgatccgtcaggagctgcagctggctgtgagcaggaaaacggagctggaggagtatcaaaggacaagtcggacttgtgagtcctaggtgaccacactgcttccctttctcagttcctgaccttcctctgagcccttgagacactttgtaatgctcttttgtaactatcgacaaaggtgtggggaagctgaggtctaggtcttcttaaaggtcaagtctgctctccctcgcctaaagtgcagcagcagctcctctcaagctcactctctaggtctccagggtaggagtgtttttctagcaagaatcttagtcaggagtaagctctgtgcgagagatctgtgaataaccagataaccccagctgccgttaaccttttcaccaggtgccacagtaatatttctggtttttagccctttctctgcactaccaacaagagataaaattgttactcacacttatgtcttactgggttgctggttttcatcgtaacacagaacgaggttatctagggttgtagcttttgatacaactccccgatctagatttattcctacattctgaatggggagcaggtaagagcagagcacctcccactgggggtggggtatttaaaaattaactcattagtatcataaacgtcaaggattgattggaccaggcaagagccatgtttttgagaaggttctggatctctgactccatcctgactgtttagtaagagcatgcttacaccctactgtgaaaaggggaggggatgtggtaagcggaaacagaagacaggcagcagaggcattaaaaatgcataccatgctttcagaacaaaagctctgggccagaaaggcaatttggctaaaaaatgaataagactacttctaatgtaactaagcatctccactatggtgtgtgccttttataaaggaaaagagagaaaaaggcaaagcaaggttgtggccttaggttggacctggaatatcccttattgcctataatggaatatgtgacactgtgggtgaaatgttctacacaccacacactaggccattttcagatcagcagtcacccatcgcttagcatagaaatcccaaaacctccagcccgggaacactataagcttcgaccattcaggaatctgccctgcactttgcatatctgtatagaaaatcaagtcaatcccccatcctcacacccactcatctctgaggagctatgaactggttttggtccctctaatgatcctccagcctcatctaatgccccccaaagactgatacaagtaacctcccctctgcttaggtgtcactttctcagcatatcaagtttaggcagcaagggaaaggaatatgggtcagttctcaaatgtcaatgtagataagagtcatctagtagagaactcatcagagtgcggattgccaagacccttctccagagattatggggttgggggtggaggtctagaggtgagctcagaaacctactgttaaccaacacccccaagtgactgacacaggtggtctaaaaattacttttctagaaacaccattctggaagtttggctgcccacaggcaggaggagaagcatgaagagaaaacctgtttgagaagttttgttttgttttgttttgctttttaataattttagcacacatctgctgactctccttcaacatcctcacccccacccctgggcaccatttaggacaagacttccttatttatcaattacttgatttatcttctcaggactcattgttccacccccaaccaatttgaatgcctacaataagttcaggagctgtgccaagcactttcctcttttacagctggagatcactggaaaggtgtctcagtcacaaaacttctccctctactactggatgaaatgtctgcatttccaccaaaatctacccagtcacccagggaataacaacttaagctgtagttagataacacctagtgattaattggctgagaaaaccctggagtggagggaggctcagagatactgatatggatgtgggagggctctaaagttagaggtcaccaactccacagatgaaacagttcaataatgaggaaacaggtgagccctgaaaacacaaaaggacagttctgtgttgaaacaccccatcccctcacgttctcaccccaggcccagaagtaggttgcaactgcctttggaagattttgccccttagccatccccacccacttgtaccagctaagaatgctggagactctgccaccatgctctgcgtgcccctgaacctctgtgcagcccggaaggctgatgtacaggtgtacctcaatccacattacagccatgctcctaatgtacatggacatttttgtaactcagctcatattctgactgtatttgagaagctggctgtttaagggaacccagaagtgaattcttttgtaaagtaaagcacccttttgtaatgcaattaattatcccttaatgtatctgttttgtaagtctgcatttttgtatatcggatttaccttaagcttctctagtgaggcattctgagcagtggtgatcacatgccagatcgccctgcctatccacaaagtagatgaccaatgcacgctcctcaaacatctttggaggaactacctggccaaaacactggccaggatgcagcaagcagcagcaggggctgacagcaggcttactgccatcaacattgcttgaaatgcctctatgttctgaataaagaaaaaccataattgcttgtggtgaaacgaagcagtcttcatgttaagtagcaatggttatttttattggtagtaactgaacagtgttttgcaatttgtgaaacagtgtattgtgttttgtaaaatgatgtcatgaaatggtgggtccttggaaacctcctttccgttcagctctgcctctgttctttcaactcctttgaggctcaaaaaaaacacaaagatcagaagccttcagatagagggtggtattctggtaaagaagaaagagataagggacgctaccttgcttttctggcacaggaagcacatgataaagcatgctcagatgagctggaacagatatagctacctggttcgtgtaaataagaataatcaaggccccagagtgtgtatgcttccaggtggaggagaaaggggaatctcccaaaatttaaaaacaaattggaagaataaccaggacagccaagtgaagcagccacagggacccaagcagtcgaggtctttaatgtgcctggagatgactctctgctattcatgaatcttgctattgcacaaaccctatcaagagctgctgcttcccttccagccagaaaagtggtaagcggagcaagtgccaagcagaacagaccttatcatctgggtaacagacttctcagtgttggtgctgtgtctgttagagccttagagcaagttaagcacttccttggtgtgggtaaagaataaaggggaaagaaactactttagagcctctttttctcccaactcatatttttgataggaaaaacagaaaacccatccagttcttcagaaattgctttctaggcattaatactactttactatctatactgtttagttattcctttctttacccacctaaactatccatctaatccaggattccctcactctttttttttagttactaatcattttatgaaaataatgtatttataagtattttcttaaggtttgtgaagagtatttgcattgtgtcttcattttaatgtgtttgcaatcgctccgctccaggaagaacggaaatgctgtcttgtgagcatgaagtgaacgggctgttttgctccagccacttttcttgtacaaccacatggatggattagatgtcctcaggtcttttccatcttcagtttctatgactgtggaataaatgttcagatagaaacttc

SEQ ID NO: 12335 - DNA, 6622 bp, Homo sapiens
gaattcccttacaaacgcctccagcttgtagaggcggtcgtggaggacccagaggaggagacgaaggggaaggaggcggtggtggaggaggcaaaggccttggacgaccattgttggcgaggggcaccactccgggagaggcggcgctgggcgtcttgggggtgcgcgccgggagcctgcagcgggaccagcgtgggaacgcggctggcaggctgtggacctcgtcctcaccaccatggtcgggctccttttgttttttttcccagcgatctttttggaggtgtcccttctccccagaagccccggcaggaaagtgttgctggcaggagcgtcgtctcagcgctcggtggccagaatggacggagatgtcatcattggagccctcttctcagtccatcaccagcctccggccgagaaagtgcccgagaggaagtgtggggagatcagggagcagtatggcatccagagggtggaggccatgttccacacgttggataagatcaacgcggacccggtcctcctgcccaacatcaccctgggcagtgagatccgggactcctgctggcactcttccgtggctctggaacagagcattgagttcattagggactctctgatttccattcgagatgagaaggatgggatcaaccggtgtctgcctgacggccagtccctccccccaggcaggactaagaagcccattgcgggagtgatcggtcccggctccagctctgtagccattcaagtgcagaacctgctccagctcttcgacatcccccagatcgcttattcagccacaagcatcgacctgagtgacaaaactttgtacaaatacttcctgagggttgtcccttctgacactttgcaggcaagggccatgcttgacatagtcaaacgttacaattggacctatgtctctgcagtccacacggaagggaattatggggagagcggaatggacgctttcaaagagctggctgcccaggaaggcctctgtatcgcccattctgacaaaatctacagcaacgctggggagaagagctttgaccgactcttgcgcaaactccgagagaggcttcccaaggctagagtggtggtctgcttctgtgaaggcatgacagtgcgaggactcctgagcgccatgcggcgccttggcgtcgtgggcgagttctcactcattggaagtgatggatgggcagacagagatgaagtcattgaaggttatgaggtggaagccaacgggggaatcacgataaagctgcagtctccagaggtcaggtcatttgatgattatttcctgaaactgaggctggacactaacacgaggaatccctggttccctgagttctggcaacatcggttccagtgccgccttccaggacaccttctggaaaatcccaactttaaacgaatctgcacaggcaatgaaagcttagaagaaaactatgtccaggacagtaagatggggtttgtcatcaatgccatctatgccatggcacatgggctgcagaacatgcaccatgccctctgccctggccacgtgggcctctgcgatgccatgaagcccatcgacggcagcaagctgctggacttcctcatcaagtcctcattcattggagtatctggagaggaggtgtggtttgatgagaaaggagacgctcctggaaggtatgatatcatgaatctgcagtacactgaagctaatcgctatgactatgtgcacgttggaacctggcatgaaggagtgctgaacattgatgattacaaaatccagatgaacaagagtggagtggtgcggtctgtgtgcagtgagccttgcttaaagggccagattaaggttatacggaaaggagaagtgagctgctgctggatttgcacggcctgcaaagagaatgaatatgtgcaagatgagttcacctgcaaagcttgtgacttgggatggtggcccaatgcagatctaacaggctgtgagcccattcctgtgcgctatcttgagtggagcaacatcgaatccattatagccatcgccttttcatgcctgggaatccttgttaccttgtttgtcaccctaatctttgtactgtaccgggacacaccagtggtcaaatcctccagtcgggagctctgctacatcatcctagctggcatcttccttggttatgtgtgcccattcactctcattgccaaacctactaccacctcctgctacctccagcgcctcttggttggcctctcctctgcgatgtgctactctgctttagtgactaaaaccaatcgtattgcacgcatcctggctggcagcaagaagaagatctgcacccggaagcccaggttcatgagtgcctgggctcaggtgatcattgcctcaattctgattagtgtgcaactaaccctggtggtaaccctgatcatcatggaaccccctatgcccattctgtcctacccaagtatcaaggaagtctaccttatctgcaataccagcaacctgggtgtggtggcccctttgggctacaatggactcctcatcatgagctgtacctactatgccttcaagacccgcaacgtgcccgccaacttcaacgaggccaaatatatcgcgttcaccatgtacaccacctgtatcatctggctagcttttgtgcccatttactttgggagcaactacaagatcatcacaacttgctttgcagtgagtctcagtgtaacagtggctctggggtgcatgttcactcccaagatgtacatcattattgccaagcctgagaggaatgtccgcagtgccttcaccacctctgatgttgtccgcatgcatgttggcgatggcaagctgccctgccgctccaacactttcctcaacatcttccgaagaaagaaggcaggggcagggaatgccaattctaatggcaagtctgtgtcatggtctgaaccaggtggaggacaggtgcccaagggacagcatatgtggcaccgcctctctgtgcacgtgaagaccaatgagacggcctgcaaccaaacagccgtcatcaagcccctcactaaaagttaccaaggctctggcaagagcctgaccttttcagataccagcaccaagaccctttacaacgtagaggaggaggaggatgcccagccgattcgctttagcccgcctggtagcccttccatggtggtgcacaggcgcgtgccaagcgcggcgaccactccgcctctgccgtcccacctgaccgcagaggagacccccctcttcctggccgaaccagccctccccaagggcttgccccctcctctccagcagcagcagcaaccccctccacagcagaaatcgctgatggaccagctccagggagtggtcagcaacttcagtaccgcgatcccggattttcacgcggtgctggcaggccccggtggtcccgggaacgggctgcggtccctgtacccgcccccgccacctccgcagcacctgcagatgctgccgctgcagctgagcacctttggggaggagctggtctccccgcccgcggacgacgacgacgacagcgagaggtttaagctcctccaggagtacgtgtatgagcacgagcgggaagggaacacggaagaagacgaactggaagaggaggaggaggacctgcaggcggccagcaaactgaccccggatgattcgcctgcgctgacgcctccgtcgcctttccgcgactcggtggcctcgggcagctcggtgcccagctcccccgtgtccgagtcggtgctctgcacccctcccaacgtatcctacgcctctgtcattctgcgggactacaagcaaagctcttccaccctgtaagggggaagggtccacatagaaaagcaagacaagccagagatctcccacacctccagagatgtgcaaacagctgggaggaaaagcctgggagtggggggcctcgtcgggaggacaggagaccgctgctgctgctgccgctactgctgctgctgccttaagtaggaagagagggaaggacaccaagcaaaaaatgttccaggccaggattcggattcttgaattactcgaagccttctctgggaagaaagggaattctgacaaagcacaattccatatggtatgtaacttttatcacaaatcaaatagtgacatcacaaacataatgtcctcttttgcacaattgtgcatagatatatatatgcccacacacactgggccatgcttgccaaggaacagcccacgtggacatgccagtcggatcatgagttcacctgatggcattcggagtgagctggtggagccagacagagcaggtgcggggaagggaagggcccaggccagacccatcccaaacggatgatgggatgatgggacagcagctccttgctcagaagcccttctccccgctgggctgacagactcctcatcttcaggagactcaggaatggagcggcacaggggtctctcttcatccactgcaacccatccagtgccagctttgagattgcacttgaagaaaggtgcatggaccccctgctgctctgcagattccctttatttaggaaaacaggaataagagcaaaattatcaccaaaaagtgcttcatcaggcgtgctacaggaggaaggagctagaaatagaacaatccatcagcatgagactttgaaaaaaaaacacatgatcagcttctcatgttccatattcacttattggcgatttggggaaaaggccggaacaagagattgttacgagagtggcagaaacccttttgtagattgacttgtgtttgtgccaagcgggctttccattgaccttcagttaaagaacaaaccatgtgacaaaattgttaccttccacttactgtagcaaataatacctacaagttgaacttctaagatgcgtatatgtacaatttggtgccattatttctcctacgtattagagaaacaaatccatctttgaatctaatggtgtactcatagcaactattactggtttaaatgacaaataattctatcctattgtcactgaagtccttgtaactagcgagtgaatgtgttcctgtgtccttgtatatgtgcgatcgtaaaatttgtgcaatgtaatgtcaaattgactggtcaatgtcaacctagtagtcaatctaactgcaattagaaattgtcttttgaatatactatatatattttttatgttccaataatgttttgtacatcattgtcatcaatatctacagaagctctttgacggtttgaatactatggctcaaggttttcatatgcagctcggatggacatttttcttctaagatggaacttatttttcagatattttctgatgtggagatatgttattaatgaagtggtttgaaaatttgttatattaaaagtgcacaaaaactgagagtgaaaataaaaggtacattttataagcttgcacacattattaacacataagattgaacaaagcatttagattattccaggttatatcatttttttaaagattttccacagctacttgagtgtctaacatacagtaacatctaactcagctaataatttgtaaaatctttatcaatcacattttgccttcttttaatttttatgttcatggacttttattcctgtgtcttggctgtcataactttttatttctgctatttgctgttgtgtaatatccatggacatgtaatccacttactccatctttacaatccctttttaccaccaataaaaggatttttcttgctgttttgatttcttctattatttgtggaatgaattataccccccttaaatatctttgtttatgccttatgttcagtcatattttaatatgcttccttcatattgaagctgctgatttctcagccaaaaatcatcttagaatctttaaatatccattgcatcatttgttcagaatttaacatccattccaatgttggaggcttgtattacttatatttcatcatattctattgccaagtttagtcagttccacaccaagaatgaactgcatttcctttaaaaattattttaaaacacctttattgaaaagatctcatgactgagatgtggactttggttccatgttttcattgtaagaaagcagagagcggaaaatcaatggctccagtgattaatagatgggtttttagtaattgacaaattcatgagggaaagcatatgatctctttattagtgaatcatgcttattttttactcttaatgccactaatatacatccctaatatcacagggcttgtgcattcagatttttaaaaaattaggatagataaggaaacaacttatattcaagtgtaagatgatatcaggttggtctaagacttttggtgaacacgttcattcaactgtgatcactttattactctgaatgcctactattatcctgattatggggtctcctgaataaatagagtattagtccttatgtcatcattgttcaaaattggagatgtacacatacataccctataccaagagggccgaaactcttcaccttgatgtatgttctgatacaagttgttcagcttcttgtaaatgtgttttccttcggcttgttactgccttttgtcaaataatcttgacaatgctgtataataaatattttctatttatt

SEQ ID NO: 12336 - DNA, 6854 bp, Homo sapiens
agtgctgaagaaagagggcactagtgtacagcccagatcgcatccttgcaccgtctggattagagctgaggcgtctgcaagccgagcgtggccacggtcctctggccccgggaccatagcgctgtctaccccgactcaggtactcagcagcatctagctcaccgctgccaacacgacttccactgtactcttgatcaatttaccttgatgcactaccggtgaagaacggggactcgaattcccttacaaacgcctccagcttgtagaggcggtcgtggaggacccagaggaggagacgaaggggaaggaggcggtggtggaggaggcaaaggccttggacgaccattgttggcgaggggcaccactccgggagaggcggcgctgggcgtcttgggggtgcgcgccgggagcctgcagcgggaccagcgtgggaacgcggctggcaggctgtggacctcgtcctcaccaccatggtcgggctccttttgttttttttcccagcgatctttttggaggtgtcccttctccccagaagccccggcaggaaagtgttgctggcaggagcgtcgtctcagcgctcggtggccagaatggacggagatgtcatcattggagccctcttctcagtccatcaccagcctccggccgagaaagtgcccgagaggaagtgtggggagatcagggagcagtatggcatccagagggtggaggccatgttccacacgttggataagatcaacgcggacccggtcctcctgcccaacatcaccctgggcagtgagatccgggactcctgctggcactcttccgtggctctggaacagagcattgagttcattagggactctctgatttccattcgagatgagaaggatgggatcaaccggtgtctgcctgacggccagtccctccccccaggcaggactaagaagcccattgcgggagtgatcggtcccggctccagctctgtagccattcaagtgcagaacctgctccagctcttcgacatcccccagatcgcttattcagccacaagcatcgacctgagtgacaaaactttgtacaaatacttcctgagggttgtcccttctgacactttgcaggcaagggccatgcttgacatagtcaaacgttacaattggacctatgtctctgcagtccacacggaagggaattatggggagagcggaatggacgctttcaaagagctggctgcccaggaaggcctctgtatcgcccattctgacaaaatctacagcaacgctggggagaagagctttgaccgactcttgcgcaaactccgagagaggcttcccaaggctagagtggtggtctgcttctgtgaaggcatgacagtgcgaggactcctgagcgccatgcggcgccttggcgtcgtgggcgagttctcactcattggaagtgatggatgggcagacagagatgaagtcattgaaggttatgaggtggaagccaacgggggaatcacgataaagctgcagtctccagaggtcaggtcatttgatgattatttcctgaaactgaggctggacactaacacgaggaatccctggttccctgagttctggcaacatcggttccagtgccgccttccaggacaccttctggaaaatcccaactttaaacgaatctgcacaggcaatgaaagcttagaagaaaactatgtccaggacagtaagatggggtttgtcatcaatgccatctatgccatggcacatgggctgcagaacatgcaccatgccctctgccctggccacgtgggcctctgcgatgccatgaagcccatcgacggcagcaagctgctggacttcctcatcaagtcctcattcattggagtatctggagaggaggtgtggtttgatgagaaaggagacgctcctggaaggtatgatatcatgaatctgcagtacactgaagctaatcgctatgactatgtgcacgttggaacctggcatgaaggagtgctgaacattgatgattacaaaatccagatgaacaagagtggagtggtgcggtctgtgtgcagtgagccttgcttaaagggccagattaaggttatacggaaaggagaagtgagctgctgctggatttgcacggcctgcaaagagaatgaatatgtgcaagatgagttcacctgcaaagcttgtgacttgggatggtggcccaatgcagatctaacaggctgtgagcccattcctgtgcgctatcttgagtggagcaacatcgaatccattatagccatcgccttttcatgcctgggaatccttgttaccttgtttgtcaccctaatctttgtactgtaccgggacacaccagtggtcaaatcctccagtcgggagctctgctacatcatcctagctggcatcttccttggttatgtgtgcccattcactctcattgccaaacctactaccacctcctgctacctccagcgcctcttggttggcctctcctctgcgatgtgctactctgctttagtgactaaaaccaatcgtattgcacgcatcctggctggcagcaagaagaagatctgcacccggaagcccaggttcatgagtgcctgggctcaggtgatcattgcctcaattctgattagtgtgcaactaaccctggtggtaaccctgatcatcatggaaccccctatgcccattctgtcctacccaagtatcaaggaagtctaccttatctgcaataccagcaacctgggtgtggtggcccctttgggctacaatggactcctcatcatgagctgtacctactatgccttcaagacccgcaacgtgcccgccaacttcaacgaggccaaatatatcgcgttcaccatgtacaccacctgtatcatctggctagcttttgtgcccatttactttgggagcaactacaagatcatcacaacttgctttgcagtgagtctcagtgtaacagtggctctggggtgcatgttcactcccaagatgtacatcattattgccaagcctgagaggaatgtccgcagtgccttcaccacctctgatgttgtccgcatgcatgttggcgatggcaagctgccctgccgctccaacactttcctcaacatcttccgaagaaagaaggcaggggcagggaatgccaattctaatggcaagtctgtgtcatggtctgaaccaggtggaggacaggtgcccaagggacagcatatgtggcaccgcctctctgtgcacgtgaagaccaatgagacggcctgcaaccaaacagccgtcatcaagcccctcactaaaagttaccaaggctctggcaagagcctgaccttttcagataccagcaccaagaccctttacaacgtagaggaggaggaggatgcccagccgattcgctttagcccgcctggtagcccttccatggtggtgcacaggcgcgtgccaagcgcggcgaccactccgcctctgccgtcccacctgaccgcagaggagacccccctcttcctggccgaaccagccctccccaagggcttgccccctcctctccagcagcagcagcaaccccctccacagcagaaatcgctgatggaccagctccagggagtggtcagcaacttcagtaccgcgatcccggattttcacgcggtgctggcaggccccggtggtcccgggaacgggctgcggtccctgtacccgcccccgccacctccgcagcacctgcagatgctgccgctgcagctgagcacctttggggaggagctggtctccccgcccgcggacgacgacgacgacagcgagaggtttaagctcctccaggagtacgtgtatgagcacgagcgggaagggaacacggaagaagacgaactggaagaggaggaggaggacctgcaggcggccagcaaactgaccccggatgattcgcctgcgctgacgcctccgtcgcctttccgcgactcggtggcctcgggcagctcggtgcccagctcccccgtgtccgagtcggtgctctgcacccctcccaacgtatcctacgcctctgtcattctgcgggactacaagcaaagctcttccaccctgtaagggggaagggtccacatagaaaagcaagacaagccagagatctcccacacctccagagatgtgcaaacagctgggaggaaaagcctgggagtggggggcctcgtcgggaggacaggagaccgctgctgctgctgccgctactgctgctgctgccttaagtaggaagagagggaaggacaccaagcaaaaaatgttccaggccaggattcggattcttgaattactcgaagccttctctgggaagaaagggaattctgacaaagcacaattccatatggtatgtaacttttatcacaaatcaaatagtgacatcacaaacataatgtcctcttttgcacaattgtgcatagatatatatatgcccacacacactgggccatgcttgccaaggaacagcccacgtggacatgccagtcggatcatgagttcacctgatggcattcggagtgagctggtggagccagacagagcaggtgcggggaagggaagggcccaggccagacccatcccaaacggatgatgggatgatgggacagcagctccttgctcagaagcccttctccccgctgggctgacagactcctcatcttcaggagactcaggaatggagcggcacaggggtctctcttcatccactgcaacccatccagtgccagctttgagattgcacttgaagaaaggtgcatggaccccctgctgctctgcagattccctttatttaggaaaacaggaataagagcaaaattatcaccaaaaagtgcttcatcaggcgtgctacaggaggaaggagctagaaatagaacaatccatcagcatgagactttgaaaaaaaaacacatgatcagcttctcatgttccatattcacttattggcgatttggggaaaaggccggaacaagagattgttacgagagtggcagaaacccttttgtagattgacttgtgtttgtgccaagcgggctttccattgaccttcagttaaagaacaaaccatgtgacaaaattgttaccttccacttactgtagcaaataatacctacaagttgaacttctaagatgcgtatatgtacaatttggtgccattatttctcctacgtattagagaaacaaatccatctttgaatctaatggtgtactcatagcaactattactggtttaaatgacaaataattctatcctattgtcactgaagtccttgtaactagcgagtgaatgtgttcctgtgtccttgtatatgtgcgatcgtaaaatttgtgcaatgtaatgtcaaattgactggtcaatgtcaacctagtagtcaatctaactgcaattagaaattgtcttttgaatatactatatatattttttatgttccaataatgttttgtacatcattgtcatcaatatctacagaagctctttgacggtttgaatactatggctcaaggttttcatatgcagctcggatggacatttttcttctaagatggaacttatttttcagatattttctgatgtggagatatgttattaatgaagtggtttgaaaatttgttatattaaaagtgcacaaaaactgagagtgaaaataaaaggtacattttataagcttgcacacattattaacacataagattgaacaaagcatttagattattccaggttatatcatttttttaaagattttccacagctacttgagtgtctaacatacagtaacatctaactcagctaataatttgtaaaatctttatcaatcacattttgccttcttttaatttttatgttcatggacttttattcctgtgtcttggctgtcataactttttatttctgctatttgctgttgtgtaatatccatggacatgtaatccacttactccatctttacaatccctttttaccaccaataaaaggatttttcttgctgttttgatttcttctattatttgtggaatgaattataccccccttaaatatctttgtttatgccttatgttcagtcatattttaatatgcttccttcatattgaagctgctgatttctcagccaaaaatcatcttagaatctttaaatatccattgcatcatttgttcagaatttaacatccattccaatgttggaggcttgtattacttatatttcatcatattctattgccaagtttagtcagttccacaccaagaatgaactgcatttcctttaaaaattattttaaaacacctttattgaaaagatctcatgactgagatgtggactttggttccatgttttcattgtaagaaagcagagagcggaaaatcaatggctccagtgattaatagatgggtttttagtaattgacaaattcatgagggaaagcatatgatctctttattagtgaatcatgcttattttttactcttaatgccactaatatacatccctaatatcacagggcttgtgcattcagatttttaaaaaattaggatagataaggaaacaacttatattcaagtgtaagatgatatcaggttggtctaagacttttggtgaacacgttcattcaactgtgatcactttattactctgaatgcctactattatcctgattatggggtctcctgaataaatagagtattagtccttatgtcatcattgttcaaaattggagatgtacacatacataccctataccaagagggccgaaactcttcaccttgatgtatgttctgatacaagttgttcagcttcttgtaaatgtgttttccttcggcttgttactgccttttgtcaaataatcttgacaatgctgtataataaatattttctattt

SEQ ID NO: 12337 - DNA, 6939 bp, Homo sapiens
agtgctgaagaaagagggcactagtgtacagcccagatcgcatccttgcaccgtctggattagagctgaggcgtctgcaagccgagcgtggccacggtcctctggccccgggaccatagcgctgtctaccccgactcaggtactcagcagcatctagctcaccgctgccaacacgacttccactgtactcttgatcaatttaccttgatgcactaccggtgaagaacggggactcgaattcccttacaaacgcctccagcttgtagaggcggtcgtggaggacccagaggaggagacgaaggggaaggaggcggtggtggaggaggcaaaggccttggacgaccattgttggcgaggggcaccactccgggagaggcggcgctgggcgtcttgggggtgcgcgccgggagcctgcagcgggaccagcgtgggaacgcggctggcaggctgtggacctcgtcctcaccaccatggtcgggctccttttgttttttttcccagcgatctttttggaggtgtcccttctccccagaagccccggcaggaaagtgttgctggcaggagcgtcgtctcagcgctcggtggccagaatggacggagatgtcatcattggagccctcttctcagtccatcaccagcctccggccgagaaagtgcccgagaggaagtgtggggagatcagggagcagtatggcatccagagggtggaggccatgttccacacgttggataagatcaacgcggacccggtcctcctgcccaacatcaccctgggcagtgagatccgggactcctgctggcactcttccgtggctctggaacagagcattgagttcattagggactctctgatttccattcgagatgagaaggatgggatcaaccggtgtctgcctgacggccagtccctccccccaggcaggactaagaagcccattgcgggagtgatcggtcccggctccagctctgtagccattcaagtgcagaacctgctccagctcttcgacatcccccagatcgcttattcagccacaagcatcgacctgagtgacaaaactttgtacaaatacttcctgagggttgtcccttctgacactttgcaggcaagggccatgcttgacatagtcaaacgttacaattggacctatgtctctgcagtccacacggaagggaattatggggagagcggaatggacgctttcaaagagctggctgcccaggaaggcctctgtatcgcccattctgacaaaatctacagcaacgctggggagaagagctttgaccgactcttgcgcaaactccgagagaggcttcccaaggctagagtggtggtctgcttctgtgaaggcatgacagtgcgaggactcctgagcgccatgcggcgccttggcgtcgtgggcgagttctcactcattggaagtgatggatgggcagacagagatgaagtcattgaaggttatgaggtggaagccaacgggggaatcacgataaagctgcagtctccagaggtcaggtcatttgatgattatttcctgaaactgaggctggacactaacacgaggaatccctggttccctgagttctggcaacatcggttccagtgccgccttccaggacaccttctggaaaatcccaactttaaacgaatctgcacaggcaatgaaagcttagaagaaaactatgtccaggacagtaagatggggtttgtcatcaatgccatctatgccatggcacatgggctgcagaacatgcaccatgccctctgccctggccacgtgggcctctgcgatgccatgaagcccatcgacggcagcaagctgctggacttcctcatcaagtcctcattcattggagtatctggagaggaggtgtggtttgatgagaaaggagacgctcctggaaggtatgatatcatgaatctgcagtacactgaagctaatcgctatgactatgtgcacgttggaacctggcatgaaggagtgctgaacattgatgattacaaaatccagatgaacaagagtggagtggtgcggtctgtgtgcagtgagccttgcttaaagggccagattaaggttatacggaaaggagaagtgagctgctgctggatttgcacggcctgcaaagagaatgaatatgtgcaagatgagttcacctgcaaagcttgtgacttgggatggtggcccaatgcagatctaacaggctgtgagcccattcctgtgcgctatcttgagtggagcaacatcgaatccattatagccatcgccttttcatgcctgggaatccttgttaccttgtttgtcaccctaatctttgtactgtaccgggacacaccagtggtcaaatcctccagtcgggagctctgctacatcatcctagctggcatcttccttggttatgtgtgcccattcactctcattgccaaacctactaccacctcctgctacctccagcgcctcttggttggcctctcctctgcgatgtgctactctgctttagtgactaaaaccaatcgtattgcacgcatcctggctggcagcaagaagaagatctgcacccggaagcccaggttcatgagtgcctgggctcaggtgatcattgcctcaattctgattagtgtgcaactaaccctggtggtaaccctgatcatcatggaaccccctatgcccattctgtcctacccaagtatcaaggaagtctaccttatctgcaataccagcaacctgggtgtggtggcccctttgggctacaatggactcctcatcatgagctgtacctactatgccttcaagacccgcaacgtgcccgccaacttcaacgaggccaaatatatcgcgttcaccatgtacaccacctgtatcatctggctagcttttgtgcccatttactttgggagcaactacaagatcatcacaacttgctttgcagtgagtctcagtgtaacagtggctctggggtgcatgttcactcccaagatgtacatcattattgccaagcctgagaggaatgtccgcagtgccttcaccacctctgatgttgtccgcatgcatgttggcgatggcaagctgccctgccgctccaacactttcctcaacatcttccgaagaaagaaggcaggggcagggaatgccaagaagaggcagccagaattctcgcccaccagccaatgtccgtcggcacatgtgcagctttgaaaacccccacactgcagtgaatgtttctaatggcaagtctgtgtcatggtctgaaccaggtggaggacaggtgcccaagggacagcatatgtggcaccgcctctctgtgcacgtgaagaccaatgagacggcctgcaaccaaacagccgtcatcaagcccctcactaaaagttaccaaggctctggcaagagcctgaccttttcagataccagcaccaagaccctttacaacgtagaggaggaggaggatgcccagccgattcgctttagcccgcctggtagcccttccatggtggtgcacaggcgcgtgccaagcgcggcgaccactccgcctctgccgtcccacctgaccgcagaggagacccccctcttcctggccgaaccagccctccccaagggcttgccccctcctctccagcagcagcagcaaccccctccacagcagaaatcgctgatggaccagctccagggagtggtcagcaacttcagtaccgcgatcccggattttcacgcggtgctggcaggccccggtggtcccgggaacgggctgcggtccctgtacccgcccccgccacctccgcagcacctgcagatgctgccgctgcagctgagcacctttggggaggagctggtctccccgcccgcggacgacgacgacgacagcgagaggtttaagctcctccaggagtacgtgtatgagcacgagcgggaagggaacacggaagaagacgaactggaagaggaggaggaggacctgcaggcggccagcaaactgaccccggatgattcgcctgcgctgacgcctccgtcgcctttccgcgactcggtggcctcgggcagctcggtgcccagctcccccgtgtccgagtcggtgctctgcacccctcccaacgtatcctacgcctctgtcattctgcgggactacaagcaaagctcttccaccctgtaagggggaagggtccacatagaaaagcaagacaagccagagatctcccacacctccagagatgtgcaaacagctgggaggaaaagcctgggagtggggggcctcgtcgggaggacaggagaccgctgctgctgctgccgctactgctgctgctgccttaagtaggaagagagggaaggacaccaagcaaaaaatgttccaggccaggattcggattcttgaattactcgaagccttctctgggaagaaagggaattctgacaaagcacaattccatatggtatgtaacttttatcacaaatcaaatagtgacatcacaaacataatgtcctcttttgcacaattgtgcatagatatatatatgcccacacacactgggccatgcttgccaaggaacagcccacgtggacatgccagtcggatcatgagttcacctgatggcattcggagtgagctggtggagccagacagagcaggtgcggggaagggaagggcccaggccagacccatcccaaacggatgatgggatgatgggacagcagctccttgctcagaagcccttctccccgctgggctgacagactcctcatcttcaggagactcaggaatggagcggcacaggggtctctcttcatccactgcaacccatccagtgccagctttgagattgcacttgaagaaaggtgcatggaccccctgctgctctgcagattccctttatttaggaaaacaggaataagagcaaaattatcaccaaaaagtgcttcatcaggcgtgctacaggaggaaggagctagaaatagaacaatccatcagcatgagactttgaaaaaaaaacacatgatcagcttctcatgttccatattcacttattggcgatttggggaaaaggccggaacaagagattgttacgagagtggcagaaacccttttgtagattgacttgtgtttgtgccaagcgggctttccattgaccttcagttaaagaacaaaccatgtgacaaaattgttaccttccacttactgtagcaaataatacctacaagttgaacttctaagatgcgtatatgtacaatttggtgccattatttctcctacgtattagagaaacaaatccatctttgaatctaatggtgtactcatagcaactattactggtttaaatgacaaataattctatcctattgtcactgaagtccttgtaactagcgagtgaatgtgttcctgtgtccttgtatatgtgcgatcgtaaaatttgtgcaatgtaatgtcaaattgactggtcaatgtcaacctagtagtcaatctaactgcaattagaaattgtcttttgaatatactatatatattttttatgttccaataatgttttgtacatcattgtcatcaatatctacagaagctctttgacggtttgaatactatggctcaaggttttcatatgcagctcggatggacatttttcttctaagatggaacttatttttcagatattttctgatgtggagatatgttattaatgaagtggtttgaaaatttgttatattaaaagtgcacaaaaactgagagtgaaaataaaaggtacattttataagcttgcacacattattaacacataagattgaacaaagcatttagattattccaggttatatcatttttttaaagattttccacagctacttgagtgtctaacatacagtaacatctaactcagctaataatttgtaaaatctttatcaatcacattttgccttcttttaatttttatgttcatggacttttattcctgtgtcttggctgtcataactttttatttctgctatttgctgttgtgtaatatccatggacatgtaatccacttactccatctttacaatccctttttaccaccaataaaaggatttttcttgctgttttgatttcttctattatttgtggaatgaattataccccccttaaatatctttgtttatgccttatgttcagtcatattttaatatgcttccttcatattgaagctgctgatttctcagccaaaaatcatcttagaatctttaaatatccattgcatcatttgttcagaatttaacatccattccaatgttggaggcttgtattacttatatttcatcatattctattgccaagtttagtcagttccacaccaagaatgaactgcatttcctttaaaaattattttaaaacacctttattgaaaagatctcatgactgagatgtggactttggttccatgttttcattgtaagaaagcagagagcggaaaatcaatggctccagtgattaatagatgggtttttagtaattgacaaattcatgagggaaagcatatgatctctttattagtgaatcatgcttattttttactcttaatgccactaatatacatccctaatatcacagggcttgtgcattcagatttttaaaaaattaggatagataaggaaacaacttatattcaagtgtaagatgatatcaggttggtctaagacttttggtgaacacgttcattcaactgtgatcactttattactctgaatgcctactattatcctgattatggggtctcctgaataaatagagtattagtccttatgtcatcattgttcaaaattggagatgtacacatacataccctataccaagagggccgaaactcttcaccttgatgtatgttctgatacaagttgttcagcttcttgtaaatgtgttttccttcggcttgttactgccttttgtcaaataatcttgacaatgctgtataataaatattttctattt

SEQ ID NO: 12338 - DNA, 6836 bp, Homo sapiens
caggtactcaggtatgtctcaagtccatgtcctccaaacagactcagcatctagctcaccgctgccaacacgacttccactgtactcttgatcaatttaccttgatgcactaccggtgaagaacggggactcgaattcccttacaaacgcctccagcttgtagaggcggtcgtggaggacccagaggaggagacgaaggggaaggaggcggtggtggaggaggcaaaggccttggacgaccattgttggcgaggggcaccactccgggagaggcggcgctgggcgtcttgggggtgcgcgccgggagcctgcagcgggaccagcgtgggaacgcggctggcaggctgtggacctcgtcctcaccaccatggtcgggctccttttgttttttttcccagcgatctttttggaggtgtcccttctccccagaagccccggcaggaaagtgttgctggcaggagcgtcgtctcagcgctcggtggccagaatggacggagatgtcatcattggagccctcttctcagtccatcaccagcctccggccgagaaagtgcccgagaggaagtgtggggagatcagggagcagtatggcatccagagggtggaggccatgttccacacgttggataagatcaacgcggacccggtcctcctgcccaacatcaccctgggcagtgagatccgggactcctgctggcactcttccgtggctctggaacagagcattgagttcattagggactctctgatttccattcgagatgagaaggatgggatcaaccggtgtctgcctgacggccagtccctccccccaggcaggactaagaagcccattgcgggagtgatcggtcccggctccagctctgtagccattcaagtgcagaacctgctccagctcttcgacatcccccagatcgcttattcagccacaagcatcgacctgagtgacaaaactttgtacaaatacttcctgagggttgtcccttctgacactttgcaggcaagggccatgcttgacatagtcaaacgttacaattggacctatgtctctgcagtccacacggaagggaattatggggagagcggaatggacgctttcaaagagctggctgcccaggaaggcctctgtatcgcccattctgacaaaatctacagcaacgctggggagaagagctttgaccgactcttgcgcaaactccgagagaggcttcccaaggctagagtggtggtctgcttctgtgaaggcatgacagtgcgaggactcctgagcgccatgcggcgccttggcgtcgtgggcgagttctcactcattggaagtgatggatgggcagacagagatgaagtcattgaaggttatgaggtggaagccaacgggggaatcacgataaagctgcagtctccagaggtcaggtcatttgatgattatttcctgaaactgaggctggacactaacacgaggaatccctggttccctgagttctggcaacatcggttccagtgccgccttccaggacaccttctggaaaatcccaactttaaacgaatctgcacaggcaatgaaagcttagaagaaaactatgtccaggacagtaagatggggtttgtcatcaatgccatctatgccatggcacatgggctgcagaacatgcaccatgccctctgccctggccacgtgggcctctgcgatgccatgaagcccatcgacggcagcaagctgctggacttcctcatcaagtcctcattcattggagtatctggagaggaggtgtggtttgatgagaaaggagacgctcctggaaggtatgatatcatgaatctgcagtacactgaagctaatcgctatgactatgtgcacgttggaacctggcatgaaggagtgctgaacattgatgattacaaaatccagatgaacaagagtggagtggtgcggtctgtgtgcagtgagccttgcttaaagggccagattaaggttatacggaaaggagaagtgagctgctgctggatttgcacggcctgcaaagagaatgaatatgtgcaagatgagttcacctgcaaagcttgtgacttgggatggtggcccaatgcagatctaacaggctgtgagcccattcctgtgcgctatcttgagtggagcaacatcgaatccattatagccatcgccttttcatgcctgggaatccttgttaccttgtttgtcaccctaatctttgtactgtaccgggacacaccagtggtcaaatcctccagtcgggagctctgctacatcatcctagctggcatcttccttggttatgtgtgcccattcactctcattgccaaacctactaccacctcctgctacctccagcgcctcttggttggcctctcctctgcgatgtgctactctgctttagtgactaaaaccaatcgtattgcacgcatcctggctggcagcaagaagaagatctgcacccggaagcccaggttcatgagtgcctgggctcaggtgatcattgcctcaattctgattagtgtgcaactaaccctggtggtaaccctgatcatcatggaaccccctatgcccattctgtcctacccaagtatcaaggaagtctaccttatctgcaataccagcaacctgggtgtggtggcccctttgggctacaatggactcctcatcatgagctgtacctactatgccttcaagacccgcaacgtgcccgccaacttcaacgaggccaaatatatcgcgttcaccatgtacaccacctgtatcatctggctagcttttgtgcccatttactttgggagcaactacaagatcatcacaacttgctttgcagtgagtctcagtgtaacagtggctctggggtgcatgttcactcccaagatgtacatcattattgccaagcctgagaggaatgtccgcagtgccttcaccacctctgatgttgtccgcatgcatgttggcgatggcaagctgccctgccgctccaacactttcctcaacatcttccgaagaaagaaggcaggggcagggaatgccaagaagaggcagccagaattctcgcccaccagccaatgtccgtcggcacatgtgcagctttgaaaacccccacactgcagtgaatgtttctaatggcaagtctgtgtcatggtctgaaccaggtggaggacaggtgcccaagggacagcatatgtggcaccgcctctctgtgcacgtgaagaccaatgagacggcctgcaaccaaacagccgtcatcaagcccctcactaaaagttaccaaggctctggcaagagcctgaccttttcagataccagcaccaagaccctttacaacgtagaggaggaggaggatgcccagccgattcgctttagcccgcctggtagcccttccatggtggtgcacaggcgcgtgccaagcgcggcgaccactccgcctctgccgtcccacctgaccgcagaggagacccccctcttcctggccgaaccagccctccccaagggcttgccccctcctctccagcagcagcagcaaccccctccacagcagaaatcgctgatggaccagctccagggagtggtcagcaacttcagtaccgcgatcccggattttcacgcggtgctggcaggccccggtggtcccgggaacgggctgcggtccctgtacccgcccccgccacctccgcagcacctgcagatgctgccgctgcagctgagcacctttggggaggagctggtctccccgcccgcggacgacgacgacgacagcgagaggtttaagctcctccaggagtacgtgtatgagcacgagcgggaagggaacacggaagaagacgaactggaagaggaggaggaggacctgcaggcggccagcaaactgaccccggatgattcgcctgcgctgacgcctccgtcgcctttccgcgactcggtggcctcgggcagctcggtgcccagctcccccgtgtccgagtcggtgctctgcacccctcccaacgtatcctacgcctctgtcattctgcgggactacaagcaaagctcttccaccctgtaagggggaagggtccacatagaaaagcaagacaagccagagatctcccacacctccagagatgtgcaaacagctgggaggaaaagcctgggagtggggggcctcgtcgggaggacaggagaccgctgctgctgctgccgctactgctgctgctgccttaagtaggaagagagggaaggacaccaagcaaaaaatgttccaggccaggattcggattcttgaattactcgaagccttctctgggaagaaagggaattctgacaaagcacaattccatatggtatgtaacttttatcacaaatcaaatagtgacatcacaaacataatgtcctcttttgcacaattgtgcatagatatatatatgcccacacacactgggccatgcttgccaaggaacagcccacgtggacatgccagtcggatcatgagttcacctgatggcattcggagtgagctggtggagccagacagagcaggtgcggggaagggaagggcccaggccagacccatcccaaacggatgatgggatgatgggacagcagctccttgctcagaagcccttctccccgctgggctgacagactcctcatcttcaggagactcaggaatggagcggcacaggggtctctcttcatccactgcaacccatccagtgccagctttgagattgcacttgaagaaaggtgcatggaccccctgctgctctgcagattccctttatttaggaaaacaggaataagagcaaaattatcaccaaaaagtgcttcatcaggcgtgctacaggaggaaggagctagaaatagaacaatccatcagcatgagactttgaaaaaaaaacacatgatcagcttctcatgttccatattcacttattggcgatttggggaaaaggccggaacaagagattgttacgagagtggcagaaacccttttgtagattgacttgtgtttgtgccaagcgggctttccattgaccttcagttaaagaacaaaccatgtgacaaaattgttaccttccacttactgtagcaaataatacctacaagttgaacttctaagatgcgtatatgtacaatttggtgccattatttctcctacgtattagagaaacaaatccatctttgaatctaatggtgtactcatagcaactattactggtttaaatgacaaataattctatcctattgtcactgaagtccttgtaactagcgagtgaatgtgttcctgtgtccttgtatatgtgcgatcgtaaaatttgtgcaatgtaatgtcaaattgactggtcaatgtcaacctagtagtcaatctaactgcaattagaaattgtcttttgaatatactatatatattttttatgttccaataatgttttgtacatcattgtcatcaatatctacagaagctctttgacggtttgaatactatggctcaaggttttcatatgcagctcggatggacatttttcttctaagatggaacttatttttcagatattttctgatgtggagatatgttattaatgaagtggtttgaaaatttgttatattaaaagtgcacaaaaactgagagtgaaaataaaaggtacattttataagcttgcacacattattaacacataagattgaacaaagcatttagattattccaggttatatcatttttttaaagattttccacagctacttgagtgtctaacatacagtaacatctaactcagctaataatttgtaaaatctttatcaatcacattttgccttcttttaatttttatgttcatggacttttattcctgtgtcttggctgtcataactttttatttctgctatttgctgttgtgtaatatccatggacatgtaatccacttactccatctttacaatccctttttaccaccaataaaaggatttttcttgctgttttgatttcttctattatttgtggaatgaattataccccccttaaatatctttgtttatgccttatgttcagtcatattttaatatgcttccttcatattgaagctgctgatttctcagccaaaaatcatcttagaatctttaaatatccattgcatcatttgttcagaatttaacatccattccaatgttggaggcttgtattacttatatttcatcatattctattgccaagtttagtcagttccacaccaagaatgaactgcatttcctttaaaaattattttaaaacacctttattgaaaagatctcatgactgagatgtggactttggttccatgttttcattgtaagaaagcagagagcggaaaatcaatggctccagtgattaatagatgggtttttagtaattgacaaattcatgagggaaagcatatgatctctttattagtgaatcatgcttattttttactcttaatgccactaatatacatccctaatatcacagggcttgtgcattcagatttttaaaaaattaggatagataaggaaacaacttatattcaagtgtaagatgatatcaggttggtctaagacttttggtgaacacgttcattcaactgtgatcactttattactctgaatgcctactattatcctgattatggggtctcctgaataaatagagtattagtccttatgtcatcattgttcaaaattggagatgtacacatacataccctataccaagagggccgaaactcttcaccttgatgtatgttctgatacaagttgttcagcttcttgtaaatgtgttttccttcggcttgttactgccttttgtcaaataatcttgacaatgctgtataataaatattttctattt

SEQ ID NO: 12339 - DNA, 3756 bp, Homo sapiens
gctggcaggctgtggacctcgtcctcaccaccatggtcgggctccttttgttttttttcccagcgatctttttggaggtgtcccttctccccagaagccccggcaggaaagtgttgctggcaggagcgtcgtctcagcgctcggtggccagaatggacggagatgtcatcattggagccctcttctcagtccatcaccagcctccggccgagaaagtgcccgagaggaagtgtggggagatcagggagcagtatggcatccagagggtggaggccatgttccacacgttggataagatcaacgcggacccggtcctcctgcccaacatcaccctgggcagtgagatccgggactcctgctggcactcttccgtggctctggaacagagcattgagttcattagggactctctgatttccattcgagatgagaaggatgggatcaaccggtgtctgcctgacggccagtccctccccccaggcaggactaagaagcccattgcgggagtgatcggtcccggctccagctctgtagccattcaagtgcagaacctgctccagctcttcgacatcccccagatcgcttattcagccacaagcatcgacctgagtgacaaaactttgtacaaatacttcctgagggttgtcccttctgacactttgcaggcaagggccatgcttgacatagtcaaacgttacaattggacctatgtctctgcagtccacacggaagggaattatggggagagcggaatggacgctttcaaagagctggctgcccaggaaggcctctgtatcgcccattctgacaaaatctacagcaacgctggggagaagagctttgaccgactcttgcgcaaactccgagagaggcttcccaaggctagagtggtggtctgcttctgtgaaggcatgacagtgcgaggactcctgagcgccatgcggcgccttggcgtcgtgggcgagttctcactcattggaagtgatggatgggcagacagagatgaagtcattgaaggttatgaggtggaagccaacgggggaatcacgataaagctgcagtctccagaggtcaggtcatttgatgattatttcctgaaactgaggctggacactaacacgaggaatccctggttccctgagttctggcaacatcggttccagtgccgccttccaggacaccttctggaaaatcccaactttaaacgaatctgcacaggcaatgaaagcttagaagaaaactatgtccaggacagtaagatggggtttgtcatcaatgccatctatgccatggcacatgggctgcagaacatgcaccatgccctctgccctggccacgtgggcctctgcgatgccatgaagcccatcgacggcagcaagctgctggacttcctcatcaagtcctcattcattggagtatctggagaggaggtgtggtttgatgagaaaggagacgctcctggaaggtatgatatcatgaatctgcagtacactgaagctaatcgctatgactatgtgcacgttggaacctggcatgaaggagtgctgaacattgatgattacaaaatccagatgaacaagagtggagtggtgcggtctgtgtgcagtgagccttgcttaaagggccagattaaggttatacggaaaggagaagtgagctgctgctggatttgcacggcctgcaaagagaatgaatatgtgcaagatgagttcacctgcaaagcttgtgacttgggatggtggcccaatgcagatctaacaggctgtgagcccattcctgtgcgctatcttgagtggagcaacatcgaatccattatagccatcgccttttcatgcctgggaatccttgttaccttgtttgtcaccctaatctttgtactgtaccgggacacaccagtggtcaaatcctccagtcgggagctctgctacatcatcctagctggcatcttccttggttatgtgtgcccattcactctcattgccaaacctactaccacctcctgctacctccagcgcctcttggttggcctctcctctgcgatgtgctactctgctttagtgactaaaaccaatcgtattgcacgcatcctggctggcagcaagaagaagatctgcacccggaagcccaggttcatgagtgcctgggctcaggtgatcattgcctcaattctgattagtgtgcaactaaccctggtggtaaccctgatcatcatggaaccccctatgcccattctgtcctacccaagtatcaaggaagtctaccttatctgcaataccagcaacctgggtgtggtggcccctttgggctacaatggactcctcatcatgagctgtacctactatgccttcaagacccgcaacgtgcccgccaacttcaacgaggccaaatatatcgcgttcaccatgtacaccacctgtatcatctggctagcttttgtgcccatttactttgggagcaactacaagatcatcacaacttgctttgcagtgagtctcagtgtaacagtggctctggggtgcatgttcactcccaagatgtacatcattattgccaagcctgagaggaatgtccgcagtgccttcaccacctctgatgttgtccgcatgcatgttggcgatggcaagctgccctgccgctccaacactttcctcaacatcttccgaagaaagaaggcaggggcagggaatgccaagaagaggcagccagaattctcgcccaccagccaatgtccgtcggcacatgtgcagctttgaaaacccccacactgcagtgaatgtgtggaggacaggtgcccaagggacagcatatgtggcaccgcctctctgtgcacgtgaagaccaatgagacggcctgcaaccaaacagccgtcatcaagcccctcactaaaagttaccaaggctctggcaagagcctgaccttttcagataccagcaccaagaccctttacaacgtagaggaggaggaggatgcccagccgattcgctttagcccgcctggtagcccttccatggtggtgcacaggcgcgtgccaagcgcggcgaccactccgcctctgccgtcccacctgaccgcagaggagacccccctcttcctggccgaaccagccctccccaagggcttgccccctcctctccagcagcagcagcaaccccctccacagcagaaatcgctgatggaccagctccagggagtggtcagcaacttcagtaccgcgatcccggattttcacgcggtgctggcaggccccggtggtcccgggaacgggctgcggtccctgtacccgcccccgccacctccgcagcacctgcagatgctgccgctgcagctgagcacctttggggaggagctggtctccccgcccgcggacgacgacgacgacagcgagaggtttaagctcctccaggagtacgtgtatgagcacgagcgggaagggaacacggaagaagacgaactggaagaggaggaggaggacctgcaggcggccagcaaactgaccccggatgattcgcctgcgctgacgcctccgtcgcctttccgcgactcggtggcctcgggcagctcggtgcccagctcccccgtgtccgagtcggtgctctgcacccctcccaacgtatcctacgcctctgtcattctgcgggactacaagcaaagctcttccaccctgtaagggggaagggtccacatagaaaagcaagacaagccagagatctcccacacctccagagatgtgcaaacagctgggaggaaaagcctggg

SEQ ID NO: 12340 - DNA, 3151 bp, Homo sapiens
gcgcagagccagcgagccagcgagcgagcgagcgggagccggagcctcgcgccccccgctccactccgattctctccgcgccagagccagcgcgccaggagctgggtcccttcgcatctctcttcttgtctgtcctttcctggtccctgtttcctcctctctttgccttcgctgcttctaatctcatcccctggagacccaggtctgcgggacccatccatcccctttggggccatgggatcgctgcttgcgctcctggcactgctgctgctgtggggtgctgtggctgagggcccagccaagaaggtgctgaccctggagggagacttggtgctgggtgggctgttcccagtgcaccagaagggcggcccagcagaggactgtggtcctgtcaatgagcaccgtggcatccagcgcctggaggccatgctttttgcactggaccgcatcaaccgtgacccgcacctgctgcctggcgtgcgcctgggtgcacacatcctcgacagttgctccaaggacacacatgcgctggagcaggcactggactttgtgcgtgcctcactcagccgtggtgctgatggctcacgccacatctgccccgacggctcttatgcgacccatggtgatgctcccactgccatcactggtgttattggcggttcctacagtgatgtctccatccaggtggccaacctcttgaggctatttcagatcccacagattagctacgcctctaccagtgccaagctgagtgacaagtcccgctatgactactttgcccgcacagtgcctcctgacttcttccaagccaaggccatggctgagattctccgcttcttcaactggacctatgtgtccactgtggcgtctgagggcgactatggcgagacaggcattgaggcctttgagctagaggctcgtgcccgcaacatctgtgtggccacctcggagaaagtgggccgtgccatgagccgcgcggcctttgagggtgtggtgcgagccctgctgcagaagcccagtgcccgcgtggctgtcctgttcacccgttctgaggatgcccgggagctgcttgctgccagccagcgcctcaatgccagcttcacctgggtggccagtgatggttggggggccctggagagtgtggtggcaggcagtgagggggctgctgagggtgctatcaccatcgagctggcctcctaccccatcagtgactttgcctcctacttccagagcctggacccttggaacaacagccggaacccctggttccgtgaattctgggagcagaggttccgctgcagcttccggcagcgagactgcgcagcccactctctccgggctgtgccctttgagcaggagtccaagatcatgtttgtggtcaatgcagtgtacgccatggcccatgcgctccacaacatgcaccgtgccctctgccccaacaccacccggctctgtgacgcgatgcggccagttaacgggcgccgcctctacaaggactttgtgctcaacgtcaagtttgatgccccctttcgcccagctgacacccacaatgaggtccgctttgaccgctttggtgatggtattggccgctacaacatcttcacctatctgcgtgcaggcagtgggcgctatcgctaccagaaggtgggctactgggcagaaggcttgactctggacaccagcctcatcccatgggcctcaccctcagccggccccctgcccgcctctcgctgcagtgagccctgcctccagaatgaggtgaagagtgtgcagccgggcgaagtctgctgctggctctgcattccgtgccagccctatgagtaccgattggacgaattcacttgcgctgattgtggcctgggctactggcccaatgccagcctgactggctgcttcgaactgccccaggagtacatccgctggggcgatgcctgggctgtgggacctgtcaccatcgcctgcctcggtgccctggccaccctctttgtgctgggtgtctttgtgcggcacaatgccacaccagtggtcaaggcctcaggtcgggagctctgctacatcctgctgggtggtgtcttcctctgctactgcatgaccttcatcttcattgccaagccatccacggcagtgtgtaccttacggcgtcttggtttgggcactgccttctctgtctgctactcagccctgctcaccaagaccaaccgcattgcacgcatcttcggtggggcccgggagggtgcccagcggccacgcttcatcagtcctgcctcacaggtggccatctgcctggcacttatctcgggccagctgctcatcgtggtcgcctggctggtggtggaggcaccgggcacaggcaaggagacagcccccgaacggcgggaggtggtgacactgcgctgcaaccaccgcgatgcaagtatgttgggctcgctggcctacaatgtgctcctcatcgcgctctgcacgctttatgccttcaagactcgcaagtgccccgaaaacttcaacgaggccaagttcattggcttcaccatgtacaccacctgcatcatctggctggcattcctgcccatcttctatgtcacctccagtgactaccgggtacagaccaccaccatgtgcgtgtcagtcagcctcagcggctccgtggtgcttggctgcctctttgcgcccaagctgcacatcatcctcttccagccgcagaagaacgtggttagccaccgggcacccaccagccgctttggcagtgctgctgccagggccagctccagccttggccaagggtctggctcccagtttgtccccactgtttgcaatggccgtgaggtggtggactcgacaacgtcatcgctttgaagaccccatactcccgccctgacacagctgctcctgggaacctagtgcagacccacgtccagggccaggaggaagttggctggagcactgcaataatttattacccaccctatgtctgcccccaaagtcacttacccacctccttaccccagctcttcagactcagaagtcaggagccttggccaggagcctctgcagtggccactaactgcccttgtagctgtgtttcctcctggccaggcccagggctcagagaggagcaagccagggttcactctgccctggacccgggtggctg

SEQ ID NO: 12341 - DNA, 590 bp, Homo sapiens
ctttctgtctgtgcctccgtctttgtctcaacctctcaggcttgctcgctccctgcccagattttgtggcccaggctcctggctgtctgactccgggtttctgtccccttcctgcctctgagcttccgtctgggcctcccctctgggagacttgcgacttgaccagttttggcttcagcccccatctgggtccctgtctccatctgtgctggtcttcctccctgcttctccctcgcttgcctgggagctgggtcccttcgcatctctcttcttgtctgtcctttcctggtccctgtttcctcctctctttgccttcgctgcttctaatctcatcccctggagacccaggtctgcgggacccatccatcccctttggggccatgggatcgctgcttgcgctcctggcactgctgctgctgtggggtgctgtggctgagggcccagccaagaaggtgctgaccctggagggagacttggtgctgggtgggctgttcccagtgcaccagaagggcggcccagcagaggactgtggtcctgtcaatgagcaccgtggcatccagcgcctggaggccatgctttttgcactggac

SEQ ID NO: 12342 - DNA, 4268 bp, Homo sapiens
gtgcagttgagtcgcgagtacggctgagctgcgtaccggcctccctggctctcacactccctctctgctcccgctctcctaatctcctctggcatgcggtcagccccctgcccagggaccacaggagagttcttgtaaggactgttagtccctgcttacctgaaagccaagcgctctagcagagctttaaagttggagccgccaccctccctaccgccccatgccccttcaccccactccgaaattcaccgacctttgcatgcactgcctaaggatttcagagtgaggcaaagcagtcggcaaatctaccctggcttttcgtataaaaatcctctcgtctaggtaccctggctcactgaagactctgcagatatacccttataagagggagggtgggggagggaaaagaacgagagagggaggaaagaatgaaaaggagaggatgccaggaggtccgtgcttctgccaagagtcccaattagatgcgacggcttcagcctggtcaaggtgaaggaaagttgcttccgcgcctaggaagtgggtttgcctgataagagaaggaggaggggactcggctgggaagagctcccctcccctccgcggaagaccactgggtcccctctttccccaacctcctccctctcttctactccacccctccgttttcccactccccactgactcggatgcctggatgttctgccaccgggcagtggtccagcgtgcagccgggagggggcaggggcagggggcactgtgacaggaagctgcgcgcacaagttggccatttcgagggcaaaataagttctcccttggatttggaaaggacaaagccagtaagctacctcttttgtgtcggatgaggaggaccaaccatgagccagagcccgggtgcaggctcaccgccgccgctgccaccgcggtcagctccagttcctgccaggagttgtcggtgcgaggaattttgtgacaggctctgttagtctgttcctcccttatttgaaggacaggccaaagatccagtttggaaatgagagaggactagcatgacacattggctccaccattgatatctcccagaggtacagaaacaggattcatgaagatgttgacaagactgcaagttcttaccttagctttgttttcaaagggatttttactctctttaggggaccataactttctaaggagagagattaaaatagaaggtgaccttgttttagggggcctgtttcctattaacgaaaaaggcactggaactgaagaatgtgggcgaatcaatgaagaccgagggattcaacgcctggaagccatgttgtttgctattgatgaaatcaacaaagatgattacttgctaccaggagtgaagttgggtgttcacattttggatacatgttcaagggatacctatgcattggagcaatcactggagtttgtcagggcatctttgacaaaagtggatgaagctgagtatatgtgtcctgatggatcctatgccattcaagaaaacatcccacttctcattgcaggggtcattggtggctcttatagcagtgtttccatacaggtggcaaacctgctgcggctcttccagatccctcagatcagctacgcatccaccagcgccaaactcagtgataagtcgcgctatgattactttgccaggaccgtgccccccgacttctaccaggccaaagccatggctgagatcttgcgcttcttcaactggacctacgtgtccacagtagcctccgagggtgattacggggagacagggatcgaggccttcgagcaggaagcccgcctgcgcaacatctgcatcgctacggcggagaaggtgggccgctccaacatccgcaagtcctacgacagcgtgatccgagaactgttgcagaagcccaacgcgcgcgtcgtggtcctcttcatgcgcagcgacgactcgcgggagctcattgcagccgccagccgcgccaatgcctccttcacctgggtggccagcgacggctggggcgcgcaggagagcatcatcaagggcagcgagcatgtggcctacggcgccatcaccctggagctggcctcccagcctgtccgccagttcgaccgctacttccagagcctcaacccctacaacaaccaccgcaacccctggttccgggacttctgggagcaaaagtttcagtgcagcctccagaacaaacgcaaccacaggcgcgtctgcgacaagcacctggccatcgacagcagcaactacgagcaagagtccaagatcatgtttgtggtgaacgcggtgtatgccatggcccacgctttgcacaaaatgcagcgcaccctctgtcccaacactaccaagctttgtgatgctatgaagatcctggatgggaagaagttgtacaaggattacttgctgaaaatcaacttcacggctccattcaacccaaataaagatgcagatagcatagtcaagtttgacacttttggagatggaatggggcgatacaacgtgttcaatttccaaaatgtaggtggaaagtattcctacttgaaagttggtcactgggcagaaaccttatcgctagatgtcaactctatccactggtcccggaactcagtccccacttcccagtgcagcgacccctgtgcccccaatgaaatgaagaatatgcaaccaggggatgtctgctgctggatttgcatcccctgtgaaccctacgaatacctggctgatgagtttacctgtatggattgtgggtctggacagtggcccactgcagacctaactggatgctatgaccttcctgaggactacatcaggtgggaagacgcctgggccattggcccagtcaccattgcctgtctgggttttatgtgtacatgcatggttgtaactgtttttatcaagcacaacaacacacccttggtcaaagcatcgggccgagaactctgctacatcttattgtttggggttggcctgtcatactgcatgacattcttcttcattgccaagccatcaccagtcatctgtgcattgcgccgactcgggctggggagttccttcgctatctgttactcagccctgctgaccaagacaaactgcattgcccgcatcttcgatggggtcaagaatggcgctcagaggccaaaattcatcagccccagttctcaggttttcatctgcctgggtctgatcctggtgcaaattgtgatggtgtctgtgtggctcatcctggaggccccaggcaccaggaggtatacccttgcagagaagcgggaaacagtcatcctaaaatgcaatgtcaaagattccagcatgttgatctctcttacctacgatgtgatcctggtgatcttatgcactgtgtacgccttcaaaacgcggaagtgcccagaaaatttcaacgaagctaagttcataggttttaccatgtacaccacgtgcatcatctggttggccttcctccctatattttatgtgacatcaagtgactacagagtgcagacgacaaccatgtgcatctctgtcagcctgagtggctttgtggtcttgggctgtttgtttgcacccaaggttcacatcatcctgtttcaaccccagaagaatgttgtcacacacagactgcacctcaacaggttcagtgtcagtggaactgggaccacatactctcagtcctctgcaagcacgtatgtgccaacggtgtgcaatgggcgggaagtcctcgactccaccacctcatctctgtgattgtgaattgcagttcagttcttgtgtttttagactgttagacaaaagtgctcacgtgcagctccagaatatggaaacagagcaaaagaacaaccctagtacctttttttagaaacagtacgataaattatttttgaggactgtatatagtgatgtgctagaactttctaggctgagtctagtgcccctattattaacaattcccccagaacatggaaataaccattgtttacagagctgagcattggtgacagggtctgacatggtcagtctactaaaaaacaaaaaaaaaaaacaaaaaaaaaaaaacaaaagaaaaaaataaaaatacggtggcaatattatgtaaccttttttcctatgaagttttttgtaggtccttgttgtaactaatttaggatgagtttctatgttgtatattaaagttacattatgtgtaacagattgattttctcagcacaaaataaaaagcatctgtattaatgtaaagatactgagaataaaaccttcaaggttttccagcatggtg

SEQ ID NO: 12343 - DNA, 1811 bp, Homo sapiens
tccagttcctgccaggagttgtcggtgcgaggaattttgtgacaggctctgttagtctgttcctcccttatttgaaggacaggccaaagatccagtttggaaatgagagaggactagcatgacacattggctccaccattgatatctcccagaggtacagaaacaggattcatgaagatgttgacaagactgcaagttcttaccttagctttgttttcaaagggatttttactctctttaggggaccataactttctaaggagagagattaaaatagaaggtgaccttgttttagggggcctgtttcctattaacgaaaaaggcactggaactgaagaatgtgggcgaatcaatgaagaccgagggattcaacgcctggaagccatgttgtttgctattgatgaaatcaacaaagatgattacttgctaccaggagtgaagttgggtgttcacattttggatacatgttcaagggatacctatgcattggagcaatcactggagtttgtcagggcatctttgacaaaagtggatgaagctgagtatatgtgtcctgatggatcctatgccattcaagaaaacatcccacttctcattgcaggggtcattggtggctcttatagcagtgtttccatacaggtggcaaacctgctgcggctcttccagatccctcagatcagctacgcatccaccagcgccaaactcagtgataagtcgcgctatgattactttgccaggaccgtgccccccgacttctaccaggccaaagccatggctgagatcttgcgcttcttcaactggacctacgtgtccacagtagcctccgagggtgattacggggagacagggatcgaggccttcgagcaggaagcccgcctgcgcaacatctgcatcgctacggcggagaaggtgggccgctccaacatccgcaagtcctacgacagcgtgatccgagaactgttgcagaagcccaacgcgcgcgtcgtggtcctcttcatgcgcagcgacgactcgcgggagctcattgcagccgccagccgcgccaatgcctccttcacctgggtggccagcgacggctggggcgcgcaggagagcatcatcaagggcagcgagcatgtggcctacggcgccatcaccctggagctggcctcccagcctgtccgccagttcgaccgctacttccagagcctcaacccctacaacaaccaccgcaacccctggttccgggacttctgggagcaaaagtttcagtgcagcctccagaacaaacgcaaccacaggcgcgtctgcgacaagcacctggccatcgacagcagcaactacgagcaagagtccaagatcatgtttgtggtgaacgcggtgtatgccatggcccacgctttgcacaaaatgcagcgcaccctctgtcccaacactaccaagctttgtgatgctatgaagatcctggatgggaagaagttgtacaaggattacttgctgaaaatcaacttcacgggtgcagacgacaaccatgtgcatctctgtcagcctgagtggctttgtggtcttgggctgtttgtttgcacccaaggttcacatcatcctgtttcaaccccagaagaatgttgtcacacacagactgcacctcaacaggttcagtgtcagtggaactgggaccacatactctcagtcctctgcaagcacgtatgtgccaacggtgtgcaatgggcgggaagtcctcgactccaccacctcatctctgtgattgtgaattgcagttcagttcttgtgtttttagactgttagacaaaagtgctcacgtgcagctccag

SEQ ID NO: 12344 - DNA, 528 bp, Homo sapiens
agttcctgccaggagttgtcggtgcgaggtaagggtcccagaggaggacgtgtccctctggagggcgcccagccagggcgcggaagctcgggtgccgcgtggggcaggcgcagccgggaaagttgaggaattttgtgacaggctctgttagtctgttcctcccttatttgaaggacaggccaaagatccagtttggaaatgagagaggactagcatgacacattggctccaccattgatatctcccagaggtacagaaacaggattcatgaagatgttgacaagactgcaagttcttaccttagctttgttttcaaagggatttttactctctttaggggaccataactttctaaggagagagattaaaatagaaggtgaccttgttttagggggcctgtttcctattaacgaaaaaggcactggaactgaagaatgtgggcgaatcaatgaagaccgagggattcaacgcctggaagccatgttgtttgctattgatgaaatcaacaaagatgattacttgctacca

SEQ ID NO: 12345 - DNA, 1811 bp, Homo sapiens; identical to SEQ ID NO: 12343

SEQ ID NO: 12346 - DNA, 491 bp, Homo sapiens
acaataatcaagagactacttgttcataagaagaataggctgcaaatgtaacttctattgtcttatcttttcattttttcataatgcaaatatgaccaattaaaaatgaattttgtgacaggctctgttagtctgttcctcccttatttgaaggacaggccaaagatccagtttggaaatgagagaggactagcatgacacattggctccaccattgatatctcccagaggtacagaaacaggattcatgaagatgttgacaagactgcaagttcttaccttagctttgttttcaaagggatttttactctctttaggggaccataactttctaaggagagagattaaaatagaaggtgaccttgttttagggggcctgtttcctattaacgaaaaaggcactggaactgaagaatgtgggcgaatcaatgaagaccgagggattcaacgcctggaagccatgttgtttgctattgatgaaatcaacaaag

SEQ ID NO: 12347 - DNA, 2685 bp, Homo sapiens
gtgcagccgggagggggcaggggcagggggcactgtgacaggaagctgcgcgcacaagttggccatttcgagggcaaaataagttctcccttggatttggaaaggacaaagccagtaagctacctcttttgtgtcggatgaggaggaccaaccatgagccagagcccgggtgcaggctcaccgccgccgctgccaccgcggtcagctccagttcctgccaggagttgtcggtgcgaggtggcaaacctgctgcggctcttccagatccctcagatcagctacgcatccaccagcgccaaactcagtgataagtcgcgctatgattactttgccaggaccgtgccccccgacttctaccaggccaaagccatggctgagatcttgcgcttcttcaactggacctacgtgtccacagtagcctccgagggtgattacggggagacagggatcgaggccttcgagcaggaagcccgcctgcgcaacatctgcatcgctacggcggagaaggtgggccgctccaacatccgcaagtcctacgacagcgtgatccgagaactgttgcagaagcccaacgcgcgcgtcgtggtcctcttcatgcgcagcgacgactcgcgggagctcattgcagccgccagccgcgccaatgcctccttcacctgggtggccagcgacggctggggcgcgcaggagagcatcatcaagggcagcgagcatgtggcctacggcgccatcaccctggagctggcctcccagcctgtccgccagttcgaccgctacttccagagcctcaacccctacaacaaccaccgcaacccctggttccgggacttctgggagcaaaagtttcagtgcagcctccagaacaaacgcaaccacaggcgcgtctgcgacaagcacctggccatcgacagcagcaactacgagcaagagtccaagatcatgtttgtggtgaacgcggtgtatgccatggcccacgctttgcacaaaatgcagcgcaccctctgtcccaacactaccaagctttgtgatgctatgaagatcctggatgggaagaagttgtacaaggattacttgctgaaaatcaacttcacggctccattcaacccaaataaagatgcagatagcatagtcaagtttgacacttttggagatggaatggggcgatacaacgtgttcaatttccaaaatgtaggtggaaagtattcctacttgaaagttggtcactgggcagaaaccttatcgctagatgtcaactctatccactggtcccggaactcagtccccacttcccagtgcagcgacccctgtgcccccaatgaaatgaagaatatgcaaccaggggatgtctgctgctggatttgcatcccctgtgaaccctacgaatacctggctgatgagtttacctgtatggattgtgggtctggacagtggcccactgcagacctaactggatgctatgaccttcctgaggactacatcaggtgggaagacgcctgggccattggcccagtcaccattgcctgtctgggttttatgtgtacatgcatggttgtaactgtttttatcaagcacaacaacacacccttggtcaaagcatcgggccgagaactctgctacatcttattgtttggggttggcctgtcatactgcatgacattcttcttcattgccaagccatcaccagtcatctgtgcattgcgccgactcgggctggggagttccttcgctatctgttactcagccctgctgaccaagacaaactgcattgcccgcatcttcgatggggtcaagaatggcgctcagaggccaaaattcatcagccccagttctcaggttttcatctgcctgggtctgatcctggtgcaaattgtgatggtgtctgtgtggctcatcctggaggccccaggcaccaggaggtatacccttgcagagaagcgggaaacagtcatcctaaaatgcaatgtcaaagattccagcatgttgatctctcttacctacgatgtgatcctggtgatcttatgcactgtgtacgccttcaaaacgcggaagtgcccagaaaatttcaacgaagctaagttcataggttttaccatgtacaccacgtgcatcatctggttggccttcctccctatattttatgtgacatcaagtgactacagagtgcagacgacaaccatgtgcatctctgtcagcctgagtggctttgtggtcttgggctgtttgtttgcacccaaggttcacatcatcctgtttcaaccccagaagaatgttgtcacacacagactgcacctcaacaggttcagtgtcagtggaactgggaccacatactctcagtcctctgcaagcacgtatgtgccaacggtgtgcaatgggcgggaagtcctcgactccaccacctcatctctgtgattgtgaattgcagttcagttcttgtgtttttagactgttagacaaaagtgctcacgtgcagctccagaatatggaaacagagcaaaagaacaaccctagtacctttttttagaaacagtacgataaattatttttgaggactgtatatagtgatgtgctagaactttctaggctgagtctagtgcccctattattaacaattcccccagaacatggaaataaccattgtttacagagctgagcattggtgacagggtctgacatggtcagtctact

SEQ ID NO: 12348 - DNA, 2045 bp, Homo sapiens
aattagatgcgacggcttcagcctggtcaaggtgaaggaaagttgcttccgcgcctaggaagtgggtttgcctgataagagaaggaggaggggactcggctgggaagagctcccctcccctccgcggaagaccactgggtcccctctttccccaacctcctccctctcttctactccacccctccgttttcccactccccactgactcggatgcctggatgttctgccaccgggcagtggtccagcgtgcagccgggagggggcaggggcagggggcactgtgacaggaagctgcgcgcacaagttggccatttcgagggcaaaataagttctcccttggatttggaaaggacaaagccagtaagctacctcttttgtgtcggatgaggaggaccaaccatgagccagagcccgggtgcaggctcaccgccgccgctgccaccgcggtcagctccagttcctgccaggagttgtcggtgcgagctccattcaacccaaataaagatgcagatagcatagtcaagtttgacacttttggagatggaatggggcgatacaacgtgttcaatttccaaaatgtaggtggaaagtattcctacttgaaagttggtcactgggcagaaaccttatcgctagatgtcaactctatccactggtcccggaactcagtccccacttcccagtgcagcgacccctgtgcccccaatgaaatgaagaatatgcaaccaggggatgtctgctgctggatttgcatcccctgtgaaccctacgaatacctggctgatgagtttacctgtatggattgtgggtctggacagtggcccactgcagacctaactggatgctatgaccttcctgaggactacatcaggtgggaagacgcctgggccattggcccagtcaccattgcctgtctgggttttatgtgtacatgcatggttgtaactgtttttatcaagcacaacaacacacccttggtcaaagcatcgggccgagaactctgctacatcttattgtttggggttggcctgtcatactgcatgacattcttcttcattgccaagccatcaccagtcatctgtgcattgcgccgactcgggctggggagttccttcgctatctgttactcagccctgctgaccaagacaaactgcattgcccgcatcttcgatggggtcaagaatggcgctcagaggccaaaattcatcagccccagttctcaggttttcatctgcctgggtctgatcctggtgcaaattgtgatggtgtctgtgtggctcatcctggaggccccaggcaccaggaggtatacccttgcagagaagcgggaaacagtcatcctaaaatgcaatgtcaaagattccagcatgttgatctctcttacctacgatgtgatcctggtgatcttatgcactgtgtacgccttcaaaacgcggaagtgcccagaaaatttcaacgaagctaagttcataggttttaccatgtacaccacgtgcatcatctggttggccttcctccctatattttatgtgacatcaagtgactacagagtgcagacgacaaccatgtgcatctctgtcagcctgagtggctttgtggtcttgggctgtttgtttgcacccaaggttcacatcatcctgtttcaaccccagaagaatgttgtcacacacagactgcacctcaacaggttcagtgtcagtggaactgggaccacatactctcagtcctctgcaagcacgtatgtgccaacggtgtgcaatgggcgggaagtcctcgactccaccacctcatctctgtgattgtgaattgcagttcagttcttgtgtttttagactgttagacaaaagtgctcacgtgcagctccagaatatggaaacagagcaaaagaacaaccctagtacctttttttagaaacagtacgataaattatttttgaggactgtatatagtgatgtgctagaactttctaggctgagtctagtgcccctattattaacaattcccccagaacatggaaataaccattgtttacagagctgagcatt

SEQ ID NO: 12349 - DNA, 3590 bp, Homo sapiens
aatcccagcgctttgctggaggatcgcttgagcccaggaattcaagaccagcctgggcaacatggcgagaccctgtctgtcccaaaacaaaaaaacagattttaattggtttgggatgcggcctggacacagggaaattttaaagctctctaggtaactccaatgtgcgtcgaggttgcgaaccgccggcctgtcacacagagggagctcaggagatgctgagagtgggaggatgccggcttgggagcctggagttgcagcttcctgcggctggcgcgcccctccttgctcccctctacgcctctgcatcgcaccccacccctgtaccccaccttcctcccaccaaggaaacctcacctgccgcctcccgcccaggtcctttggattttgccggtgtgtgtgggtgcgcacaagaggcccctccctgccaggagagcaggtgagcctggccgcgcacgaatccgagggggcggccgcccagctgggaagcagccctgaaatagacccccgccgcccccgctgcctccttccggaatctgctcagataccccagatcagctacgcctccacagcgccagacctgagtgacaacagccgctacgacttcttctcccgcgtggtgccctcggacacgtaccaggcccaggccatggtggacatcgtccgtgccctcaagtggaactatgtgtccacagtggcctcggagggcagctatggtgagagcggtgtggaggccttcatccagaagtcccgtgaggacgggggcgtgtgcatcgcccagtcggtgaagataccacgggagcccaaggcaggcgagttcgacaagatcatccgccgcctcctggagacttcgaacgccagggcagtcatcatctttgccaacgaggatgacatcaggcgtgtgctggaggcagcacgaagggccaaccagacaggccatttcttctggatgggctctgacagctggggctccaagattgcacctgtgctgcacctggaggaggtggctgagggtgctgtcacgatcctccccaagaggatgtccgtacgagaccgtgagcgaattgggcaggattcagcttatgagcaggaggggaaggtgcagtttgtgatcgatgccgtgtacgccatgggccacgcgctgcacgccatgcaccgtgacctgtgtcccggccgcgtggggctctgcccgcgcatggaccctgtagatggcacccagctgcttaagtacatccgaaacgtcaacttctcaggcatcgcagggaaccctgtgaccttcaatgagaatggagatgcgcctgggcgctatgacatctaccaataccagctgcgcaacgattctgccgagtacaaggtcattggctcctggactgaccacctgcaccttagaatagagcggatgcactggccggggagcgggcagcagctgccccgctccatctgcagcctgccctgccaaccgggtgagcggaagaagacagtgaagggcatgccttgctgctggcactgcgagccttgcacagggtaccagtaccaggtggaccgctacacctgtaagacgtgtccctatgacatgcggcccacagagaaccgcacgggctgccggcccatccccatcatcaagcttgagtggggctcgccctgggccgtgctgcccctcttcctggccgtggtgggcatcgctgccacgttgttcgtggtgatcacctttgtgcgctacaacgacacgcccatcgtcaaggcctcgggccgtgaactgagctacgtgctgctggcaggcatcttcctgtgctatgccaccaccttcctcatgatcgctgagcccgaccttggcacctgctcgctgcgccgaatcttcctgggactagggatgagcatcagctatgcagccctgctcaccaagaccaaccgcatctaccgcatcttcgagcagggcaagcgctcggtcagtgccccacgcttcatcagccccgcctcacagctggccatcaccttcagcctcatctcgctgcagctgctgggcatctgtgtgtggtttgtggtggacccctcccactcggtggtggacttccaggaccagcggacactcgacccccgcttcgccaggggtgtgctcaagtgtgacatctcggacctgtcgctcatctgcctgctgggctacagcatgctgctcatggtcacgtgcaccgtgtatgccatcaagacacgcggcgtgcccgagaccttcaatgaggccaagcccattggcttcaccatgtacaccacttgcatcgtctggctggccttcatccccatcttctttggcacctcgcagtcggccgacaagctgtacatccagacgacgacgctgacggtctcggtgagtctgagcgcctcggtgtccctgggaatgctctacatgcccaaagtctacatcatcctcttccacccggagcagaacgtgcccaagcgcaagcgcagcctcaaagccgtcgttacggcggccaccatgtccaacaagttcacgcagaagggcaacttccggcccaacggagaggccaagtctgagctctgcgagaaccttgaggccccagcgctggccaccaaacagacttacgtcacttacaccaaccatgcaatctagcgagtccatggagctgagcagcaggaggaggagccgtgaccctgtggaaggtgcgtcgggccagggccacacccaagggcccagctgtcttgcctgcccgtgggcacccacggacgtggcttggtgctgaggatagcagagcccccagccatcactgctggcagcctgggcaaaccgggtgagcaacaggaggacgaggggccggggcggtgccaggctaccacaagaacctgcgtcttggaccattgcccctcccggccccaaaccacaggggctcaggtcgtgtgggccccagtgctagatctctccctcccttcgtctctgtctgtgctgttggcgacccctctgtctgtctccagccctgtctttctgttctcttatctctttgtttcaccttttccctctctggcgtccccggctgcttgtactcttggccttttctgtgtctcctttctggctcttgcctccgcctctctctctcatcctctttgtcctcagctcctcctgctttcttgggtcccaccagtgtcacttttctgccgttttctttcctgttctcctctgcttcattctcgtccagccattgctcccctctccctgccacccttccccagttcaccaaaccttacatgttgcaaaagagaaaaaaggaaaaaaaatcaaaacacaaaaaagccaaaacgaaaacaaatctcgagtgtgttgccaagtgctgcgtcctcctggtggcctctgtgtgtgtccctgtggcccgcagcctgcccgcctgccccgcccatctgccgtgtgtcttgcccgcctgccccgcccgtctgccgtctgtcttgcccgcctgcccgcctgcccctcctgccgaccacacggagttcagtgcctgggtgtttggtgatggttattgacgacaatgtgtagcgcatgattgtttttataccaagaacatttctaataaaaataaacacatggtttt

SEQ ID NO: 12350 - DNA, 3879 bp, Homo sapiens
ccgagtgacaaggaggtgggagagggtagcagcatgggctacgcggttggctgccctcagtccccctgctgctgaagctgccctgcccatgcccacccaggccgtggggccaggggcctgccagggctaggagtgggcctgccgttcatgggtctctagggatttccgagatgcctgggaagagaggcttgggctggtggtgggcccggctgcccctttgcctgctcctcagcctttacggcccctggatgccttcctccctgggaaagcccaaaggccaccctcacatgaattccatccgcatagatggggacatcacactgggaggcctgttcccggtgcatggccggggctcagagggcaagccctgtggagaacttaagaaggaaaagggcatccaccggctggaggccatgctgttcgccctggatcgcatcaacaacgacccggacctgctgcctaacatcacgctgggcgcccgcattctggacacctgctccagggacacccatgccctcgagcagtcgctgacctttgtgcaggcgctcatcgagaaggatggcacagaggtccgctgtggcagtggcggcccacccatcatcaccaagcctgaacgtgtggtgggtgtcatcggtgcttcagggagctcggtctccatcatggtggccaacatccttcgcctcttcaagataccccagatcagctacgcctccacagcgccagacctgagtgacaacagccgctacgacttcttctcccgcgtggtgccctcggacacgtaccaggcccaggccatggtggacatcgtccgtgccctcaagtggaactatgtgtccacagtggcctcggagggcagctatggtgagagcggtgtggaggccttcatccagaagtcccgtgaggacgggggcgtgtgcatcgcccagtcggtgaagataccacgggagcccaaggcaggcgagttcgacaagatcatccgccgcctcctggagacttcgaacgccagggcagtcatcatctttgccaacgaggatgacatcaggcgtgtgctggaggcagcacgaagggccaaccagacaggccatttcttctggatgggctctgacagctggggctccaagattgcacctgtgctgcacctggaggaggtggctgagggtgctgtcacgatcctccccaagaggatgtccgtacgaggcttcgaccgctacttctccagccgcacgctggacaacaaccggcgcaacatctggtttgccgagttctgggaggacaacttccactgcaagctgagccgccacgccctcaagaagggcagccacgtcaagaagtgcaccaaccgtgagcgaattgggcaggattcagcttatgagcaggaggggaaggtgcagtttgtgatcgatgccgtgtacgccatgggccacgcgctgcacgccatgcaccgtgacctgtgtcccggccgcgtggggctctgcccgcgcatggaccctgtagatggcacccagctgcttaagtacatccgaaacgtcaacttctcaggcatcgcagggaaccctgtgaccttcaatgagaatggagatgcgcctgggcgctatgacatctaccaataccagctgcgcaacgattctgccgagtacaaggtcattggctcctggactgaccacctgcaccttagaatagagcggatgcactggccggggagcgggcagcagctgccccgctccatctgcagcctgccctgccaaccgggtgagcggaagaagacagtgaagggcatgccttgctgctggcactgcgagccttgcacagggtaccagtaccaggtggaccgctacacctgtaagacgtgtccctatgacatgcggcccacagagaaccgcacgggctgccggcccatccccatcatcaagcttgagtggggctcgccctgggccgtgctgcccctcttcctggccgtggtgggcatcgctgccacgttgttcgtggtgatcacctttgtgcgctacaacgacacgcccatcgtcaaggcctcgggccgtgaactgagctacgtgctgctggcaggcatcttcctgtgctatgccaccaccttcctcatgatcgctgagcccgaccttggcacctgctcgctgcgccgaatcttcctgggactagggatgagcatcagctatgcagccctgctcaccaagaccaaccgcatctaccgcatcttcgagcagggcaagcgctcggtcagtgccccacgcttcatcagccccgcctcacagctggccatcaccttcagcctcatctcgctgcagctgctgggcatctgtgtgtggtttgtggtggacccctcccactcggtggtggacttccaggaccagcggacactcgacccccgcttcgccaggggtgtgctcaagtgtgacatctcggacctgtcgctcatctgcctgctgggctacagcatgctgctcatggtcacgtgcaccgtgtatgccatcaagacacgcggcgtgcccgagaccttcaatgaggccaagcccattggcttcaccatgtacaccacttgcatcgtctggctggccttcatccccatcttctttggcacctcgcagtcggccgacaagctgtacatccagacgacgacgctgacggtctcggtgagtctgagcgcctcggtgtccctgggaatgctctacatgcccaaagtctacatcatcctcttccacccggagcagaacgtgcccaagcgcaagcgcagcctcaaagccgtcgttacggcggccaccatgtccaacaagttcacgcagaagggcaacttccggcccaacggagaggccaagtctgagctctgcgagaaccttgaggccccagcgctggccaccaaacagacttacgtcacttacaccaaccatgcaatctagcgagtccatggagctgagcagcaggaggaggagccgtgaccctgtggaaggtgcgtcgggccagggccacacccaagggcccagctgtcttgcctgcccgtgggcacccacggacgtggcttggtgctgaggatagcagagcccccagccatcactgctggcagcctgggcaaaccgggtgagcaacaggaggacgaggggccggggcggtgccaggctaccacaagaacctgcgtcttggaccattgcccctcccggccccaaaccacaggggctcaggtcgtgtgggccccagtgctagatctctccctcccttcgtctctgtctgtgctgttggcgacccctctgtctgtctccagccctgtctttctgttctcttatctctttgtttcaccttttccctctctggcgtccccggctgcttgtactcttggccttttctgtgtctcctttctggctcttgcctccgcctctctctctcatcctctttgtcctcagctcctcctgctttcttgggtcccaccagtgtcacttttctgccgttttctttcctgttctcctctgcttcattctcgtccagccattgctcccctctccctgccacccttccccagttcaccaaaccttacatgttgcaaaagagaaaaaaggaaaaaaaatcaaaacacaaaaaagccaaaacgaaaacaaatctcgagtgtgttgccaagtgctgcgtcctcctggtggcctctgtgtgtgtccctgtggcccgcagcctgcccgcctgccccgcccatctgccgtgtgtcttgcccgcctgccccgcccgtctgccgtctgtcttgcccgcctgcccgcctgcccctcctgccgaccacacggagttcagtgcctgggtgtttggtgatggttattgacgacaatgtgtagcgcatgattgtttttataccaagaacatttctaataaaaataaacacatggttttgca

SEQ ID NO: 12351 - DNA, 2574 bp, Homo sapiens
aaatgccccagtccttccggctggctgcaagatggtgcaaactcttcccaagctatttccccatgatggcgccaagagaaaaaagaggacccttaggacttcagggccatgctttgggggtggaggacagataccccagatcagctacgcctccacagcgccagacctgagtgacaacagccgctacgacttcttctcccgcgtggtgccctcggacacgtaccaggcccaggccatggtggacatcgtccgtgccctcaagtggaactatgtgtccacagtggcctcggagggcagctatggtgagagcggtgtggaggccttcatccagaagtcccgtgaggacgggggcgtgtgcatcgcccagtcggtgaagataccacgggagcccaaggcaggcgagttcgacaagatcatccgccgcctcctggagacttcgaacgccagggcagtcatcatctttgccaacgaggatgacatcaggcgtgtgctggaggcagcacgaagggccaaccagacaggccatttcttctggatgggctctgacagctggggctccaagattgcacctgtgctgcacctggaggaggtggctgagggtgctgtcacgatcctccccaagaggatgtccgtacgaggcttcgaccgctacttctccagccgcacgctggacaacaaccggcgcaacatctggtttgccgagttctgggaggacaacttccactgcaagctgagccgccacgccctcaagaagggcagccacgtcaagaagtgcaccaaccgtgagcgaattgggcaggattcagcttatgagcaggaggggaaggtgcagtttgtgatcgatgccgtgtacgccatgggccacgcgctgcacgccatgcaccgtgacctgtgtcccggccgcgtggggctctgcccgcgcatggaccctgtagatggcacccagctgcttaagtacatccgaaacgtcaacttctcaggcatcgcagggaaccctgtgaccttcaatgagaatggagatgcgcctgggcgctatgacatctaccaataccagctgcgcaacgattctgccgagtacaaggtcattggctcctggactgaccacctgcaccttagaatagagcggatgcactggccggggagcgggcagcagctgccccgctccatctgcagcctgccctgccaaccgggtgagcggaagaagacagtgaagggcatgccttgctgctggcactgcgagccttgcacagggtaccagtaccaggtggaccgctacacctgtaagacgtgtccctatgacatgcggcccacagagaaccgcacgggctgccggcccatccccatcatcaagcttgagtggggctcgccctgggccgtgctgcccctcttcctggccgtggtgggcatcgctgccacgttgttcgtggtgatcacctttgtgcgctacaacgacacgcccatcgtcaaggcctcgggccgtgaactgagctacgtgctgctggcaggcatcttcctgtgctatgccaccaccttcctcatgatcgctgagcccgaccttggcacctgctcgctgcgccgaatcttcctgggactagggatgagcatcagctatgcagccctgctcaccaagaccaaccgcatctaccgcatcttcgagcagggcaagcgctcggtcagtgccccacgcttcatcagccccgcctcacagctggccatcaccttcagcctcatctcgctgcagctgctgggcatctgtgtgtggtttgtggtggacccctcccactcggtggtggacttccaggaccagcggacactcgacccccgcttcgccaggggtgtgctcaagtgtgacatctcggacctgtcgctcatctgcctgctgggctacagcatgctgctcatggtcacgtgcaccgtgtatgccatcaagacacgcggcgtgcccgagaccttcaatgaggccaagcccattggcttcaccatgtacaccacttgcatcgtctggctggccttcatccccatcttctttggcacctcgcagtcggccgacaagctgtacatccagacgacgacgctgacggtctcggtgagtctgagcgcctcggtgtccctgggaatgctctacatgcccaaagtctacatcatcctcttccacccggagcagaacgtgcccaagcgcaagcgcagcctcaaagccgtcgttacggcggccaccatgtccaacaagttcacgcagaagggcaacttccggcccaacggagaggccaagtctgagctctgcgagaaccttgaggccccagcgctggccaccaaacagacttacgtcacttacaccaaccatgcaatctagcgagtccatggagctgagcagcaggaggaggagccgtgaccctgtggaaggtgcgtcgggccagggccacacccaagggcccagctgtcttgcctgcccgtgggcacccacggacgtggcttggtgctgaggatagcagagcccccagccatcactgctggcagcctgggcaaaccgggtgagcaacaggaggacgaggggccggggcggtgccaggctaccac

SEQ ID NO: 12352 - DNA, 3137 bp, Homo sapiens
gcagtgcctgacacatcccagtctttcaccgtggtgcctgtggacagatgaggagactgaggctcacaaaggaggtgacttgcccaaggtcacacagcgaggcagcttctcacctatgggagttggactttgagccctccttggaaaagggggcatggctgtgccccttggggctccttgctgggcctctgccctgcctgcctgggctcctcccggcctcccccacagatcactgttgacaaggttactgagtcagcatgtaaaacctgcaaaaataccccagatcagctacgcctccacagcgccagacctgagtgacaacagccgctacgacttcttctcccgcgtggtgccctcggacacgtaccaggcccaggccatggtggacatcgtccgtgccctcaagtggaactatgtgtccacagtggcctcggagggcagctatggtgagagcggtgtggaggccttcatccagaagtcccgtgaggacgggggcgtgtgcatcgcccagtcggtgaagataccacgggagcccaaggcaggcgagttcgacaagatcatccgccgcctcctggagacttcgaacgccagggcagtcatcatctttgccaacgaggatgacatcaggcgtgtgctggaggcagcacgaagggccaaccagacaggccatttcttctggatgggctctgacagctggggctccaagattgcacctgtgctgcacctggaggaggtggctgagggtgctgtcacgatcctccccaagaggatgtccgtacgaggcttcgaccgctacttctccagccgcacgctggacaacaaccggcgcaacatctggtttgccgagttctgggaggacaacttccactgcaagctgagccgccacgccctcaagaagggcagccacgtcaagaagtgcaccaaccgtgagcgaattgggcaggattcagcttatgagcaggaggggaaggtgcagtttgtgatcgatgccgtgtacgccatgggccacgcgctgcacgccatgcaccgtgacctgtgtcccggccgcgtggggctctgcccgcgcatggaccctgtagatggcacccagctgcttaagtacatccgaaacgtcaacttctcaggcatcgcagggaaccctgtgaccttcaatgagaatggagatgcgcctgggcgctatgacatctaccaataccagctgcgcaacgattctgccgagtacaaggtcattggctcctggactgaccacctgcaccttagaatagagcggatgcactggccggggagcgggcagcagctgccccgctccatctgcagcctgccctgccaaccgggtgagcggaagaagacagtgaagggcatgccttgctgctggcactgcgagccttgcacagggtaccagtaccaggtggaccgctacacctgtaagacgtgtccctatgacatgcggcccacagagaaccgcacgggctgccggcccatccccatcatcaagcttgagtggggctcgccctgggccgtgctgcccctcttcctggccgtggtgggcatcgctgccacgttgttcgtggtgatcacctttgtgcgctacaacgacacgcccatcgtcaaggcctcgggccgtgaactgagctacgtgctgctggcaggcatcttcctgtgctatgccaccaccttcctcatgatcgctgagcccgaccttggcacctgctcgctgcgccgaatcttcctgggactagggatgagcatcagctatgcagccctgctcaccaagaccaaccgcatctaccgcatcttcgagcagggcaagcgctcggtcagtgccccacgcttcatcagccccgcctcacagctggccatcaccttcagcctcatctcgctgcagctgctgggcatctgtgtgtggtttgtggtggacccctcccactcggtggtggacttccaggaccagcggacactcgacccccgcttcgccaggggtgtgctcaagtgtgacatctcggacctgtcgctcatctgcctgctgggctacagcatgctgctcatggtcacgtgcaccgtgtatgccatcaagacacgcggcgtgcccgagaccttcaatgaggccaagcccattggcttcaccatgtacaccacttgcatcgtctggctggccttcatccccatcttctttggcacctcgcagtcggccgacaagctgtacatccagacgacgacgctgacggtctcggtgagtctgagcgcctcggtgtccctgggaatgctctacatgcccaaagtctacatcatcctcttccacccggagcagaacgtgcccaagcgcaagcgcagcctcaaagccgtcgttacggcggccaccatgtccaacaagttcacgcagaagggcaacttccggcccaacggagaggccaagtctgagctctgcgagaaccttgaggccccagcgctggccaccaaacagacttacgtcacttacaccaaccatgcaatctagcgagtccatggagctgagcagcaggaggaggagccgtgaccctgtggaaggtgcgtcgggccagggccacacccaagggcccagctgtcttgcctgcccgtgggcacccacggacgtggcttggtgctgaggatagcagagcccccagccatcactgctggcagcctgggcaaaccgggtgagcaacaggaggacgaggggccggggcggtgccaggctaccacaagaacctgcgtcttggaccattgcccctcccggccccaaaccacaggggctcaggtcgtgtgggccccagtgctagatctctccctcccttcgtctctgtctgtgctgttggcgacccctctgtctgtctccagccctgtctttctgttctcttatctctttgtttcaccttttccctctctggcgtccccggctgcttgtactcttggccttttctgtgtctcctttctggctcttgcctccgcctctctctctcatcctctttgtcctcagctcctcctgctttcttgggtcccaccagtgtcacttttctgccgttttctttcctgttctcctctgcttcattctcgtccagccattgctcccctctccctgccacccttccccagttcaccaaaccttacatgttgcaaaagag

SEQ ID NO: 12353 - DNA, 3409 bp, Homo sapiens
ttttctgggtgtgtgttagggaggctatgttcctgaccctccccctctggggtgagaaggggtccccgccatgtcctcggggttggtaggaggagaggattggagctgttttctccttgatgccaagatacgccaagctaggagcattctgccctttccacagtcatccaccgagaacaggcctgcaggacgggacaaggatcagagccttcctgcaaccccggccactgcctgctgtctgtgggcctggactgtgcgggcaactgtgcttggcccgagtgacaaggaggtgggagagggtagcagcatgggctacgcggttggctgccctcagtccccctgctgctgaagctgccctgcccatgcccacccaggccgtggggccaggggcctgccagggctaggagtgggcctgccgttcatgggtctctagggatttccgagatgcctgggaagagaggcttgggctggtggtgggcccggctgcccctttgcctgctcctcagcctttacggcccctggatgccttcctccctgggaaagcccaaaggccaccctcacatgaattccatccgcatagatggggacatcacactgggaggcctgttcccggtgcatggccggggctcagagggcaagccctgtggagaacttaagaaggaaaagggcatccaccggctggaggccatgctgttcgccctggatcgcatcaacaacgacccggacctgctgcctaacatcacgctgggcgcccgcattctggacacctgctccagggacacccatgccctcgagcagtcgctgacctttgtgcaggcgctcatcgagaaggatggcacagaggtccgctgtggcagtggcggcccacccatcatcaccaagcctgaacgtgtggtgggtgtcatcggtgcttcagggagctcggtctccatcatggtggccaacatccttcgcctcttcaagataccccagatcagctacgcctccacagcgccagacctgagtgacaacagccgctacgacttcttctcccgcgtggtgccctcggacacgtaccaggcccaggccatggtggacatcgtccgtgccctcaagtggaactatgtgtccacagtggcctcggagggcagctatggtgagagcggtgtggaggccttcatccagaagtcccgtgaggacgggggcgtgtgcatcgcccagtcggtgaagataccacgggagcccaaggcaggcgagttcgacaagatcatccgccgcctcctggagacttcgaacgccagggcagtcatcatctttgccaacgaggatgacatcaggcgtgtgctggaggcagcacgaagggccaaccagacaggccatttcttctggatgggctctgacagctggggctccaagattgcacctgtgctgcacctggaggaggtggctgagggtgctgtcacgatcctccccaagaggatgtccgtacgaggcttcgaccgctacttctccagccgcacgctggacaacaaccggcgcaacatctggtttgccgagttctgggaggacaacttccactgcaagctgagccgccacgccctcaagaagggcagccacgtcaagaagtgcaccaaccgtgagcgaattgggcaggattcagcttatgagcaggaggggaaggtgcagtttgtgatcgatgccgtgtacgccatgggccacgcgctgcacgccatgcaccgtgacctgtgtcccggccgcgtggggctctgcccgcgcatggaccctgtagatggcacccagctgcttaagtacatccgaaacgtcaacttctcaggcatcgcagggaaccctgtgaccttcaatgagaatggagatgcgcctgggcgctatgacatctaccaataccagctgcgcaacgattctgccgagtacaaggtcattggctcctggactgaccacctgcaccttagaatagagcggatgcactggccggggagcgggcagcagctgccccgctccatctgcagcctgccctgccaaccgggtgagcggaagaagacagtgaagggcatgccttgctgctggcactgcgagccttgcacagggtaccagtaccaggtggaccgctacacctgtaagacgtgtccctatgacatgcggcccacagagaaccgcacgggctgccggcccatccccatcatcaagcttgagtggggctcgccctgggccgtgctgcccctcttcctggccgtggtgggcatcgctgccacgttgttcgtggtgatcacctttgtgcgctacaacgacacgcccatcgtcaaggcctcgggccgtgaactgagctacgtgctgctggcaggcatcttcctgtgctatgccaccaccttcctcatgatcgctgagcccgaccttggcacctgctcgctgcgccgaatcttcctgggactagggatgagcatcagctatgcagccctgctcaccaagaccaaccgcatctaccgcatcttcgagcagggcaagcgctcggtcagtgccccacgcttcatcagccccgcctcacagctggccatcaccttcagcctcatctcgctgcagctgctgggcatctgtgtgtggtttgtggtggacccctcccactcggtggtggacttccaggaccagcggacactcgacccccgcttcgccaggggtgtgctcaagtgtgacatctcggacctgtcgctcatctgcctgctgggctacagcatgctgctcatggtcacgtgcaccgtgtatgccatcaagacacgcggcgtgcccgagaccttcaatgaggccaagcccattggcttcaccatgtacaccacttgcatcgtctggctggccttcatccccatcttctttggcacctcgcagtcggccgacaagctgtacatccagacgacgacgctgacggtctcggtgagtctgagcgcctcggtgtccctgggaatgctctacatgcccaaagtctacatcatcctcttccacccggagcagaacgtgcccaagcgcaagcgcagcctcaaagccgtcgttacggcggccaccatgtccaacaagttcacgcagaagggcaacttccggcccaacggagaggccaagtctgagctctgcgagaaccttgaggccccagcgctggccaccaaacagacttacgtcacttacaccaaccatgcaatctagcgagtccatggagctgagcagcaggaggaggagccgtgaccctgtggaaggtgcgtcgggccagggccacacccaagggcccagctgtcttgcctgcccgtgggcacccacggacgtggcttggtgctgaggatagcagagcccccagccatcactgctggcagcctgggcaaaccgggtgagcaacaggaggacgaggggccggggcggtgccaggctaccacaa

SEQ ID NO: 12354 - DNA, 2712 bp, Homo sapiens
gatgccctggggactcacgggctgcaggtgctaccagcccagcaccccggcacagcggggaggctgaggcagacacacgctcctggagagacatgtcatgtaagataccccagatcagctacgcctccacagcgccagacctgagtgacaacagccgctacgacttcttctcccgcgtggtgccctcggacacgtaccaggcccaggccatggtggacatcgtccgtgccctcaagtggaactatgtgtccacagtggcctcggagggcagctatggtgagagcggtgtggaggccttcatccagaagtcccgtgaggacgggggcgtgtgcatcgcccagtcggtgaagataccacgggagcccaaggcaggcgagttcgacaagatcatccgccgcctcctggagacttcgaacgccagggcagtcatcatctttgccaacgaggatgacatcaggcgtgtgctggaggcagcacgaagggccaaccagacaggccatttcttctggatgggctctgacagctggggctccaagattgcacctgtgctgcacctggaggaggtggctgagggtgctgtcacgatcctccccaagaggatgtccgtacgaggcttcgaccgctacttctccagccgcacgctggacaacaaccggcgcaacatctggtttgccgagttctgggaggacaacttccactgcaagctgagccgccacgccctcaagaagggcagccacgtcaagaagtgcaccaaccgtgagcgaattgggcaggattcagcttatgagcaggaggggaaggtgcagtttgtgatcgatgccgtgtacgccatgggccacgcgctgcacgccatgcaccgtgacctgtgtcccggccgcgtggggctctgcccgcgcatggaccctgtagatggcacccagctgcttaagtacatccgaaacgtcaacttctcaggcatcgcagggaaccctgtgaccttcaatgagaatggagatgcgcctgggcgctatgacatctaccaataccagctgcgcaacgattctgccgagtacaaggtcattggctcctggactgaccacctgcaccttagaatagagcggatgcactggccggggagcgggcagcagctgccccgctccatctgcagcctgccctgccaaccgggtgagcggaagaagacagtgaagggcatgccttgctgctggcactgcgagccttgcacagggtaccagtaccaggtggaccgctacacctgtaagacgtgtccctatgacatgcggcccacagagaaccgcacgggctgccggcccatccccatcatcaagcttgagtggggctcgccctgggccgtgctgcccctcttcctggccgtggtgggcatcgctgccacgttgttcgtggtgatcacctttgtgcgctacaacgacacgcccatcgtcaaggcctcgggccgtgaactgagctacgtgctgctggcaggcatcttcctgtgctatgccaccaccttcctcatgatcgctgagcccgaccttggcacctgctcgctgcgccgaatcttcctgggactagggatgagcatcagctatgcagccctgctcaccaagaccaaccgcatctaccgcatcttcgagcagggcaagcgctcggtcagtgccccacgcttcatcagccccgcctcacagctggccatcaccttcagcctcatctcgctgcagctgctgggcatctgtgtgtggtttgtggtggacccctcccactcggtggtggacttccaggaccagcggacactcgacccccgcttcgccaggggtgtgctcaagtgtgacatctcggacctgtcgctcatctgcctgctgggctacagcatgctgctcatggtcacgtgcaccgtgtatgccatcaagacacgcggcgtgcccgagaccttcaatgaggccaagcccattggcttcaccatgtacaccacttgcatcgtctggctggccttcatccccatcttctttggcacctcgcagtcggccgacaagctgtacatccagacgacgacgctgacggtctcggtgagtctgagcgcctcggtgtccctgggaatgctctacatgcccaaagtctacatcatcctcttccacccggagcagaacgtgcccaagcgcaagcgcagcctcaaagccgtcgttacggcggccaccatgtccaacaagttcacgcagaagggcaacttccggcccaacggagaggccaagtctgagctctgcgagaaccttgaggccccagcgctggccaccaaacagacttacgtcacttacaccaaccatgcaatctagcgagtccatggagctgagcagcaggaggaggagccgtgaccctgtggaaggtgcgtcgggccagggccacacccaagggcccagctgtcttgcctgcccgtgggcacccacggacgtggcttggtgctgaggatagcagagcccccagccatcactgctggcagcctgggcaaaccgggtgagcaacaggaggacgaggggccggggcggtgccaggctaccacaagaacctgcgtcttggaccattgcccctcccggccccaaaccacaggggctcaggtcgtgtgggccccagtgctagatctctccctcccttcgtctctgtctgtgctgttggcgacccctctgtctgtctccagccctgtctttctgttctcttatctctttg

SEQ ID NO: 12355 - DNA, 3471 bp, Homo sapiens
agtaaacatgctcttctctagcacttgggacttcttggtgtcttaggagagacctgaggagctgtgtgtgtgtgtgcacgcacatgtgcgtgtgtgtgcatgcgtgtgtgtgtgttgtgtcctgtggccccaggccagcagggtgcctggcacagagcagccactccttccagagcgtaccctgttctctccagaatgcctgccgcctggccacttgcatcctctgaggactcagcccagtgtcactgcctttgggcagccttccctggcggccatctccctgcccacagggggcgtgtgcatcgcccagtcggtgaagataccacgggagcccaaggcaggcgagttcgacaagatcatccgccgcctcctggagacttcgaacgccagggcagtcatcatctttgccaacgaggatgacatcaggcgtgtgctggaggcagcacgaagggccaaccagacaggccatttcttctggatgggctctgacagctggggctccaagattgcacctgtgctgcacctggaggaggtggctgagggtgctgtcacgatcctccccaagaggatgtccgtacgaggcttcgaccgctacttctccagccgcacgctggacaacaaccggcgcaacatctggtttgccgagttctgggaggacaacttccactgcaagctgagccgccacgccctcaagaagggcagccacgtcaagaagtgcaccaaccgtgagcgaattgggcaggattcagcttatgagcaggaggggaaggtgcagtttgtgatcgatgccgtgtacgccatgggccacgcgctgcacgccatgcaccgtgacctgtgtcccggccgcgtggggctctgcccgcgcatggaccctgtagatggcacccagctgcttaagtacatccgaaacgtcaacttctcaggcatcgcagggaaccctgtgaccttcaatgagaatggagatgcgcctgggcgctatgacatctaccaataccagctgcgcaacgattctgccgagtacaaggtcattggctcctggactgaccacctgcaccttagaatagagcggatgcactggccggggagcgggcagcagctgccccgctccatctgcagcctgccctgccaaccgggtgagcggaagaagacagtgaagggcatgccttgctgctggcactgcgagccttgcacagggtaccagtaccaggtggaccgctacacctgtaagacgtgtccctatgacatgcggcccacagagaaccgcacgggctgccggcccatccccatcatcaagcttgagtggggctcgccctgggccgtgctgcccctcttcctggccgtggtgggcatcgctgccacgttgttcgtggtgatcacctttgtgcgctacaacgacacgcccatcgtcaaggcctcgggccgtgaactgagctacgtgctgctggcaggcatcttcctgtgctatgccaccaccttcctcatgatcgctgagcccgaccttggcacctgctcgctgcgccgaatcttcctgggactagggatgagcatcagctatgcagccctgctcaccaagaccaaccgcatctaccgcatcttcgagcagggcaagcgctcggtcagtgccccacgcttcatcagccccgcctcacagctggccatcaccttcagcctcatctcgctgcagctgctgggcatctgtgtgtggtttgtggtggacccctcccactcggtggtggacttccaggaccagcggacactcgacccccgcttcgccaggggtgtgctcaagtgtgacatctcggacctgtcgctcatctgcctgctgggctacagcatgctgctcatggtcacgtgcaccgtgtatgccatcaagacacgcggcgtgcccgagaccttcaatgaggccaagcccattggcttcaccatgtacaccacttgcatcgtctggctggccttcatccccatcttctttggcacctcgcagtcggccgacaagctgtacatccagacgacgacgctgacggtctcggtgagtctgagcgcctcggtgtccctgggaatgctctacatgcccaaagtctacatcatcctcttccacccggagcagaacgtgcccaagcgcaagcgcagcctcaaagccgtcgttacggcggccaccatgtccaacaagttcacgcagaagggcaacttccggcccaacggagaggccaagtctgagctctgcgagaaccttgaggccccagggagctcataggccactgactccacccaactctggccaggagaaaattcttcctttaactgagctggaccctgaccttcatgcctccctactggtcccatggtggacccctctgctcaccccatcctcaagcagtttgcttcgtccacatgtgatagactgatagttggacaccaaacttctgcctgtgttagtgggcttccagttacactgctgtgacaaagaggtcccagaactgagcagctcaaatcagacagatgtttgttgctctctgccgtaataggacatggtgggtgggtgggagtgaggacccaggatccttccatcttgttgctccattggctccctgaagattgaggctagatgacctcaatggttgttctgctcatggaagggaaaagagaagacgcatgggggaaagacccattttaattgaatgacatgggagctgcacacagtccttccatgtgtatttcatgaggaagaacacagtcagcgctggccaccaaacagacttacgtcacttacaccaaccatgcaatctagcgagtccatggagctgagcagcaggaggaggagccgtgaccctgtggaaggtgcgtcgggccagggccacacccaagggcccagctgtcttgcctgcccgtgggcacccacggacgtggcttggtgctgaggatagcagagcccccagccatcactgctggcagcctgggcaaaccgggtgagcaacaggaggacgaggggccggggcggtgccaggctaccacaagaacctgcgtcttggaccattgcccctcccggccccaaaccacaggggctcaggtcgtgtgggccccagtgctagatctctccctcccttcgtctctgtctgtgctgttggcgacccctctgtctgtctccagccctgtctttctgttctcttatctctttgtttcaccttttccctctctggcgtccccggctgcttgtactcttggccttttctgtgtctcctttctggctcttgcctccgcctctctctctcatcctctttgtcctcagctcctcctgctttcttgggtcccaccagtgtcacttttctgccgttttctttcctgttctcctctgcttcattctcgtccagccattgctcccctctccctgccacccttccccagttcaccaaaccttacatgttgcaaaagagaaaaaaggaaaaaaaatcaaaacacaaaaaagccaaaacg

SEQ ID NO: 12356 - DNA, 6143 bp, Homo sapiens
cggaggcccgggcaggccggctgagctaactccccagagccgaagtggaaggcgcgccccgagcgccttctccccaggaccccggtgtccctccccgcgccccgagcccgcgctctccttcccccgccctcagagcgctccccgcccctctgtctccccgcagcccgctagacgagccgatggcgcggccccggagagcccgggagccgctgctcgtggcgctgctgccgctggcgtggctggcgcaggcgggcctggcgcgcgcggcgggctctgtgcgcctggcgggcggcctgacgctgggcggcctgttcccggtgcacgcgcggggcgcggcgggccgggcgtgcgggcagctgaagaaggagcagggcgtgcaccggctggaggccatgctgtacgcgctggaccgcgtcaacgccgaccccgagctgctgcccggcgtgcgcctgggcgcgcggctgctggacacctgctcgcgggacacctacgcgctggagcaggcgctgagcttcgtgcaggcgctgatccgcggccgcggcgacggcgacgaggtgggcgtgcgctgcccgggaggcgtccctccgctgcgccccgcgccccccgagcgcgtcgtggccgtcgtgggcgcctcggccagctccgtctccatcatggtcgccaacgtgctgcgcctgtttgcgataccccagatcagctatgcctccacagccccggagctcagcgactccacacgctatgacttcttctcccgggtggtgccacccgactcctaccaggcgcaggccatggtggacatcgtgagggcactgggatggaactatgtgtccacgctggcctccgagggcaactatggcgaaagtggggttgaggccttcgttcagatctcccgagaggctgggggggtctgtattgcccagtctatcaagattcccagggaaccaaagccaggagagttcagcaaggtgatcaggagactcatggagacgcccaacgcccggggcatcatcatctttgccaatgaggatgacatcaggcgggtcctggaggcagctcgccaggccaacctgaccggccacttcctgtgggtcggctcagacagctggggagccaagacctcacccatcttgagcctggaggacgtggccgttggggccatcaccatcctgcccaaaagggcctccatcgacggatttgaccagtacttcatgactcgatccctggagaacaaccgcaggaacatctggttcgccgagttctgggaagagaattttaactgcaaactgaccagctcaggtacccagtcagacgattccacccgcaaatgcacaggcgaggaacgcatcggccgggactccacctacgagcaggagggcaaggtgcagtttgtgattgatgcggtgtacgccattgcccacgccctccacagcatgcaccaggcgctctgccctgggcacacaggcctgtgcccggcgatggaacccactgatgggcggatgcttctgcagtacattcgagctgtccgcttcaatggcagcgcaggaacccctgtgatgttcaacgagaacggagatgcgcccgggcggtacgacatcttccagtaccaggcgaccaatggcagtgccagcagtggcgggtaccaggcagtgggccagtgggcagagaccctcagactggatgtggaggccctgcagtggtctggcgacccccacgaggtgccctcgtctctgtgcagcctgccctgcgggccgggggagcggaagaagatggtgaagggcgtcccctgctgttggcactgcgaggcctgtgacgggtaccgcttccaggtggacgagttcacatgcgaggcctgtcctggggacatgaggcccacgcccaaccacacgggctgccgccccacacctgtggtgcgcctgagctggtcctccccctgggcagccccgccgctcctcctggccgtgctgggcatcgtggccactaccacggtggtggccaccttcgtgcggtacaacaacacgcccatcgtccgggcctcgggccgagagctcagctacgtcctcctcaccggcatcttcctcatctacgccatcaccttcctcatggtggctgagcctggggccgcggtctgtgccgcccgcaggctcttcctgggcctgggcacgaccctcagctactctgccctgctcaccaagaccaaccgtatctaccgcatctttgagcagggcaagcgctcggtcacaccccctcccttcatcagccccacctcacagctggtcatcaccttcagcctcacctccctgcaggtggtggggatgatagcatggctgggggcccggcccccacacagcgtgattgactatgaggaacagcggacggtggaccccgagcaggccagaggggtgctcaagtgcgacatgtcggatctgtctctcatcggctgcctgggctacagcctcctgctcatggtcacgtgcacagtgtacgccatcaaggcccgtggcgtgcccgagaccttcaacgaggccaagcccatcggcttcaccatgtacaccacctgcatcatctggctggcattcgtgcccatcttctttggcactgcccagtcagctgaaaagatctacatccagacaaccacgctaaccgtgtccttgagcctgagtgcctcggtgtccctcggcatgctctacgtacccaaaacctacgtcatcctcttccatccagagcagaatgtgcagaagcgaaagcggagcctcaaggccacctccacggtggcagccccacccaagggcgaggatgcagaggcccacaagtagcagggcaggtgggaacgggactgcttgctgcctctcctttcttcctcttgcctcgaggtggaagctgtatagagcccgggtccacggtgaacagtcagtggcagggagtttgccaagaccatgctccgcgtcggtggggctggccttgagaaggaactggacccagctctaccccgattccagcatgtgagcttcatgcttcctcaccacagaccagactcgcttcccatggtgggaaacagccaccgagaaggttctagctctagaaagggactaaacttattctctcatccgaagtccaaagaggatgatgaagccctgggctttgcctggtttgcgggagatttcctcccctcagtcaacccccataacctggggattgggcagtgtggaagaacgtgtagaccccagaatgaaacatggggttggagtggaggaggagctgtctcagcaagaggagacctggggctgtgcatctggatggaggcactcaggcctgggtaggattcctctggcacggagggagagaccctgggtgagacccctgtgagcatgggaagggcctgcagtgggcgcgggagtgagctgaggaactggggtgcgcccccatgagattcccaatgccatgggctttcccccatccccccgggattgggcaaggtcagacttagagtacagctgttttcctcccctctgtgtactcccttaaatcaccccaaccttggccaggcatggtggctcacacctgtaatcccagcactttgggaggccgaggcaggtggatcacctgaggtccggagttcgagaccagcctggccaatgtggtgaaaccctgtctctactaaaaatacaaaaattagccaggtgtgatggtgggtgcctgtaatcccagttacttgggaggctgaggcaggagaatcgcttgaacctgggaggtggaggttgcagtgagctgtgattgtgccactgtactccagcctgggtgacagagcgagactctgtctcaaaaaaacaaaacaaaaaaacaccaaaaaaacccccaaacctgaagaaattcagatacacgtgtgtaatgttagtgatgtgagaacaaggagcaggggtgcatttgtgttgtgttcgggttggggatgggtttaggagctccaggttgggagcagtgacagagagtcatggccgtggtgagggtgaatcccaagtggatggctcaggacgggtatggaaacccttcattcctcataggtactgggaagtccatttgcaagctgagcgccaggcctggggaggaagaggcttgggctgcagatgcacgcacatttgtttttcactgatagtttttacaaaaagcttggtttaagttatggagttttatgtccctgggagtagaatttacatttgttaaattgaccactgtttaagatcagtatacattctctagtctgtgatgtctggagctagttttgagggtgaaccacactttatccaacatacaaactttcccatgcagcttctctggtgcgcagttggttttgaccgtgggactaggtgcttctgcaggttttaagtaattaacttaaaagcttctcctctgagaaacatttctgttgcgctactgactctccttctccacatttgttgtgttcctagggcttctctatagtgcacattaggacgtttcatttgttgctgaatgctttccagaattatttattccatagggtttctctcctgtgcagctctctcatgggtaatggggcgtgttttcttgccaaaggcggttccaccctcgtgattgtatagggctcttctcctgtatgaactctgagatcagtgagctctgatctccaagggaaagttttcctgcatttgctgttttctcatgtctctcccagtgtgaattctttggtgtgcagtgcgctctggcttctagctgaaaacttttccacagttttacattcatgtggttttctccactgtgaactctgtgattcagaatcagaagcagttcttagtagaggcatttctacactgattgcactgaggatttctccccagtgtgaagtttctggcatagagtcctggcttcccgcagacgactttcacactctgccatgttcatgcctgtgggcctctctggcaggaactctgatgcaccgcgaggcccatgtactcctgtggctttctcacattcggtctacttgcagggtatctccacagcatgcaccattctgggtacagggggacatcctctgttactgaagatgttgtcatatttagtaccttcacaaggtttctctccttccagaattttctgatgtacacaaataactgacttccacaagagggcttttccacactcggtgtgtgcatacagtttctgcctgtgatcatttctttatgttattattttattttttcgagatagggtcttgctcaatttcttaggctggagtgcagtggcacgatcatagctcactgaagtttcgacctgggctcaagcaatcctcccgcttcagcctcctgagtagctggtgcgcacgaccatacccagctaatgttttattttttgtagagacgaggtctcactatgttgcccaggctggtctcgaacttctgagctcgagcgatcctcctgcctccacctcccaaagtgttcggattacaaacgtgagccatcgcacctagcctctttgatcatttctgtggtgttcagtggaggttgacagctccctaaagattttcctgtttttttgcatgcatgggtttgaattctttgaggtccaatttatttggacccctgaataaagttttgtgggttttcttctatgtgtggaatttataaggcattcttccagtgtggtttctcttatgtcgagtgagagctgacctgcaccgaaggttttgtcccatttgttgcccttgaattatttgtatgaattatatgttccagtgaaaatggagttctgggttggaggcttattccatgtttacacaattaaaattgcagtgttcctctctgggatgagagctctaaagcagagtaagattacgttctgatgtaagctttaaccacctatttataaggtctcacctgtggtccactgtgttgagacttctacagaagagcttctgtatagtaaccattttcttaggctgtctcacttgtgtgaatcttctgacacatttattatagctttgtcccatttcttatcctttttgctctttagaaatttccctttaatttattacattcattgcttactgtaaagagtccaggtaactgactttattcagttacttcctgttcaataaatttaacttttcccaaaa

SEQ ID NO: 12357 - DNA, 3273 bp, Homo sapiens
atgcagctggatgggctgcaggccctctgctgggggtccttgttcaggacacagcttgtaccagtatatgtggcggtcctgccctctccccagccctgcatacctcccacctgcacagcattcacggaattctcaggcccactcgcaaaacaccacagcttccagcctttccaggtggctgctccagctggccccaggtccccaccccaacccttccatctcccatctgtgtcccaggtccatgccacacaccttctgtgccccgtccgtgtcctgggccccccttaccctccctctcttgagttactgacctccatccacagcccagctgtccttcctgccccacagataccccagatcagctatgcctccacagccccggagctcagcgactccacacgctatgacttcttctcccgggtggtgccacccgactcctaccaggcgcaggccatggtggacatcgtgagggcactgggatggaactatgtgtccacgctggcctccgagggcaactatggcgaaagtggggttgaggccttcgttcagatctcccgagaggctggtgagctgggggctccgaggcaccaaggagtctacatagtgtgggcccggggccctcagttggggcagaagcagaaagatggggggcccaggtccatgctgggccgaggttgcctggctggtgctccatgtgggcgggacctctttgttttggacgactcagccctgcctcaggcttggcggagggtgcaggccagacttcacccctgcagacccttcagccagcctacacagtcctctgcagcggtggccaggtggtctatcaagattcccagggaaccaaagccaggagagttcagcaaggtgatcaggagactcatggagacgcccaacgcccggggcatcatcatctttgccaatgaggatgacatcagccctgctcctaccaggcgggtcctggaggcagctcgccaggccaacctgaccggccacttcctgtgggtcggctcagacagctggggagccaagacctcacccatcttgagcctggaggacgtggccgttggggccatcaccatcctgcccaaaagggcctccatcgacggatttgaccagtacttcatgactcgatccctggagaacaaccgcaggaacatctggttcgccgagttctgggaagagaattttaactgcaaactgaccagctcaggtacccagtcagacgattccacccgcaaatgcacaggtgagagctgcccagggtggacaggcgaggaacgcatcggccgggactccacctacgagcaggagggcaaggtgcagtttgtgattgatgcggtgtacgccattgcccacgccctccacagcatgcaccaggcgctctgccctgggcacacaggcctgtgcccggcgatggaacccactgatgggcggatgcttctgcagtacattcgatgtccgcttcaatggctgaatcgcatcccattgtgtgaatggccccgtcgtgttcgtccattcttctgtcagtggacgctcgggttgctttcatcttgtggctatgtgaataacgctgctgtgaacgtggctgtacaagcatttcttgccaccctgctttctagtctctcgagtatctacccgggagtggaactgctgggtcatgtgtttaatcttttgaggaggctccacactgttttctgcagcggctgcagccttttcccacccaccgtgcacaagggcagcgcaggaacccctgtgatgttcaacgagaacggagatgcgcccgggcggtacgacatcttccagtaccaggcgaccaatggcagtgccagcagtggcgggtaccaggcagtgggccagtgggcagagaccctcagactggatgtgagtgtgcagaccgagccccaggtgggcatgggcccaggatcccggaggcagacgccccagcctgtgttttgtgcgtcccaggtggaggccctgcagtggtctggcgacccccacgaggtgccctcgtctctgtgcagcctgccctgcgggccgggggagcggaagaagatggtgaagggcgtcccctgctgttggcactgcgaggcctgtgacgggtaccgcttccaggtggacgagttcacatgcgaggcctgtcctggggacatgaggcccacgcccaaccacacgggctgccgccccacacctgtggtgcgcctgagctggtcctccccctgggcagccccgccgctcctcctggccgtgctgggcatcgtggccactaccacggtggtggccaccttcgtgcggtacaacaacacgcccatcgtccgggcctcgggccgagagctcagctacgtcctcctcaccggcatcttcctcatctacgccatcaccttcctcatggtggctgagcctggggccgcggtctgtgccgcccgcaggctcttcctgggcctgggcacgaccctcagctactctgccctgctcaccaagaccaaccgtatctaccgcatctttgagcagggcaagcgctcggtcacaccccctcccttcatcagccccacctcacagctggtcatcaccttcagcctcacctccctgcagataaatgccgtttttagagtcactcttttctattttggttccttgcagtggcactatctcagctccctgcaagctctgccttccggagatctttctgtacaacacctgagtgcctcggtgtccctcggcatgctctactccaagagcaagacaccagtggatttggaggtggggagtgagccatggggatatctgggggatggggtcctgcaggcggagcactggggtgaggggcggggagactggcctcatgtgaaggtcatggtcgtggtgtaccagagcagtcttgtgtactacatgaagcaggcgcaggctggacgtgtgaagacagagctgctgaaggtggcacatcaccaggtggccaagtctgtccctgaagagtcccaaatcgtggtccttcatcttgtcacagctgggtatgtcgacatggccattaggactacaagagcaagcctgcacttaatgccgctgacgctagttcctggagccgcggctgaggtgaatgagactcaagtggctgcacgccttggtcctggctcaacggtaggcacataccaagtagtggtagttctcatgcgttcattacagatagacaaaaccaccaaccaactcagcttagaaacgtgcttctcagggattcaagggtttctcgccagtgtgaattctttggtgatggataag

SEQ ID NO: 12358 - DNA, 2673 bp, Homo sapiens
tgaaccgacagcggctggcgcagcccgctagacgagccgatggcgcggccccggagagcccgggagccgctgctcgtggcgctgctgccgctggcgtggctggcgcaggcgggcctggcgcgcgcggcgggctctgtgcgcctggcgggcggcctgacgctgggcggcctgttcccggtgcacgcgcggggcgcggcgggccgggcgtgcgggcagctgaagaaggagcagggcgtgcaccggctggaggccatgctgtacgcgctggaccgcgtcaacgccgaccccgagctgctgcccggcgtgcgcctgggcgcgcggctgctggacacctgctcgcgggacacctacgcgctggagcaggcgctgagcttcgtgcaggcgctgatccgcggccgcggcgacggcgacgaggtgggcgtgcgctgcccgggaggcgtccctccgctgcgccccgcgccccccgagcgcgtcgtggccgtcgtgggcgcctcggccagctccgtctccatcatggtcgccaacgtgctgcgcctgtttgcgataccccagatcagctatgcctccacagccccggagctcagcgactccacacgctatgacttcttctcccgggtggtgccacccgactcctaccaggcgcaggccatggtggacatcgtgagggcactgggatggaactatgtgtccacgctggcctccgagggcaactatggcgaaagtggggttgaggccttcgttcagatctcccgagaggctgggggggtctgtattgcccagtctatcaagattcccagggaaccaaagccaggagagttcagcaaggtgatcaggagactcatggagacgcccaacgcccggggcatcatcatctttgccaatgaggatgacatcaggcgggtcctggaggcagctcgccaggccaacctgaccggccacttcctgtgggtcggctcagacagctggggagccaagacctcacccatcttgagcctggaggacgtggccgttggggccatcaccatcctgcccaaaagggcctccatcgacggatttgaccagtacttcatgactcgatccctggagaacaaccgcaggaacatctggttcgccgagttctgggaagagaattttaactgcaaactgaccagctcaggtacccagtcagacgattccacccgcaaatgcacaggcgaggaacgcatcggccgggactccacctacgagcaggagggcaaggtgcagtttgtgattgatgcggtgtacgccattgcccacgccctccacagcatgcaccaggcgctctgccctgggcacacaggcctgtgcccggcgatggaacccactgatgggcggatgcttctgcagtacattcgagctgtccgcttcaatggcagcgcaggaacccctgtgatgttcaacgagaacggagatgcgcccgggcggtacgacatcttccagtaccaggcgaccaatggcagtgccagcagtggcgggtaccaggcagtgggccagtgggcagagaccctcagactggatgtggaggccctgcagtggtctggcgacccccacgaggtgccctcgtctctgtgcagcctgccctgcgggccgggggagcggaagaagatggtgaagggcgtcccctgctgttggcactgcgaggcctgtgacgggtaccgcttccaggtggacgagttcacatgcgaggcctgtcctggggacatgaggcccacgcccaaccacacgggctgccgccccacacctgtggtgcgcctgagctggtcctccccctgggcagccccgccgctcctcctggccgtgctgggcatcgtggccactaccacggtggtggccaccttcgtgcggtacaacaacacgcccatcgtccgggcctcgggccgagagctcagctacgtcctcctcaccggcatcttcctcatctacgccatcaccttcctcatggtggctgagcctggggccgcggtctgtgccgcccgcaggctcttcctgggcctgggcacgaccctcagctactctgccctgctcaccaagaccaaccgtatctaccgcatctttgagcagggcaagcgctcggtcacaccccctcccttcatcagccccacctcacagctggtcatcaccttcagcctcacctccctgcaggtggtggggatgatagcatggctgggggcccggcccccacacagcgtgattgactatgaggaacagcggacggtggaccccgagcaggccagaggggtgctcaagtgcgacatgtcggatctgtctctcatcggctgcctgggctacagcctcctgctcatggtcacgtgcacagtgtacgccatcaaggcccgtggcgtgcccgagaccttcaacgaggccaagcccatcggcttcaccatgtacaccacctgcatcatctggctggcattcgtgcccatcttctttggcactgcccagtcagctgaaaagatctacatccagacaaccacgctaaccgtgtccttgagcctgagtgcctcggtgtccctcggcatgctctacgtacccaaaacctacgtcatcctcttccatccagagcagaatgtgcagaagcgaaagcggagcctcaaggccacctccacggtggcagccccacccaagggcgaggatgcagaggcccacaagtag

SEQ ID NO: 12359 - DNA, 4127 bp, Homo sapiens
agtgctgggctgttggagagagcgagcagcaagccggtgagcgcgagcgcggcgcgccggccggctaacccgagagcgcgaggcgccccaggctggcaggcgccgcgggacccctcaccctctctggtcgcccctccccggattcccccaccctccgtgcctgcaggagcccctgggctttcccggaggagctcgccctgaagggcccggacctcggcgagcccaccaccgttccctccagcgccgccgccgccaccgcagcagccggagcagcatggtccagctgaggaagctgctccgcgtcctgactttgatgaagttcccctgctgcgtgctggaggtgctcctgtgcgcgctggcggcggcggcgcgcggccaggagatgtacgccccgcactcaatccggatcgagggggacgtcaccctcggggggctgttccccgtgcacgccaagggtcccagcggagtgccctgcggcgacatcaagagggaaaacgggatccacaggctggaagcgatgctctacgccctggaccagatcaacagtgatcccaacctactgcccaacgtgacgctgggcgcgcggatcctggacacttgttccagggacacttacgcgctcgaacagtcgcttactttcgtccaggcgctcatccagaaggacacctccgacgtgcgctgcaccaacggcgaaccgccggttttcgtcaagccggagaaagtagttggagtgattggggcttcggggagttcggtctccatcatggtagccaacatcctgaggctcttccagatcccccagattagttatgcatcaacggcacccgagctaagtgatgaccggcgctatgacttcttctctcgcgtggtgccacccgattccttccaagcccaggccatggtagacattgtaaaggccctaggctggaattatgtgtctaccctcgcatcggaaggaagttatggagagaaaggtgtggagtccttcacgcagatttccaaagaggcaggtggactctgcattgcccagtccgtgagaatcccccaggaacgcaaagacaggaccattgactttgatagaattatcaaacagctcctggacacccccaactccagggccgtcgtgatttttgccaacgatgaggatataaagcagatccttgcagcagccaaaagagctgaccaagttggccattttctttgggtgggatcagacagctggggatccaaaataaacccactgcaccagcatgaagatatcgcagaaggggccatcaccattcagcccaagcgagccacggtggaagggtttgatgcctactttacgtcccgtacacttgaaaacaacagaagaaatgtatggtttgccgaatactgggaggaaaacttcaactgcaagttgacgattagtgggtcaaaaaaagaagacacagatcgcaaatgcacaggacaggagagaattggaaaagattccaactatgagcaggagggtaaagtccagttcgtgattgacgcagtctatgctatggctcacgcccttcaccacatgaacaaggatctctgtgctgactaccggggtgtctgcccagagatggagcaagctggaggcaagaagttgctgaagtatatacgcaatgttaatttcaatggtagtgctggcactccagtgatgtttaacaagaacggggatgcacctgggcgttatgacatctttcagtaccagaccacaaacaccagcaacccgggttaccgtctgatcgggcagtggacagacgaacttcagctcaatatagaagacatgcagtggggtaaaggagtccgagagatacccgcctcagtgtgcacactaccatgtaagccaggacagagaaagaagacacagaaaggaactccttgctgttggacctgtgagccttgcgatggttaccagtaccagtttgatgagatgacatgccagcattgcccctatgaccagaggcccaatgaaaatcgaaccggatgccaggatattcccatcatcaaactggagtggcactccccctgggctgtgattcctgtcttcctggcaatgttggggatcattgccaccatctttgtcatggccactttcatccgctacaatgacacgcccattgtccgggcatctgggcgggaactcagctatgttcttttgacgggcatctttctttgctacatcatcactttcctgatgattgccaaaccagatgtggcagtgtgttctttccggcgagttttcttgggcttgggtatgtgcatcagttatgcagccctcttgacgaaaacaaatcggatttatcgcatatttgagcagggcaagaaatcagtaacagctcccagactcataagcccaacatcacaactggcaatcacttccagtttaatatcagttcagcttctaggggtgttcatttggtttggtgttgatccacccaacatcatcatagactatgatgaacacaagacaatgaaccctgagcaagccagaggggttctcaagtgtgacattacagatctccaaatcatttgctccttgggatatagcattcttctcatggtcacatgtactgtgtatgccatcaagactcggggtgtacccgagaattttaacgaagccaagcccattggattcactatgtacacgacatgtatagtatggcttgccttcattccaattttttttggcaccgctcaatcagcggaaaagctctacatacaaactaccacgcttacaatctccatgaacctaagtgcatcagtggcgctggggatgctatacatgccgaaagtgtacatcatcattttccaccctgaactcaatgtccagaaacggaagcgaagcttcaaggcggtagtcacagcagccaccatgtcatcgaggctgtcacacaaacccagtgacagacccaacggtgaggcaaagaccgagctctgtgaaaacgtagacccaaacagccctgctgcaaaaaagaagtatgtcagttataataacctggttatctaacctgttccattccatggaaccatggaggaggaagaccctcagttattttgtcacccaacctggcataggactctttggtcctacccgcttcccatcaccggaggagcttccccggccgggagaccagtgttagaggatccaagcgacctaaacagctgctttatgaaatatccttactttatctgggcttaataagtcactgacatcagcactgccaactcggctgcaattgtggaccttccctaccaaagggagtgttgaaactcaagtcccgccctggctctttagaatggaccactgagagccacaggaccgttttggggctgacctgtcttattacgtatgtacttctaggttgcaaggttttgaaattttctgtacagtttgtgaggacctttgcactttgccatctgatgtcgtacctcggttcactgtttgttttcgaatgccttgttttcatagagccctattctctcagacggtggaatatttggaaaaattttaaaacaattaaaattttaaagcaatcttggcagactaaaacaagtacatctgtacatgactgtataattacgattatagtaccactgcacatcatgtttttttttttaagacaaaaaagatgtttaaagaccaaaaactgtgctgagaaagtatgccccacctatctttggtatatgataggttacataaaaggaaggtattggctgaactgaatagaggtcttgatctttggaatgcatgccagtaatgtattttacagtacatgtttattatgttcaatatttgtatttgtgttctcttttgttatttttaattagggtatatgaatattttgcaataattttaataattattaagctgtttgaaggaaagaatatggatttttcatgtcttgaggttttgttcatgccccctttgactgatcagtgtgataaggactttaggaaaaaaagcatgtatgttttttactgtttgtaataagtactttcgttaatcttgctgcttatgtgccaatttagtggaaaaaaacaacccttgctgaaaaattccctctttccattctctttcaattctgtgatattgtccaagaatgtatcaataa

SEQ ID NO: 12360 - DNA, 2901 bp, Homo sapiens
ggtcgcccctccccggattcccccaccctccgtgcctgcaggagcccctgggctttcccggaggagctcgccctgaagggcccggacctcggcgagcccaccaccgttccctccagcgccgccgccgccaccgcagcagccggagcagcatggtccagctgaggaagctgctccgcgtcctgactttgatgaagttcccctgctgcgtgctggaggtgctcctgtgcgcgctggcggcggcggcgcgcggccaggagatgtacgccccgcactcaatccggatcgagggggacgtcaccctcggggggctgttccccgtgcacgccaagggtcccagcggagtgccctgcggcgacatcaagagggaaaacgggatccacaggctggaagcgatgctctacgccctggaccagatcaacagtgatcccaacctactgcccaacgtgacgctgggcgcgcggatcctggacacttgttccagggacacttacgcgctcgaacagtcgcttactttcgtccaggcgctcatccagaaggacacctccgacgtgcgctgcaccaacggcgaaccgccggttttcgtcaagccggagaaagtagttggagtgattggggcttcggggagttcggtctccatcatggtagccaacatcctgaggctcttccagatcccccagattagttatgcatcaacggcacccgagctaagtgatgaccggcgctatgacttcttctctcgcgtggtgccacccgattccttccaagcccaggccatggtagacattgtaaaggccctaggctggaattatgtgtctaccctcgcatcggaaggaagttatggagagaaaggtgtggagtccttcacgcagatttccaaagaggcaggtggactctgcattgcccagtccgtgagaatcccccaggaacgcaaagacaggaccattgactttgatagaattatcaaacagctcctggacacccccaactccagggccgtcgtgatttttgccaacgatgaggatataaagcagatccttgcagcagccaaaagagctgaccaagttggccattttctttgggtgggatcagacagctggggatccaaaataaacccactgcaccagcatgaagatatcgcagaaggggccatcaccattcagcccaagcgagccacggtggaagggtttgatgcctactttacgtcccgtacacttgaaaacaacagaagaaatgtatggtttgccgaatactgggaggaaaacttcaactgcaagttgacgattagtgggtcaaaaaaagaagacacagatcgcaaatgcacaggacaggagagaattggaaaagattccaactatgagcaggagggtaaagtccagttcgtgattgacgcagtctatgctatggctcacgcccttcaccacatgaacaaggatctctgtgctgactaccggggtgtctgcccagagatggagcaagctggaggcaagaagttgctgaagtatatacgcaatgttaatttcaatggtagtgctggcactccagtgatgtttaacaagaacggggatgcacctgggcgttatgacatctttcagtaccagaccacaaacaccagcaacccgggttaccgtctgatcgggcagtggacagacgaacttcagctcaatatagaagacatgcagtggggtaaaggagtccgagagatacccgcctcagtgtgcacactaccatgtaagccaggacagagaaagaagacacagaaaggaactccttgctgttggacctgtgagccttgcgatggttaccagtaccagtttgatgagatgacatgccagcattgcccctatgaccagaggcccaatgaaaatcgaaccggatgccaggatattcccatcatcaaactggagtggcactccccctgggctgtgattcctgtcttcctggcaatgttggggatcattgccaccatctttgtcatggccactttcatccgctacaatgacacgcccattgtccgggcatctgggcgggaactcagctatgttcttttgacgggcatctttctttgctacatcatcactttcctgatgattgccaaaccagatgtggcagtgtgttctttccggcgagttttcttgggcttgggtatgtgcatcagttatgcagccctcttgacgaaaacaaatcggatttatcgcatatttgagcagggcaagaaatcagtaacagctcccagactcataagcccaacatcacaactggcaatcacttccagtttaatatcagttcagcttctaggggtgttcatttggtttggtgttgatccacccaacatcatcatagactatgatgaacacaagacaatgaaccctgagcaagccagaggggttctcaagtgtgacattacagatctccaaatcatttgctccttgggatatagcattcttctcatggtcacatgtactgtgtatgccatcaagactcggggtgtacccgagaattttaacgaagccaagcccattggattcactatgtacacgacatgtatagtatggcttgccttcattccaattttttttggcaccgctcaatcagcggaaaagctctacatacaaactaccacgcttacaatctccatgaacctaagtgcatcagtggcgctggggatgctatacatgccgaaagtgtacatcatcattttccaccctgaactcaatgtccagaaacggaagcgaagcttcaaggcggtagtcacagcagccaccatgtcatcgaggctgtcacacaaacccagtgacagacccaacggtgaggcaaagaccgagctctgtgaaaacgtagacccaaacagtgagaagtgcaactgctactgaccatctgcactggcatctagtcaagcgattg

SEQ ID NO: 12361 - DNA, 2769 bp, Homo sapiens
atggtccagctgaggaagctgctccgcgtcctgactttgatgaagttcccctgctgcgtgctggaggtgctcctgtgcgcgctggcggcggcggcgcgcggccaggagatgtacgccccgcactcaatccggatcgagggggacgtcaccctcggggggctgttccccgtgcacgccaagggtcccagcggagtgccctgcggcgacatcaagagggaaaacgggatccacaggctggaagcgatgctctacgccctggaccagatcaacagtgatcccaacctactgcccaacgtgacgctgggcgcgcggatcctggacacttgttccagggacacttacgcgctcgaacagtcgcttactttcgtccaggcgctcatccagaaggacacctccgacgtgcgctgcaccaacggcgaaccgccggttttcgtcaagccggagaaagtagttggagtgattggggcttcggggagttcggtctccatcatggtagccaacatcctgaggctcttccagatcccccagattagttatgcatcaacggcacccgagctaagtgatgaccggcgctatgacttcttctctcgcgtggtgccacccgattccttccaagcccaggccatggtagacattgtaaaggccctaggctggaattatgtgtctaccctcgcatcggaaggaagttatggagagaaaggtgtggagtccttcacgcagatttccaaagaggcaggtggactctgcattgcccagtccgtgagaatcccccaggaacgcaaagacaggaccattgactttgatagaattatcaaacagctcctggacacccccaactccagggccgtcgtgatttttgccaacgatgaggatataaagcagatccttgcagcagccaaaagagctgaccaagttggccattttctttgggtgggatcagacagctggggatccaaaataaacccactgcaccagcatgaagatatcgcagaaggggccatcaccattcagcccaagcgagccacggtggaagggtttgatgcctactttacgtcccgtacacttgaaaacaacagaagaaatgtatggtttgccgaatactgggaggaaaacttcaactgcaagttgacgattagtgggtcaaaaaaagaagacacagatcgcaaatgcacaggacaggagagaattggaaaagattccaactatgagcaggagggtaaagtccagttcgtgattgacgcagtctatgctatggctcacgcccttcaccacatgaacaaggatctctgtgctgactaccggggtgtctgcccagagatggagcaagctggaggcaagaagttgctgaagtatatacgcaatgttaatttcaatggtagtgctggcactccagtgatgtttaacaagaacggggatgcacctgggcgttatgacatctttcagtaccagaccacaaacaccagcaacccgggttaccgtctgatcgggcagtggacagacgaacttcagctcaatatagaagacatgcagtggggtaaaggagtccgagagatacccgcctcagtgtgcacactaccatgtaagccaggacagagaaagaagacacagaaaggaactccttgctgttggacctgtgagccttgcgatggttaccagtaccagtttgatgagatgacatgccagcattgcccctatgaccagaggcccaatgaaaatcgaaccggatgccaggatattcccatcatcaaactggagtggcactccccctgggctgtgattcctgtcttcctggcaatgttggggatcattgccaccatctttgtcatggccactttcatccgctacaatgacacgcccattgtccgggcatctgggcgggaactcagctatgttcttttgacgggcatctttctttgctacatcatcactttcctgatgattgccaaaccagatgtggcagtgtgttctttccggcgagttttcttgggcttgggtatgtgcatcagttatgcagccctcttgacgaaaacaaatcggatttatcgcatatttgagcagggcaagaaatcagtaacagctcccagactcataagcccaacatcacaactggcaatcacttccagtttaatatcagttcagcttctaggggtgttcatttggtttggtgttgatccacccaacatcatcatagactatgatgaacacaagacaatgaaccctgagcaagccagaggggttctcaagtgtgacattacagatctccaaatcatttgctccttgggatatagcattcttctcatggtcacatgtactgtgtatgccatcaagactcggggtgtacccgagaattttaacgaagccaagcccattggattcactatgtacacgacatgtatagtatggcttgccttcattccaattttttttggcaccgctcaatcagcggaaaagctctacatacaaactaccacgcttacaatctccatgaacctaagtgcatcagtggcgctggggatgctatacatgccgaaagtgtacatcatcattttccaccctgaactcaatgtccagaaacggaagcgaagcttcaaggcggtagtcacagcagccaccatgtcatcgaggctgtcacacaaacccagtgacagacccaacggtgaggcaaagaccgagctctgtgaaaacgtagacccaaacaactgtataccaccagtaagaaagagtgtacaaaagtctgttacttggtacactatcccaccaacagtatag

SEQ ID NO: 12362 - DNA, 2736 bp, Homo sapiens
atggtccagctgaggaagctgctccgcgtcctgactttgatgaagttcccctgctgcgtgctggaggtgctcctgtgcgcgctggcggcggcggcgcgcggccaggagatgtacgccccgcactcaatccggatcgagggggacgtcaccctcggggggctgttccccgtgcacgccaagggtcccagcggagtgccctgcggcgacatcaagagggaaaacgggatccacaggctggaagcgatgctctacgccctggaccagatcaacagtgatcccaacctactgcccaacgtgacgctgggcgcgcggatcctggacacttgttccagggacacttacgcgctcgaacagtcgcttactttcgtccaggcgctcatccagaaggacacctccgacgtgcgctgcaccaacggcgaaccgccggttttcgtcaagccggagaaagtagttggagtgattggggcttcggggagttcggtctccatcatggtagccaacatcctgaggctcttccagatcccccagattagttatgcatcaacggcacccgagctaagtgatgaccggcgctatgacttcttctctcgcgtggtgccacccgattccttccaagcccaggccatggtagacattgtaaaggccctaggctggaattatgtgtctaccctcgcatcggaaggaagttatggagagaaaggtgtggagtccttcacgcagatttccaaagaggcaggtggactctgcattgcccagtccgtgagaatcccccaggaacgcaaagacaggaccattgactttgatagaattatcaaacagctcctggacacccccaactccagggccgtcgtgatttttgccaacgatgaggatataaagcagatccttgcagcagccaaaagagctgaccaagttggccattttctttgggtgggatcagacagctggggatccaaaataaacccactgcaccagcatgaagatatcgcagaaggggccatcaccattcagcccaagcgagccacggtggaagggtttgatgcctactttacgtcccgtacacttgaaaacaacagaagaaatgtatggtttgccgaatactgggaggaaaacttcaactgcaagttgacgattagtgggtcaaaaaaagaagacacagatcgcaaatgcacaggacaggagagaattggaaaagattccaactatgagcaggagggtaaagtccagttcgtgattgacgcagtctatgctatggctcacgcccttcaccacatgaacaaggatctctgtgctgactaccggggtgtctgcccagagatggagcaagctggaggcaagaagttgctgaagtatatacgcaatgttaatttcaatggtagtgctggcactccagtgatgtttaacaagaacggggatgcacctgggcgttatgacatctttcagtaccagaccacaaacaccagcaacccgggttaccgtctgatcgggcagtggacagacgaacttcagctcaatatagaagacatgcagtggggtaaaggagtccgagagatacccgcctcagtgtgcacactaccatgtaagccaggacagagaaagaagacacagaaaggaactccttgctgttggacctgtgagccttgcgatggttaccagtaccagtttgatgagatgacatgccagcattgcccctatgaccagaggcccaatgaaaatcgaaccggatgccaggatattcccatcatcaaactggagtggcactccccctgggctgtgattcctgtcttcctggcaatgttggggatcattgccaccatctttgtcatggccactttcatccgctacaatgacacgcccattgtccgggcatctgggcgggaactcagctatgttcttttgacgggcatctttctttgctacatcatcactttcctgatgattgccaaaccagatgtggcagtgtgttctttccggcgagttttcttgggcttgggtatgtgcatcagttatgcagccctcttgacgaaaacaaatcggatttatcgcatatttgagcagggcaagaaatcagtaacagctcccagactcataagcccaacatcacaactggcaatcacttccagtttaatatcagttcagcttctaggggtgttcatttggtttggtgttgatccacccaacatcatcatagactatgatgaacacaagacaatgaaccctgagcaagccagaggggttctcaagtgtgacattacagatctccaaatcatttgctccttgggatatagcattcttctcatggtcacatgtactgtgtatgccatcaagactcggggtgtacccgagaattttaacgaagccaagcccattggattcactatgtacacgacatgtatagtatggcttgccttcattccaattttttttggcaccgctcaatcagcggaaaagctctacatacaaactaccacgcttacaatctccatgaacctaagtgcatcagtggcgctggggatgctatacatgccgaaagtgtacatcatcattttccaccctgaactcaatgtccagaaacggaagcgaagcttcaaggcggtagtcacagcagccaccatgtcatcgaggctgtcacacaaacccagtgacagacccaacggtgaggcaaagaccgagctctgtgaaaacgtagacccaaacataacctctgaggacctcagcttgcacaaagaggattga

SEQ ID NO: 12363 - DNA, 2472 bp, Homo sapiens
atggtccagctgaggaagctgctccgcgtcctgactttgatgaagttcccctgctgcgtgctggaggtgctcctgtgcgcgctggcggcggcggcgcgcggccaggagatgtacgccccgcactcaatccggatcgagggggacgtcaccctcggggggctgttccccgtgcacgccaagggtcccagcggagtgccctgcggcgacatcaagagggaaaacgggatccacaggctggaagcgatgctctacgccctggaccagatcaacagtgatcccaacctactgcccaacgtgacgctgggcgcgcggatcctggacacttgttccagggacacttacgcgctcgaacagtcgcttactttcgtccaggcgctcatccagaaggacacctccgacgtgcgctgcaccaacggcgaaccgccggttttcgtcaagccggagaaagtagttggagtgattggggcttcggggagttcggtctccatcatggtagccaacatcctgaggctcttccagatcccccagattagttatgcatcaacggcacccgagctaagtgatgaccggcgctatgacttcttctctcgcgtggtgccacccgattccttccaagcccaggccatggtagacattgtaaaggccctaggctggaattatgtgtctaccctcgcatcggaaggaagttatggagagaaaggtgtggagtccttcacgcagatttccaaagaggcaggtggactctgcattgcccagtccgtgagaatcccccaggaacgcaaagacaggaccattgactttgatagaattatcaaacagctcctggacacccccaactccagggccgtcgtgatttttgccaacgatgaggatataaagcagatccttgcagcagccaaaagagctgaccaagttggccattttctttgggtgggatcagacagctggggatccaaaataaacccactgcaccagcatgaagatatcgcagaaggggccatcaccattcagcccaagcgagccacggtggaagggtttgatgcctactttacgtcccgtacacttgaaaacaacagaagaaatgtatggtttgccgaatactgggaggaaaacttcaactgcaagttgacgattagtgggtcaaaaaaagaagacacagatcgcaaatgcacaggacaggagagaattggaaaagattccaactatgagcaggagggtaaagtccagttcgtgattgacgcagtctatgctatggctcacgcccttcaccacatgaacaaggatctctgtgctgactaccggggtgtctgcccagagatggagcaagctggaggcaagaagttgctgaagtatatacgcaatgttaatttcaatggtgatgctggcactccagtgatgtttaacaagaacggggatgcacctgggcgttatgacatctttcagtaccagaccacaaacaccagcaacccgggttaccgtctgatcgggcagtggacagacgaacttcagctcaatatagaagacatgcagtggggtaaaggagtccgagagatacccgcctcagtgtgcacactaccatgtaagccaggacagagaaagaagacacagaaaggaactccttgctgttggacctgtgagccttgcgatggttaccagtaccagtttgatgagatgacatgccagcattgcccctatgaccagaggcccaatgaaaatcgaaccggatgccaggatattcccatcatcaaactggagtggcactccccctgggctgtgattcctgtcttcctggcaatgttggggatcattgccaccatctttgtcatggccactttcatccgctacaatgacacgcccattgtccgggcatctgggcgggaactcagctatgttcttttgacgggcatctttctttgctacatcatcactttcctgatgattgccaaaccagatgtggcagtgtgttctttccggcgagttttcttgggcttgggtatgtgcatcagttatgcagccctcttgacgaaaacaaatcggatttatcgcatatttgagcagggcaagaaatcagtaacagctcccagactcataagcccaacatcacaactggcaatcacttccagtttaatatcagttcagcttctaggggtgttcatttggtttggtgttgatccacccaacatcatcatagactatgatgaacacaagacaatgaaccctgagcaagccagaggggttctcaagtgtgacattacagatctccaaatcatttgctccttgggatatagcattcttctcatggtcacatgtactgtgtatgccatcaagactcggggtgtacccgagaattttaacgaagccaagcccattggattcactatgtacacgacatgtatagtatggcttgccttcattccaattttttttggcaccgctcaatcagcggaaaaggtaattttatgctgtatatca

SEQ ID NO: 12364 - DNA, 2775 bp, Homo sapiens
atggtccagctgaggaagctgctccgcgtcctgactttgatgaagttcccctgctgcgtgctggaggtgctcctgtgcgcgctggcggcggcggcgcgcggccaggagatgtacgccccgcactcaatccggatcgagggggacgtcaccctcggggggctgttccccgtgcacgccaagggtcccagcggagtgccctgcggcgacatcaagagggaaaacgggatccacaggctggaagcgatgctctacgccctggaccagatcaacagtgatcccaacctactgcccaacgtgacgctgggcgcgcggatcctggacacttgttccagggacacttacgcgctcgaacagtcgcttactttcgtccaggcgctcatccagaaggacacctccgacgtgcgctgcaccaacggcgaaccgccggttttcgtcaagccggagaaagtagttggagtgattggggcttcggggagttcggtctccatcatggtagccaacatcctgaggctcttccagatcccccagattagttatgcatcaacggcacccgagctaagtgatgaccggcgctatgacttcttctctcgcgtggtgccacccgattccttccaagcccaggccatggtagacattgtaaaggccctaggctggaattatgtgtctaccctcgcatcggaaggaagttatggagagaaaggtgtggagtccttcacgcagatttccaaagaggcaggtggactctgcattgcccagtccgtgagaatcccccaggaacgcaaagacaggaccattgactttgatagaattatcaaacagctcctggacacccccaactccagggccgtcgtgatttttgccaacgatgaggatataaagcagatccttgcagcagccaaaagagctgaccaagttggccattttctttgggtgggatcagacagctggggatccaaaataaacccactgcaccagcatgaagatatcgcagaaggggccatcaccattcagcccaagcgagccacggtggaagggtttgatgcctactttacgtcccgtacacttgaaaacaacagaagaaatgtatggtttgccgaatactgggaggaaaacttcaactgcaagttgacgattagtgggtcaaaaaaagaagacacagatcgcaaatgcacaggacaggagagaattggaaaagattccaactatgagcaggagggtaaagtccagttcgtgattgacgcagtctatgctatggctcacgcccttcaccacatgaacaaggatctctgtgctgactaccggggtgtctgcccagagatggagcaagctggaggcaagaagttgctgaagtatatacgcaatgttaatttcaatggtagtgctggcactccagtgatgtttaacaagaacggggatgcacctgggcgttatgacatctttcagtaccagaccacaaacaccagcaacccgggttaccgtctgatcgggcagtggacagacgaacttcagctcaatatagaagacatgcagtggggtaaaggagtccgagagatacccgcctcagtgtgcacactaccatgtaagccaggacagagaaagaagacacagaaaggaactccttgctgttggacctgtgagccttgcgatggttaccagtaccagtttgatgagatgacatgccagcattgcccctatgaccagaggcccaatgaaaatcgaaccggatgccaggatattcccatcatcaaactggagtggcactccccctgggctgtgattcctgtcttcctggcaatgttggggatcattgccaccatctttgtcatggccactttcatccgctacaatgacacgcccattgtccgggcatctgggcgggaactcagctatgttcttttgacgggcatctttctttgctacatcatcactttcctgatgattgccaaaccagatgtggcagtgtgttctttccggcgagttttcttgggcttgggtatgtgcatcagttatgcagccctcttgacgaaaacaaatcggatttatcgcatatttgagcagggcaagaaatcagtaacagctcccagactcataagcccaacatcacaactggcaatcacttccagtttaatatcagttcagcttctaggggtgttcatttggtttggtgttgatccacccaacatcatcatagactatgatgaacacaagacaatgaaccctgagcaagccagaggggttctcaagtgtgacattacagatctccaaatcatttgctccttgggatatagcattcttctcatggtcacatgtactgtgtatgccatcaagactcggggtgtacccgagaattttaacgaagccaagcccattggattcactatgtacacgacatgtatagtatggcttgccttcattccaattttttttggcaccgctcaatcagcggaaaagctctacatacaaactaccacgcttacaatctccatgaacctaagtgcatcagtggcgctggggatgctatacatgccgaaagtgtacatcatcattttccaccctgaactcaatgtccagaaacggaagcgaagcttcaaggcggtagtcacagcagccaccatgtcatcgaggctgtcacacaaacccagtgacagacccaacggtgaggcaaagaccgagctctgtgaaaacgtagacccaaacatttttttttttggctgtacagtggaacttggattacactttaaattaactttctctaggaatcaaagtaacctctga

SEQ ID NO: 12365 - DNA, 4057 bp, Homo sapiens
gatttttaaaaatcagaactattgacatttctggtctcctcgtcgcttcaggctgaagagcggagggggatccgcgggccgagggtccccctccctgcccgcgccagggccgctgggtgacaccgaaatccagaggctcccgcccctcgggggttcctcctcccgcttcccgaggtgactggttggcgcgaagcgattggcgatcccgggcgcgatcctggccgcggctccccgcgccgcgccgggtgaatggccgcgggcggaggatcgggaggcgccgggcgcagaccaatcgcggccgccggtgggagtatttgttattcacatggaagagacttggcgcctgctaggccagctcagccccctcagcccagagatcagccacaagtgcggccgctgtgctcgcctcacgcggcggcggcggcggcggcggcggcgctgacatggagctgcgggcccccggcgggcttcctcaccgcgccctctgcggggagcagggaataattctgctacaaggctgatttcaaggacatgaattgttgacctcatcccaacatcagaacctcagatgttctaatttttgcaccattccaggcaagttgatcttataaggaaataaaattgaaccttaggggtctgatggaaattcactgtgacattcaaatcaagaaaacttgctaatgcccacagagccttttccccatgggccctgatggtagcctccagaaggtgcagcctcaggtggtgccctttcttctgtggcaagaataaactttgggtcttggattgcaataccacctgtggagaaaatggtatgcgagggaaagcgatcagcctcttgcccttgtttcttcctcttgaccgccaagttctactggatcctcacaatgatgcaaagaactcacagccaggagtatgcccattccatacgggtggatggggacattattttggggggtctcttccctgtccacgcaaagggagagagaggggtgccttgtggggagctgaagaaggaaaaggggattcacagactggaggccatgctttatgcaattgaccagattaacaaggaccctgatctcctttccaacatcactctgggtgtccgcatcctcgacacgtgctctagggacacctatgctttggagcagtctctaacattcgtgcaggcattaatagagaaagatgcttcggatgtgaagtgtgctaatggagatccacccattttcaccaagcccgacaagatttctggcgtcataggtgctgcagcaagctccgtgtccatcatggttgctaacattttaagactttttaagatacctcaaatcagctatgcatccacagccccagagctaagtgataacaccaggtatgactttttctctcgagtggttccgcctgactcctaccaagcccaagccatggtggacatcgtgacagcactgggatggaattatgtttcgacactggcttctgaggggaactatggtgagagcggtgtggaggccttcacccagatctcgagggagattggtggtgtttgcattgctcagtcacagaaaatcccacgtgaaccaagacctggagaatttgaaaaaattatcaaacgcctgctagaaacacctaatgctcgagcagtgattatgtttgccaatgaggatgacatcaggaggatattggaagcagcaaaaaaactaaaccaaagtgggcattttctctggattggctcagatagttggggatccaaaatagcacctgtctatcagcaagaggagattgcagaaggggctgtgacaattttgcccaaacgagcatcaattgatggatttgatcgatactttagaagccgaactcttgccaataatcgaagaaatgtgtggtttgcagaattctgggaggagaattttggctgcaagttaggatcacatgggaaaaggaacagtcatataaagaaatgcacagggctggagcgaattgctcgggattcatcttatgaacaggaaggaaaggtccaatttgtaattgatgctgtatattccatggcttacgccctgcacaatatgcacaaagatctctgccctggatacattggcctttgtccacgaatgagtaccattgatgggaaagagctacttggttatattcgggctgtaaattttaatggcagtgctggcactcctgtcacttttaatgaaaacggagatgctcctggacgttatgatatcttccagtatcaaataaccaacaaaagcacagagtacaaagtcatcggccactggaccaatcagcttcatctaaaagtggaagacatgcagtgggctcatagagaacatactcacccggcgtctgtctgcagcctgccgtgtaagccaggggagaggaagaaaacggtgaaaggggtcccttgctgctggcactgtgaacgctgtgaaggttacaactaccaggtggatgagctgtcctgtgaactttgccctctggatcagagacccaacatgaaccgcacaggctgccagcttatccccatcatcaaattggagtggcattctccctgggctgtggtgcctgtgtttgttgcaatattgggaatcatcgccaccacctttgtgatcgtgacctttgtccgctataatgacacacctatcgtgagggcttcaggacgcgaacttagttacgtgctcctaacggggatttttctctgttattcaatcacgtttttaatgattgcagcaccagatacaatcatatgctccttccgacgggtcttcctaggacttggcatgtgtttcagctatgcagcccttctgaccaaaacaaaccgtatccaccgaatatttgagcaggggaagaaatctgtcacagcgcccaagttcattagtccagcatctcagctggtgatcaccttcagcctcatctccgtccagctccttggagtgtttgtctggtttgttgtggatcccccccacatcatcattgactatggagagcagcggacactagatccagagaaggccaggggagtgctcaagtgtgacatttctgatctctcactcatttgttcacttggatacagtatcctcttgatggtcacttgtactgtttatgccattaaaacgagaggtgtcccagagactttcaatgaagccaaacctattggatttaccatgtataccacctgcatcatttggttagctttcatccccatcttttttggtacagcccagtcagcagaaaagatgtacatccagacaacaacacttactgtctccatgagtttaagtgcttcagtatctctgggcatgctctatatgcccaaggtttatattataatttttcatccagaacagaatgttcaaaaacgcaagaggagcttcaaggctgtggtgacagctgccaccatgcaaagcaaactgatccaaaaaggaaatgacagaccaaatggcgaggtgaaaagtgaactctgtgagagtcttgaaaccaacacttcctctaccaagacaacatatatcagttacagcaatcattcaatctgaaacagggaaatggcacaatctgaagagatgtggtatatgatcttaaatgatgaacatgagaccgcaaaaattcactcctggagatctccgtagactacaatcaatcaaatcaatagtcagtcttgtaaggaacaaaaattagccatgagccaaaagtatcaataaacggggagtgaagaaacccgttttatacaataaaaccaatgagtgtcaagctaaagtattgcttattcatgagcagttaaaacaaatcacaaaaggaaaactaatgttagctcgtgaaaaaaaatgctgttgaaataaataatgtctgatgttattcttgtatttttctgtgattgtgagaactcccgttcctgtcccacattgtttaacttgtataagacaatgagtctgtttcttgtaatggctgaccagattgaagccctgggttgtgctaaaaataaatgcaatgattgatgcatgcaattttttatacaaataatttatttctaataataaaggaatgttttgcaaatgtt

SEQ ID NO: 12366 - DNA, 3850 bp, Homo sapiens
acattacagtaaagaggttcagaaaagagggagactttacccggaactcccaaggcttggagatgtgatcccccaaaagtttagtcggcgaatgggagactgaagggtgacgggaagggggcaggcgcgctcggcgctctgactgggcgtgcggcggcaggattttaaagcgctctgcctcggatcgtctgccctgggtgacctcccggacctgccctggtggaatccggacttgccccgccgagatgacgaggaataattctgctacaaggctgatttcaaggacatgaattgttgacctcatcccaacatcagaacctcagatgttctaatttttgcaccattccaggcaagttgatcttataaggaaataaaattgaaccttaggggtctgatggaaattcactgtgacattcaaatcaagaaaacttgctaatgcccacagagccttttccccatgggccctgatggtagcctccagaaggtgcagcctcaggtggtgccctttcttctgtggcaagaataaactttgggtcttggattgcaataccacctgtggagaaaatggtatgcgagggaaagcgatcagcctcttgcccttgtttcttcctcttgaccgccaagttctactggatcctcacaatgatgcaaagaactcacagccaggagtatgcccattccatacgggtggatggggacattattttggggggtctcttccctgtccacgcaaagggagagagaggggtgccttgtggggagctgaagaaggaaaaggggattcacagactggaggccatgctttatgcaattgaccagattaacaaggaccctgatctcctttccaacatcactctgggtgtccgcatcctcgacacgtgctctagggacacctatgctttggagcagtctctaacattcgtgcaggcattaatagagaaagatgcttcggatgtgaagtgtgctaatggagatccacccattttcaccaagcccgacaagatttctggcgtcataggtgctgcagcaagctccgtgtccatcatggttgctaacattttaagactttttaagatacctcaaatcagctatgcatccacagccccagagctaagtgataacaccaggtatgactttttctctcgagtggttccgcctgactcctaccaagcccaagccatggtggacatcgtgacagcactgggatggaattatgtttcgacactggcttctgaggggaactatggtgagagcggtgtggaggccttcacccagatctcgagggagattggtggtgtttgcattgctcagtcacagaaaatcccacgtgaaccaagacctggagaatttgaaaaaattatcaaacgcctgctagaaacacctaatgctcgagcagtgattatgtttgccaatgaggatgacatcaggaggatattggaagcagcaaaaaaactaaaccaaagtgggcattttctctggattggctcagatagttggggatccaaaatagcacctgtctatcagcaagaggagattgcagaaggggctgtgacaattttgcccaaacgagcatcaattgatggatttgatcgatactttagaagccgaactcttgccaataatcgaagaaatgtgtggtttgcagaattctgggaggagaattttggctgcaagttaggatcacatgggaaaaggaacagtcatataaagaaatgcacagggctggagcgaattgctcgggattcatcttatgaacaggaaggaaaggtccaatttgtaattgatgctgtatattccatggcttacgccctgcacaatatgcacaaagatctctgccctggatacattggcctttgtccacgaatgagtaccattgatgggaaagagctacttggttatattcgggctgtaaattttaatggcagtgctggcactcctgtcacttttaatgaaaacggagatgctcctggacgttatgatatcttccagtatcaaataaccaacaaaagcacagagtacaaagtcatcggccactggaccaatcagcttcatctaaaagtggaagacatgcagtgggctcatagagaacatactcacccggcgtctgtctgcagcctgccgtgtaagccaggggagaggaagaaaacggtgaaaggggtcccttgctgctggcactgtgaacgctgtgaaggttacaactaccaggtggatgagctgtcctgtgaactttgccctctggatcagagacccaacatgaaccgcacaggctgccagcttatccccatcatcaaattggagtggcattctccctgggctgtggtgcctgtgtttgttgcaatattgggaatcatcgccaccacctttgtgatcgtgacctttgtccgctataatgacacacctatcgtgagggcttcaggacgcgaacttagttacgtgctcctaacggggatttttctctgttattcaatcacgtttttaatgattgcagcaccagatacaatcatatgctccttccgacgggtcttcctaggacttggcatgtgtttcagctatgcagcccttctgaccaaaacaaaccgtatccaccgaatatttgagcaggggaagaaatctgtcacagcgcccaagttcattagtccagcatctcagctggtgatcaccttcagcctcatctccgtccagctccttggagtgtttgtctggtttgttgtggatcccccccacatcatcattgactatggagagcagcggacactagatccagagaaggccaggggagtgctcaagtgtgacatttctgatctctcactcatttgttcacttggatacagtatcctcttgatggtcacttgtactgtttatgccattaaaacgagaggtgtcccagagactttcaatgaagccaaacctattggatttaccatgtataccacctgcatcatttggttagctttcatccccatcttttttggtacagcccagtcagcagaaaagatgtacatccagacaacaacacttactgtctccatgagtttaagtgcttcagtatctctgggcatgctctatatgcccaaggtttatattataatttttcatccagaacagaatgttcaaaaacgcaagaggagcttcaaggctgtggtgacagctgccaccatgcaaagcaaactgatccaaaaaggaaatgacagaccaaatggcgaggtgaaaagtgaactctgtgagagtcttgaaaccaacagtaagtcatctgtagagtttccgatggtcaagagcgggagcacttcctaatagatcttcctctaccaagacaacatatatcagttacagcaatcattcaatctgaaacagggaaatggcacaatctgaagagatgtggtatatgatcttaaatgatgaacatgagaccgcaaaaattcactcctggagatctccgtagactacaatcaatcaaatcaatagtcagtcttgtaaggaacaaaaattagccatgagccaaaagtatcaataaacggggagtgaagaaacccgttttatacaataaaaccaatgagtgtcaagctaaagtattgcttattcatgagcagttaaaacaaatcacaaaaggaaaactaatgttagctcgtgaaaaaaaatgctgttgaaataaataatgtctgatgttattcttgtatttttctgtgattgtgagaactcccgttcctgtcccacattgtttaacttgtataagacaatgagtctgtttcttgtaatggctgaccagattgaagccctgggttgtgctaaaaataaatgcaatgattgatgcatgcaattttttatacaaataatttatttctaataataaagg

SEQ ID NO: 12367 - DNA, 1506 bp, Homo sapiens
atggtatgcgagggaaagcgatcagcctcttgcccttgtttcttcctcttgaccgccaagttctactggatcctcacaatgatgcaaagaactcacagccaggagtatgcccattccatacgggtggatggggacattattttggggggtctcttccctgtccacgcaaagggagagagaggggtgccttgtggggagctgaagaaggaaaaggggattcacagactggaggccatgctttatgcaattgaccagattaacaaggaccctgatctcctttccaacatcactctgggtgtccgcatcctcgacacgtgctctagggacacctatgctttggagcagtctctaacattcgtgcaggcattaatagagaaagatgcttcggatgtgaagtgtgctaatggagatccacccattttcaccaagcccgacaagatttctggcgtcataggtgctgcagcaagctccgtgtccatcatggttgctaacattttaagactttttaagatacctcaaatcagctatgcatccacagccccagagctaagtgataacaccaggtatgactttttctctcgagtggttccgcctgactcctaccaagcccaagccatggtggacatcgtgacagcactgggatggaattatgtttcgacactggcttctgaggggaactatggtgagagcggtgtggaggccttcacccagatctcgagggagattggtggtgtttgcattgctcagtcacagaaaatcccacgtgaaccaagacctggagaatttgaaaaaattatcaaacgcctgctagaaacacctaatgctcgagcagtgattatgtttgccaatgaggatgacatcaggaggatattggaagcagcaaaaaaactaaaccaaagtgggcattttctctggattggctcagatagttggggatccaaaatagcacctgtctatcagcaagaggagattgcagaaggggctgtgacaattttgcccaaacgagcatcaattgatggatttgatcgatactttagaagccgaactcttgccaataatcgaagaaatgtgtggtttgcagaattctgggaggagaattttggctgcaagttaggatcacatgggaaaaggaacagtcatataaagaaatgcacagggctggagcgaattgctcgggattcatcttatgaacaggaaggaaaggtccaatttgtaattgatgctgtatattccatggcttacgccctgcacaatatgcacaaagatctctgccctggatacattggcctttgtccacgaatgagtaccattgatgggaaagagctacttggttatattcgggctgtaaattttaatggttgccgaagagggatccagatgtctctaccctggccaactctttttactccttcattttccagtagttgggcagtgctggcactcctgtcacttttaatgaaaacggagatgctcctggacgttatgatatcttccagtatcaaataa

SEQ ID NO: 12368 - DNA, 551 bp, Homo sapiens
aagaatacactagagtctgggctactaccgcgattgaatacaaatcctgccaactgacagaactggaaaacagggttggtggtggagatacaagaaaaatcatgaacgggagaaaagcattcctatggtagcttgtattttgcttgaaagaaaaatagagaaaaagagccaccagcaggaataattctgctacaaggctgatttcaaggacatgaattgttgacctcatcccaacatcagaacctcagatgttctaatttttgcaccattccaggcaagttgatcttataaggaaataaaattgaaccttaggggtctgatggaaattcactgtgacattcaaatcaagaaaacttgctaatgcccacagagccttttccccatgggccctgatggtagcctccagaaggtgcagcctcaggtggtgccctttcttctgtggcaagaataaactttgggtcttggattgcaataccacctgtggagaaaatggtatgcgagggaaagcgatcagcctcttgcccttgtttcttcctcttgaccgccaagtt

SEQ ID NO: 12369 - DNA, 3559 bp, Homo sapiens
gaataattctgctacaaggctgatttcaaggacatgaattgttgacctcatcccaacatcagaacctcagatgttctaatttttgcaccattccaggcaagttgatcttataaggaaataaaattgaaccttaggggtctgatggaaattcactgtgacattcaaatcaagaaaacttgctaatgcccacagagccttttccccatgggccctgatggtagcctccagaaggtgcagcctcaggtggtgccctttcttctgtggcaagaataaactttgggtcttggattgcaataccacctgtggagaaaatggtatgcgagggaaagcgatcagcctcttgcccttgtttcttcctcttgaccgccaagttctactggatcctcacaatgatgcaaagaactcacagccaggagtatgcccattccatacgggtggatggggacattattttggggggtctcttccctgtccacgcaaagggagagagaggggtgccttgtggggagctgaagaaggaaaaggggattcacagactggaggccatgctttatgcaattgaccagattaacaaggaccctgatctcctttccaacatcactctgggtgtccgcatcctcgacacgtgctctagggacacctatgctttggagcagtctctaacattcgtgcaggcattaatagagaaagatgcttcggatgtgaagtgtgctaatggagatccacccattttcaccaagcccgacaagatttctggcgtcataggtgctgcagcaagctccgtgtccatcatggttgctaacattttaagactttttaagatacctcaaatcagctatgcatccacagccccagagctaagtgataacaccaggtatgactttttctctcgagtggttccgcctgactcctaccaagcccaagccatggtggacatcgtgacagcactgggatggaattatgtttcgacactggcttctgaggggaactatggtgagagcggtgtggaggccttcacccagatctcgagggagattggtggtgtttgcattgctcagtcacagaaaatcccacgtgaaccaagacctggagaatttgaaaaaattatcaaacgcctgctagaaacacctaatgctcgagcagtgattatgtttgccaatgaggatgacatcaggaggatattggaagcagcaaaaaaactaaaccaaagtgggcattttctctggattggctcagatagttggggatccaaaatagcacctgtctatcagcaagaggagattgcagaaggggctgtgacaattttgcccaaacgagcatcaattgatggatttgatcgatactttagaagccgaactcttgccaataatcgaagaaatgtgtggtttgcagaattctgggaggagaattttggctgcaagttaggatcacatgggaaaaggaacagtcatataaagaaatgcacagggctggagcgaattgctcgggattcatcttatgaacaggaaggaaaggtccaatttgtaattgatgctgtatattccatggcttacgccctgcacaatatgcacaaagatctctgccctggatacattggcctttgtccacgaatgagtaccattgatgggaaagagctacttggttatattcgggctgtaaattttaatggcagtgctggcactcctgtcacttttaatgaaaacggagatgctcctggacgttatgatatcttccagtatcaaataaccaacaaaagcacagagtacaaagtcatcggccactggaccaatcagcttcatctaaaagtggaagacatgcagtgggctcatagagaacatactcacccggcgtctgtctgcagcctgccgtgtaagccaggggagaggaagaaaacggtgaaaggggtcccttgctgctggcactgtgaacgctgtgaaggttacaactaccaggtggatgagctgtcctgtgaactttgccctctggatcagagacccaacatgaaccgcacaggctgccagcttatccccatcatcaaattggagtggcattctccctgggctgtggtgcctgtgtttgttgcaatattgggaatcatcgccaccacctttgtgatcgtgacctttgtccgctataatgacacacctatcgtgagggcttcaggacgcgaacttagttacgtgctcctaacggggatttttctctgttattcaatcacgtttttaatgattgcagcaccagatacaatcatatgctccttccgacgggtcttcctaggacttggcatgtgtttcagctatgcagcccttctgaccaaaacaaaccgtatccaccgaatatttgagcaggggaagaaatctgtcacagcgcccaagttcattagtccagcatctcagctggtgatcaccttcagcctcatctccgtccagctccttggagtgtttgtctggtttgttgtggatcccccccacatcatcattgactatggagagcagcggacactagatccagagaaggccaggggagtgctcaagtgtgacatttctgatctctcactcatttgttcacttggatacagtatcctcttgatggtcacttgtactgtttatgccattaaaacgagaggtgtcccagagactttcaatgaagccaaacctattggatttaccatgtataccacctgcatcatttggttagctttcatccccatcttttttggtacagcccagtcagcagaaaagatgtacatccagacaacaacacttactgtctccatgagtttaagtgcttcagtatctctgggcatgctctatatgcccaaggtttatattataatttttcatccagaacagaatgttcaaaaacgcaagaggagcttcaaggctgtggtgacagctgccaccatgcaaagcaaactgatccaaaaaggaaatgacagaccaaatggcgaggtgaaaagtgaactctgtgagagtcttgaaaccaacacttcctctaccaagacaacatatatcagttacagcaatcattcaatctgaaacagggaaatggcacaatctgaagagatgtggtatatgatcttaaatgatgaacatgagaccgcaaaaattcactcctggagatctccgtagactacaatcaatcaaatcaatagtcagtcttgtaaggaacaaaaattagccatgagccaaaagtatcaataaacggggagtgaagaaacccgttttatacaataaaaccaatgagtgtcaagctaaagtattgcttattcatgagcagttaaaacaaatcacaaaaggaaaactaatgttagctcgtgaaaaaaaatgctgttgaaataaataatgtctgatgttattcttgtatttttctgtgattgtgagaactcccgttcctgtcccacattgtttaacttgtataagacaatgagtctgtttcttgtaatggctgaccagattgaagccctgggttgtgctaaaaataaatgcaatgattgatgcatgcaattttttatacaaataatttatttctaataataaaggaatgttttgcaaatgtt

SEQ ID NO: 12370 - DNA, 1247 bp, Homo sapiens
gcccaaactgtgaagcctggtgtcagagagtgtctgcgcacccaagatagcgggggaataattctgctacaaggctgatttcaaggacatgaattgttgacctcatcccaacatcagaacctcagatgttctaatttttgcaccattccaggcaagttgatcttataaggaaataaaattgaaccttaggggtctgatggaaattcactgtgacattcaaatcaagaaaacttgctaatgcccacagagccttttccccatgggccctgatggtagcctccagaaggtgcagcctcaggtggtgccctttcttctgtggcaagaataaactttgggtcttggattgcaataccacctgtggagaaaatggtatgcgagggaaagcgatcagcctcttgcccttgtttcttcctcttgaccgccaagttctactggatcctcacaatgatgcaaagaactcacagccaggagtatgcccattccatacgggtggatggggacattattttggggggtctcttccctgtccacgcaaagggagagagaggggtgccttgtggggagctgaagaaggaaaaggggattcacagactggaggccatgctttatgcaattgaccagattaacaaggaccctgatctcctttccaacatcactctgggtgtccgcatcctcgacacgtgctctagggacacctatgctttggagcagtctctaacattcgtgcaggcattaatagagaaagatgcttcggatgtgaagtgtgctaatggagatccacccattttcaccaagcccgacaagatttctggcgtcataggtgctgcagcaagctccgtgtccatcatggttgctaacattttaagactttttaagatacctcaaatcagctatgcatccacagccccagagctaagtgataacaccaggtatgactttttctctcgagtggttccgcctgactcctaccaagcccaagccatggtggacatcgtgacagcactgggatggaattatgtttcgacactggcttctgaggggaactatggtgagagcggtgtggaggccttcacccagatctcgagggagattggtggtgtttgcattgctcagtcacagaaaatcccacgtgaaccaagacctggagaatttgaaaaaattatcaaacgcctgctagaaacacctaatgctcgagcagtgattatgtttgccaatgaggatgacatcaggaggatattggaagcagc

SEQ ID NO: 12371 - DNA, 4719 bp, Homo sapiens
gtaaaactattccccgtgaaggcggcagggcagaggtccagggcgggctttgctgggagcctcgggaccccgggttgggggccgtggggcggcacctggcgagctggcgggtgggcggcgagccgaggcttcccggcctggcggcaactcgcccctctgccctcagccctcccggctccgctcccttcccccacgccgccctgcccctcccccacgcccctttctctttctttctttctttcccagttcgcttgcccccaccccagcggcgcccgccgggctcctcgcccaatggccgcggggcccgggaccgcatcagctgatcggcccgggctcctggccgctgggagccaatcagggcaccgggggcggccccgggccgcggataaagggtgcggggctgctggcggctctgcagagtcgagagtgggagaagagcggagcgtgtgagcagtactgcggcctcctctcctctcctaacctcgctctcgcggcctagctttacccgcccgcctgctcggcgaccagcggggatcctcccccagccgcaagtccacgaagaaagcaacgaatgaaaattatgaagacaacgagaagtcagactcctccgggtcgcgctccagctgcttcggcttcgtcgcctactctgtgaactccggggagagatctcgagtcaagattaagaccttaacccaccaacctgcctgttcggacaccccccgggccggccgctgtctgtccccttctccatcgccctctcccagaaagctccggtgcttggaccagctagagtctgagaaagaggagaggcgcgaacgccactccaaaaagagaagggttaaagagggcaaccctaacgatacgcttgactttctgtggctgggaacaccttccaccatgaccacctcagcaagttcccacttaaataaaggcatcaagcaggtgtacatgtccctgcctcagggtgagaaagtccaggccatgtatatctggatcgatggtactggagaaggactgcgctgcaagacccggaccctggacagtgagcccaagtgtgtggaagagttgcctgagtggaatttcgatggctctagtactttacagtctgagggttccaacagtgacatgtatctcgtgcctgctgccatgtttcgggaccccttccgtaaggaccctaacaagctggtgttatgtgaagttttcaagtacaatcgaaggcctgcagagaccaatttgaggcacacctgtaaacggataatggacatggtgagcaaccagcacccctggtttggcatggagcaggagtataccctcatggggacagatgggcacccctttggttggccttccaacggcttcccagggccccagggtccatattactgtggtgtgggagcagacagagcctatggcagggacatcgtggaggcccattaccgggcctgcttgtatgctggagtcaagattgcggggactaatgccgaggtcatgcctgcccagtgggaatttcagattggaccttgtgaaggaatcagcatgggagatcatctctgggtggcccgtttcatcttgcatcgtgtgtgtgaagactttggagtgatagcaacctttgatcctaagcccattcctgggaactggaatggtgcaggctgccataccaacttcagcaccaaggccatgcgggaggagaatggtctgaagtacatcgaggaggccattgagaaactaagcaagcggcaccagtaccacatccgtgcctatgatcccaagggaggcctggacaatgcccgacgtctaactggattccatgaaacctccaacatcaacgacttttctgctggtgtagccaatcgtagcgccagcatacgcattccccggactgttggccaggagaagaagggttactttgaagatcgtcgcccctctgccaactgcgaccccttttcggtgacagaagccctcatccgcacgtgtcttctcaatgaaaccggcgatgagcccttccagtacaaaaattaagtggactagacctccagctgttgagcccctcctagttcttcatcccactccaactcttccccctctcccagttgtcccgattgtaactcaaagggtggaatatcaaggtcgtttttttcattccatgtgcccagttaatcttgctttctttgtttggctgggatagaggggtcaagttattaatttcttcacacctaccctcctttttttccctatcactgaagctttttagtgcattagtggggaggagggtggggagacataaccactgcttccatttaatggggtgcacctgtccaataggcgtagctatccggacagagcacgtttgcagaagggggtctcttcttccaggtagctgaaaggggaagacctgacgtactctggttaggttaggacttgccctcgtggtggaaacttttcttaaaaagttataaccaacttttctattaaaagtgggaattaggagagaaggtaggggttgggaatcagagagaatggctttggtctcttgcttgtgggactagcctggcttgggactaaatgccctgctctgaacacgaagcttagtataaactgatggatatccctaccttgaaagaagaaaaggttcttactgcttggtccttgatttatcacacaaagcagaatagtatttttatatttaaatgtaaagacaaaaaactatatgtatggttttgtggattatgtgtgttttgctaaaggaaaaaaccatccaggtcacggggcaccaaatttgagacaaatagtcggattagaaataaagcatctcattttgagtagagagcaagggaagtggttcttagatggtgatctgggattaggccctcaagacccttttgggtttctgccctgcccaccctctggagaaggtgggcactggattagttaacagacaacacgttactagcagtcacttgatctccgtggctttggtttaaaagacacacttgtccacataggtttagagataagagttggctggtcaacttgagcatgttactgacagagggggtattggggttattttctggtaggaatagcatgtcactaaagcaggccttttgatattaaattttttaaaaagcaaaattatagaagtttagattttaatcaaatttgtagggtttctaggtaatttttacagaattgcttgtttgcttcaactgtctcctacctctgctcttggaggagatggggacagggctggagtcaaaacacttgtaattttgtatcttgatgtctttgttaagactgctgaagaattattttttttcttttataataaggaataaaccccacctttattccttcatttcatctaccattttctggttcttgtgttggctgtggcaggccagctgtggttttcttttgccatgacaacttctaattgccatgtacagtatgttcaaagtcaaataactcctcattgtaaacaaactgtgtaactgcccaaagcagcacttataaatcagcctaacataagatctctctgatgtgtttgtgattctttcaaatccctatgtgccattatatttctttatttcctaaaacaggcaaaataagctcaagtttatgtactctgagtttttaaaacactggagtgatgttgctgaccagccgtttcctgtacctctctaagttgggtatttgggacttaagggattaagtttttcacctagacttagttacacacaatcttggcatttcctagcctagaggtttgtagcagggtacaagccccactcctcccccttcctttgctcccctgagtttggttttggcttaccataacattgttttgaccattcctagcctaatacaatagcctaacataatgtaagattaactggctttacgatttctattctctgctctcagtgataagaaacaaatattagctaccctgctaccctggttgaagccttccaaggctggctatgccctaggcatgggctcatccttgggtgtatcttgccttgcaggaagaccagtggaccgattgtgattctcaaaagctctgtgttgtcacctgtgcccttgccccttgctcttatcttggtccgtgtatctgggagttcttccaccttatcttggccaattcctaccttcgttcattcctcatgaggttgggtaaaagctccctccggctcccatgatgctgtgcatatacctagcaaaaagcaattattggacacattggagtgcaatattattaatagcattaatactactaataatgtgggcaatagtgattgtttttaaaaggcagtatactcttaccagtgcgaggtagctggggcctgtgatagtttttagagataagttcttcaggcaactgtgtattttacactagtcaagtaatcctagatatccgtggtttttcttaagaaagttggctcgtaatatgatttaatattcaaagtagagtcatctacctattagcttgctggcgtggtcctagtttatgcctgtttcagcatgattgttgagtaccctgtttcatccttagcattttcttgattttgttgttaaatgatgtatacccttatttccattgaatctgtgcttccacccccccaactgaagttgtcttccctttgcttggccacccttacagcctcttggatggtgtatcctacagtgtaagcactaaactgaagaggcagtgacctg

SEQ ID NO: 12372 - DNA, 4364 bp, Homo sapiens
gtaaaactattccccgtgaaggcggcagggcagaggtccagggcgggctttgctgggagcctcgggaccccgggttgggggccgtggggcggcacctggcgagctggcgggtgggcggcgagccgaggcttcccggcctggcggcaactcgcccctctgccctcagccctcccggctccgctcccttcccccacgccgccctgcccctcccccacgcccctttctctttctttctttctttcccagttcgcttgcccccaccccagcggcgcccgccgggctcctcgcccaatggccgcggggcccgggaccgcatcagctgatcggcccgggctcctggccgctgggagccaatcagggcaccgggggcggccccgggccgcggataaagggtgcggggctgctggcggctctgcagagtcgagagtgggagaagagcggagcgtgtgagcagtactgcggcctcctctcctctcctaacctcgctctcgcggcctagctttacccgcccgcctgctcggcgaccagaacaccttccaccatgaccacctcagcaagttcccacttaaataaaggcatcaagcaggtgtacatgtccctgcctcagggtgagaaagtccaggccatgtatatctggatcgatggtactggagaaggactgcgctgcaagacccggaccctggacagtgagcccaagtgtgtggaagagttgcctgagtggaatttcgatggctctagtactttacagtctgagggttccaacagtgacatgtatctcgtgcctgctgccatgtttcgggaccccttccgtaaggaccctaacaagctggtgttatgtgaagttttcaagtacaatcgaaggcctgcagagaccaatttgaggcacacctgtaaacggataatggacatggtgagcaaccagcacccctggtttggcatggagcaggagtataccctcatggggacagatgggcacccctttggttggccttccaacggcttcccagggccccagggtccatattactgtggtgtgggagcagacagagcctatggcagggacatcgtggaggcccattaccgggcctgcttgtatgctggagtcaagattgcggggactaatgccgaggtcatgcctgcccagtgggaatttcagattggaccttgtgaaggaatcagcatgggagatcatctctgggtggcccgtttcatcttgcatcgtgtgtgtgaagactttggagtgatagcaacctttgatcctaagcccattcctgggaactggaatggtgcaggctgccataccaacttcagcaccaaggccatgcgggaggagaatggtctgaagtacatcgaggaggccattgagaaactaagcaagcggcaccagtaccacatccgtgcctatgatcccaagggaggcctggacaatgcccgacgtctaactggattccatgaaacctccaacatcaacgacttttctgctggtgtagccaatcgtagcgccagcatacgcattccccggactgttggccaggagaagaagggttactttgaagatcgtcgcccctctgccaactgcgaccccttttcggtgacagaagccctcatccgcacgtgtcttctcaatgaaaccggcgatgagcccttccagtacaaaaattaagtggactagacctccagctgttgagcccctcctagttcttcatcccactccaactcttccccctctcccagttgtcccgattgtaactcaaagggtggaatatcaaggtcgtttttttcattccatgtgcccagttaatcttgctttctttgtttggctgggatagaggggtcaagttattaatttcttcacacctaccctcctttttttccctatcactgaagctttttagtgcattagtggggaggagggtggggagacataaccactgcttccatttaatggggtgcacctgtccaataggcgtagctatccggacagagcacgtttgcagaagggggtctcttcttccaggtagctgaaaggggaagacctgacgtactctggttaggttaggacttgccctcgtggtggaaacttttcttaaaaagttataaccaacttttctattaaaagtgggaattaggagagaaggtaggggttgggaatcagagagaatggctttggtctcttgcttgtgggactagcctggcttgggactaaatgccctgctctgaacacgaagcttagtataaactgatggatatccctaccttgaaagaagaaaaggttcttactgcttggtccttgatttatcacacaaagcagaatagtatttttatatttaaatgtaaagacaaaaaactatatgtatggttttgtggattatgtgtgttttgctaaaggaaaaaaccatccaggtcacggggcaccaaatttgagacaaatagtcggattagaaataaagcatctcattttgagtagagagcaagggaagtggttcttagatggtgatctgggattaggccctcaagacccttttgggtttctgccctgcccaccctctggagaaggtgggcactggattagttaacagacaacacgttactagcagtcacttgatctccgtggctttggtttaaaagacacacttgtccacataggtttagagataagagttggctggtcaacttgagcatgttactgacagagggggtattggggttattttctggtaggaatagcatgtcactaaagcaggccttttgatattaaattttttaaaaagcaaaattatagaagtttagattttaatcaaatttgtagggtttctaggtaatttttacagaattgcttgtttgcttcaactgtctcctacctctgctcttggaggagatggggacagggctggagtcaaaacacttgtaattttgtatcttgatgtctttgttaagactgctgaagaattattttttttcttttataataaggaataaaccccacctttattccttcatttcatctaccattttctggttcttgtgttggctgtggcaggccagctgtggttttcttttgccatgacaacttctaattgccatgtacagtatgttcaaagtcaaataactcctcattgtaaacaaactgtgtaactgcccaaagcagcacttataaatcagcctaacataagatctctctgatgtgtttgtgattctttcaaatccctatgtgccattatatttctttatttcctaaaacaggcaaaataagctcaagtttatgtactctgagtttttaaaacactggagtgatgttgctgaccagccgtttcctgtacctctctaagttgggtatttgggacttaagggattaagtttttcacctagacttagttacacacaatcttggcatttcctagcctagaggtttgtagcagggtacaagccccactcctcccccttcctttgctcccctgagtttggttttggcttaccataacattgttttgaccattcctagcctaatacaatagcctaacataatgtaagattaactggctttacgatttctattctctgctctcagtgataagaaacaaatattagctaccctgctaccctggttgaagccttccaaggctggctatgccctaggcatgggctcatccttgggtgtatcttgccttgcaggaagaccagtggaccgattgtgattctcaaaagctctgtgttgtcacctgtgcccttgccccttgctcttatcttggtccgtgtatctgggagttcttccaccttatcttggccaattcctaccttcgttcattcctcatgaggttgggtaaaagctccctccggctcccatgatgctgtgcatatacctagcaaaaagcaattattggacacattggagtgcaatattattaatagcattaatactactaataatgtgggcaatagtgattgtttttaaaaggcagtatactcttaccagtgcgaggtagctggggcctgtgatagtttttagagataagttcttcaggcaactgtgtattttacactagtcaagtaatcctagatatccgtggtttttcttaagaaagttggctcgtaatatgatttaatattcaaagtagagtcatctacctattagcttgctggcgtggtcctagtttatgcctgtttcagcatgattgttgagtaccctgtttcatccttagcattttcttgattttgttgttaaatgatgtatacccttatttccattgaatctgtgcttccacccccccaactgaagttgtcttccctttgcttggccacccttacagcctcttggatggtgtatcctacagtgtaagcactaaactgaagaggcagtgacctga

SEQ ID NO: 12373 - DNA, 3942 bp, Homo sapiens
gcagagtcgagagtgggagaagagcggagcgtgtgagcagtactgcggcctcctctcctctcctaacctcgctctcgcggcctagctttacccgcccgcctgctcggcgaccaggtaagcccccggacggcccggtgtcacgcaagcgaggcgcgccgcccctgctaccccgcgaggcgcgccgcccagcctcttttttcggctgcctgcccctccagtcccagccctacgctgcggcctctccggcccatgcctgagatccggcatgagtgctcctcccgcgtgcttccgccgctggtggcttggacccgtcggggctggcgctggtggggcgcgcccttggccaggctctgggaagggcggggtgagttgttttgatcttcttttcactacttgcggccgaagcgccgcccctggaggccgttgggccggcctgcgccctggggctcgcagtggtttgtttgcgctgtggatggagtggcggtgcggtcccctgtggagcgcaaacaaggcgcttggttggcgcgggcgcctggctgccttcctcgtggtggggccttcggagcaatcgtcctggttctggcgatggttgagacgcctcgattgcggcgtgtaacggtgagcgttgtttgggcggccggctcccgcctcggggtcccgggggccttccaatgtgaccgaacaatggagagcccgggcctcggcgcagtcagtggagaagccggtccgggcggaggcagcagcagcgcgcagtccctacggcctgcgcccccaccctcccccggaccccccaacccctcggcggcagggtatggccacctccgtgaggccctgagattcggacgggggcccgaggggcagggcgcccactttagggacatttcagtgggaaggggctgctctcaaagtggataattataactccctcgggggcgggaagcggggatcctcccccagccgcaagtccacgaagaaagcaacgaatgaaaattatgaagacaacgagaagtcagactcctccgggtcgcgctccagctgcttcggcttcgtcgcctactctgtgaactccggggagagatctcgagtcaagattaagaccttaacccaccaacctgcctgttcggacaccccccgggccggccgctgtctgtccccttctccatcgccctctcccagaaagctccggtgcttggaccagctagagtctgagaaagaggagaggcgcgaacgccactccaaaaagagaagggttaaagagggcaaccctaacgatacgcttgactttctgtggctgggaacaccttccaccatgaccacctcagcaagttcccacttaaataaaggcatcaagcaggtgtacatgtccctgcctcagggtgagaaagtccaggccatgtatatctggatcgatggtactggagaaggactgcgctgcaagacccggaccctggacagtgagcccaagtgtgtggaagagttgcctgagtggaatttcgatggctctagtactttacagtctgagggttccaacagtgacatgtatctcgtgcctgctgccatgtttcgggaccccttccgtaaggaccctaacaagctggtgttatgtgaagttttcaagtacaatcgaaggcctgcagagaccaatttgaggcacacctgtaaacggataatggacatggtgagcaaccagcacccctggtttggcatggagcaggagtataccctcatggggacagatgggcacccctttggttggccttccaacggcttcccagggccccagggtccatattactgtggtgtgggagcagacagagcctatggcagggacatcgtggaggcccattaccgggcctgcttgtatgctggagtcaagattgcggggactaatgccgaggtcatgcctgcccagtgggaatttcagattggaccttgtgaaggaatcagcatgggagatcatctctgggtggcccgtttcatcttgcatcgtgtgtgtgaagactttggagtgatagcaacctttgatcctaagcccattcctgggaactggaatggtgcaggctgccataccaacttcagcaccaaggccatgcgggaggagaatggtctgaagtacatcgaggaggccattgagaaactaagcaagcggcaccagtaccacatccgtgcctatgatcccaagggaggcctggacaatgcccgacgtctaactggattccatgaaacctccaacatcaacgacttttctgctggtgtagccaatcgtagcgccagcatacgcattccccggactgttggccaggagaagaagggttactttgaagatcgtcgcccctctgccaactgcgaccccttttcggtgacagaagccctcatccgcacgtgtcttctcaatgaaaccggcgatgagcccttccagtacaaaaattaagtggactagacctccagctgttgagcccctcctagttcttcatcccactccaactcttccccctctcccagttgtcccgattgtaactcaaagggtggaatatcaaggtcgtttttttcattccatgtgcccagttaatcttgctttctttgtttggctgggatagaggggtcaagttattaatttcttcacacctaccctcctttttttccctatcactgaagctttttagtgcattagtggggaggagggtggggagacataaccactgcttccatttaatggggtgcacctgtccaataggcgtagctatccggacagagcacgtttgcagaagggggtctcttcttccaggtagctgaaaggggaagacctgacgtactctggttaggttaggacttgccctcgtggtggaaacttttcttaaaaagttataaccaacttttctattaaaagtgggaattaggagagaaggtaggggttgggaatcagagagaatggctttggtctcttgcttgtgggactagcctggcttgggactaaatgccctgctctgaacacgaagcttagtataaactgatggatatccctaccttgaaagaagaaaaggttcttactgcttggtccttgatttatcacacaaagcagaatagtatttttatatttaaatgtaaagacaaaaaactatatgtatggttttgtggattatgtgtgttttgctaaaggaaaaaaccatccaggtcacggggcaccaaatttgagacaaatagtcggattagaaataaagcatctcattttgagtagagagcaagggaagtggttcttagatggtgatctgggattaggccctcaagacccttttgggtttctgccctgcccaccctctggagaaggtgggcactggattagttaacagacaacacgttactagcagtcacttgatctccgtggctttggtttaaaagacacacttgtccacataggtttagagataagagttggctggtcaacttgagcatgttactgacagagggggtattggggttattttctggtaggaatagcatgtcactaaagcaggccttttgatattaaattttttaaaaagcaaaattatagaagtttagattttaatcaaatttgtagggtttctaggtaatttttacagaattgcttgtttgcttcaactgtctcctacctctgctcttggaggagatggggacagggctggagtcaaaacacttgtaattttgtatcttgatgtctttgttaagactgctgaagaattattttttttcttttataataaggaataaaccccacctttattccttcatttcatctaccattttctggttcttgtgttggctgtggcaggccagctgtggttttcttttgccatgacaacttctaattgccatgtacagtatgttcaaagtcaaataactcctcattgtaaacaaactgtgtaactgcccaaagcagcacttataaatcagcctaacataaga

SEQ ID NO: 12374 - DNA, 4065 bp, Homo sapiens
actacttgcggccgaagcgccgcccctggaggccgttgggccggcctgcgccctggggctcgcagtggtttgtttgcgctgtggatggagtggcggtgcggtcccctgtggagcgcaaacaaggcgcttggttggcgcgggcgcctggctgccttcctcgtggtggggccttcggagcaatcgtcctggttctggcgatggttgagacgcctcgattgcggcgtgtaacgaacaccttccaccatgaccacctcagcaagttcccacttaaataaaggcatcaagcaggtgtacatgtccctgcctcagggtgagaaagtccaggccatgtatatctggatcgatggtactggagaaggactgcgctgcaagacccggaccctggacagtgagcccaagtgtgtggaagagttgcctgagtggaatttcgatggctctagtactttacagtctgagggttccaacagtgacatgtatctcgtgcctgctgccatgtttcgggaccccttccgtaaggaccctaacaagctggtgttatgtgaagttttcaagtacaatcgaaggcctgcagagaccaatttgaggcacacctgtaaacggataatggacatggtgagcaaccagcacccctggtttggcatggagcaggagtataccctcatggggacagatgggcacccctttggttggccttccaacggcttcccagggccccagggtccatattactgtggtgtgggagcagacagagcctatggcagggacatcgtggaggcccattaccgggcctgcttgtatgctggagtcaagattgcggggactaatgccgaggtcatgcctgcccagtgggaatttcagattggaccttgtgaaggaatcagcatgggagatcatctctgggtggcccgtttcatcttgcatcgtgtgtgtgaagactttggagtgatagcaacctttgatcctaagcccattcctgggaactggaatggtgcaggctgccataccaacttcagcaccaaggccatgcgggaggagaatggtctgaagtacatcgaggaggccattgagaaactaagcaagcggcaccagtaccacatccgtgcctatgatcccaagggaggcctggacaatgcccgacgtctaactggattccatgaaacctccaacatcaacgacttttctgctggtgtagccaatcgtagcgccagcatacgcattccccggactgttggccaggagaagaagggttactttgaagatcgtcgcccctctgccaactgcgaccccttttcggtgacagaagccctcatccgcacgtgtcttctcaatgaaaccggcgatgagcccttccagtacaaaaattaagtggactagacctccagctgttgagcccctcctagttcttcatcccactccaactcttccccctctcccagttgtcccgattgtaactcaaagggtggaatatcaaggtcgtttttttcattccatgtgcccagttaatcttgctttctttgtttggctgggatagaggggtcaagttattaatttcttcacacctaccctcctttttttccctatcactgaagctttttagtgcattagtggggaggagggtggggagacataaccactgcttccatttaatggggtgcacctgtccaataggcgtagctatccggacagagcacgtttgcagaagggggtctcttcttccaggtagctgaaaggggaagacctgacgtactctggttaggttaggacttgccctcgtggtggaaacttttcttaaaaagttataaccaacttttctattaaaagtgggaattaggagagaaggtaggggttgggaatcagagagaatggctttggtctcttgcttgtgggactagcctggcttgggactaaatgccctgctctgaacacgaagcttagtataaactgatggatatccctaccttgaaagaagaaaaggttcttactgcttggtccttgatttatcacacaaagcagaatagtatttttatatttaaatgtaaagacaaaaaactatatgtatggttttgtggattatgtgtgttttgctaaaggaaaaaaccatccaggtcacggggcaccaaatttgagacaaatagtcggattagaaataaagcatctcattttgagtagagagcaagggaagtggttcttagatggtgatctgggattaggccctcaagacccttttgggtttctgccctgcccaccctctggagaaggtgggcactggattagttaacagacaacacgttactagcagtcacttgatctccgtggctttggtttaaaagacacacttgtccacataggtttagagataagagttggctggtcaacttgagcatgttactgacagagggggtattggggttattttctggtaggaatagcatgtcactaaagcaggccttttgatattaaattttttaaaaagcaaaattatagaagtttagattttaatcaaatttgtagggtttctaggtaatttttacagaattgcttgtttgcttcaactgtctcctacctctgctcttggaggagatggggacagggctggagtcaaaacacttgtaattttgtatcttgatgtctttgttaagactgctgaagaattattttttttcttttataataaggaataaaccccacctttattccttcatttcatctaccattttctggttcttgtgttggctgtggcaggccagctgtggttttcttttgccatgacaacttctaattgccatgtacagtatgttcaaagtcaaataactcctcattgtaaacaaactgtgtaactgcccaaagcagcacttataaatcagcctaacataagatctctctgatgtgtttgtgattctttcaaatccctatgtgccattatatttctttatttcctaaaacaggcaaaataagctcaagtttatgtactctgagtttttaaaacactggagtgatgttgctgaccagccgtttcctgtacctctctaagttgggtatttgggacttaagggattaagtttttcacctagacttagttacacacaatcttggcatttcctagcctagaggtttgtagcagggtacaagccccactcctcccccttcctttgctcccctgagtttggttttggcttaccataacattgttttgaccattcctagcctaatacaatagcctaacataatgtaagattaactggctttacgatttctattctctgctctcagtgataagaaacaaatattagctaccctgctaccctggttgaagccttccaaggctggctatgccctaggcatgggctcatccttgggtgtatcttgccttgcaggaagaccagtggaccgattgtgattctcaaaagctctgtgttgtcacctgtgcccttgccccttgctcttatcttggtccgtgtatctgggagttcttccaccttatcttggccaattcctaccttcgttcattcctcatgaggttgggtaaaagctccctccggctcccatgatgctgtgcatatacctagcaaaaagcaattattggacacattggagtgcaatattattaatagcattaatactactaataatgtgggcaatagtgattgtttttaaaaggcagtatactcttaccagtgcgaggtagctggggcctgtgatagtttttagagataagttcttcaggcaactgtgtattttacactagtcaagtaatcctagatatccgtggtttttcttaagaaagttggctcgtaatatgatttaatattcaaagtagagtcatctacctattagcttgctggcgtggtcctagtttatgcctgtttcagcatgattgttgagtaccctgtttcatccttagcattttcttgattttgttgttaaatgatgtatacccttatttccattgaatctgtgcttccacccccccaactgaagttgtcttccctttgcttggccacccttacagcctcttggatggtgtatcctacagtgtaagcactaaactgaagaggcagtgacctg

SEQ ID NO: 12375 - DNA, 1244 bp, Homo sapiens
aagagggcaaccctaacgatacgcttgactttctgtggctgggaacaccttccaccatgaccacctcagcaagttcccacttaaataaaggcatcaagcaggtgtacatgtccctgcctcagggtgagaaagtccaggccatgtatatctggatcgatggtactggagaaggactgcgctgcaagacccggaccctggacagtgagcccaagtgtgtggaagagttgcctgagtggaatttcgatggctctagtactttacagtctgagggttccaacagtgacatgtatctcgtgcctgctgccatgtttcgggaccccttccgtaaggaccctaacaagctggtgttatgtgaagttttcaagtacaatcgaaggcctgcagagaccaatttgaggcacacctgtaaacggataatggacatggtgagcaaccagcacccctggtttggcatggagcaggagtataccctcatggggacagatgggcacccctttggttggccttccaacggcttccagggccccagggtccatattactgtggtgtgggagcagacagagcctatggcagggacatcgtggaggcccattaccgggcctgcttgtatgctggagtcaagattgcggggactaatgccgaggtcatgcctgcccagtgggaatttcagattggaccttgtgaaggaatcagcatgggagatcatctctgggtggcccgtttcatcttgcatcgtgtgtgtgaagactttggagtgatagcaacctttgatcctaagcccattcctgggaactggaatggtgcaggctgccataccaacttcagcaccaaggccatgcgggaggagaatggtctgaagtacatcgaggaggccattgagaaactaagcaagcggcaccagtaccacatccgtgcctatgatcccaagggaggcctggacaatgcccgacgtctaactggattccatgaaacctccaacatcaacgacttttctgctggtgtagccaatcgtagcgccagcatacgcattccccggactgttggccaggagaagaagggttactttgaagatcgtcgcccctctgccaactgcgaccccttttcggtgacagaagccctcatccgcacgtgtcttctcaatgaaaccggcgatgagcccttccagtacaaaaattaagtggactagacctccagctgttgagcccctcctagttcttcatcccactccaactcttccccctctc

SEQ ID NO: 12376 - DNA, 3813 bp, Homo sapiens
ataaaacctggagcgcaggatcgcgcccaggagcggcgagctagcggacgcaaagactgggcatgctccgcggcggcgcaggttttggtcacaagtaggaagaagccagtgcaccagaccggcaaagagaagcgggagccgccgcggcagcgcggccgtggggtccgccgccgccgcatcggagcgggaggaggagcagcggggagggcgaggccgccgggccgagagccgtcccgcctgctctcggtcttctgccttcgcctccgcgcggtgcgtcggacccagggtctgtcacctgggcgccaggggccgccgccggggagccggagcgggcaggaccctccctccgccgactgcggcccgagagcgcccccgcggggtggagcggcagccgccttctgcgggcggctgagtgtccgtctcgcgcccggagcgggcgaccgccgtcagcccggaggaggaggaggaggaggagggggcggccatggggctgctgtcccagggctcgccgctgagctgggaggaaaccaagcgccatgccgaccacgtgcggcggcacgggatcctccagttcctgcacatctaccacgccgtcaaggaccggcacaaggacgttctcaagtggggcgatgaggtggaatacatgttggtatcttttgatcatgaaaataaaaaagtccggttggtcctgtctggggagaaagttcttgaaactctgcaagagaagggggaaaggacaaacccaaaccatcctaccctttggagaccagagtatgggagttacatgattgaagggacaccaggacagccctacggaggaacaatgtccgagttcaatacagttgaggccaacatgcgaaaacgccggaaggaggctacttctatattagaagaaaatcaggctctttgcacaataacttcatttcccagattaggctgtcctgggttcacactgcccgaggtcaaacccaacccagtggaaggaggagcttccaagtccctcttctttccagatgaagcaataaacaagcaccctcgcttcagtaccttaacaagaaatatccgacataggagaggagaaaaggttgtcatcaatgtaccaatatttaaggacaagaatacaccatctccatttatagaaacatttactgaggatgatgaagcttcaagggcttctaagccggatcatatttacatggatgccatgggatttggaatgggcaattgctgtctccaggtgacattccaagcctgcagtatatctgaggccagatacctttatgatcagttggctactatctgtccaattgttatggctttgagtgctgcatctcccttttaccgaggctatgtgtcagacattgattgtcgctggggagtgatttctgcatctgtagatgatagaactcgggaggagcgaggactggagccattgaagaacaataactataggatcagtaaatcccgatatgactcaatagacagctatttatctaagtgtggtgagaaatataatgacatcgacttgacgatagataaagagatctacgaacagctgttgcaggaaggcattgatcatctcctggcccagcatgttgctcatctctttattagagacccactgacactgtttgaagagaaaatacacctggatgatgctaatgagtctgaccattttgagaatattcagtccacaaattggcagacaatgagatttaagccccctcctccaaactcagacattggatggagagtagaatttcgacccatggaggtgcaattaacagactttgagaactctgcctatgtggtgtttgtggtactgctcaccagagtgatcctttcctacaaattggattttctcattccactgtcaaaggttgatgagaacatgaaggtagcacagaaaagagatgctgtcttgcagggaatgttttatttcaggaaagatatttgcaaaggtggcaatgcagtggtggatggttgtggcaaggcccagaacagcacggagctcgctgcagaggagtacaccctcatgagcatagacaccatcatcaatgggaaggaaggtgtgtttcctggactgatcccaattctgaactcttaccttgaaaacatggaagtggatgtggacaccagatgtagtattctgaactacctaaagctaattaagaagagagcatctggagaactaatgacagttgccagatggatgagggagtttatcgcaaaccatcctgactacaagcaagacagtgtcataactgatgaaatgaattatagccttattttgaagtgtaaccaaattgcaaatgaattatgtgaatgcccagagttacttggatcagcatttaggaaagtaaaatatagtggaagtaaaactgactcatccaactagacattctacagaaagaaaaatgcattattgacgaactggctacagtaccatgcctctcagccagcccgtgtgtataatatgaagaccaaatgatagaactgtactgttttctgggccagtgagccagaaattgattaaggctttctttggtaggtaaatctagagtttatacagtgtacatgtacatagtaaagtatttttgattaacaatgtattttaataacatatctaaagtcatcatgaactggcttgtacatttttaaattcttactctggagcaacctactgtctaagcagttttgtaaatgtactggtaattgtacaatacttgcattccagagttaaaatgtttactgtaaatttttgttcttttaaagactacctgggacctgatttattgaaatttttctctttaaaaacattttctctcgttaattttcctttgtcatttcctttgttgtctacattaaatcacttgaatccattgaaagtgcttcaagggtaatcttgggtttctagcaccttatctatgatgtttcttttgcaattggaataatcacttggtcaccttgccccaagctttcccctctgaataaatacccattgaactctgatggctgttatcaaaggaacttttctttgtttaaatttgctgatgcaggaattaagtttaaacacaactctatagaaagaaaggagattattacccagaattcacatgtagtgattattaaggacaatttttttttttaactaaaaaagttggcggcaggggtggggggtggcaatcatttttcttcctatacatacaaaggatattgtcaaaaatggcgttcttctcttgtggcctgttattctgattgctgctgtatacagttttgtcactctttagtttttagttaagcatactgatagactttcctctaaaagccattcactccagattttacctggggaatattctacatactgcttactttctctataaaactcatcaataaatcatgaaaggcactgagttttgtaaatcaggaccctaaatgtttaattgtaaataagtttcagataattattatagctttgcgttgaagtttgttgttttttttctcaactagttaagtcaactgcttctgaaataactctgtattgtagattatgcagatctttacaggcataaatatttaaactgtaatatgctaacttgaagagattgcaataaagctgcttcagctaaccctgtttatgtttaaatactagggtttgttctatattttatacatgcattttggatgattaaagaatgcctggttttcgtttgcaatttgcttgtgtaaatcaggttgtaaaaaggcagataaattgaaatgtttgtggtatgaggaaataaaagaatggaattagctttcattcagaaa

SEQ ID NO: 12377 - DNA, 4857 bp, Homo sapiens
gctgcggccgcagtagccggagccggagccgcagccaccggtgccttcctttcccgccgccgcccagccgccgtccggcctccctcgggcccgagcgcagaccaggctccagccgcgcggcgccggcagcctcgcgctccctctcgggtctctctcgggcctcgggcaccgcgtcctgtggggcggccgcctgcctgcccgcccgcccgcagccccttcgctgcgcggcccctgggcggccgctgccatgggcaccgacagccgcgcggccaaggcgctcctggcgcgggcccgcaccctgcacctgcagacggggaacctgctgaactggggccgcctgcggaagaagtgcccgtccacgcacagcgaggagcttcatgattgtatccaaaaaaccttgaatgaatggagttcccaaatcaacccagatttggtcagggagtttccagatgtcttggaatgcactgtatctcatgcagtagaaaagataaatcctgatgaaagagaagaaatgaaagtttctgcaaaactgttcattgtagaatcaaactcttcatcatcaactagaagtgcagttgacatggcctgttcagtccttggagttgcacagctggattctgtgatcattgcttcacctcctattgaagatggagttaatctttccttggagcatttacagccttactgggaggaattagaaaacttagttcagagcaaaaagattgttgccataggtacctctgatctagacaaaacacagttggaacagctgtatcagtgggcacaggtaaaaccaaatagtaaccaagttaatcttgcctcctgctgtgtgatgccaccagatttgactgcatttgctaaacaatttgacatacagctgttgactcacaatgatccaaaagaactgctttctgaagcaagtttccaagaagctcttcaggaaagcattcctgacattcaagcgcacgagtgggtgccgctgtggctactgcggtattcggtcattgtgaaaagtagaggaattatcaaatcaaaaggctacattttacaagctaaaagaaggggttcttaactgacttaggagcataacttacctgtaatttccttcaatatgagagaaaattgagatgtgtaaaaatctagttactgcctgtaaatggtgtcattgaggcagatattctttcgtcatatttgacagtatgttgtctgtcaagttttaaatacttatcttgcctccatatcaatccattctcatgaacctctgtattgctttccttaaactattgttttctaattgaaattgtctataaagaaaatacttgcaatatatttttcctttatttttatgactaatataaatcaagaaaatttgttgttagatatattttggcctaggtatcagggtaatgtatatacatattttttatttccaaaaaaaattcattaattgcttcttaactcttattataaccaagcaatttaattacaattgttaaaactgaaatactggaagaagatatttttcctgtcattgatgagatatatcagagtaactggagtagctgggatttactagtagtgtaaataaaattcactcttcaatacatgaatggaaacttaaatttttttttatgtgtccttgcttatagtttagctgtaataatttaaccttgtattcttgtgccatattctgtctttttattacttataaagacaaaccaaagtaaatctgaaaggagactagaagctttgaaattattgtttgggggttttataaaagcaactactgtcacctccatccagattcttttaaattattgatccatccatagtatatattgctactcattcaagaatcctcaataagtattgagtatttaccatatgttgggatactgtgggctctggagagaggagggggcaatagagctaggaattaagaatcagttgagtaaaatgtgtaatatttattccccattaataactgactaggaaggactaaaagccagaaaggggatgaaaaaaaaatccttaattcagggccgacattatctacttaaacaactttgagatatggtcttaattattttaaagcagaataatataattgaaagtttatagctaaaagagactatataggtcatttagtataattcttcattagtttacgaaccacaaaattgcaaataaataagctatgaactttgatgtacactataaatctccttaattctataaatttgtgtctgtaacctgaatagtttgaaaacttctttaaaaatctcttgtatttcatccgggcgcagtggctcacacctgtaatcccagcactttgggaggccgaggtgggcagatcacgaggtcaggagtttgagaccagcctgaccaacatggtaaaaccccatctctactaaaatacaaaaattggctgggcgtggtggcactcgcctgtaatctcagctacttgggaggctgaggcaggagaatcgcttgaacccgggaggcggaggttacagtgagccgagatcacatcactgcactccagcctgggcgacagagcgagactccatctcaaaaaaaaaaaaaaactcttgtatctcaatatttttaaaccacaggcctaaataaaactaattttgctcaagttttctcaacctagggaaaaagaactatggttccatattcaaaataaatattatagacccttttcctaagtaggattttgtggtttactgattgggtaatttgatcattaaaattatgtgaaatctgcccgggcacacctcatgcctgtaatcccagcactctgggaggccaaggcagatgatcacctgaggtcaggagttctagaccagcctggctaacatggtgaaaccctgtatctgctaaaaatacaaaaattagccaggcgtggtggcgggctcctgtaatcccagctactttggaggcgaggcacgagaatcgcttgaacctgggaggcggagtttgcagtgagccgagatcacgccattgcactccagcctgggcgacagagcgagactgcgtctcaaaaaaaaaaaaaaaagaaaaattatgtgaaatcatgtgatttgcctgggaaaacttgtttagatattgagctacttatgccttctagcctttatattaattgtatgtaatgttattaaatatatatatagttcatctttacatttggaaatgcccaacatttttttcatataagtccttaaacaagcgttcattttattttaaatctatacagtgaactggccaagatattttaagagggaactttaatatcccatttattgtttttataaccctggacttataaaaatgggttgtttgaagggttattttgaaagtgggggaaaaaaaaacttagttgctaatgtatctaaacttcagcagagctttttggtgatctcctacctgcaccctcaactcttgacaaagaagcaagactatagattcattttctgaaggggatcatgtatggaattttttgatgagtttttacttttacctctctactcttgattttctattattgaatactcttttaaaacactgatttttaaggctttatatatgttttccaggctgatgttcacatctttttttcatgaactatcagaatatagtgaacacttttcaaatatttaaggacttaatgtttaaaaagccataaaatagagagtggtaatactaccaaataattacttaaaactgaaagctaagttatcaatagtttatataagagatgttttctgaggagatgtgcatccagtgagaccaaggtagaaagtttatataattgttttttttccagtaaatatgaaaaaaaaagctgtagcttgtttattacatgtccaaaatacagtggagccttactttaacacaatgtactgtaacttggaatttgttctgttatgagtctatcttgaattcccatccatgaaactgtagtcaccaaaagcaacaagtattttcacatgatgtaaaagaccatactatgatggccattgctagaaattgaatcacaaataatagctaataatttttcatttttcaaaaaagatcatttggatagcagctatgtataaaatggaaaataaaaaattattctattttgcatgaatagttcagactttcccataccacagccaagcagtaactaaaattaggatcttaattttcaatgataaaaggtctaaggttcatttaattatgctcctttaacactgtctttctagatttttcacccagtattttcaaaatttgggaatgtaaacaattgatatatttattgtatgttggctagcagttcatccttctgcaaaatatgcattcagagaaatgtgaagcttgttttaatgaagacttaaaccatttgtgtcatttgtgttttcatattcaaatacaccaaattaaaattctgaacctatatttttcatcattaacttcctaatataccagaacatatacctttttcatgtaaagttggcaatgggatatggcagttttatttttgaaaaatatgtaacatgactttaatatttttatagttttcagaattagaaacataggaagggaaaatgttttaattagataagtcaactttttatgtgtctgtagtggtgtactataatagcaaattataaagcattattaaatgtttataataatttttaatattacctacattatgaatttaactaaaataaagtgtgagttgtatattttttaattgggttgtttcaatagctggaagcatcctgaagcattatattgatttttgaactatttgaactcaaactgagtatgatttgaaaataaattaataatttaaaaaca

SEQ ID NO: 12378 - DNA, 2456 bp, Homo sapiens
actaccgcgaggaacagcgcccaaagtcacgcgaagatgcagtttctccgtatccgcaggcttctttcgctggcgccattacctgagttctcctccagcgtttccgcaccctctccgattagcggtcccaggagtttccaaggtaaccgcgcagtagggcggatctcattaggcggaaagcgaaacccggaagtgacgctcttaccgggtgtcagcagcgagagggttcgaagatggcggcgcgcaagggtcggcggcgcacgtgtgaaaccggggaacccatggaagccgagtccggcgacacaagttccgagggcccggcccaggtctacctgcccggccgggggccgccgctacgcgaaggggaggagctggtcatggacgaggaggcctatgtgctctaccaccgagcgcagactggcgccccctgtctcagctttgacatagtccgggatcacctgggagacaaccggacagagcttcctcttacactttacttgtgtgctgggacccaggctgagagcgcccagagcaacagactgatgatgcttcggatgcacaatctgcatgggacaaagcccccaccctcagagggcagtgatgaagaagaagaggaggaagatgaagaggatgaagaagagcggaaacctcagctggagctggccatggtgccccactatggtggcatcaaccgagttcgggtgtcatggctgggtgaagagcctgtggctggggtgtggtcagagaagggccaggtggaggtgtttgcgctgcggcggcttctgcaggtggtggaggagccccaggccctggcagccttcctccgggatgagcaggcccaaatgaagcccatcttctccttcgctggacacatgggcgagggctttgcccttgactggtccccccgggtgaccggtcgcctgctgaccggtgactgtcaaaagaacatccacctctggacacctacggacggcggctcctggcacgtggaccagcggccattcgtgggccacacacgctctgtggaggacctgcagtggtcaccgactgagaacacggtgtttgcctcctgctcagctgacgcctccatccgcatctgggacatccgggcagcccccagcaaggcctgcatgctcaccacagccaccgcccatgatggggacgtcaatgtcatcagctggagccgccgggagcccttcctgctcagtggcggggatgatggggccctcaagatctgggaccttcggcagttcaagtctggttccccagtggccaccttcaagcagcacgtggcccccgtgacctccgtcgagtggcacccccaggacagcggggtctttgcagcctcgggtgcagaccaccagatcacacagtgggacctggcagtggagcgggaccctgaggcgggcgacgtggaggccgaccccggactggccgacctcccgcagcagctgctgttcgtgcaccagggcgagaccgagctgaaggagctgcactggcacccgcagtgcccagggctcctggtcagcacggcgctgtcaggcttcaccatcttccgcaccatcagcgtctgaggcgtcccactggctctgatcttgcttcctgcttggaaactgaagtcgaattgggctcccctggaaggggttcattcaggtctgttgactgagactggccggcctgtgggctgccgtgatggattctgtttgacgtattgttctctagaaggcctggctctgatccagtgacccctctcaccaaagaactcggtttaaccagggctctgtaagaccactcccacccagagacttgtgtggcctggtgtggcctgtgtgtcggattccttcctgtcagctgtgacccatttgacctgtgtccccagaacccagttttttgtttgtttgtttgagacggagtcttggtctgtcgcccaggctggagtgcagtagcacgatcttggctcactgcaacctccgcctcctgggttaaagtgattctctcagctcagtctcccaggtagctgggattacaggcatgtgccaccacaccccgttaatttttgtatttttagtagagacggggtttcaccatgttggccaggctggtctcaaattcttgatctcaagtgatctgtccgccccggcctcccagagtgctgggttgggattacaggcgtgagccaccgcgtccggctcaggacccagttttggctgctggttcccagcaggggactcgggggatatacagtggctgcaccaaattggaggtgtgggttcctccaacacaatttgcttctgcccgttgtcttcctgccagctgggtttggccaggatttctccgtgtgggggctacatgcgaccctctcccctcctccctgactttagaggctggtgctgtgtcgggaggaaggtcagggctcctgagcagcaataaaggaccaggaagaggcctgaggtgta

SEQ ID NO: 12379 - DNA, 3976 bp, Homo sapiens
gcggggatgcggctgtgggcgccggggccgggtagctgctccaggcgcgcgagctaaccgagtgcggcgagggcctaccaggggcgacagggtttctctccgcaagcgcgcgatgcagcgggcggcggcgctggtccggcggggctgtggtccccggacccccagctcctggggccgcagccagagcagcgcggccgccgaggcctcggcggtgctcaaggtgcggcccgagcgcagccggcgcgagcgcatcctcacgctggagtccatgaacccgcaggtgaaggcggtggagtacgccgtgcggggacccatcgtgctcaaggccggcgagatcgagctcgagctgcagcggggtatcaaaaagccattcacagaggtcatccgagccaacatcggggacgcccaggctatggggcagcagccaatcaccttcctccggcaggtgatggcactatgcacctacccaaacctgctggacagccccagcttcccagaagatgctaagaaacgtgcccggcggatcctgcaggcttgtggcgggaacagcctggggtcctacagtgctagccagggtgtcaactgcatccgtgaagatgtggctgcctacatcaccaggagggatggcggtgtgcctgcggaccccgacaacatctacctgaccacgggagctagtgacggcatttctacgatcctgaagatcctcgtctccgggggcggcaagtcacggacaggtgtgatgatccccatcccacaatatcccctctattcagctgtcatctctgagctcgacgccatccaggtgaattactacctggacgaggagaactgctgggcgctgaatgtgaatgagctccggcgggcggtgcaggaggccaaagaccactgtgatcctaaggtgctctgcataatcaaccctgggaaccccacaggccaggtacaaagcagaaagtgcatagaagatgtgatccactttgcctgggaagagaagctctttctcctggctgatgaggtgtaccaggacaacgtgtactctccagattgcagattccactccttcaagaaggtgctgtacgagatggggcccgagtactccagcaacgtggagctcgcctccttccactccacctccaagggctacatgggcgagtgtggttacagaggaggctacatggaggtgatcaacctgcaccctgagatcaagggccagctggtgaagctgctgtcggtgcgcctgtgccccccagtgtctgggcaggccgccatggacattgtcgtgaaccccccggtggcaggagaggagtcctttgagcaattcagccgagagaaggagtcggtcctgggtaatctggccaaaaaagcaaagctgacggaagacctgtttaaccaagtcccaggaattcactgcaaccccttgcagggggccatgtacgccttccctcggatcttcattcctgccaaagctgtggaggctgctcaggcccatcaaatggctccagacatgttctactgcatgaagctcctggaggagactggcatctgtgtcgtgcccggcagtggctttgggcagagggaaggcacttaccacttcaggatgactatcctccctccagtggagaagctgaaaacggtgctgcagaaggtgaaagacttccacatcaacttcctggagaagtacgcgtgaggacgcctgagccccagcgggagacctgtccttggctcttcctcccaatgcccgtcaggctgaactcgcctcccccgtgactctgcctcgggcctcgcagaggccgctggtcacttcgtcatcattttgcccctggagacgtctttctttgtgccttgatgttgagagcgcctctcttttgagcaaacaagcattctatatgcaaccagagtagaggggacctgctcagcaggtgtgaccagggttctctgaatctgttattgtttttgcttctggaaagttcatttggggtttacaacaactaggatgtgttgggtgagatgtttcagatctggagaaatgagcaggtgtcgggaaatgtgtgacttaaccgtggtgagggctggaaatccaaactcaccaccatgatctgtgaaataaagcccttagcggtgtgaagcatccggtcctttgaacagaagggcctggaaggcccctggggctgagaaagggtccgcccggtggcctggaggcaggcgccgggagcgcagtagcacgtggactgggcaggatgttgcactagcttggggtagatgctgggggctgcggccacggtcagagggccccactgtgaggcgtgggtgtgagccaggctgcaggaggaactgggcctccgcttcccagcaacgcagccaggcctgagaattctgtgcgcccggcgggctttgggaatgaggggttcccttgaacatgcgtaggctggaaccccgtctgagaggtctccctgaatttcagtgacacatagtgcagcccggcagtgtcccacttccgtggagagagccgctggaatggtgtggacccatcccgcgggtgaccggtgcctgttctcccctgaccgagcctgtgagcacatcgccccctgctggcgacagcggggaaatgagggctgaaaatatcctccccacaagggcaatccccgggacctgccgagcagccaaggccctgtcctttcttgaatggtggcgagctgaatctggtcggtttcctagcttttaggtggtaaaagtgcctggcagcttggctgccgtggaggagtcagtcgtggttggaggttcattgccgtgctttcatgcagagtgttttgccttcatgttagcttccggctcccctcccaggctgcagactctgacctgtggcatcaggcttctcccagtacaggagggtgccatcccccagcatgcggcttctctgccattagcagccctgggcgggccgaccacactcgaggctgcggtgctacgggcttagccctcgcctccctcactgggagcttccccatcctccctgccttccccagtgggaagttagggaagctcaggagcctgggaccccgcatgtcccaaaatgggattggagaagctggagagaaagcagaagaggccgaggagtgaggcagcagcctctatgctgtgatttccacaccgggtccgtgcagaggaaacagaaactcccaactgtccttacccaccgacatcacagcccctatgaagaaagtagccacaatctcaaataacaaaagggaatgttctaaaactttttcttccttaaaaaatggagaaaattgcacttgtgcttgctgtgtggtatataaaccaggattagtcccagggtcgtgaggtttctggtgaaaaggttaaatcgtagaagctagtatattttttatatttttgtaacaattgcttttttcatgggggaggcggggttagtatttatagtcctaacaagtccagtaattttttataaatcttcagattataaacagcccctaaaaactttacaacgtttacacagttttttaaaaagagactgtatacacttgatttgctttcaaaataaataaggtcagctagtctaggaggttaacgtcgggtaggaatgctgatcatgataggtttggttttctacagattctgttccggtgcctttcctatccaggcaccacctgagaaagttgtcatttgaggtcgcacttggaagttacatctgtgaagtttctgtcattcgtccagatctgtgtgtgtagcatgtgctgaggaagcacgtgctgggctgtgcctcagacagtgcatcaccgggcacccagaggcttgcctggctattcctgttctggtgtgtgtggagtgttggggaggaacagatgcagatcaacctgtggctgttttcccgtctaggttctcacaggtatctcctgacagaggtacttaacaatggctctgctggaaatttctataaataaaatgtccaaaatggtga

SEQ ID NO: 12380 - DNA, 3873 bp, Homo sapiens
aattgttgagcgggccgtgctgccaggcaccgcacgttgtgtgtctgccctactctcgtggaaccaaggtccagtggagagaggaacataagcgaatgaagaaagaagcaatagagtctcagtgataagttcttggaaaaaaggtctttgccaatcctgattcccggaagagagtcggcagaattccttcctttaggcccctctggagccttggccgaccagccacttctgtggtctggggacagtcaccgagggtatcaaaaagccattcacagaggtcatccgagccaacatcggggacgcccaggctatggggcagcagccaatcaccttcctccggcaggtgatggcactatgcacctacccaaacctgctggacagccccagcttcccagaagatgctaagaaacgtgcccggcggatcctgcaggcttgtggcgggaacagcctggggtcctacagtgctagccagggtgtcaactgcatccgtgaagatgtggctgcctacatcaccaggagggatggcggtgtgcctgcggaccccgacaacatctacctgaccacgggagctagtgacggcatttctacgatcctgaagatcctcgtctccgggggcggcaagtcacggacaggtgtgatgatccccatcccacaatatcccctctattcagctgtcatctctgagctcgacgccatccaggtgaattactacctggacgaggagaactgctgggcgctgaatgtgaatgagctccggcgggcggtgcaggaggccaaagaccactgtgatcctaaggtgctctgcataatcaaccctgggaaccccacaggccaggtacaaagcagaaagtgcatagaagatgtgatccactttgcctgggaagagaagctctttctcctggctgatgaggtgtaccaggacaacgtgtactctccagattgcagattccactccttcaagaaggtgctgtacgagatggggcccgagtactccagcaacgtggagctcgcctccttccactccacctccaagggctacatgggcgagtgtggttacagaggaggctacatggaggtgatcaacctgcaccctgagatcaagggccagctggtgaagctgctgtcggtgcgcctgtgccccccagtgtctgggcaggccgccatggacattgtcgtgaaccccccggtggcaggagaggagtcctttgagcaattcagccgagagaaggagtcggtcctgggtaatctggccaaaaaagcaaagctgacggaagacctgtttaaccaagtcccaggaattcactgcaaccccttgcagggggccatgtacgccttccctcggatcttcattcctgccaaagctgtggaggctgctcaggcccatcaaatggctccagacatgttctactgcatgaagctcctggaggagactggcatctgtgtcgtgcccggcagtggctttgggcagagggaaggcacttaccacttcaggatgactatcctccctccagtggagaagctgaaaacggtgctgcagaaggtgaaagacttccacatcaacttcctggagaagtacgcgtgaggacgcctgagccccagcgggagacctgtccttggctcttcctcccaatgcccgtcaggctgaactcgcctcccccgtgactctgcctcgggcctcgcagaggccgctggtcacttcgtcatcattttgcccctggagacgtctttctttgtgccttgatgttgagagcgcctctcttttgagcaaacaagcattctatatgcaaccagagtagaggggacctgctcagcaggtgtgaccagggttctctgaatctgttattgtttttgcttctggaaagttcatttggggtttacaacaactaggatgtgttgggtgagatgtttcagatctggagaaatgagcaggtgtcgggaaatgtgtgacttaaccgtggtgagggctggaaatccaaactcaccaccatgatctgtgaaataaagcccttagcggtgtgaagcatccggtcctttgaacagaagggcctggaaggcccctggggctgagaaagggtccgcccggtggcctggaggcaggcgccgggagcgcagtagcacgtggactgggcaggatgttgcactagcttggggtagatgctgggggctgcggccacggtcagagggccccactgtgaggcgtgggtgtgagccaggctgcaggaggaactgggcctccgcttcccagcaacgcagccaggcctgagaattctgtgcgcccggcgggctttgggaatgaggggttcccttgaacatgcgtaggctggaaccccgtctgagaggtctccctgaatttcagtgacacatagtgcagcccggcagtgtcccacttccgtggagagagccgctggaatggtgtggacccatcccgcgggtgaccggtgcctgttctcccctgaccgagcctgtgagcacatcgccccctgctggcgacagcggggaaatgagggctgaaaatatcctccccacaagggcaatccccgggacctgccgagcagccaaggccctgtcctttcttgaatggtggcgagctgaatctggtcggtttcctagcttttaggtggtaaaagtgcctggcagcttggctgccgtggaggagtcagtcgtggttggaggttcattgccgtgctttcatgcagagtgttttgccttcatgttagcttccggctcccctcccaggctgcagactctgacctgtggcatcaggcttctcccagtacaggagggtgccatcccccagcatgcggcttctctgccattagcagccctgggcgggccgaccacactcgaggctgcggtgctacgggcttagccctcgcctccctcactgggagcttccccatcctccctgccttccccagtgggaagttagggaagctcaggagcctgggaccccgcatgtcccaaaatgggattggagaagctggagagaaagcagaagaggccgaggagtgaggcagcagcctctatgctgtgatttccacaccgggtccgtgcagaggaaacagaaactcccaactgtccttacccaccgacatcacagcccctatgaagaaagtagccacaatctcaaataacaaaagggaatgttctaaaactttttcttccttaaaaaatggagaaaattgcacttgtgcttgctgtgtggtatataaaccaggattagtcccagggtcgtgaggtttctggtgaaaaggttaaatcgtagaagctagtatattttttatatttttgtaacaattgcttttttcatgggggaggcggggttagtatttatagtcctaacaagtccagtaattttttataaatcttcagattataaacagcccctaaaaactttacaacgtttacacagttttttaaaaagagactgtatacacttgatttgctttcaaaataaataaggtcagctagtctaggaggttaacgtcgggtaggaatgctgatcatgataggtttggttttctacagattctgttccggtgcctttcctatccaggcaccacctgagaaagttgtcatttgaggtcgcacttggaagttacatctgtgaagtttctgtcattcgtccagatctgtgtgtgtagcatgtgctgaggaagcacgtgctgggctgtgcctcagacagtgcatcaccgggcacccagaggcttgcctggctattcctgttctggtgtgtgtggagtgttggggaggaacagatgcagatcaacctgtggctgttttcccgtctaggttctcacaggtatctcctgacagaggtacttaacaatggctctgctggaaatttctataaataaaatgtccaaaatggtg

SEQ ID NO: 12381 - DNA, 1947 bp, Homo sapiens
gaaatctcttgattcctagtctctcgatatggcacctccgtcagtctttgccgaggttccgcaggcccagcctgtcctggtcttcaagctcactgccgacttcagggaggatccggacccccgcaaggtcaacctgggagtgggagcatatcgcacggatgactgccatccctgggttttgccagtagtgaagaaagtggagcagaagattgctaatgacaatagcctaaatcacgagtatctgccaatcctgggcctggctgagttccggagctgtgcttctcgtcttgcccttggggatgacagcccagcactcaaggagaagcgggtaggaggtgtgcaatctttggggggaacaggtgcacttcgaattggagctgatttcttagcgcgttggtacaatggaacaaacaacaagaacacacctgtctatgtgtcctcaccaacctgggagaatcacaatgctgtgttttccgctgctggttttaaagacattcggtcctatcgctactgggatgcagagaagagaggattggacctccagggcttcctgaatgatctggagaatgctcctgagttctccattgttgtcctccacgcctgtgcacacaacccaactgggattgacccaactccggagcagtggaagcagattgcttctgtcatgaagcaccggtttctgttccccttctttgactcagcctatcagggcttcgcatctggaaacctggagagagatgcctgggccattcgctattttgtgtctgaaggcttcgagttcttctgtgcccagtccttctccaagaacttcgggctctacaatgagagagtcgggaatctgactgtggttggaaaagaacctgagagcatcctgcaagtcctttcccagatggagaagatcgtgcggattacttggtccaatccccccgcccagggagcacgaattgtggccagcaccctctctaaccctgagctctttgaggaatggacaggtaatgtgaagacaatggctgaccggattctgaccatgagatctgaactcagggcacgactagaagccctcaaaacccctgggacctggaaccacatcactgatcaaattggcatgttcagcttcactgggttgaaccccaagcaggttgagtatctggtcaatgaaaagcacatctacctgctgccaagtggtcgaatcaacgtgagtggcttaaccaccaaaaatctagattacgtggccacctccatccatgaagcagtcaccaaaatccagtgaagaaacaccacccgtccagtaccaccaaagtagttctctgtcatgtgtgttccctgcctgcacaaacctacatgtacataccatggattagagacacttgcaggactgaaaggctgctctggtgaggcagcctctgtttaaaccggccccacatgaagagaacatcccttgagacgaatttggagactgggattagagcctttggaggtcaaagcaaattaagatttttatttaagaataaaagagtactttgatcatgagacataggtatcttgtccctctcactaaaaaggagtgttgtgtgtggcggccacgtgcttctatgtggtgtttgactctgtacaaattctagtcccaaagatcaagttgtctgaaggagccaaagtgtgaatgtgggtgtcggctgcggcattaaattcatcatctcaacccagagtgtctggtctccctgctctttctgcatggttgtgtccctagtcctaagctttggttctttagggtgactgtggtaagaaggatatttaatcatgacatgcacggacacgtacatatttaactgaaacaagttttaccaaacagtatttactcgtgatgtgcgtagtgcattctgatatttttgagccattctattgtgttctacttcacctaaaaaaataaaataaaaatgttgatcaaga

SEQ ID NO: 12382 - DNA, 1536 bp, Homo sapiens
gtcgcaacggccagacctgacctgccagctccgggcgtggggtgaaatctcttgattcctagtctctcgatatggcacctccgtcagtctttgccgaggttccgcaggcccagcctgtcctggtcttcaagctcactgccgacttcagggaggatccggacccccgcaaggtcaacctgggagtgggagcatatcgcacggatgacagcccagcactcaaggagaagcgggtaggaggtgtgcaatctttggggggaacaggtgcacttcgaattggagctgatttcttagcgcgttggtacaatggaacaaacaacaagaacacacctgtctatgtgtcctcaccaacctgggagaatcacaatgctgtgttttccgctgctggttttaaagacattcggtcctatcgctactgggatgcagagaagagaggattggacctccagggcttcctgaatgatctggagaatgctcctgagttctccattgttgtcctccacgcctgtgcacacaacccaactgggattgacccaactccggagcagtggaagcagattgcttctgtcatgaagcaccggtttctgttccccttctttgactcagcctatcagggcttcgcatctggaaacctggagagagatgcctgggccattcgctattttgtgtctgaaggcttcgagttcttctgtgcccagtccttctccaagaacttcgggctctacaatgagagagtcgggaatctgactgtggttggaaaagaacctgagagcatcctgcaagtcctttcccagatggagaagatcgtgcggattacttggtccaatccccccgcccagggagcacgaattgtggccagcaccctctctaaccctgagctctttgaggaatggacaggtaatgtgaagacaatggctgaccggattctgaccatgagatctgaactcagggcacgactagaagccctcaaaacccctgggacctggaaccacatcactgatcaaattggcatgttcagcttcactgggttgaaccccaagcaggttgagtatctggtcaatgaaaagcacatctacctgctgccaagtggtcgaatcaacgtgagtggcttaaccaccaaaaatctagattacgtggccacctccatccatgaagcagtcaccaaaatccagtgaagaaacaccacccgtccagtaccaccaaagtagttctctgtcatgtgtgttccctgcctgcacaaacctacatgtacataccatggattagagacacttgcaggactgaaaggctgctctggtgaggcagcctctgtttaaaccggccccacatgaagagaacatcccttgagacgaatttggagactgggattagagcctttggaggtcaaagcaaattaagatttttatttaagaataaaagagtactttgatcatgagacataggtatcttgtccctctcactaaaaaggagtgttgtgtgtggcggccacgtgcttctatgtggtgtttgactctgtacaaattctagtcccaaagatca

SEQ ID NO: 12383 - DNA, 1432 bp, Homo sapiens
aaggatgtagtgctctggagtgtgagcagctcggggagtggagcggacccaacccaggtcgtggagactgtgggagaagccgaggcccagtgtggcgctgcctgaagagggcggcgccggagaggaggctggatccacgaaggcttcctaaaacctgcccattttacagatgcaggtgtggagtccctggaaaggggcgatgtgtccgaggccgcacaaaccagcatatcgcacggatgactgccatccctgggttttgccagtagtgaagaaagtggagcagaagattgctaatgacaatagcctaaatcacgagtatctgccaatcctgggcctggctgagttccggagctgtgcttctcgtcttgcccttggggatgacagcccagcactcaaggagaagcgggtaggaggtgtgcaatctttggggggaacaggtgcacttcgaattggagctgatttcttagcgcgttggtacaatggaacaaacaacaagaacacacctgtctatgtgtcctcaccaacctgggagaatcacaatgctgtgttttccgctgctggttttaaagacattcggtcctatcgctactgggatgcagagaagagaggattggacctccagggcttcctgaatgatctggagaatgctcctgagttctccattgttgtcctccacgcctgtgcacacaacccaactgggattgacccaactccggagcagtggaagcagattgcttctgtcatgaagcaccggtttctgttccccttctttgactcagcctatcagggcttcgcatctggaaacctggagagagatgcctgggccattcgctattttgtgtctgaaggcttcgagttcttctgtgcccagtccttctccaagaacttcgggctctacaatgagagagtcgggaatctgactgtggttggaaaagaacctgagagcatcctgcaagtcctttcccagatggagaagatcgtgcggattacttggtccaatccccccgcccagggagcacgaattgtggccagcaccctctctaaccctgagctctttgaggaatggacaggtaatgtgaagacaatggctgaccggattctgaccatgagatctgaactcagggcacgactagaagccctcaaaacccctgggacctggaaccacatcactgatcaaattggcatgttcagcttcactgggttgaaccccaagcaggttgagtatctggtcaatgaaaagcacatctacctgctgccaagtggtcgaatcaacgtgagtggcttaaccaccaaaaatctagattacgtggccacctccatccatgaagcagtcaccaaaatccagtgaagaaacaccacccgtccagtaccaccaaagtagttctctgtcatgtgtgttccctgcctgcacaaacctacatgtacataccat

SEQ ID NO: 12384 - DNA, 2385 bp, Homo sapiens
gctcgccctctgctccgtcctgcggctgcccactgccctcctacggtccaccatggccctgctgcactccggccgcgtcctccccgggatcgccgccgccttccacccgggcctcgccgccgcggcctctgccagagccagctcctggtggacccatgtggaaatgggacctccagatcccattctgggagtcactgaagcctttaagagggacaccaatagcaaaaagatgaatctgggagttggtgcctaccgggatgataatggaaagccttacgttctgcctagcgtccgcaaggcagaggcccagattgccgcaaaaaatttggacaaggaatacctgcccattgggggactggctgaattttgcaaggcatctgcagaactagccctgggtgagaacagcgaagtcttgaagagtggccggtttgtcactgtgcagaccatttctggaactggagccttaaggatcggagccagttttctgcaaagattttttaagttcagccgagatgtctttctgcccaaaccaacctggggaaaccacacacccatcttcagggatgctggcatgcagctacaaggttatcggtattatgaccccaagacttgcggttttgacttcacaggcgctgtggaggatatttcaaaaataccagagcagagtgttcttcttctgcatgcctgcgcccacaatcccacgggagtggacccgcgtccggaacagtggaaggaaatagcaacagtggtgaagaaaaggaatctctttgcgttctttgacatggcctaccaaggctttgccagtggtgatggtgataaggatgcctgggctgtgcgccacttcatcgaacagggcattaatgtttgcctctgccaatcatatgccaagaacatgggcttatatggtgagcgtgtaggagccttcactatggtctgcaaagatgcggatgaagccaaaagggtagagtcacagttgaagatcttgatccgtcccatgtattccaaccctcccctcaatggggcccggattgctgctgccattctgaacaccccagatttgcgaaaacaatggctgcaagaagtgaaagtcatggctgaccgcatcattggcatgcggactcaactggtctccaacctcaagaaggagggttccacccacaattggcaacacatcaccgaccaaattggcatgttctgtttcacagggctaaagcctgaacaggtggagcggctgatcaaggagttctccatctacatgacaaaagatggccgcatctctgtggcaggggtcacctccagcaacgtgggctaccttgcccatgccattcaccaggtcaccaagtaatgtccctggtgcgaggaaacagagacaacctttctgtcttcagcctctgctattgagagcttcacacagacaatgagagagggtggatggtggtgagtggatcatttctttcagccacagtgtgtaacactcagcatttgaatgtttctcagaaaagaacatgtagtgacacagggcagaggcatccatggctggcgtctggaatattaaaccaaactctccccggtccttttttctccaacttttctcaaagagtttacatgtgcaagaaagtcatcgcaccaaaaaacctgtcaattatgccattgcaatatttcagaagctttaactgaagtgtcaggttcctcgtgagaaacagcacacgttagaggctttgagagaaggcctagttctgtcatgagtagtcggcctcgtgtctgtcctcccatcttggaacaaccttatcaacaggccgcactgcagaaatgatgttttatgaaaaccaatgaggctgctgccactccagcaagggaaataatgcagtttcctgtcttatttaagaaaaagagaaggctctcttttctcccttgtcattgccgttcttttccttacacgcaaagattttttaactattgcagattttcatcccattctactgcttgattgaccatcaactccatcctatcgagatttatttaagaatgaagaacataattttctgctgatgctgtaccctcacccttttcagcaaagaatagtggagagtaggaaactgtactttatctcggcatcctcttgaatgatagtgcaagtttctccagttgggatgttgtctctgcccggttggacctcctccctttgttgaatgtggtgtgcagcctctcatctcacactgtgagtccagcggcgcagggtggtaccaggaaagaggatattctaggctttgcgtgctgctagctgggttcaggcttcacccactggaaagaaccaccatctgctctaaccatgtagacttattgcggcctggtttctctgttacaataaaattactgtagacccaa

SEQ ID NO: 12385 - DNA, 1342 bp, Homo sapiens
accttcagcaggagccggttccctgtgtgtgtgtccgctcgccctctgctccgtcctgcggctgcccactgccctcctacggtccaccatggccctgctgcactccggccgcgtcctccccgggatcgccgccgccttccacccgggcctcgccgccgcggcctctgccagagccagctcctggtggacccatgtggaaatgggacctccagatcccattctgggagtcactgaagcctttaagagggacaccaatagcaaaaagatgaatctgggagttggtgcctaccgggatgataatggaaagccttacgttctgcctagcgtccgcaaggcagaggcccagattgccgcaaaaaatttggacaaggaatacctgcccattgggggactggctgaattttgcaaagattttttaagttcagccgagatgtctttctgcccaaaccaacctggggaaaccacacacccatcttcagggatgctggcatgcagctacaaggttatcggtattatgaccccaagacttgcggttttgacttcacaggcgctgtggaggatatttcaaaaataccagagcagagtgttcttcttctgcatgcctgcgcccacaatcccacgggagtggacccgcgtccggaacagtggaaggaaatagcaacagtggtgaagaaaaggaatctctttgcgttctttgacatggcctaccaaggctttgccagtggtgatggtgataaggatgcctgggctgtgcgccacttcatcgaacagggcattaatgtttgcctctgccaatcatatgccaagaacatgggcttatatggtgagcgtgtaggagccttcactatggtctgcaaagatgcggatgaagccaaaagggtagagtcacagttgaagatcttgatccgtcccatgtattccaaccctcccctcaatggggcccggattgctgctgccattctgaacaccccagatttgcgaaaacaatggctgcaagaagtgaaagtcatggctgaccgcatcattggcatgcggactcaactggtctccaacctcaagaaggagggttccacccacaattggcaacacatcaccgaccaaattggcatgttctgtttcacagggctaaagcctgaacaggtggagcggctgatcaaggagttctccatctacatgacaaaagatggccgcatctctgtggcaggggtcacctccagcaacgtgggctaccttgcccatgccattcaccaggtcaccaagtaatgtccctggtgcgaggaaacagagacaacctttctgtcttcagcctctgctattgagagcttcacacagacaatgagag

SEQ ID NO: 12386 - DNA, 1615 bp, Homo sapiens
ccctgtccttaccttcagcaggagccggttccctgtgtgtgtgtccgctcgccctctgctccgtcctgcggctgcccactgccctcctacggtccaccatggccctgctgcactccggccgcgtcctccccgggatcgccgccgccttccacccgggcctcgccgccgcggcctctgccagagccagctcctggtggacccatgtggaaatgggacctccagatcccattctgggagtcactgaagcctttaagagggacaccaatagcaaaaagatgaatctgggagttggtgcctaccgggatgataatggaaagccttacgttctgcctagcgtccgcaagtttgtcactgtgcagaccatttctggaactggagccttaaggatcggagccagttttctgcaaagattttttaagttcagccgagatgtctttctgcccaaaccaacctggggaaaccacacacccatcttcagggatgctggcatgcagctacaaggttatcggtattatgaccccaagacttgcggttttgacttcacaggcgctgtggaggatatttcaaaaataccagagcagagtgttcttcttctgcatgcctgcgcccacaatcccacgggagtggacccgcgtccggaacagtggaaggaaatagcaacagtggtgaagaaaaggaatctctttgcgttctttgacatggcctaccaaggctttgccagtggtgatggtgataaggatgcctgggctgtgcgccacttcatcgaacagggcattaatgtttgcctctgccaatcatatgccaagaacatgggcttatatggtgagcgtgtaggagccttcactatggtctgcaaagatgcggatgaagccaaaagggtagagtcacagttgaagatcttgatccgtcccatgtattccaaccctcccctcaatggggcccggattgctgctgccattctgaacaccccagatttgcgaaaacaatggctgcaagaagtgaaagtcatggctgaccgcatcattggcatgcggactcaactggtctccaacctcaagaaggagggttccacccacaattggcaacacatcaccgaccaaattggcatgttctgtttcacagggctaaagcctgaacaggtggagcggctgatcaaggagttctccatctacatgacaaaagatggccgcatctctgtggcaggggtcacctccagcaacgtgggctaccttgcccatgccattcaccaggtcaccaagtaatgtccctggtgcgaggaaacagagacaacctttctgtcttcagcctctgctattgagagcttcacacagacaatgagagagggtggatggtggtgagtggatcatttctttcagccacagtgtgtaacactcagcatttgaatgtttctcagaaaagaacatgtagtgacacagggcagaggcatccatggctggcgtctggaatattaaaccaaactctccccggtccttttttctccaacttttctcaaagagtttacatgtgcaagaaagtcatcgcaccaaaaaacctgtcaattatgccattgcaatatttcagaagctttaactgaagtgtcaggttcctcgtgaga

SEQ ID NO: 12387 - DNA, 1885 bp, Homo sapiens
agacgggtggggcggggcccaactgtccccagctccttcagccctttctgtccctcccagtgaggccagctgcggtgaagagggtgctctcttgcctggagttccctctgctacggctgccccctcccagccctggcccactaagccagacccagctgtcgccattcccacttctggtcctgccacctcctgagctgccttcccgcctggtctgggtagagtcatggcctcgagcacaggtgaccggagccaggcggtgaggcatggactgagggcgaaggtgctgacgctggacggcatgaacccgcgtgtgcggagagtggagtacgcagtgcgtggccccatagtgcagcgagccttggagctggagcaggagctgcgccagggtgtgaagaagcctttcaccgaggtcatccgtgccaacatcggggacgcacaggctatggggcagaggcccatcaccttcctgcgccaggtcttggccctctgtgttaaccctgatcttctgagcagccccaacttccctgacgatgccaagaaaagggcggagcgcatcttgcaggcgtgtgggggccacagtctgggggcctacagcgtcagctccggcatccagctgatccgggaggacgtggcgcggtacattgagaggcgtgacggaggcatccctgcggaccccaacaacgtcttcctgtccacaggggccagcgatgccatcgtgacggtgctgaagctgctggtggccggcgagggccacacacgcacgggtgtgctcatccccatcccccagtacccactctactcggccacgctggcagagctgggcgcagtgcaggtggattactacctggacgaggagcgtgcctgggcgctggacgtggccgagcttcaccgtgcactgggccaggcgcgtgaccactgccgccctcgtgcgctctgtgtcatcaaccctggcaaccccaccgggcaggtgcagacccgcgagtgcatcgaggccgtgatccgcttcgccttcgaagagcggctctttctgctggcggacgaggtgtaccaggacaacgtgtacgccgcgggttcgcagttccactcattcaagaaggtgctcatggagatggggccgccctacgccgggcagcaggagcttgcctccttccactccacctccaagggctacatgggcgagtgcgggttccgcggcggctatgtggaggtggtgaacatggacgctgcagtgcagcagcagatgctgaagctgatgagtgtgcggctgtgcccgccggtgccaggacaggccctgctggacctggtggtcagcccgcccgcgcccaccgacccctcctttgcgcagttccaggctgagaagcaggcagtgctggcagagctggcggccaaggccaagctcaccgagcaggtcttcaatgaggctcctggcatcagctgcaacccagtgcagggcgccatgtactccttcccgcgcgtgcagctgcccccgcgggcggtggagcgcgctcaggagctgggcctggcccccgatatgttcttctgcctgcgcctcctggaggagaccggcatctgcgtggtgccagggagcggctttgggcagcgggaaggcacctaccacttccggatgaccattctgccccccttggagaaactgcggctgctgctggagaagctgagcaggttccatgccaagttcaccctcgagtactcctgagcaccccagctggggccaggctgggtcgccctggactgtgtgctcaggagccctgggaggctctggagcccactgtacttgctcttgatgcctggcggggtggggtggggggggtgctgggcccctgcctctctgcaggtccctaataaagctgtgtggcagtctgactcc

SEQ ID NO: 12388 - DNA, 1822 bp, Homo sapiens
agggctgccacttggactcccttgccagggggcgggcaggggctggctctgcctggggccaggcccatgttaacctgtgccccggcctgggggccagaggggcaggcctgcgcacggggaggctgttgtggcagcggaacagagacgtgcacgagtcatggcctcgagcacaggtgaccggagccaggcggtgaggcatggactgagggcgaaggtgctgacgctggacggcatgaacccgcgtgtgcggagagtggagtacgcagtgcgtggccccatagtgcagcgagccttggagctggagcaggagctgcgccagggtgtgaagaagcctttcaccgaggtcatccgtgccaacatcggggacgcacaggctatggggcagaggcccatcaccttcctgcgccaggtcttggccctctgtgttaaccctgatcttctgagcagccccaacttccctgacgatgccaagaaaagggcggagcgcatcttgcaggcgtgtgggggccacagtctgggggcctacagcgtcagctccggcatccagctgatccgggaggacgtggcgcggtacattgagaggcgtgacggaggcatccctgcggaccccaacaacgtcttcctgtccacaggggccagcgatgccatcgtgacggtgctgaagctgctggtggccggcgagggccacacacgcacgggtgtgctcatccccatcccccagtacccactctactcggccacgctggcagagctgggcgcagtgcaggtggattactacctggacgaggagcgtgcctgggcgctggacgtggccgagcttcaccgtgcactgggccaggcgcgtgaccactgccgccctcgtgcgctctgtgtcatcaaccctggcaaccccaccgggcaggtgcagacccgcgagtgcatcgaggccgtgatccgcttcgccttcgaagagcggctctttctgctggcggacgaggtgtaccaggacaacgtgtacgccgcgggttcgcagttccactcattcaagaaggtgctcatggagatggggccgccctacgccgggcagcaggagcttgcctccttccactccacctccaagggctacatgggcgagtgcgggttccgcggcggctatgtggaggtggtgaacatggacgctgcagtgcagcagcagatgctgaagctgatgagtgtgcggctgtgcccgccggtgccaggacaggccctgctggacctggtggtcagcccgcccgcgcccaccgacccctcctttgcgcagttccaggctgagaagcaggcagtgctggcagagctggcggccaaggccaagctcaccgagcaggtcttcaatgaggctcctggcatcagctgcaacccagtgcagggcgccatgtactccttcccgcgcgtgcagctgcccccgcgggcggtggagcgcgctcaggagctgggcctggcccccgatatgttcttctgcctgcgcctcctggaggagaccggcatctgcgtggtgccagggagcggctttgggcagcgggaaggcacctaccacttccggatgaccattctgccccccttggagaaactgcggctgctgctggagaagctgagcaggttccatgccaagttcaccctcgagtactcctgagcaccccagctggggccaggctgggtcgccctggactgtgtgctcaggagccctgggaggctctggagcccactgtacttgctcttgatgcctggcggggtggggtggggggggtgctgggcccctgcctctctgcaggtccctaataaagctgtgtggcagtctgactccagg

SEQ ID NO: 12389 - DNA, 4834 bp, Homo sapiens
gagccttaggcggagcgaagagaaccggtcgcggcaatcctagcgcgcagcagcagcagcagcagcagcagcagcagcagcagcagcagcagcacccgcatccgctgcgggagtccgagccggaaccacacccaagtagctgccctttcctcttctgtcatctcaccgccccaccacagaccgcgttccccgaggaaaccggccgcccacgcccggagcatcctcccctgttgagcgggcgctgacggacccggcggcatgatgcggctgcgaggctcggggatgctgcgggacctgctcctgcggtcgcccgccggcgtgagcgcgactctgcggcgggcacagcccttggtcaccctgtgccggcgtccccgaggcgggggacggccggccgcgggcccggctgccgccgcgcgactccacccgtggtggggcgggggcggctggccggcggagcccctcgcgcggggcctgtccagctctccttcggagatcttgcaggagctgggcaaggggagcacgcatccgcagcccggggtgtcgccacccgctgccccggcggcgcccggccccaaggacggccccggggagacggacgcgtttggcaacagcgagggcaaagagctggtggcctcaggtgaaaataaaataaaacagggtctgttacctagcttggaagatttgctgttctatacaattgctgaaggacaagagaaaatacctgttcataaatttattacagcactcaaatctacaggattgcgaacgtctgatcccaggttgaaagagtgtatggatatgttaagattaactcttcaaacaacatcagatggtgtcatgctagacaaagatctttttaaaaaatgtgttcagagcaacattgttttgttgacacaagcatttagaagaaagtttgtgattcctgactttatgtcttttacctcacacattgatgagttatatgaaagtgctaaaaagcagtctggaggaaaggttgcagattatattcctcaactggccaaattcagtcccgatttgtggggtgtgtctgtttgtacagtagatggacagaggcattctactggagataccaaagttcccttctgtcttcagtcctgtgtaaaacctttgaaatatgccattgctgttaatgatcttggaactgaatatgtgcatcgatatgttggaaaagagccgagtggactaagattcaacaaactatttttgaatgaagatgataaaccacataatcctatggtaaatgctggagcaattgttgtgacttcactaataaagcaaggagtaaataatgctgaaaaatttgactatgtcatgcagtttttgaataagatggctggtaatgaatatgttggattcagtaatgcaacgtttcagtctgaaagagaaagtggagatcgaaattttgcaataggatattacttaaaagaaaagaagtgttttccagaaggcacagacatggttggtatattagacttctacttccagctgtgctccattgaagtgacttgtgaatcagccagtgtgatggctgcgacactggctaatggtggtttctgcccaattactggtgaaagagtactgagccctgaagcagttcgaaatacattgagtttgatgcattcctgtggcatgtatgacttctcagggcagtttgctttccatgttggtcttcctgcaaaatctggagttgctgggggcattcttttagttgtccccaatgttatgggtatgatgtgctggtctcctcctctggataagatgggcaacagtgttaagggaattcacttttgtcacgatcttgtttctctgtgtaatttccataactatgataatttgagacactttgcaaaaaaacttgatcctcgaagagaaggtggtgatcaaagggtaaagtcagtgataaatcttttgtttgctgcatatactggagatgtgtctgcacttcgaagatttgctttgtcagctatggacatggaacagcgggactatgattctagaacagcactccatgtagctgctgcagagggtcatgttgaagttgttaaatttttgctggaagcctgcaaagtaaaccctttccccaaggacaggtggaataacactcccatggatgaagcactgcactttggacaccatgatgtatttaaaattctccaagaataccaagtccagtacacacctcaaggagattctgacaacgggaaggaaaatcaaaccgtccataagaatcttgatggattgttgtaatggtctcaaatcccaagatttaaatcacttacctatttaattgtggaaaatgattatgaagaacatgtgtatttctatctggtagtgatgtatattttacatttgtcatttcagtgttactggagttttcttcattgtgcacacaggacaaatctgatctctttgggaaaaaatagaaataaaacaatctccctccataatgtgagcaatattacctcgtgcattgtataatttgatgtaaaagaaatagttaccaatgctagcttgtgtggtcttccatgatttatttgtgttttgtgaattttcaatttatggtgatgatctgctgatatgcatttataaagtaagctctgttgtacagtctgtccaaatgggtcaaggttgcctttagaagcaaatagtgtgattttcaagacttcaaatacaaatttagtttaagtgtttgaacaactatatgcacttacggttgtgtgtttaaaatgtctctctcaccccctagcttcatgatgtgactcttaaaaaactataatagttaacaactgttagtaagatagaccaattctgattagactttatcagggaatctgtttaagatatgtttggtgaccaaaacgtatgtgtgaatgtagttataatgcttttgaaaaattttcctttttctatatccccttagtccagcctctcttctcagacatttagctatctgcctctttcctttagctgggaaagtgagagctggcatactatgcagtttttatgttttccatagtaagtcagaaaatgcctcctatttctggcatcagaactttgccatttgtctacagaagacgaaccagagacaaaattactaagtataaattagtcaagtttatcagtctaaaaaacgaagggatgtgcaactgcagctctttaagaagttttttttttttagcttctagggtaaagataaattcagaaatgctctaagctaccaaagttattctgaaagtatgggaactgctacaactaacaaacatttgtttccaagcctgtcattaagagtctgcatcaagagatttgtcctccttgggggaccactggatcattccagatttcttgtgatttttctattgtgtaattcttggtgggctctgtagtttaataataagaaaaaggccatttcattttaaattgtgacctataattctttgtcttgggttggtaattcaggattcatttggaaagtgggtaaaaggggcttcaaaaaacggatagaacaggattttctaggagttacacatacattttatcctgtcatacctcgagataaagtggcatgttagtgaggagttctgatattaagcacacacacacatgcacacaaatggacttctctgaagctgtgtttagtgaaatgagctcaagtacatgaatgttagttgttatcacatacagcaaattcctttttttttctttttctatgagcacactctgctgcttctaaactttacatgcctgatggcaccttactccagcagcctccaggtgctttcattttcacttccagtctaagccagtggctcctgccactgccctcccattacctagatggcacctcctttggtgaaaccacggccaatgttccttagctgcaccaggcccgaagctgttcccatgcttgagcttccatggggaggatgctgagtgagcagtttcctaccccgtggatctagcaagccatggagacaggtagcatttgtaagatgctgcacaggagcagcattatccccaaagatattacagggtagacacgttttaactgaaatcaatcaagataactttattcaaagagcagcccgctttgtgtgactaaaatgaaacaagacagttgaattgtgtgacttgaagattaccaatgattttgaggcttttctataataaaaagaggttctaaccattatttgggaacaaagagagttttcatcttttttcagatcaaaaccattctgtaaaatctttgttgtttaattaaatgtgccgttatttacccctgatgttatttatgactatgtgccgattcctgctcgggctgtttgctgttggctggtaataatatatttgatttaaatgctgttgactgtgctattaactgctgccgtcagtaaactccaaagatctttttgttttggctttagtatcatatgtgctttttctgtatcctgagcgctctatatgatcatgttaatttaaagctttatacacattgttgtttttgctggtctcatctttggtaatatgctataccccactgctgcccgacactgccctttagctgcagagctggattagctgttgaccatttgatgctgttgtctgtctggcagggactgaatgacctgatgtcagatttagattcttcctggggattacacagctatgaatgtatttgcttctaaaacctcccaaagtgaatctaatcttaaaactacaagttgtaagtattctgaaattgggaaacatttattttaaatgcaatcaggtagtgttgctttttacagcataataaatatatgtatcaaaaaaaaaa

SEQ ID NO: 12390 - DNA, 4475 bp, Homo sapiens
aggcggagcgaagagaaccggtcgcggcaatcctagcgcgcagcagcagcagcagcagcagcagcagcagcagcagcagcagcagcacccgcatccgctgcgggagtccgagccggaaccacacccaagtagctgccctttcctcttctgtcatctcaccgccccaccacagaccgcgttccccgaggaaaccggccgcccacgcccggagcatcctcccctgttgagcgggcgctgacggacccggcggcatgatgcggctgcgaggctcggggatgctgcgggacctgctcctgcggtcgcccgccggcgtgagcgcgactctgcggcgggcacagcccttggtcaccctgtgccggcgtccccgaggcgggggacggccggccgcgggcccggctgccgccgcgcgactccacccgtggtggggcgggggcggctggccggcggagcccctcgcgcggggcctgtccagctctccttcggagatcttgcaggagctgggcaaggggagcacgcatccgcagcccggggtgtcgccacccgctgccccggcggcgcccggccccaaggacggccccggggagacggacgcgtttggcaacagcgagggcaaagagctggtggcctcaggtgaaaataaaataaaacagggtctgttacctagcttggaagatttgctgttctatacaattgctgaaggacaagagaaaatacctgttcataaatttattacagcactcaaatctacaggattgcgaacgtctgatcccaggttgaaagagtgtatggatatgttaagattaactcttcaaacaacatcagatggtgtcatgctagacaaagatctttttaaaaaatgtgttcagagcaacattgttttgttgacacaagcatttagaagaaagtttgtgattcctgactttatgtcttttacctcacacattgatgagttatatgaaagtgctaaaaagcagtctggaggaaaggttgcagattatattcctcaactggccaaattcagtcccgatttgtggggtgtgtctgtttgtacagtagatggacagaggcattctactggagataccaaagttcccttctgtcttcagtcctgtgtaaaacctttgaaatatgccattgctgttaatgatcttggaactgaatatgtgcatcgatatgttggaaaagagccgagtggactaagattcaacaaactatttttgaatgaagatgataaaccacataatcctatggtaaatgctggagcaattgttgtgacttcactaataaagcaaggagtaaataatgctgaaaaatttgactatgtcatgcagtttttgaataagatggctggtaatgaatatgttggattcagtaatgcaacgtttcagtctgaaagagaaagtggagatcgaaattttgcaataggatattacttaaaagaaaagaagtgttttccagaaggcacagacatggttggtatattagacttctacttccagctgtgctccattgaagtgacttgtgaatcagccagtgtgatggctgcgacactggctaatggtggtttctgcccaattactggtgaaagagtactgagccctgaagcagttcgaaatacattgagtttgatgcattcctgtggcatgtatgacttctcagggcagtttgctttccatgttggtcttcctgcaaaatctggagttgctgggggcattcttttagttgtccccaatgttatgggtatgatgtgctggtctcctcctctggataagatgggcaacagtgttaagggaattcacttttgtcacgatcttgtttctctgtgtaatttccataactatgataatttgagacactttgcaaaaaaacttgatcctcgaagagaaggtggtgatcaaaggcattcctttggaccattggactatgaaagtctccaacaagaacttgctttaaaagagacagtatggaaaaaagtgtcacctgagtcaaatgaggacatctctacaactgtagtatatagaatggaaagtctgggagagaaaagctaaagaaatgggttctagtttcagaatgtttcttcatttaatctttcaaacatctttagcttttttttgcaagttataaatatttatttgaggtattttttgttctcaatcttgggtgctggagccataaagcttttttttccttttaatctttgtataaaggcagtagattaagaagtgcatttgttggtctttaaaaagtatttacaagtacataaatttgctttatttttaaaaatacaaaaaggaaaaatttaaattttttttgatgtaattaaaatgttaactatgtggtcagataatcccattttacaatagtaacagaaaattgtaattcttagttctaaaattcacaaattaaactcataagttttgttgcattttgttttttcttttccatttttaaaactaatgtgatgtctttagtggcaatagaaggtacttctatgctaaatacaaaactaaaaaggcaaaataatgaaccccaaattattttatttaaaatagcagtggattataaaattagcttgtgtttacatttatgccatttttggtgatagattggctttacattttaaaaaatttatttaaaaatttatcaaatgctttaaaatatgactcctactttttttattttgcaactcctctgttctgtcagagttgttatatacaggagtgtcttatgttactaaaacattccagccaaagaatttcagatgtgagataatgatgtttcatcaataaaaagctataatggttagttactcagaaggagaaacagtgagtgtcttcaagtgaattgttcacctaaacaattttattttcatattatccacataactttttctatgttatatttaaatatgaatggcaaattttggtttttagcttttacattttattatcttaattttataaatgctaatatttcttttgtgataagttatagcatctcataaagtttgttctatttgaagttttttagagtacttgagaaatgaatttagtctgcaggtagtaagtatgctactaaaatacgttagatctaaatccttttatttggtataaaaatgcaatattgagaatcaaaacttgtttttaagagaactatagattctacacaacctgatttcaagtaattattcatagtatttatagttgtcttggcaaagtgattgtaaaattctgtaggacctattcacacttcttccttcttccatatacttctctggttttccccatagttcccctataatttcaagtttgttgaaacctgttaattttagtgggggattagaagaaaaacttggtggtttcttagcatgatggtgtatgtatgtggtaatggaaagtctgtaaaagtaaatatagtgtagcaaaaaagatttcactgagtattttagatactagtgcaaataaagatagaaaatcttgatcataatgtcttaagtttgggaactgtgatattaagaaaagaaattcccttctagaggtgctggccaaaaagccttttgggctaacttaagtattaaatttatatatttaaataattatattttaagttgtagaggattttcccaaggattttatgcttacttgaatgttctttgaatgttcagatgcatatcctaactggatgcttctcaaggccttactgcatatttgtgttgcatatttatgttagttgcaccagggccatttgtagtttgggcaaccgaatgccttaattggaaaaaaggcattgtggtttcccctatgatctaaattgttacattttaccatttcattccgaagttggttttactttattaaatgaagatttagttttcatatcgtatacatagctgtatagatttcaaaattaggttgttaatttgtgtcacttactatttttgtgttggtaatgctttaaatgcatacttaaaaatgaagtactgttatctaagctactgtgtttagaaaatgttaagaatgagcagaaatttttatagaaaagtataaacggaagaagagataagatactgcgaataggccctcaaacttaaaaaagaaaaaactttgccagttttaaggacatattttgattctttcagtattcttaacacctttttaaacaaagttcttgatagtacccactattattgggtttgttttatgccattattgattcttgatattcaagcatttacaatgtagcatatttgattttcttttttctttctttttttggcatcattaacatttcatttgaaatgcatattgttcttgaagtactttgtttttagcataaatgttgtgcattttatcttagtgtttggatgaaaacatttgtgttgtttagctttcatttgctttgtatatttaataatgtacctttattttccagtatgcctacattttgtattgcacaataaatttattttaagctga

SEQ ID NO: 12391 - DNA, 816 bp, Homo sapiens
tggaagtttgatttatagaacctcatcccttctgcttttaaggcaatccagtgtacaaggttggtcttcctgcaaaatctggagttgctgggggcattcttttagttgtccccaatgttatgggtatgatgtgctggtctcctcctctggataagatgggcaacagtgttaagggaattcacttttgtcacgatcttgtttctctgtgtaatttccataactatgataatttgagacactttgcaaaaaaacttgatcctcgaagagaaggtggtgatcaaagggtaaagtcagtgataaatcttttgtttgctgcatatactggagatgtgtctgcacttcgaagatttgctttgtcagctatggacatggaacagcgggactatgattctagaacagcactccatgtagctgctgcagagggtcatgttgaagttgttaaatttttgctggaagcctgcaaagtaaaccctttccccaaggacaggtggaataacactcccatggatgaagcactgcactttggacaccatgatgtatttaaaattctccaagaataccaagtccagtacacacctcaaggagattctgacaacgggaaggaaaatcaaaccgtccataagaatcttgatggattgttgtaatggtctcaaatcccaagatttaaatcacttacctatttaattgtggaaaatgattatgaagaacatgtgtatttctatctggtagtgatgtatattttacatttgtcatttcagtgttactggagttttcttcattgtgcacacaggacaaatctgatctctttgggaaaaa

SEQ ID NO: 12392 - DNA, 2623 bp, Homo sapiens
cacccactagaaagccacccgggttctccttcatccccaacgctcctcacctagcccctgtcctgagggtgcccctaaccctggagccagctttaaaggggcaggccccttctcctgccccagccccagccccacccaccgggcccacattctccgtcttccaggtccagcgctccctcacagaactcccccgcaccttgtctcgctcgctccgcccctccttcccagccacagctagaggtcccgggcgcacctgcagagccggaggcttgctggggcatgcgctccatgaaggctctgcagaaggccctgagccgggctggcagtcactgcgggcgaggaggctggggtcacccgagccggagccccctccttggcgggggcgtccggcaccacctcagtgaggccgcggcgcagggcagagagacgccacacagccaccagccgcagcaccaggatcatgattcatcagaaagtggcatgctgtcccgcctgggtgatttgctcttttacactattgctgaaggacaggaacgaatccctatccacaagttcaccactgcactaaaggccactggactgcagacatcagatcctcggctccgagactgcatgagcgagatgcaccgcgtggtccaagagtccagtagtggtggcctcttggaccgagatctcttccgaaagtgtgtgagcagcaacattgtgctcctgacccaggcattccgaaagaagtttgtcattcctgattttgaggagttcacgggccatgtggatcgcatctttgaggatgtcaaagagctcactggaggcaaagtggcagcctacatccctcagctggccaagtcaaacccagacctgtggggtgtctccctgtgcactgtggatggtcaacggcactctgtgggccacacaaagatccccttctgcctgcagtcctgtgtgaagcccctcacctatgccatctccataagcaccctaggcactgactacgtgcacaagtttgtgggcaaagagccaagtggcctgcgctacaacaagctctccctcaatgaggaaggaatcccccataaccccatggtcaatgctggtgccattgttgtcagctccctgatcaagatggactgtaacaaagcagagaagtttgattttgtgttgcagtatctcaacaaaatggctgggaatgaatacatgggtttcagcaatgccacattccagtcagagaaggaaacaggggatcggaattatgccatcggctattatctcaaggaaaagaagtgctttcctaagggggtggacatgatggctgcccttgatctctacttccagctgtgttctgtggaggtcacttgtgaatcaggcagtgtcatggcagccaccctcgccaacggtgggatctgccccatcacaggcgagagtgtgctgagtgctgaagcagtgcgcaacaccctcagcctcatgcattcctgcggcatgtatgacttctctggccagtttgccttccacgtgggcctgccagccaagtcagctgtatcaggagccatcctcctggtggtacccaatgtcatgggaatgatgtgcctgtcacccccattggacaagctggggaacagccatagggggaccagcttctgccagaagttggtgtctctcttcaatttccacaactatgacaacctgaggcactgtgctcggaagttagacccacggcgtgaaggggcagaaattcggaacaagactgtggtcaacctgttatttgctgcctatagtggcgatgtctcagctcttcgaaggtttgccttgtcagccatggatatggaacagaaagactatgactcgcgcacagctctgcatgttgctgcagctgaaggacacatcgaagttgttaaattcctgatcgaggcttgcaaagtgaatccttttgccaaggacaggtggggcaacattcccctggatgatgctgtgcagttcaaccatctggaggtggtcaaactgcttcaagattaccaggactcctacacactctctgaaactcaggctgaggcagcagctgaggccctgtccaaagagaacttagaaagcatggtatgagcacaggtcatggacagcccctgctcaagaaaaagcatgagctggccacacatgtaatccataaccaccaaaaatactatggagagctacactgcttcagtggggaccaagcagtcatttggtgacttaggctagtgctttctatgggagtcaaaataccccattccctcagcagacagagtacagagaagggcctcagaggacacctgcagtacagctatccagagagactgggcttcaaggtacagcctaatggcttgccccactcaaaaccatcccagctcttcacccaggtctcctcttcctctccctgaagaaaccatcatgagagagatactctggtggagggactctagctaccatgcacatgtacatatccacagaatatgggaagtgggaatggctatatacatggctttagtagtctggagaaatctactccccttggccaggacatgctgctgctactgctaacagccaattttatagacagagaaagtattttgtgttcaaataaactttaattaccaaatca

SEQ ID NO: 12393 - DNA, 623 bp, Homo sapiens
atgcgctccatgaaggctctgcagaaggccctgagccgggctggcagtcactgcgggcgaggaggctggggtcacccgagccggagccccctccttggcgggggcgtccggcaccacctcagtgaggccgcggcgcagggcagagagacgccacacagccaccagccgcagcaccaggatcatgattcatcagaaagtggcatgctgtcccgcctgggtgatttgctcttttacactattgctgaaggacaggaacgaatccctatccacaagttcaccactgcactaaaggccactggactgcagacatcagatcctcggctccgagactgcatgagcgagatgcaccgcgtggtccaagagtccagtagtggtggcctcttggaccgagatctcttccgaaagtggcagcctacatccctcagctggccaagtcaaacccagacctgtggggtgtctccctgtgcactgtggatggtcaacggcactctgtgggccacacaaagatccccttctgcctgcagtcctgtgtgaagcccctcacctatgccatctccataagcaccctaggcactgactacgtgcacaagtttgtgggcaaagagccaagtggcctgcgctac

SEQ ID NO: 12394 - DNA, 3093 bp, Homo sapiens
cgccctctcggagggctccgggttataagggctggaggccgagcggacgggagctggagcccgcggagcccacggagcccacggagcccacggaggagcccacggaggagccccagcgtccgaacgggcagaccccctcgagccgcgaaggagcccgagaagcagccacgatgtgcggaatctttgcctacatgaactacagagtcccccggacgaggaaggagatcttcgaaaccctcatcaagggcctgcagcggctggagtacagaggctacgactcggcaggtgtggcgatcgatgggaataatcacgaagtcaaagaaagacacattcagctggtcaagaaaagggggaaagtcaaggctctcgatgaagaactttacaaacaagacagcatggacttaaaagtggagtttgagacacacttcggcattgcccacacgcgctgggccacccacggggtccccagtgctgtcaacagccaccctcagcgctcagacaaaggcaacgaatttgttgtcatccacaatgggatcatcacaaattacaaagatctgaggaaatttctggaaagcaaaggctacgagtttgagtcagaaacagatacagagaccatcgccaagctgattaaatatgtgttcgacaacagagaaactgaggacattacgttttcaacgttggtcgagagagtcattcagcagttggaaggtgcattcgcgctggttttcaagagtgtccactacccaggagaagccgttgccacacggagaggcagccccctgctcatcggagtccggagcaaatacaagctctccacagaacagatccctatcttatacaggacgtgcactctggagaatgtgaagaatatctgtaagacacggatgaagaggctggacagctccgcctgcctgcatgctgtgggcgacaaggccgtggaattcttctttgcttctgatgcaagcgctatcatagagcacaccaaccgggtcatcttcctggaggacgatgacatcgccgcagtggctgatgggaaactctccattcaccgggtcaagcgctcggccagtgatgacccatctcgagccatccagaccttgcagatggaactgcagcaaatcatgaaaggtaacttcagtgcgtttatgcagaaggagatcttcgaacagccagaatcagttttcaatactatgagaggtcgggtgaattttgaaaccaacacagtgctcctgggtggcttgaaggaccacttgaaggagattcgacgatgccgacggctcatcgtgattggctgtggaaccagctaccacgctgccgtggctacgcggcaagttttggaggaactgactgagcttcctgtgatggttgaacttgctagtgattttctggacaggaacacacctgtgttcagggatgacgtttgctttttcatcagccagtcaggcgagaccgcggacaccctcctggcgctgcgctactgtaaggaccgcggcgctctcaccgtgggcgtcaccaacaccgtgggcagctccatctctcgcgagaccgactgcggcgtccacatcaacgcagggccggagatcggcgtggccagcaccaaggcttataccagtcagttcatctctctggtgatgtttggtttgatgatgtctgaagaccgaatttcactacaaaacaggaggcaagagatcatccgtggcttgagatctttacctgagctgatcaaggaagtgctgtctctggaggagaagatccacgacttggccctggagctctacacgcagagatcgctgctggtgatggggcggggctacaactatgccacctgcctggaaggagccctgaaaattaaagagataacctacatgcactcagaaggcatcctggctggggagctgaagcacgggcccctggcactgattgacaagcagatgcccgtcatcatggtcattatgaaggatccttgcttcgccaaatgccagaacgccctgcagcaagtcacggcccgccagggtcgccccattatactgtgctccaaggacgatactgaaagttccaagtttgcgtataagacaattgagctgccccacactgtggactgcctccagggcatcctgagcgtgattccgctgcagctgctgtccttccacctggctgttctccgaggatatgacgttgacttccccagaaatctggccaagtctgtaactgtggaatgaggctgagaccgtgacaagaccatcaccacctttcatctgattccagacctgtcccaacagcagggatgctacatgggaagagaagtggacatcccacatgttctgcgtgctcctgtagagcttgacagcttccacgtgccttctacccaagtgcttttgcttacagcagatactgtttctctgtgtcctgaagtcgccagaggagaagggaatcattgtttacacatggggatcagagcagacttctccactactgtgcaatagagatacagctctcttcagagtaactgtgaaccttttataaccaacactagagttagttttaaaagacaagatatttataatgacgactgtatagcttttaagttatttttctagtatgtggctttctgtagccgtggtaacggccaaactgttcatcctagctacccatgctctgtgtccaggcttgctcctggcaggtggcattcatctcagatgtgagcacaaggcattggccctctggactcctttctccttttctttcctctctaggctgctcctgaatcctgttctctgacatccgtggagcccctcctgcatccacctatgcctcctataagtccagttgaaatctcagcctccttcaacattttcttctcgtgtgtggcccacatccctccacttctccaacttctgtttaatctgatcacggctctttttaagccctggcagcattttggtccctgctccttgcccatagtaaaacagcttgaaatatcccatgcaagagagtagtttcaagtgggcaactctgctctctatttaaaagcgtgcacaatcaaaagtactatgcaattttaggacaataaagaacatacagtttttttgtgtg

SEQ ID NO: 12395 - DNA, 1739 bp, Homo sapiens
ctgcagcctgcgcgacgcggcgggaggctacccgggggcgatgggaaggcgggcgcagtcgacccaagggtggagaagagggaaggcgaaggacgcgcgttcccgggctcgtgaccgccagcggcccggggaacccgctcccagacagactcggagagatggcaggcggaagacaccggcgcgtcgtgggcaccctccacctgctgctgctggtggccgccctgccctgggcatccaggggggtcagtccgagtgcctcagcctggccagaggagaagaattaccaccagccagccattttgaattcatcggctcttcggcaaattgcagaaggcaccagtatctctgaaatgtggcaaaatgacttacagccattgctgatagagcgatacccgggatcccctggaagctatgctgctcgtcagcacatcatgcagcgaattcagaggcttcaggctgactgggtcttggaaatagacaccttcttgagtcagacaccctatgggtaccggtctttctcaaatatcatcagcaccctcaatcccactgctaaacgacatttggtcctcgcctgccactatgactccaagtatttttcccactggaacaacagagtgtttgtaggagccactgattcagccgtgccatgtgcaatgatgttggaacttgctcgtgccttagacaagaaactcctttccttaaagactgtttcagactccaagccagatttgtcactccagctgatcttctttgatggtgaagaggcttttcttcactggtctcctcaagattctctctatgggtctcgacacttagctgcaaagatggcatcgaccccgcacccacctggagcgagaggcaccagccaactgcatggcatggatttattggtcttattggatttgattggagctccaaacccaacgtttcccaatttttttccaaactcagccaggtggttcgaaagacttcaagcaattgaacatgaacttcatgaattgggtttgctcaaggatcactctttggaggggcggtatttccagaattacagttatggaggtgtgattcaggatgaccatattccatttttaagaagaggtgttccagttctgcatctgataccgtctcctttccctgaagtctggcacaccatggatgacaatgaagaaaatttggatgaatcaaccattgacaatctaaacaaaatcctacaagtctttgtgttggaatatcttcatttgtaatactctgatttagtttaggataattggttctagaattgaattcaaaagtcaaggcatcatttaaaataatctgatttcagacaaatgctgtgtggaaacatctatcctatagatcatcctattcttatgtgtctttggttatcagatcaattacagaataattgtgttgtgatattgtgtcctaaattgctcattaatttttatttacagattgaaaaagagggaccgtgtaaagaaaatggaaaataaatatctttcaaagactcttttagataaacacgatgaggcaaaatcaggttcattcattcaacgatagtttctcaacagtacttaaatagcggttggaaaacgtagccttcattttatgattttttcatatgtggaaatctattacatgtaatacaaaacaaacatgtagtttgaaggcggtcagatttctttgagaaatctttgtagagttaattttatggaaattaaaatcagaattaaatgcta

SEQ ID NO: 12396 - DNA, 1456 bp, Homo sapiens
cgctcccagacagactcggagagatggcaggcggaagacaccggcgcgtcgtgggcaccctccacctgctgctgctggtggccgccctgccctgggcatccaggggggtcagtccgagtgcctcagcctggccagaggagaagcacatcatgcagcgaattcagaggcttcaggctgactgggtcttggaaatagacaccttcttgagtcagacaccctatgggtaccggtctttctcaaatatcatcagcaccctcaatcccactgctaaacgacatttggtcctcgcctgccactatgactccaagtatttttcccactggaacaacagagtgtttgtaggagccactgattcagccgtgccatgtgcaatgatgttggaacttgctcgtgccttagacaagaaactcctttccttaaagactgtttcagactccaagccagatttgtcactccagctgatcttctttgatggtgaagaggcttttcttcactggtctcctcaagattctctctatgggtctcgacacttagctgcaaagatggcatcgaccccgcacccacctggagcgagaggcaccagccaactgcatggcatggatttattggtcttattggatttgattggagctccaaacccaacgtttcccaatttttttccaaactcagccaggtggttcgaaagacttcaagcaattgaacatgaacttcatgaattgggtttgctcaaggatcactctttggaggggcggtatttccagaattacagttatggaggtgtgattcaggatgaccatattccatttttaagaagaggtgttccagttctgcatctgataccgtctcctttccctgaagtctggcacaccatggatgacaatgaagaaaatttggatgaatcaaccattgacaatctaaacaaaatcctacaagtctttgtgttggaatatcttcatttgtaatactctgatttagtttaggataattggttctagaattgaattcaaaagtcaaggcatcatttaaaataatctgatttcagacaaatgctgtgtggaaacatctatcctatagatcatcctattcttatgtgtctttggttatcagatcaattacagaataattgtgttgtgatattgtgtcctaaattgctcattaatttttatttacagattgaaaaagagggaccgtgtaaagaaaatggaaaataaatatctttcaaagactcttttagataaacacgatgaggcaaaatcaggttcattcattcaacgatagtttctcaacagtacttaaatagcggttggaaaacgtagccttcattttatgattttttcatatgtggaaatctattacatgtaatacaaaacaaacatgtagtttgaaggcggtcagatttctttgagaaatctttgtagagttaattttatggaaattaaaatcagaattaaatgct

SEQ ID NO: 12397 - DNA, 2763 bp, Homo sapiens
agaaaagtcagagcaaaaccacgcctgtgtcttcctcctgcctcagggacgaacaccttccttccaggtccgtggcaaatatctccaaaagccctgccgcctgccaacaccccttcaagttcccagttccacggaggcggaagcaaagcccccggaaaggccggtttgtccgccctgtgttgtttaaaggggatagacgaccttggagcgccccgccccctcccgccaaggaaggaccccattggctctccccggaggcttcactctcattggtcagcgagtgaatgccgacctgcagactggggcctaagtttcttttagtttccggtgtctctgcaatggcggctctagactccctgtcgctcttcactagcctcggcctgagcgagcagaaggcccgcgagacgctcaagaactcggctctgagcgcgcagctgcgcgaggccgctactcaggctcagcagaccctgggttccaccattgacaaagctaccgggatcctgttatatggcttggcctcccgactcagggatacccggcgtctctccttccttgtaagctacatagccagtaagaagatccacactgagccccagctaagcgctgcccttgagtatgtgcggagtcaccccttggaccccatcgacactgtggacttcgagcgggaatgtggcgtgggtgtcattgtgaccccagagcagattgaggaggctgtggaggctgctattaacaggcaccggccccagctcctggtggaacgttaccatttcaacatggggctgctgatgggagaggctcgggctgtgctgaagtgggcagatggcaaaatgatcaagaatgaagtggacatgcaggtcctccaccttctgggccccaagttggaggctgatctggagaagaagttcaaggtggcaaaagctcggctagaagaaacagaccggaggacggcaaaggatgtggtggagaatggcgagactgctgaccagaccctgtctctgatggagcagctccggggggaggcccttaagttccacaagcctggtgagaactacaagaccccaggctatgtggtcactccacacaccatgaatctactaaagcagcacctggagattactggtgggcaggtacgtacccggttcccgccagaacccaatggaatcctgcatattggacatgccaaagccatcaatttcaactttggctatgccaaggccaacaatggcatctgttttctgcgttttgatgacaccaaccctgagaaggaggaagcaaagttcttcacggccatctgtgacatggtagcctggctaggctacacaccttacaaagtcacatatgcgtctgactattttgaccagctatatgcgtgggctgtggagctcatccgcaggggtctggcttatgtgtgccaccagcgaggagaggagctcaaaggccataatactctgccttcaccctggagagaccgtcccatggaggagtcactgctgctctttgaggcaatgcgcaagggcaagttttcagagggcgaggccacactacggatgaagctggtgatggaggatggcaagatggaccctgtagcctatcgagtcaagtatacaccacaccaccgcacaggggacaaatggtgcatctatcccacctacgactacacacactgcctctgtgactccatcgagcacatcactcactcactctgcaccaaggaattccaggcccgacgctcttcctacttctggctttgcaatgcactggacgtctattgccctgtgcagtgggagtatggccgcctcaacctgcactatgctgttgtctctaagaggaagatcctccagcttgtagcaactggtgctgtgcgggactgggatgacccacggctctttacactcacggccctgcgacggcggggcttcccacctgaggccatcaacaacttctgtgcccgggtgggagtgactgtggcacaaaccacaatggagccacatcttctagaagcctgtgtgcgtgatgtgctgaatgacacagccccacgagccatggctgtgctggagtcactacgggtcatcatcaccaactttcctgctgccaagtccttggacatccaggtgcccaacttcccagctgatgagaccaaaggcttccatcaggttccctttgcacccattgtcttcattgagaggactgacttcaaggaggagccagagccaggatttaagcgcctggcttggggccagcctgtgggcctgaggcatacaggctacgtcattgagctgcagcatgttgtcaagggccccagtggttgtgtagagagtctggaggtgacctgcagacgggcagatgctggagagaagccaaaggcctttattcactgggtgtcacagcctttgatgtgtgaggttcgcctctatgagcgactattccagcacaagaaccctgaagatcctactgaggtgcctggtggatttttaagtgacctgaacctggcatcactacacgtggtggatgcagcattagtggactgctctgtggccctggcaaaacccttcgacaagttccagtttgagcgtcttggatatttctccgtggatccagacagccatcagggaaagcttgtctttaaccgaactgtcacactgaaggaagacccaggaaaggtgtgagctggaagcactgaacctacctcatcctcctggagggtgtggctaccctcgccaccccaaattccatgtcaataaagaacagctaaattctcctaga

SEQ ID NO: 12398 - DNA, 2412 bp, Homo sapiens
tcttttagtttccggtgtctctgcaatggcggctctagactccctgtcgctcttcactagcctcggcctgagcgagcagaaggcccgcgagacgctcaagaactcggctctgagcgcgcagctgcgcgaggccgctactcaggctcagcagaccctgggttccaccattgacaaagctaccgggatcctgttatatggcttggcctcccgactcagggatacccggcgtctctccttccttgtaagctacatagccactgcccttgagtatgtgcggagtcaccccttggaccccatcgacactgtggacttcgagcgggaatgtggcgtgggtgtcattgtgaccccagagcagattgaggaggctgtggaggctgctattaacaggcaccggccccagctcctggtggaacgttaccatttcaacatggggctgctgatgggagaggctcgggctgtgctgaagtgggcagatggcaaaatgatcaagaatgaagtggacatgcaggtcctccaccttctgggccccaagttggaggctgatctggagaagaagttcaaggtggcaaaagctcggctagaagaaacagaccggaggacggcaaaggatgtggtggagaatggcgagactgctgaccagaccctgtctctgatggagcagctccggggggaggcccttaagttccacaagcctggtgagaactacaagaccccaggctatgtggtcactccacacaccatgaatctactaaagcagcacctggagattactggtgggcaggtacgtacccggttcccgccagaacccaatggaatcctgcatattggacatgccaaagccatcaatttcaactttggctatgccaaggccaacaatggcatctgttttctgcgttttgatgacaccaaccctgagaaggaggaagcaaagttcttcacggccatctgtgacatggtagcctggctaggctacacaccttacaaagtcacatatgcgtctgactattttgaccagctatatgcgtgggctgtggagctcatccgcaggggtctggcttatgtgtgccaccagcgaggagaggagctcaaaggccataatactctgccttcaccctggagagaccgtcccatggaggagtcactgctgctctttgaggcaatgcgcaagggcaagttttcagagggcgaggccacactacggatgaagctggtgatggaggatggcaagatggaccctgtagcctatcgagtcaagtatacaccacaccaccgcacaggggacaaatggtgcatctatcccacctacgactacacacactgcctctgtgactccatcgagcacatcactcactcactctgcaccaaggaattccaggcccgacgctcttcctacttctggctttgcaatgcactggacgtctattgccctgtgcagtgggagtatggccgcctcaacctgcactatgctgttgtctctaagaggaagatcctccagcttgtagcaactggtgctgtgcgggactgggatgacccacggctctttacactcacggccctgcgacggcggggcttcccacctgaggccatcaacaacttctgtgcccgggtgggagtgactgtggcacaaaccacaatggagccacatcttctagaagcctgtgtgcgtgatgtgctgaatgacacagccccacgagccatggctgtgctggagtcactacgggtcatcatcaccaactttcctgctgccaagtccttggacatccaggtgcccaacttcccagctgatgagaccaaaggcttccatcaggttccctttgcacccattgtcttcattgagaggactgacttcaaggaggagccagagccaggatttaagcgcctggcttggggccagcctgtgggcctgaggcatacaggctacgtcattgagctgcagcatgttgtcaagggccccagtggttgtgtagagagtctggaggtgacctgcagacgggcagatgctggagagaagccaaaggcctttattcactgggtgtcacagcctttgatgtgtgaggttcgcctctatgagcgactattccagcacaagaaccctgaagatcctactgaggtgcctggtggatttttaagtgacctgaacctggcatcactacacgtggtggatgcagcattagtggactgctctgtggccctggcaaaacccttcgacaagttccagtttgagcgtcttggatatttctccgtggatccagacagccatcagggaaagcttgtctttaaccgaactgtcacactgaaggaagacccaggaaaggtgtgagctggaagcactgaacctacctcatcctcctggagggtgtggctaccctcgccaccccaaattccatgtcaataaagaacagctaaattctc

SEQ ID NO: 12399 - DNA, 1287 bp, Homo sapiens
gcccccgaggacaattactatattgagatggagttaccagggctgaagtagaaaagtcagagcaaaaccacgcctgtgtcttcctcctgcctcagggacgaacaccttccttccaggtccgtggcaaatatctccaaaagccctgccgcctgccaacaccccttcaagttcccagttccacggaggcggaagcaaagcccccggaaaggccggtttgtccgccctgtgttgtttaaaggggatagacgaccttggagcgccccgccccctcccgccaaggaaggaccccattggctctccccggaggcttcactctcattggtcagcgagtgaatgccgacctgcagactggggcctaagtttcttttagtttccggtgtctctgcaatggcggctctagactccctgtcgctcttcactagcctcggcctgagcgagcagaaggcccgcgagacgctcaagaactcggctctgagcgcgcagctgcgcgaggccgctactcaggctcagcagaccctgggttccaccattgacaaagctaccgggatcctgttatatggcttggcctcccgactcagggatacccggcgtctctccttccttgtaagctacatagccagtaagaagatccacactgagccccagctaagcgctgcccttgagtatgtgcggagtcaccccttggaccccatcgacactgtggacttcgagcgggaatgtggcgtgggtgtcattgtgaccccagagcagattgaggaggctgtggaggctgctattaacaggcaccggccccagctcctggtggaacgttaccatttcaacatggggctgctgatgggagaggctcgggctgtgctgaagtgggcagatggcaaaatgatcaagaatgaagtggacatgcaggtcctccaccttctgggccccaagttggaggctgatctggagaagaagttcaaggtggcaaaagctcggctagaagaaacagaccggaggacggcaaaggatgtggtggagaatggcgagactgctgaccagaccctgtctctgatggagcagctccggggggaggcccttaagttccacaagcctggtacgtacccggttcccgccagaacccaatggaatcctgcatattggacatgccaaagccatcaatttcaactttggctatgccaagtttgataaacaggattgtggggctgatggatgatgtgggagttcacagatggtgcaactttcctaggccaacaatggcatctgttttctgcgttttgatgacaccaaccc

SEQ ID NO: 12400 - DNA, 6943 bp, Homo sapiens
gttttatatttaactcgctgcagtgcaggaggggtaggggtggagatgcgtcgtttataaggggagctgtgacaatcttcttgccagccctcttcctcccactcggctcctcttacggagtcctcattccaccccccttgtttccgcattcatcctgagtggctggtgggaacgtgaaaagggagaggaaaaggcgcaagaagccagagagaggggtgtgggaaaagcgaaaacaggctgccaaatcaggggattccttccaatttaaaaaggaagtctgctgacgttagttagttaaatttaacatctttttatgtgtaacacttgactttggaagcaaaaatgaactttgcggagagagagggctctaagagatactgcattcaaacgaaacatgtggccattctctgtgcggtggtggtgggtgtaggattaatagtgggacttgccgtgggcttgaccagatcgtgtgactccagcggggacggcgggccgggcactgcgccagctccttcccacctgccttcttccacggccagcccctcaggtcctcctgcccaggaccaggacatctgcccggccagtgaggatgagagcggacagtggaaaaactttcgactgccggacttcgtcaacccagtccactacgacctgcacgtgaagcccctgttggaggaggacacctacacgggcaccgtgagcatctccatcaacctgagcgctcccacccggtacctgtggctgcacctccgggagaccaggatcacccggctcccggagctgaagaggccctctggggaccaggtgcaagtccggaggtgtttcgagtacaaaaagcaggagtacgtggtggtcgaggcggaggaagagcttacccccagcagtggagatggcctgtatctcctgaccatggagttcgccggctggctgaacggctccctcgtgggattttatagaaccacctacacggagaacggacaagtcaagagcatagtggccaccgatcatgaaccaacagatgccaggaaatcttttccttgttttgatgagcccaacaaaaaggcaacttatacaatatctatcacccatcccaaagaatacggagcactttcaaatatgccagtggcgaaagaagagtcagtggatgataaatggactcgaacaacttttgagaagtctgtccccatgagcacgtacctggtgtgctttgctgtacatcaatttgactctgtaaagagaatatcaaatagtggaaaacctcttacaatttatgtccagccagagcaaaagcacacagccgaatatgctgcaaacataactaaaagtgtgtttgattattttgaagaatactttgctatgaattattctcttcctaaattagataaaatcgctattccagattttggcactggtgccatggagaactggggactcatcacgtacagagaaacgaacctgctttatgaccctaaggaatcagcctcatcaaaccaacagagggtggccactgtggttgcccatgaacttgtgcatcagtggtttggaaatattgtgaccatggactggtgggaagacttgtggctaaatgaaggatttgcttctttctttgagtttctgggagtaaaccatgcagaaacagactggcaaatgcgtgaccaaatgttacttgaagatgtattacctgttcaagaggatgattctttgatgtcttcgcatccaattattgtgactgtgacaacccctgatgaaataacatctgtttttgatggaatatcctatagcaagggatcttctattttgagaatgcttgaagactggataaaaccagagaattttcaaaaaggatgtcagatgtacttggaaaaataccaattcaagaatgcaaaaacttctgatttttgggcagcactggaagaggcaagtaggctaccagtgaaagaagtaatggacacctggaccagacagatgggttatcctgtgcttaacgtgaacggtgtcaagaacatcacacagaaacgctttttgttggacccaagagctaacccttctcagcccccttcagatcttggttatacatggaatatcccagttaaatggactgaagataatataacaagcagtgtgttatttaataggtcagaaaaagaaggaatcactttgaactcctctaatcctagtggaaatgcttttctcaaaataaacccagatcatattgggttttatcgtgtaaattatgaagtagcaacttgggactcgatagctacagcgctctccttgaaccacaagacattttcttcagcagatcgtgcaagtcttattgatgatgcttttgccttggcaagagctcaacttctagattataaggtggctttgaacttgaccaagtatctcaaaagggaagagaattttttaccatggcagagagtaatttcagctgtaacctacatcattagcatgtttgaagatgataaagagctatatcctatgattgaggaatacttccaaggtcaagtgaagcctattgcagattctctgggatggaatgatgctggagaccatgtcacaaagttactccgttcctccgtgttagggtttgcgtgcaagatgggagacagagaagccttgaacaatgcttcctcgttatttgagcagtggctaaatgggactgtaagccttcccgtaaatctcaggcttctggtgtatcggtatgggatgcagaactctggcaatgagatttcatggaactacactcttgagcaataccagaaaacttcattagctcaagaaaaagaaaaactgctgtatggattagcatcagtgaagaacgttactcttttgtcaaggtatttggatttgctcaaggacacgaaccttattaaaactcaggatgtgtttacagtcattcgatatatctcatataacagctatgggaagaacatggcctggaattggatacaactcaactgggactatctagtcaacagatatacactcaataacagaaaccttggccgaattgtcacaatagcagagccattcaacactgaactgcaactgtggcagatggagagcttttttgcaaaatatccacaagctggagcaggagaaaaacctagggaacaagtgctggaaacagtgaaaaacaatatagagtggctaaaacaacatagaaacaccatcagagaatggttttttaatttacttgagagtggttaatgtattcaaatgttagagtttaattttgtgaatctattgtttctcctctgaagcatttggtggcctaatttacaagcacgatggagagagccttataaacagataatgcttttactaagcactgtgtttatatgtcttgcaaagcctttaaattgttcctctttgtttatgaagaaagatactaatagagtacttaatatactcagggattccttctaagtgtacttcataagatattctttacaaactgaagataatgaaatagttattttaatacctttaaatatcattctttgtatcttaaatctgtgaagtagaacaatttggtcttagctttacattttcagtaccaaagaaacaccacttaatcttctctcttgattgatttttaaagtttaaataccagtacttgagggaccaatattaccatcttaatctttattttattattcagaattatacagacctaatatcattttattcacatatgtcttactactttaaatcctaccaaagtaacctgggcttaagttttacttgaggatcatatgaattagccaaaagaatggctgactgttgcctttgctcttataaaatcaataagagaactctcctctttttttaaaaataaatctaaatgattatcttgaaaaagtattgttttccagtgtcacttgactcttgaataaaaataactgcagtgttccccaaataatttaacacattgcaaatatgattcaagaatctggcctttttcatgcttggtactctcttctcttgctccattccttacaaagctccttcaaatatgctatgaaattagagggaacatagtgcttaactctgctccatggattttagaggaaaaaagctaaataattggaaactgttcaggaaagagagaaggcagattatttcttaaaactaaatggaattagaatttagctttgacctcacctagcaatctaagtgtgaaaatggggagacctgtgggcatccccagcatgactctgcatatctgagcatatatctccttatagatcaattttatgtataaacccttagatcctaatccatacagaatagcactgatcaaatttaaatgcatgacttgattaaagacatcaatttcatagaagctggtggcaagaatatgtttaatatggcacttgatacctcctagatccataatgtaagtccaataggcagaaaagatggtaagttactatgtttcaatctgctatatctagaaaatctaaatttatttggaactttcaaaaatgtaaggtaatttagaatcggcttgatgagaattgaagcatatggaaacaaaaccttagctttaactttatttatacaataatgtgccctaatcatgtactctgaaactttataaactttcctgttgctgtttcttaattatcacttctcaatccgtacagccaaactagtaaattcaaatgtagactgggttgtgggtggcagatatagaagaagaaatttccagaccaaaaaatattaaatattattttaaattatttcagaagcaaaaacatattaacatcataacttaccagaaaaaccccactatcctcataagattaacttaaaattctgaccacaatcagaaccagcacttgaagtctatgtattgtttcaagtaggacatattatgaggtgagatggtttatccttctgttttatgaaattaatacattttaaaagaaaaatgttagtttaagggggtggtaaataaaacagatttcaacttgcctacaagacattctatttcatgccttttccttttgttgttctatttcattctattttaagcattaaaactgagaacaaattgtttacttcttttcactccacacgcgaaagagttgtatgtactttgtcagaataagtcttctagaccatcaggtccttctcaaacaacacctgttttttaaaaggctgatgcctaatagatagatctatgccaagcacagtttattactttgcttgcttggttttgcacagtattcacaggggacaaaaaatttaatatgatgtttccaaaattaagccacagtaaatttaaataattaattttaattgaaaaaaagtaaccatttaatttcaagaattaactggaaaatatgggaagcaaggtcatgtagcaaaaagcaaggccagtattactgcctcccctctaggcagcccactcctgtattccagatcattgctatgtacccacataattataaattaggagtttaaataataaaacatagacgtaaaactgacaggcaagggaggtttgggaaacaggggtgagatgtatacctgggttgaaggtaatgatactcctacagcttaccctccaagttggtgaagtgttagtccaaaagtagaaacaacagagtaggggcaaaaatctagaacaataattctcaaagggaattgggggatgagaaggaagtagaaaagaggggattcaaattaccagtggtgctttctaaaacacggttaggtaatcatcatcatcagactttcctttttttttcaagcatttttataaacactagcactccacataacattaatttttacaaaacccccttaaagtagatactgttattgttcttattttagagtggataaattgagatggagaagttatagaacttgcacaaggctacaaaagttgtatttggcaccagccagtatttgaacccaggcagtttatcactctaatctacattttaatctgtattagagtaaaaatatgcttttgaaatcagagtgacctgggttggaatatcaactacttggtagttgagtgcttttaacctctccattgttgtttcatctataaagtaaggatcaaaatagtagctacctcaatggtagttgtgaggattaaatacaaaaatgcatgtaaaggacatacgtataggaaataacaatcactcaataagtgttagctcttattattgttactattatatctccccatccctacttaagacactagtttgaagaataaaataaactttggttcaggaataaccaaacctaagcaactgaaggcactaagggtaggctatgtgttagcctgtgttattgttcataaatagtaattgccctggtctggaagaggattctatatcctaccccattgtagtctagcatggtatgtgacttgctttggccagtgaaacagagtgaaaatgatgtatgtcaattttaggcagaaacgtccagagccagcacttggtttgccatgttctccgtgtttcttctgctcctagatgcagcagtattccagatagaggccgcactatgagcctgaattccaggataaaaacaacatggaatagaacttagccagcacagagtacacatgtgctgtaaatgagaaatacccctttgttattgtaaatcactgagattttgaggttgtctgttactgcagcataatctagcctaatataaacaccaaactaatatactcctctaccatagtaatttatttcttgttctttctcctcctccttcctctacttcagggtttagcgaccttttgcctgcctgtttttgtaaggcctgaaagctaaacatagttttacatttttagatggttgaaaaaatcaaaaggagaataatagttcatgatgtaaaaattatataaaatttaaataaatgtcggcatccttaaataaagttttattggaacaca

SEQ ID NO: 12401 - DNA, 5014 bp, Homo sapiens
agcacgaaaggccacgcaggccgttctaaccctggcggccaagaggaggggtagcaggctctggaacctgcgggcggggacgaagacggcgcgcgacgatgtcgcaccgcggcgtgcgcggtgtcggcagtagctgcggcgcaggggcggagcgaaggctgcggcggcgtcgggtacgcgcacacgttgcatcttcttcctttcgcggggtcctccgtagttctggcacgagccaggcgtactgacaggtggaccagcggactggtggagatggcgacgctctctctgaccgtgaattcaggagaccctccgctaggagctttgctggcagtagaacacgtgaaagacgatgtcagcatttccgttgaagaagggaaagagaatattcttcatgtttctgaaaatgtgatattcacagatgtgaattctatacttcgctacttggctagagttgcaactacagctgggttatatggctctaatctgatggaacatactgagattgatcactggttggagttcagtgctacaaaattatcttcatgtgattcctttacttctacaattaatgaactcaatcattgcctgtctctgagaacatacttagttggaaactccttgagtttagcagatttatgtgtttgggccaccctaaaaggaaatgctgcctggcaagaacagttgaaacagaagaaagctccagttcatgtaaaacgttggtttggctttcttgaagcccagcaggccttccagtcagtaggtaccaagtgggatgtttcaacaaccaaagctcgagtggcacctgagaaaaagcaagatgttgggaaatttgttgagcttccaggtgcggagatgggaaaggttaccgtcagatttcctccagaggccagtggttacttacacattgggcatgcaaaagctgctcttctgaaccagcactaccaggttaactttaaagggaaactgatcatgagatttgatgacacaaatcctgaaaaagaaaaggaagattttgagaaggttatcttggaagatgttgcaatgttgcatatcaaaccagatcaatttacttatacttcggatcattttgaaactataatgaagtatgcagagaagctaattcaagaagggaaggcttatgtggatgatactcctgctgaacagatgaaagcagaacgtgagcagaggatagactctaaacatagaaaaaaccctattgagaagaatctacaaatgtgggaagaaatgaaaaaagggagccagtttggtcagtcctgttgtttgcgagcaaaaattgacatgagtagtaacaatggatgcatgagagatccaaccctttatcgctgcaaaattcaaccacatccaagaactggaaataaatacaatgtttatccaacatatgattttgcctgccccatagttgacagcatcgaaggtgttacacatgccctgagaacaacagaataccatgacagagatgagcagttttactggattattgaagctttaggcataagaaaaccatatatttgggaatatagtcggctaaatctcaacaacacagtgctatccaaaagaaaactcacatggtttgtcaatgaaggactagtagatggatgggatgacccaagatttcctacggttcgtggtgtactgagaagagggatgacagttgaaggactgaaacagtttattgctgctcagggctcctcacgttcagtcgtgaacatggagtgggacaaaatctgggcgtttaacaaaaaggttattgacccagtggctccacgatatgttgcattactgaagaaagaagtgatcccagtgaatgtacctgaagctcaggaggagatgaaagaagtagccaaacacccaaagaatcctgaggttggcttgaagcctgtgtggtatagtcccaaagttttcattgaaggtgctgatgcagagactttttcggagggtgagatggttacatttataaattggggcaacctcaacattacaaaaatacacaaaaatgcagatggaaaaatcatatctcttgatgcaaagttgaatttggaaaacaaagactacaagaaaaccactaaggtcacttggcttgcagagactacacatgctcttcctattccagtaatctgtgtcacttatgagcacttgatcacaaagccagtgctaggaaaagacgaggactttaagcagtatgtcaacaagaacagtaagcatgaagagctaatgctaggggatccctgccttaaggatttgaaaaaaggagatattatacaactccagagaagaggattcttcatatgtgatcaaccttatgaacctgttagcccatatagttgcaaggaagccccgtgtgttttgatatacattcctgatgggcacacaaaggaaatgccaacatcagggtcaaaggaaaagaccaaagtagaagccacaaaaaatgagacctctgctccttttaaggaaagaccaacaccttctctgaataataattgtactacatctgaggattccttggtcctttacaatagagtggctgttcaaggagatgtggttcgtgaattaaaagccaagaaagcaccaaaggaagatgtagatgcagctgtaaaacagcttttgtctttgaaagctgaatataaggagaaaactggccaggaatataaacctggaaaccctcctgctgaaataggacagaatatttcttctaattcctcagcaagtattctggaaagtaaatctctgtatgatgaagttgctgcacaaggggaggtggttcgtaagctaaaagctgaaaaatcccctaaggctaaaataaatgaagctgtagaatgcttactgtccctgaaggctcagtataaagaaaaaactgggaaggagtacatacctggtcagcccccattatctcaaagttcggattcaagcccaaccagaaattctgaacctgctggtttagaaacaccagaagcgaaagtactttttgacaaagtagcttctcaaggggaagtagttcggaaacttaaaactgaaaaagcccctaaggatcaagtagatatagctgttcaagaactccttcagctaaaggcacagtacaagtctttgataggagtagagtataagcctgtgtcggccactggagctgaggacaaagataagaagaagaaagaaaaagaaaataaatctgaaaagcagaataagcctcagaaacaaaatgatggccaaaggaaagacccttctaaaaaccaaggaggtgggctctcatcaagtggagcaggagaagggcaggggcctaagaaacagaccaggttgggtcttgaggcaaaaaaagaagaaaatcttgctgattggtattctcaggtcatcacaaagtcagaaatgattgaataccatgacataagtggctgttatattcttcgtccctgggcctatgccatttgggaagccatcaaggacttttttgatgctgagatcaagaaacttggtgttgaaaactgctacttccccatgtttgtgtctcaaagtgcattagagaaagagaagactcatgttgctgactttgccccagaggttgcttgggttacaagatctggcaaaaccgagctggcagaaccaattgccattcgtcctactagtgaaacagtaatgtatcctgcatatgcaaaatgggtacagtcacacagagacctgcccatcaagctcaatcagtggtgcaatgtggtgcgttgggaattcaagcatcctcagcctttcctacgtactcgtgaatttctttggcaggaagggcacagtgcttttgctaccatggaagaggcagcggaagaggtcttgcagatacttgacttatatgctcaggtatatgaagaactcctggcaattcctgttgttaaaggaagaaagacggaaaaggaaaaatttgcaggaggagactatacaactacaatagaagcatttatatctgctagtggaagagctatccagggaggaacatcacatcatttagggcagaatttttccaaaatgtttgaaatcgtttttgaagatccaaagataccaggagagaagcaatttgcctatcaaaactcctggggcctgacaactcgaactattggtgttatgaccatggttcatggggacaacatgggtttagtattaccaccccgtgtagcatgtgttcaggtggtgattattccttgtggcattaccaatgcactttctgaagaagacaaagaagcgctgattgcaaaatgcaatgattatcgaaggcgattactcagtgttaacatccgcgttagagctgatttacgagataattattctccaggttggaaattcaatcactgggagctcaagggagttcccattagacttgaagttgggccacgtgatatgaagagctgtcagtttgtagccgtcagacgagatactggagaaaagctgacagttgctgaaaatgaggcagagactaaacttcaagctattttggaagacatccaggtcacccttttcacaagggcttctgaagaccttaagactcatatggttgtggctaatacaatggaagactttcagaagatactagattctggaaagattgttcagattccattctgtggggaaattgactgtgaggactggatcaaaaagaccactgccagggatcaagatcttgaacctggtgctccatccatgggagctaaaagcctttgcatccccttcaaaccactctgtgaactgcagcctggagccaaatgtgtctgtggcaagaaccctgccaagtactacaccttatttggtcgcagctactgagggatgaacgaaagccccctcttcaactcctctcactttttaaagcattgatattagtatcttctcagatacagaccgttttatgattttttaaaaagtaaaagttctaaaatgaagtcacacaggacaattattcttatgcctaagttaacagtggataaaagacttttctgtaaacaactccagtaataaatatcatgaacta

SEQ ID NO: 12402 - DNA, 5085 bp, Homo sapiens
agcacgaaaggccacgcaggccgttctaaccctggcggccaagaggaggggtagcaggctctggaacctgcgggcggggacgaagacggcgcgcgacgatgtcgcaccgcggcgtgcgcggtgtcggcagtagctgcggcgcaggggcggagcgaaggctgcggcggcgtcgggtacgcgcacacgttgcatcttcttcctttcgcggggtcctccgtagttctggcacgagccaggcgtactgacaggtggaccagcggactggtggagatggcgacgctctctctgaccgtgaattcaggagaccctccgctaggagctttgctggcagtagaacacgtgaaagacgatgtcagcatttccgttgaagaagggaaagagaatattcttcatgtttctgaaaatgtgatattcacagatgtgaattctatacttcgctacttggctagagttgcaactacagctgggttatatggctctaatctgatggaacatactgagattgatcactggttggagttcagtgctacaaaattatcttcatgtgattcctttacttctacaattaatgaactcaatcattgcctgtctctgagaacatacttagttggaaactccttgagtttagcagatttatgtgtttgggccaccctaaaaggaaatgctgcctggcaagaacagttgaaacagaagaaagctccagttcatgtaaaacgttggtttggctttcttgaagcccagcaggccttccagtcagtaggtaccaagtgggatgtttcaacaaccaaagctcgagtggcacctgagaaaaagcaagatgttgggaaatttgttgagcttccaggtgcggagatgggaaaggttaccgtcagatttcctccagaggccagtggttacttacacattgggcatgcaaaagctgctcttctgaaccagcactaccaggttaactttaaagggaaactgatcatgagatttgatgacacaaatcctgaaaaagaaaaggaagattttgagaaggtaattaaaagtgtagtgatgaccctttgccagaaaagtattaaagttacaggattacctaataccttcatggttatcttggaagatgttgcaatgttgcatatcaaaccagatcaatttacttatacttcggatcattttgaaactataatgaagtatgcagagaagctaattcaagaagggaaggcttatgtggatgatactcctgctgaacagatgaaagcagaacgtgagcagaggatagactctaaacatagaaaaaaccctattgagaagaatctacaaatgtgggaagaaatgaaaaaagggagccagtttggtcagtcctgttgtttgcgagcaaaaattgacatgagtagtaacaatggatgcatgagagatccaaccctttatcgctgcaaaattcaaccacatccaagaactggaaataaatacaatgtttatccaacatatgattttgcctgccccatagttgacagcatcgaaggtgttacacatgccctgagaacaacagaataccatgacagagatgagcagttttactggattattgaagctttaggcataagaaaaccatatatttgggaatatagtcggctaaatctcaacaacacagtgctatccaaaagaaaactcacatggtttgtcaatgaaggactagtagatggatgggatgacccaagatttcctacggttcgtggtgtactgagaagagggatgacagttgaaggactgaaacagtttattgctgctcagggctcctcacgttcagtcgtgaacatggagtgggacaaaatctgggcgtttaacaaaaaggttattgacccagtggctccacgatatgttgcattactgaagaaagaagtgatcccagtgaatgtacctgaagctcaggaggagatgaaagaagtagccaaacacccaaagaatcctgaggttggcttgaagcctgtgtggtatagtcccaaagttttcattgaaggtgctgatgcagagactttttcggagggtgagatggttacatttataaattggggcaacctcaacattacaaaaatacacaaaaatgcagatggaaaaatcatatctcttgatgcaaagttgaatttggaaaacaaagactacaagaaaaccactaaggtcacttggcttgcagagactacacatgctcttcctattccagtaatctgtgtcacttatgagcacttgatcacaaagccagtgctaggaaaagacgaggactttaagcagtatgtcaacaagaacagtaagcatgaagagctaatgctaggggatccctgccttaaggatttgaaaaaaggagatattatacaactccagagaagaggattcttcatatgtgatcaaccttatgaacctgttagcccatatagttgcaaggaagccccgtgtgttttgatatacattcctgatgggcacacaaaggaaatgccaacatcagggtcaaaggaaaagaccaaagtagaagccacaaaaaatgagacctctgctccttttaaggaaagaccaacaccttctctgaataataattgtactacatctgaggattccttggtcctttacaatagagtggctgttcaaggagatgtggttcgtgaattaaaagccaagaaagcaccaaaggaagatgtagatgcagctgtaaaacagcttttgtctttgaaagctgaatataaggagaaaactggccaggaatataaacctggaaaccctcctgctgaaataggacagaatatttcttctaattcctcagcaagtattctggaaagtaaatctctgtatgatgaagttgctgcacaaggggaggtggttcgtaagctaaaagctgaaaaatcccctaaggctaaaataaatgaagctgtagaatgcttactgtccctgaaggctcagtataaagaaaaaactgggaaggagtacatacctggtcagcccccattatctcaaagttcggattcaagcccaaccagaaattctgaacctgctggtttagaaacaccagaagcgaaagtactttttgacaaagtagcttctcaaggggaagtagttcggaaacttaaaactgaaaaagcccctaaggatcaagtagatatagctgttcaagaactccttcagctaaaggcacagtacaagtctttgataggagtagagtataagcctgtgtcggccactggagctgaggacaaagataagaagaagaaagaaaaagaaaataaatctgaaaagcagaataagcctcagaaacaaaatgatggccaaaggaaagacccttctaaaaaccaaggaggtgggctctcatcaagtggagcaggagaagggcaggggcctaagaaacagaccaggttgggtcttgaggcaaaaaaagaagaaaatcttgctgattggtattctcaggtcatcacaaagtcagaaatgattgaataccatgacataagtggctgttatattcttcgtccctgggcctatgccatttgggaagccatcaaggacttttttgatgctgagatcaagaaacttggtgttgaaaactgctacttccccatgtttgtgtctcaaagtgcattagagaaagagaagactcatgttgctgactttgccccagaggttgcttgggttacaagatctggcaaaaccgagctggcagaaccaattgccattcgtcctactagtgaaacagtaatgtatcctgcatatgcaaaatgggtacagtcacacagagacctgcccatcaagctcaatcagtggtgcaatgtggtgcgttgggaattcaagcatcctcagcctttcctacgtactcgtgaatttctttggcaggaagggcacagtgcttttgctaccatggaagaggcagcggaagaggtcttgcagatacttgacttatatgctcaggtatatgaagaactcctggcaattcctgttgttaaaggaagaaagacggaaaaggaaaaatttgcaggaggagactatacaactacaatagaagcatttatatctgctagtggaagagctatccagggaggaacatcacatcatttagggcagaatttttccaaaatgtttgaaatcgtttttgaagatccaaagataccaggagagaagcaatttgcctatcaaaactcctggggcctgacaactcgaactattggtgttatgaccatggttcatggggacaacatgggtttagtattaccaccccgtgtagcatgtgttcaggtggtgattattccttgtggcattaccaatgcactttctgaagaagacaaagaagcgctgattgcaaaatgcaatgattatcgaaggcgattactcagtgttaacatccgcgttagagctgatttacgagataattattctccaggttggaaattcaatcactgggagctcaagggagttcccattagacttgaagttgggccacgtgatatgaagagctgtcagtttgtagccgtcagacgagatactggagaaaagctgacagttgctgaaaatgaggcagagactaaacttcaagctattttggaagacatccaggtcacccttttcacaagggcttctgaagaccttaagactcatatggttgtggctaatacaatggaagactttcagaagatactagattctggaaagattgttcagattccattctgtggggaaattgactgtgaggactggatcaaaaagaccactgccagggatcaagatcttgaacctggtgctccatccatgggagctaaaagcctttgcatccccttcaaaccactctgtgaactgcagcctggagccaaatgtgtctgtggcaagaaccctgccaagtactacaccttatttggtcgcagctactgagggatgaacgaaagccccctcttcaactcctctcactttttaaagcattgatattagtatcttctcagatacagaccgttttatgattttttaaaaagtaaaagttctaaaatgaagtcacacaggacaattattcttatgcctaagttaacagtggataaaagacttttctgtaaacaactccagtaataaatatcatgaact

SEQ ID NO: 12403 - DNA, 5034 bp, Homo sapiens
agcacgaaaggccacgcaggccgttctaaccctggcggccaagaggaggggtagcaggctctggaacctgcgggcggggacgaagacggcgcgcgacgatgtcgcaccgcggcgtgcgcggtgtcggcagtagctgcggcgcaggggcggagcgaaggctgcggcggcgtcgggtacgcgcacacgttgcatcttcttcctttcgcggggtcctccgtagttctggcacgagccaggcgtactgacaggtggaccagcggactggtggagatggcgacgctctctctgaccgtgaattcaggagaccctccgctaggagctttgctggcagtagaacacgtgaaagacgatgtcagcatttccgttgaagaagggaaagagaatattcttcatgtttctgaaaatgtgatattcacagatgtgaattctatacttcgctacttggctagagttgcaactacagctgggttatatggctctaatctgatggaacatactgagattgatcactggttggagttcagtgctacaaaattatcttcatgtgattcctttacttctacaattaatgaactcaatcattgcctgtctctgagaacatacttagttggaaactccttgagtttagcagatttatgtgtttgggccaccctaaaaggaaatgctgcctggcaagaacagttgaaacagaagaaagctccagttcatgtaaaacgttggtttggctttcttgaagcccagcaggccttccagtcagtaggtaccaagtgggatgtttcaacaaccaaagctcgagtggcacctgagaaaaagcaagatgttgggaaatttgttgagcttccaggtgcggagatgggaaaggttaccgtcagatttcctccagaggccagtggttacttacacattgggcatgcaaaagctgctcttctgaaccagcactaccaggttaactttaaagggaaactgatcatgagatttgatgacacaaatcctgaaaaagaaaaggaagattttgagaaggttatcttggaagatgttgcaatgttgcatatcaaaccagatcaatttacttatacttcggatcattttgaaactataatgaagtatgcagagaagctaattcaagaagggaaggcttatgtggatgatactcctgctgaacagatgaaagcagaacgtgagcagaggatagactctaaacatagaaaaaaccctattgagaagaatctacaaatgtgggaagaaatgaaaaaagggagccagtttggtcagtcctgttgtttgcgagcaaaaattgacatgagtagtaacaatggatgcatgagagatccaaccctttatcgctgcaaaattcaaccacatccaagaactggaaataaatacaatgtttatccaacatatgattttgcctgccccatagttgacagcatcgaaggtgttacacatgccctgagaacaacagaataccatgacagagatgagcagttttactggattattgaagctttaggcataagaaaaccatatatttgggaatatagtcggctaaatctcaacaacacagtgctatccaaaagaaaactcacatggtttgtcaatgaaggactagtagatggatgggatgacccaagatttcctacggttcgtggtgtactgagaagagggatgacagttgaaggactgaaacagtttattgctgctcagggctcctcacgttcagtcgtgaacatggagtgggacaaaatctgggcgtttaacaaaaagctgcgagctctctgtaagaaggttattgacccagtggctccacgatatgttgcattactgaagaaagaagtgatcccagtgaatgtacctgaagctcaggaggagatgaaagaagtagccaaacacccaaagaatcctgaggttggcttgaagcctgtgtggtatagtcccaaagttttcattgaaggtgctgatgcagagactttttcggagggtgagatggttacatttataaattggggcaacctcaacattacaaaaatacacaaaaatgcagatggaaaaatcatatctcttgatgcaaagttgaatttggaaaacaaagactacaagaaaaccactaaggtcacttggcttgcagagactacacatgctcttcctattccagtaatctgtgtcacttatgagcacttgatcacaaagccagtgctaggaaaagacgaggactttaagcagtatgtcaacaagaacagtaagcatgaagagctaatgctaggggatccctgccttaaggatttgaaaaaaggagatattatacaactccagagaagaggattcttcatatgtgatcaaccttatgaacctgttagcccatatagttgcaaggaagccccgtgtgttttgatatacattcctgatgggcacacaaaggaaatgccaacatcagggtcaaaggaaaagaccaaagtagaagccacaaaaaatgagacctctgctccttttaaggaaagaccaacaccttctctgaataataattgtactacatctgaggattccttggtcctttacaatagagtggctgttcaaggagatgtggttcgtgaattaaaagccaagaaagcaccaaaggaagatgtagatgcagctgtaaaacagcttttgtctttgaaagctgaatataaggagaaaactggccaggaatataaacctggaaaccctcctgctgaaataggacagaatatttcttctaattcctcagcaagtattctggaaagtaaatctctgtatgatgaagttgctgcacaaggggaggtggttcgtaagctaaaagctgaaaaatcccctaaggctaaaataaatgaagctgtagaatgcttactgtccctgaaggctcagtataaagaaaaaactgggaaggagtacatacctggtcagcccccattatctcaaagttcggattcaagcccaaccagaaattctgaacctgctggtttagaaacaccagaagcgaaagtactttttgacaaagtagcttctcaaggggaagtagttcggaaacttaaaactgaaaaagcccctaaggatcaagtagatatagctgttcaagaactccttcagctaaaggcacagtacaagtctttgataggagtagagtataagcctgtgtcggccactggagctgaggacaaagataagaagaagaaagaaaaagaaaataaatctgaaaagcagaataagcctcagaaacaaaatgatggccaaaggaaagacccttctaaaaaccaaggaggtgggctctcatcaagtggagcaggagaagggcaggggcctaagaaacagaccaggttgggtcttgaggcaaaaaaagaagaaaatcttgctgattggtattctcaggtcatcacaaagtcagaaatgattgaataccatgacataagtggctgttatattcttcgtccctgggcctatgccatttgggaagccatcaaggacttttttgatgctgagatcaagaaacttggtgttgaaaactgctacttccccatgtttgtgtctcaaagtgcattagagaaagagaagactcatgttgctgactttgccccagaggttgcttgggttacaagatctggcaaaaccgagctggcagaaccaattgccattcgtcctactagtgaaacagtaatgtatcctgcatatgcaaaatgggtacagtcacacagagacctgcccatcaagctcaatcagtggtgcaatgtggtgcgttgggaattcaagcatcctcagcctttcctacgtactcgtgaatttctttggcaggaagggcacagtgcttttgctaccatggaagaggcagcggaagaggtcttgcagatacttgacttatatgctcaggtatatgaagaactcctggcaattcctgttgttaaaggaagaaagacggaaaaggaaaaatttgcaggaggagactatacaactacaatagaagcatttatatctgctagtggaagagctatccagggaggaacatcacatcatttagggcagaatttttccaaaatgtttgaaatcgtttttgaagatccaaagataccaggagagaagcaatttgcctatcaaaactcctggggcctgacaactcgaactattggtgttatgaccatggttcatggggacaacatgggtttagtattaccaccccgtgtagcatgtgttcaggtggtgattattccttgtggcattaccaatgcactttctgaagaagacaaagaagcgctgattgcaaaatgcaatgattatcgaaggcgattactcagtgttaacatccgcgttagagctgatttacgagataattattctccaggttggaaattcaatcactgggagctcaagggagttcccattagacttgaagttgggccacgtgatatgaagagctgtcagtttgtagccgtcagacgagatactggagaaaagctgacagttgctgaaaatgaggcagagactaaacttcaagctattttggaagacatccaggtcacccttttcacaagggcttctgaagaccttaagactcatatggttgtggctaatacaatggaagactttcagaagatactagattctggaaagattgttcagattccattctgtggggaaattgactgtgaggactggatcaaaaagaccactgccagggatcaagatcttgaacctggtgctccatccatgggagctaaaagcctttgcatccccttcaaaccactctgtgaactgcagcctggagccaaatgtgtctgtggcaagaaccctgccaagtactacaccttatttggtcgcagctactgagggatgaacgaaagccccctcttcaactcctctcactttttaaagcattgatattagtatcttctcagatacagaccgttttatgattttttaaaaagtaaaagttctaaaatgaagtcacacaggacaattattcttatgcctaagttaacagtggataaaagacttttctgtaaacaactccagtaataaatatcatgaact

SEQ ID NO: 12404 - DNA, 2769 bp, Homo sapiens
acgtgtgctattccatcccacatggcggcgctcctgaggagactgctgcagcgcgagaggccttcggcggcctctggccgccccgtaggacggcgcgaggccaacctgggcactgatgccggggttgcggtgcgagtgcggttcgctcccagccccacaggcttcttgcacctgggtggcctccgcactgccttgtacaactacatctttgctaagaagtaccaggggagcttcatcctgaggctagaggacacagatcagactcgcgttgtgcctggggcagcggagaatattgaggacatgctggagtgggcaggcatcccgcctgatgagagcccccgccggggcggtcctgctgggccctaccagcaatctcagcggttggagctgtatgcccaggccacagaagcgctgctgaagaccggagctgcttacccctgtttctgctcaccccagcggctggagctcctgaagaaggaggccttgcggaaccaccagacgccccggtatgacaatcggtgcaggaacatgagccaggagcaggtggcccagaagctggccaaggaccccaagcctgcgatccgcttccgcctggagcaggtggtgccagccttccaggacctggtctatggctggaataggcatgaagtggccagcgtggagggagacccagtcatcatgaagagcgacggcttccccacataccacctggcctgcgtggtggacgaccaccacatgggcatcagccacgtgctgcgaggctctgagtggctcgtctccactgccaagcacctgctcctctaccaggccctgggctggcagccaccccacttcgcccacctgcccctgctcctcaacagggatggcagcaagctctccaagaggcaaggggacgttttcctggagcactttgctgctgatggcttcctgcccgattccttgttggacatcatcaccaactgtggctcaggttttgcagagaaccaaatgggcaggaccctgccggagctgatcacacagttcaacctgacacaggtcacctgtcactcagccctgctggacctggagaagctcccagaattcaacagactgcacctccagcggctggtgagcaatgagagccagaggcgccagctggtggggaagctgcaggtccttgtggaggaggcctttggttgccagctgcaaaacagggatgtcctcaacccagtctacgtggagaggatcctcctgctgagacagggtcacatttgccgcctgcaggacttggtgtccccagtatactcttacctgtggactcgccctgcagtaggtcgagcacagctggacgccatctcggagaaggtggatgtgattgccaagcgtgtgctggggcttctagaaagatctagtatgagcttaactcaggatatgctgaatggagaactgaagaagctatcagaaggtctggaaggcaccaagtacagtaatgtgatgaaactccttcggatggccctcagtggacagcagcaaggacctcctgtagctgagatgatgttggccttgggaccaaaggaagtacgggaacggatccagaaggtggtttccagctagggagaggatgtttcgggcagtggagatcgccctaagaacctgtgagcttagaaacagctttcagagaccagaaggaggcctggggcccgtcgggaagtttgctgaaggaactaagagtggaaacaatctctgactgcacacaagtgcatttgtgatccaccacaggcacgtttttgtcaattggctggggaagcccaacccatctaacctcctggactctggaaaggcattctccgggtctggtttctcacacattacacagcagaggtttggagttagttcacagaaaagttaacatcccggaacagtgcagaaggcttgggtttcagtttgctagggcccccataacaaaatgccacagaaccaggtggtttaaacaacagagatttattttctcacatttggaggctagaagttcaagatcaaggtgtcagcaggcctggtttttcctagaggcctcttttgttggcttgcagacagctgtcttctcactgtgtccttgtgcggtcttccctccatgcacacacatctctaagtttcattatgtgcccaacgttcctcttctaagaacaccagttggactggattttaactttaaccagcctcatttaagttaatcacctctttaaatgctcaatctccaagtgaaaggaggatggtggcagggtacatgaacccctaccaggcttctaggcttcccctgcatggcagccagcctctaagttggcccccaaccatccctgccttcttctattcacacccttgtgtggttccttcccacattgaataggcctgacttgtgtaaccactacactattgaagaaatgagagtttgacttctgagggtaagtcataaaatacatcgtggcttctgtcttgttttctttgatcgcttactttgggggaagccagcttccaggtcatgaaaatactcaagcagccttatggagtgctccacatgacaagggatcgaggcctcccaccaatagccatgggagtgtgcaatcttgaaagctggtccttcaattccagccaagcattcacatgaccgcaatcctagctgatctcgcttgtgacctctatgggagaccctaagccagaaccactcagagaagctgctccggaacgtcagacacacatgaactgtgagatagtaaacgtttattgtttaaagct

SEQ ID NO: 12405 - DNA, 3961 bp, Homo sapiens
gggagaagcccacgtgtgctattccatcccacatggcggcgctcctgaggagactgctgcagcgcgagaggccttcggcggcctctggccgccccgtaggacggcgcgaggccaacctgggcactgatgccggggttgcggtgcgagtgcggttcgctcccagccccacaggcttcttgcacctgggtggcctccgcactgccttgtacaactacatctttgctaagaagtaccaggggagcttcatcctgaggctagaggacacagatcagactcgcgttgtgcctggggcagcggagaatattgaggacatgctggagtgggcaggcatcccgcctgatgagagcccccgccggggcggtcctgctgggccctaccagcaatctcagcggttggagctgtatgcccaggccacagaagcgctgctgaagaccggagctgcttacccctgtttctgctcaccccagcggctggagctcctgaagaaggaggccttgcggaaccaccagacgccccggtatgacaatcggtgcaggaacatgagccaggagcaggtggcccagaagctggccaaggaccccaagcctgcgatccgcttccgcctggagcaggtggtgccagccttccaggacctggtctatggctggaataggcatgaagtggccagcgtggagggagacccagtcatcatgaagagcgacggcttccccacataccacctggcctgcgtggtggacgaccaccacatgggcatcagccacgtgctgcgaggctctgagtggctcgtctccactgccaagcacctgctcctctaccaggccctgggctggcagccaccccacttcgcccacctgcccctgctcctcaacagggatggcagcaagctctccaagaggcaaggggacgttttcctggagcactttgctgctgatggcttcctgcccgattccttgttggacatcatcaccaactgtggctcaggttttgcagagaaccaaatgggcaggaccctgccggagctgatcacacagttcaacctgacacaggtcacctgtcactcagccctgctggacctggagaagctcccagaattcaacagactgcacctccagcggctggtgagcaatgagagccagaggcgccagctggtggggaagctgcaggtccttgtggaggaggcctttggttgccagctgcaaaacagggatgtcctcaacccagtctacgtggagaggatcctcctgctgagacagggtcacatttgccgcctgcaggacttggtgtccccagtatactcttacctgtggactcgccctgcagtaggtcgagcacagctggacgccatctcggagaaggtggatgtgattgccaagcgtgtgctggggcttctagaaagatctagtatgagcttaactcaggatatgctgaatggagaactgaagaagctatcagaaggtctggaaggcaccaagtacagtaatgtgatgaaactccttcggatggccctcagtggacagcagcaaggacctcctgtagctgagatgatgttggccttgggaccaaaggaagtacgggaacggatccagaaggtggtttccagctagggagaggatgtttcgggcagtggagatcgccctaagaacctgtgagcttagaaacagctttcagagaccagaaggaggcctggggcccgtcgggaagtttgctgaaggaactaagagtggaaacaatctctgactgcacacaagtgcatttgtgatccaccacaggcacgtttttgtcaattggctggggaagcccaacccatctaacctcctggactctggaaaggcattctccgggtctggtttctcacacattacacagcagaggtttggagttagttcacagaaaagttaacatcccggaacagtgcagaaggcttgggtttcagtttgctagggcccccataacaaaatgccacagaaccaggtggtttaaacaacagagatttattttctcacatttggaggctagaagttcaagatcaaggtgtcagcaggcctggtttttcctagaggcctcttttgttggcttgcagacagctgtcttctcactgtgtccttgtgcggtcttccctccatgcacacacatctctaagtttcattatgtgcccaacgttcctcttctaagaacaccagttggactggattttaactttaaccagcctcatttaagttaatcacctctttaaatgctcaatctccaagtacagtctcattctgaggttccaggggtttctcaacgtaagaatttagggggacagaattcagcccgtagcagctgggcagcaggactcatgggtcccagttctcaggccccaaggactcagagcagcaaaggatacgtgacacaagcagggctgaactggacaccagactttctttggggttgtaaaaggagaagtgtgactccactgccaagggtaagcactcttgtcttatgctaccctttattcttgaaccttggggcagcctgtgtctcccttccctaaacgtcatctgttccgtttttccagtcttccagacctggtccttggactggagaccttcacccttcctattttgtggctttctcttcaaatccacctcgtccttcctccatgacttataagtcatcatctctgctggtttctgaaatgagatatgcttcttggggtcttcagtgaagaggaatagcaagtgaaaggaggatggtggcagggtacatgaacccctaccaggcttctaggcttcccctgcatggcagccagcctctaagttggcccccaaccatccctgccttcttctattcacacccttgtgtggttccttcccacattgaataggcctgacttgtgtaaccactacactattgaagaaatgagagtttgacttctgagggtaagtcataaaatacatcgtggcttctgtcttgttttctttgatcgcttactttgggggaagccagcttccaggtcatgaaaatactcaagcagccttatggagtgctccacatgacaagggatcgaggcctcccaccaatagccatgggagtgtgcaatcttgaaagctggtccttcaattccagccaagcattcacatgaccgcaatcctagctgatctcgcttgtgacctctatgggagaccctaagccagaaccactcagagaagctgctccggaacgtcagacacacatgaactgtgagatagtaaacgtttattgtttaaagctacttggtttggggataatttgcgtttcagcagtagacaatatatttattttgtccaggggagtggaaaggcgattacagagtttgttgagccccatagagtcctagtctttgcttaaagaaatataccagttctttctaatacagaatccattaagttcgttggttgcaaacaatagaaaccaactctgcctcacttatgtttattggaggccataagagagccacagcatctaccaaaaagccaaaaaaaaaacaggttttggaaaagacaggaactagctacaggagctaatggccaatcttgtctgagttctttgatggcgacacatgaactacagccgttttgttgttgttaatttctccgtgttttcccctcagttttggatgactctgctcaaggttcagattctgaggagcaagtatctgttgggctatctgaggtcctgctaccattccttggccagtaataggtagtttcacagggattatatgcaatggaggaaaagttgttctcaaggaaaactagggagctttctccagaagatgatgtaatggcagaaacaacaggtggttgaccacagaaggggacaataataatacttgtaatttattgtgcgcttatatgagcctcaccctctcccaggtgtcagataatgctcgtaaatgccttagtccatcatctcagtaaattttttttataacactatg

SEQ ID NO: 12406 - DNA, 1211 bp, Homo sapiens
gtaagcactttatgcttccccagaggtgactaaactctgatcattgccaatgggcaggcactccccaaatgtccaaggacaacaaagatacccagagtgtctttcatagctaccaatgattaaatagcaagtattgcattcctgggcattgctaactagtgaagtataccagatggaaatgtcttcgaagctgtccctttaaaactcgagcaagctaccaggcaaactccgcctccagggaggttccttattaaataggagccaactggctgggtcggggctcaataccccaagcaatacctgcaactgaggattcttcccggggagaccgcagcccatcggcatggctcaagagtttgtgaactgcaaaatccagcctgggaaggtggttgtgttcatcaagcccacctgcccgtactgcaggagggcccaagagatcctcagtcaattgcccatcaaacaagggcttctggaatttgtcgatatcacagccaccaaccacactaacgagattcaagattatttgcaacagctcacgggagcaagaacggtgcctcgagtctttattggtaaagattgtataggcggatgcagtgatctagtctctttgcaacagagtggggaactgctgacgcggctaaagcagattggagctctgcagtaaccacagatctcataggaaatgttcaacaattctgtgaaaggtcacaggacccaattggagaaatcatatgaaaagcatagttggtcttggtgtcatatggatcagaggcacaagtgcagaggctgtggtcatgcggaacactctgttatttaagatggctatccagataatcctgaacactgtgtatttattttatttagactaccagcaaagattaaagcatgaaatgtaaaacatctgataaaacttacagccccctacaccaagagtgtatctgtgaaagagctcctacactttgaaaacttaagaatcccttatcatgaagtttgcctgttctagaattgtaagattgttaatttccttcaatctctagtgacaacacttaatttcttttctaataaaaaaaacctatagatgattcagtgatttttgtccaattcatttgcatgttctcaagacattaaggaatgttatgcgaaatacactaacttaaaactgtgtttatatttggccctgccattataaataaagacacgtgctgctgtca

SEQ ID NO: 12407 - DNA, 1366 bp, Homo sapiens
aagcaatacctgcaactgaggattcttcccggggagaccgcagcccatcggcatggctcaagagtttgtgaactgcaaaatccagcctgggaaggtggttgtgttcatcaagcccacctgcccgtactgcaggagggcccaagagatcctcagtcaattgcccatcaaacaagggcttctggaatttgtcgatatcacagccaccaaccacactaacgagattcaagattatttgcaacagctcacgggagcaagaacggtgcctcgagtctttattggtaaagattgtataggcggatgcagtgatctagtctctttgcaacagagtggggaactgctgacgcggctaaagcagattggagctctgcagtaaccacagaacaggccccatgctgacgtccctcctcaagagctggatggcattgcaaatgatgacagcacttctggtggatgaatttgggggcacaaacagcttttttcctcttttggctcagtatttaaaagtggaccaacttgctcttaatcacagggccaagaaggttgacgggccatcttggttttcttctggatgtgctctttggttttcagaagactgtgacaagttctggcccaggattcgctcactgaccctcaattgtcctctttggcatgcgtttcttactgttctccatgtgtcggcatgtctctacctctaagccagtgtttttcaactatgtttatccagactccttctccacaatgatgaatccacagttggttatctgctactgcccattagctaaaatcattttgctgcttgactttatggagtttgtattatgaaatcagtgggtattttgaatgtgttctttctaactacatgcatctctccactcaactccaccccatcccatcccaccttgaaaatcactgctctgaaccagtgttctccaccttgtcctccacagatctcataggaaatgttcaacaattctgtgaaaggtcacaggacccaattggagaaatcatatgaaaagcatagttggtcttggtgtcatatggatcagaggcacaagtgcagaggctgtggtcatgcggaacactctgttatttaagatggctatccagataatcctgaacactgtgtatttattttatttagactaccagcaaagattaaagcatgaaatgtaaaacatctgataaaacttacagccccctacaccaagagtgtatctgtgaaagagctcctacactttgaaaacttaagaatcccttatcatgaagtttgcctgttctagaattgtaagattgttaatttccttcaatctctagtgacaacacttaatttcttttctaataaaaaaaacctatagatgattcagtg

SEQ ID NO: 12408 - DNA, 632 bp, Homo sapiens
aataccccaagcaatacctgcaactgaggattcttcccggggagaccgcagcccatcggcatggctcaagagtttgtgaactgcaaaatccagcctgggaaggtggttgtgttcatcaagcccacctgcccgtactgcaggagggcccaagagatcctcagtcaattgcccatcaaacaagggcttctggaatttgtcgatatcacagccaccaaccacactaacgagattcaagattatttgcaacagctcacgggagcaagaacggtgcctcgagtctttattggtaaagattgtataggcggatgcagtgatctagtctctttgcaacagagtggggaactgctgacgcggctaaagcagattggagctctgcagtaaccacagggccaagaaggttgacgggccatcttggttttcttctggatgtgctctttggttttcagaagactgtgacaagttctggcccaggattcgctcactgaccctcaattgtcctctttggcatgcgtttcttactgttctccatgtgtcggcatgtctctacctctaagccagtgtttttcaactatgtttatccagactccttctccacaatgatgaatccacagttggttatctgctactgccca

SEQ ID NO: 12409 - DNA, 533 bp, Homo sapiens
gctcaataccccaagcaatacctgcaactgaggattcttcccggggagaccgcagcccatcggcatggctcaagagtttgtgaactgcaaaatccagcctgggaaggtggttgtgttcatcaagcccacctgcccgtactgcaggagggcccaagagatcctcagtcaattgcccatcaaacaagggcttctggaatttgtcgatatcacagccaccaaccacactaacgagattcaagattatttgcaacagctcacgggagcaagaacggtgcctcgagtctttattggtaaagattgtataggcggatgcagtgatctagtctctttgcaacagagtggggaactgctgacgcggctaaagcagattggagctctgcagtaaccacagaaatggagtatcactatgttgctcaagctagactcaaactcctggactcaagggatcctcccgcctcagccttccaagtcactgggattataagtgcatgccatcccacgcagctactctcttgaatactcgagaaagccaa

SEQ ID NO: 12410 - DNA, 473 bp, Homo sapiens
caatacctgcaactgaggattcttcccggggagaccgcagcccatcggcatggctcaagagtttgtgaactgcaaaatccagcctgggaaggtggttgtgttcatcaagcccacctgcccgtactgcaggagggcccaagagatcctcagtcaattgcccatcaaacaagggcttctggaatttgtcgatatcacagccaccaaccacactaacgagattcaagattatttgcaacagctcacgggagcaagaacggtgcctcgagtctttattggtaaagattgtataggcggatgcagtgatctagtctctttgcaacagagtggggaactgctgacgcggctaaagcagattggagctctgcagtaaccacaggtgagtggcaggtgaggtgctgggccaggaacatgggagaccgtggaattcttctgtcgtggtttgttatactgtatgacagcattctggttggggg

SEQ ID NO: 12411 - DNA, 701 bp, Homo sapiens
gatccgcggtgtccggcagtagagctcgctgcagatccgggctctgaccatgatttggcgccgcgcggcgctggcggggacgcggctggtttggagcaggagcggctcggcaggctggcttgacagggcggcgggagctgcgggagctgcggcagctgcggcctctgggatggagagcaatacatcatcatctttggagaatttagcgacggcgcctgtgaaccagatccaagaaacaatttctgataattgtgtggtgattttctcaaaaacatcctgttcttactgtacaatggcaaaaaagcttttccatgacatgaatgttaactataaagtggtggaactggacctgcttgaatatggaaaccagttccaagatgctctttacaaaatgactggtgaaagaactgttccaagaatatttgtcaatggtacttttattggaggtgcaactgacactcataggcttcacaaagaaggaaaattgctcccactagttcatcagtgttatttaaaaaaaagtaagaggaaagaatttcagtgatgtttatactaataagtttgctagtacagtgtcagttatttaaagtggtaatgcccgataatgtcttttaaatgtttgaggatgttttaaatacatgcattgtcttcacgaagaagatgtaaaaataatgaacaataaattgcggtggaaacctctt

SEQ ID NO: 12412 - DNA, 1131 bp, Homo sapiens
aaggctattattaccaccactgagtggcttaaataatcctgtcaacagcaatcgcccatttccaaagccatggtgaaacatctctgtgctaatttcttttgttttgtttcctaattttttttttttggcaggtggtgggaaataatctttgtcttctttggagtaaaccttcaacaccggattttttcttttaattatggatgtaaaccccaatatccccataatttacattgggtctcgaccaattgcctaattataagaggatatatttaggctcttatttcatccacacaaaaacttgtgtaacaggtagttggaaacatctgaggcaccactttgattctgttttggatggtcatgttttttctcctccgtttccccagcatgtctgccaccatcctcatgcactgcttccaagtgcctgggagcctttatgagcgtccctaaacctaaaagaatccagaggcggggctcggatgaaccctcgagataagcaagtgagccgcttctcccctctaaaggatgtttacacgtgggtggcactcgctggaatccagcgctcgggcagccctgggaggacgcgctcagctgcgaggaggatggagagcaatacatcatcatctttggagaatttagcgacggcgcctgtgaaccagatccaagaaacaatttctgataattgtgtggtgattttctcaaaaacatcctgttcttactgtacaatggcaaaaaagcttttccatgacatgaatgttaactataaagtggtggaactggacctgcttgaatatggaaaccagttccaagatgctctttacaaaatgactggtgaaagaactgttccaagaatatttgtcaatggtacttttattggaggtgcaactgacactcataggcttcacaaagaaggaaaattgctcccactagttcatcagtgttatttaaaaaaaagtaagaggaaagaatttcagtgatgtttatactaataagtttgctagtacagtgtcagttatttaaagtggtaatgcccgataatgtcttttaaatgtttgaggatgttttaaatacatgcattgtcttcacgaagaagatgtaaaaataatgaacaataaattgcggtggaaacctctt

SEQ ID NO: 12413 - DNA, 1262 bp, Homo sapiens
gcttctgtctggcggcggcagcatggcggcgggggcggctgaggcagctgtagcggccgtggaggaggtcggctcagccgggcagtttgaggagctgctgcgcctcaaagccaagtccctccttgtggtccatttctgggcaccatgggctccacagtgtgcacagatgaacgaagttatggcagagttagctaaagaactccctcaagtttcatttgtgaagttggaagctgaaggtgttcctgaagtatctgaaaaatatgaaattagctctgttcccacttttctgtttttcaagaattctcagaaaatcgaccgattagatggtgcacatgccccagagttgaccaaaaaagttcagcgacatgcatctagtggctccttcctacccagcgctaatgaacatcttaaagaagatctcaaccttcgcttgaagaaattgactcatgctgccccctgcatgctgtttatgaaaggaactcctcaagaaccacgctgtggtttcagcaagcagatggtggaaattcttcacaaacataatattcagtttagcagttttgatatcttctcagatgaagaggttcgacagggactcaaagcctattccagttggcctacctatcctcagctctatgtttctggagagctcataggaggacttgatataattaaggagctagaagcatctgaagaactagatacaatttgtcccaaagctcccaaattagaggaaaggctcaaagtgctgacaaataaagcttctgtgatgctctttatgaaaggaaacaaacaggaagcaaaatgtggattcagcaaacaaattctggaaatactaaatagtactggtgttgaatatgaaacattcgatatattggaggatgaagaagttcggcaaggattaaaagcttactcaaattggccaacataccctcagctgtatgtgaaaggggagctggtgggaggattggatattgtgaaggaactgaaagaaaatggtgaattgctgcctatactgagaggagaaaattaataaatcttaaacttggtgcccaactattgtaagaaatatttaattacattgggagcagttcatgatttagtcctcagaaatggactaggaatagaaaattcctgctttctcagttacatgttttgtgtatttcacaatgtcgtgctaaataaatgtatgttacatttttttcccaccaaaaatagaatgcaataaacatcttcaaattattaacaataattgtatgaaaaaa

SEQ ID NO: 12414 - DNA, 1322 bp, Homo sapiens
gcttctgtctggcggcggcagcatggcggcgggggcggctgaggcagctgtagcggccgtggaggaggtcggctcagccgggcagtttgaggagctgctgcgcctcaaagccaagtccctccttgtggtccatttctgggcaccatgggctccacagtgtgcacagatgaacgaagttatggcagagttagctaaagaactccctcaagtttcatttgtgaagttggaagctgaaggtgttcctgaagtatctgaaaaatatgaaattagctctgttcccacttttctgtttttcaagaattctcagaaaatcgaccgattagatggtgcacatgccccagagttgaccaaaaaagttcagcgacatgcatctagtggctccttcctacccagcgctaatgaacatcttaaagaagatctcaaccttcgcttgaagaaattgactcatgctgccccctgcatgctgtttatgaaaggaactcctcaagaaccacgctgtggtttcagcaagcagatggtggaaattcttcacaaacataatattcagtttagcagttttgatatcttctcagatgaagaggttcgacagggactcaaagcctattccagttggcctacctatcctcagctctatgtttctggagagctcataggaggacttgatataattaaggagctagaagcatctgaagaactagatacaatttgtcccaaagctcccaaattagaggaaaggctcaaagtgctgacaaataaagcttctgtgatgctctttatgaaaggaaacaaacaggaagcaaaatgtggattcagcaaacaaattctggaaatactaaatagtactggtgttgaatatgaaacattcgatatattggaggatgaagaagttcggcaaggattaaaagcttactcaaattggccaacataccctcagctgtatgtgaaaggggagctggtgggaggattggatattgtgaaggaactgaaagaaaatggtgaattgctgcctatactgagaggagaaaattaataaatcttaaacttggtgcccaactattacggggtctggctctgtcacccaggctggagtgcagtggcacgattatggctcattgcagcctcgacttctcggggccaagcgatcctcctgcctcagccttctgagtagctgggaccacaggcgtgcaccaccatgcccacctaattttttatttcttgtagagatgaggtctcctgcctcagcctcccaaagtgctggaatttacaggtaggaccaccacacttggtccacttacttataataaacattgatttggtcgttc

SEQ ID NO: 12415 - DNA, 1921 bp, Homo sapiens
gcttctgtctggcggcggcagcatggcggcgggggcggctgaggcagctgtagcggccgtggaggaggtcggctcagccgggcagtttgaggagctgctgcgcctcaaagccaagtccctccttgtggtccatttctgggcaccatgggctccacagtgtgcacagatgaacgaagttatggcagagttagctaaagaactccctcaagtttcatttgtgaagttggaagctgaaggtgttcctgaagtatctgaaaaatatgaaattagctctgttcccacttttctgtttttcaagaattctcagaaaatcgaccgattagatggtgcacatgccccagagttgaccaaaaaagttcagcgacatgcatctagtggctccttcctacccagcgctaatgaacatcttaaagaagatctcaaccttcgcttgaagaaattgactcatgctgccccctgcatgctgtttatgaaaggaactcctcaagaaccacgctgtggtttcagcaagcagatggtggaaattcttcacaaacataatattcagtttagcagttttgatatcttctcagatgaagaggttcgacagggactcaaagcctattccagttggcctacctatcctcagctctatgtttctggagagctcataggaggacttgatataattaaggagctagaagcatctgaagaactagatacaatttgtcccaaagctcccaaattagaggaaaggctcaaagtgctgacaaataaagcttctgtgatgctctttatgaaaggaaacaaacaggaagcaaaatgtggattcagcaaacaaattctggaaatactaaatagtactggtgttgaatatgaaacattcgatatattggaggatgaagaagttcggcaaggattaaaagcttactcaaattggccaacataccctcagctgtatgtgaaaggggagctggtgggaggattggatattgtgaaggaactgaaagaaaatggtgaattgctgcctatactgagaggagaaaattaataaatcttaaacttggtgcccaactattacggggtctggctctgtcacccaggctggagtgcagtggcacgattatggctcattgcagcctcgacttctcggggccaagcgatcctcctgcctcagccttctgagtagctgggaccacaggcgtgcaccaccatgcccacctaattttttatttcttgtagagatgaggtctcctgcctcagcctcccaaagtgctggaatttacaggagtgtcggctgtgccccttgtgatgggtgaggaaaggtatccacctttctgaatcagacacaagctgcagtagcttcctgatgcctcattcaccaggatgggtaactttaaagacaagttttataactggcatcccatctggtttcagagtcttgggggcttttttcatacagctttgtctgatatttagagacattcagattcagaagccatgagttcagttagctcatgggccgggcacgtgcactgactcactggctgcagcagaacacgttgagggagtcttggtgcacttaggtcactgtaaggttctagggctgggagctgggatttgaaccaggatctgtcagcgcagccccagtgctgtgcttgaagcctcgtgccacactggctttgaggtagcacgctgcaagttagtgagtggagttgcccaagtctggggcttctgaaatgacctggtatttttatgttcctgttagaaatggtgtggctttcacaaattaagtgccaggctgggcacaatggctcgtgcttgtaatcccagcactttgggaggcggaggcaggcgggttgcttgagctccggagcttgagaccagcctgagcaacatggcgaaacctcatatctacaaaaaataaaaaattaactggtca

SEQ ID NO: 12416 - DNA, 1564 bp, Homo sapiens
cgcattgccatggcaattcaaccgccgctgacaccggaaccggaaacttcatcaggaggtgaccccttcccggcgttccgcggaacgggcgagtcccgcgcctctcccagttgtctcggcgtagtccagctggcctcattggctcacaggaggaaagtcgtcttccctcttgttttgcctctcgttgccctgcaagcgtgaccctgatggacatccagtctctccaattaactaacaaagcggttgccgacgaccaatagtaaggcagtaggatgaggctccggcataaggcccacctcctacctgccgggcgggacgagcaacatgattggtggaatcgagtaattactgatcagtattgtccaatcacggagggcagtttagagccggcccaatgagggcctccagggggcgggtcggactgccgcgggccggggagcgctctgggtggccagctgtgggcccgggccgtcgtgggctccggcttgcgtgcggagatgagcgggtccctcggccgagctgcggcggctctgctccgctgggggcgcggcgcgggcggcggtggcctttggggtccgggcgtgcgggcggcgggctcgggcgcgggcggcggcggctcggcggagcagttggacgcgctggtgaagaaggacaaggtggtggtcttcctcaaggggacgccggagcagccccagtgcggcttcagcaacgccgtggtgcagatcctgcggctgcacggcgtccgcgattacgcggcctacaacgtgctggacgacccggagctccgacaaggcattaaagactattccaactggcccaccatcccgcaagtgtacctcaatggcgagtttgtagggggctgtgacattcttctgcagatgcaccagaatggggacttggtggaagaactgaaaaagctggggatccactccgcccttttagatgaaaagaaagaccaagactccaagtgagggcggccaagtcctcgctgagcagagagggagccgttcatgtcagagactcactgccagaaaagccttacccattttggttttcactattgagaccgcaactgcttgcactgatcattttggttcgtgagcagttggtgattttagttggtctggtgttcgggctaagaatattttattgtggacttaattacaaccactgcactgtaatgattcaatgctgtattatgatattgctgtaaacaaaattcattcttatattgtcacttattctttgcctgattcagaagttaaataggagctttggaatcattattcatgacccctctgcaaatgtgtcagtctccaaagagagtatctccccccaaattttgtgtagcttcttttgttatggaaaatggtgaacaaaaaaagaaactgtgataactggggcgttgttttttaaaataaactccagcacagggatgctgtgcatgcctgagttgattccgaagtgcatatgtctgtaaggatttggagtgcctgcagtgttttatgtgtgggaagtaagggtgagtctcatattcttctattaaatttgccacaagaattgc

SEQ ID NO: 12417 - DNA, 991 bp, Homo sapiens
atgcttaaaagggagatgaagccagaaagtgacaggccacggaaagtccggtttcggatcgcgtcctctcacagtgggcgagttctgaaggaagtgtatgaagatgggcaaccgtcaggctctctggattctgaatgtgccagtatctgtgggatagatggactaggtgattccgatggacagcagaatggccacatagagtcagaaggtgatgagaatgagaatgaccaggatagcttgctggtgttagcaagggctgccagtgagaagggttttggtacaagaagagtcaacattttaagcaaaaatggcacagtcagaggcgtcaaatacaaagtgagtgctggccaggctctatttaacaatttgaccaaagtattacagcaaccatcaactgatctagaatttgaccgtgtagtgatttataccacctgccttcgtgtggtccggacaacctttgaaagatgtgaactggttagaaagattttccaaaaccatcgcgtaaaatttgaagagaaaaacatagccctgaatggtgaatatggaaaagagttagacgaacgatgccgacgagtttctgaagctccttccctccctgttgtgttcattgatggccattaccttgggggtgctgagaaaattttgtcaatgaatgaatcaggagaactgcaagacatcctaaccaaaattgagagagtacagcatccacatgagtgtccctcttgtggaggctttggctttcttccatgctccgtgtgccatgggagcaagatgtccatgtttcgaaactgcttcacagactctttcaaagccctgaagtgtacggcttgcaatgaaaatggtcttcagcgttgtaagaactgtgctggttaattggagcttctacccaggaaaaacctcattttattaatcaaaggcaatactttggtttatatatatatttttaaatggttatgtttatggattaatcaataaactttgtttattataa

SEQ ID NO: 12418 - DNA, 1821 bp, Homo sapiens
agttgcactgtagcctcggcagtgaaccgggaggtactaccaggtcgccgtcgttgctccgctcgctctgagagagcatggccctgagaggcgtctccgtgcggctgctgagccgcggacccggcctgcacgtccttcgcacgtgggtctcgtcggcggcgcagaccgagaaaggcgggagaacacagagccaactggctaagtcctcgcgtcccgagtttgactggcaggacccgctggtgctggaggagcagctgaccacagatgagatcctcatcagggacaccttccgcacctactgccaggagagactcatgcctcgcatcctgttggccaatcgcaacgaagtttttcatcgggagatcatttcggagatgggggagttgggtgtgctgggccccaccatcaaaggatatggctgtgctggggtttcgtctgtggcctatgggctcctggcccgagagctggagcgggtggacagtggctacaggtcggcgatgagtgtccagtcctccctcgtcatgcaccctatctatgcctatggcagcgaggaacagcggcagaagtacctgccccagctggccaagggggagctcctgggctgcttcgggctcacagagcccaacagcggaagtgaccccagcagcatggagaccagagcccactacaactcatccaacaagagctacaccctcaatgggaccaagacctggatcacgaactcgcctatggccgatctgtttgtagtgtgggctcggtgtgaagatggctgcattcggggcttcctgctggagaaggggatgcggggtctctcggcccccaggatccagggcaagttctcgctgcgggcctcagccacaggcatgatcatcatggacggtgtggaggtgccagaggagaatgtgctccctggtgcatccagcctggggggtcccttcggctgcctgaacaacgcccggtacggcatcgcgtggggcgtgcttggagcttcggagttctgcttgcacacagcccggcagtacgccctcgacaggatgcagtttggtgtcccactggccaggaaccagctgattcagaagaagctggcagacatgctcactgagattaccctgggccttcacgcctgcctgcagctcggccgcttgaaggaccaggacaaggctgcccccgagatggtttctctgctgaagaggaataactgtgggaaagccctggacatcgcccgccaggcccgagacatgctgggggggaatgggatttctgacgagtatcacgtgatccggcacgccatgaacctggaggccgtgaacacctacgaaggtacacatgacattcacgccctgatccttgggagagctatcacgggaatccaggcgttcacggccagcaagtgagccgctccatcaggggcccgaaactctcaagcccctttctggagagatgcctggctggaccgtaggagcgctgtgctctgagcttagaaagggaggtggcggatggagtgggaagtgagagacactgatttttaaatatcaaaatttcccttctgaagtcgttcagatgtgttccttaaaaagaagatggaattctctgtagagcgtctcaatccacttttaaccatggatgagagcagactccatttaccctgaaatagcagcttctcttgagaggagagtgacatggaagcaactccgtctgctgcagctgaccccctcacactgagttcacagtgcgccctccctccctcccatctgggggtagtgccttatgctgggtgttggagcagagtgagggagaggaaaataaagacctgcacatctg

SEQ ID NO: 12419 - DNA, 1109 bp, Homo sapiens
agttgcactgtagcctcggcagtgaaccgggaggtactaccaggtcgccgtcgttgctccgctcgctctgagagagcatggccctgagaggcgtctccgtgcggctgctgagccgcggacccggcctgcacgtccttcgcacgtgggtctcgtcggcggcgcagaccgcctcgcgtcccgagtttgactggcaggacccgctggtgctggaggagcagctgaccacagatgagatcctcatcagggacaccttccgcacctactgccaggagagactcatgcctcgcatcctgttggccaatcgcaacgaaggatatggctgtgctggggtttcgtctgtggcctatgggctcctggcccgagagctggagcgggtggacagtggctacaggtcggcgatgagtgtccagtcctccctcgtcatgcaccctatctatgcctatggcagcgaggaacagcggcagaagtacctgccccagctggccaagggggagctcctgggctgcttcgggctcacagagcccaacagcggaagtgaccccagcagcatggagaccagagcccactacaactcatccaacaagagctacaccctcaatgggaccaagacctggatcacgaactcgcctatggccgatctgtttgtagtgtgggctcggtgtgaagatggctgcattcggggcttcctgctggagaaggggatgcggggtctctcggcccccaggatccagggcaagttctcgctgcgggcctcagccacaggcatgatcatcatggacggtgtggaggtgccagaggagaatgtgctccctggtgcatccagcctggggggtcccttcggctgcctgaacaacgcccggtacggcatcgcgtggggcgtgcttggagcttcggagttctgcttgcacacagcccggcagtacgccctcgacaggatgcagtttggtgtcccactggccaggaaccagctgattcagaagaagctggcagacatgctcactgagattaccctgggccttcacgcctgcctgcagctcggccgcttgaaggaccaggacaagtaggggctgtgtggtgggggcggggggatggcagcggtggctggagga

SEQ ID NO: 12420 - DNA, 1871 bp, Homo sapiens
actgtagcctcggcagtgaaccgggaggtactaccaggtcgccgtcgttgctccgctcgctctgagagagcatggccctgagaggcgtctccgtgcggctgctgagccgcggacccggcctgcacgtccttcgcacgtgggtctcgtcggcggcgcagaccgagaaaggcgggagaacacagagccaactggctaagtcctcgcgtcccgagtttgactggcaggacccgctggtgctggaggagcagctgaccacagatgagatcctcatcagggacaccttccgcacctactgccaggagagactcatgcctcgcatcctgttggccaatcgcaacgaagagtctggctctgttgcccaggctggagtgcagtggcacgatcttggctcactgcaaattctgcctcccaggctcaagcgattctcctgcctccacccctctagtagctgggattacaggatatggctgtgctggggtttcgtctgtggcctatgggctcctggcccgagagctggagcgggtggacagtggctacaggtcggcgatgagtgtccagtcctccctcgtcatgcaccctatctatgcctatggcagcgaggaacagcggcagaagtacctgccccagctggccaagggggagctcctgggctgcttcgggctcacagagcccaacagcggaagtgaccccagcagcatggagaccagagcccactacaactcatccaacaagagctacaccctcaatgggaccaagacctggatcacgaactcgcctatggccgatctgtttgtagtgtgggctcggtgtgaagatggctgcattcggggcttcctgctggagaaggggatgcggggtctctcggcccccaggatccagggcaagttctcgctgcgggcctcagccacaggcatgatcatcatggacggtgtggaggtgccagaggagaatgtgctccctggtgcatccagcctggggggtcccttcggctgcctgaacaacgcccggtacggcatcgcgtggggcgtgcttggagcttcggagttctgcttgcacacagcccggcagtacgccctcgacaggatgcagtttggtgtcccactggccaggaaccagctgattcagaagaagctggcagacatgctcactgagattaccctgggccttcacgcctgcctgcagctcggccgcttgaaggaccaggacaaggctgcccccgagatggtttctctgctgaagaggaataactgtgggaaagccctggacatcgcccgccaggcccgagacatgctgggggggaatgggatttctgacgagtatcacgtgatccggcacgccatgaacctggaggccgtgaacacctacgaaggtacacatgacattcacgccctgatccttgggagagctatcacgggaatccaggcgttcacggccagcaagtgagccgctccatcaggggcccgaaactctcaagcccctttctggagagatgcctggctggaccgtaggagcgctgtgctctgagcttagaaagggaggtggcggatggagtgggaagtgagagacactgatttttaaatatcaaaatttcccttctgaagtcgttcagatgtgttccttaaaaagaagatggaattctctgtagagcgtctcaatccacttttaaccatggatgagagcagactccatttaccctgaaatagcagcttctcttgagaggagagtgacatggaagcaactccgtctgctgcagctgaccccctcacactgagttcacagtgcgccctccctccctcccatctgggggtagtgccttatgctgggtgttggagcagagtgagggagaggaaaataaagacctgcacatctga

SEQ ID NO: 12421 - DNA, 1589 bp, Homo sapiens
agttgcactgtagcctcggcagtgaaccgggaggtactaccaggtcgccgtcgttgctccgctcgctctgagagagcatggccctgagaggcgtctccgtgcggctgctgagccgcggacccggcctgcacgtccttcgcacgtgggtctcgtcggcggcgcagaccgagaaaggcgggagaacacagagccaactggctaagtcctcgcgtcccgagtttgactggcaggacccgctggtgctggaggagcagctgaccacagatgagatcctcatcagggacaccttccgcacctactgccaggagagactcatgcctcgcatcctgttggccaatcgcaacgaagtttttcatcgggagatcatttcggagatgggggagttgggtgtgctgggccccaccatcaaaggatatggctgtgctggggtttcgtctgtggcctatgggctcctggcccgagagctggagcgggtggacagtggctacaggtcggcgatgagtgtccagtcctccctcgtcatgcaccctatctatgcctatggcagcgaggaacagcggcagaagtacctgccccagctggccaagggggagctcctgggctgcttcgggctcacagagcccaacagcggaagtgaccccagcagcatggagaccagagcccactacaactcatccaacaagagctacaccctcaatgggaccaagacctggatcacgaactcgcctatggccgatctgtttgtagtgtgggctcggtgtgaagatggctgcattcggggcttcctgctggagaaggggatgcggggtctctcggcccccaggatccagggcaagttctcgctgcgggcctcagccacaggcatgatcatcatggacggtgtggaggtgccagaggagaatgtgctccctggtgcatccagcctggggggtcccttcggctgcctgaacaacgcccggtacggcatcgcgtggggcgtgcttggagcttcggagttctgcttgcacacagcccggcagtacgccctcgacaggatgcagtttggtgtcccactggccaggaaccagctgattcagaagaagctggcagacatgctcactgagattaccctgggccttcacgcctgcctgcagctcggccgcttgaaggaccaggacaaggctgcccccgagatggtttctctgctgaagaggaataactgtgggaaagccctggacatcgcccgccaggcccgagacatgctgggggggaatgggatttctgacgagtatcacgtgatccggcacgccatgaacctggaggccgtgaacacctacgaagtcgttcagatgtgttccttaaaaagaagatggaattctctgtagagcgtctcaatccacttttaaccatggatgagagcagactccatttaccctgaaatagcagcttctcttgagaggagagtgacatggaagcaactccgtctgctgcagctgaccccctcacactgagttcacagtgcgccctccctccctcccatctgggggtagtgccttatgctgggtgttggagcagagtgagggagaggaaaataaagacctgcacatctg

SEQ ID NO: 12422 - DNA, 1106 bp, Homo sapiens
gcgccatgtgtgctgctcggctagcggcggcggcggcggcggcccagtcggtgtatgccttctcggcgcgcccgctggccggcggggagcctgtgagcctgggctccctgcggggcaaggtactacttatcgagaatgtggcgtccctctgaggcaccacggtccgggactacacccagatgaacgagctgcagcggcgcctcggaccccggggcctggtggtgctcggcttcccgtgcaaccagtttgggcatcaggtgcgccgggcggagcggggcggggcgggggcggacgtgcagtagtggctgggggcgccggcggtgtgctggtgggtgccgtcggctccatgcgcggagagtctggctactctctcgtttcctttctgttgctcgtagctgctgaaattcctctccgcccttgggattgcgcatggagggcaaaatcccggtgactcatagaaaatctcccttgtttgtggttagaacgtttctctcctcctcttgaccccgggttctagctgcccttctctcctgtaggagaacgccaagaacgaagagattctgaattccctcaagtacgtccggcctggtggtgggttcgagcccaacttcatgctcttcgagaagtgcgaggtgaacggtgcgggggcgcaccctctcttcgccttcctgcgggaggccctgccagctcccagcgacgacgccaccgcgcttatgaccgaccccaagctcatcacctggtctccggtgtgtcgcaacgatgttgcctggaactttgagaagttcctggtgggccctgacggtgtgcccctacgcaggtacagccgccgcttccagaccattgacatcgagcctgacatcgaagccctgctgtctcaagggcccagctgtgcctagggcgcccctcctaccccggctgcttggcagttgcagtgctgctgtctcgggggggttttcatctatgagggtgtttcctctaaacctacgagggaggaacacctgatcttacagaaaataccacctcgagatgggtgctggtcctgttgatcccagtctctgccagaccaaggcgagtttccccactaataaagtgccgggtgtcagcag

SEQ ID NO: 12423 - DNA, 1146 bp, Homo sapiens
gagccctcgagggccccagcccttggaagggtaacctggaccgctgccgcctggttgcctgggccagaccagacatgcctgctgctccttccggcttaggaggagcacgcgtcccgctcgggcgcactctccagccttttcctggctgaggaggggccgagccctccgggtagggcgggggccggatgaggcgggaccctcaggcccggaaaactgcctgtgccacgtgacccgccgccggccagttaaaaggaggcgcctgctggcctccccttacagtgcttgttcggggcgctccgctggcttcttggacaattgcgccatgtgtgctgctcggctagcggcggcggcggcggcggcccagtcggtgtatgccttctcggcgcgcccgctggccggcggggagcctgtgagcctgggctccctgcggggcaaggtactacttatcgagaatgtggcgtccctctgaggcaccacggtccgggactacacccagatgaacgagctgcagcggcgcctcggaccccggggcctggtggtgctcggcttcccgtgcaaccagtttgggcatcaggagaacgccaagaacgaagagattctgaattccctcaagtacgtccggcctggtggtgggttcgagcccaacttcatgctcttcgagaagtgcgaggtgaacggtgcgggggcgcaccctctcttcgccttcctgcgggaggccctgccagctcccagcgacgacgccaccgcgcttatgaccgaccccaagctcatcacctggtctccggtgtgtcgcaacgatgttgcctggaactttgagaagttcctggtgggccctgacggtgtgcccctacgcaggtacagccgccgcttccagaccattgacatcgagcctgacatcgaagccctgctgtctcaagggcccagctgtgcctagggcgcccctcctaccccggctgcttggcagttgcagtgctgctgtctcgggggggttttcatctatgagggtgtttcctctaaacctacgagggaggaacacctgatcttacagaaaataccacctcgagatgggtgctggtcctgttgatcccagtctctgccagaccaaggcgagtttccccactaataaagtgccgggtgtcagcagaa

SEQ ID NO: 12424 - DNA, 990 bp, Homo sapiens
cttcctggctcctccttcctccccacccctctaataggctcataagtgggctcaggcctctctgcggggctcactctgcgcttcaccatggctttcattgccaagtccttctatgacctcagtgccatcagcctggatggggagaaggtagatttcaatacgttccggggcagggccgtgctgattgagaatgtggcttcgctctgaggcacaaccacccgggacttcacccagctcaacgagctgcaatgccgctttcccaggcgcctggtggtccttggcttcccttgcaaccaatttggacatcaggagaactgtcagaatgaggagatcctgaacagtctcaagtatgtccgtcctgggggtggataccagcccaccttcacccttgtccaaaaatgtgaggtgaatgggcagaacgagcatcctgtcttcgcctacctgaaggacaagctcccctacccttatgatgacccattttccctcatgaccgatcccaagctcatcatttggagccctgtgcgccgctcagatgtggcctggaactttgagaagttcctcatagggccggagggagagcccttccgacgctacagccgcaccttcccaaccatcaacattgagcctgacatcaagcgcctccttaaagttgccatatagatgtgaactgctcaacacacagatctcctactccatccagtcctgaggagccttaggatgcagcatgccttcaggagacactgctggacctcagcattcccttgatatcagtccccttcactgcagagccttgcctttcccctctgcctgtttccttttcctctcccaaccctctggttggtgattcaacttgggctccaagacttgggtaagctctgggccttcacagaatgatggcaccttcctaaaccctcatgggtggtgtctgagaggcgtgaagggcctggagccactctgctagaagagaccaataaagggcaggtgtggaaa

SEQ ID NO: 12425 - DNA, 916 bp, Homo sapiens
gagcgctctggagggcgtggccgtgggaaaggaggcgcggaaagccgacgcgcgtccattggtcggctggacgaggggaggagccgctggctcccagccccgccgcgatgagcctcggccgcctttgccgcctactgaagccggcgctgctctgtggggctctggccgcgcctggcctggccgggaccatgtgcgcgtcccgggacgactggcgctgtgcgcgctccatgcacgagttttccgccaaggacatcgacgggcacatggttaacctggacaagtaccggggcttcgtgtgcatcgtcaccaacgtggcctcccagtgaggcaagaccgaagtaaactacactcagctcgtcgacctgcacgcccgatacgctgagtgtggtttgcggatcctggccttcccgtgtaaccagttcgggaagcaggagccagggagtaacgaagagatcaaagagttcgccgcgggctacaacgtcaaattcgatatgttcagcaagatctgcgtgaacggggacgacgcccacccgctgtggaagtggatgaagatccaacccaagggcaagggcatcctgggaaatgccatcaagtggaacttcaccaagttcctcatcgacaagaacggctgcgtggtgaagcgctacggacccatggaggagcccctggtgatagagaaggacctgccccactatttctagctccacaagtgtgtggccccgcccgagcccctgcccacgcccttggagccttccaccggcactcatgacggcctgcctgcaaacctgctggtggggcagacccgaaaatccagcgtgcaccccgccggaggaaggtcccatggcctgctgggcttggctcggcgcccccacccctggctaccttgtgggaataaacagacaaattagcctgctgg

SEQ ID NO: 12426 - DNA, 1540 bp, Homo sapiens
ttgggctaagtccctgccaagataccaaaagactgcagaggtgggcaaagacctcaggcccccagactagcaatctacaaacactagtcatgactacacagttaagggtcgtccatctgcttccccttctcctagcctgctttgtgcaaacaagtcccaagcaggagaagatgaagatggattgccacaaagacgagaaaggcaccatctatgactatgaggccatcgcacttaataagaatgaatatgtttccttcaagcagtatgtgggcaagcacatcctcttcgtcaacgtggccacctactgtggtctgacagcgcaatatcctgaactaaatgcactccaggaggagctgaagccctatggtctagttgtgttgggctttccctgcaaccaatttggaaagcaagaaccaggagataacaaagagattcttcctgggctcaagtatgtccgtccagggggaggatttgtacctagtttccagctttttgagaaaggggatgtgaatggtgaaaaagaacagaaagtcttcagtttcttgaagcactcctgtcctcatccctctgagattttgggcacattcaaatctatatcctgggaccctgtaaaggtccatgacatccgttggaactttgaaaagttcctggtggggcctgatggaatccctgtcatgcgctggtcccaccgggctacggtcagctcagtcaagacagacatcctggcgtacttgaagcaattcaaaaccaaataggaaggtggagttaagggcaggagcaaccctacttctcacctaatgacttgctctccccacccctccaaaaaaaaggaatacccatcttctcaccacactctcttcctgcatgggctccacctgagtaaatcaccgccacatactgccagaattcccactctccacaaactagatttatatttggaaggctactgctcttttgcctctcaagagtatgtgggtgaagactgaaacaaatggaaacctaaaatccccagacctctgttacaggttgaatcattcatatccaccagagggaaatcatccttccacgacaatggttcagtcggccatcacatcctgaagaacattcctagacattctgactcttccatctctctctaccctggaggtgtagaaatagcaatggggtcacagtcacacaatttaggttccacttcataacattttttgtctcctaggacaaacgtgtatcatcagtttccaactgttttggctcagttttcatccatgacacctccccctaccagccattctcctgtgggagcaagaacattgcttcaaaagaagagagggcatctccatgcttgtgggacccaaaacctatctctggccctacaaaagttttcctaattgtctgatctttagtgcattcaggttatggcacctggagaggaatgccctttatcttttgaaggatgggatttcccatctcaaccctggattcctcaccttcagaacgagccctgccactgtctccaataaaatgttttctgcagcatcga

SEQ ID NO: 12427 - DNA, 428 bp, Homo sapiens
tcatgactacacagttaagggtcgtccatctgcttccccttctcctagcctgctttgtgcaaacaagtcccaagcaggagaagatgaagatggattgccacaaagacgagaaaggcaccatctatgactatgaggccatcgcacttaataagaatgaatatgtttccttcaagcagtatgtgggcaagcacatcctcttcgtcaacgtggccacctactgtggtctgacagcgcaatatcctggtatgtccgtccagggggaggatttgtacctagtttccagctttttgagaaaggggatgtgaatggtgaaaaagaacagaaagtcttcagtttcttgaagcactcctgtcctcatccctctgagattttgggcacattcaaatctatatcctgggaccctgtaaaggtccatgacatccgttgga

SEQ ID NO: 12428 - DNA, 3114 bp, Homo sapiens
gtgaggctgcgcttgcccggggcccgcgcccccctaccccggggaccgcccccgggccgcccgccccacttggcgcgccacttccgcgtgcatggccctgctgccccgagccctgagcgccggcgcgggaccgagctggcggcgggcggcgcgcgccttccgaggcttcctgctgcttctgcccgagcccgcggccctcacgcgcgccctctcccgtgccatggcctgcaggcaggagccgcagccgcagggcccgccgcccgctgctggcgccgtggcctcctatgactacctggtgatcgggggcggctcgggcgggctggccagcgcgcgcagggcggccgagctgggtgccagggccgccgtggtggagagccacaagctgggtggcacttgcgtgaatgttggatgtgtacccaaaaaggtaatgtggaacacagctgtccactctgaattcatgcatgatcatgctgattatggctttccaagttgtgagggtaaattcaattggcgtgttattaaggaaaagcgggatgcctatgtgagccgcctgaatgccatctatcaaaacaatctcaccaagtcccatatagaaatcatccgtggccatgcagccttcacgagtgatcccaagcccacaatagaggtcagtgggaaaaagtacaccgccccacacatcctgatcgccacaggtggtatgccctccacccctcatgagagccagatccccggtgccagcttaggaataaccagcgatggattttttcagctggaagaattgcccggccgcagcgtcattgttggtgcaggttacattgctgtggagatggcagggatcctgtcagccctgggttctaagacatcactgatgatacggcatgataaggtacttagaagttttgattcaatgatcagcaccaactgcacggaggagctggagaacgctggcgtggaggtgctgaagttctcccaggtcaaggaggttaaaaagactttgtcgggcttggaagtcagcatggttactgcagttcccggtaggctaccagtcatgaccatgattccagatgttgactgcctgctctgggccattgggcgggtcccgaataccaaggacctgagtttaaacaaactggggattcaaaccgatgacaagggtcatatcatcgtagacgaattccagaataccaacgtcaaaggcatctatgcagttggggatgtatgtggaaaagctcttcttactccagttgcaatagctgctggccgaaaacttgcccatcgactttttgaatataaggaagattccaaattagattataacaacatcccaactgtggtcttcagccacccccctattgggacagtgggactcacggaagatgaagccattcataaatatggaatagaaaatgtgaagacctattcaacgagctttaccccgatgtatcacgcagttaccaaaaggaaaacaaaatgtgtgatgaaaatggtctgtgctaacaaggaagaaaaggtggttgggatccatatgcagggacttgggtgtgatgaaatgctgcagggttttgctgttgcagtgaagatgggagcaacgaaggcagactttgacaacacagtcgccattcaccctacctcttcagaagagctggtcacacttcgttgagaaccaggagacacgtgtggcgggcagtgggacccatagatcttctgaaatgaaacaaataatcacattgacttactgtttgagttttatgtatttctttattttaatcaggatcttctgatagtggaaatttttagtacataatagaacttatttatggagttagaaatttgtagtgttatccaggattgattttcatttgatcacatctcacagtaattaatattttcaagttttttttttattaacagctctgtgctagttttttttttctgttttagcctcatcccaaatataaagctttgtgaagtacaattaacttaatgtacttgaatgaatagaacttgctactttttttttttttttttttgagacagagttttgctctcattgcccaggctggagtgcggtggtgctatttcagctcaccacaacctctgcctcctgggttcaagtgattctcctgccttagcctcccgaatagctggaattacaggcacgcaccaccatgcctgactaattttgtatttttagtagacatggggtttctccatgttggtcaggctggtctcaaactcccaccttcaggtgatccgcccacctcggcctcctgaggtgctgagattacaggcgtgagccactgtgccagcttgctaattttcacagaagttgatggcaattcttcacatgtaaacagtgccagtgcacagaacctttatatattttttgaagccagtactgtgctctgcatataacaaagctgcttcaaggatgagacctttttctaaaagcatgtaatgtgagaagccggcctgccttattttcttttttcttttttaatgattaaaaatagtttgtggcaaggcacggtggctcaggcctgtaattctagcactttgggaggccgaggcaggaggattacttgagcctacaagtttgaggccagcatgcacagcatagcaagactgcatctctacagagagtaaaaaaaattacccgagtgtggtgatgtgcatctgtaatctcagctacttgggaggctgaggtgagaggatcacttgagcttgggtgaggtgaggctgcagtgagtcctgatcatgctgctgcactcaatcttggacaacagagcaagaccctgtctcaaaaaaaaaaaaaaaaaatatatatatatatatatattatttttatgaggtgaagtgcatcaaacttgggaaagatttgaggaggctgggaacctcctggaaaaccactccttgaagaaagatatgagagacatttagaagtgattcctgctttcagaaggaggtggattcaaatacatcaaaagtcccttcctctgctaagtgtttatagttcaatgaataatttcaatatttgtatgtgttcttgtcattttatttttttctgaaaaacttccaaaaatttgaaaataaaattacagccttttcttctta

SEQ ID NO: 12429 - DNA, 2893 bp, Homo sapiens
atggcctgcaggcaggagccgcagccgcagggcccgccgcccgctgctggcgccgtggcctcctatgactacctggtgatcgggggcggctcgggcgggctggccagcgcgcgcagggcggccgagctgggtgccagggccgccgtggtggagagccacaagctgggtggcacttgcgtgaatgttggatgtgtacccaaaaaggtaatgtggaacacagctgtccactctgaattcatgcatgatcatgctgattatggctttccaagttgtgagggtaaattcaattggcgtgttattaaggaaaagcgggatgcctatgtgagccgcctgaatgccatctatcaaaacaatctcaccaagtcccatatagaaatcatccgtggccatgcagccttcacgagtgatcccaagcccacaatagaggtcagtgggaaaaagtacaccgccccacacatcctgatcgccacaggtggtatgccctccacccctcatgagagccagatccccggtgccagcttaggaataaccagcgatggattttttcagctggaagaattgcccggccgcagcgtcattgttggtgcaggttacattgctgtggagatggcagggatcctgtcagccctgggttctaagacatcactgatgatacggcatgataaggtacttagaagttttgattcaatgatcagcaccaactgcacggaggagctggagaacgctggcgtggaggtgctgaagttctcccaggtcaaggaggttaaaaagactttgtcgggcttggaagtcagcatggttactgcagttcccggtaggctaccagtcatgaccatgattccagatgttgactgcctgctctgggccattgggcgggtcccgaataccaaggacctgagtttaaacaaactggggattcaaaccgatgacaagggtcatatcatcgtagacgaattccagaataccaacgtcaaaggcatctatgcagttggggatgtatgtggaaaagctcttcttactccagttgcaatagctgctggccgaaaacttgcccatcgactttttgaatataaggaagattccaaattagattataacaacatcccaactgtggtcttcagccacccccctattgggacagtgggactcacggaagatgaagccattcataaatatggaatagaaaatgtgaagacctattcaacgagctttaccccgatgtatcacgcagttaccaaaaggaaaacaaaatgtgtgatgaaaatggtctgtgctaacaaggaagaaaaggtggttgggatccatatgcagggacttgggtgtgatgaaatgctgcagggttttgctgttgcagtgaagatgggagcaacgaaggcagactttgacaacacagtcgccattcaccctacctcttcagaagagctggtcacacttcgttgagaaccaggagacacgtgtggcgggcagtgggacccatagatcttctgaaatgaaacaaataatcacattgacttactgtttgagttttatgtatttctttattttaatcaggatcttctgatagtggaaatttttagtacataatagaacttatttatggagttagaaatttgtagtgttatccaggattgattttcatttgatcacatctcacagtaattaatattttcaagttttttttttattaacagctctgtgctagttttttttttctgttttagcctcatcccaaatataaagctttgtgaagtacaattaacttaatgtacttgaatgaatagaacttgctactttttttttttttttttttgagacagagttttgctctcattgcccaggctggagtgcggtggtgctatttcagctcaccacaacctctgcctcctgggttcaagtgattctcctgccttagcctcccgaatagctggaattacaggcacgcaccaccatgcctgactaattttgtatttttagtagacatggggtttctccatgttggtcaggctggtctcaaactcccaccttcaggtgatccgcccacctcggcctcctgaggtgctgagattacaggcgtgagccactgtgccagcttgctaattttcacagaagttgatggcaattcttcacatgtaaacagtgccagtgcacagaacctttatatattttttgaagccagtactgtgctctgcatataacaaagctgcttcaaggatgagacctttttctaaaagcatgtaatgtgagaagccggcctgccttattttcttttttcttttttaatgattaaaaatagtttgtggcaaggcacggtggctcaggcctgtaattctagcactttgggaggccgaggcaggaggattacttgagcctacaagtttgaggccagcatgcacagcatagcaagactgcatctctacagagagtaaaaaaaattacccgagtgtggtgatgtgcatctgtaatctcagctacttgggaggctgaggtgagaggatcacttgagcttgggtgaggtgaggctgcagtgagtcctgatcatgctgctgcactcaatcttggacaacagagcaagaccctgtctcaaaaaaaaaaaaaaaaaatatatatatatatatatattatttttatgaggtgaagtgcatcaaacttgggaaagatttgaggaggctgggaacctcctggaaaaccactccttgaagaaagatatgagagacatttagaagtgattcctgctttcagaaggaggtggattcaaatacatcaaaagtcccttcctctgctaagtgtttatagttcaatgaataatttcaatatttgtatgtgttcttgtcattttatttttttctgaaaaacttccaaaaatttgaaaataaaattacagccttttcttctt

SEQ ID NO: 12430 - DNA, 1323 bp, Homo sapiens
atggccctgctgccccgagccctgagcgccggcgcgggaccgagctggcggcgggcggcgcgcgccttccgaggcttcctgctgcttctgcccgagcccgcggccctcacgcgcgccctctcccgtgccatggcctgcaggcaggagccgcagccgcagggcccgccgcccgctgctggcgccgtggcctcctatgactacctggtgatcgggggcggctcgggcgggctggccagcgcgcgcagggcggccgagctgggtgccagggccgccgtggtggagagccacaagctgggtggcacttgcgtgaatgttggatgtgtacccaaaaaggtaatgtggaacacagctgtccactctgaattcatgcatgatcatgctgattatggctttccaagttgtgagggtaaattcaattggcgtgttattaaggaaaagcgggatgcctatgtgagccgcctgaatgccatctatcaaaacaatctcaccaagtcccatatagaaatcatccgtggccatgcagccttcacgagtgatcccaagcccacaatagaggtcagtgggaaaaagtacaccgccccacacatcctgatcgccacaggtggtatgccctccacccctcatgagagccagatccccggtgccagcttaggaataaccagcgatggattttttcagctggaagaattgcccggccgcagcgtcattgttggtgcaggttacattgctgtggagatggcagggatcctgtcagccctgggttctaagacatcactgatgatacggcatgataaggggattcaaaccgatgacaagggtcatatcatcgtagacgaattccagaataccaacgtcaaaggcatctatgcagttggggatgtatgtggaaaagctcttcttactccagttgcaatagctgctggccgaaaacttgcccatcgactttttgaatataaggaagattccaaattagattataacaacatcccaactgtggtcttcagccacccccctattgggacagtgggactcacggaagatgaagccattcataaatatggaatagaaaatgtgaagacctattcaacgagctttaccccgatgtatcacgcagttaccaaaaggaaaacaaaatgtgtgatgaaaatggtctgtgctaacaaggaagaaaaggtggttgggatccatatgcagggacttgggtgtgatgaaatgctgcagggttttgctgttgcagtgaagatgggagcaacgaaggcagactttgacaacacagtcgccattcaccctacctcttcagaagagctggtcacacttcgttga

SEQ ID NO: 12431 - DNA, 1410 bp, Homo sapiens
atggccctgctgccccgagccctgagcgccggcgcgggaccgagctggcggcgggcggcgcgcgccttccgaggcttcctgctgcttctgcccgagcccgcggccctcacgcgcgccctctcccgtgccatggcctgcaggcaggagccgcagccgcagggcccgccgcccgctgctggcgccgtggcctcctatgactacctggtgatcgggggcggctcgggcgggctggccagcgcgcgcagggcggccgagctgggtgccagggccgccgtggtggagagccacaagctgggtggcacttgcgtgaatgttggatgtgtacccaaaaaggtaatgtggaacacagctgtccactctgaattcatgcatgatcatgctgattatggctttccaagttgtgagggtaaattcaattggcgtgttattaaggaaaagcgggatgcctatgtgagccgcctgaatgccatctatcaaaacaatctcaccaagtcccatatagaaatcatccgtggccatgcagccttcacgagtgatcccaagcccacaatagaggtcagtgggaaaaagtacaccgccccacacatcctgatcgccacaggtggtatgccctccacccctcatgagagccagatccccggtgccagcttaggaataaccagcgatggattttttcagctggaagaattgcccggccgcagcgtcattgttggtgcaggttacattgctgtggagatggcagggatcctgtcagccctgggttctaagacatcactgatgatacggcatgataaggtacttagaagttttgattcaatgatcagcaccaactgcacggaggagctggagaacgctggcgtggaggtgctgaagttctcccaggggattcaaaccgatgacaagggtcatatcatcgtagacgaattccagaataccaacgtcaaaggcatctatgcagttggggatgtatgtggaaaagctcttcttactccagttgcaatagctgctggccgaaaacttgcccatcgactttttgaatataaggaagattccaaattagattataacaacatcccaactgtggtcttcagccacccccctattgggacagtgggactcacggaagatgaagccattcataaatatggaatagaaaatgtgaagacctattcaacgagctttaccccgatgtatcacgcagttaccaaaaggaaaacaaaatgtgtgatgaaaatggtctgtgctaacaaggaagaaaaggtggttgggatccatatgcagggacttgggtgtgatgaaatgctgcagggttttgctgttgcagtgaagatgggagcaacgaaggcagactttgacaacacagtcgccattcaccctacctcttcagaagagctggtcacacttcgttga

SEQ ID NO: 12432 - DNA, 1482 bp, Homo sapiens
atggccctgctgccccgagccctgagcgccggcgcgggaccgagctggcggcgggcggcgcgcgccttccgaggcttcctgctgcttctgcccgagcccgcggccctcacgcgcgccctctcccgtgccatggcctgcaggcaggagccgcagccgcagggcccgccgcccgctgctggcgccgtggcctcctatgactacctggtgatcgggggcggctcgggcgggctggccagcgcgcgcagggcggccgagctgggtgccagggccgccgtggtggagagccacaagctgggtggcacttgcgtgaatgttggatgtgtacccaaaaaggtaatgtggaacacagctgtccactctgaattcatgcatgatcatgctgattatggctttccaagttgtgagggtaaattcaattggcgtgttattaaggaaaagcgggatgcctatgtgagccgcctgaatgccatctatcaaaacaatctcaccaagtcccatatagaaatcatccgtggccatgcagccttcacgagtgatcccaagcccacaatagaggtcagtgggaaaaagtacaccgccccacacatcctgatcgccacaggtggtatgccctccacccctcatgagagccagatccccggtgccagcttaggaataaccagcgatggattttttcagctggaagaattgcccggccgcagcgtcattgttggtgcaggttacattgctgtggagatggcagggatcctgtcagccctgggttctaagacatcactgatgatacggcatgataaggtcaaggaggttaaaaagactttgtcgggcttggaagtcagcatggttactgcagttcccggtaggctaccagtcatgaccatgattccagatgttgactgcctgctctgggccattgggcgggtcccgaataccaaggacctgagtttaaacaaactggggattcaaaccgatgacaagggtcatatcatcgtagacgaattccagaataccaacgtcaaaggcatctatgcagttggggatgtatgtggaaaagctcttcttactccagttgcaatagctgctggccgaaaacttgcccatcgactttttgaatataaggaagattccaaattagattataacaacatcccaactgtggtcttcagccacccccctattgggacagtgggactcacggaagatgaagccattcataaatatggaatagaaaatgtgaagacctattcaacgagctttaccccgatgtatcacgcagttaccaaaaggaaaacaaaatgtgtgatgaaaatggtctgtgctaacaaggaagaaaaggtggttgggatccatatgcagggacttgggtgtgatgaaatgctgcagggttttgctgttgcagtgaagatgggagcaacgaaggcagactttgacaacacagtcgccattcaccctacctcttcagaagagctggtcacacttcgttga

SEQ ID NO: 12433 - DNA, 1019 bp, Homo sapiens
gtggcttttccctaacttgactcttctttcagtgggagagaactattgagaggaacaaagagcttataaatacattaggacctggaattcagttgtcgagccaggacggtgacagcgtttaacaaagcttagagaaacctccaggagactgctatcatggcagagaagcccaagctccactacttcaatgcacggggcagaatggagtccacccggtggctcctggctgcagctggagtagagtttgaagagaaatttataaaatctgcagaagatttggacaagttaagaaatgatggatatttgatgttccagcaagtgccaatggttgagattgatgggatgaagctggtgcagaccagagccattctcaactacattgccagcaaatacaacctctatgggaaagacataaaggagagagccctgattgatatgtatatagaaggtatagcagatttgggtgaaatgatcctccttctgcccgtatgtccacctgaggaaaaagatgccaagcttgccttgatcaaagagaaaataaaaaatcgctacttccctgcctttgaaaaagtcttaaagagccatggacaagactaccttgttggcaacaagctgagccgggctgacattcatctggtggaacttctctactacgtcgaggagcttgactccagtcttatctccagcttccctctgctgaaggccctgaaaaccagaatcagcaacctgcccacagtgaagaagtttctacagcctggcagcccaaggaagcctcccatggatgagaaatctttagaagaagcaaggaagattttcaggttttaataacgcagtcatggaggccaagaacttgcaataccaatgttctaaagttttgcaacaataaagtactttacctaagtgttgattgtgcctgttgtgaagctaatgaactctttcaaattatatgctaattaaataatacaactcctattcgctgacttagttaaaattgatttgttttcattaggatctgatgt

SEQ ID NO: 12434 - DNA, 1303 bp, Homo sapiens
gtggcttttccctaacttgacccttctttcagtgggagggaactattgagaggaacaaagagcttataaatacattaggacctggaattcggttgtccagccacaaaggtgacagcatttaacaaagcttagagaaacctccaggagactgctaccatggcagagaagcccaagctccactactccaatatacggggcagaatggagtccatccggtggctcctggctgcagctggagtagagtttgaagagaaatttataaaatctgcagaagatttggacaagttaagaaatgatggatatttgatgttccagcaagtgccaatggttgagattgatgggatgaagctggtgcagaccagagccattctcaactacattgccagcaaatacaacctctatgggaaagacataaaggagaaagccctgattgatatgtatatagaaggtatagcagatttgggtgaaatgatccttcttctgccctttagtcaacctgaggaacaagatgccaagcttgccttgatccaagagaaaacaaaaaatcgctacttccctgcctttgaaaaagtcttaaagagccacggacaagactaccttgttggcaacaagctgagccgggctgacattcacctggtggaacttctctactacgtggaagagcttgactctagccttatttccagcttccctctgctgaaggccctgaaaaccagaatcagtaacctgcccacagtgaagaagtttctacagcctggcagcccaaggaagcctcccatggatgagaaatctttagaagaatcaaggaagattttcaggttttaataaaccagccatagaggtcaagaacatgcaagaccagtattctaaagttttgcaacaattaagtgctttacctaagtgttgattgtgcctgttgtgaagctaatgaactctttcaaattatatgctaattaaataatacaactcctattcacccacttagttaaaattgatttcttctcattaggatctgatgtgaattcagttttccaatctcctcctagccaacaattttcttggaattacaaattcagtaaaaatggaaactataaattatgtggtttgtttgacttttccaagaattgccctgtaacatacaatttgtcatacaatctattaaaatgccaatgtaaaaatgcacctctgacattttcaggtatgcacaggagaagagttaccatcctggataatggcataaagacattttcttcttttcctgaacagtcattttatttctgataaaagcattctttctaatgca

SEQ ID NO: 12435 - DNA, 902 bp, Homo sapiens
ggtggccttgagaagctgagcggagaccggctagactttactcaaagaaaccaagagactgttaccatggcagggaagcccaagcttcactacttcaatggacggggcagaatggagcccatccggtggctcttggctgcagctggagtggagtttgaagagaaatttataggatctgcagaagatttgggaaagttaagaaatgatgggagtttgatgttccagcaagtaccaatggttgagattgatgggatgaagttggtacagaccagagccattctcaactacattgccagcaaatacaacctctacgggaaagacataaaggagagagccctaattgatatgtatacagaaggtatggcagatttgaatgaaatgatccttcttctgcccttatgtcgacctgaggaaaaagatgccaagattgccttgatcaaagagaaaacaaaaagtcgctatttccctgccttcgaaaaagtgttacagagccatggacaagactaccttgttggcaacaagctgagccgggctgacattagcctggtggaacttctctactatgtggaagagcttgactccagccttatctccaacttccctctgctgaaggccctgaaaaccagaatcagcaacctgcccacggtgaagaagtttctacagcctggcagcccaaggaagcctcccgcagatgcaaaagctttagaagaagccagaaagattttcaggttttaataaagcagccatggaggctaagaacatgcaagaccaatattctaaagttttgcaacaatgaagtgctttacttaagtgttgattgtgcctgttgtaaagctaatgaaccctttccaattatatgctaattaaataataaaaactcctatttgctaacttagttaaaa

SEQ ID NO: 12436 - DNA, 775 bp, Homo sapiens
gcggagaccggctagactttactcaatttgaagagaaatttataggatctgcagaagatttgggaaagttaagaaatgatgggagtttgatgttccagcaagtaccaatggttgagattgatgggatgaagttggtacagaccagagccattctcaactacattgccagcaaatacaacctctacgggaaagacataaaggagagagccctaattgatatgtatacagaaggtatggcagatttgaatgaaatgatccttcttctgcccttatgtcgacctgaggaaaaagatgccaagattgccttgatcaaagagaaaacaaaaagtcgctatttccctgccttcgaaaaagtgttacagagccatggacaagactaccttgttggcaacaagctgagccgggctgacattagcctggtggaacttctctactatgtggaagagcttgactccagccttatctccaacttccctctgctgaaggccctgaaaaccagaatcagcaacctgcccacggtgaagaagtttctacagcctggcagcccaaggaagcctcccgcagatgcaaaagctttagaagaagccagaaagattttcaggttttaataaagcagccatggaggctaagaacatgcaagaccaatattctaaagttttgcaacaatgaagtgctttacttaagtgttgattgtgcctgttgtaaagctaatgaaccctttccaattatatgctaattaaataataaaaactcctatttgctaacttagttaaaa

SEQ ID NO: 12437 - DNA, 411 bp, Homo sapiens
cccaagcttcactacttcaatggacggggcagaatggagcccatccggtggctcttggctgcagctggagtggagatgggagtttgatgttccagcaagtaccaatggttgagattgatgggatgaagttggtacagaccagagccattctcaactacattgccagcaaatacaacctctacgggaaagacataaaggagagagccctaattgatatgtatacagaaggtatggcagatttgaatgaaatgatccttcttctgcccttatgtcgacctgaggaaaaagatgccaagattgccttgatcaaagagaaaacaaaaagtcgctatttccctgccttcgaggctgacattagcctggtggaacttctctactatgtggaagagcttgactccagccttatctcca

SEQ ID NO: 12438 - DNA, 793 bp, Homo sapiens
ctcactctcgcattcttccctcactcccccagttcagtccttctcttgtcttttcttcctcttgtcctttgtcctcctgctccatccagtctgggcagagaaagcctgaaaagctatcatggcagcaaggcccaagctccactatcccaacggaagaggccggatggagtccgtgagatgggttttagctgccgccggagtcgagtttgatgaagaatttctggaaacaaaagaacagttgtacaagttgcaggatggtaaccacctgctgttccaacaagtgcccatggttgaaattgacgggatgaagttggtacagacccgaagcattctccactacatagcagacaagcacaatctctttggcaagaacctcaaggagagaaccctgattgacatgtacgtggaggggacactggatctgctggaactgcttatcatgcatcctttcttaaaaccagatgatcagcaaaaggaagtggttaacatggcccagaaggctataattagatactttcctgtgtttgaaaagattttaaggggtcacggacaaagctttcttgttggtaatcagctgagccttgcagatgtgattttactccaaaccattttagctctagaagagaaaattcctaatatcctgtctgcatttcctttcctccaggaatacacagtgaaactaagtaatatccctacaattaagagattccttgaacctggcagcaagaagaagcctccccctgatgaaatttatgtgagaaccgtctacaacatctttaggccataaaacaac

SEQ ID NO: 12439 - DNA, 859 bp, Homo sapiens
agtgagggaaaatgcagcaacaaaaataaagaacagtttcccgtgccaaaatcctgaatattcatttcgcccctgagcactgggttgaagacgcgaaattgggactgttggtctgcgacgagctgctgcatttgtatttcagaaagcctgaaaagctatcatggcagcaaggcccaagctccactatcccaacggaagaggccggatggagtccgtgagatgggttttagctgccgccggagtcgaggattgacatgtacgtggaggggacactggatctgctggaactgcttatcatgcatcctttcttaaaaccagatgatcagcaaaaggaagtggttaacatggcccagaaggctataattagatactttcctgtgtttgaaaagattttaaggggtcacggacaaagctttcttgttggtaatcagctgagccttgcagatgtgattttactccaaaccattttagctctagaagagaaaattcctaatatcctgtctgcatttcctttcctccaggaatacacagtgaaactaagtaatatccctacaattaagagattccttgaacctggcagcaagaagaagcctccccctgatgaaatttatgtgagaaccgtctacaacatctttaggccataaaacaacacatccatgtgtgagtgacagtgtgttcctagagatggtattgtctacagtcatgtcttaatggatcccagctctgtcatggtgctatctatgtattaagttgggtcctaagttgggtcttttgtgtcaacgagatcatctcttctagaaatatcaaccttttttgtccagtaaataattgttaggggatctttattggaaaacttttt

SEQ ID NO: 12440 - DNA, 1334 bp, Homo sapiens
agtctccattggtgaggtcgtcccggagcctcgcccagctcccgcgcgctagagccgcctgctggtctcacccagccgggaccgctgacctggcgctttgtgcggctccaggcctccgagtggactccagaaagcctgaaaagctatcatggcagcaaggcccaagctccactatcccaacggaagaggccggatggagtccgtgagatgggttttagctgccgccggagtcgagtttgatgaagaatttctggaaacaaaagaacagttgtacaagttgcaggatggtaaccacctgctgttccaacaagtgcccatggttgaaattgacgggatgaagttggtacagacccgaagcattctccactacatagcagacaagcacaatctctttggcaagaacctcaaggagagaaccctgattgacatgtacgtggaggggacactggatctgctggaactgcttatcatgcatcctttcttaaaaccagatgatcagcaaaaggaagtggttaacatggcccagaaggctataattagatactttcctgtgtttgaaaagattttaaggggtcacggacaaagctttcttgttggtaatcagctgagccttgcagatgtgattttactccaaaccattttagctctagaagagaaaattcctaatatcctgtctgcatttcctttcctccaggaatacacagtgaaactaagtaatatccctacaattaagagattccttgaacctggcagcaagaagaagcctccccctgatgaaatttatgtgagaaccgtctacaacatctttaggccataaaacaacacatccatgtgtgagtgacagtgtgttcctagagatggtattgtctacagtcatgtcttaatggatcccagctctgtcatggtgctatctatgtattaagttgggtcctaagttgggtcttttgtgtcaacgagatcatctcttctagaaatatcaaccttttttgtccagtaaataattgttaggggatctttattggaaaacttttttggagaggctggtatttaagttagatctgattgggctactcatgtcctgtagccagttcatcctcataataagaatgggcaggatctcttgttctctcctgagtgtctttctactctcctgagcgtctttctgctctccttatcctgttctcttatccttatcccctccagtctctgcctaatttttagtgtttaataacaaccgaatgtctagtaaatgactctcctctgagctgtaataaataaaatggtagtaatgaatgcaatcagtattagccaaaataaagaatttatgagtcatt

SEQ ID NO: 12441 - DNA, 379 bp, Homo sapiens
aaagcctgaaaagctatcatggcagcaaggcccaagctccactatcccaacggaagaggccggatggagtccgtgagatgggttttagctgccgccggagtcgaggattgacatgtacgtggaggggacactggatctgctggaactgcttatcatgcatcctttcttaaaaccagatgatcagcaaaaggaagtggttaacatggcccagaaggctataattagatactttcctgtgtttgaaaagattttaaggggtcacggacaaagctttcttgttggtaatcagctgagccttgcagatgtgattttactccaaaccattttagctctagaagagaaaattcctaatatcctgtctgcatttcctttcctccag

SEQ ID NO: 12442 - DNA, 1170 bp, Homo sapiens
aattgggactgttggtctgcgacgagctgctgcatttgtatttcagaaagcctgaaaagctatcatggcagcaaggcccaagctccactatcccaacggaagaggccggatggagtccgtgagatgggttttagctgccgccggagtcgaggtaaccacctgctgttccaacaagtgcccatggttgaaattgacgggatgaagttggtacagacccgaagcattctccactacatagcagacaagcacaatctctttggattgacatgtacgtggaggggacactggatctgctggaactgcttatcatgcatcctttcttaaaaccagatgatcagcaaaaggaagtggttaacatggcccagaaggctataattagatactttcctgtgtttgaaaagattttaaggggtcacggacaaagctttcttgttggtaatcagctgagccttgcagatgtgattttactccaaaccattttagctctagaagagaaaattcctaatatcctgtctgcatttcctttcctccaggaatacacagtgaaactaagtaatatccctacaattaagagattccttgaacctggcagcaagaagaagcctccccctgatgaaatttatgtgagaaccgtctacaacatctttaggccataaaacaacacatccatgtgtgagtgacagtgtgttcctagagatggtattgtctacagtcatgtcttaatggatcccagctctgtcatggtgctatctatgtattaagttgggtcctaagttgggtcttttgtgtcaacgagatcatctcttctagaaatatcaaccttttttgtccagtaaataattgttaggggatctttattggaaaacttttttggagaggctggtatttaagttagatctgattgggctactcatgtcctgtagccagttcatcctcataataagaatgggcaggatctcttgttctctcctgagtgtctttctactctcctgagcgtctttctgctctccttatcctgttctcttatccttatcccctccagtctctgcctaatttttagtgtttaataacaaccgaatgtctagtaaatgactctcctctgagctgtaataaataaaatggtagtaatgaatgcaatcagtattagccaaaataaagaatttatgagtc

SEQ ID NO: 12443 - DNA, 845 bp, Homo sapiens
agttgcccagccacgacagtgacagagtttaacaaactaagcttagagaaacctccaggagactgctatcatggcagagaagcccaagctccactactccaatgcacggggcagtatggagtccattcggtggctcctggctgcagctggagtagagttggaagagaaatttctagaatctgcagaagatttggacaagttaagaaatgatgggagtttgctgttccagcaagtaccaatggttgagattgacgggatgaagctggtgcagaccagagccattcttaactacattgccagcaaatacaacctttatgggaaagacatgaaggagagagccctgattgatatgtacacagaaggtatagtagatttgactgaaatgatccttcttctgctcatatgtcaaccagaggaaagagatgccaagactgccttggtcaaagagaaaataaaaaatcgctacttccctgcctttgaaaaagtcttaaagagccacagacaagactaccttgttggcaacaagctgagctgggctgacattcacctggtggaacttttctactacgtggaagagcttgactcgagtcttatctccagcttccctctgctgaaggccctgaaaaccagaatcagcaacctgcccacggtgaagaagtttctgcagcctggcagccagagaaagcctcccatggatgagaaatctttagaagaagcaaggaagattttcaggttttaataaagcagctatggaggccaagaacatgccagaccaatattctacagtttgcaacaatgaagtgctttacctaagtgtggattgtgcctcttgtaaagctaataaa

SEQ ID NO: 12444 - DNA, 1021 bp, Homo sapiens
gtgggttttccctaacttgacctttctcctttcagtgggagggaactattgaaaggaacaaagagcttataaatacattaagacctggaattcagttgcccagccacgacagtgacagagtttaacaaagcttagagaaacctccaggagactgctatcatggcagagaagcccaagctccactactccaatgcacggggcagtatggagtccattcggtggctcctggctgcagctggagtagagttggaagagaaatttctagaatctgcagaagatttggacaagttaagaaatgatgggagtttgctgttccagcaagtaccaatggttgagattgacgggatgaagctggtgcagaccagagccattcttaactacattgccagcaaatacaacctttatgggaaagacatgaaggagagagccctgattgatatgtacacagaaggtatagtagatttgactgaaatgatccttcttctgctcatatgtcaaccagaggaaagagatgccaagactgccttggtcaaagagaaaataaaaaatcgctacttccctgcctttgaaaaagtcttaaagagccacagacaagactaccttgttggcaacaagctgagctgggctgacattcacctggtggaacttttctactacgtggaagagcttgactcgagtcttatctccagcttccctctgctgaaggccctgaaaaccagaatcagcaacctgcccacggtgaagaagtttctgcagcctggcagccagagaaagcctcccatggatgagaaatctttagaagaagcaaggaagattttcaggttttaataaagcagctatggaggccaagaacatgccagaccaatattctacagtttgcaacaatgaagtgctttacctaagtgtggattgtgcctcttgtaaagctaataaactctttccaattacatgctaattaaataataaataactcttatctgtcaacttagctaaaattgatttgttttcattagtatctgat

SEQ ID NO: 12445 - DNA, 1131 bp, Homo sapiens
gcggaatccgcaccaaccagcaccatgcccatgatactggggtactgggacatccgcgggctggcccacgccatccgcctgctcctggaatacacagactcaagctatgaggaaaagaagtacacgatgggggacgctcctgattatgacagaagccagtggctgaatgaaaaattcaagctgggcctggactttcccaatctgccctacttgattgatggggctcacaagatcacccagagcaacgccatcttgtgctacattgcccgcaagcacaacctgtgtggggagacagaagaggagaagattcgtgtggacattttggagaaccagaccatggacaaccatatgcagctgggcatgatctgctacaatccagaatttgagaaactgaagccaaagtacttggaggaactccctgaaaagctaaagctctactcagagtttctggggaagcggccatggtttgcaggaaacaagatcacttttgtagattttctcgtctatgatgtccttgacctccaccgtatatttgagcccaagtgcttggacgccttcccaaatctgaaggacttcatctcccgctttgagggcttggagaagatctctgcctacatgaagtccagccgcttcctcccaagacctgtgttctcaaagatggctgtctggggcaacaagtagggccttgaaggccaggaggtgggagtgaggagcccatactcagcctgctgcccaggctgtgcagcgcagctggactctgcatcccagcacctgcctcctcgttcctttctcctgtttattcccatctttactcccaagacttcattgtccctcttcactccccctaaacccctgtcccatgcaggccctttgaagcctcagctacccactatccttcgtgaacatcccctcccatcattacccttccctgcactaaagccagcctgaccttccttcctgttagtggttgtgtctgctttaaagggcctgcctggcccctcgcctgtggagctcagccccgagctgtccccgtgttgcatgaaggagcagcattgactggtttacaggccctgctcctgcagcatggtccctgccttaggcctacctgatggaagtaaagcctcaaccaca

SEQ ID NO: 12446 - DNA, 1028 bp, Homo sapiens
aggcctgtctgcggaatccgcaccaaccagcaccatgcccatgatactggggtactgggacatccgcgggctggcccacgccatccgcctgctcctggaatacacagactcaagctatgaggaaaagaagtacacgatgggggacgctcctgattatgacagaagccagtggctgaatgaaaaattcaagctgggcctggactttcccaatctgccctacttgattgatggggctcacaagatcacccagagcaacgccatcttgtgctacattgcccgcaagcacaacctgtgtggggagacagaagaggagaagattcgtgtggacattttggagaaccagaccatggacaaccatatgcagctgggcatgatctgctacaatccagaatttgagaaactgaagccaaagtacttggaggaactccctgaaaagctaaagctctactcagagtttctggggaagcggccatggtttgcaggaaacaagggcttggagaagatctctgcctacatgaagtccagccgcttcctcccaagacctgtgttctcaaagatggctgtctggggcaacaagtagggccttgaaggccaggaggtgggagtgaggagcccatactcagcctgctgcccaggctgtgcagcgcagctggactctgcatcccagcacctgcctcctcgttcctttctcctgtttattcccatctttactcccaagacttcattgtccctcttcactccccctaaacccctgtcccatgcaggccctttgaagcctcagctacccactatccttcgtgaacatcccctcccatcattacccttccctgcactaaagccagcctgaccttccttcctgttagtggttgtgtctgctttaaagggcctgcctggcccctcgcctgtggagctcagccccgagctgtccccgtgttgcatgaaggagcagcattgactggtttacaggccctgctcctgcagcatggtccctgccttaggcctacctgatggaagtaaagcctcaacca

SEQ ID NO: 12447 - DNA, 700 bp, Homo sapiens
cgcaccaaccagcaccatgcccatgatactggggtactgggacatccgcgggctggcccacgccatccgcctgctcctggaatacacagactcaagctatgaggaaaagaagtacacgatgggggacgctcctgattatgacagaagccagtggctgaatgaaaaattcaagctgggcctggactttcccaatctgccctacttgattgatggggctcacaagatcacccagagcaacgccatcttgtgctacattgcccgcaagcacaacctgtgtggggagacagaagaggagaagattcgtgtggacattttggagaaccagaccatggacaaccatatgcagctgggcatgatctgctacaatccagaatttggcttggagaagatctctgcctacatgaagtccagccgcttcctcccaagacctgtgttctcaaagatggctgtctggggcaacaagtagggccttgaaggccaggaggtgggagtgaggagcccatactcagcctgctgcccaggctgtgcagcgcagctggactctgcatcccagcacctgcctcctcgttcctttctcctgtttattcccatctttactcccaagacttcattgtccctcttcactccccctaaacccctgtcccatgcaggccctttgaagcctcagctacccactatccttcgtgaacatcccctccca

SEQ ID NO: 12448 - DNA, 850 bp, Homo sapiens
ctgctcggtttaggcctgtctgcggaatccgcaccaaccagcaccatgcccatgatactggggtactgggacatccgcgggctggcccacgccatccgcctgctcctggaatacacagactcaagctatgaggaaaagaagtacacgatgggggacgctcctgattatgacagaagccagtggctgaatgaaaaattcaagctgggcctggactttcccaatgggatgctggggagcctggtggcccaactgagcttcgccggtttcccatccatccagctgccctacttgattgatggggctcacaagatcacccagagcaacgccatcttgtgctacattgcccgcaagcacaacctgtgtggggagacagaagaggagaagattcgtgtggacattttggagaaccagaccatggacaaccatatgcagctgggcatgatctgctacaatccagaatttgagaaactgaagccaaagtacttggaggaactccctgaaaagctaaagctctactcagagtttctggggaagcggccatggtttgcaggaaacaagatcacttttgtagattttctcgtctatgatgtccttgacctccaccgtatatttgagcccaagtgcttggacgccttcccaaatctgaaggacttcatctcccgctttgagggcttggagaagatctctgcctacatgaagtccagccgcttcctcccaagacctgtgttctcaaagatggctgtctggggcaacaagtagggccttgaaggccaggaggtgggagtgaggagcccatactcagcctgctgcccaggctgtgcagcgcagctggactctgcatcccagcacc

SEQ ID NO: 12449 - DNA, 1121 bp, Homo sapiens
cagcaaccagcaccatgcccatgacactggggtactggaacatccgcgggctggcccattccatccgcctgctcctggaatacacagactcaagctacgaggaaaagaagtacacgatgggggacgctcctgattatgacagaagccagtggctgaatgaaaaattcaagctgggcctggactttcccaatctgccctacttgattgatgggactcacaagatcacccagagcaacgccatcctgcggtacattgcccgcaagcacaacctgtgcggggaatcagaaaaggagcagattcgcgaagacattttggagaaccagtttatggacagccgtatgcagctggccaaactctgctatgacccagattttgagaaactgaaaccagaatacctgcaggcactccctgaaatgctgaagctctactcacagtttctggggaagcagccatggtttcttggggacaagatcacctttgtggatttcatcgcttatgatgtccttgagagaaaccaagtatttgagcccagctgcctggatgccttcccaaacctgaaggacttcatctcccgatttgagggcttggagaagatctctgcctacatgaagtccagccgcttcctcccaagacctgtgttcacaaagatggctgtctggggcaacaagtagggccttgaaggccaggaggtgggagtgaggagcccatactcagcctgctgcccaggctgtgcagcgcagctggactctgcatcccagcacctgcctcctcgttcctttctcctgtttattcccatctttactcccaagacttcattgtccctcttcactccccctaaacccctgtcccatgcaggccctttgaagcctcagctacccactatccttcgtgaacatcccctcccatcattacccttccctgcactaaagccagcctgaccttccttcctgttagtggttgtgtctgctttaaagggcctgcctggcccctcgcctgtggagctcagccccgagctgtccccgtgttgcatgaaggagcagcattgactggtttacaggccctgctcctgcagcatggtccctgccttaggcctacctgatggaagtaaagcctcaaccaca

SEQ ID NO: 12450 - DNA, 1087 bp, Homo sapiens
agcaaggcttcccctctaccctctctgggcctctcacaaacgctgagccccgccccgctgaggcctgtctgcagaatccacagcaaccagcaccatgcccatgacactggggtactggaacatccgcgggctggcccattccatccgcctgctcctggaatacacagactcaagctacgaggaaaagaagtacacgatgggggacgctcctgattatgacagaagccagtggctgaatgaaaaattcaagctgggcctggactttcccaatctgccctacttgattgatgggactcacaagatcacccagagcaacgccatcctgcggtacattgcccgcaagcacaacctgtgcggggaatcagaaaaggagcagattcgcgaagacattttggagaaccagtttatggacagccgtatgcagctggccaaactctgctatgacccagattttgagaaactgaaaccagaatacctgcaggcactccctgaaatgctgaagctctactcacagtttctggggaagcagccatggtttcttggggacaagggcttggagaagatctctgcctacatgaagtccagccgcttcctcccaagacctgtgttcacaaagatggctgtctggggcaacaagtagggccttgaaggccaggaggtgggagtgaggagcccatactcagcctgctgcccaggctgtgcagcgcagctggactctgcatcccagcacctgcctcctcgttcctttctcctgtttattcccatctttactcccaagacttcattgtccctcttcactccccctaaacccctgtcccatgcaggccctttgaagcctcagctacccactatccttcgtgaacatcccctcccatcattacccttccctgcactaaagccagcctgaccttccttcctgttagtggttgtgtctgctttaaagggcctgcctggcccctcgcctgtggagctcagccccgagctgtccccgtgttgcatgaaggagcagcattgactggtttacaggccctgctcctgcagcatggtccctgccttaggcctacctgatggaagtaaagcctcaacc

SEQ ID NO: 12451 - DNA, 982 bp, Homo sapiens
gtctgcagaatccacagcaaccagcaccatgcccatgacactggggtactggaacatccgcgggctggcccattccatccgcctgctcctggaatacacagactcaagctacgaggaaaagaactcctgattatgacagaagccagtggctgaatgaaaaattcaagctgggcctggactttcccaatctgccctacttgattgatgggactcacaagatcacccagagcaacgccatcctgcggtacattgcccgcaagcacaacctgtgcggggaatcagaaaaggagcagattcgcgaagacattttggagaaccagtttatggacagccgtatgcagctggccaaactctgctatgacccagattttgagaaactgaaaccagaatacctgcaggcactccctgaaatgctgaagctctactcacagtttctggggaagcagccatggtttcttggggacaagatcacctttgtggatttcatcgcttatgatgtccttgagagaaaccaagtatttgagcccagctgcctggatgccttcccaaacctgaaggacttcatctcccgatttgagcattcctgatgtttggattcaggctgcttccctcatccctgctgctcctgatccccgtccacagacccactttccccgctggtgtgatccttgtggccactatggcagctactttggagagccgctagtccagtccttcccgccttccgcagagctctactcctgcttctgaagaagccacctggggcctggccttcttcctggctcctcagagtccttgcaacagcaggcactacttctctctcctgcactcaacccctctcccactccactgcctctcagtgtgccaaaacacgaagatgtgtcctgattttcaaaatctctcccctgaagttcccacctgatatgtagttggagatgggcaaatacagcgtccttgaagcatcattttattcatagtgcct

SEQ ID NO: 12452 - DNA, 1478 bp, Homo sapiens
agcaaggcttcccctctaccctctctgggcctctcacaaacgctgagccccgccccgctgaggcctgtctgcagaatccacagcaaccagcaccatgcccatgacactggggtactggaacatccgcgggctggcccattccatccgcctgctcctggaatacacagactcaagctacgaggaaaagaagtacacgatgggggacgctcctgattatgacagaagccagtggctgaatgaaaaattcaagctgggcctggactttcccaatctgccctacttgattgatgggactcacaagatcacccagagcaacgccatcctgcggtacattgcccgcaagcacaacctgtgcggggaatcagaaaaggagcagattcgcgaagacattttggagaaccagtttatggacagccgtatgcagctggccaaactctgctatgacccagattttgagaaactgaaaccagaatacctgcaggcactccctgaaatgctgaagctctactcacagtttctggggaagcagccatggtttcttggggacaagatcacctttgtggatttcatcgcttatgatgtccttgagagaaaccaagtatttgagcccagctgcctggatgccttcccaaacctgaaggacttcatctcccgatttgagcattcctgatgtttggattcaggctgcttccctcatccctgctgctcctgatccccgtccacagacccactttccccgctggtgtgatccttgtggccactatggcagctactttggagagccgctagtccagtccttcccgccttccgcagagctctactcctgcttctgaagaagccacctggggcctggccttcttcctggctcctcagagtccttgcaacagcaggcactacttctctctcctgcactcaacccctctcccactccactgcctctcagtgtgccaaaacacgaagatgtgtcctgattttcaaaatctctcccctgaagttcccacctgatatgtagttggagatgggcaaatacagcgtccttgaagcatcattttattcatagtgcctggaatgtagtaggatctcgacaattgttgtttcaataaaggaatgaccaaatatattaatactgtaaaaagtaaagtagaggttcctcttcaaagagacttttctccccatctaattaagaataagtcgtaacttctcttagaagcaaaatttattcaaagaccggtgctgatattctgaaatatctgctagctgtaataaagaaattaatgtactttatgttcttaactcccacaatttagcctaaatacttgccctggcatgcttatactgatccaaacaagcatgaggtcatagcctgttcctcttccttatttgaaggtgtttttaccttactcagcattccacaagtgagttcccccttcctttgttctcctctgcctctgcctcttttaaaaagttctaagttgcta

SEQ ID NO: 12453 - DNA, 1443 bp, Homo sapiens
acaaacgctgagccccgccccgctgaggcctgtctgcagaatccacagcaaccagcaccatgcccatgacactggggtactggaacatccgcgggctggcccattccatccgcctgctcctggaatacacagactcaagctacgaggaaaagaagtacacgatgggggacgctcctgattatgacagaagccagtggctgaatgaaaaattcaagctgggcctggactttcccaatctgccctacttgattgatgggactcacaagatcacccagagcaacgccatcctgcggtacattgcccgcaagcacaacctgtgcggggaatcagaaaaggagcagattcgcgaagacattttggagaaccagtttatggacagccgtatgcagctggccaaactctgctatgacccagattttgagaaactgaaaccagaatacctgcaggcactccctgaaatgctgaagctctactcacagtttctggggaagcagccatggtttcttggggacaagatcacctttgtggatttcatcgcttatgatgtccttgagagaaaccaagtatttgagcccagctgcctggatgccttcccaaacctgaaggacttcatctcccgatttgagcattcctgatgtttggattcaggctgcttccctcatccctgctgctcctgatccccgtccacagacccactttccccgctggtgtgatccttgtggccactatggcagctactttggagagccgctagtccagtccttcccgccttccgcagagctctactcctgcttctgaagaagccacctggggcctggccttcttcctggctcctcagagtccttgcaacagcaggcactacttctctctcctgcactcaacccctctcccactccactgcctctcagtgtgccaaaacacgaagatgtgtcctgattttcaaaatctctcccctgaagttcccacctgatatgtagttggagatgggcaaatacagcgtccttgaagcatcattttattcatagtgcctggaatgtagtaggatctcgacaattgttgtttcaataaaggaatgaccaaatatattaatactgtaaaaagtaaagtagaggttcctcttcaaagagacttttctccccatctaattaagaataagtcgtaacttctcttagaagcaaaatttattcaaagaccggtgctgatattctgaaatatctgctagctgtaataaagaaattaatgtactttatgttcttaactcccacaatttagcctaaatacttgccctggcatgcttatactgatccaaacaagcatgaggtcatagcctgttcctcttccttatttgaaggtgtttttacctttctcagcgttccacaagtgagttcccccttcctttgttctcctctgcctctgcctcttttaaaaagttctaagttgcta

SEQ ID NO: 12454 - DNA, 4046 bp, Homo sapiens
tgcagcactcctgcccgggtcccgcctcggggtcgccaggccctgaaccccaacgccggcattagtcgcgcctgcgcacggccctgtggagccgcggaggcaagggacggagaacggggcggaggcggagtcagggcgcccgcgcgtgggccccgcccccttatgtcgggtataaagcccctcccgctcacagtttccctagtcctcgaaggctcggaagcccgtcaccatgtcgtgcgagtcgtctatggttctcgggtactgggatattcgtgggctggcgcacgccatccgcctgctcctggagttcacggatacctcttatgaggagaaacggtacacgtgcggggaagctcctgactatgatcgaagccaatggctggatgtgaaattcaagctagacctggactttcctaatctgccctacctcctggatgggaagaacaagatcacccagagcaatgccatcttgcgctacatcgctcgcaagcacaacatgtgtggtgagactgaagaagaaaagattcgagtggacatcatagagaaccaagtaatggatttccgcacacaactgataaggctctgttacagctctgaccacgaaaaactgaagcctcagtacttggaagagctacctggacaactgaaacaattctccatgtttctggggaaattctcatggtttgccggggaaaagctcacctttgtggattttctcacctatgatatcttggatcagaaccgtatatttgaccccaagtgcctggatgagttcccaaacctgaaggctttcatgtgccgttttgaggctttggagaaaatcgctgcctacttacagtctgatcagttctgcaagatgcccatcaacaacaagatggcccagtggggcaacaagcctgtatgctgagcaggaggcagacttgcagagcttgttttgtttcatcctgtccgtaaggggtcagcgctcttgctttgctcttttcaatgaatagcacttatgttactggtgtccagctgagtttctcttgggtataaaggctaaaagggaaaaaggatatgtggagaatcatcaagatatgaattgaatcgctgcgatactggcatttccctactccccaactgagttcaagggctgtaggttcatgcccaagccctgagagtgggtactagaaaaaacgagattgcacagttggagagagcaggtgtgttaaatgggactggagtccctgtgaagactgggtgaggataacacaagtaaaactgtggtactgatggacttaaccggagttcggaaaccgtcctgtgtacacatgggagtttagtgtgataaaggcagtatttcagactggtgggctagccaatagagttgggacaattgcttactcattaaaaataatagagccccacttgacactattcactaaaattaatctggaatttaaggcccaacattaaacacaaagctgttgaaatattgatgaaaatgtaagaatttttgtgaccacggggtaggagaagtttctttaaagacgtaaaaagaaaaaaaccataggctgctctgcctgtggagtagccattctttattcttttactttttaaaataataacaatcacaaaggaaagatttgccaattgaataggatcaaattctacaacttttcctaaggcacccacaaataaatgacaagtgagacaaaaagcactagtataaagattatataaagacctataaatcattaagacaactgagtttttaaaaatggacaaaatccatgaacaatttataaaatagaaatatagccaaaaatgtctaaaagatgtttatgatgtaaggaattatcaattacaacagtgagaaaccatatttccttctatccgatgagtaaaaagtttctaaagtgttggcaaggcttaggaaagtgatatgcatttcctgctggtcaagttgtaaattagtatagctactttggaggacaattgtaaaatttaaatcatatcctatgacccagcaattccatgctataaaaactcatccatggccgggcttggtggctcacgcctgtaatcccagcactttgggaggctgaggtgggcagatcacgaggtcaagagatcgagaccatcctggccaacatgatgaaaccccgtttctactaaaaatacaaaaattagctgggcatggtggcatgtgcctatagtcccagctactcaggaggctgaggcaggagaattgcttgaacctgggaggcagaggttgcagtgagccgagatcacgccactgcactccagcctggctacagggcgagactctgtctcaaaaaaaaaaaaaaaaaaaaaaaaaaaacattcaaagagacatatactaagatgttcactgtggcattgtctgtaatgacaaataagtggaaaccgtgtaaatacctgtcaatactatggagtaccatgtggcaacggaagaatgagactgaactgtgtgaactaacatgcaaagatccccaaaacaggccaggtgtggttgctcacagctgtaataacaacaccttcagaggctgaggtgagaggatcagttgaggccaggagtttaagaccagcctgggcaacatagtgagacccctgtctcccaaaaattttttttaattagctgtgcgcaattgctcatgcatagtcccagctacccaggaggctgaggtgggaggatcacttgagcccaggaatttgaagctgcagtgagctgtgttcttgccactgcactccaatctgggtgactgagcaagaccctgtctcttaaaaaaataaaaaagatctccaagcatagagaagagtctggagggaaacaccaaactcataacagtcttactgcaggcaagtgggataaaggcccagactccatggtggaagttaaagggcatttccaagttaaggctaagacttgcttttctaactaagagaatgtgctcatgcattgcttgtgtagtagaaactagtttttagaaaagaaagcaaacttaagaaacactgactcctgtggagatgacttggcaccactctcctttcacagagcagagtctgaatagtcttcagagataggcctgtgggccagattgccatcccctatggaccagaagccaaggatctctctagtgatggtcagagggcccaaatggcagggatacccagtgatgtcaggaggaatagtacagacagaaggtgctaagcagacaattcaactgccatgttttgccaccccctgtgagcagggattaggtgttcaggccagtatcttgggcatgggggagcctttggccagaagaggtataaagctcagaagtttttcagtctgataactattgatataatttccatagtgtgagggagcggtatgctctacccttgtgtatttaaggcaggacagagaaattgaggatgcccctggggctagatcgatgatatgaccagaaatcaaaaagggaatgcattatttattgctgtgtaacactgttaagagaggaggtagttaagggatggataggcacatagagagggaaggtctcaggagaagggatagaaaggaactatgttcacaagaacaacggcaagacagtgcctatactgcctctacagttaataggaaaaacggaagaagttacccttaagctaggatgttgctcagaagtgaccatcccaactttggtgcgggcacaataaatcagcctaaatgtccctaatttaacccagctcattataatgtcattaaacatgacattagcattgtggttttagcacccccatgggttttgcttaggcactcatgggtaataaccaagatggagtccctttggcaaaacttaggcatgcacagctgtagtaccccaagaagaaaatgttacttctctcatctgggcaaaacccacagaagacttcccagcttctgccacataaaagacacagaacacagacgccttactggcaacctgctttcaagacccctgtctttgctgagagctttcctttttcccaataaattctactctgccctactcactctc

SEQ ID NO: 12455 - DNA, 1557 bp, Homo sapiens
ggttggttctgagaaggcttcaaggaataggcagacatttcagcaaggctgctgaggaaggataggctgtggaaattaggatgcagcactcctgcccgggtcccgcctcggggtcgccaggccctgaaccccaacgccggcattagtcgcgcctgcgcacggccctgtggagccgcggaggcaagggacggagaacggggcggaggcggagtcagggcgcccgcgcgtgggccccgcccccttatgtcgggtataaagcccctcccgctcacagtttccctagtcctcgaaggctcggaagcccgtcaccatgtcgtgcgagtcgtctatggttctcgggtactgggatattcgtgggctggcgcacgccatccgcctgctcctggagttcacggatacctcttatgaggagaaacggtacacgtgcggggaagctcctgactatgatcgaagccaatggctggatgtgaaattcaagctagacctggactttcctaatctgccctacctcctggatgggaagaacaagatcacccagagcaatgccatcttgcgctacatcgctcgcaagcacaacatgtgtggtgagactgaagaagaaaagattcgagtggacatcatagagaaccaagtaatggatttccgcacacaactgataaggctctgttacagctctgaccacgaaaaactgaagcctcagtacttggaagagctacctggacaactgaaacaattctccatgtttctggggaaattctcatggtttgccggggaaaagctcacctttgtggattttctcacctatgatatcttggatcagaaccgtatatttgaccccaagtgcctggatgagttcccaaacctgaaggctttcatgtgccgttttgaggctttggagaaaatcgctgcctacttacagtctgatcagttctgcaagatgcccatcaacaacaagatggcccagtggggcaacaagcctgtatgctgagcaggaggcagacttgcagagcttgttttgtttcatcctgtccgtaaggggtcagcgctcttgctttgctcttttcaatgaatagcacttatgttactggtgtccagctgagtttctcttgggtataaaggctaaaagggaaaaaggatatgtggagaatcatcaagatatgaattgaatcgctgcgatactggcatttccctactccccaactgagttcaagggctgtaggttcatgcccaagccctgagagtgggtactagaaaaaacgagattgcacagttggagagagcaggtgtgttaaatgggactggagtccctgtgaagactgggtgaggataacacaagtaaaactgtggtactgatggacttaaccggagttcggaaaccgtcctgtgtacacatgggagtttagtgtgataaaggcagtatttcagactggtgggctagccaatagagttgggacaattgcttactcattaaaaataatagagccccacttgacactattcactaaaattaatctggaatttaaggcccaacattaaacacaaagctgttgaaatatt

SEQ ID NO: 12456 - DNA, 4128 bp, Homo sapiens
gggtgattctgagaaggcttcaaggaagaagtgagcatttgagcacggctacttgaggaaggctaggccatggacattagggtgcagcactcctgcccgggtcccgcctcggggtcgccaggccctgaaccccaacgccggcattagtcgcgcctgcgcacggccctgtggagccgcggaggcaagggacggagaacggggcggaggcggagtcagggcgcccgcgcgtgggccccgcccccttatgtcgggtataaagcccctcccgctcacagtttccctagtcctcgaaggctcggaagcccgtcaccatgtcgtgcgagtcgtctatggttctcgggtactgggatattcgtgggctggcgcacgccatccgcctgctcctggagttcacggatacctcttatgaggagaaacggtacacgtgcggggaagctcctgactatgatcgaagccaatggctggatgtgaaattcaagctagacctggactttcctaatctgccctacctcctggatgggaagaacaagatcacccagagcaatgccatcttgcgctacatcgctcgcaagcacaacatgtgtggtgagactgaagaagaaaagattcgagtggacatcatagagaaccaagtaatggatttccgcacacaactgataaggctctgttacagctctgaccacgaaaaactgaagcctcagtacttggaagagctacctggacaactgaaacaattctccatgtttctggggaaattctcatggtttgccggggaaaagctcacctttgtggattttctcacctatgatatcttggatcagaaccgtatatttgaccccaagtgcctggatgagttcccaaacctgaaggctttcatgtgccgttttgaggctttggagaaaatcgctgcctacttacagtctgatcagttctgcaagatgcccatcaacaacaagatggcccagtggggcaacaagcctgtatgctgagcaggaggcagacttgcagagcttgttttgtttcatcctgtccgtaaggggtcagcgctcttgctttgctcttttcaatgaatagcacttatgttactggtgtccagctgagtttctcttgggtataaaggctaaaagggaaaaaggatatgtggagaatcatcaagatatgaattgaatcgctgcgatactggcatttccctactccccaactgagttcaagggctgtaggttcatgcccaagccctgagagtgggtactagaaaaaacgagattgcacagttggagagagcaggtgtgttaaatgggactggagtccctgtgaagactgggtgaggataacacaagtaaaactgtggtactgatggacttaaccggagttcggaaaccgtcctgtgtacacatgggagtttagtgtgataaaggcagtatttcagactggtgggctagccaatagagttgggacaattgcttactcattaaaaataatagagccccacttgacactattcactaaaattaatctggaatttaaggcccaacattaaacacaaagctgttgaaatattgatgaaaatgtaagaatttttgtgaccacggggtaggagaagtttctttaaagacgtaaaaagaaaaaaaccataggctgctctgcctgtggagtagccattctttattcttttactttttaaaataataacaatcacaaaggaaagatttgccaattgaataggatcaaattctacaacttttcctaaggcacccacaaataaatgacaagtgagacaaaaagcactagtataaagattatataaagacctataaatcattaagacaactgagtttttaaaaatggacaaaatccatgaacaatttataaaatagaaatatagccaaaaatgtctaaaagatgtttatgatgtaaggaattatcaattacaacagtgagaaaccatatttccttctatccgatgagtaaaaagtttctaaagtgttggcaaggcttaggaaagtgatatgcatttcctgctggtcaagttgtaaattagtatagctactttggaggacaattgtaaaatttaaatcatatcctatgacccagcaattccatgctataaaaactcatccatggccgggcttggtggctcacgcctgtaatcccagcactttgggaggctgaggtgggcagatcacgaggtcaagagatcgagaccatcctggccaacatgatgaaaccccgtttctactaaaaatacaaaaattagctgggcatggtggcatgtgcctatagtcccagctactcaggaggctgaggcaggagaattgcttgaacctgggaggcagaggttgcagtgagccgagatcacgccactgcactccagcctggctacagggcgagactctgtctcaaaaaaaaaaaaaaaaaaaaaaaaaaaacattcaaagagacatatactaagatgttcactgtggcattgtctgtaatgacaaataagtggaaaccgtgtaaatacctgtcaatactatggagtaccatgtggcaacggaagaatgagactgaactgtgtgaactaacatgcaaagatccccaaaacaggccaggtgtggttgctcacagctgtaataacaacaccttcagaggctgaggtgagaggatcagttgaggccaggagtttaagaccagcctgggcaacatagtgagacccctgtctcccaaaaattttttttaattagctgtgcgcaattgctcatgcatagtcccagctacccaggaggctgaggtgggaggatcacttgagcccaggaatttgaagctgcagtgagctgtgttcttgccactgcactccaatctgggtgactgagcaagaccctgtctcttaaaaaaataaaaaagatctccaagcatagagaagagtctggagggaaacaccaaactcataacagtcttactgcaggcaagtgggataaaggcccagactccatggtggaagttaaagggcatttccaagttaaggctaagacttgcttttctaactaagagaatgtgctcatgcattgcttgtgtagtagaaactagtttttagaaaagaaagcaaacttaagaaacactgactcctgtggagatgacttggcaccactctcctttcacagagcagagtctgaatagtcttcagagataggcctgtgggccagattgccatcccctatggaccagaagccaaggatctctctagtgatggtcagagggcccaaatggcagggatacccagtgatgtcaggaggaatagtacagacagaaggtgctaagcagacaattcaactgccatgttttgccaccccctgtgagcagggattaggtgttcaggccagtatcttgggcatgggggagcctttggccagaagaggtataaagctcagaagtttttcagtctgataactattgatataatttccatagtgtgagggagcggtatgctctacccttgtgtatttaaggcaggacagagaaattgaggatgcccctggggctagatcgatgatatgaccagaaatcaaaaagggaatgcattatttattgctgtgtaacactgttaagagaggaggtagttaagggatggataggcacatagagagggaaggtctcaggagaagggatagaaaggaactatgttcacaagaacaacggcaagacagtgcctatactgcctctacagttaataggaaaaacggaagaagttacccttaagctaggatgttgctcagaagtgaccatcccaactttggtgcgggcacaataaatcagcctaaatgtccctaatttaacccagctcattataatgtcattaaacatgacattagcattgtggttttagcacccccatgggttttgcttaggcactcatgggtaataaccaagatggagtccctttggcaaaacttaggcatgcacagctgtagtaccccaagaagaaaatgttacttctctcatctgggcaaaacccacagaagacttcccagcttctgccacataaaagacacagaacacagacgccttactggcaacctgctttcaagacccctgtctttgctgagagctttcctttttcccaataaattctactctgccctactcactctc

SEQ ID NO: 12457 - DNA, 1321 bp, Homo sapiens
ctgaacactcggaggtggcggtggatcttactccttccagccagtgaggatccagcaacctgctccgtgcctcccgcgcctgttggttggaagtgacgaccttgaagatcggccggttggaagtgacgaccttgaagatcggcgggcgcagcggggccgagggggcgggtctggcgctaggtccagcccctgcgtgccgggaaccccagaggaggtcgcagttcagcccagctgaggcctgtctgcagaatcgacaccaaccagcatcatgtccatgacactggggtactgggacatccgcgggctggcccacgccatccgcctgctcctggaatacacagactcaagctacgaggaaaagaagtatacgatgggggacgctcctgactatgacagaagccagtggctgaatgaaaaattcaagctgggcctggactttcccaatctgccctacttgattgatggggctcacaagatcacccagagcaacgccatcctgtgctacattgcccgcaagcacaacctgtgtggggagacagaagaggagaagattcgtgtggacattttggagaaccaggctatggacgtctccaatcagctggccagagtctgctacagccctgactttgagaaactgaagccagaatacttggaggaacttcctacaatgatgcagcacttctcacagttcctggggaagaggccatggtttgttggagacaagatcacctttgtagatttcctcgcctatgatgtccttgacctccaccgtatatttgagcccaactgcttggacgcctttccaaatctgaaggacttcatctcccgctttgaggtttcctgtggcataatgtgatggtcaattttctgcatcaacttgactgggctaagggatgctcagatggcaggtaaaatcattgtgcttgtgagggtgtttccagaagagatttgcctttgaatcagaagacagcaaagatttccttcagcaatgaaggaggcatccaccaaactgtcagggcccagagagaagaaaaagacaggaagggtgaatttgacctctctgactgggacatccatctctgcctatcctgggacctccacactcctggttctctggccttcagacttgatcagggactaacaccatcgcctcccacccccacctttgttctgaggcctttagcctctgaatgataccactggctttcctgcttctctatcctgcagtcggcagatcatgggacttcttcactccaaaattgtgtgagccaattcccataacagatagataaatttataaataaacacacaaatttcctac

SEQ ID NO: 12458 - DNA, 1118 bp, Homo sapiens
cttccggaccttgctccctgaacactcggaggtggcggtggatcttactccttccagccagtgaggatccagcaacctgctccgtgcctcccgcgcctgttggttggaagtgacgaccttgaagatcggccggttggaagtgacgaccttgaagatcggcgggcgcagcggggccgagggggcgggtctggcgctaggtccagcccctgcgtgccgggaaccccagaggaggtcgcagttcagcccagctgaggcctgtctgcagaatcgacaccaaccagcatcatgtccatgacactggggtactgggacatccgcgggctggcccacgccatccgcctgctcctggaatacacagactcaagctacgaggaaaagaagtatacgatgggggacgctcctgactatgacagaagccagtggctgaatgaaaaattcaagctgggcctggactttcccaatgagaaactgaagccagaatacttggaggaacttcctacaatgatgcagcacttctcacagttcctggggaagaggccatggtttgttggagacaagatcacctttgtagatttcctcgcctatgatgtccttgacctccaccgtatatttgagcccaactgcttggacgcctttccaaatctgaaggacttcatctcccgctttgagggcttggagaagatctctgcctacatgaagtccagccgcttcctcccaaaacctctgtacacaagggtggctgtctggggcaacaagtaatgccttgaaggccaggaggtgggagtgaggagcccatactcagcctgctgcccaggctgtgcagcgcagctggactctgcatcccagcacctgcctcctcgttcctttctcctgtttattcccatctttacccccaagactttattgggcctcttcacttcccctaaacccctgtcccatgcaggccctttgaagcctcagctacccactttccttcatgaacatccccctcccaacactacccttccctgcactaaagccagcctgaccttccttcctgttagtggttgtatctgctttgaagggcctacctggcccctcgcctgtggagctcagccctgagctgtccccgtgttgca

SEQ ID NO: 12459 - DNA, 3990 bp, Homo sapiens
gtcgcagttcagcccagctgaggcctgtctgcagaatcgacaccaaccagcatcatgtccatgacactggggtactgggacatccgcgggctggcccacgccatccgcctgctcctggaatacacagactcaagctacgaggaaaagaagtatacgatgggggacggtaatgacacccttgtgtccgggctctgcccactcacgctgagttggcaccaagcaacccatggtggccacctgtggctacctctgcaggcctcccctgctggagctgcaggctgtcccttccctgagccccggtgagggagtcctgtggccttgcaaggcagaatgctggggcgggatgctgggccccctgtttaattgggttgggtgtccctcagagcttccctaaaccctggaagccttagccgtgtggggtccagagccctcagcgggattctttgtccctgaaccctgggatgtgggactgagtggtcagattctagatccacctgtctcagggatcttgccactggttccttgggagggtccccgggaaggagggctgggctctggggaggtttgttttcacttcttcttccccacggcagctcctgactatgacagaagccagtggctgaatgaaaaattcaagctgggcctggactttcccaatgtaggtgcaggggaaggggcggttttgggggaaagtgcgacgtgtctctgactgcatctcctctccccagattagaggtgttcggatcaggagtcttctgcccaattcctctcactcctggttgtctacacagcccctgcatgatgttctgtgtcccagctcatttgttcatgtgacagtatttctatgtcaggcctgccatgagcgggcacagtgagtgcctggtctcccctctgcccttgcatatgggaaggggatgctggggagcctgctggcccaactgagcttccccggtttcccatctatccagctgccctacttgattgatggggctcacaagatcacccagagcaacgccatcctgtgctacattgcccgcaagcacaacctgtgtggggagacagaagaggagaagattcgtgtggacattttggagaaccaggctatggacgtctccaatcagctggccagagtctgctacagccctgactttgagaaactgaagccagaatacttggaggaacttcctacaatgatgcagcacttctcacagttcctggggaagaggccatggtttgttggagacaagatcacctttgtagatttcctcgcctatgatgtccttgacctccaccgtatatttgagcccaactgcttggacgcctttccaaatctgaaggacttcatctcccgctttgaggtgatgcccccatcctcctttctctttgatgccccttgttccgttacctcctttcagatgctttcccagtcctggagctacataaagaataacttgcatttattgagtgctggcttcatgccaggaaccttgcccagcacattatacctatcgtgtggaatttgaaatttccaacattcctacagggtgacagaattatcttgcccatttagagataagaaaactttgaatgagagggtcagtcctttgttctgggtcccagagccagtggaggctgtgctgggctccctgtgagcatctggatctatgggtggcagtcagggctctcccttttgtgacaaaagaaagaagcctcaggcctcatccagcctggatttcacagcccagggcactttggaagaggcagagaactttaggagcatggatgcagctggcaatagtaggactgacacacggtggcattgacgtcgagtacgaaacccacaggcagtattcatagctactcccagaagctttgcacgatcagacccccacgtggggaatcctgagagccagagctgtggccagagctggattagggtacatatgtgggtgcccctgttgaaggagtgtatgttgaagtgctctgtgctggggcactctccttctttatcttttttcctctcttttttccctccagtgttccaagtgttccccctgtgagatgagtagcacactgattttactgctattcaccgaccttctcctctgcatgaggcagggtgtgaggcacagtgggagttgcatagatgactgccccatcctggaaatgagtgcagtgagaggcctgcaggcagagcagcctgtgaggtgtgtggcaccacctgggtaccaggcctggggcctgcccctcactcatggggaaccatccctcacccgtgctgaatttgtttgagagcagcaaatcctacttttagtacagatgtgagaatttgaggcattagtccaacaagtttttcagcctagaatttgttttcctttcccactacccatcaagggatctggttactcagctagttcccatcagctctggctgtggtctcggctgagtggccttggggttatgtaagaggtagtgggaggggaagagagctgagggctgcagcatatggtccacctgggcttggccctttgggaataggcagccctggctctctctgaatccttagaaattacacggctatttgatcctggaaagatcgtgcagagcacacctgagtgtcatacagcctggtctgaggtagtggggttggagatgaggtgggttggggcacagtggtgtttagctcaggtaccaggtggggaggtttagactttctgctttaaaaggaatgattagagcctggtctggcgtttcttttgctggtccaacacaccttgaccactttcatccaggttttgccaggtccttgggtgagatctgggctctcttccaggctgcacagacattttcagaggtcccctctgtgtgtgcaaacctaggcaagccaggtgcctccctgtgaaacaggagaatgttgtgtagtcagagagtgacaggacctcctgagggatttgggggaggatggggatttgacagaaagaggccagaactggagagagacagaaccagtctacgttgcagctctgtcccccttagtagctatttgagtgtgaggaagttactgaacttctgtttcccacatgagaaatggtgataatagattcagccttgcagagtagtcgagtgggttttctaagcttatgttgtaatttctcttgggtacagagcacccagcaccgggtagaatcttcataagtgttagctgttactgtggtacaacattacttaaaggaagttggaagagttaactccgcaaatctggggaccctaagaggctgtgtgatgcctcagcacttgagcccacgtggaaaggctgtggccagggccctgacctgctgtgtctgcagtggggttgtcccagccctcatgggcagctgaccttgagttctggccttattttcccccctctcagggcttggagaagatctctgcctacatgaagtccagccgcttcctcccaaaacctctgtacacaagggtggctgtctggggcaacaagtaatgccttgaaggccaggaggtgggagtgaggagcccatactcagcctgctgcccaggctgtgcagcgcagctggactctgcatcccagcacctgcctcctcgttcctttctcctgtttattcccatctttacccccaagactttattgggcctcttcacttcccctaaacccctgtcccatgcaggccctttgaagcctcagctacccactttccttcatgaacatccccctcccaacactacccttccctgcactaaagccagcctgaccttccttcctgttagtggttgtatctgctttgaagggcctacctggcccctcgcctgtggagctcagccctgagctgtccccgtgttgcatgacagcattgactggtttacaggccctgctcctgcagcatggcccctgccttaggcctacctgatcaaaataaagcctcagccacatttgctatagtcttgtcttatttgctcctggctgcccagact

SEQ ID NO: 12460 - DNA, 1412 bp, Homo sapiens
ggcgaggccgagcccctcctagtgcttccggaccttgctccctgaacactcggaggtggcggtggatcttactccttccagccagtgaggatccagcaacctgctccgtgcctcccgcgcctgttggttggaagtgacgaccttgaagatcggccggttggaagtgacgaccttgaagatcggcgggcgcagcggggccgagggggcgggtctggcgctaggtccagcccctgcgtgccgggaaccccagaggaggtcgcagttcagcccagctgaggcctgtctgcagaatcgacaccaaccagcatcatgtccatgacactggggtactgggacatccgcgggctggcccacgccatccgcctgctcctggaatacacagactcaagctacgaggaaaagaagtatacgatgggggacgctcctgactatgacagaagccagtggctgaatgaaaaattcaagctgggcctggactttcccaatctgccctacttgattgatggggctcacaagatcacccagagcaacgccatcctgtgctacattgcccgcaagcacaacctgtgtggggagacagaagaggagaagattcgtgtggacattttggagaaccaggctatggacgtctccaatcagctggccagagtctgctacagccctgactttgagaaactgaagccagaatacttggaggaacttcctacaatgatgcagcacttctcacagttcctggggaagaggccatggtttgttggagacaagatcacctttgtagatttcctcgcctatgatgtccttgacctccaccgtatatttgagcccaactgcttggacgcctttccaaatctgaaggacttcatctcccgctttgagggcttggagaagatctctgcctacatgaagtccagccgcttcctcccaaaacctctgtacacaagggtggctgtctggggcaacaagtaatgccttgaaggccaggaggtgggagtgaggagcccatactcagcctgctgcccaggctgtgcagcgcagctggactctgcatcccagcacctgcctcctcgttcctttctcctgtttattcccatctttacccccaagactttattgggcctcttcacttcccctaaacccctgtcccatgcaggccctttgaagcctcagctacccactttccttcatgaacatccccctcccaacactacccttccctgcactaaagccagcctgaccttccttcctgttagtggttgtatctgctttgaagggcctacctggcccctcgcctgtggagctcagccctgagctgtccccgtgttgcatgacagcattgactggtttacaggccctgctcctgcagcatggcccctgccttaggcctacctgatcaaaataaagcctcagccaca

SEQ ID NO: 12461 - DNA, 1555 bp, Homo sapiens
caaagtctgagccccgctccgctgatgcctgtctgcagaatccgcaccaaccagcaccatgcccatgactctggggtactgggacatccgtgggctggcccacgccatccgcttgctcctggaatacacagactcaagctatgtggaaaagaagtacacgctgggggacgctcctgactatgacagaagccagtggctgaatgaaaaattcaagctgggcctggactttcccaatctgccctacttgattgatggggctcacaagatcacccagagcaatgccatcctgcgctacattgcccgcaagcacaacctgtgtggggagacagaagaggagaagattcgtgtggacattttggagaaccaggttatggataaccacatggagctggtcagactgtgctatgacccagattttgagaaactgaagccaaaatacttggaggaactccctgaaaagctaaagctctactcagagtttctggggaagcggccatggtttgcaggagacaagatcacctttgtggatttccttgcctatgatgtccttgacatgaagcgtatatttgagcccaagtgcttggacgccttcctaaacttgaaggacttcatctcccgctttgagggtttgaagaagatctctgcctacatgaagtccagccaattcctccgaggtcttttgtttggaaagtcagctacatggaacagcaaatagggcccagtgatgccagaagatgggagggaggagccaaccttgctgcctgcgaccctggaggacagcctgactccctggacctgccttcttcctttttccttctttctactctcttctcttccccaaggcctcattggcttcctttcttctaacatcatccctccccgcatcgaggctctttaaagcttcagctccccactgtcctccatcaaagtccccctcctaacgtcttcctttccctgcactaacgccaacctgactgcttttcctgtcagtgcttttctcttctttgagaagccagactgatctctgagctccctagcactgtcctcaaagaccatctgtatgccctgctccctttgctgggtccctaccccagctccgtgtgatgcccagtaaagcctgaaccatgcctgccatgtcttgtcttattccctgaggctcccttgactcaggactgtgctcgaattgtgggtggttttttgtcttctgttgtccacagccagagcttagtggatgggtgtgtgtgtgtgtgtgttgggggtggtgatcaggcaggttcataaatttccttggtcatttctgccctctagccacatccctctgttcctcactgtggggattactacagaaaggtgctctgtgccaagttcctcactcattcgcgctcctgtaggccgtctagaactggcatggttcaaagaggggctaggctgatggggaagggggctgagcagctcccaggcagactgccttctttcaccctgtcctgatagacttccctgatctagatatccttcgtcatgacacttctcaataaaacgtatcccaccgtattgt

SEQ ID NO: 12462 - DNA, 815 bp, Homo sapiens
gctccgctgatgcctgtctgcagaatccgcaccaaccagcaccatgcccatgactctggggtactgggacatccgtgggctggcccacgccatccgcttgctcctggaatacacagactcaagctatgtggaaaagaagtacacgctgggggacgctcctgactatgacagaagccagtggctgaatgaaaaattcaagctgggcctggactttcccaatgggatgctggggagcctggtggcccaactgagcttccccggtttcccatctatccagctgccctacttgattgatggggctcacaagatcacccagagcaatgccatcctgcgctacattgcccgcaagcacaacctgtgtggggagacagaagaggagaagattcgtgtggacattttggagaaccaggttatggataaccacatggagctggtcagactgtgctatgacccagattttgagaaactgaagccaaaatacttggaggaactccctgaaaagctaaagctctactcagagtttctggggaagcggccatggtttgcaggagacaagatcacctttgtggatttccttgcctatgatgtccttgacatgaagcgtatatttgagcccaagtgcttggacgccttcctaaacttgaaggacttcatctcccgctttgagggtttgaagaagatctctgcctacatgaagtccagccaattcctccgaggtcttttgtttggaaagtcagctacatggaacagcaaatagggcccagtgatgccagaagatgggagggaggagccaaccttgctgcctgcgaccctgg

SEQ ID NO: 12463 - DNA, 4370 bp, Homo sapiens
aaagtctgagccccgctccgctgatgcctgtctgcagaatccgcaccaaccagcaccatgcccatgactctggggtactgggacatccgtgggctggcccacgccatccgcttgctcctggaatacacagactcaagctatgtggaaaagaagtacacgctgggggacggtaatggcaccctcgtgtccgggccctgcccactcacgctgagttggcaccaagcaacccatggtggccacctgtggctgcctctgcaggcctcccctgctggagctgcaggctgtcccttccctgagctcccgtgagtgagccctctggccttgcaaggcagaatgctggggcgggatgctggacaccctgtctaattgggttgggtgtccctcagagcttccctaaaccctggaagccttagccgttgtggggtccagagccctcagtgggattctttctccctgaaccctgggatgtgggactgagtggtcagattctagatccacctgtctcagggatcttgccactggctccttgggagggtccccgggaaggagggctgggctctggggaggtttgttttcacttcttccccaccacagctcctgactatgacagaagccagtggctgaatgaaaaattcaagctgggcctggactttcccaatgtaggtgcaggggaaggggcggttttgggggaaagtgcgacgtgtctctgactgcatctcctctccccaccttagaggtgttaagatcaggagtcttctgcccaattcctctcactcttggctgtctacacagcccttgcatgatgttctgtgtcccagctcatttattagtgtgacagtatttctatctcaggcctgccatgagcaggccctggtctcctctctgcccttgcatatgggaaggggatgctggggagcctggtggcccaactgagcttccccggtttcccatctatccagctgccctacttgattgatggggctcacaagatcacccagagcaatgccatcctgcgctacattgcccgcaagcacaacctgtgtggggagacagaagaggagaagattcgtgtggacattttggagaaccaggttatggataaccacatggagctggtcagactgtgctatgacccagattttgagaaactgaagccaaaatacttggaggaactccctgaaaagctaaagctctactcagagtttctggggaagcggccatggtttgcaggagacaagatcacctttgtggatttccttgcctatgatgtccttgacatgaagcgtatatttgagcccaagtgcttggacgccttcctaaacttgaaggacttcatctcccgctttgaggtgatgcccccatcctcctttctctttgatgccccttgttcctttctctcctttcagatgctttcccagtcctggagctacacaaagaataactcgtatgtattgagtacgggcttcatgccaggaatcatgcccagcacattatacctatcgtgtagaatttgaaatttccaacattcctacagggtgacagaattatcttgcccattttagagataagaaaactgagaatgagagggtcagtcctttgctcagggtcccagagccagtggaggctgtgctgggctccctgtgagcctctggatctatgggtggcagtcagggctctcccatttgtgacaaaaggagaagcctcaggcctcatccagcctgggtttcacagcccagaacactttgaaagaggcagagcacttcaggaccacggatgcagctggcaatagtaggactgacacacagtggcattgatgttgagtactaaacctgcaggcagtattcatagccacccccagaagctttgcatgatcggacccccatgtggaaaatcctgagatccggagctgtggctggagctggattagggtacatatgtgggtgcccctgttgaagcagtgtgtgttgaagtgctctgtgctggggcactctccttctttatctttcttcctctctttttttccctccaatgttccacgtcttccccctgtgagatgagtagcacactgattttactcctattcaccgaccttctcctctgcatgaggcagggtgtgaggcacagtgggagttgcatagatgactgccccatcctggaaatgagtgcagtgagaggcctgcaggcagagcagcctgtgaggtgtgtgtggcaccacctgggtaccgggcctggggcctgcccctcactcacggggaaccatccctcacctgtgttgaagttgtttgagagcagcaaatcctactttagtacagatttggggatttgaggcattagtccaacaggcttctgagcctagaatctgtttccctttcccactccccatcaagaaatctgcttgctcagctagttcccatcagctctggttctggtccagcctgagcagccttggggttatgtaagaggtggtgggaggggagcggtggggaacagccgagggctggggcatggagcctgcctgggcctggccctggccctttggggagagggagccctggatctctttgaattctttagaagttacatggtcattgaatcctggtaagattgtgtgcagcacacctgagtgtcatgtggcctggctagcagtagtagggctggagatgtgatgggggcacagggacatagggagatttagctcaggtaccaggtggagaagtttggactttatgctttaatgggaatgattagagcctggtctggccttcctttggtggttcacccttaccctattcagtttcatccaggttttgctaagtcattgggtgagatctgtgctctcttcttggctgcacaggtgtgttctgagcccctttgttctgctggaggtcctttctgtgtgtgcaatcctaggcaagccaagaacctccctgtgaaaaaggagaatgtttgtgccgacaaggagtgacaggatctggcatggggtgtggctgggtggaagaggaggagaatttggcaaaaacatgctagaactgaagacagaaccaggctatattccagccctgtcccacttactagctatttgagtgtgaggaagttgctgaacttctgttcttctatatgagaaacggtgataatagaactgaccatggagggtagtcgagtggattttctaagcctgtgttgtaatttctgttggatataaagcacccagcacagtgtagatctttcgtaaatggtagctgttattatggtataacattacttaaaggaagttggaagagttaacttagaagagctggggacctaagagaccgtgtgatgctccagcacttgagcccacatggaaaggctgtggccagggccctgacctgctgtgcctgcagcaaagctacttgagcccttctagacagcagacctggctctggccccttcttcccgccctcagggtttgaagaagatctctgcctacatgaagtccagccaattcctccgaggtcttttgtttggaaagtcagctacatggaacagcaaatagggcccagtgatgccagaagatgggagggaggagccaaccttgctgcctgcgaccctggaggacagcctgactccctggacctgccttcttcctttttccttctttctactctcttctcttccccaaggcctcattggcttcctttcttctaacatcatccctccccgcatcgaggctctttaaagcttcagctccccactgtcctccatcaaagtccccctcctaacgtcttcctttccctgcactaacgccaacctgactgcttttcctgtcagtgcttttctcttctttgagaagccagactgatctctgagctccctagcactgtcctcaaagaccatctgtatgccctgctccctttgctgggtccctaccccagctccgtgtgatgcccagtaaagcctgaaccatgcctgccatgtcttgtcttattccctgaggctcccttgactcaggactgtgctcgaattgtgggtggttttttgtcttctgttgtccacagccagagcttagtggatgggtgtgtgtgtgtgtgtgttgggggtggtgatcaggcaggttcataaatttccttggtcatttctgccctctagccacatccctctgttcctcactgtggggattactacagaaaggtgctctgtgccaagttcctcactcattcgcgctcctgtaggccgtctagaactggcatggttcaaagaggggctaggctgatggggaagggggctgagcagctcccaggcagactgccttctttcaccctgtcctgatagacttccctgatctagatatccttcgtcatgacacttctcaataaaacgtatcccaccgt

SEQ ID NO: 12464 - DNA, 900 bp, Homo sapiens
cccttggccagcgagatgctttgacacagccccttaagatgttttaagggctatcccataaagccgggaaggcacaacgggtggagctggcggccgccgggggcaggcacttttgagctaaggaggaagcgggggagggaaggagggcgggaaggacgcgccacctacttcctgaatcccctgcaaaccccagaggagctcggcctgcgctgcgccacgatgtccggggagtcagccaggagcttggggaagggaagcgcgcccccggggccggtcccggagggctcgatccgcatctacagcatgaggttctgcccgtttgctgagaggacgcgtctagtcctgaaggccaagggaatcaggcatgaagtcatcaatatcaacctgaaaaataagcctgagtggttctttaagaaaaatccctttggtctggtgccagttctggaaaacagtcagggtcagctgatctacgagtctgccatcacctgtgagtacctggatgaagcatacccagggaagaagctgttgccggatgacccctatgagaaagcttgccagaagatgatcttagagttgttttctaaggttctgactaataagaagacgaccttctttggtggcaattctatctctatgattgattacctcatctggccctggtttgaacggctggaagcaatgaagttaaatgagtgtgtagaccacactccaaaactgaaactgtggatggcagccatgaaggaagatcccacagtctcagccctgcttactagtgagaaagactggcaaggtttcctagagctctacttacagaacagccctgaggcctgtgactatgggctctgaagggggcaggagtcagcaataaagctatgtctgatattttccttcactaatatg

SEQ ID NO: 12465 - DNA, 972 bp, Homo sapiens
acagccccttaagatgttttaagggctatcccataaagccgggaaggcacaacgggtggagctggcggccgccgggggcaggcacttttgagctaaggaggaagcgggggagggaaggagggcgggaaggacgcgccacctacttcctgaatcccctgcaaaccccagaggagctcggcctgcgctgcgccacgatgtccggggagtcagccaggagcttggggaagggaagcgcgcccccggggccggtcccggagggctcgatccgcatctacagcatgaggttctgcccgtttgctgagaggacgcgtctagtcctgaaggccaagggaatcaggcatgaagtcatcaatatcaacctgaaaaataagcctgagtggttctttaagaaaaatccctttggtctggtgccagttctggaaaacagtcagggtcagctgatctacgagtctgccatcacctgtgagtacctggatgaagcatacccagggaagaagctgttgccggatgacccctatgagaaagcttgccagaagatgatcttagagttgttttctaaggtgccatccttggtaggaagctttattagaagccaaaataaagaagactatgctggcctaaaagaagaatttcgtaaagaatttaccaagctagaggaggttctgactaataagaagacgaccttctttggtggcaattctatctctatgattgattacctcatctggccctggtttgaacggctggaagcaatgaagttaaatgagtgtgtagaccacactccaaaactgaaactgtggatggcagccatgaaggaagatcccacagtctcagccctgcttactagtgagaaagactggcaaggtttcctagagctctacttacagaacagccctgaggcctgtgactatgggctctgaagggggcaggagtcagcaataaagctatgtctgatattttccttcactaata

SEQ ID NO: 12466 - DNA, 592 bp, Homo sapiens
gaagcgcgcccccggggccggtcccggagggctcgatccgcatctacagcatgaggttctgcccgtttgctgagaggacgcgtctagtcctgaaggccaagggaatcaggcatgaagtcatcaatatcaacctgaaaaataagcctgagtggttctttaagaaaaatccctttggtctggtgccagttctggaaaacagtcagggtcagctgatctacgagtctgccatcacctgtgagtacctggatgaagcatacccagggaagaagctgttgccggatgacccctatgagaaagcttgccagaagatgatcttagagttgttttctaaggttctgactaataagaagacgaccttctttggtggcaattctatctctatgattgattacctcatctggccctggtttgaacggctggaagcaatgaagttaaatgagtgtgtagaccacactccaaaactgaaactgtggatggcagccatgaaggaagatcccacagtctcagccctgcttactagtgagaaagactggcaaggtttcctagagctctacttacagaacagccctgaggcctgtgactatgggctctg

SEQ ID NO: 12467 - DNA, 829 bp, Homo sapiens
gggggtgatctcggcgacccccggcggcatgttcgaggctgctccgggagcccagccgcccgggagcgccccaccggcggggaacgggtcggagctgcagtgggacgcgggggcggtgggatacggggggtctcgacacctctctgggccgtaatcgccttcgcttctccccggcaggaagcgcgcccccggggccggtcccggagggctcgatccgcatctacagcatgaggttctgcccgtttgctgagaggacgcgtctagtcctgaaggccaagggaatcaggcatgaagtcatcaatatcaacctgaaaaataagcctgagtggttctttaagaaaaatccctttggtctggtgccagttctggaaaacagtcagggtcagctgatctacgagtctgccatcacctgtgagtacctggatgaagcatacccagggaagaagctgttgccggatgacccctatgagaaagcttgccagaagatgatcttagagttgttttctaaggtgccatccttggtaggaagctttattagaagccaaaataaagaagactatgctggcctaaaagaagaatttcgtaaagaatttaccaagctagaggaggttctgactaataagaagacgaccttctttggtggcaattctatctctatgattgattacctcatctggccctggtttgaacggctggaagcaatgaagttaaatgagtgtgtagaccacactccaaaactgaaactgtggatggcagccatgaaggaagatcccacagtctcagccctgcttactagtgagaaagactggcaaggtttcctagagctcta

SEQ ID NO: 12468 - DNA, 1052 bp, Homo sapiens
aaggatgactcctagacctgtctttgtcccatacttgggaagataagctgttagtttacattgccaagatgaaattcaactgatctgttttagagtaaagatcttgcgggccaacaaggaatttccttggggaggtgtgtggcctttgatctttgtagctatttagcaacaaaatgggaggcagtgttgcctgactcagtttccaagcttgactcttccctttggcatagtgagtttggagtcaagagatttttattttcccttcacaagctgaacaggagcctttggagagaacgctctggaccggaagcgcgcccccggggccggtcccggagggctcgatccgcatctacagcatgaggttctgcccgtttgctgagaggacgcgtctagtcctgaaggccaagggaatcaggcatgaagtcatcaatatcaacctgaaaaataagcctgagtggttctttaagaaaaatccctttggtctggtgccagttctggaaaacagtcagggtcagctgatctacgagtctgccatcacctgtgagtacctggatgaagcatacccagggaagaagctgttgccggatgacccctatgagaaagcttgccagaagatgatcttagagttgttttctaaggtgccatccttggtaggaagctttattagaagccaaaataaagaagactatgctggcctaaaagaagaatttcgtaaagaatttaccaagctagaggaggttctgactaataagaagacgaccttctttggtggcaattctatctctatgattgattacctcatctggccctggtttgaacggctggaagcaatgaagttaaatgagtgtgtagaccacactccaaaactgaaactgtggatggcagccatgaaggaagatcccacagtctcagccctgcttactagtgagaaagactggcaaggtttcctagagctctacttacagaacagccctgaggcctgtgactatgggctctgaagggggcaggagtcagcaataaagctatgtctgatattttccttcactaatatg

SEQ ID NO: 12469 - DNA, 1493 bp, Homo sapiens
accacctctgctgccgcgcgcctaccggagccgcttggccctagtgctttccagcggatttcccctcaggtgcggagccgggtgccggggtcccacagccaaccactaccggttcctctttcgtcagccaccggcgccggcaggacccgcgaatcccgatctccaggagcctgtaaggaggccgcccattggctcagccgcactgctgggcaggtacttccaaagctttgaggattggctgatgctctgggcgccggggctagttggcgggtaggatcacgtgcgaggggcaggccccgtctaggccccgcctccttgctgctgctgccgccgccaatcctggtccggttgcccgagttcccggaggtctctcgcgggacctctctcaccgccaccgctcctactctcgggcttccaaatctggggcgatgtctccccaggttaaattaccctagctcctgctccagatcgcttccccgtgccccgccagagcccagtagttcaaaaattaaatttggggcaaggggtgcgcgccagagcgcagctgtttctggagcctgcggcagcggtggcgagccacagggcggcgaccgtgagctccgggagctgcgcaaaccacctggagaccatgtctggggatgcgaccaggaccctggggaaaggaagccagcccccagggccagtcccggaggggctgatccgcatctacagcatgaggttctgcccctattctcacaggacccgcctcgtcctcaaggccaaagacatcagacatgaagtggtcaacattaacctgagaaacaagcctgaatggtactatacaaagcacccttttggccacattcctgtcctggagaccagccaatgtcaactgatctatgaatctgttattgcttgtgagtacctggatgatgcttatccaggaaggaagctgtttccatatgacccttatgaacgagctcgccaaaagatgttattggagctattttgtaaggtcccacatttgaccaaggagtgcctggtagcgttgagatgtgggagagaatgcactaatctgaaggcagccctgcgtcaggaattcagcaacctggaagagattcttgagtatcagaacaccaccttctttggtggaacctgtatatccatgattgattacctcctctggccctggtttgagcggctggatgtgtatgggatactggactgtgtgagccacacgccagccctgcggctctggatatcagccatgaagtgggaccccacagtctgtgctcttctcatggataagagcattttccagggcttcttgaatctctattttcagaacaaccctaatgcctttgactttgggctgtgctgagtctcactgtccaccccttcgctgtccagaattccccagcttgttgggagtctacgtcacggcttgtcttgggaaccaatccgtctctctttcttttctttgaagttcccaataaaatgaaaacaggaaatgt

SEQ ID NO: 12470 - DNA, 896 bp, Homo sapiens
gctccttcctcaccgggctgactagcctctcctttccctgtccccctccatcgctgctctgcaggaagccagcccccagggccagtcccggaggggctgatccgcatctacagcatgaggttctgcccctattctcacaggacccgcctcgtcctcaaggccaaagacatcagacatgaagtggtcaacattaacctgagaaacaagcctgaatggtactatacaaagcacccttttggccacattcctgtcctggagaccagccaatgtcaactgatctatgaatctgttattgcttgtgagtacctggatgatgcttatccaggaaggaagctgtttccatatgacccttatgaacgagctcgccaaaagatgttattggagctattttgtaaggtcccacatttgaccaaggagtgcctggtagcgttgagatgtgggagagaatgcactaatctgaaggcagccctgcgtcaggaattcagcaacctggaagagattcttgagtatcagaacaccaccttctttggtggaacctgtatatccatgattgattacctcctctggccctggtttgagcggctggatgtgtatgggatactggactgtgtgagccacacgccagccctgcggctctggatatcagccatgaagtgggaccccacagtctgtgctcttctcatggataagagcattttccagggcttcttgaatctctattttcagaacaaccctaatgcctttgactttgggctgtgctgagtctcactgtccaccccttcgctgtccagaattccccagcttgttgggagtctacgtcacggcttgtcttgggaaccaatccgtctctctttcttttctttgaagttcccaataaaatgaaaacaggaaatgta

SEQ ID NO: 12471 - DNA, 1495 bp, Homo sapiens
accacctctgctgccgcgcgcctaccggagccgcttggccctagtgctttccagcggatttcccctcaggtgcggagccgggtgccggggtcccacagccaaccactaccggttcctctttcgtcagccaccggcgccggcaggacccgcgaatcccgatctccaggagcctgtaaggaggccgcccattggctcagccgcactgctgggcaggtacttccaaagctttgaggattggctgatgctctgggcgccggggctagttggcgggtaggatcacgtgcgaggggcaggccccgtctaggccccgcctccttgctgctgctgccgccgccaatcctggtccggttgcccgagttcccggaggtctctcgcgggacctctctcaccgccaccggctcctactctcgggcttccaaatctggggcgatgtctccccaggttaaattaccctagctcctgctccagatcgcttccccgtgccccgccagagcccagtagttcaaaaattaaatttggggcaaggggtgcgcgccagagcgcagctgtttctggagcctgcggcagcggtggcgagccacagggcggcgaccgtgagctccgggagctgcgcaaaccacctggagaccatgtctggggatgcgaccaggaccctggggaaaggaagccagcccccagggccagtcccggaggggctgatccgcatctacagcatgaggttctgcccctattctcacaggacccgcctcgtcctcaaggccaaagacatcagacatgaagtggtcaacattaacctgagaaacaagcctgaatggtactatacaaagcacccttttggccacattcctgtcctggagaccagccaatgtcaactgatctatgaatctgttattgcttgtgagtacctggatgatgcttatccaggaaggaagctgtttccatatgacccttatgaacgagctcgccaaaagatgttattggagctattttgtaaggtcccacatttgaccaaggagtgcctggtagcgttgagatgtgggagagaatgcactaatctgaaggcagccctgcgtcaggaattcagcaacctggaagagattcttgagtatcagaacaccaccttctttggtggaacctgtatatccatgattgattacctcctctggccctggtttgagcggctggatgtgtatgggatactggactgtgtgagccacacgccagccctgcggctctggatatcagccatgaagtgggaccccacagtctgtgctcttctcatggataagagcattttccagggcttcttgaatctctattttcagaacaaccctaatgcctttgactttgggctgtgctgagtctcactgtccaccccttcgctgtccagaattccccagcttgttgggagtctacgtcacggcttgtcttgggaaccaatccgtctctctttcttttctttgaagttcccaataaaatgaaaacaggaaatgta

SEQ ID NO: 12472 - DNA, 972 bp, Homo sapiens
gagctgcgcaaaccacctggagaccatgtctggggatgcgaccaggaccctggggaaaggaagccagcccccagggccagtcccggaggggctgatccgcatctacagcatgaggttctgcccctattctcacaggacccgcctcgtcctcaaggccaaagacatcagacatgaagtggtcaacattaacctgagaaacaagcctgaatggtactatacaaagcacccttttggccacattcctgtcctggagaccagccaatgtcaactgatctatgaatctgttattgcttgtgagtacctggatgatgcttatccaggaaggaagctgtttccatatgacccttatgaacgagctcgccaaaagatgttattggagctattttgtaaggtcccacatttgaccaaggagtgcctggtagcgttgagatgtgggagagaatgcactaatctgaaggcagccctgcgtcaggaattcagcaacctggaagaggataggaagaaaagaaagtttatacctggttaattcgtcactgaaaacaattttctggaagtggaaggttttcccggaagtatgtcatcccttgctcctggtcttgcaaaatttgtctgttcagttcaggggctttgcctatctggccatcagagtcttactaattttctttgttgatttgtaaaagttccttttaaagcgttccttgtatagaaaagatatttgactggttttaaaacacatttttgttttcttttgacttttaatttggcttatatatttttgcatatggaagtacagcatttgaaagtattgtgctataaggctttccttatatgtgctatgatttcctccactgttttatgtgtaggaagtcctctccccacttcagagacttgataaatattcatttatattttcatctaccaccaatcactttacagacatttgactggtcaagcattaccctcctagctttt

SEQ ID NO: 12473 - DNA, 1123 bp, Homo sapiens
cttcctcaccgggctgactagcctctcctttccctgtccccctccatcgctgctctgcaggaagccagcccccagggccagtcccggaggggctgatccgcatctacagcatgaggttctgcccctattctcacaggacccgcctcgtcctcaaggccaaagacatcagacatgaagtggtcaacattaacctgagaaacaagcctgaatggtactatacaaagcacccttttggccacattcctgtcctggagaccagccaatgtcaactgatctatgaatctgttattgcttgtgagtacctggatgatgcttatccaggaaggaagctgtttccatatgacccttatgaacgagctcgccaaaagatgttattggagctattttgtaagctgtgtgagccacacgccagccctgcggctctggatatcagccatgaagtgggaccccacagtctgtgctcttctcatggataagagcattttccagggcttcttgaatctctattttcagaacaaccctaatgcctttgactttgggctgtgctgagtctcactgtccaccccttcgctgtccagaattccccagcttgttgggagtctacgtcacggcttgtcttgggaaccaatccgtctctctttcttttctttgaagttcccaataaaatgaaaacaggaaatgtattcttctgataatcatttgtctgactcctctagcctgtagctgctgctactgctgcttttttttcctttttttttttgaggcaagatcttgcttcgttactcaggctggagtgcagtgggacagtcggctcactgcagccttgaactcctgggctcagttgattctcccgcctcagcctcctgagaagctaggactacaggtatgtgtcaccacgcccagctaatttttaaaaaaatgttgttgagacagggtctcactatgttgctcaggctggtctccatctcctggccgcaagccatccacccaacttggtctccaaagtgttgagattacaggcatgagccacctggcctgcctagcctgtagcttctaactattttctagaaagtgcctggtgctaatgtcagagcacattttgggagcctgtgtgcctcctaac

SEQ ID NO: 12474 - DNA, 1391 bp, Homo sapiens
accacctctgctgccgcgcgcctaccggagccgcttggccctagtgctttccagcggatttcccctcaggtgcggagccgggtgccggggtcccacagccaaccactaccggttcctctttcgtcagccaccggcgccggcaggacccgcgaatcccgatctccaggagcctgtaaggaggccgcccattggctcagccgcactgctgggcaggtacttccaaagctttgaggattggctgatgctctgggcgccggggctagttggcgggtaggatcacgtgcgaggggcaggccccgtctaggccccgcctccttgctgctgctgccgccgccaatcctggtccggttgcccgagttcccggaggtctctcgcgggacctctctcaccgccaccgctcctactctcgggcttccaaatctggggcgatgtctccccaggttaaattaccctagctcctgctccagatcgcttccccgtgccccgccagagcccagtagttcaaaaattaaatttggggcaaggggtgcgcgccagagcgcagctgtttctggagcctgcggcagcggtggcgagccacagggcggcgaccgtgagctccgggagctgcgcaaaccacctggagaccatgtctggggatgcgaccaggaccctggggaaaggaagccagcccccagggccagtcccggaggggctgatccgcatctacagcatgaggttctgcccctattctcacaggacccgcctcgtcctcaaggccaaagacatcagacatgaagtggtcaacattaacctgagaaacaagcctgaatggtactatacaaagcacccttttggccacattcctgtcctggagaccagccaatgtcaactgatctatgaatctgttattgcttgtgagtacctggatgatgcttatccaggaaggaagctgtttccatatgacccttatgaacgagctcgccaaaagatgttattggagctattttgtaagattcttgagtatcagaacaccaccttctttggtggaacctgtatatccatgattgattacctcctctggccctggtttgagcggctggatgtgtatgggatactggactgtgtgagccacacgccagccctgcggctctggatatcagccatgaagtgggaccccacagtctgtgctcttctcatggataagagcattttccagggcttcttgaatctctattttcagaacaaccctaatgcctttgactttgggctgtgctgagtctcactgtccaccccttcgctgtccagaattccccagcttgttgggagtctacgtcacggcttgtcttgggaaccaatccgtctctctttcttttctttgaagttcccaataaaatgaaaacaggaaatgt

SEQ ID NO: 12475 - DNA, 1066 bp, Homo sapiens
actggagtttgctgactccctctggtttccggtcaggtcggtcggtccccactatgggcctggagctgtacctggacctgctgtcccagccctgccgcgctgtttacatctttgccaagaagaacgacattcccttcgagctgcgcatcgtggatctgattaaaggtcagcacttaagcgatgcctttgcccaggtgaaccccctcaagaaggtgccagccttgaaggacggggacttcaccttgacggagagtgtggccatcctgctctacctgacgcgcaaatataaggtccctgactactggtaccctcaggacctgcaggcccgtgcccgtgtggatgagtacctggcatggcagcacacgactctgcggagaagctgcctccgggccttgtggcataaggtgatgttccctgttttcctgggtgagccagtatctccccagacactggcagccaccctggcagagttggatgtgaccctgcagttgctcgaggacaagttcctccagaacaaggccttccttactggtcctcacatctccttagctgacctcgtagccatcacggagctgatgcatcccgtgggtgctggctgccaagtcttcgaaggccgacccaagctggccacatggcggcagcgcgtggaggcagcagtgggggaggacctcttccaggaggcccatgaggtcattctgaaggccaaggacttcccacctgcagaccccaccataaagcagaagctgatgccctgggtgctggccatgatccggtgagctgggaaacctcacccttgcaccgtcctcagcagtccacaaagcattttcatttctaatggcccatgggagccaggcccagaaagcaggaatggcttgcctaagacttgcccaagtcccagagcacctcacctcccgaagccaccatccccaccctgtcttccacagccgcctgaaagccacaatgagaatgatgcacactgaggccttgtgtcctttaatcactgcatttcattttgattttggataataaacctgggctcagcctgagcctctgcttctaactctaa

SEQ ID NO: 12476 - DNA, 807 bp, Homo sapiens
gactccctctggtttccggtcaggtcggtcggtccccactatgggcctggagctgtacctggacctgctgtcccagccctgccgcgctgtttacatctttgccaagaagaacgacattcccttcgagctgcgcatcgtggatctgattaaaggggtgatgttccctgttttcctgggtgagccagtatctccccagacactggcagccaccctggcagagttggatgtgaccctgcagttgctcgaggacaagttcctccagaacaaggccttccttactggtcctcacatctccttagctgacctcgtagccatcacggagctgatgcatcccgtgggtgctggctgccaagtcttcgaaggccgacccaagctggccacatggcggcagcgcgtggaggcagcagtgggggaggacctcttccaggaggcccatgaggtcattctgaaggccaaggacttcccacctgcagaccccaccataaagcagaagctgatgccctgggtgctggccatgatccggtgagctgggaaacctcacccttgcaccgtcctcagcagtccacaaagcattttcatttctaatggcccatgggagccaggcccagaaagcaggaatggcttgcctaagacttgcccaagtcccagagcacctcacctcccgaagccaccatccccaccctgtcttccacagccgcctgaaagccacaatgagaatgatgcacactgaggccttgtgtcctttaatcactgcatttcattttgattttggataataaacctgggctcagcctgagcctctgcttc

SEQ ID NO: 12477 - DNA, 778 bp, Homo sapiens
cggtccccactatgggcctggagctgtacctggacctgctgtcccagccctgccgcgctgtttacatctttgccaagaagaacgacattcccttcgagctgcgcatcgtggatctgattaaagtgtggccatcctgctctacctgacgcgcaaatataaggtccctgactactggtaccctcaggacctgcaggcccgtgcccgtgtggatgagtacctggcatggcagcacacgactctgcggagaagctgcctccgggccttgtggcataaggtgatgttccctgttttcctgggtgagccagtatctccccagacactggcagccaccctggcagagttggatgtgaccctgcagttgctcgaggacaagttcctccagaacaaggccttccttactggtcctcacatctccttagctgacctcgtagccatcacggagctgatgcatcccgtgggtgctggctgccaagtcttcgaaggccgacccaagctggccacatggcggcagcgcgtggaggcagcagtgggggaggacctcttccaggaggcccatgaggtcattctgaaggccaaggacttcccacctgcagaccccaccataaagcagaagctgatgccctgggtgctggccatgatccggtgagctgggaaacctcacccttgcaccgtcctcagcagtccacaaagcattttcatttctaatggcccatgggagccaggcccagaaagcaggaatggcttgcctaagacttgcccaagtcccagagcacctcac

SEQ ID NO: 12478 - DNA, 559 bp, Homo sapiens
agtgttgagccaagaggatggactttggagccagactttctgggtctataatcattcagtgtctgtctcctcctctaaaatgcggacggtgggaaattctgacacacgcttcaacacagatgcaccttgaagacattatgctaagtgaaatgagcgagccaggcacgaaagggatgggactggggcctctctgtgcgtccccctgagagacaacggtctcttggccacccaccctgatcccacaggagccaggcgggcccagccctgagacaggccgcccgccgcccgcaattggactaaagagtgtcccaggcgtccgtgccgcccaatggggcacagcggtcggggtcggtcggtccccactatgggcctggagctgtacctggacctgctgtcccagccctgccgcgctgtttacatctttgccaagaagaacgacattcccttcgagctgcgcatcgtggatctgattaaaggtcagcacttaagcgatgcctttgcccaggtgaaccccctcaagaaggtgccagccttgaaggacggggacttcaccttgacg

SEQ ID NO: 12479 - DNA, 628 bp, Homo sapiens
gactccctctggtttccggtcaggtcggtcggtccccactatgggcctggagctgtacctggacctgctgtcccagccctgccgcgctgtttacatctttgccaagaagaacgacattcccttcgagctgcgcatcgtggatctgattaaagcccgtgggtgctggctgccaagtcttcgaaggccgacccaagctggccacatggcggcagcgcgtggaggcagcagtgggggaggacctcttccaggaggcccatgaggtcattctgaaggccaaggacttcccacctgcagaccccaccataaagcagaagctgatgccctgggtgctggccatgatccggtgagctgggaaacctcacccttgcaccgtcctcagcagtccacaaagcattttcatttctaatggcccatgggagccaggcccagaaagcaggaatggcttgcctaagacttgcccaagtcccagagcacctcacctcccgaagccaccatccccaccctgtcttccacagccgcctgaaagccacaatgagaatgatgcacactgaggccttgtgtcctttaatcactgcatttcattttgattttggataataaacctgggctcagcctgagcctctgcttc

SEQ ID NO: 12480 - DNA, 1094 bp, Homo sapiens
ccgcgctcagcgccttcactgccatccccgctgtccttgccgcccccgccatgggcctagagctgtttcttgacctggtgtcccagcccagccgcgccgtctacatcttcgccaagaagaatggcatccccttagagctgcgcaccgtggatttggtcaaagggcagcacaagagcaaggagttcttgcagatcaacagcctggggaaactgccgacgctcaaggatggtgatttcatcttgaccgaaagctcggccatcctgatttacctgagctgtaagtaccagacgccggaccactggtatccatctgacctgcaggctcgtgcccgtgttcatgagtacctgggctggcatgccgactgcatccgtggcacctttggtatacccctgtgggtccaggtgttggggccactcattggggtccaggtgcccaaggagaaggtggaacgcaacaggactgccatggaccaggccctgcaatggctggaggacaagttcctgggggacaggcccttcctcgctggccagcaggtgacactggctgatctcatggccctggaggagctgatgcagccggtggctctcggctatgaactgtttgagggacggccacgactggcagcatggcgtggacgagtggaggctttcctgggtgctgagctatgccaggaggcccacagcatcatcttgagcatcctggaacaggcggccaagaaaaccctcccaacaccctcaccagaggcctatcaggctatgctgcttcgaatcgccaggatcccctgaagggtctgggatgggggccaggagattagcaacaaggattcattctgttacttacttgcccctttttatctttccctcttgccccagtcccttctctccagcttcatgtgaagctctgcacagacaagacactcagtgtccttggcagtgctgctactcctcaggtgcagcatacataaccagtaagagactaaatctgcaatatataaagagctcctacaaatcagtaacatgaagaacactcaaaaattggcaaatgtcatcagtgttttaaacagaataaagattccaaacactttgaatagagaa

SEQ ID NO: 12481 - DNA, 1919 bp, Homo sapiens
aagcgcactgggtcgcatcgaggccccgccccctgagcctgggtagcggcgcgagggccgggagaaccgttcgcggaggaaaggcgaactagtgttgggatggccaccaactgggggagcctcttgcaggataaacagcagctagaggagctggcacggcaggccgtggaccgggccctggctgagggagtattgctgaggacctcacaggagcccacttcctcggaggtggtgagctatgccccattcacgctcttcccctcactggtccccagtgccctgctggagcaagcctatgctgtgcagatggacttcaacctgctagtggatgctgtcagccagaacgctgccttcctggagcaaactctttccagcaccatcaaacaggatgactttaccgctcgtctctttgacatccacaagcaagtcctaaaagagggcattgcccagactgtgttcctgggcctgaatcgctcagactacatgttccagcgcagcgcagatggctccccagccctgaaacagatcgaaatcaacaccatctctgccagctttgggggcctggcctcccggaccccagctgtgcaccgacatgttctcagtgtcctgagtaagaccaaagaagctggcaagatcctctctaataatcccagcaagggactggccctgggaattgccaaagcctgggagctctacggctcacccaatgctctggtgctactgattgctcaagagaaggaaagaaacatatttgaccagcgtgccatagagaatgagctactggccaggaacatccatgtgatccgacgaacatttgaagatatctctgaaaaggggtctctggaccaagaccgaaggctgtttgtggatggccaggaaattgctgtggtttacttccgggatggctacatgcctcgtcagtacagtctacagaattgggaagcacgtctactgctggagaggtcacatgctgccaagtgcccagacattgccacccagctggctgggactaagaaggtgcagcaggagctaagcaggccgggcatgctggagatgttgctccctggccagcctgaggctgtggcccgcctccgcgccacctttgctggcctctactcactggatgtgggtgaagaaggggaccaggccatcgccgaggcccttgctgcccctagccggtttgtgctaaagccccagagagagggtggaggtaacaacctatatggggaggaaatggtacaggccctgaaacagctgaaggacagtgaggagagggcctcctacatcctcatggagaagatcgaacctgagccttttgagaattgcctgctacggcctggcagccctgcccgagtggtccagtgcatttcagagctgggcatctttggggtctatgtcaggcaggaaaagacactcgtgatgaacaagcacgtggggcatctacttcgaaccaaagccatcgagcatgcagatggtggtgtggcagcgggagtggcagtcctggacaacccataccctgtgtgagggcacaaccaggccacgggaccttctatcctctgtatttgtcattcctctcctagccctcctgaggggtatcctcctaaagacctccaaagtttttatggaagggtaaatactggtaccttcccccagctttccatctgaggaccagaaaagttgtgtctcccttagatgagatctagacgcccccaaatccttgagatgtgggtatagctcagggtaagctgctctgaggtaaaggtccatgaaccctgccccactcctgtcagcccctcatcagccttttcagcaggttccagtgcctgacttgggataggactgagtggtaggaggagggggagtggaggggcatagcctttccctaattctgccttaaataaaactgcattgctgattca

SEQ ID NO: 12482 - DNA, 1092 bp, Homo sapiens
atggccaccaactgggggagcctcttgcaggataaacagcagctagaggagctggcacggcaggccgtggaccgggccctggctgagggagtattgctgaggacctcacaggagcccacttcctcggaggtggtgagctatgccccattcacgctcttcccctcactggtccccagtgccctgctggagcaagcctatgctgtgcagatggacttcaacctgctagtggatgctgtcagccagaacgctgccttcctggagcaaactctttccagtgctctggtgctactgattgctcaagagaaggaaagaaacatatttgaccagcgtgccatagagaatgagctactggccaggaacatccatgtgatccgacgaacatttgaagatatctctgaaaaggggtctctggaccaagaccgaaggctgtttgtggatggccaggaaattgctgtggtttacttccgggatggctacatgcctcgtcagtacagtctacagaattgggaagcacgtctactgctggagaggtcacatgctgccaagtgcccagacattgccacccagctggctgggactaagaaggtgcagcaggagctaagcaggccgggcatgctggagatgttgctccctggccagcctgaggctgtggcccgcctccgcgccacctttgctggcctctactcactggatgtgggtgaagaaggggaccaggccatcgccgaggcccttgctgcccctagccggtttgtgctaaagccccagagagagggtggaggtaacaacctatatggggaggaaatggtacaggccctgaaacagctgaaggacagtgaggagagggcctcctacatcctcatggagaagatcgaacctgagccttttgagaattgcctgctacggcctggcagccctgcccgagtggtccagtgcatttcagagctgggcatctttggggtctatgtcaggcaggaaaagacactcgtgatgaacaagcacgtggggcatctacttcgaaccaaagccatcgagcatgcagatggtggtgtggcagcgggagtggcagtcctggacaacccataccctgtgtga

SEQ ID NO: 12483 - DNA, 1780 bp, Homo sapiens
agtaaccaaatcaaaatcaaaaggcaaggaaactggagtgtgagctcctgatgcatggaagggcctgggcttgaacatcaaccagcaaggagcaggcttccatgtggtgagctatgccccattcacgctcttcccctcactggtccccagtgccctgctggagcaagcctatgctgtgcagatggacttcaacctgctagtggatgctgtcagccagaacgctgccttcctggagcaaactctttccagcaccatcaaacaggatgactttaccgctcgtctctttgacatccacaagcaagtcctaaaagagggcattgcccaggtaaccattcccagccctactccagtctgtaacctgtccctcccatctctgtttgttttctgttttgcttgaagaatttggtccaggccctcagctcatgggaatctgcctctcactggtcctcactgggtttatcccagtgaccaattctaggatgaccagaagaatgattccactgggcttgggagtgtttgctggtacctctaatctctgtgtagagttcatggtacctgtgtgctctgtggctaggtcctcagagtcagtccctgggcaggtactgtcagccttcagttttccccacagactgtgttcctgggcctgaatcgctcagactacatgttccagcgcagcgcagatggctccccagccctgaaacagatcgaaatcaacaccatctctgccagctttgggggcctggcctcccggaccccagctgtgcaccgacatgttctcagtgtcctgagtaagaccaaagaagctggcaagatcctctctaataatcccagcaagggactggccctgggaattgccaaagcctgggagctctacggctcacccaatgctctggtgctactgattgctcaagagaaggaaagaaacatatttgaccagcgtgccatagagaatgagctactggccaggaacatccatgtgatccgacgaacatttgaagatatctctgaaaaggggtctctggaccaagaccgaaggctgtttgtggatggccaggaaattgctgtggtttacttccgggatggctacatgcctcgtcagtacagtctacagaattgggaagcacgtctactgctggagaggtcacatgctgccaagtgcccagacattgccacccagctggctgggactaagaaggtgcagcaggagctaagcaggccgggcatgctggagatgttgctccctggccagcctgaggctgtggcccgcctccgcgccacctttgctggcctctactcactggatgtgggtgaagaaggggaccaggccatcgccgaggcccttgctgcccctagccggtttgtgctaaagccccagagagagggtggaggtaacaacctatatggggaggaaatggtacaggccctgaaacagctgaaggacagtgaggagagggcctcctacatcctcatggagaagatcgaacctgagccttttgagaattgcctgctacggcctggcagccctgcccgagtggtccagtgcatttcagagctgggcatctttggggtctatgtcaggcaggaaaagacactcgtgatgaacaagcacgtggggcatctacttcgaaccaaagccatcgagcatgcagatggtggtgtggcagcgggagtggcagtcctggacaacccataccctgtgtgagggcacaaccaggccacgggaccttctatcctctgtatttgtcattcctctcctagccctcctgaggggtatcctcct

SEQ ID NO: 12484 - DNA, 1338 bp, Homo sapiens
agagcatgtcgggaccgggagggccggccggcccggggcgggggggactgggcaggaggggtcgggctcagggaactgcaactcccagcagcccccaggtacggggcgtggcgggagagctgggcgagccagaggcgaccggaaggatctttctagtccagcccctcgctttacccggacgaaagacacgggcctgattcgtcgagtctcactgagccttagtcgtcggcaggtcccaggcgcgaagtttctcggcctggaggagggggtcgcgcgaagtgccagatgcaggcggggaagcccatcctctattcctatttccgaagctcctgctcatggagagttcgaattgctctggccttgaaaggcatcgactacgagacggtgcccatcaatctcataaaggatgggggccaacagttttctaaggacttccaggcactgaatcctatgaagcaggtgccaaccctgaagattgatggaatcaccattcaccagtcactggccatcattgagtatctagaggagatgcgtcccactccgcgacttctgcctcaggacccaaagaagagggccagcgtgcgtatgatttctgacctcatcgctggtggcatccagcccctgcagaacctgtctgtcctgaagcaagtgggagaggagatgcagctgacctgggcccagaacgccatcacttgtggctttaacgccctggagcagatcctacagagcacagcgggcatatactgtgtaggagacgaggtgaccatggctgatctgtgcttggtgcctcaggtggcaaatgctgaaagattcaaggtggatctcaccccctaccctaccatcagctccatcaacaagaggctgctggtcttggaggccttccaggtgtctcacccctgccggcagccagatacacccactgagctgagggcctagctcccaaatcctgccccgttggcacagggccacaggagcagaagctgggtgggctgaagaggcctggaaacgagagtcttaattgaggagatgggagactcgaactctagccctggatctgccttcctgctgaaacttgttccacctcagtcccctcatctgtcacacgcatgtggggtggagtagggagatgcggggagcagggtgggcaggaatactgttatctatgtgacggggcagtcgtgaggctgagatgagaatgcggattaaaatgcctggcgtgctcaccgtaacaccacggggaaggctgtgtgccttttctcatccgcttttgttgtgtgtgactccaaagaatgcccgcgctgaaatttggcgtgaattaaactgaagcccaggcctcta

SEQ ID NO: 12485 - DNA, 867 bp, Homo sapiens
gaaggatctttctagtccagcccctcgctttacccggacgaaagacacgggcctgattcgtcgagtctcactgagccttagtcgtcggcaggtcccaggcgcgaagtttctcggcctggaggagggggtcgcgcgaagtgccagatgcaggcggggaagcccatcctctattcctatttccgaagctcctgctcatggagagttcgaattgctctggccttgaaaggcatcgactacgagacggtgcccatcaatctcataaaggatgggggccaacagttttctaaggacttccaggcactgaatcctatgaagcaggtgccaaccctgaagattgatggaatcaccattcaccagtcaaacctgtctgtcctgaagcaagtgggagaggagatgcagctgacctgggcccagaacgccatcacttgtggctttaacgccctggagcagatcctacagagcacagcgggcatatactgtgtaggagacgaggtgaccatggctgatctgtgcttggtgcctcaggtggcaaatgctgaaagattcaaggtggatctcaccccctaccctaccatcagctccatcaacaagaggctgctggtcttggaggccttccaggtgtctcacccctgccggcagccagatacacccactgagctgagggcctagctcccaaatcctgccccgttggcacagggccacaggagcagaagctgggtgggctgaagaggcctggaaacgagagtcttaattgaggagatgggagactcgaactctagccctggatctgccttcctgctgaaacttgttccacctcagtcccctcatctgtcacacgcatgtggggtggagtagggagatgcgggg

SEQ ID NO: 12486 - DNA, 1010 bp, Homo sapiens
gggagagctgggcgagccagaggcgaccggaaggatctttctagtccagcccctcgctttacccggacgaaagacacgggcctgattcgtcgagtctcactgagccttagtcgtcggcaggtcccaggcgcgaagtttctcggcctggaggagggggtcgcgcgaagtgccagatgcaggcggggaagtggtcaccagcagtccctgtcccttggcaccaggagtccctgtagcctggctaggtaaggaaagggagttgcatctccaaataaggaagatccagttgtggccacccaattcctcctcttcgaaagacactttctgcccatcacctgctttctgtgccaggaccatctttactttctccacaaaagcccatcctctattcctatttccgaagctcctgctcatggagagttcgaattgctctggccttgaaaggcatcgactacgagacggtgcccatcaatctcataaaggatgggggccaacagttttctaaggacttccaggcactgaatcctatgaagcaggtgccaaccctgaagattgatggaatcaccattcaccagtcactggccatcattgagtatctagaggagatgcgtcccactccgcgacttctgcctcaggacccaaagaagagggccagcgtgcgtatgatttctgacctcatcgctggtggcatccagcccctgcagaacctgtctgtcctgaagcaagtgggagaggagatgcagctgacctgggcccagaacgccatcacttgtggctttaacgccctggagcagatcctacagagcacagcgggcatatactgtgtaggagacgaggtgaccatggctgatctgtgcttggtgcctcaggtggcaaatgctgaaagattcaaggtggatctcaccccctaccctaccatcagctccatcaacaagaggctgctggtcttggaggccttccaggtgtctcacccctgccggcagccagatacacccactgagctgagggcctag

SEQ ID NO: 12487 - DNA, 1424 bp, Homo sapiens
ccgggagggttgggccagaggaggcggtcctggtagggagtgcgtagcagggtggagtcgctgtccggtcgcgcttcacttctgctccgccctccctgctccccataacagacccctccctccactaaggcttccaaacgtcgccccaagcctcccaatttctcgcagcccttcatgctcttctcttggccctagcaggagtggtcaccagcagtccctgtcccttggcaccaggagtccctgtagcctggctaggtaaggaaagggagttgcatctccaaataaggaagatccagttgtggccacccaattcctcctcttcgaaagacactttctgcccatcacctgctttctgtgccaggaccatctttactttctccacaaaagcccatcctctattcctatttccgaagctcctgctcatggagagttcgaattgctctggccttgaaaggcatcgactacgagacggtgcccatcaatctcataaaggatgggggccaacagttttctaaggacttccaggcactgaatcctatgaagcaggtgccaaccctgaagattgatggaatcaccattcaccagtcactggccatcattgagtatctagaggagatgcgtcccactccgcgacttctgcctcaggacccaaagaagagggccagcgtgcgtatgatttctgacctcatcgctggtggcatccagcccctgcagaacctgtctgtcctgaagcaagtgggagaggagatgcagctgacctgggcccagaacgccatcacttgtggctttaacgccctggagcagatcctacagagcacagcgggcatatactgtgtaggagacgaggtgaccatggctgatctgtgcttggtgcctcaggtggcaaatgctgaaagattcaaggtggatctcaccccctaccctaccatcagctccatcaacaagaggctgctggtcttggaggccttccaggtgtctcacccctgccggcagccagatacacccactgagctgagggcctagctcccaaatcctgccccgttggcacagggccacaggagcagaagctgggtgggctgaagaggcctggaaacgagagtcttaattgaggagatgggagactcgaactctagccctggatctgccttcctgctgaaacttgttccacctcagtcccctcatctgtcacacgcatgtggggtggagtagggagatgcggggagcagggtgggcaggaatactgttatctatgtgacggggcagtcgtgaggctgagatgagaatgcggattaaaatgcctggcgtgctcaccgtaacaccacggggaaggctgtgtgccttttctcatccgcttttgttgtgtgtgactccaaagaatgcccgcgctgaaatttggcgtgaattaaactgaagcccaggcctct

SEQ ID NO: 12488 - DNA, 714 bp, Homo sapiens
ccgggagggttgggccagaggaggcggtcctggtagggagtgcgtagcagggtggagtcgctgtccggtcgcgcttcacttctgctccgccctccctgctccccataacagacccctccctccactaaggcttccaaacgtcgccccaagcctcccaatttctcgcagcccttcatgctcttctcttggccctagcaggagtggtcaccagcagtccctgtcccttggcaccaggagtccctgtagcctggctaggtaaggaaagggagttgcatctccaaataaggaagatccagttgtggccacccaattcctcctcttcgaaagacactttctgcccatcacctgctttctgtgccaggaccatctttactttctccacaaaagcccatcctctattcctatttccgaagctcctgctcatggagagttcgaattgctctggccttgaaaggcatcgactacgagacggtgcccatcaatctcataaaggatgggggccaacagttttctaaggacttccaggcactgaatcctatgaagcaggtgccaaccctgaagattgatggaatcaccattcaccagtcactggccatcattgagtatctagaggagatgcgtcccactccgcgacttctgcctcaggacccaaagaagagggccagcgtgcgtatgatttctgacctcatcgctggtggcatccagcccctgcag

SEQ ID NO: 12489 - DNA, 564 bp, Homo sapiens
acatttcctgggaggctgagggtcaccacgataccatgacagagtctggcaaggtatggaaggcactctcaggctagctgcccctttgggggcctcttggacctcaggagctcaaaccagcataattttggagccaagggacctcatgagcctctcagagagcttggagtctgccctgatttgcacagatgcaggcctgagagaggaggcctggcaggacaggaagaaatggttgactcctcccaagctggagcccacccagcatgggttaacacgcgccttcatcctctctctcctcagcccatcctctattcctatttccgaagctcctgctcatggagagttcgaattgctctggccttgaaaggcatcgactacgagacggtgcccatcaatctcataaaggatgggggccaacagttttctaaggacttccaggcactgaatcctatgaagcaggtgccaaccctgaagattgatggaatcaccattcaccagtcactggccatcattgagtatctagaggagatgcgtcccactccgcgacttctgcctcaggaccca

SEQ ID NO: 12490 - DNA, 873 bp, Homo sapiens
gaccggaaggatctttctagtccagcccctcgctttacccggacgaaagacacgggcctgattcgtcgagtctcactgagccttagtcgtcggcaggtcccaggcgcgaagtttctcggcctggaggagggggtcgcgcgaagtgccagatgcaggcggggaagctctggccttgaaaggcatcgactacgagacggtgcccatcaatctcataaaggatgggggccaacagttttctaaggacttccaggcactgaatcctatgaagcaggtgccaaccctgaagattgatggaatcaccattcaccagtcactggccatcattgagtatctagaggagatgcgtcccactccgcgacttctgcctcaggacccaaagaagagggccagcgtgcgtatgatttctgacctcatcgctggtggcatccagcccctgcagaacctgtctgtcctgaagcaagtgggagaggagatgcagctgacctgggcccagaacgccatcacttgtggctttaacgccctggagcagatcctacagagcacagcgggcatatactgtgtaggagacgaggtgaccatggctgatctgtgcttggtgcctcaggtggcaaatgctgaaagattcaaggtggatctcaccccctaccctaccatcagctccatcaacaagaggctgctggtcttggaggccttccaggtgtctcacccctgccggcagccagatacacccactgagctgagggcctagctcccaaatcctgccccgttggcacagggccacaggagcagaagctgggtgggctgaagaggcctggaaacgagagtcttaattgaggagatgggagactcgaactctagccctggatctgcctt

SEQ ID NO: 12491 - DNA, 1875 bp, Homo sapiens
gggggaagtgggggctgggaaggaaccacgggcccccgcccgaggcccatgggcccctcctaggcctttgcctgagcagtccggtgtcactaccgcagagcctcgaggagaagttccccaactttcccgcctctcagcctttgaaagaaagaaaggggagggggcaggccgcgtgcagccgcgagcggtgctgggctccggctccaattccccatctcagtcgttcccaaagtcctcctgtttcatccaagcgtgtaagggtccccgtccttgactccctagtgtcctgctgcccacagtccagtcctgggaaccagcaccgatcacctcccatcgggccaatctcagtcccttcccccctacgtcggggcccacacgctcggtgcgtgcccagttgaaccaggcggctgcggaaaaaaaaaagcggggagaaagtagggcccggctactagcggttttacgggcgcacgtagctcaggcctcaagaccttgggctgggactggctgagcctggcgggaggcggggtccgagtcaccgcctgccgccgcgcccccggtttctataaattgagcccgcagcctcccgcttcgctctctgctcctcctgttcgacagtcagccgcatcttcttttgcgtcgccagccgagccacatcgctcagacaccatggggaaggtgaaggtcggagtcaacggatttggtcgtattgggcgcctggtcaccagggctgcttttaactctggtaaagtggatattgttgccatcaatgaccccttcattgacctcaactacatggtttacatgttccaatatgattccacccatggcaaattccatggcaccgtcaaggctgagaacgggaagcttgtcatcaatggaaatcccatcaccatcttccaggagcgagatccctccaaaatcaagtggggcgatgctggcgctgagtacgtcgtggagtccactggcgtcttcaccaccatggagaaggctggggctcatttgcaggggggagccaaaagggtcatcatctctgccccctctgctgatgcccccatgttcgtcatgggtgtgaaccatgagaagtatgacaacagcctcaagatcatcagcaatgcctcctgcaccaccaactgcttagcacccctggccaaggtcatccatgacaactttggtatcgtggaaggactcatgaccacagtccatgccatcactgccacccagaagactgtggatggcccctccgggaaactgtggcgtgatggccgcggggctctccagaacatcatccctgcctctactggcgctgccaaggctgtgggcaaggtcatccctgagctgaacgggaagctcactggcatggccttccgtgtccccactgccaacgtgtcagtggtggacctgacctgccgtctagaaaaacctgccaaatatgatgacatcaagaaggtggtgaagcaggcgtcggagggccccctcaagggcatcctgggctacactgagcaccaggtggtctcctctgacttcaacagcgacacccactcctccacctttgacgctggggctggcattgccctcaacgaccactttgtcaagctcatttcctggtatgacaacgaatttggctacagcaacagggtggtggacctcatggcccacatggcctccaaggagtaagacccctggaccaccagccccagcaagagcacaagaggaagagagagaccctcactgctggggagtccctgccacactcagtcccccaccacactgaatctcccctcctcacagttgccatgtagaccccttgaagaggggaggggcctagggagccgcaccttgtcatgtaccatcaataaagtaccctgtgctcaacca

SEQ ID NO: 12492 - DNA, 1266 bp, Homo sapiens
tgttcgacagtcagccgcatcttcttttgcgtcgccagccgagccacatcgctcagacaccatggggaaggtgaaggtcggagtcaacggatttggtcgtattgggcgcctggtcaccagggctgcttttaactctggtaaagtggatattgttgccatcaatgaccccttcattgacctcaactacatggtttacatgttccaatatgattccacccatggcaaattccatggcaccgtcaaggctgagaacgggaagcttgtcatcaatggaaatcccatcaccatcttccaggagtgagtggaagacagaatggaagaaatgcgagatccctccaaaatcaagtggggcgatgctggcgctgagtacgtcgtggagtccactggcgtcttcaccaccatggagaaggctggggctcatttgcaggggggagccaaaagggtcatcatctctgccccctctgctgatgcccccatgttcgtcatgggtgtgaaccatgagaagtatgacaacagcctcaagatcatcagcaatgcctcctgcaccaccaactgcttagcacccctggccaaggtcatccatgacaactttggtatcgtggaaggactcatgaccacagtccatgccatcactgccacccagaagactgtggatggcccctccgggaaactgtggcgtgatggccgcggggctctccagaacatcatccctgcctctactggcgctgccaaggctgtgggcaaggtcatccctgagctgaacgggaagctcactggcatggccttccgtgtccccactgccaacgtgtcagtggtggacctgacctgccgtctagaaaaacctgccaaatatgatgacatcaagaaggtggtgaagcaggcgtcggagggccccctcaagggcatcctgggctacactgagcaccaggtggtctcctctgacttcaacagcgacacccactcctccacctttgacgctggggctggcattgccctcaacgaccactttgtcaagctcatttcctggtatgacaacgaatttggctacagcaacagggtggtggacctcatggcccacatggcctccaaggagtaagacccctggaccaccagccccagcaagagcacaagaggaagagagagaccctcactgctggggagtccctgccacactcagtcccccaccacactgaatctcccctcctcacagttgccatgtagaccccttgaagaggggaggggcctagggagccgcaccttgtcatg

SEQ ID NO: 12493 - DNA, 1292 bp, Homo sapiens
tgcaaccgggaaggaaatgaatgggcagccgttaggaaagcctgccggtgactaaccctgcgctcctgcctcgatgggtggagtcgcgtgtggcggggaagtcaggtggagcgaggctagctggcccgatttctcctccgggtgatgcttttcctagattattctctgatttggtcgtattgggcgcctggtcaccagggctgcttttaactctggtaaagtggatattgttgccatcaatgaccccttcattgacctcaactacatggtttacatgttccaatatgattccacccatggcaaattccatggcaccgtcaaggctgagaacgggaagcttgtcatcaatggaaatcccatcaccatcttccaggagcgagatccctccaaaatcaagtggggcgatgctggcgctgagtacgtcgtggagtccactggcgtcttcaccaccatggagaaggctggggctcatttgcaggggggagccaaaagggtcatcatctctgccccctctgctgatgcccccatgttcgtcatgggtgtgaaccatgagaagtatgacaacagcctcaagatcatcagcaatgcctcctgcaccaccaactgcttagcacccctggccaaggtcatccatgacaactttggtatcgtggaaggactcatgaccacagtccatgccatcactgccacccagaagactgtggatggcccctccgggaaactgtggcgtgatggccgcggggctctccagaacatcatccctgcctctactggcgctgccaaggctgtgggcaaggtcatccctgagctgaacgggaagctcactggcatggccttccgtgtccccactgccaacgtgtcagtggtggacctgacctgccgtctagaaaaacctgccaaatatgatgacatcaagaaggtggtgaagcaggcgtcggagggccccctcaagggcatcctgggctacactgagcaccaggtggtctcctctgacttcaacagcgacacccactcctccacctttgacgctggggctggcattgccctcaacgaccactttgtcaagctcatttcctggtatgacaacgaatttggctacagcaacagggtggtggacctcatggcccacatggcctccaaggagtaagacccctggaccaccagccccagcaagagcacaagaggaagagagagaccctcactgctggggagtccctgccacactcagtcccccaccacactgaatctcccctcctcacagttgccatgtagaccccttgaagaggggaggg

SEQ ID NO: 12494 - DNA, 1256 bp, Homo sapiens
aggcgtgtgtgtcggccggggccactaggcgctcactgttctctccctccgcgcagccgagccacatcgctcagacaccatggggaaggtgaaggtcggagtcaacggatttggtcgtattgggcgcctggtcaccagggctgcttttaactctggtaaagtggatattgttgccatcaatgaccccttcattgacctcaactacatggtttacatgttccaatatgattccacccatggcaaattccatggcaccgtcaaggctgagaacgggaagcttgtcatcaatggaaatcccatcaccatcttccaggagcgagatccctccaaaatcaagtggggcgatgctggcgctgagtacgtcgtggagtccactggcgtcttcaccaccatggagaaggctggggctcatttgcaggggggagccaaaagggtcatcatctctgccccctctgctgatgcccccatgttcgtcatgggtgtgaaccatgagaagtatgacaacagcctcaagatcatcagcaatgcctcctgcaccaccaactgcttagcacccctggccaaggtcatccatgacaactttggtatcgtggaaggactcatgaccacagtccatgccatcactgccacccagaagactgtggatggcccctccgggaaactgtggcgtgatggccgcggggctctccagaacatcatccctgcctctactggcgctgccaaggctgtgggcaaggtcatccctgagctgaacgggaagctcactggcatggccttccgtgtccccactgccaacgtgtcagtggtggacctgacctgccgtctagaaaaacctgccaaatatgatgacatcaagaaggtggtgaagcaggcgtcggagggccccctcaagggcatcctgggctacactgagcaccaggtggtctcctctgacttcaacagcgacacccactcctccacctttgacgctggggctggcattgccctcaacgaccactttgtcaagctcatttcctggtatgacaacgaatttggctacagcaacagggtggtggacctcatggcccacatggcctccaaggagtaagacccctggaccaccagccccagcaagagcacaagaggaagagagagaccctcactgctggggagtccctgccacactcagtcccccaccacactgaatctcccctcctcacagttgccatgtagaccccttgaagaggggaggggcctagggagccgcaccttgtcat

SEQ ID NO: 12495 - DNA, 1348 bp, Homo sapiens
ttcgacagtcagccgcatcttcttttgcgtcgccaggtgaagacgggcggagagaaacccgggaggctagggacggcctgaaggcggcaggggcgggcgcaggccggatgtgttcgcgccgctgcgggccgagccacatcgctcagacaccatggggaaggtgaaggtcggagtcaacggatttggtcgtattgggcgcctggtcaccagggctgcttttaactctggtaaagtggatattgttgccatcaatgaccccttcattgacctcaactacatggtttacatgttccaatatgattccacccatggcaaattccatggcaccgtcaaggctgagaacgggaagcttgtcatcaatggaaatcccatcaccatcttccaggagcgagatccctccaaaatcaagtggggcgatgctggcgctgagtacgtcgtggagtccactggcgtcttcaccaccatggagaaggctggggctcatttgcaggggggagccaaaagggtcatcatctctgccccctctgctgatgcccccatgttcgtcatgggtgtgaaccatgagaagtatgacaacagcctcaagatcatcagcaatgcctcctgcaccaccaactgcttagcacccctggccaaggtcatccatgacaactttggtatcgtggaaggactcatgaccacagtccatgccatcactgccacccagaagactgtggatggcccctccgggaaactgtggcgtgatggccgcggggctctccagaacatcatccctgcctctactggcgctgccaaggctgtgggcaaggtcatccctgagctgaacgggaagctcactggcatggccttccgtgtccccactgccaacgtgtcagtggtggacctgacctgccgtctagaaaaacctgccaaatatgatgacatcaagaaggtggtgaagcaggcgtcggagggccccctcaagggcatcctgggctacactgagcaccaggtggtctcctctgacttcaacagcgacacccactcctccacctttgacgctggggctggcattgccctcaacgaccactttgtcaagctcatttcctggtatgacaacgaatttggctacagcaacagggtggtggacctcatggcccacatggcctccaaggagtaagacccctggaccaccagccccagcaagagcacaagaggaagagagagaccctcactgctggggagtccctgccacactcagtcccccaccacactgaatctcccctcctcacagttgccatgtagaccccttgaagaggggaggggcctagggagccgcaccttgtcatgtaccatcaataaagtaccc

SEQ ID NO: 12496 - DNA, 926 bp, Homo sapiens
ctctgctcctcctgttcgacagtcagccgcatcttcttttgcgtcgccagccgagccacatcgctcagacaccatggggaaggtgaaggtcggagtcaacggatttggtcgtattgggcgcctggtcaccagggctgcttttaactctggtaaagtggatattgttgccatcaatgaccccttcattgacctcaactacatggtttacatgttccaatatgattccacccatggcaaattccatggcaccgtcaaggctgagaacgggaagcttgtcatcaatggaaatcccatcaccatcttccaggagcgagatccctccaaaatcaagtggggcgatgctggcgctgagtacgtcgtggagtccactggcgtcttcaccaccatggagaaggctggggctcatttgcaggggggagccaaaagggtcatcatctctgccccctctgctgatgcccccatgttcgtcatgggtgtgaaccatgagaagtatgacaacagcctcaagatcatcagcaatgcctcctgcaccaccaactgcttagcacccctggccaaggtcatccatgacaactttggtatcgtggaaggactcatgaccacagtccatgccatcactgccacccaacgggaagctcactggcatggccttccgtgtccccactgccaacgtgtcagtggtggacctgacctgccgtctagaaaaacctgccaaatatgatgacatcaagaaggtggtgaagcaggcgtcggagggccccctcaagggcatcctgggctacactggggagtccctgccacactcagtcccccaccacactgaatctcccctcctcacagttgccatgtagaccccttgaagaggggaggggcctagggagccgcaccttgtcatgtaccatcaataaagtaccctgtgctcaacc

SEQ ID NO: 12497 - DNA, 1492 bp, Homo sapiens
gtcactgggtgctgtgacatcagggcaattagcccaggacccacagccctggcgctccgcacgcacctcggtaacatcacagcaggtccaggccaatgataaccttataagaggccatgtcgaagcgcgacatcgtcctcaccaatgtcaccgttgtccagttgctgcgacagccgtgcccggtgaccagagcaccgcccccacctgagcctaaggctgaagtagagccccagccacaaccagagcccacaccagtcagggaggaaataaagccaccaccgccaccactgcctcctcaccccgctactcctcctcctaagatggtgtctgtggcccgggagctgactgtgggcatcaatggatttggacgcatcggtcgcctggtcctgcgcgcctgcatggagaagggtgttaaggtggtggctgtgaatgatccattcattgacccggaatacatggtgtacatgtttaagtatgactccacccacggccgatacaagggaagtgtggaattcaggaatggacaactggtcgtggacaaccatgagatctctgtctaccagtgcaaagagcccaaacagatcccctggagggctgtcgggagcccctacgtggtggagtccacaggcgtgtacctctccatacaggcagcttcggaccacatctctgcaggtgctcaacgtgtggtcatctccgcgccctcaccggatgcaccaatgttcgtcatgggtgtcaatgaaaatgactataaccctggctccatgaacattgtgagcaacgcgtcctgcaccaccaactgtttggctcccctcgccaaagtcatccacgagcgatttgggatcgtggaagggttgatgaccacagtccattcctacacggccacccagaagacagtggacgggccatcaaggaaggcctggcgagatgggcggggtgcccaccagaacatcatcccagcctccactggggctgcgaaagctgtgaccaaagtcatcccagagctcaaagggaagctgacagggatggcgttccgggtaccaaccccggatgtgtctgtcgtggacctgacctgccgcctcgcccagcctgccccctactcagccatcaaggaggctgtaaaagcagcagccaaggggcccatggctggcatccttgcctacaccgaggatgaggtcgtctctacggacttcctcggtgatacccactcgtccatcttcgatgctaaggccggcattgcgctcaatgacaatttcgtgaagctcatttcatggtacgacaacgaatatggctacagtcaccgggtggtcgacctcctccgctacatgttcagccgagacaagtgaaacgggaaggtcctttctttccttcccaggggccggggccggaacatgtgcctcccgttccagcatctggctgcccgggggaggaaggacacccggggcgggcgccccacgccgatgggtccatggtgaaataaaaaacagtgctcacg

SEQ ID NO: 12498 - DNA, 1200 bp, Homo sapiens
caccccctagtacttccgttctccagcgctgggcaccgcggccggagctgtgggctggcagccatgggtgccaggcagtgctgagagcagtggggcatggctgcagccctgcaggtcctgccccgcttggcccgagcccccttgcatccactcctctggcggggctcagtggcccgtctggccagcagcatggccttggcagagcaggccaggcagctgtttgagagtgctgtaggtgcagtgctgccgggccccatgctgcaccgggcactatccttggaccctggtggcagacagctgaaggtgcgggaccggaactttcagctgaggcaaaacctctacctggtgggctttggcaaggctgtgctgggtatggcagctgcagctgaggaactactgggccagcatcttgtgcagggcgtgatcagcgttcccaaggggatccgtgctgccatggagcgtgccggcaagcaggagatgctgctgaagccacatagccgtgtccaggtattcgagggtgcggaggacaacctcccggaccgcgatgcgctgcgggctgcactggccatccagcaactggctgagggactcacagctgatgacctgctgctcgtgctgatctcaggtgggggttcagctctgctgcctgcccccatcccacctgtcacactggaggagaagcagacactcactagactgctggcagcccgtggagccaccatccaggagttgaacaccattcggaaggccctgtcccagctcaagggtggggggctggctcaggccgcctaccctgcccaggtggtgagcctcatcctgtcagatgtggtgggggaccctgtggaggtgattgccagtggccccaccgtggccagttcccacaatgtgcaagattgcctgcatatcctcaatcgctacggcctccgtgcagccctgccacgttctgtgaagactgtgctgtctcgggccgactctgacccccatgggccacacacctgtggccatgtcctgaatgtgatcattggctctaatgtgctggcgctagctgaggcccagcggcaggccgaggcactgggctaccaggctgtggtgctgagtgcagccatgcaagggtggggcacacctgctgcacacagggatgacaggtaccaatgtcatggacacccacctcttgttcctgcggcctcggtgatggcatag

SEQ ID NO: 12499 - DNA, 3622 bp, Homo sapiens
caccccctagtacttccgttctccagcgctgggcaccgcggccggagctgtgggctggcagccatgggtgccaggcagtgctgagagcagtggggcatggctgcagccctgcaggtcctgccccgcttggcccgagcccccttgcatccactcctctggcggggctcagtggcccgtctggccagcagcatggccttggcagagcaggccaggcagctgtttgagagtgctgtaggtgcagtgctgccgggccccatgctgcaccgggcactatccttggaccctggtggcagacagctgaaggtgcgggaccggaactttcagctgaggcaaaacctctacctggtgggctttggcaaggctgtgctgggtatggcagctgcagctgaggaactactgggccagcatcttgtgcagggcgtgatcagcgttcccaaggggatccgtgctgccatggagcgtgccggcaagcaggagatgctgctgaagccacatagccgtgtccaggtattcgagggtgcggaggacaacctcccggaccgcgatgcgctgcgggctgcactggccatccagcaactggctgagggactcacagctgatgacctgctgctcgtgctgatctcaggtggtgagcctcatcctgtcagatgtggtgggggaccctgtggaggtgattgccagtggccccaccgtggccagttcccacaatgtgcaagattgcctgcatatcctcaatcgctacggcctccgtgcagccctgccacgttctgtgaagactgtgctgtctcgggccgactctgacccccatgggccacacacctgtggccatgtcctgaatgtgatcattggctctaatgtgctggcgctagctgaggcccagcggcaggccgaggcactgggctaccaggctgtggtgctgagtgcagccatgcaaggtgatgtaaaaagtatggcccagttctacgggctgctggcccatgtggctagaacccgcctcaccccatccatggctggggcttctgtggaggaagatgcacagctccatgagctggcagctgagcttcagatcccagacctgcagctggaggaggctctggagaccatggcatggggaaggggcccagtctgcctgctggctggtggcgagcccacagtacagctgcagggctcgggcaggggtggccggaaccaggaactggccctgcgtgttggagcagagttgagaaggtggccgctggggccgatagatgtgctgtttttgagcggtggcaccgatgggcaggatgggcccacagaggctgctggggcctgggtcacacctgagcttgccagccaggctgcagctgagggcctggacatagccaccttcctagcccacaatgactcacataccttcttctgctgcctccagggtggggcacacctgctgcacacagggatgacaggtaccaatgtcatggacacccacctcttgttcctgcggcctcggtgatggcataggtcacattttgggagttcagaggaggcctacaagggcaaggtcagatggcagagcaaggttggtcctcagggcctctctaagccttagggcccctcctctccttggccttggctgtttggttaactgtcaccttccactcagggcctctgctctatatctattcccttccagccagactggcagatgggggcttccccctacccctgaggatgaggacaagcccctcggccagttcagcgttcccgtgcttctcccttgggcagcctctctcttgagcccctcaccctgtttctttctgtgaagcgagaatgtctgaaaataaataggaccatgccatgggttctcagtgcgccttccctcagagtgaggcctcacgggggagccgctgggaggggagcgtggtacggctgcagccacagtaccagggcctggcaggactcttaacacccctctactgggctgggtacgtgcaggatgtgcctcgcataacgggagcctgtgcccatccctctggagtgtgtgagggttgagcttggctcctgacagctttgatgtgcgtgagcagagaccccagggaggacaggcctaaagactgcagtctggggtgaccagccacccacccacccaaccatgactccaccatggcactgtcaccatggcttctccagcctcagcttgtaggcctcgttggatggatgtcctttctgtctttggacagcccttagccacatactgcacttctggttgagctgaagtttgtcccaccccccagtgctgtttccttgtgacagcccttgtcctaggctgaacatccctagttccttcagccactcctctggggaccaagtccagaccctgaagtcagcccttcagtgggggtcccagcactgggatggtgggtccagccagtgatgaggtccagtgacccacacctcttcctgtgaccactggcgggagaagaggcaagtgggaatagaggaacggctgtgttggcctggccagcagcctgggttgagagagggaggtgccactgtcctgcctccttttgagcccccttgctcagtgtcagaaccctccgctggctgtccccgccgtgcgccacggctccaatccctatatgagtgagcagtagaatcacataggaataaaaagccatagagaacagcgaggcctggggctgctcttgcaggcacttcttccaccccaaccctcccctcctccctgagggtgtggaggggccctgggccagggctggcaggactttcccctgggaagggtttcccttccccacctgggctctgggcagcctagcttgcagacagttcatgacctgggggcctggctcacacagggcaggctggagattgggagggaggtaaacgtggtaagcgggctctggggaccagggaggtttaggaaaaggggagcttgcaccccactgggatgcgcaggcaccgcttcctttccttctgtgctggcatggagttcctgctgactagggtcacagtctctggggttatggtgatcctcgcatgatcctgtgccgtggtgctcctctggcagcgtctacatgtagcctgttcctgcctcagtccttgctcttgggagcatgagtattggcactgggttccaagttccaggcaaaagcaggataggagagctggggcaggggctgcaggagctgagggcctggcagccatgtccccagtgtgtgtgtgggtggtaggtgtgtgagtatacagacgttggtgttggcgtactcagagtgggaatgcatctctgagtgtacacatagatacttagtacagggcacatgactccctgcatccctgctgagggctttgggtatggataggatcttgcaggaggttccccctgctctacattgaccccttccctatacttctgtttgtaggggctgggaggccagggcccggattggaccccatagggccaaatggtctgtgagcctaacccgttagatttgctcactggataccccagagataagaaaggatgtatttggccacagtctaaatgctgagatgagaaaaccctgcacagtgaatgttttgataggattcattacttgctccataaatgtcaattttggatcattga

SEQ ID NO: 12500 - DNA, 3504 bp, Homo sapiens
atggctgcagccctgcaggtcctgccccgcttggcccgagcccccttgcatccactcctctggcggggctcagtggcccgtctggccagcagcatggccttggcagagcaggccaggcagctgtttgagagtgctgtaggtgcagtgctgccgggccccatgctgcaccgggcactatccttggaccctggtggcagacagctgaaggtgcgggaccggaactttcagctgaggcaaaacctctacctggtgggctttggcaaggctgtgctgggtatggcagctgcagctgaggaactactgggccagcatcttgtgcagggcgtgatcagcgttcccaaggggatccgtgctgcccccatcccacctgtcacactggaggagaagcagacactcactagactgctggcagcccgtggagccaccatccaggagttgaacaccattcggaaggccctgtcccagctcaagggtggggggctggctcaggccgcctaccctgcccaggtggtgagcctcatcctgtcagatgtggtgggggaccctgtggaggtgattgccagtggccccaccgtggccagttcccacaatgtgcaagattgcctgcatatcctcaatcgctacggcctccgtgcagccctgccacgttctgtgaagactgtgctgtctcgggccgactctgacccccatgggccacacacctgtggccatgtcctgaatgtgatcattggctctaatgtgctggcgctagctgaggcccagcggcaggccgaggcactgggctaccaggctgtggtgctgagtgcagccatgcaaggtgatgtaaaaagtatggcccagttctacgggctgctggcccatgtggctagaacccgcctcaccccatccatggctggggcttctgtggaggaagatgcacagctccatgagctggcagctgagcttcagatcccagacctgcagctggaggaggctctggagaccatggcatggggaaggggcccagtctgcctgctggctggtggcgagcccacagtacagctgcagggctcgggcaggggtggccggaaccaggaactggccctgcgtgttggagcagagttgagaaggtggccgctggggccgatagatgtgctgtttttgagcggtggcaccgatgggcaggatgggcccacagaggctgctggggcctgggtcacacctgagcttgccagccaggctgcagctgagggcctggacatagccaccttcctagcccacaatgactcacataccttcttctgctgcctccagggtggggcacacctgctgcacacagggatgacaggtaccaatgtcatggacacccacctcttgttcctgcggcctcggtgatggcataggtcacattttgggagttcagaggaggcctacaagggcaaggtcagatggcagagcaaggttggtcctcagggcctctctaagccttagggcccctcctctccttggccttggctgtttggttaactgtcaccttccactcagggcctctgctctatatctattcccttccagccagactggcagatgggggcttccccctacccctgaggatgaggacaagcccctcggccagttcagcgttcccgtgcttctcccttgggcagcctctctcttgagcccctcaccctgtttctttctgtgaagcgagaatgtctgaaaataaataggaccatgccatgggttctcagtgcgccttccctcagagtgaggcctcacgggggagccgctgggaggggagcgtggtacggctgcagccacagtaccagggcctggcaggactcttaacacccctctactgggctgggtacgtgcaggatgtgcctcgcataacgggagcctgtgcccatccctctggagtgtgtgagggttgagcttggctcctgacagctttgatgtgcgtgagcagagaccccagggaggacaggcctaaagactgcagtctggggtgaccagccacccacccacccaaccatgactccaccatggcactgtcaccatggcttctccagcctcagcttgtaggcctcgttggatggatgtcctttctgtctttggacagcccttagccacatactgcacttctggttgagctgaagtttgtcccaccccccagtgctgtttccttgtgacagcccttgtcctaggctgaacatccctagttccttcagccactcctctggggaccaagtccagaccctgaagtcagcccttcagtgggggtcccagcactgggatggtgggtccagccagtgatgaggtccagtgacccacacctcttcctgtgaccactggcgggagaagaggcaagtgggaatagaggaacggctgtgttggcctggccagcagcctgggttgagagagggaggtgccactgtcctgcctccttttgagcccccttgctcagtgtcagaaccctccgctggctgtccccgccgtgcgccacggctccaatccctatatgagtgagcagtagaatcacataggaataaaaagccatagagaacagcgaggcctggggctgctcttgcaggcacttcttccaccccaaccctcccctcctccctgagggtgtggaggggccctgggccagggctggcaggactttcccctgggaagggtttcccttccccacctgggctctgggcagcctagcttgcagacagttcatgacctgggggcctggctcacacagggcaggctggagattgggagggaggtaaacgtggtaagcgggctctggggaccagggaggtttaggaaaaggggagcttgcaccccactgggatgcgcaggcaccgcttcctttccttctgtgctggcatggagttcctgctgactagggtcacagtctctggggttatggtgatcctcgcatgatcctgtgccgtggtgctcctctggcagcgtctacatgtagcctgttcctgcctcagtccttgctcttgggagcatgagtattggcactgggttccaagttccaggcaaaagcaggataggagagctggggcaggggctgcaggagctgagggcctggcagccatgtccccagtgtgtgtgtgggtggtaggtgtgtgagtatacagacgttggtgttggcgtactcagagtgggaatgcatctctgagtgtacacatagatacttagtacagggcacatgactccctgcatccctgctgagggctttgggtatggataggatcttgcaggaggttccccctgctctacattgaccccttccctatacttctgtttgtaggggctgggaggccagggcccggattggaccccatagggccaaatggtctgtgagcctaacccgttagatttgctcactggataccccagagataagaaaggatgtatttggccacagtctaaatgctgagatgagaaaaccctgcacagtgaatgttttgataggattcattacttgctccataaatgtcaattttggatcattga

SEQ ID NO: 12501 - DNA, 1982 bp, Homo sapiens
cgcggccggagctgtgggctggcagccatgggtgccaggcagtgctgagagcagtggggcatggctgcagccctgcaggtcctgccccgcttggcccgagcccccttgcatccactcctctggcggggctcagtggcccgtctggccagcagcatggccttggcagagcaggccaggcagctgtttgagagtgctgtaggtgcagtgctgccgggccccatgctgcaccgggcactatccttggaccctggtggcagacagctgaaggtgcgggaccggaactttcagctgaggcaaaacctctacctggtgggctttggcaaggctgtgctgggtatggcagctgcagctgaggaactactgggccagcatcttgtgcagggcgtgatcagcgttcccaaggggatccgtgctgccatggagcgtgccggcaagcaggagatgctgctgaagccacatagccgtgtccaggtattcgagggtgcggaggacaacctcccggaccgcgatgcgctgcgggctgcactggccatccagcaactggctgagggactcacagctgatgacctgctgctcgtgctgatctcaggtgggggttcagctctgctgcctgcccccatcccacctgtcacactggaggagaagcagacactcactagactgctggcagcccgtggagccaccatccaggagttgaacaccattcggaaggccctgtcccagctcaagggtggggggctggctcaggccgcctaccctgcccaggtggtgagcctcatcctgtcagatgtggtgggggaccctgtggaggtgattgccagtggccccaccgtggccagttcccacaatgtgcaagattgcctgcatatcctcaatcgctacggcctccgtgcagccctgccacgttctgtgaagactgtgctgtctcgggccgactctgacccccatgggccacacacctgtggccatgtcctgaatgtgatcattggctctaatgtgctggcgctagctgaggcccagcggcaggccgaggcactgggctaccaggctgtggtgctgagtgcagccatgcaaggtgatgtaaaaagtatggcccagttctacgggctgctggcccatgtggctagaacccgcctcaccccatccatggctggggcttctgtggaggaagatgcacagctccatgagctggcagctgagcttcagatcccagacctgcagctggaggaggctctggagaccatggcatggggaaggggcccagtctgcctgctggctggtggcgagcccacagtacagctgcagggctcgggcaggggtggccggaaccaggaactggccctgcgtgttggagcagagttgagaaggtggccgctggggccgatagatgtgctgtttttgagcggtggcaccgatgggcaggatgggcccacagaggctgctggggcctgggtcacacctgagcttgccagccaggctgcagctgagggcctggacatagccaccttcctagcccacaatgactcacataccttcttctgctgcctccagggtggggcacacctgctgcacacagggatgacaggtaccaatgtcatggacacccacctcttgttcctgcggcctcggtgatggcataggtcacattttgggagttcagaggaggcctacaagggcaaggtcagatggcagagcaaggttggtcctcagggcctctctaagccttagggcccctcctctccttggccttggctgtttggttaactgtcaccttccactcagggcctctgctctatatctattcccttccagccagactggcagatgggggcttccccctacccctgaggatgaggacaagcccctcggccagttcagcgttcccgtgcttctcccttgggcagcctctctcttgagcccctcaccctgtttctttctgtgaagcgagaatgtctgaaaataaataggaccatgccatgggt

SEQ ID NO: 12502 - DNA, 889 bp, Homo sapiens
gcagaatggaactcttgctaagccagagctgtatttggtggcccatggtgggagagggaagaacaataataagttgtggaataaaagccatggagaggagcgggaattacttaatctggctccagaagggggagatgctgctgaagccacatagccgtgtccaggtattcgagggtgcggaggacaacctcccggaccgcgatgcgctgcgggctgcactggccatccagcaactggctgagggactcacagctgatgacctgctgctcgtgctgatctcaggtgggggttcagctctgctgcctgcccccatcccacctgtcacactggaggagaagcagacactcactagactgctggcagcccgtggagccaccatccaggagttgaacaccattcggaaggccctgtcccagctcaagggtggggggctggctcaggccgcctaccctgcccaggtggtgagcctcatcctgtcagatgtggtgggggaccctgtggaggtgattgccagtggccccaccgtggccagttcccacaatgtgcaagattgcctgcatatcctcaatcgctacggcctccgtgcagccctgccacgttctgtgaagactgtgctgtctcgggccgactctgacccccatgggccacacacctgtggccatgtcctgaatgtgatcattggctctaatgtgctggcgctagctgaggcccagcggcaggccgaggcactgggctaccaggctgtggtgctgagtgcagccatgcaagggtggggcacacctgctgcacacagggatgacaggtaccaatgtcatggacacccacctcttgttcctgcggcctcggtgatggcataggtcacattttgggagttcagaggaggcctaca

SEQ ID NO: 12503 - DNA, 992 bp, Homo sapiens
ccgttctccagcgctgggcaccgcggccggagctgtgggctgggagatgctgctgaagccacatagccgtgtccaggtattcgagggtgcggaggacaacctcccggaccgcgatgcgctgcgggctgcactggccatccagcaactggctgagggactcacagctgatgacctgctgctcgtgctgatctcaggtgggggttcagctctgctgcctgcccccatcccacctgtcacactggaggagaagcagacactcactagactgctggcagcccgtggagccaccatccaggagttgaacaccattcggaaggccctgtcccagctcaagggtggggggctggctcaggccgcctaccctgcccaggtggtgagcctcatcctgtcagatgtggtgggggaccctgtggaggtgattgccagtggccccaccgtggccagttcccacaatgtgcaagattgcctgcatatcctcaatcgctacggcctccgtgcagccctgccacgttctgtgaagactgtgctgtctcgggccgactctgacccccatgggccacacacctgtggccatgtcctgaatgtgatcattggctctaatgtgctggcgctagctgaggcccagcggcaggccgaggcactgggctaccaggctgtggtgctgagtgcagccatgcaagggtggggcacacctgctgcacacagggatgacaggtaccaatgtcatggacacccacctcttgttcctgcggcctcggtgatggcataggtcacattttgggagttcagaggaggcctacaagggcaaggtcagatggcagagcaagccagactggcagatgggggcttccccctacccctgaggatgaggacaagcccctcggccagttcagcgttcccgtgcttctcccttgggcagcctctctcttgagcccctcaccctgtttctttctgtgaagcgagaatgtctgaaaataaataggaccatgcca

SEQ ID NO: 12504 - DNA, 935 bp, Homo sapiens
caccccctagtacttccgttctccagcgctgggcaccgcggccggagctgtgggctggcagccatgggtgccaggcagtgctgagagcagtggggcatggctgcagccctgcaggtcctgccccgcttggcccgagcccccttgcatccactcctctggcggggctcagtggcccgtctggccagcagcatggccttggcagagcaggccaggcagctgtttgagagtgctgtaggtgcagtgctgccgggccccatgctgcaccgggcactatccttggaccctggtggcagacagctgaaggtgcgggaccggaactttcagctgaggcaaaacctctacctggtgggctttggcaaggctgtgctgggtatggcagctgcagctgaggaactactgggccagcatcttgtgcagggcgtgatcagcgttcccaaggggatccgtgctgccatggagcgtgccggcaagcaggagatgctgctgaagccacatagccgtgtccaggtattcgagggtgcggaggacaacctcccggaccgcgatgcgctgcgggctgcactggccatccagcaactggctgagggactcacagctgatgacctgctgctcgtgctgatctcagggtggggcacacctgctgcacacagggatgacaggtaccaatgtcatggacacccacctcttgttcctgcggcctcggtgatggcataggtcacattttgggagttcagaggaggcctacaagggcaaggtcagatggcagagcaagccagactggcagatgggggcttccccctacccctgaggatgaggacaagcccctcggccagttcagcgttcccgtgcttctcccttgggcagcctctctcttgagcccctcaccctgtttctttctgtgaagcgagaatgtctgaaaataaataggaccatgc

SEQ ID NO: 12505 - DNA, 1304 bp, Homo sapiens
gtgccaggcagtgctgagagcagtggggcatggctgcagccctgcaggtcctgccccgcttggcccgagcccccttgcatccactcctctggcggggctcagtggcccgtctggccagcagcatggccttggcagagcaggccaggcagctgtttgagagtgctgtaggtgcagtgctgccgggccccatgctgcaccgggcactatccttggaccctggtggcagacagctgaaggtgcgggaccggaactttcagctgaggcaaaacctctacctggtgggctttggcaaggctgtgctgggtatggcagctgcagctgaggaactactgggccagcatcttgtgcagggcgtgatcagcgttcccaaggggatccgtgctgccatggagcgtgccggcaagcaggagatgctgctgaagccacatagccgtgtccaggtattcgagggtgcggaggacaacctcccggaccgcgatgcgctgcgggctgcactggccatccagcaactggctgagggactcacagctgatgacctgctgctcgtgctgatctcaggtggtgagcctcatcctgtcagatgtggtgggggaccctgtggaggtgattgccagtggccccaccgtggccagttcccacaatgtgcaagattgcctgcatatcctcaatcgctacggcctccgtgcagccctgccacgttctgtgaagactgtgctgtctcgggccgactctgacccccatgggccacacacctgtggccatgtcctgaatgtgatcattggctctaatgtgctggcgctagctgaggcccagcggcaggccgaggcactgggctaccaggctgtggtgctgagtgcagccatgcaaggtgatgtaaaaagtatggcccagttctacgggctgctggcccatgtggctagaacccgcctcaccccatccatggctggggcttctgtggaggaagatgcacagctccatgagctggcagctgagcttcagatcccagacctgcagctggaggaggctctggagaccatggcatggggaaggggcccagtctgcctgctggctggtggcgagcccacagtacagctgcagggctcgggcaggggtggccggaaccaggaactggccctgcgtgttggagcagagttgagaaggtggccgctggggccgatagatgtgctgtttttgagcggtggcaccgatgggcaggatgggcccacagaggctgctggggcctgggtcacacctgagcttgccagccaggctgcagctgagggcctggacatagccaccttcct

SEQ ID NO: 12506 - DNA, 464 bp, Homo sapiens
aagattttggatgccatgaatcgagactgtggaattccactcagtcatttgcaggtagatggaggaatgaccagcaacaaaattcttatgcagctacaagcagacattctgtatataccagtagtgaagccctcaatgcccgaaaccactgcactgggtgcggctatggcggcaggggctgcagaaggagtcggcgtatggagtctcgaacccgaggatttgtctgccgtcacgatggagcggtttgaacctcagattaatgcggagggtacatttaaagaatgaaatgttcagtgatatactgtgaaaacgaccttagtgcacgggagttttgtttttctgtttagttaaaagttaaggaaccaagtaaaatagtaaatgttatcattgcagattcggctgccaagcatattgggctttactgaataaatgtgaatgagagaaatcgttgcttatcaaaagaa

SEQ ID NO: 12507 - DNA, 3707 bp, Homo sapiens
gggccggaggggcggggtgagaaggctgcgcgcgggtaaaggggccgcctcgagcgcggtccgagcgttcagcggacgcgcgcggcctcgatctctggactcgtcacctgcccctccccctcccgccgccgtcacccaggaaaccggccgcaatcgccggccgacctgaagctggtttcatggcagcctcaaagaaggcagttttggggccattggtgggggcggtggaccagggcaccagttcgacgcgctttttggttttcaattcaaaaacagctgaactacttagtcatcatcaagtagaaataaaacaagagttcccaagagaaggatgggtggaacaggaccctaaggaaattctacattctgtctatgagtgtatagagaaaacatgtgagaaacttggacagctcaatattgatatttccaacataaaagctattggtgtcagcaaccagagggaaaccactgtagtctgggacaagataactggagagcctctctacaatgctgtggtgtggcttgatctaagaacccagtctaccgttgagagtcttagtaaaagaattccaggaaataataactttgtcaagtccaagacaggccttccacttagcacttacttcagtgcagtgaaacttcgttggctccttgacaatgtgagaaaagttcaaaaggccgttgaagaaaaacgagctctttttgggactattgattcatggcttatttggagtttgacaggaggagtcaatggaggtgtccactgtacagatgtaacaaatgcaagtaggactatgcttttcaacattcattctttggaatgggataaacaactctgcgaattttttggaattccaatggaaattcttccaaatgtccggagttcttctgagatctatggcctaatgaaagctggggccttggaaggtgtgccaatatctgggtgtttaggggaccagtctgctgcattggtgggacaaatgtgcttccagattggacaagccaaaaatacgtatggaacaggatgtttcttactatgtaatacaggccataagtgtgtattttctgatcatggccttctcaccacagtggcttacaaacttggcagagacaaaccagtatattatgctttggaaggttctgtagctatagctggtgctgttattcgctggctaagagacaatcttggaattataaagacctcagaagaaattgaaaaacttgctaaagaagtaggtacttcttatggctgctacttcgtcccagcattttcggggttatatgcaccttattgggagcccagcgcaagagggataatctgtggactcactcagttcaccaataaatgccatattgcttttgctgcattagaagctgtttgtttccaaactcgagagattttggatgccatgaatcgagactgtggaattccactcagtcatttgcaggtagatggaggaatgaccagcaacaaaattcttatgcagctacaagcagacattctgtatataccagtagtgaagccctcaatgcccgaaaccactgcactgggtgcggctatggcggcaggggctgcagaaggagtcggcgtatggagtctcgaacccgaggatttgtctgccgtcacgatggagcggtttgaacctcagattaatgcggaggaaagtgaaattcgttattctacatggaagaaagctgtgatgaagtcaatgggttgggttacaactcaatctccagaaagtggtgaccctagtatcttctgtagtctgcccttgggcttttttatagtgagtagcatggtaatgttaatcggagcaaggtacatctcaggtattccataaaacctaccaactcatggattcccaagatgtgagctttttacataatgaaagaacccagcaattctgtctcttaatgcaatgacactattcatagactttgattttatttataagccacttgctgcatgaccctccaagtagacctgtggcttaaaataaagaaaatgcagcaaaaagaatgctatagaaatatttggtggttttttttttttttaaacatccacagttaaggttgggccagctacctttggggctgaccccctccattgccataacatcctgctccattccctctaagatgtaggaagaattcggatccttaccattggaatcttccatcgaacatactcaaacacttttggaccaggatttgagtctctgcatgacatatacttgattaaaaggttattactaacctgttaaaaatcagcagctctttgcttttaacagacaccctaaaagtcttcttttctacatagttgaagacagcaacatcttcactgaatgtttgaatagaaacctctactaaattattaaaatagacatttagtgttctcacagcttggatatttttctgaaaagttatttgccaaaactgaaatccttcagatgttttccatggtcccactaattataatgactttctgtctggatcttataggaaaagatactttcttttttcttccatctttcctttttatattttttactttgtatgtataacatacatgcctatatattttatacactgagggtagcccatttataaattaagagcacattatattcagaaggttctaacagggctggtcttaagtgaaccactgtgtatataaatatgttggaaaacagctgtatacatttttgggcaacggttatgcataatatttaccaggagaatttttttcttaacaagccaacatttaaaatttatgttttatgtcaataaaagaaaatatactttattgtgacttcaactatatttcttatcccttacatttttatttaattgtcttagcttaaaaaaagaagaaactgtggaatactacagtaaatattgttttcaaacacaagcaataattcaaatagttatttttcttttgaattaattttagacatattttggatcctattgaggggataagaggatgtcaaaaaagttaaatacctaagtagaaaaaaatatagaaataaagccaagaatctctttcagttcaaatgttatcaattgttaataagaaattgctatctgggatgacagaattacctctgcttagtatctcattataactgaaagaaggtttatcattacaaataccttccaatgaaaccaagaatttctcaaaatatttaatgtcacatattataagaagttacctaatcctgcttcttaacatcaatttttaaaaatatcttaaaattactttgttttgtagtaaacagtgaagaaaagattgcctcctaattatttttttcaatgagtgctgaatgggaaaacatttatatcttactataaaaggttctgttttgtttggaatcaatggtagctttattgactgttctgattgtgctgtttctaatttattgaatctgctaggttttattgatgcagccaccacttaagtgacataaatattatagaaaggtactgtgaaatgatcactttgtggcaggggtacttttaaacataaatgtttctacaaaagtaggttgagttcattgtaaataattgtgaaagccactgttcaaataattttaagattacattaatttttctataaattggaagatttataaatgtttgaaattgtacacattgatatttaatgacaaatttacttaaaataaattgaccccttgttctta

SEQ ID NO: 12508 - DNA, 2063 bp, Homo sapiens
ctcccgccgccgtcacccaggaaaccggccgcaatcgccggccgacctgaagctggtttcatggcagcctcaaagaaggcagttttggggccattggtgggggcggtggaccagggcaccagttcgacgcgctttttggttttcaattcaaaaacagctgaactacttagtcatcatcaagtagaaataaaacaagagttcccaagagaaggatgggtggaacaggaccctaaggaaattctacattctgtctatgagtgtatagagaaaacatgtgagaaacttggacagctcaatattgatatttccaacataaaagctattggtgtcagcaaccagagggaaaccactgtagtctgggacaagataactggagagcctctctacaatgctgtggtgtggcttgatctaagaacccagtctaccgttgagagtcttagtaaaagaattccaggaaataataactttgtcaagtccaagacaggccttccacttagcacttacttcagtgcagtgaaacttcgttggctccttgacaatgtgagaaaagttcaaaaggccgttgaagaaaaacgagctctttttgggactattgattcatggcttatttggagtttgacaggaggagtcaatggaggtgtccactgtacagatgtaacaaatgcaagtaggactatgcttttcaacattcattctttggaatgggataaacaactctgcgaattttttggaattccaatggaaattcttccaaatgtccggagttcttctgagatctatggcctaatgaaagctggggccttggaaggtgtgccaatatctgggtgtttaggggaccagtctgctgcattggtgggacaaatgtgcttccagattggacaagccaaaaatacgtatggaacaggatgtttcttactatgtaatacaggccataagtgtgtattttctgatcatggccttctcaccacagtggcttacaaacttggcagagacaaaccagtatattatgctttggaaggttctgtagctatagctggtgctgttattcgctggctaagagacaatcttggaattataaagacctcagaagaaattgaaaaacttgctaaagaagtaggtacttcttatggctgctacttcgtcccagcattttcggggttatatgcaccttattgggagcccagcgcaagagggataatctgtggactcactcagttcaccaataaatgccatattgcttttgctgcattagaagctgtttgtttccaaactcgagagattttggatgccatgaatcgagactgtggaattccactcagtcatttgcaggtagatggaggaatgaccagcaacaaaattcttatgcagctacaagcagacattctgtatataccagtagtgaagccctcaatgcccgaaaccactgcactgggtgcggctatggcggcaggggctgcagaaggagtcggcgtatggagtctcgaacccgaggatttgtctgccgtcacgatggagcggtttgaacctcagattaatgcggaggaaagtgaaattcgttattctacatggaagaaagctgtgatgaagtcaatgggttgggttacaactcaatctccagaaagtggtattccataaaacctaccaactcatggattcccaagatgtgagctttttacataatgaaagaacccagcaattctgtctcttaatgcaatgacactattcatagactttgattttatttataagccacttgctgcatgaccctccaagtagacctgtggcttaaaataaagaaaatgcagcaaaaagaatgctatagaaatatttggtggttttttttttttttaaacatccacagttaaggttgggccagctacctttggggctgaccccctccattgccataacatcctgctccattccctctaagatgtaggaagaattcggatccttaccattggaatcttccatcgaacatactcaaacacttttggaccaggatttgagtctctgcatgacatatacttgattaaaaggttattactaacctgttaaaaatc

SEQ ID NO: 12509 - DNA, 3638 bp, Homo sapiens
gggccggaggggcggggtgagaaggctgcgcgcgggtaaaggggccgcctcgagcgcggtccgagcgttcagcggacgcgcgcggcctcgatctctggactcgtcacctgcccctccccctcccgccgccgtcacccaggaaaccggccgcaatcgccggccgacctgaagctggtttcatggcagcctcaaagaaggcagttttggggccattggtgggggcggtggaccagggcaccagttcgacgcgctttttggttttcaattcaaaaacagctgaactacttagtcatcatcaagtagaaataaaacaagagttcccaagagaaggatgggtggaacaggaccctaaggaaattctacattctgtctatgagtgtatagagaaaacatgtgagaaacttggacagctcaatattgatatttccaacataaaagctattggtgtcagcaaccagagggaaaccactgtagtctgggacaagataactggagagcctctctacaatgctgtggtgtggcttgatctaagaacccagtctaccgttgagagtcttagtaaaagaattccaggaaataataactttgtcaagtccaagacaggccttccacttagcacttacttcagtgcagtgaaacttcgttggctccttgacaatgtgagaaaagttcaaaaggccgttgaagaaaaacgagctctttttgggactattgattcatggcttatttggagtttgacaggaggagtcaatggaggtgtccactgtacagatgtaacaaatgcaagtaggactatgcttttcaacattcattctttggaatgggataaacaactctgcgaattttttggaattccaatggaaattcttccaaatgtccggagttcttctgagatctatggcctaatgaaaatctctcatagcgtgaaagctggggccttggaaggtgtgccaatatctgggtgtttaggggaccagtctgctgcattggtgggacaaatgtgcttccagattggacaagccaaaaatacgtatggaacaggatgtttcttactatgtaatacaggccataagtgtgtattttctgatcatggccttctcaccacagtggcttacaaacttggcagagacaaaccagtatattatgctttggaaggttctgtagctatagctggtgctgttattcgctggctaagagacaatcttggaattataaagacctcagaagaaattgaaaaacttgctaaagaagtaggtacttcttatggctgctacttcgtcccagcattttcggggttatatgcaccttattgggagcccagcgcaagagggataatctgtggactcactcagttcaccaataaatgccatattgcttttgctgcattagaagctgtttgtttccaaactcgagagattttggatgccatgaatcgagactgtggaattccactcagtcatttgcaggtagatggaggaatgaccagcaacaaaattcttatgcagctacaagcagacattctgtatataccagtagtgaagccctcaatgcccgaaaccactgcactgggtgcggctatggcggcaggggctgcagaaggagtcggcgtatggagtctcgaacccgaggatttgtctgccgtcacgatggagcggtttgaacctcagattaatgcggaggaaagtgaaattcgttattctacatggaagaaagctgtgatgaagtcaatgggttgggttacaactcaatctccagaaagtggtattccataaaacctaccaactcatggattcccaagatgtgagctttttacataatgaaagaacccagcaattctgtctcttaatgcaatgacactattcatagactttgattttatttataagccacttgctgcatgaccctccaagtagacctgtggcttaaaataaagaaaatgcagcaaaaagaatgctatagaaatatttggtggttttttttttttttaaacatccacagttaaggttgggccagctacctttggggctgaccccctccattgccataacatcctgctccattccctctaagatgtaggaagaattcggatccttaccattggaatcttccatcgaacatactcaaacacttttggaccaggatttgagtctctgcatgacatatacttgattaaaaggttattactaacctgttaaaaatcagcagctctttgcttttaacagacaccctaaaagtcttcttttctacatagttgaagacagcaacatcttcactgaatgtttgaatagaaacctctactaaattattaaaatagacatttagtgttctcacagcttggatatttttctgaaaagttatttgccaaaactgaaatccttcagatgttttccatggtcccactaattataatgactttctgtctggatcttataggaaaagatactttcttttttcttccatctttcctttttatattttttactttgtatgtataacatacatgcctatatattttatacactgagggtagcccatttataaattaagagcacattatattcagaaggttctaacagggctggtcttaagtgaaccactgtgtatataaatatgttggaaaacagctgtatacatttttgggcaacggttatgcataatatttaccaggagaatttttttcttaacaagccaacatttaaaatttatgttttatgtcaataaaagaaaatatactttattgtgacttcaactatatttcttatcccttacatttttatttaattgtcttagcttaaaaaaagaagaaactgtggaatactacagtaaatattgttttcaaacacaagcaataattcaaatagttatttttcttttgaattaattttagacatattttggatcctattgaggggataagaggatgtcaaaaaagttaaatacctaagtagaaaaaaatatagaaataaagccaagaatctctttcagttcaaatgttatcaattgttaataagaaattgctatctgggatgacagaattacctctgcttagtatctcattataactgaaagaaggtttatcattacaaataccttccaatgaaaccaagaatttctcaaaatatttaatgtcacatattataagaagttacctaatcctgcttcttaacatcaatttttaaaaatatcttaaaattactttgttttgtagtaaacagtgaagaaaagattgcctcctaattatttttttcaatgagtgctgaatgggaaaacatttatatcttactataaaaggttctgttttgtttggaatcaatggtagctttattgactgttctgattgtgctgtttctaatttattgaatctgctaggttttattgatgcagccaccacttaagtgacataaatattatagaaaggtactgtgaaatgatcactttgtggcaggggtacttttaaacataaatgtttctacaaaagtaggttgagttcattgtaaataattgtgaaagccactgttcaaataattttaagattacattaatttttctataaattggaagatttataaatgtttgaaattgtacacattgatatttaatgacaaatttacttaaaataaattgaccccttgttctta

SEQ ID NO: 12510 - DNA, 2401 bp, Homo sapiens
gtcacccaggaaaccggccgcaatcgccggccgacctgaagctggtttcatggcagcctcaaagaaggcagttttggggccattggtgggggcggtggaccagggcaccagttcgacgcgctttttggttttcaattcaaaaacagctgaactacttagtcatcatcaagtagaaataaaacaagagttcccaagagaaggatgggtggaacaggaccctaaggaaattctacattctgtctatgagtgtatagagaaaacatgtgagaaacttggacagctcaatattgatatttccaacataaaagataaccctacctcctgcttcatggagaaagttgagggtctgcggccttaaatcctcaccttcctgttgctgtgcttaatatctggatctcctgccaactttccttcatcacaagggcagcaatagccttctgccccacttggagctcctccctccacttgtgctgctattggtgtcagcaaccagagggaaaccactgtagtctgggacaagataactggagagcctctctacaatgctgtggtgtggcttgatctaagaacccagtctaccgttgagagtcttagtaaaagaattccaggaaataataactttgtcaagtccaagacaggccttccacttagcacttacttcagtgcagtgaaacttcgttggctccttgacaatgtgagaaaagttcaaaaggccgttgaagaaaaacgagctctttttgggactattgattcatggcttatttggagtttgacaggaggagtcaatggaggtgtccactgtacagatgtaacaaatgcaagtaggactatgcttttcaacattcattctttggaatgggataaacaactctgcgaattttttggaattccaatggaaattcttccaaatgtccggagttcttctgagatctatggcctaatgaaaatctctcatagcgtgaaagctggggccttggaaggtgtgccaatatctgggtgtttaggggaccagtctgctgcattggtgggacaaatgtgcttccagattggacaagccaaaaatacgtatggaacaggatgtttcttactatgtaatacaggccataagtgtgtattttctgatcatggccttctcaccacagtggcttacaaacttggcagagacaaaccagtatattatgctttggaaggttctgtagctatagctggtgctgttattcgctggctaagagacaatcttggaattataaagacctcagaagaaattgaaaaacttgctaaagaagtaggtacttcttatggctgctacttcgtcccagcattttcggggttatatgcaccttattgggagcccagcgcaagagggataatctgtggactcactcagttcaccaataaatgccatattgcttttgctgcattagaagctgtttgtttccaaactcgagagattttggatgccatgaatcgagactgtggaattccactcagtcatttgcaggtagatggaggaatgaccagcaacaaaattcttatgcagctacaagcagacattctgtatataccagtagtgaagccctcaatgcccgaaaccactgcactgggtgcggctatggcggcaggggctgcagaaggagtcggcgtatggagtctcgaacccgaggatttgtctgccgtcacgatggagcggtttgaacctcagattaatgcggaggaaagtgaaattcgttattctacatggaagaaagctgtgatgaagtcaatgggttgggttacaactcaatctccagaaagtggtgaccctagtatcttctgtagtctgcccttgggcttttttatagtgagtagcatggtaatgttaatcggagcaaggtacatctcaggtattccataaaacctaccaactcatggattcccaagatgtgagctttttacataatgaaagaacccagcaattctgtctcttaatgcaatgacactattcatagactttgattttatttataagccacttgctgcatgaccctccaagtagacctgtggcttaaaataaagaaaatgcagcaaaaagaatgctatagaaatatttggtggttttttttttttttaaacatccacagttaaggttgggccagctacctttggggctgaccccctccattgccataacatcctgctccattccctctaagatgtaggaagaattcggatccttaccattggaatcttccatcgaacatactcaaacacttttggaccaggatttgagtctctgcatgacatatacttgattaaaaggttattactaacctgttaaaaatcagcagctctttgcttttaacagacaccctaaaagtcttcttttctacatagttgaagacagcaacatcttcactgaatg

SEQ ID NO: 12511 - DNA, 2172 bp, Homo sapiens
aggaaaccggccgcaatcgccggccgacctgaagctggtttcatggcagcctcaaagaaggcagttttggggccattggtgggggcggtggaccagggcaccagttcgacgcgctttttggttttcaattcaaaaacagctgaactacttagtcatcatcaagtagaaataaaacaagagttcccaagagaaggctattggtgtcagcaaccagagggaaaccactgtagtctgggacaagataactggagagcctctctacaatgctgtggtgtggcttgatctaagaacccagtctaccgttgagagtcttagtaaaagaattccaggaaataataactttgtcaagtccaagacaggccttccacttagcacttacttcagtgcagtgaaacttcgttggctccttgacaatgtgagaaaagttcaaaaggccgttgaagaaaaacgagctctttttgggactattgattcatggcttatttggataattttaaaacaaatgccagacatttcattttatttgtaaatatttcaagtttgacaggaggagtcaatggaggtgtccactgtacagatgtaacaaatgcaagtaggactatgcttttcaacattcattctttggaatgggataaacaactctgcgaattttttggaattccaatggaaattcttccaaatgtccggagttcttctgagatctatggcctaatgaaaatctctcatagcgtgaaagctggggccttggaaggtgtgccaatatctgggtgtttaggggaccagtctgctgcattggtgggacaaatgtgcttccagattggacaagccaaaaatacgtatggaacaggatgtttcttactatgtaatacaggccataagtgtgtattttctgatcatggccttctcaccacagtggcttacaaacttggcagagacaaaccagtatattatgctttggaaggttctgtagctatagctggtgctgttattcgctggctaagagacaatcttggaattataaagacctcagaagaaattgaaaaacttgctaaagaagtaggtacttcttatggctgctacttcgtcccagcattttcggggttatatgcaccttattgggagcccagcgcaagagggataatctgtggactcactcagttcaccaataaatgccatattgcttttgctgcattagaagctgtttgtttccaaactcgagagattttggatgccatgaatcgagactgtggaattccactcagtcatttgcaggtagatggaggaatgaccagcaacaaaattcttatgcagctacaagcagacattctgtatataccagtagtgaagccctcaatgcccgaaaccactgcactgggtgcggctatggcggcaggggctgcagaaggagtcggcgtatggagtctcgaacccgaggatttgtctgccgtcacgatggagcggtttgaacctcagattaatgcggaggaaagtgaaattcgttattctacatggaagaaagctgtgatgaagtcaatgggttgggttacaactcaatctccagaaagtggtattccataaaacctaccaactcatggattcccaagatgtgagctttttacataatgaaagaacccagcaattctgtctcttaatgcaatgacactattcatagactttgattttatttataagccacttgctgcatgaccctccaagtagacctgtggcttaaaataaagaaaatgcagcaaaaagaatgctatagaaatatttggtggttttttttttttttaaacatccacagttaaggttgggccagctacctttggggctgaccccctccattgccataacatcctgctccattccctctaagatgtaggaagaattcggatccttaccattggaatcttccatcgaacatactcaaacacttttggaccaggatttgagtctctgcatgacatatacttgattaaaaggttattactaacctgttaaaaatcagcagctctttgcttttaacagacaccctaaaagtcttcttttctacatagttgaagacagcaacatcttcactgaatgtttgaatagaaacctctactaattataatgactttctgtctggatcttataggaaaagatactttcttttttcttccatctttcctt

SEQ ID NO: 12512 - DNA, 3725 bp, Homo sapiens
gggccggaggggcggggtgagaaggctgcgcgcgggtaaaggggccgcctcgagcgcggtccgagcgttcagcggacgcgcgcggcctcgatctctggactcgtcacctgcccctccccctcccgccgccgtcacccaggaaaccggccgcaatcgccggccgacctgaagctggtttcatggcagcctcaaagaaggcagttttggggccattggtgggggcggtggaccagggcaccagttcgacgcgctttttggttttcaattcaaaaacagctgaactacttagtcatcatcaagtagaaataaaacaagagttcccaagagaaggatgggtggaacaggaccctaaggaaattctacattctgtctatgagtgtatagagaaaacatgtgagaaacttggacagctcaatattgatatttccaacataaaagctattggtgtcagcaaccagagggaaaccactgtagtctgggacaagataactggagagcctctctacaatgctgtggtgtggcttgatctaagaacccagtctaccgttgagagtcttagtaaaagaattccaggaaataataactttgtcaagtccaagacaggccttccacttagcacttacttcagtgcagtgaaacttcgttggctccttgacaatgtgagaaaagttcaaaaggccgttgaagaaaaacgagctctttttgggactattgattcatggcttatttggagtttgacaggaggagtcaatggaggtgtccactgtacagatgtaacaaatgcaagtaggactatgcttttcaacattcattctttggaatgggataaacaactctgcgaattttttggaattccaatggaaattcttccaaatgtccggagttcttctgagatctatggcctaatgactattcataattcaaaaaaagctggggccttggaaggtgtgccaatatctgggtgtttaggggaccagtctgctgcattggtgggacaaatgtgcttccagattggacaagccaaaaatacgtatggaacaggatgtttcttactatgtaatacaggccataagtgtgtattttctgatcatggccttctcaccacagtggcttacaaacttggcagagacaaaccagtatattatgctttggaaggttctgtagctatagctggtgctgttattcgctggctaagagacaatcttggaattataaagacctcagaagaaattgaaaaacttgctaaagaagtaggtacttcttatggctgctacttcgtcccagcattttcggggttatatgcaccttattgggagcccagcgcaagagggataatctgtggactcactcagttcaccaataaatgccatattgcttttgctgcattagaagctgtttgtttccaaactcgagagattttggatgccatgaatcgagactgtggaattccactcagtcatttgcaggtagatggaggaatgaccagcaacaaaattcttatgcagctacaagcagacattctgtatataccagtagtgaagccctcaatgcccgaaaccactgcactgggtgcggctatggcggcaggggctgcagaaggagtcggcgtatggagtctcgaacccgaggatttgtctgccgtcacgatggagcggtttgaacctcagattaatgcggaggaaagtgaaattcgttattctacatggaagaaagctgtgatgaagtcaatgggttgggttacaactcaatctccagaaagtggtgaccctagtatcttctgtagtctgcccttgggcttttttatagtgagtagcatggtaatgttaatcggagcaaggtacatctcaggtattccataaaacctaccaactcatggattcccaagatgtgagctttttacataatgaaagaacccagcaattctgtctcttaatgcaatgacactattcatagactttgattttatttataagccacttgctgcatgaccctccaagtagacctgtggcttaaaataaagaaaatgcagcaaaaagaatgctatagaaatatttggtggttttttttttttttaaacatccacagttaaggttgggccagctacctttggggctgaccccctccattgccataacatcctgctccattccctctaagatgtaggaagaattcggatccttaccattggaatcttccatcgaacatactcaaacacttttggaccaggatttgagtctctgcatgacatatacttgattaaaaggttattactaacctgttaaaaatcagcagctctttgcttttaacagacaccctaaaagtcttcttttctacatagttgaagacagcaacatcttcactgaatgtttgaatagaaacctctactaaattattaaaatagacatttagtgttctcacagcttggatatttttctgaaaagttatttgccaaaactgaaatccttcagatgttttccatggtcccactaattataatgactttctgtctggatcttataggaaaagatactttcttttttcttccatctttcctttttatattttttactttgtatgtataacatacatgcctatatattttatacactgagggtagcccatttataaattaagagcacattatattcagaaggttctaacagggctggtcttaagtgaaccactgtgtatataaatatgttggaaaacagctgtatacatttttgggcaacggttatgcataatatttaccaggagaatttttttcttaacaagccaacatttaaaatttatgttttatgtcaataaaagaaaatatactttattgtgacttcaactatatttcttatcccttacatttttatttaattgtcttagcttaaaaaaagaagaaactgtggaatactacagtaaatattgttttcaaacacaagcaataattcaaatagttatttttcttttgaattaattttagacatattttggatcctattgaggggataagaggatgtcaaaaaagttaaatacctaagtagaaaaaaatatagaaataaagccaagaatctctttcagttcaaatgttatcaattgttaataagaaattgctatctgggatgacagaattacctctgcttagtatctcattataactgaaagaaggtttatcattacaaataccttccaatgaaaccaagaatttctcaaaatatttaatgtcacatattataagaagttacctaatcctgcttcttaacatcaatttttaaaaatatcttaaaattactttgttttgtagtaaacagtgaagaaaagattgcctcctaattatttttttcaatgagtgctgaatgggaaaacatttatatcttactataaaaggttctgttttgtttggaatcaatggtagctttattgactgttctgattgtgctgtttctaatttattgaatctgctaggttttattgatgcagccaccacttaagtgacataaatattatagaaaggtactgtgaaatgatcactttgtggcaggggtacttttaaacataaatgtttctacaaaagtaggttgagttcattgtaaataattgtgaaagccactgttcaaataattttaagattacattaatttttctataaattggaagatttataaatgtttgaaattgtacacattgatatttaatgacaaatttacttaaaataaattgaccccttgttctta

SEQ ID NO: 12513 - DNA, 1865 bp, Homo sapiens
agccgacctactggtgtcatggcagccccaaagacagcagctgtggggccgttggtgggagcggtggtccagggcaccaactccactcgctttctggttttcaattcaaaaacagcggaactacttagtcatcacaaagtggaattaacacaagagttcccaaaagaaggatgggtggaacaagaccctaaagaaattcttcagtctgtctacgagtgtatagcgagaacgtgtgagaaacttgacgaactgaatattgatatatccaacataaaagctgttggtgtcagcaatcagagggaaaccactgtaatctgggacaagttaacaggagagcctctctacaatgctgtggtgtggcttgatctaagaacccagactactgttgaggatcttagtaaaaaaattccaggaaatagtaacttcgtcaagtctaagacaggccttccactcagcacttacttcagtgcagtaaaacttcgttggatgcttgacaatgtgagaaacgtccaaaaggctgttgaagaaggtagagctctttttggtaccattgattcatggcttatctggagtttgacaggaggagttaatggaggcgtgcattgtacagatgtaacaaatgcaagtaggacaatgctttttaatatccattctttggaatgggataaagagctctgtgacttttttgaaattccaatggaccttcttccaaatgtcttcagttcttctgagatctatggcctaattaaaactggagccctggaaggtgtgccaatatctgggtgtttgggggaccaatgtgctgcattagtaggacaaatgtgcttccaggagggacaagccaaaaacacctatggaacaggttgcttcttactgtgtaatacgggtcgtaaatgtgtgttttctgaacatggccttttgaccacagtagcttacaaactaggcagagagaagccagcatattatgcactggaaggttctgttgctatagcaggtgctgttattcgttggctaagagacaatcttggaattatagagacctcaggagacattgaaagacttgctaaagaagtaggaacttcttatggctgttactttgtcccagccttttcagggttatatgcaccttattgggagcccagtgcaagagggatactctgtggcctcactcagtttaccaataaatgtcatattgcttttgctgcattagaagctgtttgtttccaaacccgagagattttggaagccatgaaccgtgactgtggaattccacttcgtcatttgcaggtagatggaggaatgaccaacaacaaagttcttatgcagctacaagcagatattcttcatattccagtaataaaaccctttatgcctgaaacaactgcactaggagctgccatggcagcaggggctgcagagggagtaagcgtttggagccttgaaccccaggctttgtcagttctcaggatggaacgatttgaaccacagatccaggccacagaaagtgaaattcgttatgccacatggaagaaagccgtaatgaagtcaatgggttgggttaccagtcagtctcctgaaggtggtgatccttctatcttctctagtctgcctttgggattttttatagtgagtagcatggtaatgctaattggagcaagatatatctcgggtgtgccataataataccagctatggagtcccaagatgtaaacattttacataatgaaagcatatagcagttctgcctcttaatataatgacactattatagactctgattttgtttataaaccacttgctacatgacccatgaaaaccctagacttgtgacctgaaataaagaaaatacgttagaagagcactgt

SEQ ID NO: 12514 - DNA, 3082 bp, Homo sapiens
agaaaaagctgggcctagtctctgccccattcctgttccacacctgtctgtacccctgtctctcctttccctggctctgccagactctctatctccctgggcgccagcctccccacccacccctggagggcggggcttggctgcacccacgtgtggtggagttaaatgctcctagccggcagaggagctagggagtgtggcactgagccggctcaggcagagacgcggcaccatggctagcaagaaagtctgcattgtaggctccgggaactggggctcagccatcgccaagatcgtgggtggcaatgcagcccagctggcacagtttgacccacgggtgaccatgtgggtatttgaggaagacattggaggcaaaaagctgactgagatcatcaacacgcagcatgagaatgtcaaatacctgccagggcacaagttgcccccaaatgtggtggctgtcccagatgtggtccaggctgcagaggatgctgacatcctgatctttgtggtgccccatcagttcatcggcaagatctgtgaccagctcaagggccatctgaaggcaaacgccactggcatatctcttattaagggggtagacgagggccccaatgggctgaagctcatctcggaagtgattggggagcgcctcggcatccccatgagtgtgctgatgggggccaacattgccagcgaggtggctgatgagaagttctgtgagacaaccattggctgcaaggacccggcccagggacaactcctgaaagagctgatgcagacaccaaacttccgtatcacagtggtgcaagaggtggacacagtagagatctgtggagccttaaagaatgtagtggccgtgggggctggcttctgtgatggcctgggctttggcgacaacaccaaggcggcagtgatccggctgggactcatggagatgatagccttcgccaagctcttctgcagtggccctgtgtcctctgccaccttcttggagagctgtggtgttgctgacctgatcactacctgctatggagggcggaaccggaaagtggctgaggcctttgcgcgtacaggaaagtccattgagcagctggagaaagagttgctgaatgggcagaaactgcaggggcccgagacagcccgggagctatacagcatcctccagcacaagggcctggtagacaagtttcccttgttcatggctgtgtacaaggtgtgctacgagggccagccagtgggtgaattcatccactgcctgcagaatcatccagaacatatgtgagtggggccagggcccaggccaggccgcttttttaccccagtggagaccagcagaagcctggggtacctagtcaccaggatctccaggactcccagggagcagagtcttctcatcttttcactggaggacaggaggctatggggcccagctacgcacctggagatcctgaactgtcaagccactggcagcctcatgccaccacatttgccagaaatgcagttgccctgtccctctccagatgtggggctttctccatatcctctgggaggggtggaatcaagccccagtgctgcctgcttggtggcgggggtgatgtatgtggagaagggttgggggagaggccggtagggcaggggctgctagtggctgtctcacatacaccagtaatcctgttaaagggctgaagaagtatcttagccacaggagcgatgaggcaaggattgtcagggaggggtctgggcttctgagctgatgcaggccccaaggacccctttgctgacctctgccaggacccacacagcttcgatggatctcagtgtttgttaacaaaatacaaagatctcaaacaaaccccttttagcttctcctagcaacatctgtgtcctcagaaacctctggttctcccccttccccctcccccaggctgccctggcacccaaattgctgccatgctggcatctgtagctcggtggcttgacattctccccagggacttcccggttcctagttctttgccagctcctccccactctgtgcgacctttccaagccttccctcaccctccccgccagcaccctctttggggagcaggaacttaatctgctgacagagctacacctttcataacaggctcagatcactcagctccctgtgacctttgtattcacccaggcttccttctcagtagctctagctgggggaggtgtcagctgggcccctcctgtgctatctccccagaggacatccctgactccacccctttcttcctcccaaactctgcacctcttcctcagctgctccagaccggccagggtaaccagctaaccatgcctggcatctggaagccagcaggccagagggtggcccaaaggctgatgaacggtagggaagggtgagcagattcctatgttggtgggcaccaatattccaagggcagctctctttgctgaatgagggccttctcgtgaggtactgacaacaccagcaactcgagagctgggaaactcaaggaggaggaagaaaatcaaaaccaccctactccctggggtgaggaaagaacaggaggggaggaggaggagtgtgctctgcacttgccttgctccaggatggggtggcagcagaggaatgtcacaggtcagcagcctaggcctccagctataaatagtccggagggcccgagaggctcccgcccgtccagcagggctgtcagcttcctgtgtggcagcacctggcacactggctctggccagcattatgctaaaaccctgttactctccaatgaaccagggaggcgggctcctctctgcgcctatcccttgagaattctgtcttaccagtgaagggtggggctgcccagatcaggcagcaggagtgaggggcacagtcaccccaggccttgctgagcccaggtctgggtactgagtgtccagagctgcctccccaggaggttaaggtgggggcaaaggggaagcttcaagcactttgcctacttttgttcactccccagtgcactgtgactcaggccttcccatcaggcctatttgtctacccaataaagcgtgttttttccagaaacaagaa

SEQ ID NO: 12515 - DNA, 981 bp, Homo sapiens
atgcagacaccaaacttccgtatcacagtggtgcaagaggtggacacagtagagatctgtggagccttaaaggtgagaggggcacagaggcagctatggggtgaggagaaggccccaaaggaggtctggctgagctctgcaaggctgcaggtactccaggctctcactattgagcagtggttcccctttcctaccatgtcccatgcatataggaggagctgcagaagcaaggccagggccattcaggctgattattcatcatcagaccgtggacccccttgctcctgtcccattttagccccgtgtgggactccccaccctctggctccaggaggtcagggggacaaggagatgcccaggctaatgggagacaaaacatccttgacacccagacagactaatggccagaactatggatcctggacagctgttgacgggctgtacaatggaatggtcagatgggaagatcaactagagagaagagtggttttcagaaaatgtcctcgaggagggagtatggggcagggcttaagaaagggggtgcagcaaggggggaaaccaagaggcggaagtaggcttctaaaaggccacacactatacctctcttctgcagtgggtgtcacggctgatgaaatgagtatgagggggctccacatggggcctataggagggggtcttttcacctatgacctccactccttcaagaatgtagtggccgtgggggctggcttctgtgatggcctgggctttggcgacaacaccaaggcggcagtgatccggctgggactcatggagatgatagccttcgccaagctcttctgcagtggccctgtgtcctctgccaccttcttggagagctgtggtgttgctgacctgatcactacctgctatggagggcggaaccggaaagtggctgaggcctttgcgcgtacaggaaaggtgggccccgggagaagggagaacagaggggcggctctgtag

SEQ ID NO: 12516 - DNA, 4060 bp, Homo sapiens
gcagtggttcttgggagtggcgaagcgggtcctgccccgctgtcagctgcggcccccggcgccgggcgggggtggccgcgaccattggcggagaggcgaaaggggcggggccgccgccagccgctgcgggcaaggctgaacaggcggaggtgggcagccggccagggaagcacggtccaggcggctacattcggcccggccatggcagcggcgcccctgaaagtgtgcatcgtgggctcggggaactggggttcagctgttgcaaaaataattggtaataatgtcaagaaacttcagaaatttgcctccacagtcaagatgtgggtctttgaagaaacagtgaatggcagaaaactgacagacatcataaataatgaccatgaaaatgtaaaatatcttcctggacacaagctgccagaaaatgtggttgccatgtcaaatcttagcgaggctgtgcaggatgcagacctgctggtgtttgtcattccccaccagttcattcacagaatctgtgatgagatcactgggagagtgcccaagaaagcgctgggaatcaccctcatcaagggcatagacgagggccccgaggggctgaagctcatttctgacatcatccgtgagaagatgggtattgacatcagtgtgctgatgggagccaacattgccaatgaggtggctgcagagaagttctgtgagaccaccatcggcagcaaagtaatggagaacggccttctcttcaaagaacttctgcagactccaaattttcgaattaccgtggttgatgatgcagacactgttgaactctgtggtgcgcttaagaacatcgtagctgtgggagctgggttctgcgacggcctccgctgtggagacaacaccaaagcggccgtcatccgcctgggactcatggaaatgattgcttttgccaggatcttctgcaaaggccaagtgtctacagccaccttcctagagagctgcggggtggccgacctgatcaccacctgttacggagggcggaaccgcagggtggccgaggccttcgccagaactgggaagaccattgaagagttggagaaggagatgctgaatgggcaaaagctccaaggaccgcagacttctgctgaagtgtaccgcatcctcaaacagaagggactactggacaagtttccattgtttactgcagtgtatcagatctgctacgaaagcagaccagttcaagagatgttgtcttgtcttcagagccatccagagcatacataaagtgaatcatgcaacgtgttgggggaagttctgcctttctgatcaatcttttgggttcacgtggaaaccaggacttggcaacatgatgtttgactgtaatctcatcacggatatgtatgaatttttacaggttcgtttttgaattgtgagaggcagttcattagcaaagatgtactgggcagtaactaaacacacatgcaaacatgtgaatggtggtttattcctcattctgtggatgtttctatgagccaaaatttgatgtctttttttcaaaattgcttatgaaatttccacacaatcgtagcttataagattggaacgatctcagccaaatattttaggtgtaattcatatgtatttgagtggaggattttttttctcatttttctagtgttaaattttaaccagcattaacatggtagagtggaggagtgagtgtgttcaaagatcaacatatttaacttttaaacactatctcaaagccagcataattaactactttgattgtgggctgacctttgtttttttaacaatcaggcatttttaattagataatccactcatgtatttccccctcactgcagttgtctgcatttttagcctcttttctcttcgttagttgtcagaatatgccttcgtcaaggctcagaggtaacaagacagaaaattcatctgggattttcctgctgtggctggcacattcttctgattaacagacacttgtatgatgctttaggctagttagtgcattttttagcaaacatttatcttaaacatcacagatccactggggggtgcaaggggctactgttagtcctcttgttagatgcagtcactcctcctggtcacctagtgagcagggacagagccaggagtcaagtgcagtgccaaggtgcatgaccctctgagaagtcactgggctgatttgacctccgactcattggttgtgcaaatgccatgtgcagcctttcctgaggccataggagggcttcctgcagctgagatctatgcaggccatcctctcaacaagtgccactccaagggcggtcctcggtgcagcagcatcagcttcacttgtgggggggtgggggaaggggcggtctcagaaatgcaggttcccaggtcccaccctggacttctgaaggggtgtggcatctgtgtttctgatgcttactacaatatgtgaaccactactttagaaaatctgctttaacttggtattcctctaattgtgttccctaggaaatgactgtcccaagagccagtgattattccaggtgttccctggaaaggtcaagtgagtctgggaaacactatgtctgtacacctcttgaaggtgtcgaatgtatgtttatacatcagtggaacccatttttctagcctagcaagtcccaaacacattacactgaagagattttggtgaggaaacttgctggagttttcagggaacactgttctaggcttaggtgaccttaggatcactcaagtagacccttcactccctgcgagaaattaggatgaataactacctgtggcattgttggttctgaacttttacagttcaggcctgctgtgaatctttgatgaagctttaaggtgacactgttgtacaagatgtcagctttgctgaaacgcacattacctggaataagtgctttaattgtagaattagaatgggatttactgtactgttttaaatgagattggcttcagaatccattacagttaccttacatagcacttgatacgtgttaaatgaacatatgaatgtaatttatatattcctagaatttaagttactttgtgagatttgggcctgtccctcaatgccagtttaggatttctttttttctataccttgaaatgattataaaatagattttcatgggaattttaaaaactctatccaaaacatttttggagcattttaaagccccatacacagaagtatacgaaagcacacaaaacactccaagtttcagcagttttagcgccaccattaacccactttgcttgtctcatgaaaaatctttgttaaagtttgtacacaggtaacaaaaagttactttaaaagatatataaagggctgtaagctaattgtggtgtctagtaagtagcataatgagatgtgaggagttggaactttgcgtgttttgcgtattttcatctgcattcagcttcttactctgggtttgtactcgagtgttatttctttacaaatgcccttgtaattaccactctgaagtctgctgactgtgtctcttgaacatacttaggatattctgcacattatggaaaaaggtaaattttagaagtttctgctctactaactgtagatatttatgactctgcgagttatctatttttataaccacctgtggtccattgttcattttaattcacatttcttatgaagtatggtaacagggagggagacacctagattagcagctcaatttgtactacttcagccaatctgtgaatgtaaaaactacactgttgccttgctaggatccaccctcctataatatggaacaaatatctgaatgaaatccaccctaggagacggagtcaaactaaacttgtggtttttcatttaacttttgactacagcatggccccatggcatccacaccaagagggtgttgtgatgaggtgccggtgtgcaaagggaactttagtttttccactggttcttatctgctagccttttacatacatgtgtactatatttgtttatagactgtaggtggatatataatttaaaagcttgatttaataaacatttaaccccctaaacttg

SEQ ID NO: 12517 - DNA, 2076 bp, Homo sapiens
ccgtcctggctgagatggcggcgcccgggatcctgtgtagcggctgcagagggtgccgccgccctaggcgaagtagggccgtcctgagcgaaagaaccgcccccagcaggagcaccaccacggcttagcaaagaatcccagaccccgcccgggaaggcagccgcaccatggagtcttccagttcatctaactcttatttctccgttggcccaaccagtcccagcgctgtcgtgctcctctactcgctttccaaggaatcccttcaatctgtggatgtcctccgagaggaagtgagtgagatcttagatgaaatgagtcacaaactgcgtcttggagccattcggttttgtgccttcaccctgagcaaagtatttaaacaaattttctcgaaggtgtgtgtaaatgaagaaggtattcagaaactacaaagagccatccaggagcatcctgttgttctgctgcctagtcatcgaagttacattgacttcctcatgttgtcttttcttctatacaattatgatttgcctgtgccagttatagcagcaggaatggacttcctgggaatgaaaatggttggtgagctgctacgaatgtcgggtgcctttttcatgcggcgtacctttggtggcaataaactctactgggctgtattctctgaatatgtaaaaactatgttacggaatggttatgctcctgttgaatttttcctcgaagggacaagaagccgctctgccaagacattgactcctaaatttggtcttctgaatattgtgatggagccattttttaaaagagaagtttttgatacctaccttgtcccaattagtatcagttatgataagatcttggaagaaactctttatgtgtatgagcttctaggggttcctaaaccaaaagagtctacaactgggttgctgaaagccagaaagattctctctgaaaattttggaagcatccatgtgtactttggagatcctgtgtcacttcgatctttggcagctgggaggatgagtcggagctcatataacttggttccaagatacattcctcagaaacagtctgaggacatgcatgcctttgtcactgaagttgcctacaaaatggagcttctgcaaattgaaaacatggttttgagcccctggaccctaatagttgctgttctgcttcagaaccggccatccatggactttgatgctctggtggaaaagactttatggctaaaaggcttaacccaggcatttggagggtttctcatttggcctgataataaacctgctgaagaagttgtcccggccagcattcttctgcattccaacattgccagccttgtcaaagaccaggtgattctgaaagtggactccggagactcggaagtggtcgatgggcttatgctccagcacatcactctcctcatgtgctcagcttataggaaccagctgctcaacatttttgtgcgcccatccttagtagcagtagcattgcagatgacaccagggttcaggaaagaggatgtctacagttgctttcgcttcctacgtgatgtttttgcagatgagttcatcttccttccaggaaacacactaaaggactttgaagaaggctgttacctgctttgtaaaagtgaagccatacaagtgactacgaaagacatcctagttacagagaaaggaaatactgtgttagaatttttagtaggactctttaaaccttttgtggaaagctatcagataatttgcaagtaccttttgagtgaagaagaggaccacttcagtgaggaacagtacttggctgcagtcagaaaattcacaagtcagcttctcgatcaaggtacctctcaatgttatgatgtattatcttctgatgtgcagaaaaacgccttagcagcctgtgtgaggctcggagtagtggagaagaagaagataaataataactgtatatttaatgtgaatgaacctgccacaaccaaattagaagaaatgcttggttgtaagacaccaataggaaaaccagccactgcaaaactttaataatcaacaaatagttatggaaaattcggtcacgtaattactctcatcg

SEQ ID NO: 12518 - DNA, 2643 bp, Homo sapiens
ttccgtcctggctgagatggcggcgcccgggatcctgtgtagcggctgcagagggtgccgccgccctaggcgaagtagggccgtcctgagcgaaagaaccgcccccagcaggagcaccaccacggcttagcaaagaatcccagaccccgcccgggaaggcagccgcaccatggagtcttccagttcatctaactcttatttctccgttggcccaaccagtcccagcgctgtcgtgctcctctactcgaaggagctcaaaaagtgggatgagtttgaagatattttagaagagaggaggcatgtcagtgacttgaaatttgcaatgaaatgctacacacctcttgtctataagggaattactccatgtaaaccaattgatattaaatgtagtgttctcaattctgaggagattcattatgtcattaaacagctttccaaggaatcccttcaatctgtggatgtcctccgagaggaagtgagtgagatcttagatgaaatgagtcacaaactgcgtcttggagccattcggttttgtgccttcaccctgagcaaagtatttaaacaaattttctcgaaggtgtgtgtaaatgaagaaggtattcagaaactacaaagagccatccaggagcatcctgttgttctgctgcctagtcatcgaagttacattgacttcctcatgttgtcttttcttctatacaattatgatttgcctgtgccagttatagcagcaggaatggacttcctgggaatgaaaatggttggtgagctgctacgaatgtcgggtgcctttttcatgcggcgtacctttggtggcaataaactctactgggctgtattctctgaatatgtaaaaactatgttacggaatggttatgctcctgttgaatttttcctcgaagggacaagaagccgctctgccaagacattgactcctaaatttggtcttctgaatattgtgatggagccattttttaaaagagaagtttttgatacctaccttgtcccaattagtatcagttatgataagatcttggaagaaactctttatgtgtatgagcttctaggggttcctaaaccaaaagagtctacaactgggttgctgaaagccagaaagattctctctgaaaattttggaagcatccatgtgtactttggagatcctgtgtcacttcgatctttggcagctgggaggatgagtcggagctcatataacttggttccaagatacattcctcagaaacagtctgaggacatgcatgcctttgtcactgaagttgcctacaaaatggagcttctgcaaattgaaaacatggttttgagcccctggaccctaatagttgctgttctgcttcagaaccggccatccatggactttgatgctctggtggaaaagactttatggctaaaaggcttaacccaggcatttggagggtttctcatttggcctgataataaacctgctgaagaagttgtcccggccagcattcttctgcattccaacattgccagccttgtcaaagaccaggtgattctgaaagtggactccggagactcggaagtggtcgatgggcttatgctccagcacatcactctcctcatgtgctcagcttataggaaccagctgctcaacatttttgtgcgcccatccttagtagcagtagcattgcagatgacaccagggttcaggaaagaggatgtctacagttgctttcgcttcctacgtgatgtttttgcagatgagttcatcttccttccaggaaacacactaaaggactttgaagaaggctgttacctgctttgtaaaagtgaagccatacaagtgactacgaaagacatcctagttacagagaaaggaaatactgtgttagaatttttagtaggactctttaaaccttttgtggaaagctatcagataatttgcaagtaccttttgagtgaagaagaggaccacttcagtgaggaacagtacttggctgcagtcagaaaattcacaagtcagcttctcgatcaaggtacctctcaatgttatgatgtattatcttctgatgtgcagaaaaacgccttagcagcctgtgtgaggctcggagtagtggagaagaagaagataaataataactgtatatttaatgtgaatgaacctgccacaaccaaattagaagaaatgcttggttgtaagacaccaataggaaaaccagccactgcaaaactttaataatcaacaaatagttatggaaaattcggtcacgtaattactctcatcgaaggactcattacaacaaacagggaagtaaaggaagagacacatcctctcatactccctgagactctgagaacagtggacgcagagggaagagatgatcattggaagcaatcagtttactcttccccaccacagtggttaaaaggcgtttgtatctgacactatgtgtgtgttttaaaataaacttttggaaacatgtttggaaaagcaaagctcagctcatttcactaacacttttcagcttactatatgtattaaacttttatgttgacttttgaattaaagtatgacaacactgaaagctctggatattaaaagaaaatgaaaagggcatatctacgttacttgtagcttgctttaattaaagttgcctcaaacaagta

SEQ ID NO: 12519 - DNA, 1924 bp, Homo sapiens
cctggctgagatggcggcgcccgggatcctgtgtagcggctgcagagggtgccgccgccctaggcgaagtagggccgtcctgagcgaaagaaccgcccccagcaggagcaccaccacggcttagcaaagaatcccagaccccgcccgggaaggcagccgcaccatggagtcttccagttcatctaactcttatttctccgttggcccaaccagtcccagcgctgtcgtgctcctctactcgaaggagctcaaaaagtgggatgagtttgaagatattttagaagagaggaggcatgtcagtgacttgaaatttgcaatgaaatgctacacacctcttgtctataagggaattactccatgtaaaccaattgatattaaatgtagtgttctcaattctgaggagattcattatgtcattaaacagctttccaaggaatcccttcaatctgtggatgtcctccgagaggaagtgagtgagatcttagatgaaatgagtcacaaactgcgtcttggagccattcggttttgtgccttcaccctgagcaaagtatttaaacaaattttctcgaagctacaaagagccatccaggagcatcctgttgttctgctgcctagtcatcgaagttacattgacttcctcatgttgtcttttcttctatacaattatgatttgcctgtgccagttatagcagcaggaatggacttcctgggaatgaaaatggttggtgagctgctacgaatgtcgggtgcctttttcatgcggcgtacctttggtggcaataaactctactgggctgtattctctgaatatgtaaaaactatgttacggaatggttatgctcctgttgaatttttcctcgaagggacaagaagccgctctgccaagacattgactcctaaatttggtcttctgaatattgtgatggagccattttttaaaagagaagtttttgatacctaccttgtcccaattagtatcagttatgataagatcttggaagaaactctttatgtgtatgagcttctaggggttcctaaaccaaaagagtctacaactgggttgctgaaagccagaaagattctctctgaaaattttggaagcatccatgtgtactttggagatcctgtgtcacttcgatctttggcagctgggaggatgagtcggagctcatataacttggttccaagatacattcctcagaaacagtctgaggacatgcatgcctttgtcactgaagttgcctacaaaatggagcttctgcaaattgaaaacatggttttgagcccctggaccctaatagttgctgttctgcttcagaaccggccatccatggactttgatgctctggtggaaaagactttatggctaaaaggcttaacccaggcatttggagggtttctcatttggcctgataataaacctgctgaagaagttgtcccggccagcattcttctgcattccaacattgccagccttgtcaaagaccaggtgattctgaaagtggactccggagactcggaagtggtcgatgggcttatgctccagcacatcactctcctcatgtgctcagcttataggaaccagctgctcaacatttttgtgcgcccatccttagtagcagtagcattgcagatgacaccagggttcaggaaagaggatgtctacagttgctttcgcttcctacgtgatgtttttgcagatgagttcatcttccttccaggaaacacactaaaggactttgaagaaggctgttacctgctttgtaaaagtgaagccatacaagtgactacgaaagacatcctagttacagagaaaggaaatactgtgttagaatttttagtaggactctttaaaccttttgtggaaagctatcagataatttgcaagtaccttttgagtgaagaagaggaccacttcagtgag

SEQ ID NO: 12520 - DNA, 839 bp, Homo sapiens
ggcttccgtcctggctgagatggcggcgcccgggatcctgtgtagcggctgcagagggtgccgccgccctaggcgaagtagggccgtcctgagcgaaagaaccgcccccagcaggagcaccaccacggcttagcaaagaatcccagaccccgcccgggaaggcagccgcaccatggagtcttccagttcatctaactcttatttctccgttggcccaaccagtcccagcgctgtcgtgctcctctactcgctttccaaggaatcccttcaatctgtggatgtcctccgagaggaagtgagtgagatcttagatgaaatgagtcacaaactgcgtcttggagccattcggttttgtgccttcaccctgagcaaagtatttaaacaaattttctcgaaggtgtgtgtaaatgaagaaggtattcagaaactacaaagagccatccaggagcatcctgttgttctgctgcctagtcatcgaagttacattgacttcctcatgttgtcttttcttctatacaattatgatttgcctgtgccagttatagcagcaggaatggacttcctgggaatgaaaatggttggtgagctgctacgaatgtcgggtgcctttttcatgcggcgtacctttggtggcaataaactctactgggctgtattctctgaatatgtaaaaactatgttacggaatggttatgctcctgttgaatttttcctcgaagggacaagaagccgctctgccaagacattgactcctaaatttggtcttctgaatattgtgatggagccattttttaaaagagaagtttttgatacctaccttgtcccaattagtatcagtt
